United States Patent 11,640,849 (METHODS FOR HISTOLOGICAL DIAGNOSIS AND TREATMENT OF DISEASES) - sequence listing, part 58

SEQ ID NO: 2215709 - protein, 6 aa, Cryptosporidium parvum
GSNEKK

SEQ ID NO: 2215710 - protein, 5 aa, Cryptosporidium parvum
GSNEL

SEQ ID NO: 2215711 - protein, 15 aa, Cryptosporidium parvum
GSNESNANSSSGCGP

SEQ ID NO: 2215712 - protein, 6 aa, Cryptosporidium parvum
GSNGET

SEQ ID NO: 2215713 - protein, 6 aa, Cryptosporidium parvum
GSNGVI

SEQ ID NO: 2215714 - protein, 14 aa, Cryptosporidium parvum
GSNIGNGNSTTGLG

SEQ ID NO: 2215715 - protein, 6 aa, Cryptosporidium parvum
GSNKSE

SEQ ID NO: 2215716 - protein, 13 aa, Cryptosporidium parvum
GSNLDSRRSVENT

SEQ ID NO: 2215717 - protein, 6 aa, Cryptosporidium parvum
GSNNKH

SEQ ID NO: 2215718 - protein, 9 aa, Cryptosporidium parvum
GSNNQNKSE

SEQ ID NO: 2215719 - protein, 15 aa, Cryptosporidium parvum
GSNSKRNNSGNLDDR

SEQ ID NO: 2215720 - protein, 6 aa, Cryptosporidium parvum
GSNSQN

SEQ ID NO: 2215721 - protein, 5 aa, Cryptosporidium parvum
GSNTQ

SEQ ID NO: 2215722 - protein, 28 aa, Cryptosporidium parvum
GSNTTNNSKGGEGIIGNGKGGGKRGRKI

SEQ ID NO: 2215723 - protein, 25 aa, Cryptosporidium parvum
GSNVNNLNNSLPSLTNNNANENSEI

SEQ ID NO: 2215724 - protein, 6 aa, Cryptosporidium parvum
GSPEQL

SEQ ID NO: 2215725 - protein, 5 aa, Cryptosporidium parvum
GSPIT

SEQ ID NO: 2215726 - protein, 15 aa, Cryptosporidium parvum
GSPKTNNEDETNKNI

SEQ ID NO: 2215727 - protein, 4 aa, Cryptosporidium parvum
GSPQ

SEQ ID NO: 2215728 - protein, 5 aa, Cryptosporidium parvum
GSPRI

SEQ ID NO: 2215729 - protein, 8 aa, Cryptosporidium parvum
GSPRWSAR

SEQ ID NO: 2215730 - protein, 9 aa, Cryptosporidium parvum
GSPSYKPKT

SEQ ID NO: 2215731 - protein, 7 aa, Cryptosporidium parvum
GSQDDEM

SEQ ID NO: 2215732 - protein, 15 aa, Cryptosporidium parvum
GSQDISKKVEEDKDS

SEQ ID NO: 2215733 - protein, 6 aa, Cryptosporidium parvum
GSQFEN

SEQ ID NO: 2215734 - protein, 4 aa, Cryptosporidium parvum
GSQH

SEQ ID NO: 2215735 - protein, 6 aa, Cryptosporidium parvum
GSQIST

SEQ ID NO: 2215736 - protein, 10 aa, Cryptosporidium parvum
GSQSFKNADV

SEQ ID NO: 2215737 - protein, 7 aa, Cryptosporidium parvum
GSQSGEE

SEQ ID NO: 2215738 - protein, 8 aa, Cryptosporidium parvum
GSQYEELR

SEQ ID NO: 2215739 - protein, 6 aa, Cryptosporidium parvum
GSRAGG

SEQ ID NO: 2215740 - protein, 4 aa, Cryptosporidium parvum
GSRI

SEQ ID NO: 2215741 - protein, 14 aa, Cryptosporidium parvum
GSRLEGDFSNAEEF

SEQ ID NO: 2215742 - protein, 7 aa, Cryptosporidium parvum
GSRNECP

SEQ ID NO: 2215743 - protein, 10 aa, Cryptosporidium parvum
GSRSQASKTY

SEQ ID NO: 2215744 - protein, 6 aa, Cryptosporidium parvum
GSRTSD

SEQ ID NO: 2215745 - protein, 4 aa, Cryptosporidium parvum
GSRV

SEQ ID NO: 2215746 - protein, 23 aa, Cryptosporidium parvum
GSSCTNKKNIKSPTSKSTPSNRR

SEQ ID NO: 2215747 - protein, 14 aa, Cryptosporidium parvum
GSSDPLNSEESSDL

SEQ ID NO: 2215748 - protein, 8 aa, Cryptosporidium parvum
GSSEADIS

SEQ ID NO: 2215749 - protein, 17 aa, Cryptosporidium parvum
GSSEEEKEYLNDGTIKD

SEQ ID NO: 2215750 - protein, 6 aa, Cryptosporidium parvum
GSSEGK

SEQ ID NO: 2215751 - protein, 24 aa, Cryptosporidium parvum
GSSENTKSLDYSTSSLVSTGPLGR

SEQ ID NO: 2215752 - protein, 9 aa, Cryptosporidium parvum
GSSEPLQAS

SEQ ID NO: 2215753 - protein, 16 aa, Cryptosporidium parvum
GSSESIQSFSKNRKLS

SEQ ID NO: 2215754 - protein, 5 aa, Cryptosporidium parvum
GSSFE

SEQ ID NO: 2215755 - protein, 4 aa, Cryptosporidium parvum
GSSG

SEQ ID NO: 2215756 - protein, 5 aa, Cryptosporidium parvum
GSSGE

SEQ ID NO: 2215757 - protein, 15 aa, Cryptosporidium parvum
GSSGRYSIPSRKKDK

SEQ ID NO: 2215758 - protein, 10 aa, Cryptosporidium parvum
GSSGSGKTTL

SEQ ID NO: 2215759 - protein, 24 aa, Cryptosporidium parvum
GSSGSSNGKLRASRNNTSKEENSY

SEQ ID NO: 2215760 - protein, 6 aa, Cryptosporidium parvum
GSSHGT

SEQ ID NO: 2215761 - protein, 7 aa, Cryptosporidium parvum
GSSIEEY

SEQ ID NO: 2215762 - protein, 12 aa, Cryptosporidium parvum
GSSIGRRSRPST

SEQ ID NO: 2215763 - protein, 19 aa, Cryptosporidium parvum
GSSKTLNSITTNSLTKSIK

SEQ ID NO: 2215764 - protein, 5 aa, Cryptosporidium parvum
GSSLN

SEQ ID NO: 2215765 - protein, 7 aa, Cryptosporidium parvum
GSSLPNP

SEQ ID NO: 2215766 - protein, 6 aa, Cryptosporidium parvum
GSSLTG

SEQ ID NO: 2215767 - protein, 10 aa, Cryptosporidium parvum
GSSNINDQSS

SEQ ID NO: 2215768 - protein, 7 aa, Cryptosporidium parvum
GSSNSNL

SEQ ID NO: 2215769 - protein, 9 aa, Cryptosporidium parvum
GSSQRPSIE

SEQ ID NO: 2215770 - protein, 8 aa, Cryptosporidium parvum
GSSQVTKE

SEQ ID NO: 2215771 - protein, 7 aa, Cryptosporidium parvum
GSSSALP

SEQ ID NO: 2215772 - protein, 4 aa, Cryptosporidium parvum
GSST

SEQ ID NO: 2215773 - protein, 7 aa, Cryptosporidium parvum
GSSYTAA

SEQ ID NO: 2215774 - protein, 6 aa, Cryptosporidium parvum
GSTDLE

SEQ ID NO: 2215775 - protein, 7 aa, Cryptosporidium parvum
GSTGNKG

SEQ ID NO: 2215776 - protein, 5 aa, Cryptosporidium parvum
GSTLT

SEQ ID NO: 2215777 - protein, 8 aa, Cryptosporidium parvum
GSTNSDNY

SEQ ID NO: 2215778 - protein, 16 aa, Cryptosporidium parvum
GSTNSNDLGNHSQANA

SEQ ID NO: 2215779 - protein, 10 aa, Cryptosporidium parvum
GSTSPKVAST

SEQ ID NO: 2215780 - protein, 7 aa, Cryptosporidium parvum
GSTTAKA

SEQ ID NO: 2215781 - protein, 4 aa, Cryptosporidium parvum
GSTV

SEQ ID NO: 2215782 - protein, 4 aa, Cryptosporidium parvum
GSVA

SEQ ID NO: 2215783 - protein, 7 aa, Cryptosporidium parvum
GSVAGTT

SEQ ID NO: 2215784 - protein, 6 aa, Cryptosporidium parvum
GSVDSL

SEQ ID NO: 2215785 - protein, 9 aa, Cryptosporidium parvum
GSVGNPVNS

SEQ ID NO: 2215786 - protein, 4 aa, Cryptosporidium parvum
GSVS

SEQ ID NO: 2215787 - protein, 8 aa, Cryptosporidium parvum
GSVTHDNS

SEQ ID NO: 2215788 - protein, 7 aa, Cryptosporidium parvum
GSWNSKD

SEQ ID NO: 2215789 - protein, 10 aa, Cryptosporidium parvum
GSYSNQLNTQ

SEQ ID NO: 2215790 - protein, 5 aa, Cryptosporidium parvum
GTAST

SEQ ID NO: 2215791 - protein, 6 aa, Cryptosporidium parvum
GTATGG

SEQ ID NO: 2215792 - protein, 15 aa, Cryptosporidium parvum
GTDSLERGEDRATFE

SEQ ID NO: 2215793 - protein, 5 aa, Cryptosporidium parvum
GTDTK

SEQ ID NO: 2215794 - protein, 10 aa, Cryptosporidium parvum
GTDTTNINNN

SEQ ID NO: 2215795 - protein, 9 aa, Cryptosporidium parvum
GTDVAKEAS

SEQ ID NO: 2215796 - protein, 9 aa, Cryptosporidium parvum
GTEACNKGK

SEQ ID NO: 2215797 - protein, 5 aa, Cryptosporidium parvum
GTEDF

SEQ ID NO: 2215798 - protein, 10 aa, Cryptosporidium parvum
GTEDNDKSCN

SEQ ID NO: 2215799 - protein, 10 aa, Cryptosporidium parvum
GTEENKYKNE

SEQ ID NO: 2215800 - protein, 6 aa, Cryptosporidium parvum
GTEGSE

SEQ ID NO: 2215801 - protein, 4 aa, Cryptosporidium parvum
GTEI

SEQ ID NO: 2215802 - protein, 9 aa, Cryptosporidium parvum
GTERNSEEV

SEQ ID NO: 2215803 - protein, 7 aa, Cryptosporidium parvum
GTESTLG

SEQ ID NO: 2215804 - protein, 9 aa, Cryptosporidium parvum
GTEVAKGAS

SEQ ID NO: 2215805 - protein, 17 aa, Cryptosporidium parvum
GTEVTPRSELESTQEEY

SEQ ID NO: 2215806 - protein, 5 aa, Cryptosporidium parvum
GTGCN

SEQ ID NO: 2215807 - protein, 10 aa, Cryptosporidium parvum
GTGEGLKENN

SEQ ID NO: 2215808 - protein, 14 aa, Cryptosporidium parvum
GTGFASNQVIVYNN

SEQ ID NO: 2215809 - protein, 13 aa, Cryptosporidium parvum
GTGGSSHKESNLG

SEQ ID NO: 2215810 - protein, 8 aa, Cryptosporidium parvum
GTGNDLSR

SEQ ID NO: 2215811 - protein, 5 aa, Cryptosporidium parvum
GTGTL

SEQ ID NO: 2215812 - protein, 9 aa, Cryptosporidium parvum
GTGTPLGDP

SEQ ID NO: 2215813 - protein, 11 aa, Cryptosporidium parvum
GTGTPLGDPIE

SEQ ID NO: 2215814 - protein, 5 aa, Cryptosporidium parvum
GTHSD

SEQ ID NO: 2215815 - protein, 4 aa, Cryptosporidium parvum
GTIG

SEQ ID NO: 2215816 - protein, 9 aa, Cryptosporidium parvum
GTIKGSNGE

SEQ ID NO: 2215817 - protein, 11 aa, Cryptosporidium parvum
GTINDSQNKLN

SEQ ID NO: 2215818 - protein, 11 aa, Cryptosporidium parvum
GTIPSSSENNM

SEQ ID NO: 2215819 - protein, 15 aa, Cryptosporidium parvum
GTIRPNNKQLSNNKL

SEQ ID NO: 2215820 - protein, 5 aa, Cryptosporidium parvum
GTKDK

SEQ ID NO: 2215821 - protein, 8 aa, Cryptosporidium parvum
GTKIENRQ

SEQ ID NO: 2215822 - protein, 5 aa, Cryptosporidium parvum
GTKIG

SEQ ID NO: 2215823 - protein, 4 aa, Cryptosporidium parvum
GTKQ

SEQ ID NO: 2215824 - protein, 6 aa, Cryptosporidium parvum
GTKSQN

SEQ ID NO: 2215825 - protein, 5 aa, Cryptosporidium parvum
GTKSR

SEQ ID NO: 2215826 - protein, 5 aa, Cryptosporidium parvum
GTNEV

SEQ ID NO: 2215827 - protein, 5 aa, Cryptosporidium parvum
GTNFT

SEQ ID NO: 2215828 - protein, 4 aa, Cryptosporidium parvum
GTNH

SEQ ID NO: 2215829 - protein, 6 aa, Cryptosporidium parvum
GTNHNN

SEQ ID NO: 2215830 - protein, 4 aa, Cryptosporidium parvum
GTNI

SEQ ID NO: 2215831 - protein, 6 aa, Cryptosporidium parvum
GTNKPQ

SEQ ID NO: 2215832 - protein, 6 aa, Cryptosporidium parvum
GTNNNT

SEQ ID NO: 2215833 - protein, 6 aa, Cryptosporidium parvum
GTNSAS

SEQ ID NO: 2215834 - protein, 6 aa, Cryptosporidium parvum
GTPAAT

SEQ ID NO: 2215835 - protein, 8 aa, Cryptosporidium parvum
GTPAENYE

SEQ ID NO: 2215836 - protein, 4 aa, Cryptosporidium parvum
GTPF

SEQ ID NO: 2215837 - protein, 13 aa, Cryptosporidium parvum
GTPGYTAPEGGAL

SEQ ID NO: 2215838 - protein, 14 aa, Cryptosporidium parvum
GTPKKLRRSSRLKS

SEQ ID NO: 2215839 - protein, 11 aa, Cryptosporidium parvum
GTPNSSQEGEG

SEQ ID NO: 2215840 - protein, 7 aa, Cryptosporidium parvum
GTPQSYS

SEQ ID NO: 2215841 - protein, 20 aa, Cryptosporidium parvum
GTPTQTDPTTGLPSDPSTGL

SEQ ID NO: 2215842 - protein, 9 aa, Cryptosporidium parvum
GTQEKDDNT

SEQ ID NO: 2215843 - protein, 5 aa, Cryptosporidium parvum
GTQLE

SEQ ID NO: 2215844 - protein, 23 aa, Cryptosporidium parvum
GTRIQTKTGAGIGIGTGEPGASD

SEQ ID NO: 2215845 - protein, 6 aa, Cryptosporidium parvum
GTRRTK

SEQ ID NO: 2215846 - protein, 5 aa, Cryptosporidium parvum
GTRTN

SEQ ID NO: 2215847 - protein, 7 aa, Cryptosporidium parvum
GTSASYS

SEQ ID NO: 2215848 - protein, 13 aa, Cryptosporidium parvum
GTSESSEDSESFS

SEQ ID NO: 2215849 - protein, 9 aa, Cryptosporidium parvum
GTSFEGRPI

SEQ ID NO: 2215850 - protein, 9 aa, Cryptosporidium parvum
GTSKTNEGC

SEQ ID NO: 2215851 - protein, 11 aa, Cryptosporidium parvum
GTSPDLKTASE

SEQ ID NO: 2215852 - protein, 15 aa, Cryptosporidium parvum
GTSPEAEIASKYPTS

SEQ ID NO: 2215853 - protein, 5 aa, Cryptosporidium parvum
GTSQF

SEQ ID NO: 2215854 - protein, 7 aa, Cryptosporidium parvum
GTSSGRT

SEQ ID NO: 2215855 - protein, 6 aa, Cryptosporidium parvum
GTSSGT

SEQ ID NO: 2215856 - protein, 9 aa, Cryptosporidium parvum
GTSSISSNN

SEQ ID NO: 2215857 - protein, 6 aa, Cryptosporidium parvum
GTSTSS

SEQ ID NO: 2215858 - protein, 35 aa, Cryptosporidium parvum
GTSVGGTSVGGTSAGGTSVGGSDLEETSQGFGNDA

SEQ ID NO: 2215859 - protein, 5 aa, Cryptosporidium parvum
GTTES

SEQ ID NO: 2215860 - protein, 35 aa, Cryptosporidium parvum
GTTSGATSSSATSSSAISSSATSSSATSSGTTVAQ

SEQ ID NO: 2215861 - protein, 24 aa, Cryptosporidium parvum
GTTSGQKSSSSLQEESQTSLGGGG

SEQ ID NO: 2215862 - protein, 5 aa, Cryptosporidium parvum
GTTSS

SEQ ID NO: 2215863 - protein, 14 aa, Cryptosporidium parvum
GTVPPKPLTEIPSH

SEQ ID NO: 2215864 - protein, 8 aa, Cryptosporidium parvum
GTVRSEDD

SEQ ID NO: 2215865 - protein, 5 aa, Cryptosporidium parvum
GTWES

SEQ ID NO: 2215866 - protein, 19 aa, Cryptosporidium parvum
GVDRDGNGIPCDSAEDFDT

SEQ ID NO: 2215867 - protein, 5 aa, Cryptosporidium parvum
GVDSE

SEQ ID NO: 2215868 - protein, 22 aa, Cryptosporidium parvum
GVEQISDSAEKAGEKDQEETQE

SEQ ID NO: 2215869 - protein, 5 aa, Cryptosporidium parvum
GVESP

SEQ ID NO: 2215870 - protein, 5 aa, Cryptosporidium parvum
GVGAS

SEQ ID NO: 2215871 - protein, 4 aa, Cryptosporidium parvum
GVGG

SEQ ID NO: 2215872 - protein, 8 aa, Cryptosporidium parvum
GVGGAGLS

SEQ ID NO: 2215873 - protein, 6 aa, Cryptosporidium parvum
GVGGGI

SEQ ID NO: 2215874 - protein, 10 aa, Cryptosporidium parvum
GVGYSSPSHA

SEQ ID NO: 2215875 - protein, 7 aa, Cryptosporidium parvum
GVHPRKY

SEQ ID NO: 2215876 - protein, 8 aa, Cryptosporidium parvum
GVKASNIA

SEQ ID NO: 2215877 - protein, 5 aa, Cryptosporidium parvum
GVNNA

SEQ ID NO: 2215878 - protein, 4 aa, Cryptosporidium parvum
GVPD

SEQ ID NO: 2215879 - protein, 4 aa, Cryptosporidium parvum
GVPP

SEQ ID NO: 2215880 - protein, 12 aa, Cryptosporidium parvum
GVPQHQQQPQSM

SEQ ID NO: 2215881 - protein, 10 aa, Cryptosporidium parvum
GVRAAAQQPR

SEQ ID NO: 2215882 - protein, 5 aa, Cryptosporidium parvum
GVSEG

SEQ ID NO: 2215883 - protein, 7 aa, Cryptosporidium parvum
GVSGSTT

SEQ ID NO: 2215884 - protein, 9 aa, Cryptosporidium parvum
GVSQRIQED

SEQ ID NO: 2215885 - protein, 5 aa, Cryptosporidium parvum
GVTDD

SEQ ID NO: 2215886 - protein, 14 aa, Cryptosporidium parvum
GVTKGVSSERFNTG

SEQ ID NO: 2215887 - protein, 13 aa, Cryptosporidium parvum
GVTNNTNITQNKI

SEQ ID NO: 2215888 - protein, 4 aa, Cryptosporidium parvum
GVYS

SEQ ID NO: 2215889 - protein, 20 aa, Cryptosporidium parvum
GVYTPDTESQAKTTEKTYTA

SEQ ID NO: 2215890 - protein, 13 aa, Cryptosporidium parvum
GYAPKNKDRSQIQ

SEQ ID NO: 2215891 - protein, 8 aa, Cryptosporidium parvum
GYDGNKRS

SEQ ID NO: 2215892 - protein, 4 aa, Cryptosporidium parvum
GYDS

SEQ ID NO: 2215893 - protein, 5 aa, Cryptosporidium parvum
GYEQE

SEQ ID NO: 2215894 - protein, 8 aa, Cryptosporidium parvum
GYESTPIS

SEQ ID NO: 2215895 - protein, 13 aa, Cryptosporidium parvum
GYGDSEGTPSEEG

SEQ ID NO: 2215896 - protein, 7 aa, Cryptosporidium parvum
GYGKKEE

SEQ ID NO: 2215897 - protein, 9 aa, Cryptosporidium parvum
GYKRKAPDE

SEQ ID NO: 2215898 - protein, 7 aa, Cryptosporidium parvum
GYKSDER

SEQ ID NO: 2215899 - protein, 4 aa, Cryptosporidium parvum
GYNL

SEQ ID NO: 2215900 - protein, 8 aa, Cryptosporidium parvum
GYNPEWDN

SEQ ID NO: 2215901 - protein, 4 aa, Cryptosporidium parvum
GYNT

SEQ ID NO: 2215902 - protein, 4 aa, Cryptosporidium parvum
GYQD

SEQ ID NO: 2215903 - protein, 13 aa, Cryptosporidium parvum
GYRSSSDIPVENE

SEQ ID NO: 2215904 - protein, 6 aa, Cryptosporidium parvum
GYSDQS

SEQ ID NO: 2215905 - protein, 6 aa, Cryptosporidium parvum
GYSQSY

SEQ ID NO: 2215906 - protein, 7 aa, Cryptosporidium parvum
GYSRVNK

SEQ ID NO: 2215907 - protein, 9 aa, Cryptosporidium parvum
GYSSKNEEL

SEQ ID NO: 2215908 - protein, 15 aa, Cryptosporidium parvum
GYSSRPESIPMPSPG

SEQ ID NO: 2215909 - protein, 7 aa, Cryptosporidium parvum
GYTETSQ

SEQ ID NO: 2215910 - protein, 5 aa, Cryptosporidium parvum
GYTRT

SEQ ID NO: 2215911 - protein, 11 aa, Cryptosporidium parvum
GYYGDGKKSCI

SEQ ID NO: 2215912 - protein, 9 aa, Cryptosporidium parvum
HAGMSGGSE

SEQ ID NO: 2215913 - protein, 6 aa, Cryptosporidium parvum
HARAQR

SEQ ID NO: 2215914 - protein, 9 aa, Cryptosporidium parvum
HDDEIQGNN

SEQ ID NO: 2215915 - protein, 9 aa, Cryptosporidium parvum
HDEKERTDL

SEQ ID NO: 2215916 - protein, 9 aa, Cryptosporidium parvum
HDHNNHGFE

SEQ ID NO: 2215917 - protein, 11 aa, Cryptosporidium parvum
HDHRSSIDPGN

SEQ ID NO: 2215918 - protein, 20 aa, Cryptosporidium parvum
HDPNTQAKQDTCAEEKLENK

SEQ ID NO: 2215919 - protein, 5 aa, Cryptosporidium parvum
HDPSK

SEQ ID NO: 2215920 - protein, 5 aa, Cryptosporidium parvum
HDQDA

SEQ ID NO: 2215921 - protein, 21 aa, Cryptosporidium parvum
HDQERDQEDSDEKKDETEEVG

SEQ ID NO: 2215922 - protein, 6 aa, Cryptosporidium parvum
HDQNER

SEQ ID NO: 2215923 - protein, 17 aa, Cryptosporidium parvum
HDQYPDKIREILYYVNF

SEQ ID NO: 2215924 - protein, 26 aa, Cryptosporidium parvum
HDSTRSEGRIGNSGQSNRYSNSIQGS

SEQ ID NO: 2215925 - protein, 7 aa, Cryptosporidium parvum
HDTRSQS

SEQ ID NO: 2215926 - protein, 7 aa, Cryptosporidium parvum
HEDISDN

SEQ ID NO: 2215927 - protein, 9 aa, Cryptosporidium parvum
HEDLRNREE

SEQ ID NO: 2215928 - protein, 10 aa, Cryptosporidium parvum
HEDNSSAHEQ

SEQ ID NO: 2215929 - protein, 6 aa, Cryptosporidium parvum
HEDQEK

SEQ ID NO: 2215930 - protein, 5 aa, Cryptosporidium parvum
HEDSE

SEQ ID NO: 2215931 - protein, 8 aa, Cryptosporidium parvum
HEDSSYEV

SEQ ID NO: 2215932 - protein, 14 aa, Cryptosporidium parvum
HEEESSLQEEKRPY

SEQ ID NO: 2215933 - protein, 27 aa, Cryptosporidium parvum
HEESELKTLSQDSQESYSSTSQRGLRG

SEQ ID NO: 2215934 - protein, 6 aa, Cryptosporidium parvum
HEFDPS

SEQ ID NO: 2215935 - protein, 8 aa, Cryptosporidium parvum
HEGPNDGE

SEQ ID NO: 2215936 - protein, 21 aa, Cryptosporidium parvum
HEGRNSEIEMGGGKMNSDDAI

SEQ ID NO: 2215937 - protein, 13 aa, Cryptosporidium parvum
HEGSESSEAEEIE

SEQ ID NO: 2215938 - protein, 8 aa, Cryptosporidium parvum
HEHTDTEE

SEQ ID NO: 2215939 - protein, 5 aa, Cryptosporidium parvum
HEIDT

SEQ ID NO: 2215940 - protein, 6 aa, Cryptosporidium parvum
HEINNR

SEQ ID NO: 2215941 - protein, 4 aa, Cryptosporidium parvum
HEKK

SEQ ID NO: 2215942 - protein, 11 aa, Cryptosporidium parvum
HEKKTDHVKAS

SEQ ID NO: 2215943 - protein, 8 aa, Cryptosporidium parvum
HEKSSFNN

SEQ ID NO: 2215944 - protein, 4 aa, Cryptosporidium parvum
HEKV

SEQ ID NO: 2215945 - protein, 6 aa, Cryptosporidium parvum
HELNED

SEQ ID NO: 2215946 - protein, 5 aa, Cryptosporidium parvum
HENNK

SEQ ID NO: 2215947 - protein, 8 aa, Cryptosporidium parvum
HENSPASA

SEQ ID NO: 2215948 - protein, 4 aa, Cryptosporidium parvum
HEPY

SEQ ID NO: 2215949 - protein, 14 aa, Cryptosporidium parvum
HEQDTSKEPEPVPE

SEQ ID NO: 2215950 - protein, 6 aa, Cryptosporidium parvum
HEQVDQ

SEQ ID NO: 2215951 - protein, 7 aa, Cryptosporidium parvum
HEREPKL

SEQ ID NO: 2215952 - protein, 19 aa, Cryptosporidium parvum
HERGETTEHLESRQGKKSP

SEQ ID NO: 2215953 - protein, 10 aa, Cryptosporidium parvum
HESETKRSKH

SEQ ID NO: 2215954 - protein, 6 aa, Cryptosporidium parvum
HESNSN

SEQ ID NO: 2215955 - protein, 21 aa, Cryptosporidium parvum
HESNSNCSINSESAPKSNPKR

SEQ ID NO: 2215956 - protein, 15 aa, Cryptosporidium parvum
HESSHFSSKKSNHSN

SEQ ID NO: 2215957 - protein, 15 aa, Cryptosporidium parvum
HESWTGEKSAKERFS

SEQ ID NO: 2215958 - protein, 5 aa, Cryptosporidium parvum
HETKN

SEQ ID NO: 2215959 - protein, 8 aa, Cryptosporidium parvum
HETQKGRF

SEQ ID NO: 2215960 - protein, 13 aa, Cryptosporidium parvum
HETVAKSNRKRMK

SEQ ID NO: 2215961 - protein, 12 aa, Cryptosporidium parvum
HFEGSDTEESTI

SEQ ID NO: 2215962 - protein, 56 aa, Cryptosporidium parvum
HFGNSTEKLDHYDSRDNSNCKNSNGNSTNSNSTNSNNNNNNNNNNNNNNSNTNNNI

SEQ ID NO: 2215963 - protein, 5 aa, Cryptosporidium parvum
HFQKK

SEQ ID NO: 2215964 - protein, 17 aa, Cryptosporidium parvum
HFSPNNTSLEKKEGSLH

SEQ ID NO: 2215965 - protein, 6 aa, Cryptosporidium parvum
HGANGY

SEQ ID NO: 2215966 - protein, 4 aa, Cryptosporidium parvum
HGCD

SEQ ID NO: 2215967 - protein, 9 aa, Cryptosporidium parvum
HGDKDVAEA

SEQ ID NO: 2215968 - protein, 10 aa, Cryptosporidium parvum
HGEEIEENSN

SEQ ID NO: 2215969 - protein, 8 aa, Cryptosporidium parvum
HGEKDDYS

SEQ ID NO: 2215970 - protein, 5 aa, Cryptosporidium parvum
HGEQL

SEQ ID NO: 2215971 - protein, 8 aa, Cryptosporidium parvum
HGIGTSNK

SEQ ID NO: 2215972 - protein, 4 aa, Cryptosporidium parvum
HGIT

SEQ ID NO: 2215973 - protein, 11 aa, Cryptosporidium parvum
HGNPQDKNGLF

SEQ ID NO: 2215974 - protein, 5 aa, Cryptosporidium parvum
HGPHT

SEQ ID NO: 2215975 - protein, 14 aa, Cryptosporidium parvum
HGPNHGNRQHHNQF

SEQ ID NO: 2215976 - protein, 17 aa, Cryptosporidium parvum
HGQNENGGHGGSCITET

SEQ ID NO: 2215977 - protein, 11 aa, Cryptosporidium parvum
HGRNTVDDQKS

SEQ ID NO: 2215978 - protein, 7 aa, Cryptosporidium parvum
HGSGKTT

SEQ ID NO: 2215979 - protein, 17 aa, Cryptosporidium parvum
HGSNDQFNSQTQQWNNS

SEQ ID NO: 2215980 - protein, 10 aa, Cryptosporidium parvum
HGTDPTPLGR

SEQ ID NO: 2215981 - protein, 11 aa, Cryptosporidium parvum
HGTGTKLGDPI

SEQ ID NO: 2215982 - protein, 9 aa, Cryptosporidium parvum
HGTGTQLGD

SEQ ID NO: 2215983 - protein, 14 aa, Cryptosporidium parvum
HGTSKNSQKNSSNI

SEQ ID NO: 2215984 - protein, 11 aa, Cryptosporidium parvum
HGYLSSDSRIG

SEQ ID NO: 2215985 - protein, 36 aa, Cryptosporidium parvum
HHDNGSPIETSFDASPKPLKSTDDLDTHKNNEQVIQ

SEQ ID NO: 2215986 - protein, 18 aa, Cryptosporidium parvum
HHKYNSSLEYQNRQSTHC

SEQ ID NO: 2215987 - protein, 17 aa, Cryptosporidium parvum
HHQRNNKVETIGGELQE

SEQ ID NO: 2215988 - protein, 9 aa, Cryptosporidium parvum
HHRNQGRKD

SEQ ID NO: 2215989 - protein, 6 aa, Cryptosporidium parvum
HHTTLT

SEQ ID NO: 2215990 - protein, 9 aa, Cryptosporidium parvum
HIKTKKGGI

SEQ ID NO: 2215991 - protein, 6 aa, Cryptosporidium parvum
HISQQG

SEQ ID NO: 2215992 - protein, 5 aa, Cryptosporidium parvum
HISSK

SEQ ID NO: 2215993 - protein, 11 aa, Cryptosporidium parvum
HISSPPSSSWE

SEQ ID NO: 2215994 - protein, 5 aa, Cryptosporidium parvum
HITGS

SEQ ID NO: 2215995 - protein, 9 aa, Cryptosporidium parvum
HKADSEINN

SEQ ID NO: 2215996 - protein, 8 aa, Cryptosporidium parvum
HKDGKITK

SEQ ID NO: 2215997 - protein, 7 aa, Cryptosporidium parvum
HKEDNSI

SEQ ID NO: 2215998 - protein, 12 aa, Cryptosporidium parvum
HKEDRKTSVERQ

SEQ ID NO: 2215999 - protein, 42 aa, Cryptosporidium parvum
HKEESKDEDISHNHEDQDKSSLKDTFKSSKKRRMNSTHPQDQ

SEQ ID NO: 2216000 - protein, 7 aa, Cryptosporidium parvum
HKELNSS

SEQ ID NO: 2216001 - protein, 14 aa, Cryptosporidium parvum
HKGITGKKSKLRNL

SEQ ID NO: 2216002 - protein, 8 aa, Cryptosporidium parvum
HKGNEESK

SEQ ID NO: 2216003 - protein, 6 aa, Cryptosporidium parvum
HKGQND

SEQ ID NO: 2216004 - protein, 11 aa, Cryptosporidium parvum
HKISDNKTEFK

SEQ ID NO: 2216005 - protein, 15 aa, Cryptosporidium parvum
HKITGTKNEKYEENA

SEQ ID NO: 2216006 - protein, 8 aa, Cryptosporidium parvum
HKKTKETM

SEQ ID NO: 2216007 - protein, 10 aa, Cryptosporidium parvum
HKNENKEVNF

SEQ ID NO: 2216008 - protein, 7 aa, Cryptosporidium parvum
HKNKQEN

SEQ ID NO: 2216009 - protein, 5 aa, Cryptosporidium parvum
HKNRY

SEQ ID NO: 2216010 - protein, 8 aa, Cryptosporidium parvum
HKNSGATF

SEQ ID NO: 2216011 - protein, 4 aa, Cryptosporidium parvum
HKQE

SEQ ID NO: 2216012 - protein, 22 aa, Cryptosporidium parvum
HKQNFGKETQTKNTNLTKGEKI

SEQ ID NO: 2216013 - protein, 15 aa, Cryptosporidium parvum
HKQRNDSEAQTSVDT

SEQ ID NO: 2216014 - protein, 32 aa, Cryptosporidium parvum
HKQRNTSNQHSSSKRNDDRSYSGSRGHRGSHQ

SEQ ID NO: 2216015 - protein, 9 aa, Cryptosporidium parvum
HKQSTDIST

SEQ ID NO: 2216016 - protein, 5 aa, Cryptosporidium parvum
HKSEN

SEQ ID NO: 2216017 - protein, 9 aa, Cryptosporidium parvum
HKSKAIEPY

SEQ ID NO: 2216018 - protein, 6 aa, Cryptosporidium parvum
HKSSVK

SEQ ID NO: 2216019 - protein, 7 aa, Cryptosporidium parvum
HKSTEYN

SEQ ID NO: 2216020 - protein, 7 aa, Cryptosporidium parvum
HKSTGLP

SEQ ID NO: 2216021 - protein, 4 aa, Cryptosporidium parvum
HKTL

SEQ ID NO: 2216022 - protein, 8 aa, Cryptosporidium parvum
HKTPNKYQ

SEQ ID NO: 2216023 - protein, 6 aa, Cryptosporidium parvum
HKYPDG

SEQ ID NO: 2216024 - protein, 13 aa, Cryptosporidium parvum
HLGPSIKQNSMNQ

SEQ ID NO: 2216025 - protein, 11 aa, Cryptosporidium parvum
HLNNGNERSLK

SEQ ID NO: 2216026 - protein, 12 aa, Cryptosporidium parvum
HLPKDSDITNIN

SEQ ID NO: 2216027 - protein, 20 aa, Cryptosporidium parvum
HNDDPASAAHPSHDSIKQQK

SEQ ID NO: 2216028 - protein, 26 aa, Cryptosporidium parvum
HNDNYNVDKTNNIRSEKKSHNNSKEE

SEQ ID NO: 2216029 - protein, 5 aa, Cryptosporidium parvum
HNDPN

SEQ ID NO: 2216030 - protein, 5 aa, Cryptosporidium parvum
HNEKY

SEQ ID NO: 2216031 - protein, 9 aa, Cryptosporidium parvum
HNGNNGNGN

SEQ ID NO: 2216032 - protein, 5 aa, Cryptosporidium parvum
HNIGG

SEQ ID NO: 2216033 - protein, 10 aa, Cryptosporidium parvum
HNIGNSEISS

SEQ ID NO: 2216034 - protein, 23 aa, Cryptosporidium parvum
HNIKTDKAIRKNKESNINGENSY

SEQ ID NO: 2216035 - protein, 9 aa, Cryptosporidium parvum
HNKEESNQG

SEQ ID NO: 2216036 - protein, 8 aa, Cryptosporidium parvum
HNLPPNLP

SEQ ID NO: 2216037 - protein, 16 aa, Cryptosporidium parvum
HNNESNNGNNRNNSFN

SEQ ID NO: 2216038 - protein, 5 aa, Cryptosporidium parvum
HNNFE

SEQ ID NO: 2216039 - protein, 8 aa, Cryptosporidium parvum
HNNNNEYD

SEQ ID NO: 2216040 - protein, 7 aa, Cryptosporidium parvum
HNNQTIN

SEQ ID NO: 2216041 - protein, 9 aa, Cryptosporidium parvum
HNNQTNDES

SEQ ID NO: 2216042 - protein, 23 aa, Cryptosporidium parvum
HNPELEQPLSTASSTRGHGITGT

SEQ ID NO: 2216043 - protein, 5 aa, Cryptosporidium parvum
HNPNN

SEQ ID NO: 2216044 - protein, 5 aa, Cryptosporidium parvum
HNQGS

SEQ ID NO: 2216045 - protein, 7 aa, Cryptosporidium parvum
HNQNTNL

SEQ ID NO: 2216046 - protein, 8 aa, Cryptosporidium parvum
HNQPNDNG

SEQ ID NO: 2216047 - protein, 35 aa, Cryptosporidium parvum
HNQSGGGNGDGSSIINSNSNNSGNNNNSSSLPIKT

SEQ ID NO: 2216048 - protein, 5 aa, Cryptosporidium parvum
HNRQS

SEQ ID NO: 2216049 - protein, 4 aa, Cryptosporidium parvum
HNSD

SEQ ID NO: 2216050 - protein, 5 aa, Cryptosporidium parvum
HNSFT

SEQ ID NO: 2216051 - protein, 26 aa, Cryptosporidium parvum
HNSSDSDALNNSISENANDSRNNMDP

SEQ ID NO: 2216052 - protein, 13 aa, Cryptosporidium parvum
HNTANLEKKLSKG

SEQ ID NO: 2216053 - protein, 7 aa, Cryptosporidium parvum
HNTDQNK

SEQ ID NO: 2216054 - protein, 14 aa, Cryptosporidium parvum
HNTPIYGMKSDNSI

SEQ ID NO: 2216055 - protein, 10 aa, Cryptosporidium parvum
HNTSNTIDHE

SEQ ID NO: 2216056 - protein, 4 aa, Cryptosporidium parvum
HNTT

SEQ ID NO: 2216057 - protein, 6 aa, Cryptosporidium parvum
HPAEIQ

SEQ ID NO: 2216058 - protein, 12 aa, Cryptosporidium parvum
HPDKNPNDPTAA

SEQ ID NO: 2216059 - protein, 4 aa, Cryptosporidium parvum
HPEF

SEQ ID NO: 2216060 - protein, 5 aa, Cryptosporidium parvum
HPEIE

SEQ ID NO: 2216061 - protein, 4 aa, Cryptosporidium parvum
HPEK

SEQ ID NO: 2216062 - protein, 6 aa, Cryptosporidium parvum
HPENFT

SEQ ID NO: 2216063 - protein, 11 aa, Cryptosporidium parvum
HPGSCNPSGTV

SEQ ID NO: 2216064 - protein, 6 aa, Cryptosporidium parvum
HPGSSE

SEQ ID NO: 2216065 - protein, 5 aa, Cryptosporidium parvum
HPLSG

SEQ ID NO: 2216066 - protein, 4 aa, Cryptosporidium parvum
HPNS

SEQ ID NO: 2216067 - protein, 6 aa, Cryptosporidium parvum
HPNYEN

SEQ ID NO: 2216068 - protein, 10 aa, Cryptosporidium parvum
HPPISEPPMK

SEQ ID NO: 2216069 - protein, 4 aa, Cryptosporidium parvum
HPQK

SEQ ID NO: 2216070 - protein, 5 aa, Cryptosporidium parvum
HPQKK

SEQ ID NO: 2216071 - protein, 9 aa, Cryptosporidium parvum
HPSTQLKDS

SEQ ID NO: 2216072 - protein, 8 aa, Cryptosporidium parvum
HPSYSKVD

SEQ ID NO: 2216073 - protein, 5 aa, Cryptosporidium parvum
HPTIK

SEQ ID NO: 2216074 - protein, 21 aa, Cryptosporidium parvum
HPTNELSGSNHNKNLNTKSSL

SEQ ID NO: 2216075 - protein, 13 aa, Cryptosporidium parvum
HPTSKISKNKSVF

SEQ ID NO: 2216076 - protein, 6 aa, Cryptosporidium parvum
HPVGPF

SEQ ID NO: 2216077 - protein, 15 aa, Cryptosporidium parvum
HQADKVRGGGLDREM

SEQ ID NO: 2216078 - protein, 13 aa, Cryptosporidium parvum
HQGCPPPKIPLCR

SEQ ID NO: 2216079 - protein, 6 aa, Cryptosporidium parvum
HQGGKF

SEQ ID NO: 2216080 - protein, 6 aa, Cryptosporidium parvum
HQIETS

SEQ ID NO: 2216081 - protein, 8 aa, Cryptosporidium parvum
HQKRKSRQ

SEQ ID NO: 2216082 - protein, 14 aa, Cryptosporidium parvum
HQKTPNQDTLGSKS

SEQ ID NO: 2216083 - protein, 6 aa, Cryptosporidium parvum
HQKTVS

SEQ ID NO: 2216084 - protein, 15 aa, Cryptosporidium parvum
HQNDQEKNKDNSNYK

SEQ ID NO: 2216085 - protein, 20 aa, Cryptosporidium parvum
HQNNKSQVTNESSSKQEDNN

SEQ ID NO: 2216086 - protein, 16 aa, Cryptosporidium parvum
HQQQQQSSGAKQGWNT

SEQ ID NO: 2216087 - protein, 6 aa, Cryptosporidium parvum
HQQRNE

SEQ ID NO: 2216088 - protein, 13 aa, Cryptosporidium parvum
HQQTNKNTENEIT

SEQ ID NO: 2216089 - protein, 14 aa, Cryptosporidium parvum
HQSKDLKSSVNDQS

SEQ ID NO: 2216090 - protein, 6 aa, Cryptosporidium parvum
HQSNGN

SEQ ID NO: 2216091 - protein, 7 aa, Cryptosporidium parvum
HQSNIES

SEQ ID NO: 2216092 - protein, 4 aa, Cryptosporidium parvum
HQTT

SEQ ID NO: 2216093 - protein, 6 aa, Cryptosporidium parvum
HQVSES

SEQ ID NO: 2216094 - protein, 11 aa, Cryptosporidium parvum
HRADTKSKQMS

SEQ ID NO: 2216095 - protein, 7 aa, Cryptosporidium parvum
HREERNR

SEQ ID NO: 2216096 - protein, 13 aa, Cryptosporidium parvum
HRESNSDKNDYEK

SEQ ID NO: 2216097 - protein, 20 aa, Cryptosporidium parvum
HRKGQKTAARIQASRNSDYN

SEQ ID NO: 2216098 - protein, 12 aa, Cryptosporidium parvum
HRKNAPNNIGCK

SEQ ID NO: 2216099 - protein, 4 aa, Cryptosporidium parvum
HRNF

SEQ ID NO: 2216100 - protein, 8 aa, Cryptosporidium parvum
HRPPRNWP

SEQ ID NO: 2216101 - protein, 7 aa, Cryptosporidium parvum
HRRGTNW

SEQ ID NO: 2216102 - protein, 7 aa, Cryptosporidium parvum
HRSKSQM

SEQ ID NO: 2216103 - protein, 10 aa, Cryptosporidium parvum
HRSVNSQSTL

SEQ ID NO: 2216104 - protein, 5 aa, Cryptosporidium parvum
HRTTT

SEQ ID NO: 2216105 - protein, 5 aa, Cryptosporidium parvum
HSAAA

SEQ ID NO: 2216106 - protein, 9 aa, Cryptosporidium parvum
HSAVNRRGN

SEQ ID NO: 2216107 - protein, 7 aa, Cryptosporidium parvum
HSDNSKF

SEQ ID NO: 2216108 - protein, 5 aa, Cryptosporidium parvum
HSDSR

SEQ ID NO: 2216109 - protein, 14 aa, Cryptosporidium parvum
HSEKIENPNEATPF

SEQ ID NO: 2216110 - protein, 8 aa, Cryptosporidium parvum
HSEKLSDE

SEQ ID NO: 2216111 - protein, 5 aa, Cryptosporidium parvum
HSEPQ

SEQ ID NO: 2216112 - protein, 9 aa, Cryptosporidium parvum
HSEQGEFEG

SEQ ID NO: 2216113 - protein, 11 aa, Cryptosporidium parvum
HSFEDEKYSKS

SEQ ID NO: 2216114 - protein, 16 aa, Cryptosporidium parvum
HSGHQKFKADTDLSSE

SEQ ID NO: 2216115 - protein, 11 aa, Cryptosporidium parvum
HSGRASCSPFG

SEQ ID NO: 2216116 - protein, 8 aa, Cryptosporidium parvum
HSKIPYSR

SEQ ID NO: 2216117 - protein, 11 aa, Cryptosporidium parvum
HSKNPNNYTKE

SEQ ID NO: 2216118 - protein, 10 aa, Cryptosporidium parvum
HSKSKPVNSE

SEQ ID NO: 2216119 - protein, 6 aa, Cryptosporidium parvum
HSKSKY

SEQ ID NO: 2216120 - protein, 9 aa, Cryptosporidium parvum
HSKTDKGAQ

SEQ ID NO: 2216121 - protein, 5 aa, Cryptosporidium parvum
HSLGS

SEQ ID NO: 2216122 - protein, 6 aa, Cryptosporidium parvum
HSLSND

SEQ ID NO: 2216123 - protein, 29 aa, Cryptosporidium parvum
HSNLGSEKYLENDHKDLSNNFNSSNQIDK

SEQ ID NO: 2216124 - protein, 18 aa, Cryptosporidium parvum
HSNNSTNNLVASTGKTFN

SEQ ID NO: 2216125 - protein, 8 aa, Cryptosporidium parvum
HSNRKPLE

SEQ ID NO: 2216126 - protein, 4 aa, Cryptosporidium parvum
HSNS

SEQ ID NO: 2216127 - protein, 10 aa, Cryptosporidium parvum
HSNSDKKGFD

SEQ ID NO: 2216128 - protein, 14 aa, Cryptosporidium parvum
HSNSNNINSKVPDT

SEQ ID NO: 2216129 - protein, 8 aa, Cryptosporidium parvum
HSNSSRGR

SEQ ID NO: 2216130 - protein, 7 aa, Cryptosporidium parvum
HSNYTET

SEQ ID NO: 2216131 - protein, 7 aa, Cryptosporidium parvum
HSPDIYE

SEQ ID NO: 2216132 - protein, 4 aa, Cryptosporidium parvum
HSPI

SEQ ID NO: 2216133 - protein, 12 aa, Cryptosporidium parvum
HSPSKRSPNHQQ

SEQ ID NO: 2216134 - protein, 9 aa, Cryptosporidium parvum
HSQDSQTGL

SEQ ID NO: 2216135 - protein, 27 aa, Cryptosporidium parvum
HSQKPDRGIQNNEHTNRSNNVSNTNTD

SEQ ID NO: 2216136 - protein, 28 aa, Cryptosporidium parvum
HSQRNNSSLNNLPAQSERKLSSETNRSN

SEQ ID NO: 2216137 - protein, 10 aa, Cryptosporidium parvum
HSRRNEDIDL

SEQ ID NO: 2216138 - protein, 9 aa, Cryptosporidium parvum
HSRSENSIQ

SEQ ID NO: 2216139 - protein, 4 aa, Cryptosporidium parvum
HSSE

SEQ ID NO: 2216140 - protein, 8 aa, Cryptosporidium parvum
HSSSNRGT

SEQ ID NO: 2216141 - protein, 14 aa, Cryptosporidium parvum
HSSTESQSSQIPNS

SEQ ID NO: 2216142 - protein, 6 aa, Cryptosporidium parvum
HSTGKT

SEQ ID NO: 2216143 - protein, 7 aa, Cryptosporidium parvum
HSTGSSS

SEQ ID NO: 2216144 - protein, 8 aa, Cryptosporidium parvum
HSTNQESE

SEQ ID NO: 2216145 - protein, 6 aa, Cryptosporidium parvum
HSVPAP

SEQ ID NO: 2216146 - protein, 5 aa, Cryptosporidium parvum
HSYKN

SEQ ID NO: 2216147 - protein, 7 aa, Cryptosporidium parvum
HSYSEHA

SEQ ID NO: 2216148 - protein, 4 aa, Cryptosporidium parvum
HTDG

SEQ ID NO: 2216149 - protein, 7 aa, Cryptosporidium parvum
HTDYTEH

SEQ ID NO: 2216150 - protein, 5 aa, Cryptosporidium parvum
HTGSE

SEQ ID NO: 2216151 - protein, 5 aa, Cryptosporidium parvum
HTIKD

SEQ ID NO: 2216152 - protein, 4 aa, Cryptosporidium parvum
HTKT

SEQ ID NO: 2216153 - protein, 11 aa, Cryptosporidium parvum
HTKYTGYSSND

SEQ ID NO: 2216154 - protein, 6 aa, Cryptosporidium parvum
HTNESK

SEQ ID NO: 2216155 - protein, 11 aa, Cryptosporidium parvum
HTNNDEMQENT

SEQ ID NO: 2216156 - protein, 8 aa, Cryptosporidium parvum
HTNSKTGE

SEQ ID NO: 2216157 - protein, 13 aa, Cryptosporidium parvum
HTPKSKRESFSDS

SEQ ID NO: 2216158 - protein, 4 aa, Cryptosporidium parvum
HTQQ

SEQ ID NO: 2216159 - protein, 5 aa, Cryptosporidium parvum
HTQTM

SEQ ID NO: 2216160 - protein, 14 aa, Cryptosporidium parvum
HTRHNTDSNHMKDN

SEQ ID NO: 2216161 - protein, 14 aa, Cryptosporidium parvum
HTRNSLESTSIIKK

SEQ ID NO: 2216162 - protein, 7 aa, Cryptosporidium parvum
HTSAGKT

SEQ ID NO: 2216163 - protein, 14 aa, Cryptosporidium parvum
HTSISSNANDGGVN

SEQ ID NO: 2216164 - protein, 6 aa, Cryptosporidium parvum
HTSQGH

SEQ ID NO: 2216165 - protein, 27 aa, Cryptosporidium parvum
HTSSAKSSKHKGSKFDTSISEGSSSLK

SEQ ID NO: 2216166 - protein, 8 aa, Cryptosporidium parvum
HTSTASAA

SEQ ID NO: 2216167 - protein, 12 aa, Cryptosporidium parvum
HTTIKQKKSRRN

SEQ ID NO: 2216168 - protein, 8 aa, Cryptosporidium parvum
HTTKSSKY

SEQ ID NO: 2216169 - protein, 15 aa, Cryptosporidium parvum
HTTNGYSSSPKNAQL

SEQ ID NO: 2216170 - protein, 342 aa, Cryptosporidium parvum
HTTTTTTTTTTTTTTTTTTTTTTTTTTTTTTTTTTTTTTTTTTTTTTTTTTTTTTTTTTTTTTTTTTTKKPTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTSTKKPTTTTTTTTTTTTTTTTTTTTTTTTTTTTTTTTTKKPTTTTTTTTTTTTTTTTTTTTTTTTTTTTTTTTTTTTTTKKPTTTTTTTTTTTTKKPTTTTTATTTTTTSETESVI

SEQ ID NO: 2216171 - protein, 5 aa, Cryptosporidium parvum
HTYKH

SEQ ID NO: 2216172 - protein, 28 aa, Cryptosporidium parvum
HTYKNQLKTRSNNNIADKGSPSEEEASD

SEQ ID NO: 2216173 - protein, 11 aa, Cryptosporidium parvum
HVNAGKGRRGT

SEQ ID NO: 2216174 - protein, 8 aa, Cryptosporidium parvum
HVNKGKTG

SEQ ID NO: 2216175 - protein, 33 aa, Cryptosporidium parvum
HVPNDRDEINNNERISNNGSITGQTPGNSNDRI

SEQ ID NO: 2216176 - protein, 6 aa, Cryptosporidium parvum
HVYPSK

SEQ ID NO: 2216177 - protein, 8 aa, Cryptosporidium parvum
HYKGNEKV

SEQ ID NO: 2216178 - protein, 5 aa, Cryptosporidium parvum
HYNNS

SEQ ID NO: 2216179 - protein, 11 aa, Cryptosporidium parvum
HYNTSSRSNFS

SEQ ID NO: 2216180 - protein, 8 aa, Cryptosporidium parvum
HYSSSDNE

SEQ ID NO: 2216181 - protein, 12 aa, Cryptosporidium parvum
IADPDKRTTSLE

SEQ ID NO: 2216182 - protein, 7 aa, Cryptosporidium parvum
IADQARM

SEQ ID NO: 2216183 - protein, 11 aa, Cryptosporidium parvum
IAEEEGKITTT

SEQ ID NO: 2216184 - protein, 11 aa, Cryptosporidium parvum
IAEPSRKSSKY

SEQ ID NO: 2216185 - protein, 10 aa, Cryptosporidium parvum
IAETENKSTF

SEQ ID NO: 2216186 - protein, 10 aa, Cryptosporidium parvum
IAETGAGQHG

SEQ ID NO: 2216187 - protein, 17 aa, Cryptosporidium parvum
IAKKTQVRRKTTTKSKQ

SEQ ID NO: 2216188 - protein, 8 aa, Cryptosporidium parvum
IANKGDIS

SEQ ID NO: 2216189 - protein, 7 aa, Cryptosporidium parvum
IANREKN

SEQ ID NO: 2216190 - protein, 5 aa, Cryptosporidium parvum
IAPEE

SEQ ID NO: 2216191 - protein, 7 aa, Cryptosporidium parvum
IAPNSSS

SEQ ID NO: 2216192 - protein, 5 aa, Cryptosporidium parvum
IAPRN

SEQ ID NO: 2216193 - protein, 6 aa, Cryptosporidium parvum
IASESP

SEQ ID NO: 2216194 - protein, 9 aa, Cryptosporidium parvum
IASKDEANY

SEQ ID NO: 2216195 - protein, 23 aa, Cryptosporidium parvum
IASNSNDINMKSPSTQTSSSSLT

SEQ ID NO: 2216196 - protein, 30 aa, Cryptosporidium parvum
IASQGEDKFSQKDSDDHQGSKASTNTDTQY

SEQ ID NO: 2216197 - protein, 9 aa, Cryptosporidium parvum
IASSHGDPL

SEQ ID NO: 2216198 - protein, 6 aa, Cryptosporidium parvum
IASSNH

SEQ ID NO: 2216199 - protein, 21 aa, Cryptosporidium parvum
IATSPNANCSNGNSGTPPQYS

SEQ ID NO: 2216200 - protein, 7 aa, Cryptosporidium parvum
ICNETNS

SEQ ID NO: 2216201 - protein, 4 aa, Cryptosporidium parvum
IDAS

SEQ ID NO: 2216202 - protein, 23 aa, Cryptosporidium parvum
IDDCREEAEYDKEDNTEDTPLQD

SEQ ID NO: 2216203 - protein, 4 aa, Cryptosporidium parvum
IDDE

SEQ ID NO: 2216204 - protein, 5 aa, Cryptosporidium parvum
IDDNI

SEQ ID NO: 2216205 - protein, 8 aa, Cryptosporidium parvum
IDDPEKKK

SEQ ID NO: 2216206 - protein, 9 aa, Cryptosporidium parvum
IDDPSSGKK

SEQ ID NO: 2216207 - protein, 7 aa, Cryptosporidium parvum
IDEEKSI

SEQ ID NO: 2216208 - protein, 5 aa, Cryptosporidium parvum
IDEEN

SEQ ID NO: 2216209 - protein, 8 aa, Cryptosporidium parvum
IDEEQSEK

SEQ ID NO: 2216210 - protein, 4 aa, Cryptosporidium parvum
IDEK

SEQ ID NO: 2216211 - protein, 13 aa, Cryptosporidium parvum
IDEKVQERKDDPV

SEQ ID NO: 2216212 - protein, 6 aa, Cryptosporidium parvum
IDENVS

SEQ ID NO: 2216213 - protein, 29 aa, Cryptosporidium parvum
IDESTPDLKGKVRGNKEATGSESGQNTTS

SEQ ID NO: 2216214 - protein, 4 aa, Cryptosporidium parvum
IDET

SEQ ID NO: 2216215 - protein, 7 aa, Cryptosporidium parvum
IDETGEE

SEQ ID NO: 2216216 - protein, 9 aa, Cryptosporidium parvum
IDGDGKLSV

SEQ ID NO: 2216217 - protein, 8 aa, Cryptosporidium parvum
IDGDSSTI

SEQ ID NO: 2216218 - protein, 9 aa, Cryptosporidium parvum
IDGGREKIT

SEQ ID NO: 2216219 - protein, 11 aa, Cryptosporidium parvum
IDGKETENSQQ

SEQ ID NO: 2216220 - protein, 9 aa, Cryptosporidium parvum
IDGKGSSSF

SEQ ID NO: 2216221 - protein, 34 aa, Cryptosporidium parvum
IDGNKVSTEDNTPKKRRIGESNNLETNKEQQNGI

SEQ ID NO: 2216222 - protein, 7 aa, Cryptosporidium parvum
IDGTEIS

SEQ ID NO: 2216223 - protein, 8 aa, Cryptosporidium parvum
IDGTSSAD

SEQ ID NO: 2216224 - protein, 5 aa, Cryptosporidium parvum
IDHPD

SEQ ID NO: 2216225 - protein, 12 aa, Cryptosporidium parvum
IDHQKNNTTPDL

SEQ ID NO: 2216226 - protein, 11 aa, Cryptosporidium parvum
IDKHGSKLRNS

SEQ ID NO: 2216227 - protein, 11 aa, Cryptosporidium parvum
IDKNDDSSTNS

SEQ ID NO: 2216228 - protein, 9 aa, Cryptosporidium parvum
IDKNESLET

SEQ ID NO: 2216229 - protein, 19 aa, Cryptosporidium parvum
IDKRGSVSSSKKKSGYPVG

SEQ ID NO: 2216230 - protein, 5 aa, Cryptosporidium parvum
IDMSN

SEQ ID NO: 2216231 - protein, 8 aa, Cryptosporidium parvum
IDNGIRAT

SEQ ID NO: 2216232 - protein, 18 aa, Cryptosporidium parvum
IDNSGNTYTLSNSSNASL

SEQ ID NO: 2216233 - protein, 9 aa, Cryptosporidium parvum
IDPRDDPNN

SEQ ID NO: 2216234 - protein, 34 aa, Cryptosporidium parvum
IDQRSTGSNPERKHDDGDQTKAEDTTGVVGGTYG

SEQ ID NO: 2216235 - protein, 7 aa, Cryptosporidium parvum
IDQSNSL

SEQ ID NO: 2216236 - protein, 7 aa, Cryptosporidium parvum
IDQTKKG

SEQ ID NO: 2216237 - protein, 7 aa, Cryptosporidium parvum
IDRENNE

SEQ ID NO: 2216238 - protein, 15 aa, Cryptosporidium parvum
IDRTPSNFRVESGDD

SEQ ID NO: 2216239 - protein, 26 aa, Cryptosporidium parvum
IDSDKDKNNLEHNNNNNNNNNNINAQ

SEQ ID NO: 2216240 - protein, 4 aa, Cryptosporidium parvum
IDSK

SEQ ID NO: 2216241 - protein, 9 aa, Cryptosporidium parvum
IDSKSEEFE

SEQ ID NO: 2216242 - protein, 8 aa, Cryptosporidium parvum
IDSNKGHY

SEQ ID NO: 2216243 - protein, 10 aa, Cryptosporidium parvum
IDSNNDGDVD

SEQ ID NO: 2216244 - protein, 15 aa, Cryptosporidium parvum
IDSNSETDSDETELD

SEQ ID NO: 2216245 - protein, 6 aa, Cryptosporidium parvum
IDSPKL

SEQ ID NO: 2216246 - protein, 14 aa, Cryptosporidium parvum
IDSRGNAGSDLKTE

SEQ ID NO: 2216247 - protein, 8 aa, Cryptosporidium parvum
IDSRRKST

SEQ ID NO: 2216248 - protein, 8 aa, Cryptosporidium parvum
IDSSEDYQ

SEQ ID NO: 2216249 - protein, 7 aa, Cryptosporidium parvum
IDSSKSN

SEQ ID NO: 2216250 - protein, 7 aa, Cryptosporidium parvum
IDSSPTL

SEQ ID NO: 2216251 - protein, 5 aa, Cryptosporidium parvum
IDSSY

SEQ ID NO: 2216252 - protein, 6 aa, Cryptosporidium parvum
IDSSYN

SEQ ID NO: 2216253 - protein, 6 aa, Cryptosporidium parvum
IDTDND

SEQ ID NO: 2216254 - protein, 5 aa, Cryptosporidium parvum
IDTNE

SEQ ID NO: 2216255 - protein, 10 aa, Cryptosporidium parvum
IDTNQGQDTA

SEQ ID NO: 2216256 - protein, 8 aa, Cryptosporidium parvum
IDTNSTPW

SEQ ID NO: 2216257 - protein, 9 aa, Cryptosporidium parvum
IDYSDNRDL

SEQ ID NO: 2216258 - protein, 4 aa, Cryptosporidium parvum
IEAK

SEQ ID NO: 2216259 - protein, 6 aa, Cryptosporidium parvum
IEDDGA

SEQ ID NO: 2216260 - protein, 10 aa, Cryptosporidium parvum
IEDEEKRSIY

SEQ ID NO: 2216261 - protein, 7 aa, Cryptosporidium parvum
IEDPPKS

SEQ ID NO: 2216262 - protein, 11 aa, Cryptosporidium parvum
IEDSNGNPNIC

SEQ ID NO: 2216263 - protein, 7 aa, Cryptosporidium parvum
IEDSSSG

SEQ ID NO: 2216264 - protein, 5 aa, Cryptosporidium parvum
IEDTQ

SEQ ID NO: 2216265 - protein, 10 aa, Cryptosporidium parvum
IEEDDNPSAL

SEQ ID NO: 2216266 - protein, 6 aa, Cryptosporidium parvum
IEEDEY

SEQ ID NO: 2216267 - protein, 17 aa, Cryptosporidium parvum
IEEEEKEEETEKSFEIS

SEQ ID NO: 2216268 - protein, 12 aa, Cryptosporidium parvum
IEEEKEEEENNN

SEQ ID NO: 2216269 - protein, 14 aa, Cryptosporidium parvum
IEEGLPTGNNNENR

SEQ ID NO: 2216270 - protein, 8 aa, Cryptosporidium parvum
IEEKRNEV

SEQ ID NO: 2216271 - protein, 13 aa, Cryptosporidium parvum
IEENNGNEDGENC

SEQ ID NO: 2216272 - protein, 5 aa, Cryptosporidium parvum
IEENS

SEQ ID NO: 2216273 - protein, 9 aa, Cryptosporidium parvum
IEESSKKAA

SEQ ID NO: 2216274 - protein, 9 aa, Cryptosporidium parvum
IEETNKRME

SEQ ID NO: 2216275 - protein, 87 aa, Cryptosporidium parvum
  misc_feature (48)..(48): Xaa can be any naturally occurring amino acid
  misc_feature (68)..(68): Xaa can be any naturally occurring amino acid
IEGEDDDLSNDDIVGDDDLTSDVDDVDDDDDDDDDDDDDDDDDDDDDXDDDDEGDDEDGMNFDESDMXSGMSSEDSDVDELRRTPRI

SEQ ID NO: 2216276 - protein, 4 aa, Cryptosporidium parvum
IEGK

SEQ ID NO: 2216277 - protein, 13 aa, Cryptosporidium parvum
IEGNSDKMESNEL

SEQ ID NO: 2216278 - protein, 6 aa, Cryptosporidium parvum
IEGPKK

SEQ ID NO: 2216279 - protein, 6 aa, Cryptosporidium parvum
IEGSNK

SEQ ID NO: 2216280 - protein, 5 aa, Cryptosporidium parvum
IEHQN

SEQ ID NO: 2216281 - protein, 4 aa, Cryptosporidium parvum
IEIQ

SEQ ID NO: 2216282 - protein, 6 aa, Cryptosporidium parvum
IEKADT

SEQ ID NO: 2216283 - protein, 4 aa, Cryptosporidium parvum
IEKD

SEQ ID NO: 2216284 - protein, 8 aa, Cryptosporidium parvum
IEKDSDSF

SEQ ID NO: 2216285 - protein, 8 aa, Cryptosporidium parvum
IEKGKEVS

SEQ ID NO: 2216286 - protein, 8 aa, Cryptosporidium parvum
IEKGSSKK

SEQ ID NO: 2216287 - protein, 8 aa, Cryptosporidium parvum
IEKKSSLN

SEQ ID NO: 2216288 - protein, 21 aa, Cryptosporidium parvum
IEKSESKVEIENSPLSDSSDY

SEQ ID NO: 2216289 - protein, 11 aa, Cryptosporidium parvum
IELEDKKQKRI

SEQ ID NO: 2216290 - protein, 6 aa, Cryptosporidium parvum
IELGGN

SEQ ID NO: 2216291 - protein, 4 aa, Cryptosporidium parvum
IENE

SEQ ID NO: 2216292 - protein, 44 aa, Cryptosporidium parvum
IENGNSNNNNINNQNPNLSSGTSSKNPPNYRHSADNDTISESHW

SEQ ID NO: 2216293 - protein, 7 aa, Cryptosporidium parvum
IENHPEV

SEQ ID NO: 2216294 - protein, 16 aa, Cryptosporidium parvum
IENNDESNSSNNNNMN

SEQ ID NO: 2216295 - protein, 9 aa, Cryptosporidium parvum
IENNSFDKS

SEQ ID NO: 2216296 - protein, 8 aa, Cryptosporidium parvum
IENNSQNI

SEQ ID NO: 2216297 - protein, 17 aa, Cryptosporidium parvum
IENSGDFSINAPKDTEY

SEQ ID NO: 2216298 - protein, 10 aa, Cryptosporidium parvum
IENSNRRANR

SEQ ID NO: 2216299 - protein, 14 aa, Cryptosporidium parvum
IENTEKGDEPRETE

SEQ ID NO: 2216300 - protein, 7 aa, Cryptosporidium parvum
IENTPIE

SEQ ID NO: 2216301 - protein, 11 aa, Cryptosporidium parvum
IENTQSNNLNE

SEQ ID NO: 2216302 - protein, 15 aa, Cryptosporidium parvum
IEPSITSTETQGPSE

SEQ ID NO: 2216303 - protein, 5 aa, Cryptosporidium parvum
IEPSQ

SEQ ID NO: 2216304 - protein, 41 aa, Cryptosporidium parvum
IEPSSSSNSAASSSAASSASGQTQTNSGTGFSGTGTSTIPT

SEQ ID NO: 2216305 - protein, 4 aa, Cryptosporidium parvum
IEQA

SEQ ID NO: 2216306 - protein, 11 aa, Cryptosporidium parvum
IEQDEESDNHT

SEQ ID NO: 2216307 - protein, 7 aa, Cryptosporidium parvum
IEQDSNS

SEQ ID NO: 2216308 - protein, 11 aa, Cryptosporidium parvum
IEQEDEEIINE

SEQ ID NO: 2216309 - protein, 13 aa, Cryptosporidium parvum
IEQENSRKDENNS

SEQ ID NO: 2216310 - protein, 9 aa, Cryptosporidium parvum
IEQENSSLT

SEQ ID NO: 2216311 - protein, 5 aa, Cryptosporidium parvum
IEQER

SEQ ID NO: 2216312 - protein, 8 aa, Cryptosporidium parvum
IERRSNKP

SEQ ID NO: 2216313 - protein, 9 aa, Cryptosporidium parvum
IERSNSDQF

SEQ ID NO: 2216314 - protein, 17 aa, Cryptosporidium parvum
IESAQTKKSSSDQKKPS

SEQ ID NO: 2216315 - protein, 5 aa, Cryptosporidium parvum
IESEL

SEQ ID NO: 2216316 - protein, 13 aa, Cryptosporidium parvum
IESGISSRSIQSN

SEQ ID NO: 2216317 - protein, 9 aa, Cryptosporidium parvum
IESNKQNAF

SEQ ID NO: 2216318 - protein, 8 aa, Cryptosporidium parvum
IESNPNIS

SEQ ID NO: 2216319 - protein, 8 aa, Cryptosporidium parvum
IESNPQSN

SEQ ID NO: 2216320 - protein, 7 aa, Cryptosporidium parvum
IESNPTD

SEQ ID NO: 2216321 - protein, 15 aa, Cryptosporidium parvum
IESNSNNDNIQEEIQ

SEQ ID NO: 2216322 - protein, 7 aa, Cryptosporidium parvum
IESNTKI

SEQ ID NO: 2216323 - protein, 13 aa, Cryptosporidium parvum
IESPLKGDESTLS

SEQ ID NO: 2216324 - protein, 10 aa, Cryptosporidium parvum
IESQLEDYSK

SEQ ID NO: 2216325 - protein, 8 aa, Cryptosporidium parvum
IESQSKEE

SEQ ID NO: 2216326 - protein, 13 aa, Cryptosporidium parvum
IESSKKFPGFLNL

SEQ ID NO: 2216327 - protein, 6 aa, Cryptosporidium parvum
IESSTP

SEQ ID NO: 2216328 - protein, 15 aa, Cryptosporidium parvum
IESTFDKKNSENHNL

SEQ ID NO: 2216329 - protein, 8 aa, Cryptosporidium parvum
IETDGTNE

SEQ ID NO: 2216330 - protein, 9 aa, Cryptosporidium parvum
IETKGRGGP

SEQ ID NO: 2216331 - protein, 19 aa, Cryptosporidium parvum
IETNPVSKVDKEKVTGKEI

SEQ ID NO: 2216332 - protein, 19 aa, Cryptosporidium parvum
IETQNKGSVGVEATENTSI

SEQ ID NO: 2216333 - protein, 4 aa, Cryptosporidium parvum
IETS

SEQ ID NO: 2216334 - protein, 18 aa, Cryptosporidium parvum
IETSDLNSSPYSDSQSNH

SEQ ID NO: 2216335 - protein, 8 aa, Cryptosporidium parvum
IETSENKM

SEQ ID NO: 2216336 - protein, 7 aa, Cryptosporidium parvum
IETTHSN

SEQ ID NO: 2216337 - protein, 4 aa, Cryptosporidium parvum
IFES

SEQ ID NO: 2216338 - protein, 5 aa, Cryptosporidium parvum
IGASY

SEQ ID NO: 2216339 - protein, 11 aa, Cryptosporidium parvum
IGAYGKDIGTN

SEQ ID NO: 2216340 - protein, 5 aa, Cryptosporidium parvum
IGDAQ

SEQ ID NO: 2216341 - protein, 7 aa, Cryptosporidium parvum
IGDKSGK

SEQ ID NO: 2216342 - protein, 11 aa, Cryptosporidium parvum
IGDSGREKLSD

SEQ ID NO: 2216343 - protein, 6 aa, Cryptosporidium parvum
IGDSYE

SEQ ID NO: 2216344 - protein, 16 aa, Cryptosporidium parvum
IGDTSYSKPNGEGKLT

SEQ ID NO: 2216345 - protein, 6 aa, Cryptosporidium parvum
IGEDDS

SEQ ID NO: 2216346 - protein, 16 aa, Cryptosporidium parvum
IGEGGTGLNHNNSGLN

SEQ ID NO: 2216347 - protein, 5 aa, Cryptosporidium parvum
IGEGS

SEQ ID NO: 2216348 - protein, 7 aa, Cryptosporidium parvum
IGEQDSF

SEQ ID NO: 2216349 - protein, 5 aa, Cryptosporidium parvum
IGESL

SEQ ID NO: 2216350 - protein, 12 aa, Cryptosporidium parvum
IGGADSSTNQEV

SEQ ID NO: 2216351 - protein, 34 aa, Cryptosporidium parvum
IGGANSSNSISLTSASLSSSETVKAQNKLEGSGS

SEQ ID NO: 2216352 - protein, 4 aa, Cryptosporidium parvum
IGGF

SEQ ID NO: 2216353 - protein, 8 aa, Cryptosporidium parvum
IGGGGNGY

SEQ ID NO: 2216354 - protein, 9 aa, Cryptosporidium parvum
IGGLGTGAS

SEQ ID NO: 2216355 - protein, 9 aa, Cryptosporidium parvum
IGGPQQNPI

SEQ ID NO: 2216356 - protein, 27 aa, Cryptosporidium parvum
IGGTSVGGSSAGGTSIGGTSIGGTSIG

SEQ ID NO: 2216357 - protein, 9 aa, Cryptosporidium parvum
IGHRDHKGN

SEQ ID NO: 2216358 - protein, 9 aa, Cryptosporidium parvum
IGKEQGEEE

SEQ ID NO: 2216359 - protein, 8 aa, Cryptosporidium parvum
IGKESNLA

SEQ ID NO: 2216360 - protein, 8 aa, Cryptosporidium parvum
IGKSTGYK

SEQ ID NO: 2216361 - protein, 4 aa, Cryptosporidium parvum
IGKT

SEQ ID NO: 2216362 - protein, 6 aa, Cryptosporidium parvum
IGMNRS

SEQ ID NO: 2216363 - protein, 11 aa, Cryptosporidium parvum
IGNENNEKGIE

SEQ ID NO: 2216364 - protein, 17 aa, Cryptosporidium parvum
IGNESRKTNKDSISDTS

SEQ ID NO: 2216365 - protein, 6 aa, Cryptosporidium parvum
IGNGES

SEQ ID NO: 2216366 - protein, 9 aa, Cryptosporidium parvum
IGNKNSELN

SEQ ID NO: 2216367 - protein, 11 aa, Cryptosporidium parvum
IGNNPEKRGIH

SEQ ID NO: 2216368 - protein, 6 aa, Cryptosporidium parvum
IGNNQN

SEQ ID NO: 2216369 - protein, 5 aa, Cryptosporidium parvum
IGNPK

SEQ ID NO: 2216370 - protein, 6 aa, Cryptosporidium parvum
IGNRPN

SEQ ID NO: 2216371 - protein, 21 aa, Cryptosporidium parvum
IGPDDSKSSNGEKNKQESKLS

SEQ ID NO: 2216372 - protein, 4 aa, Cryptosporidium parvum
IGPE

SEQ ID NO: 2216373 - protein, 12 aa, Cryptosporidium parvum
IGPSSTSNQENF

SEQ ID NO: 2216374 - protein, 12 aa, Cryptosporidium parvum
IGQSNNTDSELN

SEQ ID NO: 2216375 - protein, 7 aa, Cryptosporidium parvum
IGQSSSD

SEQ ID NO: 2216376 - protein, 10 aa, Cryptosporidium parvum
IGQSSSVSNN

SEQ ID NO: 2216377 - protein, 6 aa, Cryptosporidium parvum
IGRQDS

SEQ ID NO: 2216378 - protein, 4 aa, Cryptosporidium parvum
IGRV

SEQ ID NO: 2216379 - protein, 4 aa, Cryptosporidium parvum
IGSE

SEQ ID NO: 2216380 - protein, 9 aa, Cryptosporidium parvum
IGSGGEKGE

SEQ ID NO: 2216381 - protein, 7 aa, Cryptosporidium parvum
IGSGKTG

SEQ ID NO: 2216382 - protein, 10 aa, Cryptosporidium parvum
IGSGQELGFE

SEQ ID NO: 2216383 - protein, 9 aa, Cryptosporidium parvum
IGSNSSEIY

SEQ ID NO: 2216384 - protein, 5 aa, Cryptosporidium parvum
IGSPN

SEQ ID NO: 2216385 - protein, 15 aa, Cryptosporidium parvum
IGSQTSQRVENTNAA

SEQ ID NO: 2216386 - protein, 18 aa, Cryptosporidium parvum
IGSSDNLSRSRLSKSTTK

SEQ ID NO: 2216387 - protein, 5 aa, Cryptosporidium parvum
IGSTK

SEQ ID NO: 2216388 - protein, 5 aa, Cryptosporidium parvum
IGTAG

SEQ ID NO: 2216389 - protein, 10 aa, Cryptosporidium parvum
IGTEYSATYT

SEQ ID NO: 2216390 - protein, 7 aa, Cryptosporidium parvum
IGTGAGL

SEQ ID NO: 2216391 - protein, 8 aa, Cryptosporidium parvum
IGTNQTSV

SEQ ID NO: 2216392 - protein, 7 aa, Cryptosporidium parvum
IGTSPGI

SEQ ID NO: 2216393 - protein, 7 aa, Cryptosporidium parvum
IGTSSQA

SEQ ID NO: 2216394 - protein, 11 aa, Cryptosporidium parvum
IGVTENNPDEC

SEQ ID NO: 2216395 - protein, 10 aa, Cryptosporidium parvum
IGYSDSGNYN

SEQ ID NO: 2216396 - protein, 6 aa, Cryptosporidium parvum
IHGGDL

SEQ ID NO: 2216397 - protein, 6 aa, Cryptosporidium parvum
IHNENG

SEQ ID NO: 2216398 - protein, 8 aa, Cryptosporidium parvum
IHNNNSSK

SEQ ID NO: 2216399 - protein, 10 aa, Cryptosporidium parvum
IHNTEQDKEV

SEQ ID NO: 2216400 - protein, 15 aa, Cryptosporidium parvum
IHPNSSITVTGGSDN

SEQ ID NO: 2216401 - protein, 4 aa, Cryptosporidium parvum
IHTD

SEQ ID NO: 2216402 - protein, 12 aa, Cryptosporidium parvum
IIGGQGSLLSNQ

SEQ ID NO: 2216403 - protein, 5 aa, Cryptosporidium parvum
IIPPE

SEQ ID NO: 2216404 - protein, 26 aa, Cryptosporidium parvum
IIPQNQPPMQPPPGRQVFGYAVVPNI

SEQ ID NO: 2216405 - protein, 12 aa, Cryptosporidium parvum
IKAKETDKSGIY

SEQ ID NO: 2216406 - protein, 8 aa, Cryptosporidium parvum
IKAKTTHN

SEQ ID NO: 2216407 - protein, 15 aa, Cryptosporidium parvum
IKAQTAGITASSDSF

SEQ ID NO: 2216408 - protein, 9 aa, Cryptosporidium parvum
IKCNKDEKI

SEQ ID NO: 2216409 - protein, 5 aa, Cryptosporidium parvum
IKDEI

SEQ ID NO: 2216410 - protein, 16 aa, Cryptosporidium parvum
IKDEKGPSNQEEENEK

SEQ ID NO: 2216411 - protein, 12 aa, Cryptosporidium parvum
IKDENKVNNYPE

SEQ ID NO: 2216412 - protein, 31 aa, Cryptosporidium parvum
IKDGEKVKIGKQGPVTLDDPDENNKGKTIPP

SEQ ID NO: 2216413 - protein, 7 aa, Cryptosporidium parvum
IKDKESR

SEQ ID NO: 2216414 - protein, 4 aa, Cryptosporidium parvum
IKDS

SEQ ID NO: 2216415 - protein, 5 aa, Cryptosporidium parvum
IKDSE

SEQ ID NO: 2216416 - protein, 47 aa, Cryptosporidium parvum
IKEEKESDSEVKNQKSKSKSKSRAKSRTKMEGRISSRAKSKKKKVDM

SEQ ID NO: 2216417 - protein, 5 aa, Cryptosporidium parvum
IKEEV

SEQ ID NO: 2216418 - protein, 4 aa, Cryptosporidium parvum
IKEG

SEQ ID NO: 2216419 - protein, 16 aa, Cryptosporidium parvum
IKEKNAVQGGVSPGGI

SEQ ID NO: 2216420 - protein, 8 aa, Cryptosporidium parvum
IKENEPNI

SEQ ID NO: 2216421 - protein, 12 aa, Cryptosporidium parvum
IKENNGGTTGQV

SEQ ID NO: 2216422 - protein, 7 aa, Cryptosporidium parvum
IKEPNSG

SEQ ID NO: 2216423 - protein, 9 aa, Cryptosporidium parvum
IKERPENLS

SEQ ID NO: 2216424 - protein, 6 aa, Cryptosporidium parvum
IKERPK

SEQ ID NO: 2216425 - protein, 4 aa, Cryptosporidium parvum
IKES

SEQ ID NO: 2216426 - protein, 6 aa, Cryptosporidium parvum
IKESTK

SEQ ID NO: 2216427 - protein, 6 aa, Cryptosporidium parvum
IKEYEE

SEQ ID NO: 2216428 - protein, 5 aa, Cryptosporidium parvum
IKGAQ

SEQ ID NO: 2216429 - protein, 4 aa, Cryptosporidium parvum
IKGH

SEQ ID NO: 2216430 - protein, 4 aa, Cryptosporidium parvum
IKGK

SEQ ID NO: 2216431 - protein, 5 aa, Cryptosporidium parvum
IKGKE

SEQ ID NO: 2216432 - protein, 7 aa, Cryptosporidium parvum
IKGKNSD

SEQ ID NO: 2216433 - protein, 5 aa, Cryptosporidium parvum
IKGNK

SEQ ID NO: 2216434 - protein, 7 aa, Cryptosporidium parvum
IKGSKDI

SEQ ID NO: 2216435 - protein, 21 aa, Cryptosporidium parvum
IKGSTNRDFENTNSEGSRKQS

SEQ ID NO: 2216436 - protein, 7 aa, Cryptosporidium parvum
IKGTASR

SEQ ID NO: 2216437 - protein, 9 aa, Cryptosporidium parvum
IKHKSTDNQ

SEQ ID NO: 2216438 - protein, 9 aa, Cryptosporidium parvum
IKISKEKRN

SEQ ID NO: 2216439 - protein, 6 aa, Cryptosporidium parvum
IKKESN

SEQ ID NO: 2216440 - protein, 4 aa, Cryptosporidium parvum
IKKG

SEQ ID NO: 2216441 - protein, 14 aa, Cryptosporidium parvum
IKKKPQKVTSDQDR

SEQ ID NO: 2216442 - protein, 24 aa, Cryptosporidium parvum
IKKNSNERFNSAQNEISANTKEWA

SEQ ID NO: 2216443 - protein, 8 aa, Cryptosporidium parvum
IKKPDSNI

SEQ ID NO: 2216444 - protein, 9 aa, Cryptosporidium parvum
IKKSTNPSK

SEQ ID NO: 2216445 - protein, 17 aa, Cryptosporidium parvum
IKKTGKKTSAKNRSKSI

SEQ ID NO: 2216446 - protein, 11 aa, Cryptosporidium parvum
IKKTSKDGSLT

SEQ ID NO: 2216447 - protein, 10 aa, Cryptosporidium parvum
IKLKPEDKNH

SEQ ID NO: 2216448 - protein, 8 aa, Cryptosporidium parvum
IKLKSEKR

SEQ ID NO: 2216449 - protein, 8 aa, Cryptosporidium parvum
IKNDRTEG

SEQ ID NO: 2216450 - protein, 12 aa, Cryptosporidium parvum
IKNDTNNDYSIE

SEQ ID NO: 2216451 - protein, 11 aa, Cryptosporidium parvum
IKNETSSTNIN

SEQ ID NO: 2216452 - protein, 11 aa, Cryptosporidium parvum
IKNKVNNKSIT

SEQ ID NO: 2216453 - protein, 11 aa, Cryptosporidium parvum
IKNNNKKGINT

SEQ ID NO: 2216454 - protein, 9 aa, Cryptosporidium parvum
IKPAKSDKQ

SEQ ID NO: 2216455 - protein, 5 aa, Cryptosporidium parvum
IKPGD

SEQ ID NO: 2216456 - protein, 16 aa, Cryptosporidium parvum
IKPKSQRTTEESGIST

SEQ ID NO: 2216457 - protein, 5 aa, Cryptosporidium parvum
IKPPK

SEQ ID NO: 2216458 - protein, 12 aa, Cryptosporidium parvum
IKPPSGGEWSEP

SEQ ID NO: 2216459 - protein, 7 aa, Cryptosporidium parvum
IKPSSSR

SEQ ID NO: 2216460 - protein, 16 aa, Cryptosporidium parvum
IKQESSIEDINGSSFE

SEQ ID NO: 2216461 - protein, 12 aa, Cryptosporidium parvum
IKQYADDRPRDF

SEQ ID NO: 2216462 - protein, 8 aa, Cryptosporidium parvum
IKRDPGAY

SEQ ID NO: 2216463 - protein, 15 aa, Cryptosporidium parvum
IKRKQALSEKKHSHN

SEQ ID NO: 2216464 - protein, 8 aa, Cryptosporidium parvum
IKSEHSEN

SEQ ID NO: 2216465 - protein, 9 aa, Cryptosporidium parvum
IKSEPDDDK

SEQ ID NO: 2216466 - protein, 12 aa, Cryptosporidium parvum
IKSFSQKSLSTK

SEQ ID NO: 2216467 - protein, 10 aa, Cryptosporidium parvum
IKSGPNNNFR

SEQ ID NO: 2216468 - protein, 10 aa, Cryptosporidium parvum
IKSHDKNEGG

SEQ ID NO: 2216469 - protein, 4 aa, Cryptosporidium parvum
IKSK

SEQ ID NO: 2216470 - protein, 8 aa, Cryptosporidium parvum
IKSNESQD

SEQ ID NO: 2216471 - protein, 36 aa, Cryptosporidium parvum; identical to SEQ ID NO: 2114366

SEQ ID NO: 2216472 - protein, 9 aa, Cryptosporidium parvum
IKSQSSTTS

SEQ ID NO: 2216473 - protein, 17 aa, Cryptosporidium parvum
IKSTKKDILENKETNRP

SEQ ID NO: 2216474 - protein, 41 aa, Cryptosporidium parvum
IKSTLTESENFDDSEKSTSGSFGGENFEKDDSSVSEDSANK

SEQ ID NO: 2216475 - protein, 8 aa, Cryptosporidium parvum
IKTANNLD

SEQ ID NO: 2216476 - protein, 4 aa, Cryptosporidium parvum
IKTD

SEQ ID NO: 2216477 - protein, 9 aa, Cryptosporidium parvum
IKTGSSSDI

SEQ ID NO: 2216478 - protein, 15 aa, Cryptosporidium parvum
IKTNGYEYKNKEELD

SEQ ID NO: 2216479 - protein, 7 aa, Cryptosporidium parvum
IKTSGVP

SEQ ID NO: 2216480 - protein, 6 aa, Cryptosporidium parvum
IKTTTD

SEQ ID NO: 2216481 - protein, 7 aa, Cryptosporidium parvum
ILASPDN

SEQ ID NO: 2216482 - protein, 9 aa, Cryptosporidium parvum
ILDGGRGKY

SEQ ID NO: 2216483 - protein, 17 aa, Cryptosporidium parvum
ILEQDTDTHWNSSDGTA

SEQ ID NO: 2216484 - protein, 4 aa, Cryptosporidium parvum
ILES

SEQ ID NO: 2216485 - protein, 7 aa, Cryptosporidium parvum
ILGPNDA

SEQ ID NO: 2216486 - protein, 4 aa, Cryptosporidium parvum
ILPG

SEQ ID NO: 2216487 - protein, 9 aa, Cryptosporidium parvum
ILPPPGVGS

SEQ ID NO: 2216488 - protein, 5 aa, Cryptosporidium parvum
ILPSD

SEQ ID NO: 2216489 - protein, 4 aa, Cryptosporidium parvum
ILQN

SEQ ID NO: 2216490 - protein, 7 aa, Cryptosporidium parvum
ILSQTDS

SEQ ID NO: 2216491 - protein, 5 aa, Cryptosporidium parvum
ILSSS

SEQ ID NO: 2216492 - protein, 6 aa, Cryptosporidium parvum
ILTEDK

SEQ ID NO: 2216493 - protein, 13 aa, Cryptosporidium parvum
INAEDKPVTTQKP

SEQ ID NO: 2216494 - protein, 9 aa, Cryptosporidium parvum
INDASPNNF

SEQ ID NO: 2216495 - protein, 8 aa, Cryptosporidium parvum
INDEPTKF

SEQ ID NO: 2216496 - protein, 4 aa, Cryptosporidium parvum
INDG

SEQ ID NO: 2216497 - protein, 8 aa, Cryptosporidium parvum
INDGNNIS

SEQ ID NO: 2216498 - protein, 5 aa, Cryptosporidium parvum
INDPW

SEQ ID NO: 2216499 - protein, 9 aa, Cryptosporidium parvum
INDRNTYHG

SEQ ID NO: 2216500 - protein, 8 aa, Cryptosporidium parvum
INDSNNSF

SEQ ID NO: 2216501 - protein, 7 aa, Cryptosporidium parvum
INDSQTN

SEQ ID NO: 2216502 - protein, 15 aa, Cryptosporidium parvum
INEAKSGYNRNNNKN

SEQ ID NO: 2216503 - protein, 6 aa, Cryptosporidium parvum
INEENE

SEQ ID NO: 2216504 - protein, 11 aa, Cryptosporidium parvum
INEENSEAAEK

SEQ ID NO: 2216505 - protein, 9 aa, Cryptosporidium parvum
INEKDGISS

SEQ ID NO: 2216506 - protein, 6 aa, Cryptosporidium parvum
INEKSY

SEQ ID NO: 2216507 - protein, 4 aa, Cryptosporidium parvum
INEN

SEQ ID NO: 2216508 - protein, 10 aa, Cryptosporidium parvum
INENKLRKQY

SEQ ID NO: 2216509 - protein, 7 aa, Cryptosporidium parvum
INEPTRY

SEQ ID NO: 2216510 - protein, 4 aa, Cryptosporidium parvum
INES

SEQ ID NO: 2216511 - protein, 12 aa, Cryptosporidium parvum
INESQETSSMQI

SEQ ID NO: 2216512 - protein, 6 aa, Cryptosporidium parvum
INGDSS

SEQ ID NO: 2216513 - protein, 7 aa, Cryptosporidium parvum
INGEEET

SEQ ID NO: 2216514 - protein, 8 aa, Cryptosporidium parvum
INGEKSEI

SEQ ID NO: 2216515 - protein, 13 aa, Cryptosporidium parvum
INGNKNLSVEELH

SEQ ID NO: 2216516 - protein, 6 aa, Cryptosporidium parvum
INGNNP

SEQ ID NO: 2216517 - protein, 13 aa, Cryptosporidium parvum
INGNNSNNSDNEY

SEQ ID NO: 2216518 - protein, 5 aa, Cryptosporidium parvum
INGPT

SEQ ID NO: 2216519 - protein, 11 aa, Cryptosporidium parvum
INGQGEDDDDL

SEQ ID NO: 2216520 - protein, 44 aa, Cryptosporidium parvum
INGREGSSSGFSSGGRHGSLQGGSLRDSARSRGGPRCSRAPHPR

SEQ ID NO: 2216521 - protein, 8 aa, Cryptosporidium parvum
INGRRSSC

SEQ ID NO: 2216522 - protein, 5 aa, Cryptosporidium parvum
INGSE

SEQ ID NO: 2216523 - protein, 16 aa, Cryptosporidium parvum
INGSNLSESPVDTRAK

SEQ ID NO: 2216524 - protein, 6 aa, Cryptosporidium parvum
INGSTS

SEQ ID NO: 2216525 - protein, 6 aa, Cryptosporidium parvum
INGTPG

SEQ ID NO: 2216526 - protein, 17 aa, Cryptosporidium parvum
INISSTNSSTQAPLNTA

SEQ ID NO: 2216527 - protein, 9 aa, Cryptosporidium parvum
INKANESSI

SEQ ID NO: 2216528 - protein, 7 aa, Cryptosporidium parvum
INKEDNE

SEQ ID NO: 2216529 - protein, 10 aa, Cryptosporidium parvum
INKEGNQTYC

SEQ ID NO: 2216530 - protein, 18 aa, Cryptosporidium parvum
INKEKQSASNWTKEDDEE

SEQ ID NO: 2216531 - protein, 6 aa, Cryptosporidium parvum
INKGAT

SEQ ID NO: 2216532 - protein, 9 aa, Cryptosporidium parvum
INKKSKKGV

SEQ ID NO: 2216533 - protein, 7 aa, Cryptosporidium parvum
INKLDPK

SEQ ID NO: 2216534 - protein, 11 aa, Cryptosporidium parvum
INKLSNESKRE

SEQ ID NO: 2216535 - protein, 9 aa, Cryptosporidium parvum
INKNNKEEV

SEQ ID NO: 2216536 - protein, 43 aa, Cryptosporidium parvum
INKSGGNSSNQNSNINDNNNIDNNNNNNNNNNSNNNSSNYGSS

SEQ ID NO: 2216537 - protein, 12 aa, Cryptosporidium parvum
INKSKKKKRRIG

SEQ ID NO: 2216538 - protein, 9 aa, Cryptosporidium parvum
INKTNYNNN

SEQ ID NO: 2216539 - protein, 19 aa, Cryptosporidium parvum
INKTTELTTGDTINSDMNS

SEQ ID NO: 2216540 - protein, 11 aa, Cryptosporidium parvum
INLSGGQKQRV

SEQ ID NO: 2216541 - protein, 10 aa, Cryptosporidium parvum
INNDKNMKSV

SEQ ID NO: 2216542 - protein, 7 aa, Cryptosporidium parvum
INNDPYH

SEQ ID NO: 2216543 - protein, 8 aa, Cryptosporidium parvum
INNEKNHE

SEQ ID NO: 2216544 - protein, 22 aa, Cryptosporidium parvum
INNGNNPATEVATSGSSPTQCA

SEQ ID NO: 2216545 - protein, 5 aa, Cryptosporidium parvum
INNGT

SEQ ID NO: 2216546 - protein, 7 aa, Cryptosporidium parvum
INNISDS

SEQ ID NO: 2216547 - protein, 12 aa, Cryptosporidium parvum
INNKENKKEGGF

SEQ ID NO: 2216548 - protein, 9 aa, Cryptosporidium parvum
INNKSINSH

SEQ ID NO: 2216549 - protein, 4 aa, Cryptosporidium parvum
INNN

SEQ ID NO: 2216550 - protein, 10 aa, Cryptosporidium parvum
INNNKKDMNN

SEQ ID NO: 2216551 - protein, 25 aa, Cryptosporidium parvum
INNNNDTDNNNDTDKNNHKGNHNFN

SEQ ID NO: 2216552 - protein, 29 aa, Cryptosporidium parvum
INNNNNNNNNNLSTLNSTPDNKCNQPAPT

SEQ ID NO: 2216553 - protein, 14 aa, Cryptosporidium parvum
INNNNNNNNNNNNI

SEQ ID NO: 2216554 - protein, 17 aa, Cryptosporidium parvum
INNNSLNSMQSKPKTGK

SEQ ID NO: 2216555 - protein, 11 aa, Cryptosporidium parvum
INNNTTKKENL

SEQ ID NO: 2216556 - protein, 20 aa, Cryptosporidium parvum
INNQNQRSNPKSKPKPKSKP

SEQ ID NO: 2216557 - protein, 6 aa, Cryptosporidium parvum
INNQRE

SEQ ID NO: 2216558 - protein, 12 aa, Cryptosporidium parvum
INNRIDDDTPDM

SEQ ID NO: 2216559 - protein, 7 aa, Cryptosporidium parvum
INNSQLD

SEQ ID NO: 2216560 - protein, 25 aa, Cryptosporidium parvum
INNSSNQNDEDMVTNNSKKKSNSDI

SEQ ID NO: 2216561 - protein, 5 aa, Cryptosporidium parvum
INNST

SEQ ID NO: 2216562 - protein, 4 aa, Cryptosporidium parvum
INNW

SEQ ID NO: 2216563 - protein, 11 aa, Cryptosporidium parvum
INNYPKKSESP

SEQ ID NO: 2216564 - protein, 6 aa, Cryptosporidium parvum
INPDDL

SEQ ID NO: 2216565 - protein, 13 aa, Cryptosporidium parvum
INPEKSHDTGTKS

SEQ ID NO: 2216566 - protein, 6 aa, Cryptosporidium parvum
INPETG

SEQ ID NO: 2216567 - protein, 4 aa, Cryptosporidium parvum
INPK

SEQ ID NO: 2216568 - protein, 10 aa, Cryptosporidium parvum
INPKTSSSSM

SEQ ID NO: 2216569 - protein, 4 aa, Cryptosporidium parvum
INPN

SEQ ID NO: 2216570 - protein, 5 aa, Cryptosporidium parvum
INPPI

SEQ ID NO: 2216571 - protein, 18 aa, Cryptosporidium parvum
INQEEEEIQTEEEPERDY

SEQ ID NO: 2216572 - protein, 10 aa, Cryptosporidium parvum
INQETKKSVY

SEQ ID NO: 2216573 - protein, 7 aa, Cryptosporidium parvum
INQKTES

SEQ ID NO: 2216574 - protein, 21 aa, Cryptosporidium parvum
INQNYGNNSEIDQSQEKDEEI

SEQ ID NO: 2216575 - protein, 5 aa, Cryptosporidium parvum
INQPA

SEQ ID NO: 2216576 - protein, 26 aa, Cryptosporidium parvum
INQPDFKSKDKKKEGKNEEEKTEEKK

SEQ ID NO: 2216577 - protein, 5 aa, Cryptosporidium parvum
INQPE

SEQ ID NO: 2216578 - protein, 7 aa, Cryptosporidium parvum
INQPSDS

SEQ ID NO: 2216579 - protein, 9 aa, Cryptosporidium parvum
INQQGEFEN

SEQ ID NO: 2216580 - protein, 8 aa, Cryptosporidium parvum
INQQTDRG

SEQ ID NO: 2216581 - protein, 10 aa, Cryptosporidium parvum
INQTKTSQDE

SEQ ID NO: 2216582 - protein, 22 aa, Cryptosporidium parvum
INRDKSKSIIGETGVNTETKNV

SEQ ID NO: 2216583 - protein, 9 aa, Cryptosporidium parvum
INRNNGKSV

SEQ ID NO: 2216584 - protein, 6 aa, Cryptosporidium parvum
INRNNN

SEQ ID NO: 2216585 - protein, 6 aa, Cryptosporidium parvum
INRTTG

SEQ ID NO: 2216586 - protein, 4 aa, Cryptosporidium parvum
INSD

SEQ ID NO: 2216587 - protein, 9 aa, Cryptosporidium parvum
INSDEDKSQ

SEQ ID NO: 2216588 - protein, 7 aa, Cryptosporidium parvum
INSEENQ

SEQ ID NO: 2216589 - protein, 6 aa, Cryptosporidium parvum
INSENF

SEQ ID NO: 2216590 - protein, 4 aa, Cryptosporidium parvum
INSG

SEQ ID NO: 2216591 - protein, 11 aa, Cryptosporidium parvum
INSGETDSSMD

SEQ ID NO: 2216592 - protein, 9 aa, Cryptosporidium parvum
INSGPIGRQ

SEQ ID NO: 2216593 - protein, 24 aa, Cryptosporidium parvum
INSGRGVGKAGSRPLTRGVSSSCP

SEQ ID NO: 2216594 - protein, 6 aa, Cryptosporidium parvum
INSKAH

SEQ ID NO: 2216595 - protein, 7 aa, Cryptosporidium parvum
INSKDDK

SEQ ID NO: 2216596 - protein, 11 aa, Cryptosporidium parvum
INSKDECNPIS

SEQ ID NO: 2216597 - protein, 20 aa, Cryptosporidium parvum
INSKKDKSSKFADEENDNKD

SEQ ID NO: 2216598 - protein, 18 aa, Cryptosporidium parvum
INSKKSNENITNDNIDED

SEQ ID NO: 2216599 - protein, 5 aa, Cryptosporidium parvum
INSKL

SEQ ID NO: 2216600 - protein, 20 aa, Cryptosporidium parvum
INSNKGIQRNGGGVNDNDDE

SEQ ID NO: 2216601 - protein, 12 aa, Cryptosporidium parvum
INSNSKKEEVKH

SEQ ID NO: 2216602 - protein, 10 aa, Cryptosporidium parvum
INSNSQNKIT

SEQ ID NO: 2216603 - protein, 6 aa, Cryptosporidium parvum
INSNST

SEQ ID NO: 2216604 - protein, 6 aa, Cryptosporidium parvum
INSPKD

SEQ ID NO: 2216605 - protein, 6 aa, Cryptosporidium parvum
INSREA

SEQ ID NO: 2216606 - protein, 4 aa, Cryptosporidium parvum
INSS

SEQ ID NO: 2216607 - protein, 25 aa, Cryptosporidium parvum
INSSGNSNNHGSGSGNNNSNSHTNN

SEQ ID NO: 2216608 - protein, 11 aa, Cryptosporidium parvum
INSSKSNPKPI

SEQ ID NO: 2216609 - protein, 6 aa, Cryptosporidium parvum
INSTEA

SEQ ID NO: 2216610 - protein, 13 aa, Cryptosporidium parvum
INTDLSNNSTINS

SEQ ID NO: 2216611 - protein, 18 aa, Cryptosporidium parvum
INTKPNNFRGNNGSPSNA

SEQ ID NO: 2216612 - protein, 18 aa, Cryptosporidium parvum
INTNNSNSEETENNQDQE

SEQ ID NO: 2216613 - protein, 5 aa, Cryptosporidium parvum
INTNR

SEQ ID NO: 2216614 - protein, 13 aa, Cryptosporidium parvum
INTNTDDKNLNNR

SEQ ID NO: 2216615 - protein, 11 aa, Cryptosporidium parvum
INTNTKTAGIS

SEQ ID NO: 2216616 - protein, 13 aa, Cryptosporidium parvum
INTNTTSDKNIHS

SEQ ID NO: 2216617 - protein, 18 aa, Cryptosporidium parvum
INTPSTNLDYSPGTQHFI

SEQ ID NO: 2216618 - protein, 4 aa, Cryptosporidium parvum
INTS

SEQ ID NO: 2216619 - protein, 4 aa, Cryptosporidium parvum
INTT

SEQ ID NO: 2216620 - protein, 7 aa, Cryptosporidium parvum
INTTNED

SEQ ID NO: 2216621 - protein, 8 aa, Cryptosporidium parvum
INTTSGSF

SEQ ID NO: 2216622 - protein, 10 aa, Cryptosporidium parvum
INYQDEDNKV

SEQ ID NO: 2216623 - protein, 13 aa, Cryptosporidium parvum
INYQTEKEQLEEQ

SEQ ID NO: 2216624 - protein, 7 aa, Cryptosporidium parvum
IPAHTQN

SEQ ID NO: 2216625 - protein, 12 aa, Cryptosporidium parvum
IPAKGKKAISTA

SEQ ID NO: 2216626 - protein, 8 aa, Cryptosporidium parvum
IPASDNKP

SEQ ID NO: 2216627 - protein, 16 aa, Cryptosporidium parvum
IPDLSGENSNNKKRTL

SEQ ID NO: 2216628 - protein, 12 aa, Cryptosporidium parvum
IPDNTGSKFTGR

SEQ ID NO: 2216629 - protein, 11 aa, Cryptosporidium parvum
IPDSEKDSLTY

SEQ ID NO: 2216630 - protein, 5 aa, Cryptosporidium parvum
IPDTS

SEQ ID NO: 2216631 - protein, 5 aa, Cryptosporidium parvum
IPEAS

SEQ ID NO: 2216632 - protein, 4 aa, Cryptosporidium parvum
IPEG

SEQ ID NO: 2216633 - protein, 10 aa, Cryptosporidium parvum
IPEGKQQEVG

SEQ ID NO: 2216634 - protein, 9 aa, Cryptosporidium parvum
IPEKGNESI

SEQ ID NO: 2216635 - protein, 8 aa, Cryptosporidium parvum
IPENDNQT

SEQ ID NO: 2216636 - protein, 7 aa, Cryptosporidium parvum
IPENSEI

SEQ ID NO: 2216637 - protein, 7 aa, Cryptosporidium parvum
IPEQEGN

SEQ ID NO: 2216638 - protein, 38 aa, Cryptosporidium parvum
IPERPRSSIPREASGNKEGISSINTEEKNHIGKNNESF

SEQ ID NO: 2216639 - protein, 15 aa, Cryptosporidium parvum
IPESDDENFKKTKNS

SEQ ID NO: 2216640 - protein, 5 aa, Cryptosporidium parvum
IPESQ

SEQ ID NO: 2216641 - protein, 18 aa, Cryptosporidium parvum
IPETNSSISLKKENRKMG

SEQ ID NO: 2216642 - protein, 10 aa, Cryptosporidium parvum
IPGESSGKNM

SEQ ID NO: 2216643 - protein, 17 aa, Cryptosporidium parvum
IPGGGTSGSPTSPGSPI

SEQ ID NO: 2216644 - protein, 13 aa, Cryptosporidium parvum
IPGLPDSKTDSLT

SEQ ID NO: 2216645 - protein, 5 aa, Cryptosporidium parvum
IPGND

SEQ ID NO: 2216646 - protein, 14 aa, Cryptosporidium parvum
IPGNNTNSTLKMLN

SEQ ID NO: 2216647 - protein, 5 aa, Cryptosporidium parvum
IPGSG

SEQ ID NO: 2216648 - protein, 6 aa, Cryptosporidium parvum
IPHNNN

SEQ ID NO: 2216649 - protein, 5 aa, Cryptosporidium parvum
IPIGN

SEQ ID NO: 2216650 - protein, 12 aa, Cryptosporidium parvum
IPIGQSETNNTE

SEQ ID NO: 2216651 - protein, 4 aa, Cryptosporidium parvum
IPIP

SEQ ID NO: 2216652 - protein, 5 aa, Cryptosporidium parvum
IPKDN

SEQ ID NO: 2216653 - protein, 5 aa, Cryptosporidium parvum
IPKEG

SEQ ID NO: 2216654 - protein, 8 aa, Cryptosporidium parvum
IPKEKSKV

SEQ ID NO: 2216655 - protein, 18 aa, Cryptosporidium parvum
IPKKENVTLTKNENKTIS

SEQ ID NO: 2216656 - protein, 6 aa, Cryptosporidium parvum
IPKKSK

SEQ ID NO: 2216657 - protein, 4 aa, Cryptosporidium parvum
IPKN

SEQ ID NO: 2216658 - protein, 10 aa, Cryptosporidium parvum
IPKNSSNNHE

SEQ ID NO: 2216659 - protein, 7 aa, Cryptosporidium parvum
IPKSEEV

SEQ ID NO: 2216660 - protein, 12 aa, Cryptosporidium parvum
IPKSESGINSSN

SEQ ID NO: 2216661 - protein, 4 aa, Cryptosporidium parvum
IPKV

SEQ ID NO: 2216662 - protein, 5 aa, Cryptosporidium parvum
IPLEN

SEQ ID NO: 2216663 - protein, 24 aa, Cryptosporidium parvum
IPLPTEENHSSLKNSTNALNVEAR

SEQ ID NO: 2216664 - protein, 4 aa, Cryptosporidium parvum
IPNE

SEQ ID NO: 2216665 - protein, 13 aa, Cryptosporidium parvum
IPNESKSSRDDEV

SEQ ID NO: 2216666 - protein, 8 aa, Cryptosporidium parvum
IPNKNNNL

SEQ ID NO: 2216667 - protein, 9 aa, Cryptosporidium parvum
IPNKSCGRK

SEQ ID NO: 2216668 - protein, 36 aa, Cryptosporidium parvum
IPNNDEIGYQENASGQFSQNFSNRNDHSSKEVDSTI

SEQ ID NO: 2216669 - protein, 27 aa, Cryptosporidium parvum
IPNNNNGPIAINGNNSRNSNNQSICDD

SEQ ID NO: 2216670 - protein, 5 aa, Cryptosporidium parvum
IPNQK

SEQ ID NO: 2216671 - protein, 12 aa, Cryptosporidium parvum
IPNRRKKKKEYE

SEQ ID NO: 2216672 - protein, 6 aa, Cryptosporidium parvum
IPNSGV

SEQ ID NO: 2216673 - protein, 9 aa, Cryptosporidium parvum
IPNSPSNYQ

SEQ ID NO: 2216674 - protein, 15 aa, Cryptosporidium parvum
IPNSSSSSSPDESYS

SEQ ID NO: 2216675 - protein, 6 aa, Cryptosporidium parvum
IPNTSF

SEQ ID NO: 2216676 - protein, 5 aa, Cryptosporidium parvum
IPPEK

SEQ ID NO: 2216677 - protein, 7 aa, Cryptosporidium parvum
IPPENSA

SEQ ID NO: 2216678 - protein, 9 aa, Cryptosporidium parvum
IPPGGQNDT

SEQ ID NO: 2216679 - protein, 21 aa, Cryptosporidium parvum
IPPGSQNSDHITKNSSSQMNT

SEQ ID NO: 2216680 - protein, 8 aa, Cryptosporidium parvum
IPPKPENE

SEQ ID NO: 2216681 - protein, 8 aa, Cryptosporidium parvum
IPPKPESL

SEQ ID NO: 2216682 - protein, 4 aa, Cryptosporidium parvum
IPPM

SEQ ID NO: 2216683 - protein, 18 aa, Cryptosporidium parvum
IPPPGTPNAPQNPPYNSR

SEQ ID NO: 2216684 - protein, 5 aa, Cryptosporidium parvum
IPPPK

SEQ ID NO: 2216685 - protein, 11 aa, Cryptosporidium parvum
IPPPPRGTNFP

SEQ ID NO: 2216686 - protein, 7 aa, Cryptosporidium parvum
IPPPQPP

SEQ ID NO: 2216687 - protein, 10 aa, Cryptosporidium parvum
IPPPVDSIDA

SEQ ID NO: 2216688 - protein, 6 aa, Cryptosporidium parvum
IPPSNQ

SEQ ID NO: 2216689 - protein, 6 aa, Cryptosporidium parvum
IPPSRG

SEQ ID NO: 2216690 - protein, 18 aa, Cryptosporidium parvum
IPPSVPESIPEKDQKIDS

SEQ ID NO: 2216691 - protein, 9 aa, Cryptosporidium parvum
IPPTASSTD

SEQ ID NO: 2216692 - protein, 39 aa, Cryptosporidium parvum
IPQGNNTRNTSNTSSSIADNNNSNTNGVNENNNGTINNN

SEQ ID NO: 2216693 - protein, 6 aa, Cryptosporidium parvum
IPSEEE

SEQ ID NO: 2216694 - protein, 19 aa, Cryptosporidium parvum
IPSGNEQNLKEVEPKLSSG

SEQ ID NO: 2216695 - protein, 12 aa, Cryptosporidium parvum
IPSNERMETTSR

SEQ ID NO: 2216696 - protein, 11 aa, Cryptosporidium parvum
IPSQDQGHRDL

SEQ ID NO: 2216697 - protein, 6 aa, Cryptosporidium parvum
IPSQST

SEQ ID NO: 2216698 - protein, 6 aa, Cryptosporidium parvum
IPSSHN

SEQ ID NO: 2216699 - protein, 6 aa, Cryptosporidium parvum
IPSSIP

SEQ ID NO: 2216700 - protein, 8 aa, Cryptosporidium parvum
IPSSPLDN

SEQ ID NO: 2216701 - protein, 5 aa, Cryptosporidium parvum
IPSTP

SEQ ID NO: 2216702 - protein, 17 aa, Cryptosporidium parvum
IPTDDENKNKDIDEEEE

SEQ ID NO: 2216703 - protein, 4 aa, Cryptosporidium parvum
IPTI

SEQ ID NO: 2216704 - protein, 11 aa, Cryptosporidium parvum
IPTKKPSKPCS

SEQ ID NO: 2216705 - protein, 11 aa, Cryptosporidium parvum
IPTSSGSHSSC

SEQ ID NO: 2216706 - protein, 4 aa, Cryptosporidium parvum
IPVE

SEQ ID NO: 2216707 - protein, 6 aa, Cryptosporidium parvum
IPYDEA

SEQ ID NO: 2216708 - protein, 10 aa, Cryptosporidium parvum
IPYKSTKIKS

SEQ ID NO: 2216709 - protein, 4 aa, Cryptosporidium parvum
IPYS

SEQ ID NO: 2216710 - protein, 19 aa, Cryptosporidium parvum
IPYSKENISTAKSNPDKEY

SEQ ID NO: 2216711 - protein, 5 aa, Cryptosporidium parvum
IPYSS

SEQ ID NO: 2216712 - protein, 8 aa, Cryptosporidium parvum
IQAGQSKE

SEQ ID NO: 2216713 - protein, 8 aa, Cryptosporidium parvum
IQDGISSQ

SEQ ID NO: 2216714 - protein, 9 aa, Cryptosporidium parvum
IQDKTDNEL

SEQ ID NO: 2216715 - protein, 4 aa, Cryptosporidium parvum
IQDN

SEQ ID NO: 2216716 - protein, 11 aa, Cryptosporidium parvum
IQDQKRENPSI

SEQ ID NO: 2216717 - protein, 5 aa, Cryptosporidium parvum
IQDQL

SEQ ID NO: 2216718 - protein, 6 aa, Cryptosporidium parvum
IQDSPN

SEQ ID NO: 2216719 - protein, 5 aa, Cryptosporidium parvum
IQDSS

SEQ ID NO: 2216720 - protein, 5 aa, Cryptosporidium parvum
IQEGA

SEQ ID NO: 2216721 - protein, 12 aa, Cryptosporidium parvum
IQEGESSSIIPT

SEQ ID NO: 2216722 - protein, 9 aa, Cryptosporidium parvum
IQEKDSKNI

SEQ ID NO: 2216723 - protein, 11 aa, Cryptosporidium parvum
IQENEGEESFE

SEQ ID NO: 2216724 - protein, 5 aa, Cryptosporidium parvum
IQESS

SEQ ID NO: 2216725 - protein, 6 aa, Cryptosporidium parvum
IQEVST

SEQ ID NO: 2216726 - protein, 9 aa, Cryptosporidium parvum
IQGEPTEGA

SEQ ID NO: 2216727 - protein, 5 aa, Cryptosporidium parvum
IQGGK

SEQ ID NO: 2216728 - protein, 7 aa, Cryptosporidium parvum
IQGGSTV

SEQ ID NO: 2216729 - protein, 9 aa, Cryptosporidium parvum
IQGNNRAKE

SEQ ID NO: 2216730 - protein, 9 aa, Cryptosporidium parvum
IQGSDNPGI

SEQ ID NO: 2216731 - protein, 8 aa, Cryptosporidium parvum
IQGSNNEI

SEQ ID NO: 2216732 - protein, 9 aa, Cryptosporidium parvum
IQGSPLNEF

SEQ ID NO: 2216733 - protein, 9 aa, Cryptosporidium parvum
IQGSRKGSA

SEQ ID NO: 2216734 - protein, 4 aa, Cryptosporidium parvum
IQHK

SEQ ID NO: 2216735 - protein, 8 aa, Cryptosporidium parvum
IQKDNTGL

SEQ ID NO: 2216736 - protein, 6 aa, Cryptosporidium parvum
IQKEPS

SEQ ID NO: 2216737 - protein, 31 aa, Cryptosporidium parvum
IQKGDQNSEDELINETNKVADEDGSNHDNEI

SEQ ID NO: 2216738 - protein, 13 aa, Cryptosporidium parvum
IQKGEKEGVERSN

SEQ ID NO: 2216739 - protein, 20 aa, Cryptosporidium parvum
IQKKPETEVSSNNNNNRIPI

SEQ ID NO: 2216740 - protein, 14 aa, Cryptosporidium parvum
IQKQTVDEEDSESL

SEQ ID NO: 2216741 - protein, 4 aa, Cryptosporidium parvum
IQMD

SEQ ID NO: 2216742 - protein, 7 aa, Cryptosporidium parvum
IQNEQKN

SEQ ID NO: 2216743 - protein, 7 aa, Cryptosporidium parvum
IQNPDAT

SEQ ID NO: 2216744 - protein, 6 aa, Cryptosporidium parvum
IQNPIE

SEQ ID NO: 2216745 - protein, 6 aa, Cryptosporidium parvum
IQNQEY

SEQ ID NO: 2216746 - protein, 18 aa, Cryptosporidium parvum
IQNQQQKLKSSTSLEHGN

SEQ ID NO: 2216747 - protein, 17 aa, Cryptosporidium parvum
IQNQTVQSSMATKSSNT

SEQ ID NO: 2216748 - protein, 7 aa, Cryptosporidium parvum
IQNRGKN

SEQ ID NO: 2216749 - protein, 10 aa, Cryptosporidium parvum
IQNSSDRNVS

SEQ ID NO: 2216750 - protein, 6 aa, Cryptosporidium parvum
IQPEEG

SEQ ID NO: 2216751 - protein, 4 aa, Cryptosporidium parvum
IQPS

SEQ ID NO: 2216752 - protein, 5 aa, Cryptosporidium parvum
IQPYQ

SEQ ID NO: 2216753 - protein, 13 aa, Cryptosporidium parvum
IQQGGKTSSYSSL

SEQ ID NO: 2216754 - protein, 8 aa, Cryptosporidium parvum
IQQPPPSY

SEQ ID NO: 2216755 - protein, 7 aa, Cryptosporidium parvum
IQQSGGI

SEQ ID NO: 2216756 - protein, 8 aa, Cryptosporidium parvum
IQQSTNPY

SEQ ID NO: 2216757 - protein, 18 aa, Cryptosporidium parvum
IQREKSKLNPEDRNYERR

SEQ ID NO: 2216758 - protein, 6 aa, Cryptosporidium parvum
IQRPPR

SEQ ID NO: 2216759 - protein, 4 aa, Cryptosporidium parvum
IQSE

SEQ ID NO: 2216760 - protein, 4 aa, Cryptosporidium parvum
IQSN

SEQ ID NO: 2216761 - protein, 11 aa, Cryptosporidium parvum
IQSNETEVNIT

SEQ ID NO: 2216762 - protein, 42 aa, Cryptosporidium parvum
IQSPPVSQIETQPSVSSPELENNNEDQETQIENNNLSNPLSE

SEQ ID NO: 2216763 - protein, 17 aa, Cryptosporidium parvum
IQSPSEKRYSKGSKHIS

SEQ ID NO: 2216764 - protein, 5 aa, Cryptosporidium parvum
IQSRN

SEQ ID NO: 2216765 - protein, 33 aa, Cryptosporidium parvum; identical to SEQ ID NO: 2114537

SEQ ID NO: 2216766 - protein, 17 aa, Cryptosporidium parvum
IQTLDENKKQSKDNNDI

SEQ ID NO: 2216767 - protein, 5 aa, Cryptosporidium parvum
IQTNN

SEQ ID NO: 2216768 - protein, 14 aa, Cryptosporidium parvum
IQTNSLSSLNSTHT

SEQ ID NO: 2216769 - protein, 11 aa, Cryptosporidium parvum
IQTNTQDKHNQ

SEQ ID NO: 2216770 - protein, 4 aa, Cryptosporidium parvum
IQTP

SEQ ID NO: 2216771 - protein, 19 aa, Cryptosporidium parvum
IQTPGQEPKEGNQTQNTPY

SEQ ID NO: 2216772 - protein, 6 aa, Cryptosporidium parvum
IRDDDY

SEQ ID NO: 2216773 - protein, 9 aa, Cryptosporidium parvum
IRDSDNDKP

SEQ ID NO: 2216774 - protein, 7 aa, Cryptosporidium parvum
IREEPVE

SEQ ID NO: 2216775 - protein, 37 aa, Cryptosporidium parvum
IREERKKALNQKSNKSNESNNKAKDSQDNLDQPNKGI

SEQ ID NO: 2216776 - protein, 10 aa, Cryptosporidium parvum
IREKNKVKNW

SEQ ID NO: 2216777 - protein, 16 aa, Cryptosporidium parvum
IRESEKKTNKNPNCEP

SEQ ID NO: 2216778 - protein, 19 aa, Cryptosporidium parvum
IRGANSASSIIKSSSRSSL

SEQ ID NO: 2216779 - protein, 4 aa, Cryptosporidium parvum
IRGP

SEQ ID NO: 2216780 - protein, 9 aa, Cryptosporidium parvum
IRINPTSTN

SEQ ID NO: 2216781 - protein, 20 aa, Cryptosporidium parvum
IRKKDSNIFEGGEENNKTSL

SEQ ID NO: 2216782 - protein, 8 aa, Cryptosporidium parvum
IRKQQEEM

SEQ ID NO: 2216783 - protein, 5 aa, Cryptosporidium parvum
IRNNL

SEQ ID NO: 2216784 - protein, 6 aa, Cryptosporidium parvum
IRNQKN

SEQ ID NO: 2216785 - protein, 14 aa, Cryptosporidium parvum
IRPENSDLESERKS

SEQ ID NO: 2216786 - protein, 6 aa, Cryptosporidium parvum
IRPESM

SEQ ID NO: 2216787 - protein, 6 aa, Cryptosporidium parvum
IRPSAS

SEQ ID NO: 2216788 - protein, 5 aa, Cryptosporidium parvum
IRQGA

SEQ ID NO: 2216789 - protein, 9 aa, Cryptosporidium parvum
IRRNELNRN

SEQ ID NO: 2216790 - protein, 16 aa, Cryptosporidium parvum
IRRRSRALSEDTDQLE

SEQ ID NO: 2216791 - protein, 5 aa, Cryptosporidium parvum
IRRSD

SEQ ID NO: 2216792 - protein, 17 aa, Cryptosporidium parvum
IRSDKLQKSSETPTELQ

SEQ ID NO: 2216793 - protein, 5 aa, Cryptosporidium parvum
IRSGG

SEQ ID NO: 2216794 - protein, 14 aa, Cryptosporidium parvum
IRSLNSKNSNREDF

SEQ ID NO: 2216795 - protein, 8 aa, Cryptosporidium parvum
IRSNTEKI

SEQ ID NO: 2216796 - protein, 9 aa, Cryptosporidium parvum
IRSSKSSEY

SEQ ID NO: 2216797 - protein, 4 aa, Cryptosporidium parvum
IRTP

SEQ ID NO: 2216798 - protein, 12 aa, Cryptosporidium parvum
IRTTPKQTAVSS

SEQ ID NO: 2216799 - protein, 6 aa, Cryptosporidium parvum
ISADSE

SEQ ID NO: 2216800 - protein, 9 aa, Cryptosporidium parvum
ISANKNNDH

SEQ ID NO: 2216801 - protein, 12 aa, Cryptosporidium parvum
ISAPNQKSIFSL

SEQ ID NO: 2216802 - protein, 7 aa, Cryptosporidium parvum
ISAPTNI

SEQ ID NO: 2216803 - protein, 12 aa, Cryptosporidium parvum
ISASGQLGRGDS

SEQ ID NO: 2216804 - protein, 25 aa, Cryptosporidium parvum
ISATAKTSKMGIASSSETESFTETN

SEQ ID NO: 2216805 - protein, 15 aa, Cryptosporidium parvum
ISDAEQSNVQNRNSI

SEQ ID NO: 2216806 - protein, 11 aa, Cryptosporidium parvum
ISDDEEQDFGE

SEQ ID NO: 2216807 - protein, 4 aa, Cryptosporidium parvum
ISDE

SEQ ID NO: 2216808 - protein, 10 aa, Cryptosporidium parvum
ISDNEAKNEY

SEQ ID NO: 2216809 - protein, 10 aa, Cryptosporidium parvum
ISDNSSKFKD

SEQ ID NO: 2216810 - protein, 6 aa, Cryptosporidium parvum
ISDPGL

SEQ ID NO: 2216811 - protein, 9 aa, Cryptosporidium parvum
ISDPGTELK

SEQ ID NO: 2216812 - protein, 8 aa, Cryptosporidium parvum
ISDQSISS

SEQ ID NO: 2216813 - protein, 9 aa, Cryptosporidium parvum
ISDSENSTI

SEQ ID NO: 2216814 - protein, 12 aa, Cryptosporidium parvum
ISDTNSTYTSVN

SEQ ID NO: 2216815 - protein, 11 aa, Cryptosporidium parvum
ISDTPSIESPD

SEQ ID NO: 2216816 - protein, 7 aa, Cryptosporidium parvum
ISEASGR

SEQ ID NO: 2216817 - protein, 7 aa, Cryptosporidium parvum
ISEDTKP

SEQ ID NO: 2216818 - protein, 5 aa, Cryptosporidium parvum
ISEEA

SEQ ID NO: 2216819 - protein, 6 aa, Cryptosporidium parvum
ISEESQ

SEQ ID NO: 2216820 - protein, 7 aa, Cryptosporidium parvum
ISEKESL

SEQ ID NO: 2216821 - protein, 17 aa, Cryptosporidium parvum
ISEKNGIEQKRHSKRKV

SEQ ID NO: 2216822 - protein, 6 aa, Cryptosporidium parvum
ISEKSE

SEQ ID NO: 2216823 - protein, 4 aa, Cryptosporidium parvum
ISEN

SEQ ID NO: 2216824 - protein, 7 aa, Cryptosporidium parvum
ISENDKV

SEQ ID NO: 2216825 - protein, 24 aa, Cryptosporidium parvum
ISENNFSSSNETLEPHPKVGGMKG

SEQ ID NO: 2216826 - protein, 9 aa, Cryptosporidium parvum
ISERTSNTN

SEQ ID NO: 2216827 - protein, 17 aa, Cryptosporidium parvum
ISESESESEIQKKKKIR

SEQ ID NO: 2216828 - protein, 7 aa, Cryptosporidium parvum
ISETQNS

SEQ ID NO: 2216829 - protein, 11 aa, Cryptosporidium parvum
ISETSENLNRS

SEQ ID NO: 2216830 - protein, 8 aa, Cryptosporidium parvum
ISGDFSAE

SEQ ID NO: 2216831 - protein, 10 aa, Cryptosporidium parvum
ISGDINDESY

SEQ ID NO: 2216832 - protein, 11 aa, Cryptosporidium parvum
ISGGGGGMHSD

SEQ ID NO: 2216833 - protein, 6 aa, Cryptosporidium parvum
ISGGGR

SEQ ID NO: 2216834 - protein, 7 aa, Cryptosporidium parvum
ISGGISG

SEQ ID NO: 2216835 - protein, 4 aa, Cryptosporidium parvum
ISGK

SEQ ID NO: 2216836 - protein, 20 aa, Cryptosporidium parvum
ISGKDSELNNLKNKEKKNIR

SEQ ID NO: 2216837 - protein, 9 aa, Cryptosporidium parvum
ISGSKNLVN

SEQ ID NO: 2216838 - protein, 5 aa, Cryptosporidium parvum
ISGVV

SEQ ID NO: 2216839 - protein, 5 aa, Cryptosporidium parvum
ISHSE

SEQ ID NO: 2216840 - protein, 16 aa, Cryptosporidium parvum
ISKAAKEGVQLKEIDL

SEQ ID NO: 2216841 - protein, 12 aa, Cryptosporidium parvum
ISKEADKESWNT

SEQ ID NO: 2216842 - protein, 10 aa, Cryptosporidium parvum
ISKEEYENAK

SEQ ID NO: 2216843 - protein, 5 aa, Cryptosporidium parvum
ISKEQ

SEQ ID NO: 2216844 - protein, 17 aa, Cryptosporidium parvum
ISKGQEVENDRISGKNM

SEQ ID NO: 2216845 - protein, 4 aa, Cryptosporidium parvum
ISKI

SEQ ID NO: 2216846 - protein, 6 aa, Cryptosporidium parvum
ISKKDF

SEQ ID NO: 2216847 - protein, 6 aa, Cryptosporidium parvum
ISKKTG

SEQ ID NO: 2216848 - protein, 8 aa, Cryptosporidium parvum
ISKKVSDT

SEQ ID NO: 2216849 - protein, 6 aa, Cryptosporidium parvum
ISKLEP

SEQ ID NO: 2216850 - protein, 9 aa, Cryptosporidium parvum
ISKNQSNRK

SEQ ID NO: 2216851 - protein, 15 aa, Cryptosporidium parvum
ISKNSFKETKIPNYT

SEQ ID NO: 2216852 - protein, 6 aa, Cryptosporidium parvum
ISKPED

SEQ ID NO: 2216853 - protein, 4 aa, Cryptosporidium parvum
ISKS

SEQ ID NO: 2216854 - protein, 7 aa, Cryptosporidium parvum
ISKSEFE

SEQ ID NO: 2216855 - protein, 9 aa, Cryptosporidium parvum
ISKSNSWNS

SEQ ID NO: 2216856 - protein, 6 aa, Cryptosporidium parvum
ISKTEQ

SEQ ID NO: 2216857 - protein, 16 aa, Cryptosporidium parvum
ISLDSQNQSRIEEAPI

SEQ ID NO: 2216858 - protein, 6 aa, Cryptosporidium parvum
ISNAKG

SEQ ID NO: 2216859 - protein, 4 aa, Cryptosporidium parvum
ISNC

SEQ ID NO: 2216860 - protein, 6 aa, Cryptosporidium parvum
ISNDTV

SEQ ID NO: 2216861 - protein, 5 aa, Cryptosporidium parvum
ISNEE

SEQ ID NO: 2216862 - protein, 21 aa, Cryptosporidium parvum
ISNEEDEEDQEEEKNMSQTKI

SEQ ID NO: 2216863 - protein, 10 aa, Cryptosporidium parvum
ISNESRAVQS

SEQ ID NO: 2216864 - protein, 5 aa, Cryptosporidium parvum
ISNGF

SEQ ID NO: 2216865 - protein, 4 aa, Cryptosporidium parvum
ISNI

SEQ ID NO: 2216866 - protein, 4 aa, Cryptosporidium parvum
ISNK

SEQ ID NO: 2216867 - protein, 9 aa, Cryptosporidium parvum
ISNKNPVAI

SEQ ID NO: 2216868 - protein, 10 aa, Cryptosporidium parvum
ISNKNYTNRD

SEQ ID NO: 2216869 - protein, 7 aa, Cryptosporidium parvum
ISNLTGS

SEQ ID NO: 2216870 - protein, 8 aa, Cryptosporidium parvum
ISNNDSEI

SEQ ID NO: 2216871 - protein, 4 aa, Cryptosporidium parvum
ISNP

SEQ ID NO: 2216872 - protein, 7 aa, Cryptosporidium parvum
ISNQNND

SEQ ID NO: 2216873 - protein, 5 aa, Cryptosporidium parvum
ISNRR

SEQ ID NO: 2216874 - protein, 7 aa, Cryptosporidium parvum
ISNSEYN

SEQ ID NO: 2216875 - protein, 9 aa, Cryptosporidium parvum
ISNSTAPEL

SEQ ID NO: 2216876 - protein, 22 aa, Cryptosporidium parvum
ISNSTDNELVSDAGESKYKTGS

SEQ ID NO: 2216877 - protein, 4 aa, Cryptosporidium parvum
ISNT

SEQ ID NO: 2216878 - protein, 53 aa, Cryptosporidium parvum
ISNTDESNSGGTNGNDEEDPKCCSSSSSSSSSSSSSSKRKKVDVSKSHPSHPG

SEQ ID NO: 2216879 - protein, 8 aa, Cryptosporidium parvum
ISNTPSTR

SEQ ID NO: 2216880 - protein, 5 aa, Cryptosporidium parvum
ISNVN

SEQ ID NO: 2216881 - protein, 7 aa, Cryptosporidium parvum
ISPESRI

SEQ ID NO: 2216882 - protein, 5 aa, Cryptosporidium parvum
ISPGQ

SEQ ID NO: 2216883 - protein, 7 aa, Cryptosporidium parvum
ISPGSSL

SEQ ID NO: 2216884 - protein, 5 aa, Cryptosporidium parvum
ISPGY

SEQ ID NO: 2216885 - protein, 11 aa, Cryptosporidium parvum
ISPKQSNKNCS

SEQ ID NO: 2216886 - protein, 10 aa, Cryptosporidium parvum
ISPNSPKSMG

SEQ ID NO: 2216887 - protein, 15 aa, Cryptosporidium parvum
ISPPQKESRSNNHHQ

SEQ ID NO: 2216888 - protein, 5 aa, Cryptosporidium parvum
ISPSI

SEQ ID NO: 2216889 - protein, 5 aa, Cryptosporidium parvum
ISPSP

SEQ ID NO: 2216890 - protein, 9 aa, Cryptosporidium parvum
ISPSSGQVI

SEQ ID NO: 2216891 - protein, 6 aa, Cryptosporidium parvum
ISQDEN

SEQ ID NO: 2216892 - protein, 14 aa, Cryptosporidium parvum
ISQFSSSKKDSELY

SEQ ID NO: 2216893 - protein, 11 aa, Cryptosporidium parvum
ISQHDTSGEYE

SEQ ID NO: 2216894 - protein, 4 aa, Cryptosporidium parvum
ISQI

SEQ ID NO: 2216895 - protein, 4 aa, Cryptosporidium parvum
ISQN

SEQ ID NO: 2216896 - protein, 10 aa, Cryptosporidium parvum
ISQNDSNSSL

SEQ ID NO: 2216897 - protein, 10 aa, Cryptosporidium parvum
ISQNSDPKVI

SEQ ID NO: 2216898 - protein, 5 aa, Cryptosporidium parvum
ISQPI

SEQ ID NO: 2216899 - protein, 4 aa, Cryptosporidium parvum
ISQQ

SEQ ID NO: 2216900 - protein, 9 aa, Cryptosporidium parvum
ISQRNEKKV

SEQ ID NO: 2216901 - protein, 8 aa, Cryptosporidium parvum
ISQTERRK

SEQ ID NO: 2216902 - protein, 7 aa, Cryptosporidium parvum
ISRERVG

SEQ ID NO: 2216903 - protein, 13 aa, Cryptosporidium parvum
ISRESSTDLKSSM

SEQ ID NO: 2216904 - protein, 13 aa, Cryptosporidium parvum
ISRKNDDKNSNIS

SEQ ID NO: 2216905 - protein, 4 aa, Cryptosporidium parvum
ISRN

SEQ ID NO: 2216906 - protein, 14 aa, Cryptosporidium parvum
ISRQEDKNELNQND

SEQ ID NO: 2216907 - protein, 10 aa, Cryptosporidium parvum
ISRSSPLDSR

SEQ ID NO: 2216908 - protein, 4 aa, Cryptosporidium parvum
ISSD

SEQ ID NO: 2216909 - protein, 4 aa, Cryptosporidium parvum
ISSE

SEQ ID NO: 2216910 - protein, 6 aa, Cryptosporidium parvum
ISSEPK

SEQ ID NO: 2216911 - protein, 6 aa, Cryptosporidium parvum
ISSESD

SEQ ID NO: 2216912 - protein, 5 aa, Cryptosporidium parvum
ISSET

SEQ ID NO: 2216913 - protein, 4 aa, Cryptosporidium parvum
ISSG

SEQ ID NO: 2216914 - protein, 5 aa, Cryptosporidium parvum
ISSGE

SEQ ID NO: 2216915 - protein, 25 aa, Cryptosporidium parvum
ISSGGKNEQKKGSQINDINLIYNDK

SEQ ID NO: 2216916 - protein, 12 aa, Cryptosporidium parvum
ISSGGSSHKSIK

SEQ ID NO: 2216917 - protein, 30 aa, Cryptosporidium parvum
ISSGVSGGAGKISENYTSKGGAGEGRSAAR

SEQ ID NO: 2216918 - protein, 12 aa, Cryptosporidium parvum
ISSKDRGKGSEN

SEQ ID NO: 2216919 - protein, 8 aa, Cryptosporidium parvum
ISSKSDQK

SEQ ID NO: 2216920 - protein, 6 aa, Cryptosporidium parvum
ISSNGE

SEQ ID NO: 2216921 - protein, 37 aa, Cryptosporidium parvum
ISSNKSSKTYLKDSENNQKTINNHYNQSQNSKSSNSL

SEQ ID NO: 2216922 - protein, 5 aa, Cryptosporidium parvum
ISSNN

SEQ ID NO: 2216923 - protein, 20 aa, Cryptosporidium parvum
ISSNSHKHSASHSLKTQSGY

SEQ ID NO: 2216924 - protein, 33 aa, Cryptosporidium parvum; identical to SEQ ID NO: 2114633

SEQ ID NO: 2216925 - protein, 6 aa, Cryptosporidium parvum
ISSNTH

SEQ ID NO: 2216926 - protein, 12 aa, Cryptosporidium parvum
ISSNYDESGLQS

SEQ ID NO: 2216927 - protein, 7 aa, Cryptosporidium parvum
ISSPEND

SEQ ID NO: 2216928 - protein, 4 aa, Cryptosporidium parvum
ISSQ

SEQ ID NO: 2216929 - protein, 9 aa, Cryptosporidium parvum
ISSQGHPDT

SEQ ID NO: 2216930 - protein, 22 aa, Cryptosporidium parvum
ISSQNQSSSEQISSQSSTYTNQ

SEQ ID NO: 2216931 - protein, 9 aa, Cryptosporidium parvum
ISSRGGTNC

SEQ ID NO: 2216932 - protein, 5 aa, Cryptosporidium parvum
ISSRN

SEQ ID NO: 2216933 - protein, 12 aa, Cryptosporidium parvum
ISSSASKSEITA

SEQ ID NO: 2216934 - protein, 8 aa, Cryptosporidium parvum
ISSSESKC

SEQ ID NO: 2216935 - protein, 9 aa, Cryptosporidium parvum
ISSSESSTL

SEQ ID NO: 2216936 - protein, 8 aa, Cryptosporidium parvum
ISSSEVPS

SEQ ID NO: 2216937 - protein, 8 aa, Cryptosporidium parvum
ISSSGGIP

SEQ ID NO: 2216938 - protein, 11 aa, Cryptosporidium parvum
ISSSRDDIGNS

SEQ ID NO: 2216939 - protein, 11 aa, Cryptosporidium parvum
ISSSSGGSTSI

SEQ ID NO: 2216940 - protein, 6 aa, Cryptosporidium parvum
ISSSSQ

SEQ ID NO: 2216941 - protein, 7 aa, Cryptosporidium parvum
ISSSSRK

SEQ ID NO: 2216942 - protein, 20 aa, Cryptosporidium parvum
ISSSSTSTPSISLNTSTPNI

SEQ ID NO: 2216943 - protein, 13 aa, Cryptosporidium parvum
ISSVGNNDNNNNA

SEQ ID NO: 2216944 - protein, 7 aa, Cryptosporidium parvum
ISSYRNS

SEQ ID NO: 2216945 - protein, 5 aa, Cryptosporidium parvum
ISTDG

SEQ ID NO: 2216946 - protein, 6 aa, Cryptosporidium parvum
ISTENS

SEQ ID NO: 2216947 - protein, 5 aa, Cryptosporidium parvum
ISTIP

SEQ ID NO: 2216948 - protein, 4 aa, Cryptosporidium parvum
ISTK

SEQ ID NO: 2216949 - protein, 8 aa, Cryptosporidium parvum
ISTKNSDI

SEQ ID NO: 2216950 - protein, 10 aa, Cryptosporidium parvum
ISTNSTDHHG

SEQ ID NO: 2216951 - protein, 5 aa, Cryptosporidium parvum
ISTPN

SEQ ID NO: 2216952 - protein, 4 aa, Cryptosporidium parvum
ISTR

SEQ ID NO: 2216953 - protein, 8 aa, Cryptosporidium parvum
ISTRSENI

SEQ ID NO: 2216954 - protein, 6 aa, Cryptosporidium parvum
ISTSDE

SEQ ID NO: 2216955 - protein, 5 aa, Cryptosporidium parvum
ISTSN

SEQ ID NO: 2216956 - protein, 8 aa, Cryptosporidium parvum
ISTSPAAI

SEQ ID NO: 2216957 - protein, 7 aa, Cryptosporidium parvum
ISTSQNT

SEQ ID NO: 2216958 - protein, 7 aa, Cryptosporidium parvum
ISTSRNS

SEQ ID NO: 2216959 - protein, 11 aa, Cryptosporidium parvum
ISTTQNGSDPT

SEQ ID NO: 2216960 - protein, 11 aa, Cryptosporidium parvum
ISYDDKSDLES

SEQ ID NO: 2216961 - protein, 5 aa, Cryptosporidium parvum
ITAEA

SEQ ID NO: 2216962 - protein, 5 aa, Cryptosporidium parvum
ITDSS

SEQ ID NO: 2216963 - protein, 4 aa, Cryptosporidium parvum
ITEE

SEQ ID NO: 2216964 - protein, 11 aa, Cryptosporidium parvum
ITEEEGESSRF

SEQ ID NO: 2216965 - protein, 8 aa, Cryptosporidium parvum
ITEKKEKK

SEQ ID NO: 2216966 - protein, 10 aa, Cryptosporidium parvum
ITESDPYANN

SEQ ID NO: 2216967 - protein, 17 aa, Cryptosporidium parvum
ITESEIRNSTESDSTTF

SEQ ID NO: 2216968 - protein, 7 aa, Cryptosporidium parvum
ITESSKG

SEQ ID NO: 2216969 - protein, 7 aa, Cryptosporidium parvum
ITGASGG

SEQ ID NO: 2216970 - protein, 8 aa, Cryptosporidium parvum
ITGKGGVG

SEQ ID NO: 2216971 - protein, 8 aa, Cryptosporidium parvum
ITGKKNNI

SEQ ID NO: 2216972 - protein, 4 aa, Cryptosporidium parvum
ITGP

SEQ ID NO: 2216973 - protein, 18 aa, Cryptosporidium parvum
ITGQNKNEDIDQKTEGSF

SEQ ID NO: 2216974 - protein, 15 aa, Cryptosporidium parvum
ITGSSTALADAQRGE

SEQ ID NO: 2216975 - protein, 32 aa, Cryptosporidium parvum
ITKSRIEKSALSDLNDTKNTVTVEKSTDFQPT

SEQ ID NO: 2216976 - protein, 4 aa, Cryptosporidium parvum
ITND

SEQ ID NO: 2216977 - protein, 5 aa, Cryptosporidium parvum
ITNDE

SEQ ID NO: 2216978 - protein, 7 aa, Cryptosporidium parvum
ITNGTGK

SEQ ID NO: 2216979 - protein, 7 aa, Cryptosporidium parvum
ITNKGQK

SEQ ID NO: 2216980 - protein, 30 aa, Cryptosporidium parvum
ITNNNKTNNNKQTSKNKNSAKSKKGKKHKT

SEQ ID NO: 2216981 - protein, 5 aa, Cryptosporidium parvum
ITNPL

SEQ ID NO: 2216982 - protein, 8 aa, Cryptosporidium parvum
ITNQPSMT

SEQ ID NO: 2216983 - protein, 6 aa, Cryptosporidium parvum
ITNREK

SEQ ID NO: 2216984 - protein, 7 aa, Cryptosporidium parvum
ITNSKGE

SEQ ID NO: 2216985 - protein, 4 aa, Cryptosporidium parvum
ITNY

SEQ ID NO: 2216986 - protein, 6 aa, Cryptosporidium parvum
ITPASI

SEQ ID NO: 2216987 - protein, 4 aa, Cryptosporidium parvum
ITPE

SEQ ID NO: 2216988 - protein, 8 aa, Cryptosporidium parvum
ITPEGKSD

SEQ ID NO: 2216989 - protein, 10 aa, Cryptosporidium parvum
ITPGGKASGI

SEQ ID NO: 2216990 - protein, 4 aa, Cryptosporidium parvum
ITPN

SEQ ID NO: 2216991 - protein, 9 aa, Cryptosporidium parvum
ITPNQSPIN

SEQ ID NO: 2216992 - protein, 5 aa, Cryptosporidium parvum
ITPYS

SEQ ID NO: 2216993 - protein, 7 aa, Cryptosporidium parvum
ITSAGAK

SEQ ID NO: 2216994 - protein, 10 aa, Cryptosporidium parvum
ITSDDNRKRK

SEQ ID NO: 2216995 - protein, 8 aa, Cryptosporidium parvum
ITSEDQSH

SEQ ID NO: 2216996 - protein, 5 aa, Cryptosporidium parvum
ITSGY

SEQ ID NO: 2216997 - protein, 4 aa, Cryptosporidium parvum
ITSH

SEQ ID NO: 2216998 - protein, 7 aa, Cryptosporidium parvum
ITSKNGI

SEQ ID NO: 2216999 - protein, 4 aa, Cryptosporidium parvum
ITSN

SEQ ID NO: 2217000 - protein, 10 aa, Cryptosporidium parvum
ITSNKESNNL

SEQ ID NO: 2217001 - protein, 7 aa, Cryptosporidium parvum
ITSNSFE

SEQ ID NO: 2217002 - protein, 7 aa, Cryptosporidium parvum
ITSQEDS

SEQ ID NO: 2217003 - protein, 10 aa, Cryptosporidium parvum
ITSSKTPSIV

SEQ ID NO: 2217004 - protein, 5 aa, Cryptosporidium parvum
ITSSN

SEQ ID NO: 2217005 - protein, 7 aa, Cryptosporidium parvum
ITSSSGL

SEQ ID NO: 2217006 - protein, 6 aa, Cryptosporidium parvum
ITSTEE

SEQ ID NO: 2217007 - protein, 11 aa, Cryptosporidium parvum
ITSTTTNATTA

SEQ ID NO: 2217008 - protein, 4 aa, Cryptosporidium parvum
ITTK

SEQ ID NO: 2217009 - protein, 9 aa, Cryptosporidium parvum
ITTLPTKEN

SEQ ID NO: 2217010 - protein, 15 aa, Cryptosporidium parvum
ITTSETGNTTTNSRV

SEQ ID NO: 2217011 - protein, 6 aa, Cryptosporidium parvum
ITTSSI

SEQ ID NO: 2217012 - protein, 18 aa, Cryptosporidium parvum
ITTSTSGKTVSLRPSIDS

SEQ ID NO: 2217013 - protein, 5 aa, Cryptosporidium parvum
ITYGS

SEQ ID NO: 2217014 - protein, 23 aa, Cryptosporidium parvum
IVDPSKSKNNRSKRKRPSRASTS

SEQ ID NO: 2217015 - protein, 4 aa, Cryptosporidium parvum
IYGQ

SEQ ID NO: 2217016 - protein, 9 aa, Cryptosporidium parvum
IYKNKPELK

SEQ ID NO: 2217017 - protein, 13 aa, Cryptosporidium parvum
IYNNTKTAKKLNE

SEQ ID NO: 2217018 - protein, 6 aa, Cryptosporidium parvum
IYNSQY

SEQ ID NO: 2217019 - protein, 12 aa, Cryptosporidium parvum
IYPKDSSDISTP

SEQ ID NO: 2217020 - protein, 7 aa, Cryptosporidium parvum
IYRNEND

SEQ ID NO: 2217021 - protein, 7 aa, Cryptosporidium parvum
IYTKDSK

SEQ ID NO: 2217022 - protein, 6 aa, Cryptosporidium parvum
KAADSA

SEQ ID NO: 2217023 - protein, 8 aa, Cryptosporidium parvum
KAAESFPV

SEQ ID NO: 2217024 - protein, 9 aa, Cryptosporidium parvum
KAAYNSSKR

SEQ ID NO: 2217025 - protein, 6 aa, Cryptosporidium parvum
KADGNY

SEQ ID NO: 2217026 - protein, 7 aa, Cryptosporidium parvum
KADHNGD

SEQ ID NO: 2217027 - protein, 8 aa, Cryptosporidium parvum
KAEETGCN

SEQ ID NO: 2217028 - protein, 6 aa, Cryptosporidium parvum
KAEFSE

SEQ ID NO: 2217029 - protein, 10 aa, Cryptosporidium parvum
KAEGEAKAAK

SEQ ID NO: 2217030 - protein, 6 aa, Cryptosporidium parvum
KAENLG

SEQ ID NO: 2217031 - protein, 6 aa, Cryptosporidium parvum
KAFKER

SEQ ID NO: 2217032 - protein, 6 aa, Cryptosporidium parvum
KAGESV

SEQ ID NO: 2217033 - protein, 6 aa, Cryptosporidium parvum
KAGITS

SEQ ID NO: 2217034 - protein, 8 aa, Cryptosporidium parvum
KAKENNEK

SEQ ID NO: 2217035 - protein, 15 aa, Cryptosporidium parvum
KAKPKRTSSHQTNAA

SEQ ID NO: 2217036 - protein, 14 aa, Cryptosporidium parvum
KAKPVEETTSTRMA

SEQ ID NO: 2217037 - protein, 8 aa, Cryptosporidium parvum
KAKVPTKF

SEQ ID NO: 2217038 - protein, 7 aa, Cryptosporidium parvum
KALDDAG

SEQ ID NO: 2217039 - protein, 7 aa, Cryptosporidium parvum
KALESQK

SEQ ID NO: 2217040 - protein, 12 aa, Cryptosporidium parvum
KALGEKQRGHNI

SEQ ID NO: 2217041 - protein, 7 aa, Cryptosporidium parvum
KALKTQI

SEQ ID NO: 2217042 - protein, 6 aa, Cryptosporidium parvum
KALQDF

SEQ ID NO: 2217043 - protein, 5 aa, Cryptosporidium parvum
KALVS

SEQ ID NO: 2217044 - protein, 7 aa, Cryptosporidium parvum
KANETPY

SEQ ID NO: 2217045 - protein, 13 aa, Cryptosporidium parvum
KANKENKSEKGAV

SEQ ID NO: 2217046 - protein, 10 aa, Cryptosporidium parvum
KANKKSIRRA

SEQ ID NO: 2217047 - protein, 6 aa, Cryptosporidium parvum
KANKSL

SEQ ID NO: 2217048 - protein, 8 aa, Cryptosporidium parvum
KANPETQK

SEQ ID NO: 2217049 - protein, 5 aa, Cryptosporidium parvum
KANQS

SEQ ID NO: 2217050 - protein, 6 aa, Cryptosporidium parvum
KANSVG

SEQ ID NO: 2217051 - protein, 6 aa, Cryptosporidium parvum
KAPKDQ

SEQ ID NO: 2217052 - protein, 5 aa, Cryptosporidium parvum
KAPKF

SEQ ID NO: 2217053 - protein, 12 aa, Cryptosporidium parvum
KAPKKSKRNGFS

SEQ ID NO: 2217054 - protein, 7 aa, Cryptosporidium parvum
KAPKLSE

SEQ ID NO: 2217055 - protein, 7 aa, Cryptosporidium parvum
KAPKRIS

SEQ ID NO: 2217056 - protein, 22 aa, Cryptosporidium parvum
KAPNPSKTTSNRTESSLNENVG

SEQ ID NO: 2217057 - protein, 5 aa, Cryptosporidium parvum
KAQEI

SEQ ID NO: 2217058 - protein, 8 aa, Cryptosporidium parvum
KAQSSYSN

SEQ ID NO: 2217059 - protein, 18 aa, Cryptosporidium parvum
KARAIESDGQEDFSAEAT

SEQ ID NO: 2217060 - protein, 7 aa, Cryptosporidium parvum
KARESQI

SEQ ID NO: 2217061 - protein, 5 aa, Cryptosporidium parvum
KARKV

SEQ ID NO: 2217062 - protein, 7 aa, Cryptosporidium parvum
KARSTYG

SEQ ID NO: 2217063 - protein, 13 aa, Cryptosporidium parvum
KASGSKSEKKETN

SEQ ID NO: 2217064 - protein, 11 aa, Cryptosporidium parvum
KASHSYSNEVN

SEQ ID NO: 2217065 - protein, 9 aa, Cryptosporidium parvum
KASKPKVNK

SEQ ID NO: 2217066 - protein, 7 aa, Cryptosporidium parvum
KASKTKM

SEQ ID NO: 2217067 - protein, 6 aa, Cryptosporidium parvum
KASNDF

SEQ ID NO: 2217068 - protein, 10 aa, Cryptosporidium parvum
KASNSSENMK

SEQ ID NO: 2217069 - protein, 10 aa, Cryptosporidium parvum
KASQNSTDLK

SEQ ID NO: 2217070 - protein, 7 aa, Cryptosporidium parvum
KASRISK

SEQ ID NO: 2217071 - protein, 10 aa, Cryptosporidium parvum
KASSGKTMDR

SEQ ID NO: 2217072 - protein, 18 aa, Cryptosporidium parvum
KASSQQKIKYEKDHTQLS

SEQ ID NO: 2217073 - protein, 25 aa, Cryptosporidium parvum
KASVSEEQTQNTTYMNNSGSPSTLF

SEQ ID NO: 2217074 - protein, 6 aa, Cryptosporidium parvum
KASYGI

SEQ ID NO: 2217075 - protein, 6 aa, Cryptosporidium parvum
KATARA

SEQ ID NO: 2217076 - protein, 11 aa, Cryptosporidium parvum
KATKSKNEAER

SEQ ID NO: 2217077 - protein, 14 aa, Cryptosporidium parvum
KATNNTIDSPYSPN

SEQ ID NO: 2217078 - protein, 8 aa, Cryptosporidium parvum
KATNQTND

SEQ ID NO: 2217079 - protein, 9 aa, Cryptosporidium parvum
KAVASKGAE

SEQ ID NO: 2217080 - protein, 14 aa, Cryptosporidium parvum
KAVGASKGPKNEQL

SEQ ID NO: 2217081 - protein, 7 aa, Cryptosporidium parvum
KAVRSQS

SEQ ID NO: 2217082 - protein, 15 aa, Cryptosporidium parvum
KCDKTSESDISTHPP

SEQ ID NO: 2217083 - protein, 4 aa, Cryptosporidium parvum
KCDQ

SEQ ID NO: 2217084 - protein, 4 aa, Cryptosporidium parvum
KCDR

SEQ ID NO: 2217085 - protein, 6 aa, Cryptosporidium parvum
KCEPHD

SEQ ID NO: 2217086 - protein, 6 aa, Cryptosporidium parvum
KCETNK

SEQ ID NO: 2217087 - protein, 10 aa, Cryptosporidium parvum
KCKAPSAEEA

SEQ ID NO: 2217088 - protein, 8 aa, Cryptosporidium parvum
KCKEKKSC

SEQ ID NO: 2217089 - protein, 6 aa, Cryptosporidium parvum
KCLTST

SEQ ID NO: 2217090 - protein, 6 aa, Cryptosporidium parvum
KCNPNS

SEQ ID NO: 2217091 - protein, 6 aa, Cryptosporidium parvum
KCNTQY

SEQ ID NO: 2217092 - protein, 5 aa, Cryptosporidium parvum
KCPNT

SEQ ID NO: 2217093 - protein, 4 aa, Cryptosporidium parvum
KCQN

SEQ ID NO: 2217094 - protein, 9 aa, Cryptosporidium parvum
KCSEIEPQV

SEQ ID NO: 2217095 - protein, 7 aa, Cryptosporidium parvum
KCTTHSE

SEQ ID NO: 2217096 - protein, 13 aa, Cryptosporidium parvum
KCYTTSSKETAEI

SEQ ID NO: 2217097 - protein, 11 aa, Cryptosporidium parvum
KDALNDQNLSP

SEQ ID NO: 2217098 - protein, 21 aa, Cryptosporidium parvum
KDASKVLETDMSGKGYSQSNS

SEQ ID NO: 2217099 - protein, 11 aa, Cryptosporidium parvum
KDASPQDPLDK

SEQ ID NO: 2217100 - protein, 6 aa, Cryptosporidium parvum
KDATVS

SEQ ID NO: 2217101 - protein, 6 aa, Cryptosporidium parvum
KDDDIK

SEQ ID NO: 2217102 - protein, 5 aa, Cryptosporidium parvum
KDDFS

SEQ ID NO: 2217103 - protein, 5 aa, Cryptosporidium parvum
KDDGR

SEQ ID NO: 2217104 - protein, 6 aa, Cryptosporidium parvum
KDDINS

SEQ ID NO: 2217105 - protein, 8 aa, Cryptosporidium parvum
KDDIPSNV

SEQ ID NO: 2217106 - protein, 7 aa, Cryptosporidium parvum
KDDIQEK

SEQ ID NO: 2217107 - protein, 6 aa, Cryptosporidium parvum
KDDISS

SEQ ID NO: 2217108 - protein, 8 aa, Cryptosporidium parvum
KDDLPSLS

SEQ ID NO: 2217109 - protein, 5 aa, Cryptosporidium parvum
KDDLS

SEQ ID NO: 2217110 - protein, 13 aa, Cryptosporidium parvum
KDDNDTDHDNHND

SEQ ID NO: 2217111 - protein, 7 aa, Cryptosporidium parvum
KDDNNIE

SEQ ID NO: 2217112 - protein, 9 aa, Cryptosporidium parvum
KDDQDYIKK

SEQ ID NO: 2217113 - protein, 37 aa, Cryptosporidium parvum
KDDSAKSDKSVKTESNSKVSIQSQKTKNEDDDQVNEE

SEQ ID NO: 2217114 - protein, 15 aa, Cryptosporidium parvum
KDDSTSSHSDQSNSS

SEQ ID NO: 2217115 - protein, 12 aa, Cryptosporidium parvum
KDDTVTLRERDS

SEQ ID NO: 2217116 - protein, 6 aa, Cryptosporidium parvum
KDEAAL

SEQ ID NO: 2217117 - protein, 9 aa, Cryptosporidium parvum
KDEARSGSI

SEQ ID NO: 2217118 - protein, 5 aa, Cryptosporidium parvum
KDEGN

SEQ ID NO: 2217119 - protein, 14 aa, Cryptosporidium parvum
KDEGYYTKNGEINQ

SEQ ID NO: 2217120 - protein, 10 aa, Cryptosporidium parvum
KDEITEKNSQ

SEQ ID NO: 2217121 - protein, 8 aa, Cryptosporidium parvum
KDEMSTAY

SEQ ID NO: 2217122 - protein, 4 aa, Cryptosporidium parvum
KDEN

SEQ ID NO: 2217123 - protein, 5 aa, Cryptosporidium parvum
KDENG

SEQ ID NO: 2217124 - protein, 14 aa, Cryptosporidium parvum
KDENKEKTSQINSS

SEQ ID NO: 2217125 - protein, 6 aa, Cryptosporidium parvum
KDENQK

SEQ ID NO: 2217126 - protein, 11 aa, Cryptosporidium parvum
KDEQEPAKFSR

SEQ ID NO: 2217127 - protein, 5 aa, Cryptosporidium parvum
KDEQQ

SEQ ID NO: 2217128 - protein, 8 aa, Cryptosporidium parvum
KDESHSKP

SEQ ID NO: 2217129 - protein, 9 aa, Cryptosporidium parvum
KDETAKFTI

SEQ ID NO: 2217130 - protein, 6 aa, Cryptosporidium parvum
KDETLS

SEQ ID NO: 2217131 - protein, 4 aa, Cryptosporidium parvum
KDEV

SEQ ID NO: 2217132 - protein, 6 aa, Cryptosporidium parvum
KDEVSK

SEQ ID NO: 2217133 - protein, 9 aa, Cryptosporidium parvum
KDFGKPIPA

SEQ ID NO: 2217134 - protein, 18 aa, Cryptosporidium parvum
KDFKRRKKDDTQQEEATL

SEQ ID NO: 2217135 - protein, 4 aa, Cryptosporidium parvum
KDGE

SEQ ID NO: 2217136 - protein, 9 aa, Cryptosporidium parvum
KDGGSESIQ

SEQ ID NO: 2217137 - protein, 5 aa, Cryptosporidium parvum
KDGKI

SEQ ID NO: 2217138 - protein, 7 aa, Cryptosporidium parvum
KDGRIEN

SEQ ID NO: 2217139 - protein, 10 aa, Cryptosporidium parvum
KDGSSVPNVK

SEQ ID NO: 2217140 - protein, 8 aa, Cryptosporidium parvum
KDHDPEYK

SEQ ID NO: 2217141 - protein, 8 aa, Cryptosporidium parvum
KDHGLTST

SEQ ID NO: 2217142 - protein, 7 aa, Cryptosporidium parvum
KDHGNGK

SEQ ID NO: 2217143 - protein, 6 aa, Cryptosporidium parvum
KDIDNN

SEQ ID NO: 2217144 - protein, 5 aa, Cryptosporidium parvum
KDIKN

SEQ ID NO: 2217145 - protein, 8 aa, Cryptosporidium parvum
KDINTEQE

SEQ ID NO: 2217146 - protein, 10 aa, Cryptosporidium parvum
KDIPTSTARQ

SEQ ID NO: 2217147 - protein, 5 aa, Cryptosporidium parvum
KDIQD

SEQ ID NO: 2217148 - protein, 5 aa, Cryptosporidium parvum
KDIRA

SEQ ID NO: 2217149 - protein, 7 aa, Cryptosporidium parvum
KDISNDT

SEQ ID NO: 2217150 - protein, 7 aa, Cryptosporidium parvum
KDISPNI

SEQ ID NO: 2217151 - protein, 12 aa, Cryptosporidium parvum
KDISRGNRESQH

SEQ ID NO: 2217152 - protein, 12 aa, Cryptosporidium parvum
KDITNQKSLDEL

SEQ ID NO: 2217153 - protein, 12 aa, Cryptosporidium parvum
KDKDGSPSATST

SEQ ID NO: 2217154 - protein, 7 aa, Cryptosporidium parvum
KDKDTNC

SEQ ID NO: 2217155 - protein, 8 aa, Cryptosporidium parvum
KDKEICDE

SEQ ID NO: 2217156 - protein, 27 aa, Cryptosporidium parvum
KDKEIESENTIEEGKENMMNNGGEQVR

SEQ ID NO: 2217157 - protein, 7 aa, Cryptosporidium parvum
KDKERNY

SEQ ID NO: 2217158 - protein, 4 aa, Cryptosporidium parvum
KDKN

SEQ ID NO: 2217159 - protein, 7 aa, Cryptosporidium parvum
KDKNDQI

SEQ ID NO: 2217160 - protein, 32 aa, Cryptosporidium parvum
KDKNFKSDKNSFGRRGKTSNFDIQNNKKKIRN

SEQ ID NO: 2217161 - protein, 6 aa, Cryptosporidium parvum
KDKNIS

SEQ ID NO: 2217162 - protein, 10 aa, Cryptosporidium parvum
KDKNQSGVNS

SEQ ID NO: 2217163 - protein, 17 aa, Cryptosporidium parvum
KDKSNEVGSNECEAVSS

SEQ ID NO: 2217164 - protein, 20 aa, Cryptosporidium parvum
KDKSSMEKIPDTQSFIEIKA

SEQ ID NO: 2217165 - protein, 30 aa, Cryptosporidium parvum
KDKTGIITENTTLSSSYSNKIKKNPKIESL

SEQ ID NO: 2217166 - protein, 4 aa, Cryptosporidium parvum
KDKW

SEQ ID NO: 2217167 - protein, 18 aa, Cryptosporidium parvum
KDKYSSKISKLGQKNDNY

SEQ ID NO: 2217168 - protein, 13 aa, Cryptosporidium parvum
KDLDENYNFFLSL

SEQ ID NO: 2217169 - protein, 4 aa, Cryptosporidium parvum
KDLK

SEQ ID NO: 2217170 - protein, 14 aa, Cryptosporidium parvum
KDLKEDDNKTNPVK

SEQ ID NO: 2217171 - protein, 10 aa, Cryptosporidium parvum
KDLKRAKNKT

SEQ ID NO: 2217172 - protein, 5 aa, Cryptosporidium parvum
KDLND

SEQ ID NO: 2217173 - protein, 6 aa, Cryptosporidium parvum
KDLNEN

SEQ ID NO: 2217174 - protein, 7 aa, Cryptosporidium parvum
KDLNGSR

SEQ ID NO: 2217175 - protein, 6 aa, Cryptosporidium parvum
KDLNKI

SEQ ID NO: 2217176 - protein, 6 aa, Cryptosporidium parvum
KDLSES

SEQ ID NO: 2217177 - protein, 13 aa, Cryptosporidium parvum
KDLSSNNKPKDYQ

SEQ ID NO: 2217178 - protein, 6 aa, Cryptosporidium parvum
KDMKQN

SEQ ID NO: 2217179 - protein, 11 aa, Cryptosporidium parvum
KDMKRSDTIEE

SEQ ID NO: 2217180 - protein, 12 aa, Cryptosporidium parvum
KDNEKDETQDDK

SEQ ID NO: 2217181 - protein, 4 aa, Cryptosporidium parvum
KDNF

SEQ ID NO: 2217182 - protein, 5 aa, Cryptosporidium parvum
KDNKH

SEQ ID NO: 2217183 - protein, 7 aa, Cryptosporidium parvum
KDNLDEV

SEQ ID NO: 2217184 - protein, 6 aa, Cryptosporidium parvum
KDNNFN

SEQ ID NO: 2217185 - protein, 7 aa, Cryptosporidium parvum
KDNNRMN

SEQ ID NO: 2217186 - protein, 7 aa, Cryptosporidium parvum
KDNPRSF

SEQ ID NO: 2217187 - protein, 16 aa, Cryptosporidium parvum
KDNPSVRPETSKDVEA

SEQ ID NO: 2217188 - protein, 6 aa, Cryptosporidium parvum
KDNQNF

SEQ ID NO: 2217189 - protein, 4 aa, Cryptosporidium parvum
KDNS

SEQ ID NO: 2217190 - protein, 5 aa, Cryptosporidium parvum
KDNSD

SEQ ID NO: 2217191 - protein, 6 aa, Cryptosporidium parvum
KDNSFE

SEQ ID NO: 2217192 - protein, 31 aa, Cryptosporidium parvum
KDNSSNNQPTNTQNNSSGINNAQESPTCSTS

SEQ ID NO: 2217193 - protein, 6 aa, Cryptosporidium parvum
KDNVLD

SEQ ID NO: 2217194 - protein, 20 aa, Cryptosporidium parvum
KDPCSNTETMSRNRTVKTVS

SEQ ID NO: 2217195 - protein, 9 aa, Cryptosporidium parvum
KDPDDSKIV

SEQ ID NO: 2217196 - protein, 15 aa, Cryptosporidium parvum
KDPECENQEKKIRKL

SEQ ID NO: 2217197 - protein, 5 aa, Cryptosporidium parvum
KDPET

SEQ ID NO: 2217198 - protein, 4 aa, Cryptosporidium parvum
KDPK

SEQ ID NO: 2217199 - protein, 18 aa, Cryptosporidium parvum
KDPNLNSDSTSKNSDNQF

SEQ ID NO: 2217200 - protein, 7 aa, Cryptosporidium parvum
KDPRQEI

SEQ ID NO: 2217201 - protein, 7 aa, Cryptosporidium parvum
KDPSGTI

SEQ ID NO: 2217202 - protein, 10 aa, Cryptosporidium parvum
KDPSHPNSNP

SEQ ID NO: 2217203 - protein, 9 aa, Cryptosporidium parvum
KDPSISSTE

SEQ ID NO: 2217204 - protein, 7 aa, Cryptosporidium parvum
KDPTNKI

SEQ ID NO: 2217205 - protein, 17 aa, Cryptosporidium parvum
KDQDQSTKEGIGKHSSS

SEQ ID NO: 2217206 - protein, 6 aa, Cryptosporidium parvum
KDQEDL

SEQ ID NO: 2217207 - protein, 6 aa, Cryptosporidium parvum
KDQEPT

SEQ ID NO: 2217208 - protein, 10 aa, Cryptosporidium parvum
KDQNQDYIPE

SEQ ID NO: 2217209 - protein, 7 aa, Cryptosporidium parvum
KDQQGIQ

SEQ ID NO: 2217210 - protein, 11 aa, Cryptosporidium parvum
KDQTDPAPRYI

SEQ ID NO: 2217211 - protein, 8 aa, Cryptosporidium parvum
KDQTEKST

SEQ ID NO: 2217212 - protein, 7 aa, Cryptosporidium parvum
KDRDPES

SEQ ID NO: 2217213 - protein, 18 aa, Cryptosporidium parvum
KDREIRRSSRSSLKSISK

SEQ ID NO: 2217214 - protein, 12 aa, Cryptosporidium parvum
KDRGTGNNFQDP

SEQ ID NO: 2217215 - protein, 9 aa, Cryptosporidium parvum
KDRITSGKR

SEQ ID NO: 2217216 - protein, 6 aa, Cryptosporidium parvum
KDRPEK

SEQ ID NO: 2217217 - protein, 6 aa, Cryptosporidium parvum
KDRPLP

SEQ ID NO: 2217218 - protein, 25 aa, Cryptosporidium parvum
KDRSSNNQGDFSKKRTLECKSDQIN

SEQ ID NO: 2217219 - protein, 10 aa, Cryptosporidium parvum
KDRSSVSASD

SEQ ID NO: 2217220 - protein, 7 aa, Cryptosporidium parvum
KDRTGDY

SEQ ID NO: 2217221 - protein, 6 aa, Cryptosporidium parvum
KDSACK

SEQ ID NO: 2217222 - protein, 5 aa, Cryptosporidium parvum
KDSAN

SEQ ID NO: 2217223 - protein, 14 aa, Cryptosporidium parvum
KDSDAKNKQDEHST

SEQ ID NO: 2217224 - protein, 6 aa, Cryptosporidium parvum
KDSDNM

SEQ ID NO: 2217225 - protein, 9 aa, Cryptosporidium parvum
KDSDSEEKE

SEQ ID NO: 2217226 - protein, 4 aa, Cryptosporidium parvum
KDSE

SEQ ID NO: 2217227 - protein, 6 aa, Cryptosporidium parvum
KDSEKS

SEQ ID NO: 2217228 - protein, 8 aa, Cryptosporidium parvum
KDSENSPI

SEQ ID NO: 2217229 - protein, 23 aa, Cryptosporidium parvum
KDSETQDSTSDTYLEEESNPENT

SEQ ID NO: 2217230 - protein, 5 aa, Cryptosporidium parvum
KDSEV

SEQ ID NO: 2217231 - protein, 5 aa, Cryptosporidium parvum
KDSGF

SEQ ID NO: 2217232 - protein, 7 aa, Cryptosporidium parvum
KDSGGQI

SEQ ID NO: 2217233 - protein, 7 aa, Cryptosporidium parvum
KDSGNFQ

SEQ ID NO: 2217234 - protein, 4 aa, Cryptosporidium parvum
KDSI

SEQ ID NO: 2217235 - protein, 5 aa, Cryptosporidium parvum
KDSID

SEQ ID NO: 2217236 - protein, 9 aa, Cryptosporidium parvum
KDSIPGTTV

SEQ ID NO: 2217237 - protein, 9 aa, Cryptosporidium parvum
KDSKDDERV

SEQ ID NO: 2217238 - protein, 11 aa, Cryptosporidium parvum
KDSKENNPENI

SEQ ID NO: 2217239 - protein, 7 aa, Cryptosporidium parvum
KDSKING

SEQ ID NO: 2217240 - protein, 10 aa, Cryptosporidium parvum
KDSKKEFGSN

SEQ ID NO: 2217241 - protein, 6 aa, Cryptosporidium parvum
KDSNFE

SEQ ID NO: 2217242 - protein, 9 aa, Cryptosporidium parvum
KDSNHHGRS

SEQ ID NO: 2217243 - protein, 8 aa, Cryptosporidium parvum
KDSNPRDL

SEQ ID NO: 2217244 - protein, 8 aa, Cryptosporidium parvum
KDSNYQKS

SEQ ID NO: 2217245 - protein, 20 aa, Cryptosporidium parvum
KDSPIEKTGDFKSNDNLKNQ

SEQ ID NO: 2217246 - protein, 11 aa, Cryptosporidium parvum
KDSQREDTTSI

SEQ ID NO: 2217247 - protein, 6 aa, Cryptosporidium parvum
KDSQTP

SEQ ID NO: 2217248 - protein, 8 aa, Cryptosporidium parvum
KDSQYDEQ

SEQ ID NO: 2217249 - protein, 7 aa, Cryptosporidium parvum
KDSSDFS

SEQ ID NO: 2217250 - protein, 32 aa, Cryptosporidium parvum
KDSSFNENANNISTNNNNRDINTSSSAFDRGE

SEQ ID NO: 2217251 - protein, 11 aa, Cryptosporidium parvum
KDSSSGNTKPI

SEQ ID NO: 2217252 - protein, 17 aa, Cryptosporidium parvum
KDSSSHFSSNSLPSSNE

SEQ ID NO: 2217253 - protein, 8 aa, Cryptosporidium parvum
KDSSSYIP

SEQ ID NO: 2217254 - protein, 4 aa, Cryptosporidium parvum
KDST

SEQ ID NO: 2217255 - protein, 30 aa, Cryptosporidium parvum
KDSTPSKQSTGSKKRNSSNKSSSGTASSNG

SEQ ID NO: 2217256 - protein, 15 aa, Cryptosporidium parvum
KDTDERIHTGNGEFQ

SEQ ID NO: 2217257 - protein, 7 aa, Cryptosporidium parvum
KDTGENI

SEQ ID NO: 2217258 - protein, 10 aa, Cryptosporidium parvum
KDTGSFSGAN

SEQ ID NO: 2217259 - protein, 4 aa, Cryptosporidium parvum
KDTL

SEQ ID NO: 2217260 - protein, 12 aa, Cryptosporidium parvum
KDTNDKSKNNEL

SEQ ID NO: 2217261 - protein, 10 aa, Cryptosporidium parvum
KDTPSVASEF

SEQ ID NO: 2217262 - protein, 6 aa, Cryptosporidium parvum
KDTQHE

SEQ ID NO: 2217263 - protein, 7 aa, Cryptosporidium parvum
KDTRSNL

SEQ ID NO: 2217264 - protein, 19 aa, Cryptosporidium parvum
KDTTETDDQKYNENIPSPE

SEQ ID NO: 2217265 - protein, 7 aa, Cryptosporidium parvum
KDVEEKG

SEQ ID NO: 2217266 - protein, 39 aa, Cryptosporidium parvum
KDVQKNKRKKRRNAIKKKKAKIQNKQISKNKEEQEEEEL

SEQ ID NO: 2217267 - protein, 6 aa, Cryptosporidium parvum
KDVQSE

SEQ ID NO: 2217268 - protein, 18 aa, Cryptosporidium parvum
KDVSSKNNFTKNKKPEDV

SEQ ID NO: 2217269 - protein, 7 aa, Cryptosporidium parvum
KDYGPAT

SEQ ID NO: 2217270 - protein, 5 aa, Cryptosporidium parvum
KDYSF

SEQ ID NO: 2217271 - protein, 6 aa, Cryptosporidium parvum
KDYSND

SEQ ID NO: 2217272 - protein, 4 aa, Cryptosporidium parvum
KEAC

SEQ ID NO: 2217273 - protein, 6 aa, Cryptosporidium parvum
KEADAG

SEQ ID NO: 2217274 - protein, 8 aa, Cryptosporidium parvum
KEAEKRHE

SEQ ID NO: 2217275 - protein, 7 aa, Cryptosporidium parvum
KEAESIA

SEQ ID NO: 2217276 - protein, 8 aa, Cryptosporidium parvum
KEATEPKV

SEQ ID NO: 2217277 - protein, 8 aa, Cryptosporidium parvum
KECKGDQD

SEQ ID NO: 2217278 - protein, 5 aa, Cryptosporidium parvum
KECNT

SEQ ID NO: 2217279 - protein, 8 aa, Cryptosporidium parvum
KECSGGNC

SEQ ID NO: 2217280 - protein, 8 aa, Cryptosporidium parvum
KEDAEKSE

SEQ ID NO: 2217281 - protein, 12 aa, Cryptosporidium parvum
KEDDKKLETISE

SEQ ID NO: 2217282 - protein, 8 aa, Cryptosporidium parvum
KEDDSDDF

SEQ ID NO: 2217283 - protein, 6 aa, Cryptosporidium parvum
KEDFEK

SEQ ID NO: 2217284 - protein, 11 aa, Cryptosporidium parvum
KEDGDSGSGYA

SEQ ID NO: 2217285 - protein, 8 aa, Cryptosporidium parvum
KEDNGKQK

SEQ ID NO: 2217286 - protein, 8 aa, Cryptosporidium parvum
KEDNSYTN

SEQ ID NO: 2217287 - protein, 10 aa, Cryptosporidium parvum
KEDPRTRKDS

SEQ ID NO: 2217288 - protein, 12 aa, Cryptosporidium parvum
KEDQVRKGNGSD

SEQ ID NO: 2217289 - protein, 6 aa, Cryptosporidium parvum
KEDTYI

SEQ ID NO: 2217290 - protein, 4 aa, Cryptosporidium parvum
KEED

SEQ ID NO: 2217291 - protein, 13 aa, Cryptosporidium parvum
KEEDAASKITNAE

SEQ ID NO: 2217292 - protein, 27 aa, Cryptosporidium parvum
KEEDNSLTISSSRNLDNSTEKDSYFTS

SEQ ID NO: 2217293 - protein, 6 aa, Cryptosporidium parvum
KEEEER

SEQ ID NO: 2217294 - protein, 12 aa, Cryptosporidium parvum
KEEEKSLQREEV

SEQ ID NO: 2217295 - protein, 8 aa, Cryptosporidium parvum
KEEESNEK

SEQ ID NO: 2217296 - protein, 7 aa, Cryptosporidium parvum
KEEKSGK

SEQ ID NO: 2217297 - protein, 15 aa, Cryptosporidium parvum
KEELENDSDIKNSDI

SEQ ID NO: 2217298 - protein, 18 aa, Cryptosporidium parvum
KEELKEGIGELDRNQDEE

SEQ ID NO: 2217299 - protein, 16 aa, Cryptosporidium parvum
KEELSSQKTREESQNM

SEQ ID NO: 2217300 - protein, 24 aa, Cryptosporidium parvum
KEELYEKNKEENSSESAPKTVNAH

SEQ ID NO: 2217301 - protein, 6 aa, Cryptosporidium parvum
KEENQK

SEQ ID NO: 2217302 - protein, 11 aa, Cryptosporidium parvum
KEEQKSLQREE

SEQ ID NO: 2217303 - protein, 5 aa, Cryptosporidium parvum
KEETF

SEQ ID NO: 2217304 - protein, 7 aa, Cryptosporidium parvum
KEETKTM

SEQ ID NO: 2217305 - protein, 22 aa, Cryptosporidium parvum
KEEVKPLDETPRQVNKRSGGII

SEQ ID NO: 2217306 - protein, 15 aa, Cryptosporidium parvum
KEEYKNKEMSDSKEI

SEQ ID NO: 2217307 - protein, 6 aa, Cryptosporidium parvum
KEEYSG

SEQ ID NO: 2217308 - protein, 4 aa, Cryptosporidium parvum
KEFE

SEQ ID NO: 2217309 - protein, 9 aa, Cryptosporidium parvum
KEFENLSGN

SEQ ID NO: 2217310 - protein, 5 aa, Cryptosporidium parvum
KEFGE

SEQ ID NO: 2217311 - protein, 14 aa, Cryptosporidium parvum
KEFNRENKQVNKQS

SEQ ID NO: 2217312 - protein, 9 aa, Cryptosporidium parvum
KEFQGRPTP

SEQ ID NO: 2217313 - protein, 5 aa, Cryptosporidium parvum
KEFTN

SEQ ID NO: 2217314 - protein, 7 aa, Cryptosporidium parvum
KEGENQS

SEQ ID NO: 2217315 - protein, 8 aa, Cryptosporidium parvum
KEGGGISI

SEQ ID NO: 2217316 - protein, 6 aa, Cryptosporidium parvum
KEGGNE

SEQ ID NO: 2217317 - protein, 5 aa, Cryptosporidium parvum
KEGKI

SEQ ID NO: 2217318 - protein, 20 aa, Cryptosporidium parvum
KEGKNKNWPPEGPGNESNSI

SEQ ID NO: 2217319 - protein, 5 aa, Cryptosporidium parvum
KEGLD

SEQ ID NO: 2217320 - protein, 6 aa, Cryptosporidium parvum
KEGLEI

SEQ ID NO: 2217321 - protein, 16 aa, Cryptosporidium parvum
KEGNNNFDEREEDNQV

SEQ ID NO: 2217322 - protein, 10 aa, Cryptosporidium parvum
KEGQQAANAA

SEQ ID NO: 2217323 - protein, 7 aa, Cryptosporidium parvum
KEGRVSR

SEQ ID NO: 2217324 - protein, 7 aa, Cryptosporidium parvum
KEGRVTG

SEQ ID NO: 2217325 - protein, 10 aa, Cryptosporidium parvum
KEGSPNSSPA

SEQ ID NO: 2217326 - protein, 6 aa, Cryptosporidium parvum
KEGSSG

SEQ ID NO: 2217327 - protein, 11 aa, Cryptosporidium parvum
KEGVSEENEIN

SEQ ID NO: 2217328 - protein, 5 aa, Cryptosporidium parvum
KEGYN

SEQ ID NO: 2217329 - protein, 15 aa, Cryptosporidium parvum
KEHEIQQSELSSNNS

SEQ ID NO: 2217330 - protein, 4 aa, Cryptosporidium parvum
KEIA

SEQ ID NO: 2217331 - protein, 6 aa, Cryptosporidium parvum
KEIAAA

SEQ ID NO: 2217332 - protein, 16 aa, Cryptosporidium parvum
KEIDLDQNQKNATQKN

SEQ ID NO: 2217333 - protein, 8 aa, Cryptosporidium parvum
KEIDPDSM

SEQ ID NO: 2217334 - protein, 4 aa, Cryptosporidium parvum
KEIE

SEQ ID NO: 2217335 - protein, 12 aa, Cryptosporidium parvum
KEIESKASQEIT

SEQ ID NO: 2217336 - protein, 4 aa, Cryptosporidium parvum
KEIG

SEQ ID NO: 2217337 - protein, 21 aa, Cryptosporidium parvum
KEIKKSKTINVSSVSESQISN

SEQ ID NO: 2217338 - protein, 13 aa, Cryptosporidium parvum
KEIKYSRKSRNHR

SEQ ID NO: 2217339 - protein, 7 aa, Cryptosporidium parvum
KEINDHN

SEQ ID NO: 2217340 - protein, 12 aa, Cryptosporidium parvum
KEIQERKIGNEL

SEQ ID NO: 2217341 - protein, 12 aa, Cryptosporidium parvum
KEIQSKNSTGLI

SEQ ID NO: 2217342 - protein, 6 aa, Cryptosporidium parvum
KEISEK

SEQ ID NO: 2217343 - protein, 8 aa, Cryptosporidium parvum
KEISTKEF

SEQ ID NO: 2217344 - protein, 19 aa, Cryptosporidium parvum
KEKAEDMKEHQGFKSNFIS

SEQ ID NO: 2217345 - protein, 7 aa, Cryptosporidium parvum
KEKANNI

SEQ ID NO: 2217346 - protein, 5 aa, Cryptosporidium parvum
KEKDQ

SEQ ID NO: 2217347 - protein, 23 aa, Cryptosporidium parvum
KEKDTIKSSSLSSPSPSPLPLSP

SEQ ID NO: 2217348 - protein, 5 aa, Cryptosporidium parvum
KEKEL

SEQ ID NO: 2217349 - protein, 21 aa, Cryptosporidium parvum
KEKEQEEERQKAQEEAKRKEF

SEQ ID NO: 2217350 - protein, 8 aa, Cryptosporidium parvum
KEKEQEEL

SEQ ID NO: 2217351 - protein, 19 aa, Cryptosporidium parvum
KEKIKKKINSNKKTKSGLI

SEQ ID NO: 2217352 - protein, 8 aa, Cryptosporidium parvum
KEKISSSL

SEQ ID NO: 2217353 - protein, 4 aa, Cryptosporidium parvum
KEKK

SEQ ID NO: 2217354 - protein, 13 aa, Cryptosporidium parvum
KEKKDPYNPSDFG

SEQ ID NO: 2217355 - protein, 9 aa, Cryptosporidium parvum
KEKKKNSKI

SEQ ID NO: 2217356 - protein, 10 aa, Cryptosporidium parvum
KEKKNYKKCR

SEQ ID NO: 2217357 - protein, 5 aa, Cryptosporidium parvum
KEKNK

SEQ ID NO: 2217358 - protein, 15 aa, Cryptosporidium parvum
KEKNKVKDLKKSQNN

SEQ ID NO: 2217359 - protein, 19 aa, Cryptosporidium parvum
KEKNNENLEENKIEKNTNI

SEQ ID NO: 2217360 - protein, 7 aa, Cryptosporidium parvum
KEKPYDS

SEQ ID NO: 2217361 - protein, 9 aa, Cryptosporidium parvum
KEKRAEGEL

SEQ ID NO: 2217362 - protein, 8 aa, Cryptosporidium parvum
KEKYTKST

SEQ ID NO: 2217363 - protein, 13 aa, Cryptosporidium parvum
KELDKSAIETKNT

SEQ ID NO: 2217364 - protein, 23 aa, Cryptosporidium parvum
KELEQEKEQEKQQEKQQETENAN

SEQ ID NO: 2217365 - protein, 19 aa, Cryptosporidium parvum
KELKIEDDTYEKDQNKIPI

SEQ ID NO: 2217366 - protein, 6 aa, Cryptosporidium parvum
KELNER

SEQ ID NO: 2217367 - protein, 8 aa, Cryptosporidium parvum
KELSRQSG

SEQ ID NO: 2217368 - protein, 7 aa, Cryptosporidium parvum
KELTDDD

SEQ ID NO: 2217369 - protein, 4 aa, Cryptosporidium parvum
KEME

SEQ ID NO: 2217370 - protein, 7 aa, Cryptosporidium parvum
KEMHNKK

SEQ ID NO: 2217371 - protein, 7 aa, Cryptosporidium parvum
KENCNDQ

SEQ ID NO: 2217372 - protein, 11 aa, Cryptosporidium parvum
KENDDQVQDEK

SEQ ID NO: 2217373 - protein, 21 aa, Cryptosporidium parvum
KENDSSKSETESAEKKLKITS

SEQ ID NO: 2217374 - protein, 6 aa, Cryptosporidium parvum
KENEIK

SEQ ID NO: 2217375 - protein, 12 aa, Cryptosporidium parvum
KENEMKKSKFNR

SEQ ID NO: 2217376 - protein, 6 aa, Cryptosporidium parvum
KENHPF

SEQ ID NO: 2217377 - protein, 15 aa, Cryptosporidium parvum
KENKIPSNKVSSDQD

SEQ ID NO: 2217378 - protein, 13 aa, Cryptosporidium parvum
KENKNNQSNKNEN

SEQ ID NO: 2217379 - protein, 19 aa, Cryptosporidium parvum
KENLSKNEDSGKKEGLKEV

SEQ ID NO: 2217380 - protein, 5 aa, Cryptosporidium parvum
KENMN

SEQ ID NO: 2217381 - protein, 5 aa, Cryptosporidium parvum
KENNF

SEQ ID NO: 2217382 - protein, 6 aa, Cryptosporidium parvum
KENNFS

SEQ ID NO: 2217383 - protein, 8 aa, Cryptosporidium parvum
KENPNIKT

SEQ ID NO: 2217384 - protein, 7 aa, Cryptosporidium parvum
KENPRLS

SEQ ID NO: 2217385 - protein, 19 aa, Cryptosporidium parvum
KENRGSDERNGSYKGSDLD

SEQ ID NO: 2217386 - protein, 5 aa, Cryptosporidium parvum
KENRS

SEQ ID NO: 2217387 - protein, 8 aa, Cryptosporidium parvum
KENSKKYL

SEQ ID NO: 2217388 - protein, 5 aa, Cryptosporidium parvum
KENSL

SEQ ID NO: 2217389 - protein, 9 aa, Cryptosporidium parvum
KENTENDNT

SEQ ID NO: 2217390 - protein, 6 aa, Cryptosporidium parvum
KENTKA

SEQ ID NO: 2217391 - protein, 7 aa, Cryptosporidium parvum
KENTNKN

SEQ ID NO: 2217392 - protein, 14 aa, Cryptosporidium parvum
KENYEDDNASTSSD

SEQ ID NO: 2217393 - protein, 8 aa, Cryptosporidium parvum
KENYQGNR

SEQ ID NO: 2217394 - protein, 5 aa, Cryptosporidium parvum
KEPGK

SEQ ID NO: 2217395 - protein, 13 aa, Cryptosporidium parvum
KEQDEMDSESETN

SEQ ID NO: 2217396 - protein, 6 aa, Cryptosporidium parvum
KEQGQM

SEQ ID NO: 2217397 - protein, 18 aa, Cryptosporidium parvum
KEQHKEAKITNKDKYPYA

SEQ ID NO: 2217398 - protein, 6 aa, Cryptosporidium parvum
KEQNKT

SEQ ID NO: 2217399 - protein, 24 aa, Cryptosporidium parvum
KEQNSNVRQESDSKSEKNNTQSSY

SEQ ID NO: 2217400 - protein, 11 aa, Cryptosporidium parvum
KEQSGESGGKY

SEQ ID NO: 2217401 - protein, 9 aa, Cryptosporidium parvum
KEQTVDNST

SEQ ID NO: 2217402 - protein, 5 aa, Cryptosporidium parvum
KEREI

SEQ ID NO: 2217403 - protein, 6 aa, Cryptosporidium parvum
KERFQA

SEQ ID NO: 2217404 - protein, 17 aa, Cryptosporidium parvum
KERKPIKEKKKKQINRD

SEQ ID NO: 2217405 - protein, 25 aa, Cryptosporidium parvum
KERKTYTDEDESDSFSSDENDQQIE

SEQ ID NO: 2217406 - protein, 13 aa, Cryptosporidium parvum
KERPKKDLSESER

SEQ ID NO: 2217407 - protein, 7 aa, Cryptosporidium parvum
KERPNSI

SEQ ID NO: 2217408 - protein, 6 aa, Cryptosporidium parvum
KERREK

SEQ ID NO: 2217409 - protein, 7 aa, Cryptosporidium parvum
KERRNPQ

SEQ ID NO: 2217410 - protein, 9 aa, Cryptosporidium parvum
KERSGTYKR

SEQ ID NO: 2217411 - protein, 6 aa, Cryptosporidium parvum
KERSKI

SEQ ID NO: 2217412 - protein, 8 aa, Cryptosporidium parvum
KERSYNNR

SEQ ID NO: 2217413 - protein, 5 aa, Cryptosporidium parvum
KESAN

SEQ ID NO: 2217414 - protein, 61 aa, Cryptosporidium parvum
KESEGIKSSDFGEDIRNEDNYVQEQEQEQEQDQDQDQDQDQDQSNSAWETKYRKGKRARMN

SEQ ID NO: 2217415 - protein, 8 aa, Cryptosporidium parvum
KESEISEQ

SEQ ID NO: 2217416 - protein, 7 aa, Cryptosporidium parvum
KESESHL

SEQ ID NO: 2217417 - protein, 8 aa, Cryptosporidium parvum
KESGDPQR

SEQ ID NO: 2217418 - protein, 8 aa, Cryptosporidium parvum
KESGSETI

SEQ ID NO: 2217419 - protein, 5 aa, Cryptosporidium parvum
KESHG

SEQ ID NO: 2217420 - protein, 5 aa, Cryptosporidium parvum
KESKN

SEQ ID NO: 2217421 - protein, 8 aa, Cryptosporidium parvum
KESNYSPE

SEQ ID NO: 2217422 - protein, 6 aa, Cryptosporidium parvum
KESPKS

SEQ ID NO: 2217423 - protein, 10 aa, Cryptosporidium parvum
KESPPNGPAK

SEQ ID NO: 2217424 - protein, 14 aa, Cryptosporidium parvum
KESRLTTNEDSGEY

SEQ ID NO: 2217425 - protein, 8 aa, Cryptosporidium parvum
KETAEDGY

SEQ ID NO: 2217426 - protein, 5 aa, Cryptosporidium parvum
KETAN

SEQ ID NO: 2217427 - protein, 7 aa, Cryptosporidium parvum
KETFPDS

SEQ ID NO: 2217428 - protein, 5 aa, Cryptosporidium parvum
KETHE

SEQ ID NO: 2217429 - protein, 5 aa, Cryptosporidium parvum
KETIY

SEQ ID NO: 2217430 - protein, 4 aa, Cryptosporidium parvum
KETK

SEQ ID NO: 2217431 - protein, 9 aa, Cryptosporidium parvum
KETKDEENI

SEQ ID NO: 2217432 - protein, 7 aa, Cryptosporidium parvum
KETKREF

SEQ ID NO: 2217433 - protein, 7 aa, Cryptosporidium parvum
KETNPDS

SEQ ID NO: 2217434 - protein, 7 aa, Cryptosporidium parvum
KETRSRN

SEQ ID NO: 2217435 - protein, 6 aa, Cryptosporidium parvum
KETRSV

SEQ ID NO: 2217436 - protein, 9 aa, Cryptosporidium parvum
KETTSPIEG

SEQ ID NO: 2217437 - protein, 13 aa, Cryptosporidium parvum
KEVARQSVGTASD

SEQ ID NO: 2217438 - protein, 5 aa, Cryptosporidium parvum
KEVEY

SEQ ID NO: 2217439 - protein, 14 aa, Cryptosporidium parvum
KEVLSSNSNSNSIS

SEQ ID NO: 2217440 - protein, 38 aa, Cryptosporidium parvum; identical to SEQ ID NO: 2114971

SEQ ID NO: 2217441 - protein, 5 aa, Cryptosporidium parvum
KEVTE

SEQ ID NO: 2217442 - protein, 5 aa, Cryptosporidium parvum
KEYGD

SEQ ID NO: 2217443 - protein, 13 aa, Cryptosporidium parvum
KEYHFTKSSKDKM

SEQ ID NO: 2217444 - protein, 9 aa, Cryptosporidium parvum
KEYNEDPMG

SEQ ID NO: 2217445 - protein, 10 aa, Cryptosporidium parvum
KEYVPNKSSQ

SEQ ID NO: 2217446 - protein, 6 aa, Cryptosporidium parvum
KFDQDE

SEQ ID NO: 2217447 - protein, 7 aa, Cryptosporidium parvum
KFEKSEG

SEQ ID NO: 2217448 - protein, 15 aa, Cryptosporidium parvum
KFENKSLKSLGPTGV

SEQ ID NO: 2217449 - protein, 22 aa, Cryptosporidium parvum
KFESPETKITENDIETSDEANK

SEQ ID NO: 2217450 - protein, 12 aa, Cryptosporidium parvum
KFGQDSGRGERK

SEQ ID NO: 2217451 - protein, 9 aa, Cryptosporidium parvum
KFKDGNDNS

SEQ ID NO: 2217452 - protein, 10 aa, Cryptosporidium parvum
KFKHENNSSI

SEQ ID NO: 2217453 - protein, 5 aa, Cryptosporidium parvum
KFNPF

SEQ ID NO: 2217454 - protein, 9 aa, Cryptosporidium parvum
KFPAKTSTS

SEQ ID NO: 2217455 - protein, 6 aa, Cryptosporidium parvum
KFPEEK

SEQ ID NO: 2217456 - protein, 5 aa, Cryptosporidium parvum
KFPKE

SEQ ID NO: 2217457 - protein, 6 aa, Cryptosporidium parvum
KFPKRS

SEQ ID NO: 2217458 - protein, 7 aa, Cryptosporidium parvum
KFPPPDT

SEQ ID NO: 2217459 - protein, 5 aa, Cryptosporidium parvum
KFPSD

SEQ ID NO: 2217460 - protein, 12 aa, Cryptosporidium parvum
KFPTKDSEDLHN

SEQ ID NO: 2217461 - protein, 4 aa, Cryptosporidium parvum
KFPW

SEQ ID NO: 2217462 - protein, 11 aa, Cryptosporidium parvum
KFQDQPNEKWP

SEQ ID NO: 2217463 - protein, 6 aa, Cryptosporidium parvum
KFQKSN

SEQ ID NO: 2217464 - protein, 8 aa, Cryptosporidium parvum
KFQSSQNS

SEQ ID NO: 2217465 - protein, 5 aa, Cryptosporidium parvum
KFSEE

SEQ ID NO: 2217466 - protein, 16 aa, Cryptosporidium parvum
KFSNSAPGLSQRNYQD

SEQ ID NO: 2217467 - protein, 6 aa, Cryptosporidium parvum
KFTNNS

SEQ ID NO: 2217468 - protein, 25 aa, Cryptosporidium parvum
KGCEPHNKYDPKLSTSYQKLGDGSL

SEQ ID NO: 2217469 - protein, 9 aa, Cryptosporidium parvum
KGCSPEDRL

SEQ ID NO: 2217470 - protein, 17 aa, Cryptosporidium parvum
KGCSVSPYEEDSVKNPD

SEQ ID NO: 2217471 - protein, 13 aa, Cryptosporidium parvum
KGDAKKWVDIALG

SEQ ID NO: 2217472 - protein, 10 aa, Cryptosporidium parvum
KGDDSGMDHS

SEQ ID NO: 2217473 - protein, 9 aa, Cryptosporidium parvum
KGDESQEDT

SEQ ID NO: 2217474 - protein, 8 aa, Cryptosporidium parvum
KGDEVPSI

SEQ ID NO: 2217475 - protein, 9 aa, Cryptosporidium parvum
KGDLKTSNL

SEQ ID NO: 2217476 - protein, 13 aa, Cryptosporidium parvum
KGDNNDVDDRGLY

SEQ ID NO: 2217477 - protein, 6 aa, Cryptosporidium parvum
KGDPSQ

SEQ ID NO: 2217478 - protein, 21 aa, Cryptosporidium parvum
KGDQTMISGSSNNLSGGQRQR

SEQ ID NO: 2217479 - protein, 4 aa, Cryptosporidium parvum
KGEE

SEQ ID NO: 2217480 - protein, 20 aa, Cryptosporidium parvum
KGEEKTITYEGKSVKSLSDD

SEQ ID NO: 2217481 - protein, 5 aa, Cryptosporidium parvum
KGEIS

SEQ ID NO: 2217482 - protein, 12 aa, Cryptosporidium parvum
KGEKEDKNAKLK

SEQ ID NO: 2217483 - protein, 7 aa, Cryptosporidium parvum
KGEKKVD

SEQ ID NO: 2217484 - protein, 16 aa, Cryptosporidium parvum
KGELNANVSSQSEEEE

SEQ ID NO: 2217485 - protein, 16 aa, Cryptosporidium parvum
KGENKGKARMKPENPP

SEQ ID NO: 2217486 - protein, 6 aa, Cryptosporidium parvum
KGENRP

SEQ ID NO: 2217487 - protein, 5 aa, Cryptosporidium parvum
KGEPD

SEQ ID NO: 2217488 - protein, 6 aa, Cryptosporidium parvum
KGEREQ

SEQ ID NO: 2217489 - protein, 5 aa, Cryptosporidium parvum
KGESF

SEQ ID NO: 2217490 - protein, 8 aa, Cryptosporidium parvum
KGETKKDK

SEQ ID NO: 2217491 - protein, 6 aa, Cryptosporidium parvum
KGFDGK

SEQ ID NO: 2217492 - protein, 5 aa, Cryptosporidium parvum
KGFEG

SEQ ID NO: 2217493 - protein, 5 aa, Cryptosporidium parvum
KGFGT

SEQ ID NO: 2217494 - protein, 7 aa, Cryptosporidium parvum
KGFSSSF

SEQ ID NO: 2217495 - protein, 13 aa, Cryptosporidium parvum
KGFTGDSEENLDN

SEQ ID NO: 2217496 - protein, 4 aa, Cryptosporidium parvum
KGFY

SEQ ID NO: 2217497 - protein, 11 aa, Cryptosporidium parvum
KGGASSFNNNE

SEQ ID NO: 2217498 - protein, 8 aa, Cryptosporidium parvum
KGGDFVSP

SEQ ID NO: 2217499 - protein, 35 aa, Cryptosporidium parvum
KGGKEEDDENEQASLDGTNSEISGIQKESDDLNNV

SEQ ID NO: 2217500 - protein, 8 aa, Cryptosporidium parvum
KGGKISQN

SEQ ID NO: 2217501 - protein, 7 aa, Cryptosporidium parvum
KGGNPTV

SEQ ID NO: 2217502 - protein, 6 aa, Cryptosporidium parvum
KGGNYK

SEQ ID NO: 2217503 - protein, 7 aa, Cryptosporidium parvum
KGGWGIK

SEQ ID NO: 2217504 - protein, 6 aa, Cryptosporidium parvum
KGHKST

SEQ ID NO: 2217505 - protein, 5 aa, Cryptosporidium parvum
KGHLS

SEQ ID NO: 2217506 - protein, 6 aa, Cryptosporidium parvum
KGHNEY

SEQ ID NO: 2217507 - protein, 4 aa, Cryptosporidium parvum
KGHS

SEQ ID NO: 2217508 - protein, 5 aa, Cryptosporidium parvum
KGIGN

SEQ ID NO: 2217509 - protein, 12 aa, Cryptosporidium parvum
KGIKDSSEIEEL

SEQ ID NO: 2217510 - protein, 18 aa, Cryptosporidium parvum
KGIKSDNRGQNTNQQEDI

SEQ ID NO: 2217511 - protein, 10 aa, Cryptosporidium parvum
KGINSEEVTK

SEQ ID NO: 2217512 - protein, 5 aa, Cryptosporidium parvum
KGIPA

SEQ ID NO: 2217513 - protein, 9 aa, Cryptosporidium parvum
KGKQGNLTK

SEQ ID NO: 2217514 - protein, 14 aa, Cryptosporidium parvum
KGKSSYSDKNNNRS

SEQ ID NO: 2217515 - protein, 10 aa, Cryptosporidium parvum
KGKYTFDSPE

SEQ ID NO: 2217516 - protein, 14 aa, Cryptosporidium parvum
KGLDSETDMENQTK

SEQ ID NO: 2217517 - protein, 8 aa, Cryptosporidium parvum
KGLKPDNR

SEQ ID NO: 2217518 - protein, 7 aa, Cryptosporidium parvum
KGLNSKN

SEQ ID NO: 2217519 - protein, 13 aa, Cryptosporidium parvum
KGLSSTSQHKTTF

SEQ ID NO: 2217520 - protein, 5 aa, Cryptosporidium parvum
KGLTR

SEQ ID NO: 2217521 - protein, 12 aa, Cryptosporidium parvum
KGNEVKINGSNK

SEQ ID NO: 2217522 - protein, 8 aa, Cryptosporidium parvum
KGNGNNFE

SEQ ID NO: 2217523 - protein, 7 aa, Cryptosporidium parvum
KGNKQGL

SEQ ID NO: 2217524 - protein, 8 aa, Cryptosporidium parvum
KGNNTDIS

SEQ ID NO: 2217525 - protein, 11 aa, Cryptosporidium parvum
KGNPKNKESGE

SEQ ID NO: 2217526 - protein, 6 aa, Cryptosporidium parvum
KGNSTM

SEQ ID NO: 2217527 - protein, 15 aa, Cryptosporidium parvum
KGPASLKMKSGSTFA

SEQ ID NO: 2217528 - protein, 4 aa, Cryptosporidium parvum
KGPI

SEQ ID NO: 2217529 - protein, 7 aa, Cryptosporidium parvum
KGPQVSP

SEQ ID NO: 2217530 - protein, 7 aa, Cryptosporidium parvum
KGQDKEV

SEQ ID NO: 2217531 - protein, 13 aa, Cryptosporidium parvum
KGQECRDDPQVEE

SEQ ID NO: 2217532 - protein, 5 aa, Cryptosporidium parvum
KGQLT

SEQ ID NO: 2217533 - protein, 19 aa, Cryptosporidium parvum
KGRCEDNESDIESCNEQSC

SEQ ID NO: 2217534 - protein, 24 aa, Cryptosporidium parvum
KGRKNYKGEKTASEGKGLRQKGVL

SEQ ID NO: 2217535 - protein, 19 aa, Cryptosporidium parvum
KGRRLPYGKNDKRLNEIPE

SEQ ID NO: 2217536 - protein, 5 aa, Cryptosporidium parvum
KGRSA

SEQ ID NO: 2217537 - protein, 13 aa, Cryptosporidium parvum
KGRTSGYSDPENS

SEQ ID NO: 2217538 - protein, 9 aa, Cryptosporidium parvum
KGRVKESQL

SEQ ID NO: 2217539 - protein, 13 aa, Cryptosporidium parvum
KGSDTKYKTEESR

SEQ ID NO: 2217540 - protein, 5 aa, Cryptosporidium parvum
KGSLT

SEQ ID NO: 2217541 - protein, 4 aa, Cryptosporidium parvum
KGSN

SEQ ID NO: 2217542 - protein, 7 aa, Cryptosporidium parvum
KGSNPQI

SEQ ID NO: 2217543 - protein, 7 aa, Cryptosporidium parvum
KGSNQPL

SEQ ID NO: 2217544 - protein, 9 aa, Cryptosporidium parvum
KGSNYQENV

SEQ ID NO: 2217545 - protein, 5 aa, Cryptosporidium parvum
KGSPE

SEQ ID NO: 2217546 - protein, 10 aa, Cryptosporidium parvum
KGSQSSFPTI

SEQ ID NO: 2217547 - protein, 35 aa, Cryptosporidium parvum
KGSRVSDIKEDNTLSKASDKIDHRNNRDQSVSGIR

SEQ ID NO: 2217548 - protein, 9 aa, Cryptosporidium parvum
KGSSSKFPF

SEQ ID NO: 2217549 - protein, 12 aa, Cryptosporidium parvum
KGSSSKGGSKPF

SEQ ID NO: 2217550 - protein, 5 aa, Cryptosporidium parvum
KGSTK

SEQ ID NO: 2217551 - protein, 7 aa, Cryptosporidium parvum
KGSVSGW

SEQ ID NO: 2217552 - protein, 7 aa, Cryptosporidium parvum
KGSYDQL

SEQ ID NO: 2217553 - protein, 6 aa, Cryptosporidium parvum
KGTEMS

SEQ ID NO: 2217554 - protein, 14 aa, Cryptosporidium parvum
KGTESYADGFSFFE

SEQ ID NO: 2217555 - protein, 6 aa, Cryptosporidium parvum
KGTKGY

SEQ ID NO: 2217556 - protein, 8 aa, Cryptosporidium parvum
KGTLTQED

SEQ ID NO: 2217557 - protein, 4 aa, Cryptosporidium parvum
KGTP

SEQ ID NO: 2217558 - protein, 4 aa, Cryptosporidium parvum
KGTR

SEQ ID NO: 2217559 - protein, 8 aa, Cryptosporidium parvum
KGTSPKLA

SEQ ID NO: 2217560 - protein, 18 aa, Cryptosporidium parvum
KGWQSPSLSITPSSPKTF

SEQ ID NO: 2217561 - protein, 5 aa, Cryptosporidium parvum
KGYDK

SEQ ID NO: 2217562 - protein, 4 aa, Cryptosporidium parvum
KGYS

SEQ ID NO: 2217563 - protein, 14 aa, Cryptosporidium parvum
KHANNKSKNKRNAA

SEQ ID NO: 2217564 - protein, 10 aa, Cryptosporidium parvum
KHDDSVPNKK

SEQ ID NO: 2217565 - protein, 10 aa, Cryptosporidium parvum
KHDSNTEQVE

SEQ ID NO: 2217566 - protein, 14 aa, Cryptosporidium parvum
KHEGRAYNNYENKN

SEQ ID NO: 2217567 - protein, 17 aa, Cryptosporidium parvum
KHEKARKEAHNGPSLSQ

SEQ ID NO: 2217568 - protein, 28 aa, Cryptosporidium parvum
KHESRPSFGVESRNSSAEREKEKVSGVG

SEQ ID NO: 2217569 - protein, 4 aa, Cryptosporidium parvum
KHFN

SEQ ID NO: 2217570 - protein, 12 aa, Cryptosporidium parvum
KHGENEKSSIQE

SEQ ID NO: 2217571 - protein, 12 aa, Cryptosporidium parvum
KHGNLSLQNHLN

SEQ ID NO: 2217572 - protein, 8 aa, Cryptosporidium parvum
KHIKKSQK

SEQ ID NO: 2217573 - protein, 7 aa, Cryptosporidium parvum
KHISNKQ

SEQ ID NO: 2217574 - protein, 14 aa, Cryptosporidium parvum
KHISNSDNKASSVK

SEQ ID NO: 2217575 - protein, 15 aa, Cryptosporidium parvum
KHKGKISHPISSNNN

SEQ ID NO: 2217576 - protein, 16 aa, Cryptosporidium parvum
KHKKRKEKYGISGSEY

SEQ ID NO: 2217577 - protein, 6 aa, Cryptosporidium parvum
KHKNGK

SEQ ID NO: 2217578 - protein, 6 aa, Cryptosporidium parvum
KHKQIT

SEQ ID NO: 2217579 - protein, 15 aa, Cryptosporidium parvum
KHLERPPSVDDFPDE

SEQ ID NO: 2217580 - protein, 7 aa, Cryptosporidium parvum
KHNGLQG

SEQ ID NO: 2217581 - protein, 7 aa, Cryptosporidium parvum
KHNNDLR

SEQ ID NO: 2217582 - protein, 6 aa, Cryptosporidium parvum
KHPDPL

SEQ ID NO: 2217583 - protein, 8 aa, Cryptosporidium parvum
KHPQTSTS

SEQ ID NO: 2217584 - protein, 6 aa, Cryptosporidium parvum
KHPTAD

SEQ ID NO: 2217585 - protein, 13 aa, Cryptosporidium parvum
KHPTISKTNHNDL

SEQ ID NO: 2217586 - protein, 4 aa, Cryptosporidium parvum
KHPY

SEQ ID NO: 2217587 - protein, 5 aa, Cryptosporidium parvum
KHQGP

SEQ ID NO: 2217588 - protein, 8 aa, Cryptosporidium parvum
KHSENIKK

SEQ ID NO: 2217589 - protein, 4 aa, Cryptosporidium parvum
KHSG

SEQ ID NO: 2217590 - protein, 13 aa, Cryptosporidium parvum
KHSKKNKDTSETN

SEQ ID NO: 2217591 - protein, 4 aa, Cryptosporidium parvum
KHSL

SEQ ID NO: 2217592 - protein, 8 aa, Cryptosporidium parvum
KHSPSKKA

SEQ ID NO: 2217593 - protein, 9 aa, Cryptosporidium parvum
KHTEISKTT

SEQ ID NO: 2217594 - protein, 6 aa, Cryptosporidium parvum
KHTEPS

SEQ ID NO: 2217595 - protein, 11 aa, Cryptosporidium parvum
KHTIDKSKNIK

SEQ ID NO: 2217596 - protein, 11 aa, Cryptosporidium parvum
KHTSNSKSVCN

SEQ ID NO: 2217597 - protein, 4 aa, Cryptosporidium parvum
KHWG

SEQ ID NO: 2217598 - protein, 15 aa, Cryptosporidium parvum
KHYSGSPEDFDENEK

SEQ ID NO: 2217599 - protein, 5 aa, Cryptosporidium parvum
KIDDE

SEQ ID NO: 2217600 - protein, 5 aa, Cryptosporidium parvum
KIDDS

SEQ ID NO: 2217601 - protein, 6 aa, Cryptosporidium parvum
KIDIND

SEQ ID NO: 2217602 - protein, 19 aa, Cryptosporidium parvum
KIDKNEKERKLNRRKREER

SEQ ID NO: 2217603 - protein, 5 aa, Cryptosporidium parvum
KIDPE

SEQ ID NO: 2217604 - protein, 13 aa, Cryptosporidium parvum
KIDQIPDNLFGED

SEQ ID NO: 2217605 - protein, 19 aa, Cryptosporidium parvum
KIDSEISQGEYNEKLNESY

SEQ ID NO: 2217606 - protein, 6 aa, Cryptosporidium parvum
KIDSHS

SEQ ID NO: 2217607 - protein, 11 aa, Cryptosporidium parvum
KIDSKNEQSQI

SEQ ID NO: 2217608 - protein, 14 aa, Cryptosporidium parvum
KIEDSDNKSKSNLK

SEQ ID NO: 2217609 - protein, 6 aa, Cryptosporidium parvum
KIEKEE

SEQ ID NO: 2217610 - protein, 5 aa, Cryptosporidium parvum
KIENL

SEQ ID NO: 2217611 - protein, 5 aa, Cryptosporidium parvum
KIENR

SEQ ID NO: 2217612 - protein, 9 aa, Cryptosporidium parvum
KIGGKTGEN

SEQ ID NO: 2217613 - protein, 21 aa, Cryptosporidium parvum
KIGKDSLDLDSEASVSTEDYQ

SEQ ID NO: 2217614 - protein, 4 aa, Cryptosporidium parvum
KIGS

SEQ ID NO: 2217615 - protein, 5 aa, Cryptosporidium parvum
KIIPG

SEQ ID NO: 2217616 - protein, 7 aa, Cryptosporidium parvum
KIKDEKI

SEQ ID NO: 2217617 - protein, 7 aa, Cryptosporidium parvum
KIKEKSD

SEQ ID NO: 2217618 - protein, 10 aa, Cryptosporidium parvum
KIKGSGNRRQ

SEQ ID NO: 2217619 - protein, 13 aa, Cryptosporidium parvum
KIKKSSKSTKPEF

SEQ ID NO: 2217620 - protein, 9 aa, Cryptosporidium parvum
KIKNGKNDG

SEQ ID NO: 2217621 - protein, 27 aa, Cryptosporidium parvum
KIKNQDNNNNNNTTLVPNGNDKSSIKT

SEQ ID NO: 2217622 - protein, 9 aa, Cryptosporidium parvum
KIKNQQREF

SEQ ID NO: 2217623 - protein, 18 aa, Cryptosporidium parvum
KIKSGYRRDSVPVSNASI

SEQ ID NO: 2217624 - protein, 5 aa, Cryptosporidium parvum
KIKTT

SEQ ID NO: 2217625 - protein, 5 aa, Cryptosporidium parvum
KINDE

SEQ ID NO: 2217626 - protein, 11 aa, Cryptosporidium parvum
KINGSQKKVTS

SEQ ID NO: 2217627 - protein, 11 aa, Cryptosporidium parvum
KINKDRGSERV

SEQ ID NO: 2217628 - protein, 6 aa, Cryptosporidium parvum
KINKEK

SEQ ID NO: 2217629 - protein, 4 aa, Cryptosporidium parvum
KINP

SEQ ID NO: 2217630 - protein, 4 aa, Cryptosporidium parvum
KIPD

SEQ ID NO: 2217631 - protein, 7 aa, Cryptosporidium parvum
KIPDTSE

SEQ ID NO: 2217632 - protein, 6 aa, Cryptosporidium parvum
KIPIET

SEQ ID NO: 2217633 - protein, 12 aa, Cryptosporidium parvum
KIPIQKNKKELE

SEQ ID NO: 2217634 - protein, 7 aa, Cryptosporidium parvum
KIPPEPK

SEQ ID NO: 2217635 - protein, 7 aa, Cryptosporidium parvum
KIQNSGF

SEQ ID NO: 2217636 - protein, 6 aa, Cryptosporidium parvum
KIQPIP

SEQ ID NO: 2217637 - protein, 10 aa, Cryptosporidium parvum
KIQSKSRPEV

SEQ ID NO: 2217638 - protein, 5 aa, Cryptosporidium parvum
KIRGT

SEQ ID NO: 2217639 - protein, 9 aa, Cryptosporidium parvum
KIRSNARAE

SEQ ID NO: 2217640 - protein, 6 aa, Cryptosporidium parvum
KISCEN

SEQ ID NO: 2217641 - protein, 18 aa, Cryptosporidium parvum
KISDSNPVGKGREPPNVD

SEQ ID NO: 2217642 - protein, 6 aa, Cryptosporidium parvum
KISEQV

SEQ ID NO: 2217643 - protein, 7 aa, Cryptosporidium parvum
KISETSN

SEQ ID NO: 2217644 - protein, 31 aa, Cryptosporidium parvum
KISNGDSAEKNTSDKATANNFSNNRAEDISS

SEQ ID NO: 2217645 - protein, 5 aa, Cryptosporidium parvum
KISNN

SEQ ID NO: 2217646 - protein, 10 aa, Cryptosporidium parvum
KISPPEDFTP

SEQ ID NO: 2217647 - protein, 4 aa, Cryptosporidium parvum
KISQ

SEQ ID NO: 2217648 - protein, 6 aa, Cryptosporidium parvum
KISQKF

SEQ ID NO: 2217649 - protein, 6 aa, Cryptosporidium parvum
KISRSS

SEQ ID NO: 2217650 - protein, 8 aa, Cryptosporidium parvum
KISSKGNN

SEQ ID NO: 2217651 - protein, 9 aa, Cryptosporidium parvum
KISSTDSNN

SEQ ID NO: 2217652 - protein, 9 aa, Cryptosporidium parvum
KISTSSKRI

SEQ ID NO: 2217653 - protein, 4 aa, Cryptosporidium parvum
KISV

SEQ ID NO: 2217654 - protein, 9 aa, Cryptosporidium parvum
KITARSSVE

SEQ ID NO: 2217655 - protein, 15 aa, Cryptosporidium parvum
KITGNHSSTNNSGDL

SEQ ID NO: 2217656 - protein, 6 aa, Cryptosporidium parvum
KITGYY

SEQ ID NO: 2217657 - protein, 28 aa, Cryptosporidium parvum
KITPPPTNNNKSNIGNNFNQDNSSGIEL

SEQ ID NO: 2217658 - protein, 6 aa, Cryptosporidium parvum
KITSST

SEQ ID NO: 2217659 - protein, 30 aa, Cryptosporidium parvum
KIVEGERKTIEKSVKAQEKSYIENGKSSLE

SEQ ID NO: 2217660 - protein, 7 aa, Cryptosporidium parvum
KKADSCD

SEQ ID NO: 2217661 - protein, 16 aa, Cryptosporidium parvum
KKAELDEYQKMLSKTG

SEQ ID NO: 2217662 - protein, 6 aa, Cryptosporidium parvum
KKAEVN

SEQ ID NO: 2217663 - protein, 6 aa, Cryptosporidium parvum
KKAEWA

SEQ ID NO: 2217664 - protein, 7 aa, Cryptosporidium parvum
KKAFENK

SEQ ID NO: 2217665 - protein, 4 aa, Cryptosporidium parvum
KKAG

SEQ ID NO: 2217666 - protein, 8 aa, Cryptosporidium parvum
KKALANSK

SEQ ID NO: 2217667 - protein, 11 aa, Cryptosporidium parvum
KKAQFSESHKT

SEQ ID NO: 2217668 - protein, 8 aa, Cryptosporidium parvum
KKASEELY

SEQ ID NO: 2217669 - protein, 24 aa, Cryptosporidium parvum
KKCQQGDLDSSNPKKKEDEVDEDD

SEQ ID NO: 2217670 - protein, 8 aa, Cryptosporidium parvum
KKDAMENQ

SEQ ID NO: 2217671 - protein, 11 aa, Cryptosporidium parvum
KKDDPSTEISG

SEQ ID NO: 2217672 - protein, 16 aa, Cryptosporidium parvum
KKDEGDIKSKVNYDTK

SEQ ID NO: 2217673 - protein, 26 aa, Cryptosporidium parvum
KKDENESNGDGDENSNIGGNNINNEN

SEQ ID NO: 2217674 - protein, 10 aa, Cryptosporidium parvum
KKDGKKYPKL

SEQ ID NO: 2217675 - protein, 7 aa, Cryptosporidium parvum
KKDKSYL

SEQ ID NO: 2217676 - protein, 11 aa, Cryptosporidium parvum
KKDNKTSNSVR

SEQ ID NO: 2217677 - protein, 8 aa, Cryptosporidium parvum
KKDQSNAF

SEQ ID NO: 2217678 - protein, 6 aa, Cryptosporidium parvum
KKDTLS

SEQ ID NO: 2217679 - protein, 5 aa, Cryptosporidium parvum
KKDTS

SEQ ID NO: 2217680 - protein, 5 aa, Cryptosporidium parvum
KKDVY

SEQ ID NO: 2217681 - protein, 13 aa, Cryptosporidium parvum
KKEDGISLSNNSS

SEQ ID NO: 2217682 - protein, 8 aa, Cryptosporidium parvum
KKEEAGLK

SEQ ID NO: 2217683 - protein, 14 aa, Cryptosporidium parvum
KKEEEPPKNKNDQL

SEQ ID NO: 2217684 - protein, 11 aa, Cryptosporidium parvum
KKEEINSDKDN

SEQ ID NO: 2217685 - protein, 10 aa, Cryptosporidium parvum
KKEEKNYVEN

SEQ ID NO: 2217686 - protein, 8 aa, Cryptosporidium parvum
KKEESMRM

SEQ ID NO: 2217687 - protein, 18 aa, Cryptosporidium parvum
KKEESSEVGRISNSSTYR

SEQ ID NO: 2217688 - protein, 14 aa, Cryptosporidium parvum
KKEFPKSTPSGSQI

SEQ ID NO: 2217689 - protein, 13 aa, Cryptosporidium parvum
KKEGKTNGNATTP

SEQ ID NO: 2217690 - protein, 7 aa, Cryptosporidium parvum
KKEGYPE

SEQ ID NO: 2217691 - protein, 9 aa, Cryptosporidium parvum
KKEIDVRSS

SEQ ID NO: 2217692 - protein, 6 aa, Cryptosporidium parvum
KKEIQS

SEQ ID NO: 2217693 - protein, 10 aa, Cryptosporidium parvum
KKEKERNEKN

SEQ ID NO: 2217694 - protein, 29 aa, Cryptosporidium parvum
KKEKKNTGEHGNNSNNNKQEERPLDDPTR

SEQ ID NO: 2217695 - protein, 15 aa, Cryptosporidium parvum
KKELESTERNGFGSK

SEQ ID NO: 2217696 - protein, 5 aa, Cryptosporidium parvum
KKELN

SEQ ID NO: 2217697 - protein, 8 aa, Cryptosporidium parvum
KKENESEK

SEQ ID NO: 2217698 - protein, 7 aa, Cryptosporidium parvum
KKENGSI

SEQ ID NO: 2217699 - protein, 6 aa, Cryptosporidium parvum
KKENSL

SEQ ID NO: 2217700 - protein, 5 aa, Cryptosporidium parvum
KKEPL

SEQ ID NO: 2217701 - protein, 7 aa, Cryptosporidium parvum
KKEQNRI

SEQ ID NO: 2217702 - protein, 7 aa, Cryptosporidium parvum
KKERMTN

SEQ ID NO: 2217703 - protein, 23 aa, Cryptosporidium parvum
KKERSKKNDESTKKGNDISSSIS

SEQ ID NO: 2217704 - protein, 6 aa, Cryptosporidium parvum
KKESNI

SEQ ID NO: 2217705 - protein, 7 aa, Cryptosporidium parvum
KKESTDI

SEQ ID NO: 2217706 - protein, 4 aa, Cryptosporidium parvum
KKET

SEQ ID NO: 2217707 - protein, 6 aa, Cryptosporidium parvum
KKETKS

SEQ ID NO: 2217708 - protein, 5 aa, Cryptosporidium parvum
KKEYP

SEQ ID NO: 2217709 - protein, 13 aa, Cryptosporidium parvum
KKEYQSSIERTNA

SEQ ID NO: 2217710 - protein, 12 aa, Cryptosporidium parvum
KKFKSKEYIENK

SEQ ID NO: 2217711 - protein, 7 aa, Cryptosporidium parvum
KKFRSSK

SEQ ID NO: 2217712 - protein, 5 aa, Cryptosporidium parvum
KKGAE

SEQ ID NO: 2217713 - protein, 10 aa, Cryptosporidium parvum
KKGDTNGGYG

SEQ ID NO: 2217714 - protein, 6 aa, Cryptosporidium parvum
KKGFDS

SEQ ID NO: 2217715 - protein, 7 aa, Cryptosporidium parvum
KKGKDVL

SEQ ID NO: 2217716 - protein, 7 aa, Cryptosporidium parvum
KKGKEWG

SEQ ID NO: 2217717 - protein, 7 aa, Cryptosporidium parvum
KKGKTAV

SEQ ID NO: 2217718 - protein, 4 aa, Cryptosporidium parvum
KKGL

SEQ ID NO: 2217719 - protein, 8 aa, Cryptosporidium parvum
KKGNSKIS

SEQ ID NO: 2217720 - protein, 6 aa, Cryptosporidium parvum
KKGQRY

SEQ ID NO: 2217721 - protein, 5 aa, Cryptosporidium parvum
KKGTK

SEQ ID NO: 2217722 - protein, 6 aa, Cryptosporidium parvum
KKGTQA

SEQ ID NO: 2217723 - protein, 6 aa, Cryptosporidium parvum
KKGVTT

SEQ ID NO: 2217724 - protein, 7 aa, Cryptosporidium parvum
KKHCSSE

SEQ ID NO: 2217725 - protein, 17 aa, Cryptosporidium parvum
KKHGKSSKQDESDNEQQ

SEQ ID NO: 2217726 - protein, 7 aa, Cryptosporidium parvum
KKHGSTF

SEQ ID NO: 2217727 - protein, 4 aa, Cryptosporidium parvum
KKHS

SEQ ID NO: 2217728 - protein, 7 aa, Cryptosporidium parvum
KKHSREK

SEQ ID NO: 2217729 - protein, 27 aa, Cryptosporidium parvum
KKIAAKKNKIKEEKENTSKGESNYDNA

SEQ ID NO: 2217730 - protein, 12 aa, Cryptosporidium parvum
KKIDEQPKDGGL

SEQ ID NO: 2217731 - protein, 10 aa, Cryptosporidium parvum
KKINKSPDKR

SEQ ID NO: 2217732 - protein, 10 aa, Cryptosporidium parvum
KKINSRIKED

SEQ ID NO: 2217733 - protein, 6 aa, Cryptosporidium parvum
KKITDK

SEQ ID NO: 2217734 - protein, 10 aa, Cryptosporidium parvum
KKKAGRINPP

SEQ ID NO: 2217735 - protein, 7 aa, Cryptosporidium parvum
KKKASTL

SEQ ID NO: 2217736 - protein, 7 aa, Cryptosporidium parvum
KKKDDKF

SEQ ID NO: 2217737 - protein, 6 aa, Cryptosporidium parvum
KKKDNC

SEQ ID NO: 2217738 - protein, 8 aa, Cryptosporidium parvum
KKKEANGK

SEQ ID NO: 2217739 - protein, 11 aa, Cryptosporidium parvum
KKKEFPDTREN

SEQ ID NO: 2217740 - protein, 8 aa, Cryptosporidium parvum
KKKEIQNK

SEQ ID NO: 2217741 - protein, 9 aa, Cryptosporidium parvum
KKKEKEKRI

SEQ ID NO: 2217742 - protein, 23 aa, Cryptosporidium parvum
KKKETRTNLNQSQNNPSGSSSSY

SEQ ID NO: 2217743 - protein, 5 aa, Cryptosporidium parvum
KKKFP

SEQ ID NO: 2217744 - protein, 7 aa, Cryptosporidium parvum
KKKHKED

SEQ ID NO: 2217745 - protein, 4 aa, Cryptosporidium parvum
KKKI

SEQ ID NO: 2217746 - protein, 5 aa, Cryptosporidium parvum
KKKID

SEQ ID NO: 2217747 - protein, 5 aa, Cryptosporidium parvum
KKKIH

SEQ ID NO: 2217748 - protein, 26 aa, Cryptosporidium parvum
KKKKKKKKKKNQWEKSKGDAENDAKA

SEQ ID NO: 2217749 - protein, 77 aa, Cryptosporidium parvum
KKKKSKSKNKEEKKRKKKEEKERKKQEKEKKKQEKASAKAQAKEMKKKDKEDEREIKNLGKKDNVPSKEVSKKLKEL

SEQ ID NO: 2217750 - protein, 4 aa, Cryptosporidium parvum
KKKL

SEQ ID NO: 2217751 - protein, 9 aa, Cryptosporidium parvum
KKKNKTSFS

SEQ ID NO: 2217752 - protein, 5 aa, Cryptosporidium parvum
KKKNS

SEQ ID NO: 2217753 - protein, 19 aa, Cryptosporidium parvum
KKKNSNNSKNNKKKKNKRS

SEQ ID NO: 2217754 - protein, 8 aa, Cryptosporidium parvum
KKKPYSKI

SEQ ID NO: 2217755 - protein, 4 aa, Cryptosporidium parvum
KKKQ

SEQ ID NO: 2217756 - protein, 11 aa, Cryptosporidium parvum
KKKQKNTKTSR

SEQ ID NO: 2217757 - protein, 6 aa, Cryptosporidium parvum
KKKSAY

SEQ ID NO: 2217758 - protein, 8 aa, Cryptosporidium parvum
KKKSENVS

SEQ ID NO: 2217759 - protein, 7 aa, Cryptosporidium parvum
KKKSEQE

SEQ ID NO: 2217760 - protein, 6 aa, Cryptosporidium parvum
KKKSIP

SEQ ID NO: 2217761 - protein, 39 aa, Cryptosporidium parvum
KKKSKVSNPKGEESEIEESDNDDNNDDSDDSSDDDDNDD

SEQ ID NO: 2217762 - protein, 6 aa, Cryptosporidium parvum
KKLESD

SEQ ID NO: 2217763 - protein, 7 aa, Cryptosporidium parvum
KKLETTI

SEQ ID NO: 2217764 - protein, 6 aa, Cryptosporidium parvum
KKLGHE

SEQ ID NO: 2217765 - protein, 8 aa, Cryptosporidium parvum
KKLNYEAE

SEQ ID NO: 2217766 - protein, 15 aa, Cryptosporidium parvum
KKLPKTNTSNVEGGD

SEQ ID NO: 2217767 - protein, 9 aa, Cryptosporidium parvum
KKLSKYNNS

SEQ ID NO: 2217768 - protein, 7 aa, Cryptosporidium parvum
KKLSSNS

SEQ ID NO: 2217769 - protein, 7 aa, Cryptosporidium parvum
KKLTENE

SEQ ID NO: 2217770 - protein, 5 aa, Cryptosporidium parvum
KKLTY

SEQ ID NO: 2217771 - protein, 6 aa, Cryptosporidium parvum
KKMEKR

SEQ ID NO: 2217772 - protein, 7 aa, Cryptosporidium parvum
KKMKERL

SEQ ID NO: 2217773 - protein, 8 aa, Cryptosporidium parvum
KKMKGGEI

SEQ ID NO: 2217774 - protein, 7 aa, Cryptosporidium parvum
KKMTESF

SEQ ID NO: 2217775 - protein, 17 aa, Cryptosporidium parvum
KKNAFKKQGGDSLGGHS

SEQ ID NO: 2217776 - protein, 4 aa, Cryptosporidium parvum
KKNE

SEQ ID NO: 2217777 - protein, 8 aa, Cryptosporidium parvum
KKNEESDL

SEQ ID NO: 2217778 - protein, 6 aa, Cryptosporidium parvum
KKNELE

SEQ ID NO: 2217779 - protein, 7 aa, Cryptosporidium parvum
KKNENLK

SEQ ID NO: 2217780 - protein, 26 aa, Cryptosporidium parvum
KKNHKNDQNGIDPNKIGKYKNKGRRI

SEQ ID NO: 2217781 - protein, 22 aa, Cryptosporidium parvum
KKNIRQISNKEEDDQSNSINNL

SEQ ID NO: 2217782 - protein, 14 aa, Cryptosporidium parvum
KKNLTKIGPNDPTS

SEQ ID NO: 2217783 - protein, 8 aa, Cryptosporidium parvum
KKNMNESR

SEQ ID NO: 2217784 - protein, 7 aa, Cryptosporidium parvum
KKNNSIN

SEQ ID NO: 2217785 - protein, 27 aa, Cryptosporidium parvum
KKNQISDTSSNQSYESPDLSDRIETKA

SEQ ID NO: 2217786 - protein, 7 aa, Cryptosporidium parvum
KKNQKSN

SEQ ID NO: 2217787 - protein, 13 aa, Cryptosporidium parvum
KKNSELLSFSKLE

SEQ ID NO: 2217788 - protein, 5 aa, Cryptosporidium parvum
KKNSY

SEQ ID NO: 2217789 - protein, 9 aa, Cryptosporidium parvum
KKNTSEDDK

SEQ ID NO: 2217790 - protein, 17 aa, Cryptosporidium parvum
KKNTSLKKQRRSNSTEI

SEQ ID NO: 2217791 - protein, 8 aa, Cryptosporidium parvum
KKNTSSSE

SEQ ID NO: 2217792 - protein, 10 aa, Cryptosporidium parvum
KKNVKESKIY

SEQ ID NO: 2217793 - protein, 6 aa, Cryptosporidium parvum
KKNYEN

SEQ ID NO: 2217794 - protein, 4 aa, Cryptosporidium parvum
KKPA

SEQ ID NO: 2217795 - protein, 7 aa, Cryptosporidium parvum
KKPLEGE

SEQ ID NO: 2217796 - protein, 7 aa, Cryptosporidium parvum
KKPLNET

SEQ ID NO: 2217797 - protein, 6 aa, Cryptosporidium parvum
KKPNCK

SEQ ID NO: 2217798 - protein, 7 aa, Cryptosporidium parvum
KKPPNVE

SEQ ID NO: 2217799 - protein, 10 aa, Cryptosporidium parvum
KKPSSVENQD

SEQ ID NO: 2217800 - protein, 6 aa, Cryptosporidium parvum
KKPVDF

SEQ ID NO: 2217801 - protein, 6 aa, Cryptosporidium parvum
KKQCNG

SEQ ID NO: 2217802 - protein, 16 aa, Cryptosporidium parvum
KKQEDSEGVKKEYKDG

SEQ ID NO: 2217803 - protein, 6 aa, Cryptosporidium parvum
KKQETV

SEQ ID NO: 2217804 - protein, 6 aa, Cryptosporidium parvum
KKQFES

SEQ ID NO: 2217805 - protein, 10 aa, Cryptosporidium parvum
KKQGDQPRYG

SEQ ID NO: 2217806 - protein, 4 aa, Cryptosporidium parvum
KKQL

SEQ ID NO: 2217807 - protein, 12 aa, Cryptosporidium parvum
KKQNNQQEKQNV

SEQ ID NO: 2217808 - protein, 8 aa, Cryptosporidium parvum
KKQNQKDE

SEQ ID NO: 2217809 - protein, 10 aa, Cryptosporidium parvum
KKQSGAPKRV

SEQ ID NO: 2217810 - protein, 9 aa, Cryptosporidium parvum
KKQTEDLTA

SEQ ID NO: 2217811 - protein, 6 aa, Cryptosporidium parvum
KKRAGS

SEQ ID NO: 2217812 - protein, 18 aa, Cryptosporidium parvum
KKREKELREKRKKYRSPL

SEQ ID NO: 2217813 - protein, 7 aa, Cryptosporidium parvum
KKRHGFT

SEQ ID NO: 2217814 - protein, 7 aa, Cryptosporidium parvum
KKRITKN

SEQ ID NO: 2217815 - protein, 21 aa, Cryptosporidium parvum
KKRKDQQEKDDDMDSPSQSDE

SEQ ID NO: 2217816 - protein, 14 aa, Cryptosporidium parvum
KKRKNRIYEHLYKE

SEQ ID NO: 2217817 - protein, 10 aa, Cryptosporidium parvum
KKRNSNSDQQ

SEQ ID NO: 2217818 - protein, 7 aa, Cryptosporidium parvum
KKRNTAY

SEQ ID NO: 2217819 - protein, 8 aa, Cryptosporidium parvum
KKRPHNND

SEQ ID NO: 2217820 - protein, 4 aa, Cryptosporidium parvum
KKRS

SEQ ID NO: 2217821 - protein, 11 aa, Cryptosporidium parvum
KKRSQDHITTQ

SEQ ID NO: 2217822 - protein, 24 aa, Cryptosporidium parvum
KKRTGEETKKETEAKGDAEVGIEG

SEQ ID NO: 2217823 - protein, 9 aa, Cryptosporidium parvum
KKSDENSGR

SEQ ID NO: 2217824 - protein, 6 aa, Cryptosporidium parvum
KKSDFY

SEQ ID NO: 2217825 - protein, 8 aa, Cryptosporidium parvum
KKSDYPKF

SEQ ID NO: 2217826 - protein, 7 aa, Cryptosporidium parvum
KKSENDE

SEQ ID NO: 2217827 - protein, 8 aa, Cryptosporidium parvum
KKSFKGKS

SEQ ID NO: 2217828 - protein, 9 aa, Cryptosporidium parvum
KKSHRETNY

SEQ ID NO: 2217829 - protein, 15 aa, Cryptosporidium parvum
KKSKKNKKLGKKNSG

SEQ ID NO: 2217830 - protein, 14 aa, Cryptosporidium parvum
KKSKKPIQNGESIE

SEQ ID NO: 2217831 - protein, 6 aa, Cryptosporidium parvum
KKSKYF

SEQ ID NO: 2217832 - protein, 4 aa, Cryptosporidium parvum
KKSN

SEQ ID NO: 2217833 - protein, 8 aa, Cryptosporidium parvum
KKSNEKNK

SEQ ID NO: 2217834 - protein, 5 aa, Cryptosporidium parvum
KKSNI

SEQ ID NO: 2217835 - protein, 15 aa, Cryptosporidium parvum
KKSNSNGDNKKKDAI

SEQ ID NO: 2217836 - protein, 7 aa, Cryptosporidium parvum
KKSPIFP

SEQ ID NO: 2217837 - protein, 7 aa, Cryptosporidium parvum
KKSPRTS

SEQ ID NO: 2217838 - protein, 6 aa, Cryptosporidium parvum
KKSQEC

SEQ ID NO: 2217839 - protein, 10 aa, Cryptosporidium parvum
KKSRSNSSQK

SEQ ID NO: 2217840 - protein, 6 aa, Cryptosporidium parvum
KKSSDI

SEQ ID NO: 2217841 - protein, 7 aa, Cryptosporidium parvum
KKSSLSG

SEQ ID NO: 2217842 - protein, 7 aa, Cryptosporidium parvum
KKSSPIQ

SEQ ID NO: 2217843 - protein, 5 aa, Cryptosporidium parvum
KKSSS

SEQ ID NO: 2217844 - protein, 9 aa, Cryptosporidium parvum
KKSSSAGNK

SEQ ID NO: 2217845 - protein, 8 aa, Cryptosporidium parvum
KKSSSRII

SEQ ID NO: 2217846 - protein, 11 aa, Cryptosporidium parvum
KKSSSSGFTSN

SEQ ID NO: 2217847 - protein, 13 aa, Cryptosporidium parvum
KKSSSSSKEIEMK

SEQ ID NO: 2217848 - protein, 7 aa, Cryptosporidium parvum
KKSTIGG

SEQ ID NO: 2217849 - protein, 22 aa, Cryptosporidium parvum
KKSTNSKTPNSEVSSPKVPASN

SEQ ID NO: 2217850 - protein, 16 aa, Cryptosporidium parvum
KKSTTNYESKKNRNIP

SEQ ID NO: 2217851 - protein, 6 aa, Cryptosporidium parvum
KKSVKK

SEQ ID NO: 2217852 - protein, 4 aa, Cryptosporidium parvum
KKTF

SEQ ID NO: 2217853 - protein, 17 aa, Cryptosporidium parvum
KKTHKTKRGFYLKFISN

SEQ ID NO: 2217854 - protein, 4 aa, Cryptosporidium parvum
KKTI

SEQ ID NO: 2217855 - protein, 8 aa, Cryptosporidium parvum
KKTNSRQE

SEQ ID NO: 2217856 - protein, 5 aa, Cryptosporidium parvum
KKTPL

SEQ ID NO: 2217857 - protein, 6 aa, Cryptosporidium parvum
KKTRVD

SEQ ID NO: 2217858 - protein, 4 aa, Cryptosporidium parvum
KKTV

SEQ ID NO: 2217859 - protein, 8 aa, Cryptosporidium parvum
KKTVSTSN

SEQ ID NO: 2217860 - protein, 16 aa, Cryptosporidium parvum
KKVEIGKGEPRKSEKS

SEQ ID NO: 2217861 - protein, 14 aa, Cryptosporidium parvum
KKVRKNKDSKANKL

SEQ ID NO: 2217862 - protein, 12 aa, Cryptosporidium parvum
KKVSCSNPSSVN

SEQ ID NO: 2217863 - protein, 6 aa, Cryptosporidium parvum
KKVSPI

SEQ ID NO: 2217864 - protein, 11 aa, Cryptosporidium parvum
KKVTSKDLKSR

SEQ ID NO: 2217865 - protein, 7 aa, Cryptosporidium parvum
KKYASNG

SEQ ID NO: 2217866 - protein, 5 aa, Cryptosporidium parvum
KKYEN

SEQ ID NO: 2217867 - protein, 4 aa, Cryptosporidium parvum
KKYG

SEQ ID NO: 2217868 - protein, 10 aa, Cryptosporidium parvum
KKYKKKKELY

SEQ ID NO: 2217869 - protein, 12 aa, Cryptosporidium parvum
KKYKQNQEDECN

SEQ ID NO: 2217870 - protein, 6 aa, Cryptosporidium parvum
KKYNKG

SEQ ID NO: 2217871 - protein, 4 aa, Cryptosporidium parvum
KKYQ

SEQ ID NO: 2217872 - protein, 7 aa, Cryptosporidium parvum
KKYQTNN

SEQ ID NO: 2217873 - protein, 6 aa, Cryptosporidium parvum
KLANEV

SEQ ID NO: 2217874 - protein, 8 aa, Cryptosporidium parvum
KLANTRKQ

SEQ ID NO: 2217875 - protein, 27 aa, Cryptosporidium parvum
KLDEEAPTADQDSEHKSIDLSGESSVP

SEQ ID NO: 2217876 - protein, 5 aa, Cryptosporidium parvum
KLDEL

SEQ ID NO: 2217877 - protein, 10 aa, Cryptosporidium parvum
KLDGDTNMNQ

SEQ ID NO: 2217878 - protein, 18 aa, Cryptosporidium parvum
KLDKSESKLKSSNQGNIA

SEQ ID NO: 2217879 - protein, 8 aa, Cryptosporidium parvum
KLDNQTSV

SEQ ID NO: 2217880 - protein, 4 aa, Cryptosporidium parvum
KLDP

SEQ ID NO: 2217881 - protein, 7 aa, Cryptosporidium parvum
KLDQEEL

SEQ ID NO: 2217882 - protein, 12 aa, Cryptosporidium parvum
KLDQKTESIIPN

SEQ ID NO: 2217883 - protein, 9 aa, Cryptosporidium parvum
KLDSDDKDT

SEQ ID NO: 2217884 - protein, 6 aa, Cryptosporidium parvum
KLDSPA

SEQ ID NO: 2217885 - protein, 5 aa, Cryptosporidium parvum
KLEDL

SEQ ID NO: 2217886 - protein, 8 aa, Cryptosporidium parvum
KLEENKTI

SEQ ID NO: 2217887 - protein, 7 aa, Cryptosporidium parvum
KLEKEDQ

SEQ ID NO: 2217888 - protein, 29 aa, Cryptosporidium parvum
KLEKKGEEGSKETDRANKNPINEGFESKP

SEQ ID NO: 2217889 - protein, 12 aa, Cryptosporidium parvum
KLEKMNSSLEEE

SEQ ID NO: 2217890 - protein, 7 aa, Cryptosporidium parvum
KLEKTDT

SEQ ID NO: 2217891 - protein, 12 aa, Cryptosporidium parvum
KLENINSNNYSN

SEQ ID NO: 2217892 - protein, 5 aa, Cryptosporidium parvum
KLENV

SEQ ID NO: 2217893 - protein, 14 aa, Cryptosporidium parvum
KLERSGSVGSSSGS

SEQ ID NO: 2217894 - protein, 4 aa, Cryptosporidium parvum
KLET

SEQ ID NO: 2217895 - protein, 5 aa, Cryptosporidium parvum
KLGER

SEQ ID NO: 2217896 - protein, 9 aa, Cryptosporidium parvum
KLGNREEAS

SEQ ID NO: 2217897 - protein, 6 aa, Cryptosporidium parvum
KLGQEE

SEQ ID NO: 2217898 - protein, 5 aa, Cryptosporidium parvum
KLGRK

SEQ ID NO: 2217899 - protein, 13 aa, Cryptosporidium parvum
KLGSERGQTLSSG

SEQ ID NO: 2217900 - protein, 6 aa, Cryptosporidium parvum
KLHSSE

SEQ ID NO: 2217901 - protein, 13 aa, Cryptosporidium parvum
KLIQNEDSNPNIS

SEQ ID NO: 2217902 - protein, 4 aa, Cryptosporidium parvum
KLKD

SEQ ID NO: 2217903 - protein, 7 aa, Cryptosporidium parvum
KLKETKK

SEQ ID NO: 2217904 - protein, 10 aa, Cryptosporidium parvum
KLKGESNNNI

SEQ ID NO: 2217905 - protein, 4 aa, Cryptosporidium parvum
KLKK

SEQ ID NO: 2217906 - protein, 12 aa, Cryptosporidium parvum
KLKKKNRGFNEG

SEQ ID NO: 2217907 - protein, 39 aa, Cryptosporidium parvum
KLKNPKRFRNKDERLNYGDDDDDDDDNNNNDNDDIDDHY

SEQ ID NO: 2217908 - protein, 7 aa, Cryptosporidium parvum
KLKTEKP

SEQ ID NO: 2217909 - protein, 8 aa, Cryptosporidium parvum
KLNDESME

SEQ ID NO: 2217910 - protein, 7 aa, Cryptosporidium parvum
KLNKKSM

SEQ ID NO: 2217911 - protein, 14 aa, Cryptosporidium parvum
KLNKKTGKLESSKN

SEQ ID NO: 2217912 - protein, 11 aa, Cryptosporidium parvum
KLNKNENQKNY

SEQ ID NO: 2217913 - protein, 7 aa, Cryptosporidium parvum
KLNSKKN

SEQ ID NO: 2217914 - protein, 12 aa, Cryptosporidium parvum
KLNTETDQEDSE

SEQ ID NO: 2217915 - protein, 8 aa, Cryptosporidium parvum
KLNTKKDS

SEQ ID NO: 2217916 - protein, 6 aa, Cryptosporidium parvum
KLNTSN

SEQ ID NO: 2217917 - protein, 6 aa, Cryptosporidium parvum
KLPGDD

SEQ ID NO: 2217918 - protein, 13 aa, Cryptosporidium parvum
KLPPSSNSETSQL

SEQ ID NO: 2217919 - protein, 14 aa, Cryptosporidium parvum
KLPSATKNLNRLSN

SEQ ID NO: 2217920 - protein, 7 aa, Cryptosporidium parvum
KLPSDPE

SEQ ID NO: 2217921 - protein, 7 aa, Cryptosporidium parvum
KLPTDND

SEQ ID NO: 2217922 - protein, 12 aa, Cryptosporidium parvum
KLQEKESALKTK

SEQ ID NO: 2217923 - protein, 34 aa, Cryptosporidium parvum
KLQENENSDNSTETLSNGLKQETFGYSTSSETLK

SEQ ID NO: 2217924 - protein, 18 aa, Cryptosporidium parvum
KLQKGGRYQGSMRETKAI

SEQ ID NO: 2217925 - protein, 8 aa, Cryptosporidium parvum
KLQRENPL

SEQ ID NO: 2217926 - protein, 7 aa, Cryptosporidium parvum
KLQRKRR

SEQ ID NO: 2217927 - protein, 11 aa, Cryptosporidium parvum
KLQSKHPNTGF

SEQ ID NO: 2217928 - protein, 11 aa, Cryptosporidium parvum
KLQSKKTKIEP

SEQ ID NO: 2217929 - protein, 17 aa, Cryptosporidium parvum
KLRHKDGVRKRLGSIFV

SEQ ID NO: 2217930 - protein, 14 aa, Cryptosporidium parvum
KLRRNQNRQDKERD

SEQ ID NO: 2217931 - protein, 7 aa, Cryptosporidium parvum
KLRSSTA

SEQ ID NO: 2217932 - protein, 10 aa, Cryptosporidium parvum
KLSEKQVSEM

SEQ ID NO: 2217933 - protein, 19 aa, Cryptosporidium parvum
KLSEKSNSVNNSSSAKNDI

SEQ ID NO: 2217934 - protein, 10 aa, Cryptosporidium parvum
KLSEKSQSID

SEQ ID NO: 2217935 - protein, 5 aa, Cryptosporidium parvum
KLSER

SEQ ID NO: 2217936 - protein, 13 aa, Cryptosporidium parvum
KLSFKSKKKITPS

SEQ ID NO: 2217937 - protein, 6 aa, Cryptosporidium parvum
KLSGEE

SEQ ID NO: 2217938 - protein, 8 aa, Cryptosporidium parvum
KLSGSSIN

SEQ ID NO: 2217939 - protein, 7 aa, Cryptosporidium parvum
KLSNKYV

SEQ ID NO: 2217940 - protein, 7 aa, Cryptosporidium parvum
KLSNPPC

SEQ ID NO: 2217941 - protein, 17 aa, Cryptosporidium parvum
KLSNSEKQDSRKSNTKF

SEQ ID NO: 2217942 - protein, 7 aa, Cryptosporidium parvum
KLSQDED

SEQ ID NO: 2217943 - protein, 20 aa, Cryptosporidium parvum
KLSRNQPKNNTENSEFSKSS

SEQ ID NO: 2217944 - protein, 20 aa, Cryptosporidium parvum
KLSSNNTDTFDSAEKTEQFK

SEQ ID NO: 2217945 - protein, 7 aa, Cryptosporidium parvum
KLSTGDV

SEQ ID NO: 2217946 - protein, 5 aa, Cryptosporidium parvum
KLTNF

SEQ ID NO: 2217947 - protein, 6 aa, Cryptosporidium parvum
KLTNNL

SEQ ID NO: 2217948 - protein, 11 aa, Cryptosporidium parvum
KLTPQPVPDPL

SEQ ID NO: 2217949 - protein, 7 aa, Cryptosporidium parvum
KLTPSDS

SEQ ID NO: 2217950 - protein, 23 aa, Cryptosporidium parvum
KMENENRKDCNSRGFEKPTFNEE

SEQ ID NO: 2217951 - protein, 5 aa, Cryptosporidium parvum
KMIEE

SEQ ID NO: 2217952 - protein, 9 aa, Cryptosporidium parvum
KMIETSDNE

SEQ ID NO: 2217953 - protein, 10 aa, Cryptosporidium parvum
KMKENKLSNY

SEQ ID NO: 2217954 - protein, 8 aa, Cryptosporidium parvum
KMKSGEKI

SEQ ID NO: 2217955 - protein, 11 aa, Cryptosporidium parvum
KMNKTSSIKRN

SEQ ID NO: 2217956 - protein, 22 aa, Cryptosporidium parvum
KMNNNGVNEKVEAKRREKIRSE

SEQ ID NO: 2217957 - protein, 5 aa, Cryptosporidium parvum
KMNST

SEQ ID NO: 2217958 - protein, 14 aa, Cryptosporidium parvum
KMPKTSSGKVQRSK

SEQ ID NO: 2217959 - protein, 6 aa, Cryptosporidium parvum
KNAESV

SEQ ID NO: 2217960 - protein, 7 aa, Cryptosporidium parvum
KNAKNHE

SEQ ID NO: 2217961 - protein, 10 aa, Cryptosporidium parvum
KNANNKSEEL

SEQ ID NO: 2217962 - protein, 7 aa, Cryptosporidium parvum
KNAPKGL

SEQ ID NO: 2217963 - protein, 8 aa, Cryptosporidium parvum
KNASFEGR

SEQ ID NO: 2217964 - protein, 17 aa, Cryptosporidium parvum
KNCGPYANLSLRKALSF

SEQ ID NO: 2217965 - protein, 8 aa, Cryptosporidium parvum
KNCNNSKK

SEQ ID NO: 2217966 - protein, 4 aa, Cryptosporidium parvum
KNDF

SEQ ID NO: 2217967 - protein, 9 aa, Cryptosporidium parvum
KNDGGGNEI

SEQ ID NO: 2217968 - protein, 9 aa, Cryptosporidium parvum
KNDHLTPKE

SEQ ID NO: 2217969 - protein, 6 aa, Cryptosporidium parvum
KNDIQQ

SEQ ID NO: 2217970 - protein, 7 aa, Cryptosporidium parvum
KNDKSEC

SEQ ID NO: 2217971 - protein, 8 aa, Cryptosporidium parvum
KNDLNRSE

SEQ ID NO: 2217972 - protein, 5 aa, Cryptosporidium parvum
KNDNE

SEQ ID NO: 2217973 - protein, 7 aa, Cryptosporidium parvum
KNDNGIV

SEQ ID NO: 2217974 - protein, 16 aa, Cryptosporidium parvum
KNDNSNNNNNNNNNNK

SEQ ID NO: 2217975 - protein, 6 aa, Cryptosporidium parvum
KNDPCK

SEQ ID NO: 2217976 - protein, 8 aa, Cryptosporidium parvum
KNDQGLTK

SEQ ID NO: 2217977 - protein, 25 aa, Cryptosporidium parvum
KNDQREICSNKNRNNGSDEKITGSV

SEQ ID NO: 2217978 - protein, 6 aa, Cryptosporidium parvum
KNDQSD

SEQ ID NO: 2217979 - protein, 7 aa, Cryptosporidium parvum
KNDQSTF

SEQ ID NO: 2217980 - protein, 4 aa, Cryptosporidium parvum
KNDR

SEQ ID NO: 2217981 - protein, 8 aa, Cryptosporidium parvum
KNDRTNRI

SEQ ID NO: 2217982 - protein, 4 aa, Cryptosporidium parvum
KNDS

SEQ ID NO: 2217983 - protein, 20 aa, Cryptosporidium parvum
KNDSKESFSISSQKEHISSN

SEQ ID NO: 2217984 - protein, 40 aa, Cryptosporidium parvum
KNDSTECSNLNSGDENISSLENTEFSEAYANRSRSYKSHS

SEQ ID NO: 2217985 - protein, 10 aa, Cryptosporidium parvum
KNDTGNPSSI

SEQ ID NO: 2217986 - protein, 5 aa, Cryptosporidium parvum
KNDYN

SEQ ID NO: 2217987 - protein, 4 aa, Cryptosporidium parvum
KNEC

SEQ ID NO: 2217988 - protein, 9 aa, Cryptosporidium parvum
KNEDDLEKI

SEQ ID NO: 2217989 - protein, 4 aa, Cryptosporidium parvum
KNEE

SEQ ID NO: 2217990 - protein, 7 aa, Cryptosporidium parvum
KNEEIEN

SEQ ID NO: 2217991 - protein, 7 aa, Cryptosporidium parvum
KNEEIPT

SEQ ID NO: 2217992 - protein, 16 aa, Cryptosporidium parvum
KNEEITKRDKRNENNK

SEQ ID NO: 2217993 - protein, 5 aa, Cryptosporidium parvum
KNEES

SEQ ID NO: 2217994 - protein, 7 aa, Cryptosporidium parvum
KNEFDRE

SEQ ID NO: 2217995 - protein, 7 aa, Cryptosporidium parvum
KNEFSQT

SEQ ID NO: 2217996 - protein, 12 aa, Cryptosporidium parvum
KNEGNKNDELRR

SEQ ID NO: 2217997 - protein, 7 aa, Cryptosporidium parvum
KNEIQRE

SEQ ID NO: 2217998 - protein, 7 aa, Cryptosporidium parvum
KNEISYS

SEQ ID NO: 2217999 - protein, 6 aa, Cryptosporidium parvum
KNEKEE

SEQ ID NO: 2218000 - protein, 6 aa, Cryptosporidium parvum
KNELSS

SEQ ID NO: 2218001 - protein, 9 aa, Cryptosporidium parvum
KNENEDFKY

SEQ ID NO: 2218002 - protein, 12 aa, Cryptosporidium parvum
KNENKSSGYGNS

SEQ ID NO: 2218003 - protein, 7 aa, Cryptosporidium parvum
KNENNQQ

SEQ ID NO: 2218004 - protein, 7 aa, Cryptosporidium parvum
KNENPKI

SEQ ID NO: 2218005 - protein, 12 aa, Cryptosporidium parvum
KNENSNKSSSCC

SEQ ID NO: 2218006 - protein, 5 aa, Cryptosporidium parvum
KNEPI

SEQ ID NO: 2218007 - protein, 8 aa, Cryptosporidium parvum
KNEQNSYI

SEQ ID NO: 2218008 - protein, 6 aa, Cryptosporidium parvum
KNERKS

SEQ ID NO: 2218009 - protein, 9 aa, Cryptosporidium parvum
KNERKTPES

SEQ ID NO: 2218010 - protein, 6 aa, Cryptosporidium parvum
KNESLK

SEQ ID NO: 2218011 - protein, 6 aa, Cryptosporidium parvum
KNESNR

SEQ ID NO: 2218012 - protein, 8 aa, Cryptosporidium parvum
KNETNTEI

SEQ ID NO: 2218013 - protein, 5 aa, Cryptosporidium parvum
KNFPE

SEQ ID NO: 2218014 - protein, 8 aa, Cryptosporidium parvum
KNFSNNKN

SEQ ID NO: 2218015 - protein, 9 aa, Cryptosporidium parvum
KNGDGQLDR

SEQ ID NO: 2218016 - protein, 11 aa, Cryptosporidium parvum
KNGDSNNTHDN

SEQ ID NO: 2218017 - protein, 11 aa, Cryptosporidium parvum
KNGFEKTANYV

SEQ ID NO: 2218018 - protein, 10 aa, Cryptosporidium parvum
KNGGTETVDQ

SEQ ID NO: 2218019 - protein, 6 aa, Cryptosporidium parvum
KNGKAY

SEQ ID NO: 2218020 - protein, 8 aa, Cryptosporidium parvum
KNGKSFGD

SEQ ID NO: 2218021 - protein, 14 aa, Cryptosporidium parvum
KNGNLGNKQKFNNS

SEQ ID NO: 2218022 - protein, 8 aa, Cryptosporidium parvum
KNGNLKSR

SEQ ID NO: 2218023 - protein, 8 aa, Cryptosporidium parvum
KNGNVEEA

SEQ ID NO: 2218024 - protein, 10 aa, Cryptosporidium parvum
KNGQNNKGKQ

SEQ ID NO: 2218025 - protein, 4 aa, Cryptosporidium parvum
KNGS

SEQ ID NO: 2218026 - protein, 21 aa, Cryptosporidium parvum
KNGSYIKNEKGSYIKERNGKY

SEQ ID NO: 2218027 - protein, 6 aa, Cryptosporidium parvum
KNGTNS

SEQ ID NO: 2218028 - protein, 18 aa, Cryptosporidium parvum
KNHEQLKRDYAKNSKIHE

SEQ ID NO: 2218029 - protein, 4 aa, Cryptosporidium parvum
KNHK

SEQ ID NO: 2218030 - protein, 6 aa, Cryptosporidium parvum
KNHKNV

SEQ ID NO: 2218031 - protein, 13 aa, Cryptosporidium parvum
KNHQESDKNQISE

SEQ ID NO: 2218032 - protein, 7 aa, Cryptosporidium parvum
KNHSKKN

SEQ ID NO: 2218033 - protein, 6 aa, Cryptosporidium parvum
KNIDEP

SEQ ID NO: 2218034 - protein, 4 aa, Cryptosporidium parvum
KNIE

SEQ ID NO: 2218035 - protein, 11 aa, Cryptosporidium parvum
KNIENKRLGNI

SEQ ID NO: 2218036 - protein, 11 aa, Cryptosporidium parvum
KNIESDKSLNE

SEQ ID NO: 2218037 - protein, 5 aa, Cryptosporidium parvum
KNIET

SEQ ID NO: 2218038 - protein, 12 aa, Cryptosporidium parvum
KNINNQNIPTRL

SEQ ID NO: 2218039 - protein, 7 aa, Cryptosporidium parvum
KNINSSS

SEQ ID NO: 2218040 - protein, 19 aa, Cryptosporidium parvum
KNINTDTNINNNGNSISNW

SEQ ID NO: 2218041 - protein, 13 aa, Cryptosporidium parvum
KNIPKNDSSCKTD

SEQ ID NO: 2218042 - protein, 12 aa, Cryptosporidium parvum
KNISEYGAGTAI

SEQ ID NO: 2218043 - protein, 7 aa, Cryptosporidium parvum
KNISNSK

SEQ ID NO: 2218044 - protein, 6 aa, Cryptosporidium parvum
KNITEL

SEQ ID NO: 2218045 - protein, 33 aa, Cryptosporidium parvum
KNITKSLPSIGDELEETTTVSDKKLRRRSSVKP

SEQ ID NO: 2218046 - protein, 10 aa, Cryptosporidium parvum
KNKAINPNKR

SEQ ID NO: 2218047 - protein, 10 aa, Cryptosporidium parvum
KNKAKKMKEQ

SEQ ID NO: 2218048 - protein, 12 aa, Cryptosporidium parvum
KNKDDKEKDHSN

SEQ ID NO: 2218049 - protein, 22 aa, Cryptosporidium parvum
KNKDKSDKNNKNNNNNNNNSLT

SEQ ID NO: 2218050 - protein, 6 aa, Cryptosporidium parvum
KNKDND

SEQ ID NO: 2218051 - protein, 23 aa, Cryptosporidium parvum
KNKDSDFDEIEDQDQDEQEDKYE

SEQ ID NO: 2218052 - protein, 8 aa, Cryptosporidium parvum
KNKELSNI

SEQ ID NO: 2218053 - protein, 6 aa, Cryptosporidium parvum
KNKEQL

SEQ ID NO: 2218054 - protein, 9 aa, Cryptosporidium parvum
KNKESKSVQ

SEQ ID NO: 2218055 - protein, 17 aa, Cryptosporidium parvum
KNKESQRIENMPLLNNK

SEQ ID NO: 2218056 - protein, 7 aa, Cryptosporidium parvum
KNKEWNS

SEQ ID NO: 2218057 - protein, 66 aa, Cryptosporidium parvum
KNKGGKHGKTQENIASSEEELRNKKHSSSAGLKKEDDTDDEDDEEEEAVQKPPNPNLEKISESDNL

SEQ ID NO: 2218058 - protein, 5 aa, Cryptosporidium parvum
KNKHP

SEQ ID NO: 2218059 - protein, 5 aa, Cryptosporidium parvum
KNKIR

SEQ ID NO: 2218060 - protein, 8 aa, Cryptosporidium parvum
KNKKECDK

SEQ ID NO: 2218061 - protein, 26 aa, Cryptosporidium parvum
KNKKIENSVNNNTRINGNEEDNSLDE

SEQ ID NO: 2218062 - protein, 7 aa, Cryptosporidium parvum
KNKKKNL

SEQ ID NO: 2218063 - protein, 8 aa, Cryptosporidium parvum
KNKKSPFD

SEQ ID NO: 2218064 - protein, 13 aa, Cryptosporidium parvum
KNKLETLLKSCII

SEQ ID NO: 2218065 - protein, 12 aa, Cryptosporidium parvum
KNKMSYKPPDLS

SEQ ID NO: 2218066 - protein, 7 aa, Cryptosporidium parvum
KNKNEIS

SEQ ID NO: 2218067 - protein, 9 aa, Cryptosporidium parvum
KNKNGDSNL

SEQ ID NO: 2218068 - protein, 5 aa, Cryptosporidium parvum
KNKNI

SEQ ID NO: 2218069 - protein, 7 aa, Cryptosporidium parvum
KNKNISS

SEQ ID NO: 2218070 - protein, 24 aa, Cryptosporidium parvum
KNKNNTKGDIVNEDSNAVQSKNKM

SEQ ID NO: 2218071 - protein, 16 aa, Cryptosporidium parvum
KNKNYNKGGGTGGTPN

SEQ ID NO: 2218072 - protein, 7 aa, Cryptosporidium parvum
KNKPIKE

SEQ ID NO: 2218073 - protein, 4 aa, Cryptosporidium parvum
KNKQ

SEQ ID NO: 2218074 - protein, 7 aa, Cryptosporidium parvum
KNKQDLK

SEQ ID NO: 2218075 - protein, 7 aa, Cryptosporidium parvum
KNKSIPE

SEQ ID NO: 2218076 - protein, 8 aa, Cryptosporidium parvum
KNKSISSS

SEQ ID NO: 2218077 - protein, 29 aa, Cryptosporidium parvum
KNKSKSELKNQKNLDKGKSDNAENNESEL

SEQ ID NO: 2218078 - protein, 8 aa, Cryptosporidium parvum
KNKSNSNH

SEQ ID NO: 2218079 - protein, 7 aa, Cryptosporidium parvum
KNKSREG

SEQ ID NO: 2218080 - protein, 4 aa, Cryptosporidium parvum
KNKT

SEQ ID NO: 2218081 - protein, 5 aa, Cryptosporidium parvum
KNKTA

SEQ ID NO: 2218082 - protein, 6 aa, Cryptosporidium parvum
KNKTIP

SEQ ID NO: 2218083 - protein, 10 aa, Cryptosporidium parvum
KNKTTRTTTS

SEQ ID NO: 2218084 - protein, 6 aa, Cryptosporidium parvum
KNKTYR

SEQ ID NO: 2218085 - protein, 5 aa, Cryptosporidium parvum
KNKVQ

SEQ ID NO: 2218086 - protein, 12 aa, Cryptosporidium parvum
KNKYKASVPKST

SEQ ID NO: 2218087 - protein, 6 aa, Cryptosporidium parvum
KNKYLN

SEQ ID NO: 2218088 - protein, 10 aa, Cryptosporidium parvum
KNLGKNNLEE

SEQ ID NO: 2218089 - protein, 13 aa, Cryptosporidium parvum
KNLKDENHNSSRH

SEQ ID NO: 2218090 - protein, 4 aa, Cryptosporidium parvum
KNLN

SEQ ID NO: 2218091 - protein, 20 aa, Cryptosporidium parvum
KNLNSEESGFSSGENEPVVK

SEQ ID NO: 2218092 - protein, 6 aa, Cryptosporidium parvum
KNLQIS

SEQ ID NO: 2218093 - protein, 24 aa, Cryptosporidium parvum
KNLVDSKNETEKKSLKNNNKELIS

SEQ ID NO: 2218094 - protein, 4 aa, Cryptosporidium parvum
KNMD

SEQ ID NO: 2218095 - protein, 21 aa, Cryptosporidium parvum
KNMDGNHGNCSHNKNKIPVTD

SEQ ID NO: 2218096 - protein, 5 aa, Cryptosporidium parvum
KNMDQ

SEQ ID NO: 2218097 - protein, 7 aa, Cryptosporidium parvum
KNMDSAQ

SEQ ID NO: 2218098 - protein, 5 aa, Cryptosporidium parvum
KNNDF

SEQ ID NO: 2218099 - protein, 6 aa, Cryptosporidium parvum
KNNDID

SEQ ID NO: 2218100 - protein, 5 aa, Cryptosporidium parvum
KNNDK

SEQ ID NO: 2218101 - protein, 10 aa, Cryptosporidium parvum
KNNDNNKEEK

SEQ ID NO: 2218102 - protein, 7 aa, Cryptosporidium parvum
KNNEADE

SEQ ID NO: 2218103 - protein, 10 aa, Cryptosporidium parvum
KNNESKYKNK

SEQ ID NO: 2218104 - protein, 9 aa, Cryptosporidium parvum
KNNETDLEM

SEQ ID NO: 2218105 - protein, 4 aa, Cryptosporidium parvum
KNNF

SEQ ID NO: 2218106 - protein, 8 aa, Cryptosporidium parvum
KNNGEEAV

SEQ ID NO: 2218107 - protein, 9 aa, Cryptosporidium parvum
KNNGEEEYL

SEQ ID NO: 2218108 - protein, 9 aa, Cryptosporidium parvum
KNNGENSLE

SEQ ID NO: 2218109 - protein, 8 aa, Cryptosporidium parvum
KNNGNESI

SEQ ID NO: 2218110 - protein, 8 aa, Cryptosporidium parvum
KNNHGQNS

SEQ ID NO: 2218111 - protein, 6 aa, Cryptosporidium parvum
KNNINL

SEQ ID NO: 2218112 - protein, 6 aa, Cryptosporidium parvum
KNNKKD

SEQ ID NO: 2218113 - protein, 6 aa, Cryptosporidium parvum
KNNKSE

SEQ ID NO: 2218114 - protein, 4 aa, Cryptosporidium parvum
KNNL

SEQ ID NO: 2218115 - protein, 8 aa, Cryptosporidium parvum
KNNLNNER

SEQ ID NO: 2218116 - protein, 4 aa, Cryptosporidium parvum
KNNN

SEQ ID NO: 2218117 - protein, 6 aa, Cryptosporidium parvum
KNNNIP

SEQ ID NO: 2218118 - protein, 7 aa, Cryptosporidium parvum
KNNNNRE

SEQ ID NO: 2218119 - protein, 8 aa, Cryptosporidium parvum
KNNNNTYS

SEQ ID NO: 2218120 - protein, 10 aa, Cryptosporidium parvum
KNNNSNNNNY

SEQ ID NO: 2218121 - protein, 7 aa, Cryptosporidium parvum
KNNNSTM

SEQ ID NO: 2218122 - protein, 16 aa, Cryptosporidium parvum
KNNPRFSSENVEDRGT

SEQ ID NO: 2218123 - protein, 5 aa, Cryptosporidium parvum
KNNPS

SEQ ID NO: 2218124 - protein, 7 aa, Cryptosporidium parvum
KNNPSDA

SEQ ID NO: 2218125 - protein, 11 aa, Cryptosporidium parvum
KNNQKNIKDYE

SEQ ID NO: 2218126 - protein, 6 aa, Cryptosporidium parvum
KNNQLT

SEQ ID NO: 2218127 - protein, 13 aa, Cryptosporidium parvum
KNNQRLNDEASEF

SEQ ID NO: 2218128 - protein, 11 aa, Cryptosporidium parvum
KNNQSISQNKE

SEQ ID NO: 2218129 - protein, 7 aa, Cryptosporidium parvum
KNNRNES

SEQ ID NO: 2218130 - protein, 7 aa, Cryptosporidium parvum
KNNSDLN

SEQ ID NO: 2218131 - protein, 5 aa, Cryptosporidium parvum
KNNSE

SEQ ID NO: 2218132 - protein, 10 aa, Cryptosporidium parvum
KNNSNSKKEG

SEQ ID NO: 2218133 - protein, 8 aa, Cryptosporidium parvum
KNNSSKEF

SEQ ID NO: 2218134 - protein, 7 aa, Cryptosporidium parvum
KNNSSLM

SEQ ID NO: 2218135 - protein, 13 aa, Cryptosporidium parvum
KNNSYESNSYHLD

SEQ ID NO: 2218136 - protein, 8 aa, Cryptosporidium parvum
KNNTNNYD

SEQ ID NO: 2218137 - protein, 12 aa, Cryptosporidium parvum
KNPAQEEVSKYS

SEQ ID NO: 2218138 - protein, 7 aa, Cryptosporidium parvum
KNPDSRL

SEQ ID NO: 2218139 - protein, 6 aa, Cryptosporidium parvum
KNPESL

SEQ ID NO: 2218140 - protein, 18 aa, Cryptosporidium parvum
KNPGEKITEGGRSDHEKK

SEQ ID NO: 2218141 - protein, 9 aa, Cryptosporidium parvum
KNPGNPNFN

SEQ ID NO: 2218142 - protein, 5 aa, Cryptosporidium parvum
KNPKQ

SEQ ID NO: 2218143 - protein, 6 aa, Cryptosporidium parvum
KNPNGF

SEQ ID NO: 2218144 - protein, 9 aa, Cryptosporidium parvum
KNPNHTHSD

SEQ ID NO: 2218145 - protein, 7 aa, Cryptosporidium parvum
KNPPITG

SEQ ID NO: 2218146 - protein, 8 aa, Cryptosporidium parvum
KNPPPEMH

SEQ ID NO: 2218147 - protein, 7 aa, Cryptosporidium parvum
KNPPPVQ

SEQ ID NO: 2218148 - protein, 12 aa, Cryptosporidium parvum
KNPPSNTQYKGG

SEQ ID NO: 2218149 - protein, 7 aa, Cryptosporidium parvum
KNPQRNE

SEQ ID NO: 2218150 - protein, 5 aa, Cryptosporidium parvum
KNPSQ

SEQ ID NO: 2218151 - protein, 6 aa, Cryptosporidium parvum
KNPVEN

SEQ ID NO: 2218152 - protein, 4 aa, Cryptosporidium parvum
KNQA

SEQ ID NO: 2218153 - protein, 14 aa, Cryptosporidium parvum
KNQDPYIDPSETFQ

SEQ ID NO: 2218154 - protein, 28 aa, Cryptosporidium parvum
KNQEISEDVDGNENGSENQVKDSNSNSG

SEQ ID NO: 2218155 - protein, 7 aa, Cryptosporidium parvum
KNQFSSE

SEQ ID NO: 2218156 - protein, 8 aa, Cryptosporidium parvum
KNQFSSSG

SEQ ID NO: 2218157 - protein, 7 aa, Cryptosporidium parvum
KNQGFES

SEQ ID NO: 2218158 - protein, 6 aa, Cryptosporidium parvum
KNQIRE

SEQ ID NO: 2218159 - protein, 4 aa, Cryptosporidium parvum
KNQK

SEQ ID NO: 2218160 - protein, 9 aa, Cryptosporidium parvum
KNQNVQTDL

SEQ ID NO: 2218161 - protein, 15 aa, Cryptosporidium parvum
KNQQINSSDNNHNND

SEQ ID NO: 2218162 - protein, 7 aa, Cryptosporidium parvum
KNQQSIS

SEQ ID NO: 2218163 - protein, 6 aa, Cryptosporidium parvum
KNQRIK

SEQ ID NO: 2218164 - protein, 6 aa, Cryptosporidium parvum
KNQRVM

SEQ ID NO: 2218165 - protein, 9 aa, Cryptosporidium parvum
KNQSEAGIE

SEQ ID NO: 2218166 - protein, 8 aa, Cryptosporidium parvum
KNQSTEEI

SEQ ID NO: 2218167 - protein, 7 aa, Cryptosporidium parvum
KNQSYDH

SEQ ID NO: 2218168 - protein, 7 aa, Cryptosporidium parvum
KNQTGSI

SEQ ID NO: 2218169 - protein, 5 aa, Cryptosporidium parvum
KNQTN

SEQ ID NO: 2218170 - protein, 36 aa, Cryptosporidium parvum
KNQTSKKVNEEEDSNKEIGSKVNNCEKNKDKKRTAV

SEQ ID NO: 2218171 - protein, 4 aa, Cryptosporidium parvum
KNQV

SEQ ID NO: 2218172 - protein, 14 aa, Cryptosporidium parvum
KNRDAQEKQGIDDN

SEQ ID NO: 2218173 - protein, 7 aa, Cryptosporidium parvum
KNREDKQ

SEQ ID NO: 2218174 - protein, 8 aa, Cryptosporidium parvum
KNRGDDSA

SEQ ID NO: 2218175 - protein, 7 aa, Cryptosporidium parvum
KNRKGPL

SEQ ID NO: 2218176 - protein, 10 aa, Cryptosporidium parvum
KNRKTKRSMD

SEQ ID NO: 2218177 - protein, 7 aa, Cryptosporidium parvum
KNRNNGY

SEQ ID NO: 2218178 - protein, 5 aa, Cryptosporidium parvum
KNRPA

SEQ ID NO: 2218179 - protein, 8 aa, Cryptosporidium parvum
KNRPTALP

SEQ ID NO: 2218180 - protein, 6 aa, Cryptosporidium parvum
KNRTGQ

SEQ ID NO: 2218181 - protein, 7 aa, Cryptosporidium parvum
KNRVEHE

SEQ ID NO: 2218182 - protein, 6 aa, Cryptosporidium parvum
KNRYSS

SEQ ID NO: 2218183 - protein, 6 aa, Cryptosporidium parvum
KNSADL

SEQ ID NO: 2218184 - protein, 4 aa, Cryptosporidium parvum
KNSC

SEQ ID NO: 2218185 - protein, 14 aa, Cryptosporidium parvum
KNSDDKVEGQGKGG

SEQ ID NO: 2218186 - protein, 6 aa, Cryptosporidium parvum
KNSDLN

SEQ ID NO: 2218187 - protein, 4 aa, Cryptosporidium parvum
KNSE

SEQ ID NO: 2218188 - protein, 10 aa, Cryptosporidium parvum
KNSECSSDLD

SEQ ID NO: 2218189 - protein, 8 aa, Cryptosporidium parvum
KNSEFSEN

SEQ ID NO: 2218190 - protein, 15 aa, Cryptosporidium parvum
KNSEGRTKSSSSIPT

SEQ ID NO: 2218191 - protein, 11 aa, Cryptosporidium parvum
KNSEGVPPKGT

SEQ ID NO: 2218192 - protein, 6 aa, Cryptosporidium parvum
KNSEMG

SEQ ID NO: 2218193 - protein, 11 aa, Cryptosporidium parvum
KNSESISEQTD

SEQ ID NO: 2218194 - protein, 6 aa, Cryptosporidium parvum
KNSGNL

SEQ ID NO: 2218195 - protein, 10 aa, Cryptosporidium parvum
KNSHIDTKKN

SEQ ID NO: 2218196 - protein, 4 aa, Cryptosporidium parvum
KNSI

SEQ ID NO: 2218197 - protein, 17 aa, Cryptosporidium parvum
KNSIEENENNNENNSLK

SEQ ID NO: 2218198 - protein, 8 aa, Cryptosporidium parvum
KNSIESDH

SEQ ID NO: 2218199 - protein, 8 aa, Cryptosporidium parvum
KNSISESI

SEQ ID NO: 2218200 - protein, 9 aa, Cryptosporidium parvum
KNSKELNSE

SEQ ID NO: 2218201 - protein, 9 aa, Cryptosporidium parvum
KNSLESEDE

SEQ ID NO: 2218202 - protein, 5 aa, Cryptosporidium parvum
KNSLN

SEQ ID NO: 2218203 - protein, 10 aa, Cryptosporidium parvum
KNSLSTPKAI

SEQ ID NO: 2218204 - protein, 10 aa, Cryptosporidium parvum
KNSMDPSSSR

SEQ ID NO: 2218205 - protein, 6 aa, Cryptosporidium parvum
KNSMHG

SEQ ID NO: 2218206 - protein, 4 aa, Cryptosporidium parvum
KNSN

SEQ ID NO: 2218207 - protein, 10 aa, Cryptosporidium parvum
KNSNKINKTM

SEQ ID NO: 2218208 - protein, 6 aa, Cryptosporidium parvum
KNSNSI

SEQ ID NO: 2218209 - protein, 4 aa, Cryptosporidium parvum
KNSP

SEQ ID NO: 2218210 - protein, 8 aa, Cryptosporidium parvum
KNSPENVA

SEQ ID NO: 2218211 - protein, 8 aa, Cryptosporidium parvum
KNSQFRAK

SEQ ID NO: 2218212 - protein, 7 aa, Cryptosporidium parvum
KNSQKIN

SEQ ID NO: 2218213 - protein, 7 aa, Cryptosporidium parvum
KNSRDEI

SEQ ID NO: 2218214 - protein, 5 aa, Cryptosporidium parvum
KNSRH

SEQ ID NO: 2218215 - protein, 10 aa, Cryptosporidium parvum
KNSSCTNSSD

SEQ ID NO: 2218216 - protein, 7 aa, Cryptosporidium parvum
KNSSKIN

SEQ ID NO: 2218217 - protein, 10 aa, Cryptosporidium parvum
KNSSLNKNSV

SEQ ID NO: 2218218 - protein, 6 aa, Cryptosporidium parvum
KNSSNL

SEQ ID NO: 2218219 - protein, 8 aa, Cryptosporidium parvum
KNSSPLNK

SEQ ID NO: 2218220 - protein, 8 aa, Cryptosporidium parvum
KNTCEYYG

SEQ ID NO: 2218221 - protein, 5 aa, Cryptosporidium parvum
KNTDE

SEQ ID NO: 2218222 - protein, 6 aa, Cryptosporidium parvum
KNTIDS

SEQ ID NO: 2218223 - protein, 6 aa, Cryptosporidium parvum
KNTKNS

SEQ ID NO: 2218224 - protein, 8 aa, Cryptosporidium parvum
KNTKSKIR

SEQ ID NO: 2218225 - protein, 20 aa, Cryptosporidium parvum
KNTNDNKDLIEKSRNEKFES

SEQ ID NO: 2218226 - protein, 8 aa, Cryptosporidium parvum
KNTNEYKS

SEQ ID NO: 2218227 - protein, 15 aa, Cryptosporidium parvum
KNTNLDGESRSPKCD

SEQ ID NO: 2218228 - protein, 7 aa, Cryptosporidium parvum
KNTNTNI

SEQ ID NO: 2218229 - protein, 14 aa, Cryptosporidium parvum
KNTPYEPLSTPKQL

SEQ ID NO: 2218230 - protein, 8 aa, Cryptosporidium parvum
KNTQEEIN

SEQ ID NO: 2218231 - protein, 8 aa, Cryptosporidium parvum
KNTQISEK

SEQ ID NO: 2218232 - protein, 7 aa, Cryptosporidium parvum
KNTQKAD

SEQ ID NO: 2218233 - protein, 11 aa, Cryptosporidium parvum
KNTRLEEKEEV

SEQ ID NO: 2218234 - protein, 7 aa, Cryptosporidium parvum
KNTSLSD

SEQ ID NO: 2218235 - protein, 12 aa, Cryptosporidium parvum
KNTTNTSSEKSN

SEQ ID NO: 2218236 - protein, 26 aa, Cryptosporidium parvum
KNTTTNTRNASSIPVESKKQTDSTIG

SEQ ID NO: 2218237 - protein, 5 aa, Cryptosporidium parvum
KNVGG

SEQ ID NO: 2218238 - protein, 4 aa, Cryptosporidium parvum
KNVK

SEQ ID NO: 2218239 - protein, 23 aa, Cryptosporidium parvum
KNVQEEDTECQTNASNVSNHEND

SEQ ID NO: 2218240 - protein, 9 aa, Cryptosporidium parvum
KNVSARETE

SEQ ID NO: 2218241 - protein, 9 aa, Cryptosporidium parvum
KNVSEGAKD

SEQ ID NO: 2218242 - protein, 31 aa, Cryptosporidium parvum
KNVSKDKATEEEAVSNNGELSGNASNKEAAS

SEQ ID NO: 2218243 - protein, 22 aa, Cryptosporidium parvum
KNYDSSNDSELAKTQSSYTDNS

SEQ ID NO: 2218244 - protein, 6 aa, Cryptosporidium parvum
KNYFNE

SEQ ID NO: 2218245 - protein, 9 aa, Cryptosporidium parvum
KNYGEENVQ

SEQ ID NO: 2218246 - protein, 6 aa, Cryptosporidium parvum
KNYHEK

SEQ ID NO: 2218247 - protein, 16 aa, Cryptosporidium parvum
KNYNNNNKNNNDSNDF

SEQ ID NO: 2218248 - protein, 6 aa, Cryptosporidium parvum
KNYNTT

SEQ ID NO: 2218249 - protein, 18 aa, Cryptosporidium parvum
KNYQELNESREEFNGSRD

SEQ ID NO: 2218250 - protein, 9 aa, Cryptosporidium parvum
KNYSNSIKN

SEQ ID NO: 2218251 - protein, 4 aa, Cryptosporidium parvum
KNYT

SEQ ID NO: 2218252 - protein, 5 aa, Cryptosporidium parvum
KPADS

SEQ ID NO: 2218253 - protein, 15 aa, Cryptosporidium parvum
KPAKKLVPQKPPNSI

SEQ ID NO: 2218254 - protein, 8 aa, Cryptosporidium parvum
KPAKSDKQ

SEQ ID NO: 2218255 - protein, 6 aa, Cryptosporidium parvum
KPAPVG

SEQ ID NO: 2218256 - protein, 18 aa, Cryptosporidium parvum
KPDDLTERNKEKRRGVTE

SEQ ID NO: 2218257 - protein, 7 aa, Cryptosporidium parvum
KPDKSFS

SEQ ID NO: 2218258 - protein, 14 aa, Cryptosporidium parvum
KPDNSHVFPFILDI

SEQ ID NO: 2218259 - protein, 4 aa, Cryptosporidium parvum
KPDP

SEQ ID NO: 2218260 - protein, 7 aa, Cryptosporidium parvum
KPDSDEC

SEQ ID NO: 2218261 - protein, 10 aa, Cryptosporidium parvum
KPDVSKSASD

SEQ ID NO: 2218262 - protein, 5 aa, Cryptosporidium parvum
KPEAI

SEQ ID NO: 2218263 - protein, 7 aa, Cryptosporidium parvum
KPELKEC

SEQ ID NO: 2218264 - protein, 8 aa, Cryptosporidium parvum
KPESSIIE

SEQ ID NO: 2218265 - protein, 4 aa, Cryptosporidium parvum
KPEY

SEQ ID NO: 2218266 - protein, 17 aa, Cryptosporidium parvum
KPEYQRSDQNFRRGSGK

SEQ ID NO: 2218267 - protein, 14 aa, Cryptosporidium parvum
KPFYTGANSGTTNG

SEQ ID NO: 2218268 - protein, 11 aa, Cryptosporidium parvum
KPGEIPDTPEW

SEQ ID NO: 2218269 - protein, 4 aa, Cryptosporidium parvum
KPGN

SEQ ID NO: 2218270 - protein, 6 aa, Cryptosporidium parvum
KPGNVN

SEQ ID NO: 2218271 - protein, 5 aa, Cryptosporidium parvum
KPGWG

SEQ ID NO: 2218272 - protein, 4 aa, Cryptosporidium parvum
KPIE

SEQ ID NO: 2218273 - protein, 13 aa, Cryptosporidium parvum
KPIKSNEKQKNKQ

SEQ ID NO: 2218274 - protein, 7 aa, Cryptosporidium parvum
KPINNIE

SEQ ID NO: 2218275 - protein, 8 aa, Cryptosporidium parvum
KPINSTAP

SEQ ID NO: 2218276 - protein, 16 aa, Cryptosporidium parvum
KPIPGDKKEEMNNENS

SEQ ID NO: 2218277 - protein, 9 aa, Cryptosporidium parvum
KPIPQGNNN

SEQ ID NO: 2218278 - protein, 13 aa, Cryptosporidium parvum
KPIPTETHQRGTY

SEQ ID NO: 2218279 - protein, 6 aa, Cryptosporidium parvum
KPISKK

SEQ ID NO: 2218280 - protein, 15 aa, Cryptosporidium parvum
KPISKREESRNEVSQ

SEQ ID NO: 2218281 - protein, 6 aa, Cryptosporidium parvum
KPITPK

SEQ ID NO: 2218282 - protein, 13 aa, Cryptosporidium parvum
KPKDFTGPRRAES

SEQ ID NO: 2218283 - protein, 12 aa, Cryptosporidium parvum
KPKDFVWKNILL

SEQ ID NO: 2218284 - protein, 12 aa, Cryptosporidium parvum
KPKESYSKKSRL

SEQ ID NO: 2218285 - protein, 5 aa, Cryptosporidium parvum
KPKGF

SEQ ID NO: 2218286 - protein, 9 aa, Cryptosporidium parvum
KPKGKTIPP

SEQ ID NO: 2218287 - protein, 6 aa, Cryptosporidium parvum
KPKHKK

SEQ ID NO: 2218288 - protein, 4 aa, Cryptosporidium parvum
KPKI

SEQ ID NO: 2218289 - protein, 8 aa, Cryptosporidium parvum
KPKKGWSE

SEQ ID NO: 2218290 - protein, 11 aa, Cryptosporidium parvum
KPKNSSNSQCR

SEQ ID NO: 2218291 - protein, 4 aa, Cryptosporidium parvum
KPKQ

SEQ ID NO: 2218292 - protein, 7 aa, Cryptosporidium parvum
KPKRYID

SEQ ID NO: 2218293 - protein, 12 aa, Cryptosporidium parvum
KPKSGSHQRYPK

SEQ ID NO: 2218294 - protein, 10 aa, Cryptosporidium parvum
KPKYAPPSHN

SEQ ID NO: 2218295 - protein, 23 aa, Cryptosporidium parvum
KPLGEKKTINAKASNIDAKNNVD

SEQ ID NO: 2218296 - protein, 7 aa, Cryptosporidium parvum
KPLPNSN

SEQ ID NO: 2218297 - protein, 6 aa, Cryptosporidium parvum
KPNASR

SEQ ID NO: 2218298 - protein, 4 aa, Cryptosporidium parvum
KPNC

SEQ ID NO: 2218299 - protein, 6 aa, Cryptosporidium parvum
KPNEGF

SEQ ID NO: 2218300 - protein, 49 aa, Cryptosporidium parvum
KPNSFQEKRGPEISPRQKVTNSNSPVASPSLREKLKNQNKSSNAVRTFI

SEQ ID NO: 2218301 - protein, 4 aa, Cryptosporidium parvum
KPNY

SEQ ID NO: 2218302 - protein, 9 aa, Cryptosporidium parvum
KPNYKTYED

SEQ ID NO: 2218303 - protein, 8 aa, Cryptosporidium parvum
KPPEGYEK

SEQ ID NO: 2218304 - protein, 8 aa, Cryptosporidium parvum
KPPESLNQ

SEQ ID NO: 2218305 - protein, 15 aa, Cryptosporidium parvum
KPPVDSPTLNEATTT

SEQ ID NO: 2218306 - protein, 5 aa, Cryptosporidium parvum
KPQTY

SEQ ID NO: 2218307 - protein, 5 aa, Cryptosporidium parvum
KPQYC

SEQ ID NO: 2218308 - protein, 6 aa, Cryptosporidium parvum
KPREIL

SEQ ID NO: 2218309 - protein, 4 aa, Cryptosporidium parvum
KPRI

SEQ ID NO: 2218310 - protein, 30 aa, Cryptosporidium parvum; identical to SEQ ID NO: 2148869

SEQ ID NO: 2218311 - protein, 6 aa, Cryptosporidium parvum
KPRKVS

SEQ ID NO: 2218312 - protein, 7 aa, Cryptosporidium parvum
KPRLSNQ

SEQ ID NO: 2218313 - protein, 5 aa, Cryptosporidium parvum
KPRNQ

SEQ ID NO: 2218314 - protein, 12 aa, Cryptosporidium parvum
KPRSNVSRNTLE

SEQ ID NO: 2218315 - protein, 15 aa, Cryptosporidium parvum
KPSAPKLPPDSNVSS

SEQ ID NO: 2218316 - protein, 6 aa, Cryptosporidium parvum
KPSDIS

SEQ ID NO: 2218317 - protein, 12 aa, Cryptosporidium parvum
KPSEADCNSQRS

SEQ ID NO: 2218318 - protein, 5 aa, Cryptosporidium parvum
KPSEI

SEQ ID NO: 2218319 - protein, 8 aa, Cryptosporidium parvum
KPSEMKNL

SEQ ID NO: 2218320 - protein, 12 aa, Cryptosporidium parvum
KPSETASYSSSV

SEQ ID NO: 2218321 - protein, 7 aa, Cryptosporidium parvum
KPSIEYE

SEQ ID NO: 2218322 - protein, 6 aa, Cryptosporidium parvum
KPSLDV

SEQ ID NO: 2218323 - protein, 6 aa, Cryptosporidium parvum
KPSLGE

SEQ ID NO: 2218324 - protein, 7 aa, Cryptosporidium parvum
KPSPDVF

SEQ ID NO: 2218325 - protein, 6 aa, Cryptosporidium parvum
KPSPLY

SEQ ID NO: 2218326 - protein, 8 aa, Cryptosporidium parvum
KPSPYKKD

SEQ ID NO: 2218327 - protein, 6 aa, Cryptosporidium parvum
KPSTEI

SEQ ID NO: 2218328 - protein, 10 aa, Cryptosporidium parvum
KPSYSEKNGL

SEQ ID NO: 2218329 - protein, 9 aa, Cryptosporidium parvum
KPTGGLRQA

SEQ ID NO: 2218330 - protein, 6 aa, Cryptosporidium parvum
KPTNVQ

SEQ ID NO: 2218331 - protein, 14 aa, Cryptosporidium parvum
KPTSSSSTTTTSEP

SEQ ID NO: 2218332 - protein, 12 aa, Cryptosporidium parvum
KPVEFGKGDSDE

SEQ ID NO: 2218333 - protein, 32 aa, Cryptosporidium parvum
KPVGSGINEDTNISGNNSASREVNSELGPDQI

SEQ ID NO: 2218334 - protein, 9 aa, Cryptosporidium parvum
KPVGTNTGD

SEQ ID NO: 2218335 - protein, 4 aa, Cryptosporidium parvum
KPWF

SEQ ID NO: 2218336 - protein, 15 aa, Cryptosporidium parvum
KPYEKATEESNSEIH

SEQ ID NO: 2218337 - protein, 11 aa, Cryptosporidium parvum
KPYSQFDNNNN

SEQ ID NO: 2218338 - protein, 5 aa, Cryptosporidium parvum
KPYVS

SEQ ID NO: 2218339 - protein, 7 aa, Cryptosporidium parvum
KQAKSGA

SEQ ID NO: 2218340 - protein, 9 aa, Cryptosporidium parvum
KQASSNNGF

SEQ ID NO: 2218341 - protein, 8 aa, Cryptosporidium parvum
KQDATKAY

SEQ ID NO: 2218342 - protein, 6 aa, Cryptosporidium parvum
KQDKKN

SEQ ID NO: 2218343 - protein, 6 aa, Cryptosporidium parvum
KQDPAS

SEQ ID NO: 2218344 - protein, 12 aa, Cryptosporidium parvum
KQDQNGNNQAIL

SEQ ID NO: 2218345 - protein, 9 aa, Cryptosporidium parvum
KQDSGNTEE

SEQ ID NO: 2218346 - protein, 7 aa, Cryptosporidium parvum
KQDSVEL

SEQ ID NO: 2218347 - protein, 6 aa, Cryptosporidium parvum
KQDYDS

SEQ ID NO: 2218348 - protein, 11 aa, Cryptosporidium parvum
KQEDNDLKEAS

SEQ ID NO: 2218349 - protein, 5 aa, Cryptosporidium parvum
KQEKE

SEQ ID NO: 2218350 - protein, 9 aa, Cryptosporidium parvum
KQEKGVDNR

SEQ ID NO: 2218351 - protein, 8 aa, Cryptosporidium parvum
KQEKSQEL

SEQ ID NO: 2218352 - protein, 12 aa, Cryptosporidium parvum
KQELGKKDSSIE

SEQ ID NO: 2218353 - protein, 4 aa, Cryptosporidium parvum
KQEN

SEQ ID NO: 2218354 - protein, 6 aa, Cryptosporidium parvum
KQENNI

SEQ ID NO: 2218355 - protein, 5 aa, Cryptosporidium parvum
KQENW

SEQ ID NO: 2218356 - protein, 6 aa, Cryptosporidium parvum
KQEQGL

SEQ ID NO: 2218357 - protein, 7 aa, Cryptosporidium parvum
KQESPNS

SEQ ID NO: 2218358 - protein, 5 aa, Cryptosporidium parvum
KQETP

SEQ ID NO: 2218359 - protein, 7 aa, Cryptosporidium parvum
KQEYPEI

SEQ ID NO: 2218360 - protein, 5 aa, Cryptosporidium parvum
KQFQD

SEQ ID NO: 2218361 - protein, 6 aa, Cryptosporidium parvum
KQFSPS

SEQ ID NO: 2218362 - protein, 11 aa, Cryptosporidium parvum
KQGEDDPSEIK

SEQ ID NO: 2218363 - protein, 8 aa, Cryptosporidium parvum
KQGFSEKE

SEQ ID NO: 2218364 - protein, 8 aa, Cryptosporidium parvum
KQGLSGGQ

SEQ ID NO: 2218365 - protein, 5 aa, Cryptosporidium parvum
KQGNN

SEQ ID NO: 2218366 - protein, 6 aa, Cryptosporidium parvum
KQGSVA

SEQ ID NO: 2218367 - protein, 6 aa, Cryptosporidium parvum
KQGTAV

SEQ ID NO: 2218368 - protein, 4 aa, Cryptosporidium parvum
KQID

SEQ ID NO: 2218369 - protein, 8 aa, Cryptosporidium parvum
KQIKSKEL

SEQ ID NO: 2218370 - protein, 4 aa, Cryptosporidium parvum
KQIN

SEQ ID NO: 2218371 - protein, 7 aa, Cryptosporidium parvum
KQINSSV

SEQ ID NO: 2218372 - protein, 4 aa, Cryptosporidium parvum
KQIS

SEQ ID NO: 2218373 - protein, 7 aa, Cryptosporidium parvum
KQISTGQ

SEQ ID NO: 2218374 - protein, 8 aa, Cryptosporidium parvum
KQITPESK

SEQ ID NO: 2218375 - protein, 10 aa, Cryptosporidium parvum
KQKDSGKKKV

SEQ ID NO: 2218376 - protein, 6 aa, Cryptosporidium parvum
KQKEAE

SEQ ID NO: 2218377 - protein, 12 aa, Cryptosporidium parvum
KQKGKRGRKRKN

SEQ ID NO: 2218378 - protein, 10 aa, Cryptosporidium parvum
KQKKENGKDE

SEQ ID NO: 2218379 - protein, 9 aa, Cryptosporidium parvum
KQKNLASKM

SEQ ID NO: 2218380 - protein, 9 aa, Cryptosporidium parvum
KQKRDQKME

SEQ ID NO: 2218381 - protein, 10 aa, Cryptosporidium parvum
KQKRSSSISY

SEQ ID NO: 2218382 - protein, 15 aa, Cryptosporidium parvum
KQKSGVSKSSSQQHG

SEQ ID NO: 2218383 - protein, 11 aa, Cryptosporidium parvum
KQKSPNSKMTK

SEQ ID NO: 2218384 - protein, 5 aa, Cryptosporidium parvum
KQKSS

SEQ ID NO: 2218385 - protein, 5 aa, Cryptosporidium parvum
KQKYS

SEQ ID NO: 2218386 - protein, 23 aa, Cryptosporidium parvum
KQLDYSREELNGQDEDKEPKRGL

SEQ ID NO: 2218387 - protein, 11 aa, Cryptosporidium parvum
KQLGNDNLSKK

SEQ ID NO: 2218388 - protein, 6 aa, Cryptosporidium parvum
KQLGNS

SEQ ID NO: 2218389 - protein, 13 aa, Cryptosporidium parvum
KQLKQARKNGNPR

SEQ ID NO: 2218390 - protein, 6 aa, Cryptosporidium parvum
KQLNGG

SEQ ID NO: 2218391 - protein, 7 aa, Cryptosporidium parvum
KQLYGDK

SEQ ID NO: 2218392 - protein, 12 aa, Cryptosporidium parvum
KQNAQHSNQHSG

SEQ ID NO: 2218393 - protein, 8 aa, Cryptosporidium parvum
KQNDRIGV

SEQ ID NO: 2218394 - protein, 24 aa, Cryptosporidium parvum
KQNGIEVTNRSGNSHTNNYGNSKI

SEQ ID NO: 2218395 - protein, 12 aa, Cryptosporidium parvum
KQNGNFGCDGGT

SEQ ID NO: 2218396 - protein, 6 aa, Cryptosporidium parvum
KQNISC

SEQ ID NO: 2218397 - protein, 6 aa, Cryptosporidium parvum
KQNLAS

SEQ ID NO: 2218398 - protein, 14 aa, Cryptosporidium parvum
KQNLDNSSRDESAF

SEQ ID NO: 2218399 - protein, 11 aa, Cryptosporidium parvum
KQNNTDDNGFK

SEQ ID NO: 2218400 - protein, 5 aa, Cryptosporidium parvum
KQNQT

SEQ ID NO: 2218401 - protein, 6 aa, Cryptosporidium parvum
KQNTDN

SEQ ID NO: 2218402 - protein, 19 aa, Cryptosporidium parvum
KQNTLNSELRSNIEAKAPI

SEQ ID NO: 2218403 - protein, 4 aa, Cryptosporidium parvum
KQPK

SEQ ID NO: 2218404 - protein, 12 aa, Cryptosporidium parvum
KQPNPSQINTSM

SEQ ID NO: 2218405 - protein, 4 aa, Cryptosporidium parvum
KQQA

SEQ ID NO: 2218406 - protein, 4 aa, Cryptosporidium parvum
KQQE

SEQ ID NO: 2218407 - protein, 25 aa, Cryptosporidium parvum
KQQISRDKSGIEGSLGVNSNNKQAL

SEQ ID NO: 2218408 - protein, 9 aa, Cryptosporidium parvum
KQQKDQAIQ

SEQ ID NO: 2218409 - protein, 13 aa, Cryptosporidium parvum
KQQSQNESLEGSE

SEQ ID NO: 2218410 - protein, 6 aa, Cryptosporidium parvum
KQSEEH

SEQ ID NO: 2218411 - protein, 6 aa, Cryptosporidium parvum
KQSGIR

SEQ ID NO: 2218412 - protein, 6 aa, Cryptosporidium parvum
KQSGYK

SEQ ID NO: 2218413 - protein, 8 aa, Cryptosporidium parvum
KQSNELKE

SEQ ID NO: 2218414 - protein, 12 aa, Cryptosporidium parvum
KQSNSNQPKNLP

SEQ ID NO: 2218415 - protein, 4 aa, Cryptosporidium parvum
KQST

SEQ ID NO: 2218416 - protein, 10 aa, Cryptosporidium parvum
KQSTKNSGEI

SEQ ID NO: 2218417 - protein, 8 aa, Cryptosporidium parvum
KQTATERT

SEQ ID NO: 2218418 - protein, 12 aa, Cryptosporidium parvum
KQTISSNSNFNS

SEQ ID NO: 2218419 - protein, 7 aa, Cryptosporidium parvum
KQTNNQQ

SEQ ID NO: 2218420 - protein, 5 aa, Cryptosporidium parvum
KQVNS

SEQ ID NO: 2218421 - protein, 5 aa, Cryptosporidium parvum
KQVPN

SEQ ID NO: 2218422 - protein, 9 aa, Cryptosporidium parvum
KQVRPESEI

SEQ ID NO: 2218423 - protein, 7 aa, Cryptosporidium parvum
KQVSSKS

SEQ ID NO: 2218424 - protein, 5 aa, Cryptosporidium parvum
KQYED

SEQ ID NO: 2218425 - protein, 8 aa, Cryptosporidium parvum
KRAAENDI

SEQ ID NO: 2218426 - protein, 7 aa, Cryptosporidium parvum
KRAAKST

SEQ ID NO: 2218427 - protein, 6 aa, Cryptosporidium parvum
KRADKT

SEQ ID NO: 2218428 - protein, 5 aa, Cryptosporidium parvum
KRAKS

SEQ ID NO: 2218429 - protein, 10 aa, Cryptosporidium parvum
KRANKDPNYR

SEQ ID NO: 2218430 - protein, 7 aa, Cryptosporidium parvum
KRASKDR

SEQ ID NO: 2218431 - protein, 9 aa, Cryptosporidium parvum
KRASSGKGI

SEQ ID NO: 2218432 - protein, 10 aa, Cryptosporidium parvum
KRDKEFNNKK

SEQ ID NO: 2218433 - protein, 11 aa, Cryptosporidium parvum
KRDKSIHGSGT

SEQ ID NO: 2218434 - protein, 18 aa, Cryptosporidium parvum
KRDSDSFSSSLSEGSDEN

SEQ ID NO: 2218435 - protein, 13 aa, Cryptosporidium parvum
KRDYGTSGNKVKD

SEQ ID NO: 2218436 - protein, 6 aa, Cryptosporidium parvum
KREASR

SEQ ID NO: 2218437 - protein, 7 aa, Cryptosporidium parvum
KREDRSR

SEQ ID NO: 2218438 - protein, 12 aa, Cryptosporidium parvum
KREINKNKINER

SEQ ID NO: 2218439 - protein, 16 aa, Cryptosporidium parvum
KREKANPIDFDGEREV

SEQ ID NO: 2218440 - protein, 9 aa, Cryptosporidium parvum
KREKDNSSI

SEQ ID NO: 2218441 - protein, 11 aa, Cryptosporidium parvum
KREKSKSDQEH

SEQ ID NO: 2218442 - protein, 6 aa, Cryptosporidium parvum
KRENSQ

SEQ ID NO: 2218443 - protein, 7 aa, Cryptosporidium parvum
KRENSSS

SEQ ID NO: 2218444 - protein, 20 aa, Cryptosporidium parvum
KREQSIDAEMSNSSYRNKND

SEQ ID NO: 2218445 - protein, 7 aa, Cryptosporidium parvum
KRERSEF

SEQ ID NO: 2218446 - protein, 12 aa, Cryptosporidium parvum
KRESKGGAPCPN

SEQ ID NO: 2218447 - protein, 4 aa, Cryptosporidium parvum
KRET

SEQ ID NO: 2218448 - protein, 7 aa, Cryptosporidium parvum
KRFKGPK

SEQ ID NO: 2218449 - protein, 9 aa, Cryptosporidium parvum
KRGAAPYLN

SEQ ID NO: 2218450 - protein, 5 aa, Cryptosporidium parvum
KRGGA

SEQ ID NO: 2218451 - protein, 14 aa, Cryptosporidium parvum
KRGGFNEDKIPKKD

SEQ ID NO: 2218452 - protein, 5 aa, Cryptosporidium parvum
KRGGL

SEQ ID NO: 2218453 - protein, 4 aa, Cryptosporidium parvum
KRGI

SEQ ID NO: 2218454 - protein, 6 aa, Cryptosporidium parvum
KRGKKA

SEQ ID NO: 2218455 - protein, 55 aa, Cryptosporidium parvum
KRGKSRNKKKKQKKQRKNKKSTRNDKKKSKKRVSTKEKRMKKKKINKRKQERMEK

SEQ ID NO: 2218456 - protein, 8 aa, Cryptosporidium parvum
KRGRQRLR

SEQ ID NO: 2218457 - protein, 11 aa, Cryptosporidium parvum
KRGRSNAHSSI

SEQ ID NO: 2218458 - protein, 26 aa, Cryptosporidium parvum
KRGTNEKKISNSDIFGSSDEERDEEF

SEQ ID NO: 2218459 - protein, 7 aa, Cryptosporidium parvum
KRHPGTK

SEQ ID NO: 2218460 - protein, 14 aa, Cryptosporidium parvum
KRIESKNPLGSKTI

SEQ ID NO: 2218461 - protein, 6 aa, Cryptosporidium parvum
KRIPSG

SEQ ID NO: 2218462 - protein, 19 aa, Cryptosporidium parvum
KRIQKNEKLNGRIDSNKGI

SEQ ID NO: 2218463 - protein, 6 aa, Cryptosporidium parvum
KRISKG

SEQ ID NO: 2218464 - protein, 16 aa, Cryptosporidium parvum
KRKERETRGREKGNTE

SEQ ID NO: 2218465 - protein, 9 aa, Cryptosporidium parvum
KRKETKPIQ

SEQ ID NO: 2218466 - protein, 13 aa, Cryptosporidium parvum
KRKGYSGKNTLSA

SEQ ID NO: 2218467 - protein, 7 aa, Cryptosporidium parvum
KRKKKKN

SEQ ID NO: 2218468 - protein, 9 aa, Cryptosporidium parvum
KRKNSQISD

SEQ ID NO: 2218469 - protein, 6 aa, Cryptosporidium parvum
KRKPEI

SEQ ID NO: 2218470 - protein, 9 aa, Cryptosporidium parvum
KRKPSKSTK

SEQ ID NO: 2218471 - protein, 8 aa, Cryptosporidium parvum
KRKSFSYE

SEQ ID NO: 2218472 - protein, 10 aa, Cryptosporidium parvum
KRKSINDYQE

SEQ ID NO: 2218473 - protein, 8 aa, Cryptosporidium parvum
KRKSNKNS

SEQ ID NO: 2218474 - protein, 9 aa, Cryptosporidium parvum
KRLYGTNKE

SEQ ID NO: 2218475 - protein, 5 aa, Cryptosporidium parvum
KRMRK

SEQ ID NO: 2218476 - protein, 9 aa, Cryptosporidium parvum
KRNINSFES

SEQ ID NO: 2218477 - protein, 10 aa, Cryptosporidium parvum
KRNKKKNHPG

SEQ ID NO: 2218478 - protein, 27 aa, Cryptosporidium parvum
KRNKQGNGKRCESVDRSRSIYSGTRES

SEQ ID NO: 2218479 - protein, 9 aa, Cryptosporidium parvum
KRNLGLTNE

SEQ ID NO: 2218480 - protein, 7 aa, Cryptosporidium parvum
KRNLSNK

SEQ ID NO: 2218481 - protein, 15 aa, Cryptosporidium parvum
KRNNQSDYQLEESRD

SEQ ID NO: 2218482 - protein, 6 aa, Cryptosporidium parvum
KRNPGL

SEQ ID NO: 2218483 - protein, 7 aa, Cryptosporidium parvum
KRNQNAK

SEQ ID NO: 2218484 - protein, 10 aa, Cryptosporidium parvum
KRNSCGDTGK

SEQ ID NO: 2218485 - protein, 5 aa, Cryptosporidium parvum
KRNSI

SEQ ID NO: 2218486 - protein, 8 aa, Cryptosporidium parvum
KRNSNIGK

SEQ ID NO: 2218487 - protein, 9 aa, Cryptosporidium parvum
KRNSNSHIE

SEQ ID NO: 2218488 - protein, 14 aa, Cryptosporidium parvum
KRNSRSEYTNPNSQ

SEQ ID NO: 2218489 - protein, 4 aa, Cryptosporidium parvum
KRNV

SEQ ID NO: 2218490 - protein, 6 aa, Cryptosporidium parvum
KRPDAF

SEQ ID NO: 2218491 - protein, 7 aa, Cryptosporidium parvum
KRPDPIC

SEQ ID NO: 2218492 - protein, 5 aa, Cryptosporidium parvum
KRPDY

SEQ ID NO: 2218493 - protein, 8 aa, Cryptosporidium parvum
KRPIPGSI

SEQ ID NO: 2218494 - protein, 8 aa, Cryptosporidium parvum
KRPKRTHT

SEQ ID NO: 2218495 - protein, 8 aa, Cryptosporidium parvum
KRPLDSQE

SEQ ID NO: 2218496 - protein, 5 aa, Cryptosporidium parvum
KRPNS

SEQ ID NO: 2218497 - protein, 30 aa, Cryptosporidium parvum
KRPPPPKSESSNSSSSSSSSSSSTETSHRS

SEQ ID NO: 2218498 - protein, 7 aa, Cryptosporidium parvum
KRPQEKK

SEQ ID NO: 2218499 - protein, 24 aa, Cryptosporidium parvum
KRPQSKIASDANQVPSNNDKNNGS

SEQ ID NO: 2218500 - protein, 8 aa, Cryptosporidium parvum
KRQDPIES

SEQ ID NO: 2218501 - protein, 19 aa, Cryptosporidium parvum
KRQDTSEETKGMDVDEETP

SEQ ID NO: 2218502 - protein, 10 aa, Cryptosporidium parvum
KRQKKIPSIN

SEQ ID NO: 2218503 - protein, 10 aa, Cryptosporidium parvum
KRQQELKEKE

SEQ ID NO: 2218504 - protein, 7 aa, Cryptosporidium parvum
KRQSPPS

SEQ ID NO: 2218505 - protein, 5 aa, Cryptosporidium parvum
KRRAI

SEQ ID NO: 2218506 - protein, 8 aa, Cryptosporidium parvum
KRRDGDNQ

SEQ ID NO: 2218507 - protein, 4 aa, Cryptosporidium parvum
KRRG

SEQ ID NO: 2218508 - protein, 25 aa, Cryptosporidium parvum
KRRKENEEFEVQNSSSIENIGNEGF

SEQ ID NO: 2218509 - protein, 10 aa, Cryptosporidium parvum
KRRPVDKSGI

SEQ ID NO: 2218510 - protein, 10 aa, Cryptosporidium parvum
KRRQKITNEN

SEQ ID NO: 2218511 - protein, 8 aa, Cryptosporidium parvum
KRRSSSLQ

SEQ ID NO: 2218512 - protein, 15 aa, Cryptosporidium parvum
KRSDSISNINSKTNL

SEQ ID NO: 2218513 - protein, 5 aa, Cryptosporidium parvum
KRSEE

SEQ ID NO: 2218514 - protein, 6 aa, Cryptosporidium parvum
KRSESR

SEQ ID NO: 2218515 - protein, 5 aa, Cryptosporidium parvum
KRSFE

SEQ ID NO: 2218516 - protein, 4 aa, Cryptosporidium parvum
KRSG

SEQ ID NO: 2218517 - protein, 5 aa, Cryptosporidium parvum
KRSGI

SEQ ID NO: 2218518 - protein, 5 aa, Cryptosporidium parvum
KRSGS

SEQ ID NO: 2218519 - protein, 10 aa, Cryptosporidium parvum
KRSHPEITTE

SEQ ID NO: 2218520 - protein, 15 aa, Cryptosporidium parvum
KRSIETEEKKKKPIR

SEQ ID NO: 2218521 - protein, 6 aa, Cryptosporidium parvum
KRSKEK

SEQ ID NO: 2218522 - protein, 22 aa, Cryptosporidium parvum
KRSKSDSSVNPKPTTSKPAPLN

SEQ ID NO: 2218523 - protein, 9 aa, Cryptosporidium parvum
KRSLQNQQF

SEQ ID NO: 2218524 - protein, 5 aa, Cryptosporidium parvum
KRSQL

SEQ ID NO: 2218525 - protein, 6 aa, Cryptosporidium parvum
KRSSQD

SEQ ID NO: 2218526 - protein, 6 aa, Cryptosporidium parvum
KRSSTN

SEQ ID NO: 2218527 - protein, 16 aa, Cryptosporidium parvum
KRSTTTPCNQSFGSEK

SEQ ID NO: 2218528 - protein, 6 aa, Cryptosporidium parvum
KRSYIT

SEQ ID NO: 2218529 - protein, 25 aa, Cryptosporidium parvum
KRSYTSGNNHSTRSSSKLENTNYSI

SEQ ID NO: 2218530 - protein, 7 aa, Cryptosporidium parvum
KRTEEEI

SEQ ID NO: 2218531 - protein, 8 aa, Cryptosporidium parvum
KRTGKKED

SEQ ID NO: 2218532 - protein, 5 aa, Cryptosporidium parvum
KRTIG

SEQ ID NO: 2218533 - protein, 6 aa, Cryptosporidium parvum
KRTISS

SEQ ID NO: 2218534 - protein, 18 aa, Cryptosporidium parvum
KRTWTQGQNQCKHKNNIP

SEQ ID NO: 2218535 - protein, 12 aa, Cryptosporidium parvum
KRTYNSNGRVRV

SEQ ID NO: 2218536 - protein, 13 aa, Cryptosporidium parvum
KRVDNVTKSTPNF

SEQ ID NO: 2218537 - protein, 29 aa, Cryptosporidium parvum
KRVNGDNSNNNNNKGGDLGSEEEDEEEDI

SEQ ID NO: 2218538 - protein, 11 aa, Cryptosporidium parvum
KRVNNGESEIK

SEQ ID NO: 2218539 - protein, 20 aa, Cryptosporidium parvum
KRVPFKNEKSSLSPINNTSS

SEQ ID NO: 2218540 - protein, 6 aa, Cryptosporidium parvum
KRYEER

SEQ ID NO: 2218541 - protein, 11 aa, Cryptosporidium parvum
KRYGNLKGGVS

SEQ ID NO: 2218542 - protein, 10 aa, Cryptosporidium parvum
KRYRGGKNAK

SEQ ID NO: 2218543 - protein, 4 aa, Cryptosporidium parvum
KRYV

SEQ ID NO: 2218544 - protein, 13 aa, Cryptosporidium parvum
KSAKGWRKKPPSF

SEQ ID NO: 2218545 - protein, 10 aa, Cryptosporidium parvum
KSAKRFPSEI

SEQ ID NO: 2218546 - protein, 7 aa, Cryptosporidium parvum
KSAQIGS

SEQ ID NO: 2218547 - protein, 5 aa, Cryptosporidium parvum
KSASI

SEQ ID NO: 2218548 - protein, 6 aa, Cryptosporidium parvum
KSASNT

SEQ ID NO: 2218549 - protein, 7 aa, Cryptosporidium parvum
KSASQRE

SEQ ID NO: 2218550 - protein, 8 aa, Cryptosporidium parvum
KSASRSIS

SEQ ID NO: 2218551 - protein, 9 aa, Cryptosporidium parvum
KSASRTSKL

SEQ ID NO: 2218552 - protein, 5 aa, Cryptosporidium parvum
KSATD

SEQ ID NO: 2218553 - protein, 9 aa, Cryptosporidium parvum
KSATSKGLI

SEQ ID NO: 2218554 - protein, 8 aa, Cryptosporidium parvum
KSCDPSPC

SEQ ID NO: 2218555 - protein, 6 aa, Cryptosporidium parvum
KSCEGE

SEQ ID NO: 2218556 - protein, 9 aa, Cryptosporidium parvum
KSCQSNPQY

SEQ ID NO: 2218557 - protein, 5 aa, Cryptosporidium parvum
KSCRD

SEQ ID NO: 2218558 - protein, 10 aa, Cryptosporidium parvum
KSDEDYEQQL

SEQ ID NO: 2218559 - protein, 7 aa, Cryptosporidium parvum
KSDEYSR

SEQ ID NO: 2218560 - protein, 15 aa, Cryptosporidium parvum
KSDIDKNSNNKINSE

SEQ ID NO: 2218561 - protein, 15 aa, Cryptosporidium parvum
KSDKDDSKVKNIWKR

SEQ ID NO: 2218562 - protein, 8 aa, Cryptosporidium parvum
KSDKDHRE

SEQ ID NO: 2218563 - protein, 7 aa, Cryptosporidium parvum
KSDKESI

SEQ ID NO: 2218564 - protein, 6 aa, Cryptosporidium parvum
KSDNEI

SEQ ID NO: 2218565 - protein, 9 aa, Cryptosporidium parvum
KSDNENSNH

SEQ ID NO: 2218566 - protein, 5 aa, Cryptosporidium parvum
KSDNI

SEQ ID NO: 2218567 - protein, 5 aa, Cryptosporidium parvum
KSDNR

SEQ ID NO: 2218568 - protein, 4 aa, Cryptosporidium parvum
KSDQ

SEQ ID NO: 2218569 - protein, 6 aa, Cryptosporidium parvum
KSDQGN

SEQ ID NO: 2218570 - protein, 9 aa, Cryptosporidium parvum
KSDQNLSSQ

SEQ ID NO: 2218571 - protein, 11 aa, Cryptosporidium parvum
KSDSAKKRKIK

SEQ ID NO: 2218572 - protein, 6 aa, Cryptosporidium parvum
KSEADF

SEQ ID NO: 2218573 - protein, 7 aa, Cryptosporidium parvum
KSEDNLN

SEQ ID NO: 2218574 - protein, 9 aa, Cryptosporidium parvum
KSEEDCPEN

SEQ ID NO: 2218575 - protein, 4 aa, Cryptosporidium parvum
KSEF

SEQ ID NO: 2218576 - protein, 8 aa, Cryptosporidium parvum
KSEGSLAS

SEQ ID NO: 2218577 - protein, 17 aa, Cryptosporidium parvum
KSEIKSNRQEDSESITK

SEQ ID NO: 2218578 - protein, 20 aa, Cryptosporidium parvum
KSEKDITKTTTMTEQTPPLS

SEQ ID NO: 2218579 - protein, 8 aa, Cryptosporidium parvum
KSEKDKQV

SEQ ID NO: 2218580 - protein, 9 aa, Cryptosporidium parvum
KSEKEKIKK

SEQ ID NO: 2218581 - protein, 5 aa, Cryptosporidium parvum
KSELA

SEQ ID NO: 2218582 - protein, 7 aa, Cryptosporidium parvum
KSELQRS

SEQ ID NO: 2218583 - protein, 19 aa, Cryptosporidium parvum
KSEQEQEQEQKYCNDESSL

SEQ ID NO: 2218584 - protein, 19 aa, Cryptosporidium parvum
KSESDSTSHRFKRNKKEQI

SEQ ID NO: 2218585 - protein, 10 aa, Cryptosporidium parvum
KSESGPEERV

SEQ ID NO: 2218586 - protein, 5 aa, Cryptosporidium parvum
KSESK

SEQ ID NO: 2218587 - protein, 8 aa, Cryptosporidium parvum
KSESLSKP

SEQ ID NO: 2218588 - protein, 35 aa, Cryptosporidium parvum
KSETGGVTSNQQSKHNSAQSIKSIDTTSENSPSFK

SEQ ID NO: 2218589 - protein, 5 aa, Cryptosporidium parvum
KSFAS

SEQ ID NO: 2218590 - protein, 7 aa, Cryptosporidium parvum
KSFDTDK

SEQ ID NO: 2218591 - protein, 4 aa, Cryptosporidium parvum
KSFK

SEQ ID NO: 2218592 - protein, 12 aa, Cryptosporidium parvum
KSFKPSSAPPGI

SEQ ID NO: 2218593 - protein, 5 aa, Cryptosporidium parvum
KSFNP

SEQ ID NO: 2218594 - protein, 4 aa, Cryptosporidium parvum
KSFS

SEQ ID NO: 2218595 - protein, 7 aa, Cryptosporidium parvum
KSFSESL

SEQ ID NO: 2218596 - protein, 5 aa, Cryptosporidium parvum
KSFSK

SEQ ID NO: 2218597 - protein, 16 aa, Cryptosporidium parvum
KSFSSSQLSTSSSNLD

SEQ ID NO: 2218598 - protein, 4 aa, Cryptosporidium parvum
KSFT

SEQ ID NO: 2218599 - protein, 6 aa, Cryptosporidium parvum
KSGAQT

SEQ ID NO: 2218600 - protein, 16 aa, Cryptosporidium parvum
KSGENINRSNRETKEY

SEQ ID NO: 2218601 - protein, 23 aa, Cryptosporidium parvum
KSGGAILGRNTDKINGSSTSNIA

SEQ ID NO: 2218602 - protein, 7 aa, Cryptosporidium parvum
KSGGHLG

SEQ ID NO: 2218603 - protein, 5 aa, Cryptosporidium parvum
KSGGL

SEQ ID NO: 2218604 - protein, 8 aa, Cryptosporidium parvum
KSGGPEKD

SEQ ID NO: 2218605 - protein, 7 aa, Cryptosporidium parvum
KSGKTIG

SEQ ID NO: 2218606 - protein, 15 aa, Cryptosporidium parvum
KSGLKCDTKNLEKGW

SEQ ID NO: 2218607 - protein, 10 aa, Cryptosporidium parvum
KSGNGRFNEE

SEQ ID NO: 2218608 - protein, 7 aa, Cryptosporidium parvum
KSGRGPV

SEQ ID NO: 2218609 - protein, 7 aa, Cryptosporidium parvum
KSGSSIK

SEQ ID NO: 2218610 - protein, 37 aa, Cryptosporidium parvum
KSGSSSSGTTANTQTLPSSTVASNVSSSLGNAPLTDE

SEQ ID NO: 2218611 - protein, 10 aa, Cryptosporidium parvum
KSGYSTEGGS

SEQ ID NO: 2218612 - protein, 7 aa, Cryptosporidium parvum
KSHDSNH

SEQ ID NO: 2218613 - protein, 7 aa, Cryptosporidium parvum
KSHEGIK

SEQ ID NO: 2218614 - protein, 21 aa, Cryptosporidium parvum
KSHIDEENDNQKEDQSNENEA

SEQ ID NO: 2218615 - protein, 8 aa, Cryptosporidium parvum
KSHKSKSY

SEQ ID NO: 2218616 - protein, 21 aa, Cryptosporidium parvum
KSHLSDSEFHSPDEHKVSSVS

SEQ ID NO: 2218617 - protein, 7 aa, Cryptosporidium parvum
KSHNPSE

SEQ ID NO: 2218618 - protein, 8 aa, Cryptosporidium parvum
KSHPSLQS

SEQ ID NO: 2218619 - protein, 6 aa, Cryptosporidium parvum
KSHRLP

SEQ ID NO: 2218620 - protein, 10 aa, Cryptosporidium parvum
KSHSANKGGS

SEQ ID NO: 2218621 - protein, 6 aa, Cryptosporidium parvum
KSHSEA

SEQ ID NO: 2218622 - protein, 13 aa, Cryptosporidium parvum
KSHSFSATNDGRI

SEQ ID NO: 2218623 - protein, 6 aa, Cryptosporidium parvum
KSHTGR

SEQ ID NO: 2218624 - protein, 9 aa, Cryptosporidium parvum
KSIATSPSS

SEQ ID NO: 2218625 - protein, 6 aa, Cryptosporidium parvum
KSIDTL

SEQ ID NO: 2218626 - protein, 11 aa, Cryptosporidium parvum
KSIEGSPEKEL

SEQ ID NO: 2218627 - protein, 8 aa, Cryptosporidium parvum
KSIEPTSG

SEQ ID NO: 2218628 - protein, 16 aa, Cryptosporidium parvum
KSIETSNYNDNPRSLS

SEQ ID NO: 2218629 - protein, 5 aa, Cryptosporidium parvum
KSIKA

SEQ ID NO: 2218630 - protein, 10 aa, Cryptosporidium parvum
KSIKDEKEIS

SEQ ID NO: 2218631 - protein, 14 aa, Cryptosporidium parvum
KSIKDKDSGRREER

SEQ ID NO: 2218632 - protein, 14 aa, Cryptosporidium parvum
KSIKEKKDEAEDEN

SEQ ID NO: 2218633 - protein, 7 aa, Cryptosporidium parvum
KSIKESS

SEQ ID NO: 2218634 - protein, 14 aa, Cryptosporidium parvum
KSIKGAKGKITKKN

SEQ ID NO: 2218635 - protein, 11 aa, Cryptosporidium parvum
KSIPQNFRGSE

SEQ ID NO: 2218636 - protein, 4 aa, Cryptosporidium parvum
KSIQ

SEQ ID NO: 2218637 - protein, 11 aa, Cryptosporidium parvum
KSIRNRQMNQG

SEQ ID NO: 2218638 - protein, 7 aa, Cryptosporidium parvum
KSISDSE

SEQ ID NO: 2218639 - protein, 13 aa, Cryptosporidium parvum
KSISSAAGNVEES

SEQ ID NO: 2218640 - protein, 19 aa, Cryptosporidium parvum
KSIVTGSSSLRLNKGDDSY

SEQ ID NO: 2218641 - protein, 8 aa, Cryptosporidium parvum
KSKAFGND

SEQ ID NO: 2218642 - protein, 5 aa, Cryptosporidium parvum
KSKAK

SEQ ID NO: 2218643 - protein, 25 aa, Cryptosporidium parvum
KSKDSDSNSKESSGSKIKSDQSKSL

SEQ ID NO: 2218644 - protein, 8 aa, Cryptosporidium parvum
KSKDSPEF

SEQ ID NO: 2218645 - protein, 7 aa, Cryptosporidium parvum
KSKEQDI

SEQ ID NO: 2218646 - protein, 11 aa, Cryptosporidium parvum
KSKESQKNENF

SEQ ID NO: 2218647 - protein, 8 aa, Cryptosporidium parvum
KSKETDNC

SEQ ID NO: 2218648 - protein, 21 aa, Cryptosporidium parvum
KSKGEKSPVSPKSTKISPSLS

SEQ ID NO: 2218649 - protein, 9 aa, Cryptosporidium parvum
KSKHSETAL

SEQ ID NO: 2218650 - protein, 13 aa, Cryptosporidium parvum
KSKHSSTERTSGL

SEQ ID NO: 2218651 - protein, 11 aa, Cryptosporidium parvum
KSKILDGQKQD

SEQ ID NO: 2218652 - protein, 19 aa, Cryptosporidium parvum
KSKKSNKSSYRQKPRKVTV

SEQ ID NO: 2218653 - protein, 7 aa, Cryptosporidium parvum
KSKKYNK

SEQ ID NO: 2218654 - protein, 4 aa, Cryptosporidium parvum
KSKL

SEQ ID NO: 2218655 - protein, 11 aa, Cryptosporidium parvum
KSKNKDSMDHS

SEQ ID NO: 2218656 - protein, 10 aa, Cryptosporidium parvum
KSKQKAKYIE

SEQ ID NO: 2218657 - protein, 10 aa, Cryptosporidium parvum
KSKQNNNKRN

SEQ ID NO: 2218658 - protein, 22 aa, Cryptosporidium parvum
KSKQTSSNYHSNHSSSNNDKEQ

SEQ ID NO: 2218659 - protein, 4 aa, Cryptosporidium parvum
KSKS

SEQ ID NO: 2218660 - protein, 14 aa, Cryptosporidium parvum
KSKSKINGNKSIET

SEQ ID NO: 2218661 - protein, 6 aa, Cryptosporidium parvum
KSKSLI

SEQ ID NO: 2218662 - protein, 19 aa, Cryptosporidium parvum
KSKSSPEISSIGAKKGLKS

SEQ ID NO: 2218663 - protein, 10 aa, Cryptosporidium parvum
KSKSSSGTNT

SEQ ID NO: 2218664 - protein, 8 aa, Cryptosporidium parvum
KSKTAPHI

SEQ ID NO: 2218665 - protein, 11 aa, Cryptosporidium parvum
KSKTKKKNKRN

SEQ ID NO: 2218666 - protein, 13 aa, Cryptosporidium parvum
KSKTSVNLSNASS

SEQ ID NO: 2218667 - protein, 6 aa, Cryptosporidium parvum
KSKVEV

SEQ ID NO: 2218668 - protein, 6 aa, Cryptosporidium parvum
KSKVSE

SEQ ID NO: 2218669 - protein, 6 aa, Cryptosporidium parvum
KSKYDL

SEQ ID NO: 2218670 - protein, 22 aa, Cryptosporidium parvum
KSKYKIDNPELGPESNLDRSKR

SEQ ID NO: 2218671 - protein, 12 aa, Cryptosporidium parvum
KSLAKKYTKQTN

SEQ ID NO: 2218672 - protein, 12 aa, Cryptosporidium parvum
KSLAKSGLDGGT

SEQ ID NO: 2218673 - protein, 9 aa, Cryptosporidium parvum
KSLAPSLTS

SEQ ID NO: 2218674 - protein, 5 aa, Cryptosporidium parvum
KSLDK

SEQ ID NO: 2218675 - protein, 11 aa, Cryptosporidium parvum
KSLDTKQNKGL

SEQ ID NO: 2218676 - protein, 58 aa, Cryptosporidium parvum
KSLEDSEGSENKAENGCPKVASEEVGGELTGTIDSSSMKDSKELEKMESNVTDGKAIY

SEQ ID NO: 2218677 - protein, 6 aa, Cryptosporidium parvum
KSLENN

SEQ ID NO: 2218678 - protein, 11 aa, Cryptosporidium parvum
KSLERGSGKSI

SEQ ID NO: 2218679 - protein, 12 aa, Cryptosporidium parvum
KSLGDSYNTDPL

SEQ ID NO: 2218680 - protein, 9 aa, Cryptosporidium parvum
KSLNKQSYT

SEQ ID NO: 2218681 - protein, 6 aa, Cryptosporidium parvum
KSLNND

SEQ ID NO: 2218682 - protein, 14 aa, Cryptosporidium parvum
KSLSHEKNNNQPEL

SEQ ID NO: 2218683 - protein, 17 aa, Cryptosporidium parvum
KSLSNKRCNTKLNNTWQ

SEQ ID NO: 2218684 - protein, 8 aa, Cryptosporidium parvum
KSLTEEEV

SEQ ID NO: 2218685 - protein, 8 aa, Cryptosporidium parvum
KSMDLEQE

SEQ ID NO: 2218686 - protein, 7 aa, Cryptosporidium parvum
KSNANLN

SEQ ID NO: 2218687 - protein, 33 aa, Cryptosporidium parvum
KSNAPSKKSGKKSSKNDSSNRGQGQNSQTFEET

SEQ ID NO: 2218688 - protein, 33 aa, Cryptosporidium parvum
KSNDDKKVSQKDSNSVSYSKKLTKEQERTSSPF

SEQ ID NO: 2218689 - protein, 6 aa, Cryptosporidium parvum
KSNDLD

SEQ ID NO: 2218690 - protein, 9 aa, Cryptosporidium parvum
KSNDNSEKL

SEQ ID NO: 2218691 - protein, 5 aa, Cryptosporidium parvum
KSNDW

SEQ ID NO: 2218692 - protein, 14 aa, Cryptosporidium parvum
KSNEEIKNKESDIQ

SEQ ID NO: 2218693 - protein, 12 aa, Cryptosporidium parvum
KSNEPAEKAGKS

SEQ ID NO: 2218694 - protein, 9 aa, Cryptosporidium parvum
KSNGSSEIG

SEQ ID NO: 2218695 - protein, 4 aa, Cryptosporidium parvum
KSNH

SEQ ID NO: 2218696 - protein, 41 aa, Cryptosporidium parvum
KSNHGLSPSLPGSYNITSNSNPNLNQNIQTSPRISRRGSRV

SEQ ID NO: 2218697 - protein, 13 aa, Cryptosporidium parvum
KSNILSSKEQLKN

SEQ ID NO: 2218698 - protein, 8 aa, Cryptosporidium parvum
KSNISDGG

SEQ ID NO: 2218699 - protein, 9 aa, Cryptosporidium parvum
KSNITHSNK

SEQ ID NO: 2218700 - protein, 8 aa, Cryptosporidium parvum
KSNKISEK

SEQ ID NO: 2218701 - protein, 15 aa, Cryptosporidium parvum
KSNLSRINSNISDSN

SEQ ID NO: 2218702 - protein, 8 aa, Cryptosporidium parvum
KSNMSSDI

SEQ ID NO: 2218703 - protein, 4 aa, Cryptosporidium parvum
KSNN

SEQ ID NO: 2218704 - protein, 6 aa, Cryptosporidium parvum
KSNNEP

SEQ ID NO: 2218705 - protein, 11 aa, Cryptosporidium parvum
KSNNSKKRETF

SEQ ID NO: 2218706 - protein, 6 aa, Cryptosporidium parvum
KSNNTS

SEQ ID NO: 2218707 - protein, 13 aa, Cryptosporidium parvum
KSNPDKDQDHKIG

SEQ ID NO: 2218708 - protein, 7 aa, Cryptosporidium parvum
KSNPEAR

SEQ ID NO: 2218709 - protein, 5 aa, Cryptosporidium parvum
KSNPL

SEQ ID NO: 2218710 - protein, 7 aa, Cryptosporidium parvum
KSNPTAE

SEQ ID NO: 2218711 - protein, 8 aa, Cryptosporidium parvum
KSNQEKTI

SEQ ID NO: 2218712 - protein, 6 aa, Cryptosporidium parvum
KSNQGL

SEQ ID NO: 2218713 - protein, 7 aa, Cryptosporidium parvum
KSNSGYL

SEQ ID NO: 2218714 - protein, 7 aa, Cryptosporidium parvum
KSNSNSI

SEQ ID NO: 2218715 - protein, 7 aa, Cryptosporidium parvum
KSNTLNS

SEQ ID NO: 2218716 - protein, 10 aa, Cryptosporidium parvum
KSNTPSGNKY

SEQ ID NO: 2218717 - protein, 8 aa, Cryptosporidium parvum
KSNYDEEK

SEQ ID NO: 2218718 - protein, 6 aa, Cryptosporidium parvum
KSPELS

SEQ ID NO: 2218719 - protein, 5 aa, Cryptosporidium parvum
KSPIE

SEQ ID NO: 2218720 - protein, 7 aa, Cryptosporidium parvum
KSPIKCQ

SEQ ID NO: 2218721 - protein, 6 aa, Cryptosporidium parvum
KSPIKT

SEQ ID NO: 2218722 - protein, 6 aa, Cryptosporidium parvum
KSPLTN

SEQ ID NO: 2218723 - protein, 7 aa, Cryptosporidium parvum
KSPNEAL

SEQ ID NO: 2218724 - protein, 16 aa, Cryptosporidium parvum
KSPNISPAKQEESSLL

SEQ ID NO: 2218725 - protein, 6 aa, Cryptosporidium parvum
KSPSKA

SEQ ID NO: 2218726 - protein, 7 aa, Cryptosporidium parvum
KSPSNTL

SEQ ID NO: 2218727 - protein, 18 aa, Cryptosporidium parvum
KSPTEERNDSKKRRIEES

SEQ ID NO: 2218728 - protein, 6 aa, Cryptosporidium parvum
KSPVEH

SEQ ID NO: 2218729 - protein, 6 aa, Cryptosporidium parvum
KSPVSS

SEQ ID NO: 2218730 - protein, 4 aa, Cryptosporidium parvum
KSQE

SEQ ID NO: 2218731 - protein, 13 aa, Cryptosporidium parvum
KSQENISNSNNTF

SEQ ID NO: 2218732 - protein, 9 aa, Cryptosporidium parvum
KSQIQNHEY

SEQ ID NO: 2218733 - protein, 8 aa, Cryptosporidium parvum
KSQKNDDF

SEQ ID NO: 2218734 - protein, 5 aa, Cryptosporidium parvum
KSQLL

SEQ ID NO: 2218735 - protein, 8 aa, Cryptosporidium parvum
KSQNNTNI

SEQ ID NO: 2218736 - protein, 6 aa, Cryptosporidium parvum
KSQRKN

SEQ ID NO: 2218737 - protein, 7 aa, Cryptosporidium parvum
KSQYQKD

SEQ ID NO: 2218738 - protein, 7 aa, Cryptosporidium parvum
KSRGYNK

SEQ ID NO: 2218739 - protein, 19 aa, Cryptosporidium parvum
KSRKDSKTDNNNHFENNSQ

SEQ ID NO: 2218740 - protein, 12 aa, Cryptosporidium parvum
KSRKSKYNSTNG

SEQ ID NO: 2218741 - protein, 36 aa, Cryptosporidium parvum
KSRMQSPCPSSNSTNTGLKPTLSQLNNSNGSTSLSS

SEQ ID NO: 2218742 - protein, 5 aa, Cryptosporidium parvum
KSRMS

SEQ ID NO: 2218743 - protein, 25 aa, Cryptosporidium parvum
KSRNSGSDSQANEISSTPSTTTDDF

SEQ ID NO: 2218744 - protein, 9 aa, Cryptosporidium parvum
KSRQDAQYT

SEQ ID NO: 2218745 - protein, 5 aa, Cryptosporidium parvum
KSRRD

SEQ ID NO: 2218746 - protein, 7 aa, Cryptosporidium parvum
KSRSFGN

SEQ ID NO: 2218747 - protein, 8 aa, Cryptosporidium parvum
KSRSTSYT

SEQ ID NO: 2218748 - protein, 19 aa, Cryptosporidium parvum
KSRTPGDSWNGKEDGEKEE

SEQ ID NO: 2218749 - protein, 19 aa, Cryptosporidium parvum
KSRVESNQNFTENDNKSNV

SEQ ID NO: 2218750 - protein, 4 aa, Cryptosporidium parvum
KSSA

SEQ ID NO: 2218751 - protein, 20 aa, Cryptosporidium parvum
KSSAEWSNYEKRQKNDEELE

SEQ ID NO: 2218752 - protein, 6 aa, Cryptosporidium parvum
KSSCNQ

SEQ ID NO: 2218753 - protein, 5 aa, Cryptosporidium parvum
KSSDG

SEQ ID NO: 2218754 - protein, 6 aa, Cryptosporidium parvum
KSSDIP

SEQ ID NO: 2218755 - protein, 5 aa, Cryptosporidium parvum
KSSDL

SEQ ID NO: 2218756 - protein, 6 aa, Cryptosporidium parvum
KSSDLS

SEQ ID NO: 2218757 - protein, 9 aa, Cryptosporidium parvum
KSSDSGGRS

SEQ ID NO: 2218758 - protein, 6 aa, Cryptosporidium parvum
KSSEHL

SEQ ID NO: 2218759 - protein, 10 aa, Cryptosporidium parvum
KSSEKNFDCD

SEQ ID NO: 2218760 - protein, 8 aa, Cryptosporidium parvum
KSSENKTK

SEQ ID NO: 2218761 - protein, 8 aa, Cryptosporidium parvum
KSSENSNY

SEQ ID NO: 2218762 - protein, 23 aa, Cryptosporidium parvum
KSSESGNGKDGAEVQANGSSVSS

SEQ ID NO: 2218763 - protein, 28 aa, Cryptosporidium parvum
KSSFLQSAKSSFSQFDEEKRGKLNYTET

SEQ ID NO: 2218764 - protein, 9 aa, Cryptosporidium parvum
KSSGAENSN

SEQ ID NO: 2218765 - protein, 9 aa, Cryptosporidium parvum
KSSGTSDLG

SEQ ID NO: 2218766 - protein, 4 aa, Cryptosporidium parvum
KSSH

SEQ ID NO: 2218767 - protein, 22 aa, Cryptosporidium parvum
KSSHSNQSSSISINSHKNNKIN

SEQ ID NO: 2218768 - protein, 9 aa, Cryptosporidium parvum
KSSINGKLS

SEQ ID NO: 2218769 - protein, 9 aa, Cryptosporidium parvum
KSSIPNPIT

SEQ ID NO: 2218770 - protein, 8 aa, Cryptosporidium parvum
KSSKCGLN

SEQ ID NO: 2218771 - protein, 7 aa, Cryptosporidium parvum
KSSKFSK

SEQ ID NO: 2218772 - protein, 8 aa, Cryptosporidium parvum
KSSKHERS

SEQ ID NO: 2218773 - protein, 10 aa, Cryptosporidium parvum
KSSKNPSEIT

SEQ ID NO: 2218774 - protein, 11 aa, Cryptosporidium parvum
KSSKSIDRSQE

SEQ ID NO: 2218775 - protein, 7 aa, Cryptosporidium parvum
KSSKSVI

SEQ ID NO: 2218776 - protein, 6 aa, Cryptosporidium parvum
KSSNFE

SEQ ID NO: 2218777 - protein, 5 aa, Cryptosporidium parvum
KSSNL

SEQ ID NO: 2218778 - protein, 10 aa, Cryptosporidium parvum
KSSNNNNHLP

SEQ ID NO: 2218779 - protein, 8 aa, Cryptosporidium parvum
KSSNNNSA

SEQ ID NO: 2218780 - protein, 6 aa, Cryptosporidium parvum
KSSNPK

SEQ ID NO: 2218781 - protein, 6 aa, Cryptosporidium parvum
KSSPKI

SEQ ID NO: 2218782 - protein, 19 aa, Cryptosporidium parvum
KSSPTVTKKDDIDKEVAPG

SEQ ID NO: 2218783 - protein, 7 aa, Cryptosporidium parvum
KSSQSAR

SEQ ID NO: 2218784 - protein, 4 aa, Cryptosporidium parvum
KSSR

SEQ ID NO: 2218785 - protein, 7 aa, Cryptosporidium parvum
KSSRERM

SEQ ID NO: 2218786 - protein, 9 aa, Cryptosporidium parvum
KSSRLSKRN

SEQ ID NO: 2218787 - protein, 9 aa, Cryptosporidium parvum
KSSRPVGDG

SEQ ID NO: 2218788 - protein, 7 aa, Cryptosporidium parvum
KSSRPYG

SEQ ID NO: 2218789 - protein, 14 aa, Cryptosporidium parvum
KSSSLNNKSFERSK

SEQ ID NO: 2218790 - protein, 6 aa, Cryptosporidium parvum
KSSSNK

SEQ ID NO: 2218791 - protein, 10 aa, Cryptosporidium parvum
KSSSNYINNK

SEQ ID NO: 2218792 - protein, 11 aa, Cryptosporidium parvum
KSSSSDSTVSR

SEQ ID NO: 2218793 - protein, 10 aa, Cryptosporidium parvum
KSSSSTQEYE

SEQ ID NO: 2218794 - protein, 6 aa, Cryptosporidium parvum
KSSTKL

SEQ ID NO: 2218795 - protein, 10 aa, Cryptosporidium parvum
KSSTSNKKLN

SEQ ID NO: 2218796 - protein, 6 aa, Cryptosporidium parvum
KSSVEM

SEQ ID NO: 2218797 - protein, 14 aa, Cryptosporidium parvum
KSSVKVKKSSTGGE

SEQ ID NO: 2218798 - protein, 12 aa, Cryptosporidium parvum
KSSYQSKKPLKS

SEQ ID NO: 2218799 - protein, 5 aa, Cryptosporidium parvum
KSSYV

SEQ ID NO: 2218800 - protein, 4 aa, Cryptosporidium parvum
KSTA

SEQ ID NO: 2218801 - protein, 4 aa, Cryptosporidium parvum
KSTE

SEQ ID NO: 2218802 - protein, 9 aa, Cryptosporidium parvum
KSTEESESY

SEQ ID NO: 2218803 - protein, 7 aa, Cryptosporidium parvum
KSTENSL

SEQ ID NO: 2218804 - protein, 8 aa, Cryptosporidium parvum
KSTESFER

SEQ ID NO: 2218805 - protein, 8 aa, Cryptosporidium parvum
KSTESQLN

SEQ ID NO: 2218806 - protein, 7 aa, Cryptosporidium parvum
KSTGYKS

SEQ ID NO: 2218807 - protein, 8 aa, Cryptosporidium parvum
KSTHSTDN

SEQ ID NO: 2218808 - protein, 5 aa, Cryptosporidium parvum
KSTIE

SEQ ID NO: 2218809 - protein, 21 aa, Cryptosporidium parvum
KSTISHSRSLSTSISPPPPYV

SEQ ID NO: 2218810 - protein, 10 aa, Cryptosporidium parvum
KSTKERDDNI

SEQ ID NO: 2218811 - protein, 6 aa, Cryptosporidium parvum
KSTNGD

SEQ ID NO: 2218812 - protein, 7 aa, Cryptosporidium parvum
KSTSNDC

SEQ ID NO: 2218813 - protein, 8 aa, Cryptosporidium parvum
KSTSNLKN

SEQ ID NO: 2218814 - protein, 18 aa, Cryptosporidium parvum
KSTSNSPDDAKDKEASDL

SEQ ID NO: 2218815 - protein, 8 aa, Cryptosporidium parvum
KSTSSNNN

SEQ ID NO: 2218816 - protein, 8 aa, Cryptosporidium parvum
KSTTASSN

SEQ ID NO: 2218817 - protein, 7 aa, Cryptosporidium parvum
KSTYNQS

SEQ ID NO: 2218818 - protein, 4 aa, Cryptosporidium parvum
KSVE

SEQ ID NO: 2218819 - protein, 6 aa, Cryptosporidium parvum
KSVEDA

SEQ ID NO: 2218820 - protein, 14 aa, Cryptosporidium parvum
KSVEIDDSYADKEI

SEQ ID NO: 2218821 - protein, 7 aa, Cryptosporidium parvum
KSVSNSN

SEQ ID NO: 2218822 - protein, 7 aa, Cryptosporidium parvum
KSVTDGL

SEQ ID NO: 2218823 - protein, 14 aa, Cryptosporidium parvum
KSVTSENAANGKLN

SEQ ID NO: 2218824 - protein, 8 aa, Cryptosporidium parvum
KSVVAGDD

SEQ ID NO: 2218825 - protein, 7 aa, Cryptosporidium parvum
KSYEGKN

SEQ ID NO: 2218826 - protein, 9 aa, Cryptosporidium parvum
KSYKNTKAL

SEQ ID NO: 2218827 - protein, 8 aa, Cryptosporidium parvum
KSYNKSGI

SEQ ID NO: 2218828 - protein, 10 aa, Cryptosporidium parvum
KSYPKVKQSG

SEQ ID NO: 2218829 - protein, 5 aa, Cryptosporidium parvum
KSYQS

SEQ ID NO: 2218830 - protein, 8 aa, Cryptosporidium parvum
KSYSSKEN

SEQ ID NO: 2218831 - protein, 4 aa, Cryptosporidium parvum
KTAC

SEQ ID NO: 2218832 - protein, 10 aa, Cryptosporidium parvum
KTANNPNYYT

SEQ ID NO: 2218833 - protein, 5 aa, Cryptosporidium parvum
KTAPN

SEQ ID NO: 2218834 - protein, 7 aa, Cryptosporidium parvum
KTARSGY

SEQ ID NO: 2218835 - protein, 8 aa, Cryptosporidium parvum
KTAYRSKG

SEQ ID NO: 2218836 - protein, 6 aa, Cryptosporidium parvum
KTCNQE

SEQ ID NO: 2218837 - protein, 11 aa, Cryptosporidium parvum
KTCSTGSKARY

SEQ ID NO: 2218838 - protein, 8 aa, Cryptosporidium parvum
KTCTGNSC

SEQ ID NO: 2218839 - protein, 10 aa, Cryptosporidium parvum
KTCTRTEAFP

SEQ ID NO: 2218840 - protein, 6 aa, Cryptosporidium parvum
KTDAKV

SEQ ID NO: 2218841 - protein, 17 aa, Cryptosporidium parvum
KTDDDTINATGDDKEKM

SEQ ID NO: 2218842 - protein, 5 aa, Cryptosporidium parvum
KTDDN

SEQ ID NO: 2218843 - protein, 8 aa, Cryptosporidium parvum
KTDEYDSS

SEQ ID NO: 2218844 - protein, 10 aa, Cryptosporidium parvum
KTDHENSVND

SEQ ID NO: 2218845 - protein, 4 aa, Cryptosporidium parvum
KTDI

SEQ ID NO: 2218846 - protein, 30 aa, Cryptosporidium parvum
KTDSFRDPPKRPSSFSPKISENQDQSDNQR

SEQ ID NO: 2218847 - protein, 18 aa, Cryptosporidium parvum
KTEEEKDNGAPKPSNNEL

SEQ ID NO: 2218848 - protein, 4 aa, Cryptosporidium parvum
KTEF

SEQ ID NO: 2218849 - protein, 15 aa, Cryptosporidium parvum
KTEKDNNNKKSHHTS

SEQ ID NO: 2218850 - protein, 4 aa, Cryptosporidium parvum
KTEN

SEQ ID NO: 2218851 - protein, 11 aa, Cryptosporidium parvum
KTENEENKEMP

SEQ ID NO: 2218852 - protein, 8 aa, Cryptosporidium parvum
KTENLEEL

SEQ ID NO: 2218853 - protein, 8 aa, Cryptosporidium parvum
KTENNSEE

SEQ ID NO: 2218854 - protein, 14 aa, Cryptosporidium parvum
KTENSTPSTPRVPT

SEQ ID NO: 2218855 - protein, 7 aa, Cryptosporidium parvum
KTERSVK

SEQ ID NO: 2218856 - protein, 7 aa, Cryptosporidium parvum
KTEVNDN

SEQ ID NO: 2218857 - protein, 13 aa, Cryptosporidium parvum
KTFDKDADGYVRG

SEQ ID NO: 2218858 - protein, 5 aa, Cryptosporidium parvum
KTFET

SEQ ID NO: 2218859 - protein, 6 aa, Cryptosporidium parvum
KTFETP

SEQ ID NO: 2218860 - protein, 6 aa, Cryptosporidium parvum
KTGEIS

SEQ ID NO: 2218861 - protein, 11 aa, Cryptosporidium parvum
KTGKKLTGNSF

SEQ ID NO: 2218862 - protein, 8 aa, Cryptosporidium parvum
KTGNQSNG

SEQ ID NO: 2218863 - protein, 7 aa, Cryptosporidium parvum
KTGNSLT

SEQ ID NO: 2218864 - protein, 6 aa, Cryptosporidium parvum
KTGQTP

SEQ ID NO: 2218865 - protein, 4 aa, Cryptosporidium parvum
KTGR

SEQ ID NO: 2218866 - protein, 6 aa, Cryptosporidium parvum
KTGRKN

SEQ ID NO: 2218867 - protein, 9 aa, Cryptosporidium parvum
KTGTLTEGK

SEQ ID NO: 2218868 - protein, 7 aa, Cryptosporidium parvum
KTGTLTT

SEQ ID NO: 2218869 - protein, 7 aa, Cryptosporidium parvum
KTGTYNQ

SEQ ID NO: 2218870 - protein, 8 aa, Cryptosporidium parvum
KTGVRTKG

SEQ ID NO: 2218871 - protein, 10 aa, Cryptosporidium parvum
KTHTASDVGQ

SEQ ID NO: 2218872 - protein, 4 aa, Cryptosporidium parvum
KTIE

SEQ ID NO: 2218873 - protein, 10 aa, Cryptosporidium parvum
KTIEENRAAP

SEQ ID NO: 2218874 - protein, 5 aa, Cryptosporidium parvum
KTIKE

SEQ ID NO: 2218875 - protein, 50 aa, Cryptosporidium parvum
KTIKEQKSSNTSTRRRKQDERRANNETRREREERERVEERERERERERER

SEQ ID NO: 2218876 - protein, 8 aa, Cryptosporidium parvum
KTINDSSK

SEQ ID NO: 2218877 - protein, 19 aa, Cryptosporidium parvum
KTINPNQVTSNGKSNPDLK

SEQ ID NO: 2218878 - protein, 20 aa, Cryptosporidium parvum
KTKAVSKSLNVSRSPTINSE

SEQ ID NO: 2218879 - protein, 15 aa, Cryptosporidium parvum
KTKFSASNDKTNSPF

SEQ ID NO: 2218880 - protein, 4 aa, Cryptosporidium parvum
KTKN

SEQ ID NO: 2218881 - protein, 8 aa, Cryptosporidium parvum
KTKPFSPD

SEQ ID NO: 2218882 - protein, 5 aa, Cryptosporidium parvum
KTKPK

SEQ ID NO: 2218883 - protein, 9 aa, Cryptosporidium parvum
KTKRNYDSI

SEQ ID NO: 2218884 - protein, 8 aa, Cryptosporidium parvum
KTKSKSPG

SEQ ID NO: 2218885 - protein, 14 aa, Cryptosporidium parvum
KTKTEYRKTDSLGE

SEQ ID NO: 2218886 - protein, 8 aa, Cryptosporidium parvum
KTKTYSPI

SEQ ID NO: 2218887 - protein, 7 aa, Cryptosporidium parvum
KTKYSNL

SEQ ID NO: 2218888 - protein, 13 aa, Cryptosporidium parvum
KTKYSRNSLPKGA

SEQ ID NO: 2218889 - protein, 10 aa, Cryptosporidium parvum
KTLENSRNLD

SEQ ID NO: 2218890 - protein, 6 aa, Cryptosporidium parvum
KTLKAE

SEQ ID NO: 2218891 - protein, 6 aa, Cryptosporidium parvum
KTLSKN

SEQ ID NO: 2218892 - protein, 8 aa, Cryptosporidium parvum
KTNDNDQE

SEQ ID NO: 2218893 - protein, 26 aa, Cryptosporidium parvum
KTNEEAVDHNQNGTGNRRTRKYTSRW

SEQ ID NO: 2218894 - protein, 6 aa, Cryptosporidium parvum
KTNEPL

SEQ ID NO: 2218895 - protein, 6 aa, Cryptosporidium parvum
KTNEQN

SEQ ID NO: 2218896 - protein, 8 aa, Cryptosporidium parvum
KTNEQNKF

SEQ ID NO: 2218897 - protein, 7 aa, Cryptosporidium parvum
KTNGSSF

SEQ ID NO: 2218898 - protein, 5 aa, Cryptosporidium parvum
KTNIK

SEQ ID NO: 2218899 - protein, 5 aa, Cryptosporidium parvum
KTNIS

SEQ ID NO: 2218900 - protein, 6 aa, Cryptosporidium parvum
KTNKDN

SEQ ID NO: 2218901 - protein, 6 aa, Cryptosporidium parvum
KTNLQI

SEQ ID NO: 2218902 - protein, 9 aa, Cryptosporidium parvum
KTNLSEKRN

SEQ ID NO: 2218903 - protein, 15 aa, Cryptosporidium parvum
KTNNNDVTLTSRNEE

SEQ ID NO: 2218904 - protein, 12 aa, Cryptosporidium parvum
KTNNPCQNGGKC

SEQ ID NO: 2218905 - protein, 5 aa, Cryptosporidium parvum
KTNNR

SEQ ID NO: 2218906 - protein, 5 aa, Cryptosporidium parvum
KTNQV

SEQ ID NO: 2218907 - protein, 11 aa, Cryptosporidium parvum
KTNSNNKIDRN

SEQ ID NO: 2218908 - protein, 7 aa, Cryptosporidium parvum
KTNSSQN

SEQ ID NO: 2218909 - protein, 11 aa, Cryptosporidium parvum
KTPDSDEPHPL

SEQ ID NO: 2218910 - protein, 6 aa, Cryptosporidium parvum
KTPETL

SEQ ID NO: 2218911 - protein, 4 aa, Cryptosporidium parvum
KTPF

SEQ ID NO: 2218912 - protein, 4 aa, Cryptosporidium parvum
KTPK

SEQ ID NO: 2218913 - protein, 6 aa, Cryptosporidium parvum
KTPLTV

SEQ ID NO: 2218914 - protein, 9 aa, Cryptosporidium parvum
KTPNSNNNI

SEQ ID NO: 2218915 - protein, 19 aa, Cryptosporidium parvum
KTPTQTDSVTGKPIDPTTG

SEQ ID NO: 2218916 - protein, 7 aa, Cryptosporidium parvum
KTQDDRP

SEQ ID NO: 2218917 - protein, 5 aa, Cryptosporidium parvum
KTQNI

SEQ ID NO: 2218918 - protein, 8 aa, Cryptosporidium parvum
KTQRRRNA

SEQ ID NO: 2218919 - protein, 17 aa, Cryptosporidium parvum
KTRPIKAQTVPKPQPKT

SEQ ID NO: 2218920 - protein, 9 aa, Cryptosporidium parvum
KTRPSSKDV

SEQ ID NO: 2218921 - protein, 12 aa, Cryptosporidium parvum
KTRSIEKPAPKP

SEQ ID NO: 2218922 - protein, 9 aa, Cryptosporidium parvum
KTRSSEEKL

SEQ ID NO: 2218923 - protein, 5 aa, Cryptosporidium parvum
KTRWA

SEQ ID NO: 2218924 - protein, 9 aa, Cryptosporidium parvum
KTSAEYSHL

SEQ ID NO: 2218925 - protein, 5 aa, Cryptosporidium parvum
KTSCN

SEQ ID NO: 2218926 - protein, 7 aa, Cryptosporidium parvum
KTSDNSH

SEQ ID NO: 2218927 - protein, 7 aa, Cryptosporidium parvum
KTSDSSL

SEQ ID NO: 2218928 - protein, 6 aa, Cryptosporidium parvum
KTSEPL

SEQ ID NO: 2218929 - protein, 7 aa, Cryptosporidium parvum
KTSESLA

SEQ ID NO: 2218930 - protein, 10 aa, Cryptosporidium parvum
KTSESSTSRI

SEQ ID NO: 2218931 - protein, 5 aa, Cryptosporidium parvum
KTSHH

SEQ ID NO: 2218932 - protein, 5 aa, Cryptosporidium parvum
KTSIE

SEQ ID NO: 2218933 - protein, 7 aa, Cryptosporidium parvum
KTSKQDP

SEQ ID NO: 2218934 - protein, 8 aa, Cryptosporidium parvum
KTSKSSYF

SEQ ID NO: 2218935 - protein, 16 aa, Cryptosporidium parvum
KTSNDDDTSRNNNGNS

SEQ ID NO: 2218936 - protein, 5 aa, Cryptosporidium parvum
KTSNI

SEQ ID NO: 2218937 - protein, 17 aa, Cryptosporidium parvum
KTSNKVSNIHKDDGTSY

SEQ ID NO: 2218938 - protein, 17 aa, Cryptosporidium parvum
KTSNRSGRINMNSSKQL

SEQ ID NO: 2218939 - protein, 10 aa, Cryptosporidium parvum
KTSNSSEAKF

SEQ ID NO: 2218940 - protein, 8 aa, Cryptosporidium parvum
KTSNSTGM

SEQ ID NO: 2218941 - protein, 15 aa, Cryptosporidium parvum
KTSQIGDQDGERVDD

SEQ ID NO: 2218942 - protein, 4 aa, Cryptosporidium parvum
KTSR

SEQ ID NO: 2218943 - protein, 6 aa, Cryptosporidium parvum
KTSSFD

SEQ ID NO: 2218944 - protein, 13 aa, Cryptosporidium parvum
KTSSIINSSNHSK

SEQ ID NO: 2218945 - protein, 7 aa, Cryptosporidium parvum
KTSSYNQ

SEQ ID NO: 2218946 - protein, 5 aa, Cryptosporidium parvum
KTSTI

SEQ ID NO: 2218947 - protein, 10 aa, Cryptosporidium parvum
KTSTSGMTSV

SEQ ID NO: 2218948 - protein, 9 aa, Cryptosporidium parvum
KTSVPTSTQ

SEQ ID NO: 2218949 - protein, 7 aa, Cryptosporidium parvum
KTSVTEL

SEQ ID NO: 2218950 - protein, 11 aa, Cryptosporidium parvum
KTTAENVSQMN

SEQ ID NO: 2218951 - protein, 22 aa, Cryptosporidium parvum
KTTGGLQSDLKSKELKSNGERR

SEQ ID NO: 2218952 - protein, 7 aa, Cryptosporidium parvum
KTTGKRN

SEQ ID NO: 2218953 - protein, 6 aa, Cryptosporidium parvum
KTTMEN

SEQ ID NO: 2218954 - protein, 29 aa, Cryptosporidium parvum
KTTMGTTGVTVSSSTSTANANANNNANVN

SEQ ID NO: 2218955 - protein, 20 aa, Cryptosporidium parvum
KTTNPLYNSSKGDKSSSSLN

SEQ ID NO: 2218956 - protein, 4 aa, Cryptosporidium parvum
KTTP

SEQ ID NO: 2218957 - protein, 5 aa, Cryptosporidium parvum
KTTRT

SEQ ID NO: 2218958 - protein, 19 aa, Cryptosporidium parvum
KTTSGQAAEPSEQSSSSDH

SEQ ID NO: 2218959 - protein, 4 aa, Cryptosporidium parvum
KTTV

SEQ ID NO: 2218960 - protein, 5 aa, Cryptosporidium parvum
KTTYE

SEQ ID NO: 2218961 - protein, 7 aa, Cryptosporidium parvum
KTVENDQ

SEQ ID NO: 2218962 - protein, 12 aa, Cryptosporidium parvum
KTVKRKNNFKKV

SEQ ID NO: 2218963 - protein, 4 aa, Cryptosporidium parvum
KTYD

SEQ ID NO: 2218964 - protein, 6 aa, Cryptosporidium parvum
KTYKNN

SEQ ID NO: 2218965 - protein, 18 aa, Cryptosporidium parvum
KTYQKKNSQNTISNHTET

SEQ ID NO: 2218966 - protein, 4 aa, Cryptosporidium parvum
KTYS

SEQ ID NO: 2218967 - protein, 7 aa, Cryptosporidium parvum
KTYSQRR

SEQ ID NO: 2218968 - protein, 6 aa, Cryptosporidium parvum
KTYSSK

SEQ ID NO: 2218969 - protein, 14 aa, Cryptosporidium parvum
KVAGNEKQTDEEIS

SEQ ID NO: 2218970 - protein, 7 aa, Cryptosporidium parvum
KVAPSKA

SEQ ID NO: 2218971 - protein, 9 aa, Cryptosporidium parvum
KVDGLTGNR

SEQ ID NO: 2218972 - protein, 6 aa, Cryptosporidium parvum
KVDKGN

SEQ ID NO: 2218973 - protein, 7 aa, Cryptosporidium parvum
KVDNQYD

SEQ ID NO: 2218974 - protein, 5 aa, Cryptosporidium parvum
KVDSL

SEQ ID NO: 2218975 - protein, 12 aa, Cryptosporidium parvum
KVEDSNNSDESY

SEQ ID NO: 2218976 - protein, 14 aa, Cryptosporidium parvum
KVENKEKIEFEEDN

SEQ ID NO: 2218977 - protein, 7 aa, Cryptosporidium parvum
KVENKSE

SEQ ID NO: 2218978 - protein, 9 aa, Cryptosporidium parvum
KVESSPSPY

SEQ ID NO: 2218979 - protein, 4 aa, Cryptosporidium parvum
KVET

SEQ ID NO: 2218980 - protein, 8 aa, Cryptosporidium parvum
KVETAREI

SEQ ID NO: 2218981 - protein, 13 aa, Cryptosporidium parvum
KVETEEASTEEGI

SEQ ID NO: 2218982 - protein, 8 aa, Cryptosporidium parvum
KVETNSKS

SEQ ID NO: 2218983 - protein, 9 aa, Cryptosporidium parvum
KVFSSKDIT

SEQ ID NO: 2218984 - protein, 9 aa, Cryptosporidium parvum
KVGDQSTEK

SEQ ID NO: 2218985 - protein, 7 aa, Cryptosporidium parvum
KVGHSLK

SEQ ID NO: 2218986 - protein, 10 aa, Cryptosporidium parvum
KVHGRGGDLG

SEQ ID NO: 2218987 - protein, 6 aa, Cryptosporidium parvum
KVHSDT

SEQ ID NO: 2218988 - protein, 10 aa, Cryptosporidium parvum
KVIKSGSDSL

SEQ ID NO: 2218989 - protein, 10 aa, Cryptosporidium parvum
KVKASTTNNH

SEQ ID NO: 2218990 - protein, 9 aa, Cryptosporidium parvum
KVKDNDSFD

SEQ ID NO: 2218991 - protein, 8 aa, Cryptosporidium parvum
KVKKVRNS

SEQ ID NO: 2218992 - protein, 7 aa, Cryptosporidium parvum
KVKSEND

SEQ ID NO: 2218993 - protein, 11 aa, Cryptosporidium parvum
KVKTEKQNTKS

SEQ ID NO: 2218994 - protein, 11 aa, Cryptosporidium parvum
KVLDDDNNNNN

SEQ ID NO: 2218995 - protein, 5 aa, Cryptosporidium parvum
KVLSG

SEQ ID NO: 2218996 - protein, 22 aa, Cryptosporidium parvum
KVLTPSSNYGFGRDKDNEDFEK

SEQ ID NO: 2218997 - protein, 9 aa, Cryptosporidium parvum
KVNNNDGKL

SEQ ID NO: 2218998 - protein, 7 aa, Cryptosporidium parvum
KVNSDSN

SEQ ID NO: 2218999 - protein, 9 aa, Cryptosporidium parvum
KVNSINENN

SEQ ID NO: 2219000 - protein, 7 aa, Cryptosporidium parvum
KVPGKAD

SEQ ID NO: 2219001 - protein, 6 aa, Cryptosporidium parvum
KVPKSI

SEQ ID NO: 2219002 - protein, 12 aa, Cryptosporidium parvum
KVPKSLKASSPL

SEQ ID NO: 2219003 - protein, 9 aa, Cryptosporidium parvum
KVPLDQQSK

SEQ ID NO: 2219004 - protein, 7 aa, Cryptosporidium parvum
KVPREVS

SEQ ID NO: 2219005 - protein, 7 aa, Cryptosporidium parvum
KVPSIST

SEQ ID NO: 2219006 - protein, 4 aa, Cryptosporidium parvum
KVQD

SEQ ID NO: 2219007 - protein, 9 aa, Cryptosporidium parvum
KVQFQSGRT

SEQ ID NO: 2219008 - protein, 7 aa, Cryptosporidium parvum
KVQKQVK

SEQ ID NO: 2219009 - protein, 7 aa, Cryptosporidium parvum
KVQQSNA

SEQ ID NO: 2219010 - protein, 4 aa, Cryptosporidium parvum
KVQR

SEQ ID NO: 2219011 - protein, 8 aa, Cryptosporidium parvum
KVRGQQGS

SEQ ID NO: 2219012 - protein, 11 aa, Cryptosporidium parvum
KVRSISGGERK

SEQ ID NO: 2219013 - protein, 13 aa, Cryptosporidium parvum
KVSDDEDNSDEDF

SEQ ID NO: 2219014 - protein, 6 aa, Cryptosporidium parvum
KVSEEE

SEQ ID NO: 2219015 - protein, 13 aa, Cryptosporidium parvum
KVSGYSGESSISS

SEQ ID NO: 2219016 - protein, 17 aa, Cryptosporidium parvum
KVSPKNQNGSKYSTKNS

SEQ ID NO: 2219017 - protein, 11 aa, Cryptosporidium parvum
KVSQPKEITDR

SEQ ID NO: 2219018 - protein, 5 aa, Cryptosporidium parvum
KVSRS

SEQ ID NO: 2219019 - protein, 6 aa, Cryptosporidium parvum
KVSSAF

SEQ ID NO: 2219020 - protein, 18 aa, Cryptosporidium parvum
KVSSTGKVVNSNKISKVD

SEQ ID NO: 2219021 - protein, 8 aa, Cryptosporidium parvum
KVTEEQFT

SEQ ID NO: 2219022 - protein, 4 aa, Cryptosporidium parvum
KVTK

SEQ ID NO: 2219023 - protein, 9 aa, Cryptosporidium parvum
KVTNSDLEN

SEQ ID NO: 2219024 - protein, 7 aa, Cryptosporidium parvum
KVTPYTN

SEQ ID NO: 2219025 - protein, 8 aa, Cryptosporidium parvum
KVTTLGSV

SEQ ID NO: 2219026 - protein, 11 aa, Cryptosporidium parvum
KVVKGKNSSRR

SEQ ID NO: 2219027 - protein, 6 aa, Cryptosporidium parvum
KWDTPE

SEQ ID NO: 2219028 - protein, 4 aa, Cryptosporidium parvum
KWEK

SEQ ID NO: 2219029 - protein, 9 aa, Cryptosporidium parvum
KWENYDSED

SEQ ID NO: 2219030 - protein, 4 aa, Cryptosporidium parvum
KYDD

SEQ ID NO: 2219031 - protein, 5 aa, Cryptosporidium parvum
KYDEK

SEQ ID NO: 2219032 - protein, 12 aa, Cryptosporidium parvum
KYDKMNKSTSSS

SEQ ID NO: 2219033 - protein, 9 aa, Cryptosporidium parvum
KYDNNTNIG

SEQ ID NO: 2219034 - protein, 8 aa, Cryptosporidium parvum
KYDQNNDS

SEQ ID NO: 2219035 - protein, 10 aa, Cryptosporidium parvum
KYEEATQSAY

SEQ ID NO: 2219036 - protein, 10 aa, Cryptosporidium parvum
KYEESPSDAV

SEQ ID NO: 2219037 - protein, 5 aa, Cryptosporidium parvum
KYESH

SEQ ID NO: 2219038 - protein, 4 aa, Cryptosporidium parvum
KYET

SEQ ID NO: 2219039 - protein, 27 aa, Cryptosporidium parvum
KYETLKNSGMEKDHSFNNSESNSRTVS

SEQ ID NO: 2219040 - protein, 10 aa, Cryptosporidium parvum
KYGNNFNKES

SEQ ID NO: 2219041 - protein, 13 aa, Cryptosporidium parvum
KYGPNKLQKEKHE

SEQ ID NO: 2219042 - protein, 6 aa, Cryptosporidium parvum
KYGPRF

SEQ ID NO: 2219043 - protein, 5 aa, Cryptosporidium parvum
KYGQL

SEQ ID NO: 2219044 - protein, 4 aa, Cryptosporidium parvum
KYGS

SEQ ID NO: 2219045 - protein, 15 aa, Cryptosporidium parvum
KYHPDKNKLDEKSNY

SEQ ID NO: 2219046 - protein, 15 aa, Cryptosporidium parvum
KYIDNNKESTSIAKN

SEQ ID NO: 2219047 - protein, 11 aa, Cryptosporidium parvum
KYKEDNEEINA

SEQ ID NO: 2219048 - protein, 12 aa, Cryptosporidium parvum
KYKERPKGMKQL

SEQ ID NO: 2219049 - protein, 5 aa, Cryptosporidium parvum
KYKIP

SEQ ID NO: 2219050 - protein, 4 aa, Cryptosporidium parvum
KYKP

SEQ ID NO: 2219051 - protein, 24 aa, Cryptosporidium parvum
KYKSNQLINNSSKNNYLQNETLGN

SEQ ID NO: 2219052 - protein, 7 aa, Cryptosporidium parvum
KYKTENI

SEQ ID NO: 2219053 - protein, 17 aa, Cryptosporidium parvum
KYKTSEGEDENSEEKTD

SEQ ID NO: 2219054 - protein, 7 aa, Cryptosporidium parvum
KYKYDDY

SEQ ID NO: 2219055 - protein, 4 aa, Cryptosporidium parvum
KYLN

SEQ ID NO: 2219056 - protein, 5 aa, Cryptosporidium parvum
KYNDK

SEQ ID NO: 2219057 - protein, 8 aa, Cryptosporidium parvum
KYNESTSQ

SEQ ID NO: 2219058 - protein, 5 aa, Cryptosporidium parvum
KYNNA

SEQ ID NO: 2219059 - protein, 7 aa, Cryptosporidium parvum
KYNPTSD

SEQ ID NO: 2219060 - protein, 7 aa, Cryptosporidium parvum
KYNSPIS

SEQ ID NO: 2219061 - protein, 17 aa, Cryptosporidium parvum
KYNSSLKDIPNYNETDN

SEQ ID NO: 2219062 - protein, 4 aa, Cryptosporidium parvum
KYNY

SEQ ID NO: 2219063 - protein, 5 aa, Cryptosporidium parvum
KYPEF

SEQ ID NO: 2219064 - protein, 6 aa, Cryptosporidium parvum
KYPELD

SEQ ID NO: 2219065 - protein, 5 aa, Cryptosporidium parvum
KYPNA

SEQ ID NO: 2219066 - protein, 8 aa, Cryptosporidium parvum
KYQKKTQK

SEQ ID NO: 2219067 - protein, 16 aa, Cryptosporidium parvum
KYQNKEGSRTSKTSSI

SEQ ID NO: 2219068 - protein, 7 aa, Cryptosporidium parvum
KYRISNP

SEQ ID NO: 2219069 - protein, 12 aa, Cryptosporidium parvum
KYRPLKTNSPRD

SEQ ID NO: 2219070 - protein, 7 aa, Cryptosporidium parvum
KYSAEEY

SEQ ID NO: 2219071 - protein, 13 aa, Cryptosporidium parvum
KYSDSNFGKEEIR

SEQ ID NO: 2219072 - protein, 8 aa, Cryptosporidium parvum
KYSDSTPS

SEQ ID NO: 2219073 - protein, 5 aa, Cryptosporidium parvum
KYSGN

SEQ ID NO: 2219074 - protein, 5 aa, Cryptosporidium parvum
KYSGP

SEQ ID NO: 2219075 - protein, 4 aa, Cryptosporidium parvum
KYSK

SEQ ID NO: 2219076 - protein, 8 aa, Cryptosporidium parvum
KYSKDSTT

SEQ ID NO: 2219077 - protein, 8 aa, Cryptosporidium parvum
KYSKELSS

SEQ ID NO: 2219078 - protein, 6 aa, Cryptosporidium parvum
KYSKIS

SEQ ID NO: 2219079 - protein, 8 aa, Cryptosporidium parvum
KYSNTYES

SEQ ID NO: 2219080 - protein, 5 aa, Cryptosporidium parvum
KYSQN

SEQ ID NO: 2219081 - protein, 8 aa, Cryptosporidium parvum
KYSRSGQK

SEQ ID NO: 2219082 - protein, 6 aa, Cryptosporidium parvum
KYSSDD

SEQ ID NO: 2219083 - protein, 9 aa, Cryptosporidium parvum
KYSSIEATS

SEQ ID NO: 2219084 - protein, 19 aa, Cryptosporidium parvum
KYSSKESGDSIERLKNDSE

SEQ ID NO: 2219085 - protein, 9 aa, Cryptosporidium parvum
KYSSTKREM

SEQ ID NO: 2219086 - protein, 7 aa, Cryptosporidium parvum
KYTGNPA

SEQ ID NO: 2219087 - protein, 5 aa, Cryptosporidium parvum
KYTQS

SEQ ID NO: 2219088 - protein, 5 aa, Cryptosporidium parvum
KYYPE

SEQ ID NO: 2219089 - protein, 8 aa, Cryptosporidium parvum
KYYTGTAE

SEQ ID NO: 2219090 - protein, 7 aa, Cryptosporidium parvum
LADNELP

SEQ ID NO: 2219091 - protein, 6 aa, Cryptosporidium parvum
LADPGT

SEQ ID NO: 2219092 - protein, 9 aa, Cryptosporidium parvum
LAEASSPYG

SEQ ID NO: 2219093 - protein, 8 aa, Cryptosporidium parvum
LAEEDRNI

SEQ ID NO: 2219094 - protein, 8 aa, Cryptosporidium parvum
LAERPSRI

SEQ ID NO: 2219095 - protein, 20 aa, Cryptosporidium parvum
LAGGGERGDLPFSGTTLGGG

SEQ ID NO: 2219096 - protein, 7 aa, Cryptosporidium parvum
LAGTQEK

SEQ ID NO: 2219097 - protein, 19 aa, Cryptosporidium parvum
LAHKKQNKEIKEEITDSKQ

SEQ ID NO: 2219098 - protein, 5 aa, Cryptosporidium parvum
LAKDS

SEQ ID NO: 2219099 - protein, 21 aa, Cryptosporidium parvum
LAKGGKKLPEDEDQMDDDESD

SEQ ID NO: 2219100 - protein, 26 aa, Cryptosporidium parvum
LAKNTNRGGIKSSNNNNIKEKNTIGP

SEQ ID NO: 2219101 - protein, 6 aa, Cryptosporidium parvum
LANAKD

SEQ ID NO: 2219102 - protein, 5 aa, Cryptosporidium parvum
LANDT

SEQ ID NO: 2219103 - protein, 8 aa, Cryptosporidium parvum
LANTTKNV

SEQ ID NO: 2219104 - protein, 5 aa, Cryptosporidium parvum
LANYS

SEQ ID NO: 2219105 - protein, 6 aa, Cryptosporidium parvum
LAPPDK

SEQ ID NO: 2219106 - protein, 7 aa, Cryptosporidium parvum
LAQTGLE

SEQ ID NO: 2219107 - protein, 7 aa, Cryptosporidium parvum
LASAGKA

SEQ ID NO: 2219108 - protein, 4 aa, Cryptosporidium parvum
LASD

SEQ ID NO: 2219109 - protein, 6 aa, Cryptosporidium parvum
LASPSE

SEQ ID NO: 2219110 - protein, 26 aa, Cryptosporidium parvum
LASPSSPSIISSSNSYSHSPLPPSFG

SEQ ID NO: 2219111 - protein, 5 aa, Cryptosporidium parvum
LASPV

SEQ ID NO: 2219112 - protein, 37 aa, Cryptosporidium parvum
LASSNEDDFEDSDESDIGSDIEDSTSIKVSKSPENIM

SEQ ID NO: 2219113 - protein, 10 aa, Cryptosporidium parvum
LASVSGSRQV

SEQ ID NO: 2219114 - protein, 15 aa, Cryptosporidium parvum
LCSDETIKSNSENSE

SEQ ID NO: 2219115 - protein, 19 aa, Cryptosporidium parvum
LDAERRKKHPDTGKLPRYP

SEQ ID NO: 2219116 - protein, 17 aa, Cryptosporidium parvum
LDAPNKKKNYSASSNGC

SEQ ID NO: 2219117 - protein, 9 aa, Cryptosporidium parvum
LDDKPIEQS

SEQ ID NO: 2219118 - protein, 6 aa, Cryptosporidium parvum
LDDNTE

SEQ ID NO: 2219119 - protein, 4 aa, Cryptosporidium parvum
LDDS

SEQ ID NO: 2219120 - protein, 6 aa, Cryptosporidium parvum
LDDTED

SEQ ID NO: 2219121 - protein, 6 aa, Cryptosporidium parvum
LDDTTD

SEQ ID NO: 2219122 - protein, 5 aa, Cryptosporidium parvum
LDEEE

SEQ ID NO: 2219123 - protein, 7 aa, Cryptosporidium parvum
LDEKDAR

SEQ ID NO: 2219124 - protein, 7 aa, Cryptosporidium parvum
LDELSSK

SEQ ID NO: 2219125 - protein, 15 aa, Cryptosporidium parvum
LDEPPLYSASSTDEE

SEQ ID NO: 2219126 - protein, 4 aa, Cryptosporidium parvum
LDET

SEQ ID NO: 2219127 - protein, 6 aa, Cryptosporidium parvum
LDETHK

SEQ ID NO: 2219128 - protein, 11 aa, Cryptosporidium parvum
LDGEDNYQGIE

SEQ ID NO: 2219129 - protein, 9 aa, Cryptosporidium parvum
LDGNSTDTN

SEQ ID NO: 2219130 - protein, 7 aa, Cryptosporidium parvum
LDGNTKK

SEQ ID NO: 2219131 - protein, 7 aa, Cryptosporidium parvum
LDINGDR

SEQ ID NO: 2219132 - protein, 9 aa, Cryptosporidium parvum
LDKDNETDI

SEQ ID NO: 2219133 - protein, 8 aa, Cryptosporidium parvum
LDKEEEKL

SEQ ID NO: 2219134 - protein, 9 aa, Cryptosporidium parvum
LDKEGQGLD

SEQ ID NO: 2219135 - protein, 15 aa, Cryptosporidium parvum
LDKNQDEYYNSRRNG

SEQ ID NO: 2219136 - protein, 19 aa, Cryptosporidium parvum
LDKNTKNVELSSNSSARRK

SEQ ID NO: 2219137 - protein, 9 aa, Cryptosporidium parvum
LDKPQPRSL

SEQ ID NO: 2219138 - protein, 14 aa, Cryptosporidium parvum
LDKSKNKALSQSNI

SEQ ID NO: 2219139 - protein, 25 aa, Cryptosporidium parvum
LDLNSSKGGGDQSSYDAKGGSSAAA

SEQ ID NO: 2219140 - protein, 13 aa, Cryptosporidium parvum
LDLPSRNSESSRI

SEQ ID NO: 2219141 - protein, 12 aa, Cryptosporidium parvum
LDNENEGAIATE

SEQ ID NO: 2219142 - protein, 6 aa, Cryptosporidium parvum
LDNPNP

SEQ ID NO: 2219143 - protein, 5 aa, Cryptosporidium parvum
LDNSS

SEQ ID NO: 2219144 - protein, 8 aa, Cryptosporidium parvum
LDNSSNNV

SEQ ID NO: 2219145 - protein, 7 aa, Cryptosporidium parvum
LDPAELP

SEQ ID NO: 2219146 - protein, 11 aa, Cryptosporidium parvum
LDPGNEDYRPY

SEQ ID NO: 2219147 - protein, 6 aa, Cryptosporidium parvum
LDPKDK

SEQ ID NO: 2219148 - protein, 9 aa, Cryptosporidium parvum
LDPKEYSKL

SEQ ID NO: 2219149 - protein, 6 aa, Cryptosporidium parvum
LDPKYR

SEQ ID NO: 2219150 - protein, 5 aa, Cryptosporidium parvum
LDPNT

SEQ ID NO: 2219151 - protein, 12 aa, Cryptosporidium parvum
LDPQSDDLDQNI

SEQ ID NO: 2219152 - protein, 6 aa, Cryptosporidium parvum
LDQNNS

SEQ ID NO: 2219153 - protein, 26 aa, Cryptosporidium parvum
LDQQDNGLDSSSPSNSRSNKDREHAN

SEQ ID NO: 2219154 - protein, 15 aa, Cryptosporidium parvum
LDRDEDSGHDLNQSK

SEQ ID NO: 2219155 - protein, 17 aa, Cryptosporidium parvum
LDREKSCTQIKKGTGLN

SEQ ID NO: 2219156 - protein, 7 aa, Cryptosporidium parvum
LDRPPSK

SEQ ID NO: 2219157 - protein, 27 aa, Cryptosporidium parvum
LDRSSSGSFESDSTESGRANEERNDTL

SEQ ID NO: 2219158 - protein, 6 aa, Cryptosporidium parvum
LDSEKE

SEQ ID NO: 2219159 - protein, 5 aa, Cryptosporidium parvum
LDSGG

SEQ ID NO: 2219160 - protein, 10 aa, Cryptosporidium parvum
LDSGGDSIQD

SEQ ID NO: 2219161 - protein, 9 aa, Cryptosporidium parvum
LDSKPNNNK

SEQ ID NO: 2219162 - protein, 12 aa, Cryptosporidium parvum
LDSPENKSTEYS

SEQ ID NO: 2219163 - protein, 9 aa, Cryptosporidium parvum
LDSRSNPLL

SEQ ID NO: 2219164 - protein, 4 aa, Cryptosporidium parvum
LDSS

SEQ ID NO: 2219165 - protein, 7 aa, Cryptosporidium parvum
LDSSQSD

SEQ ID NO: 2219166 - protein, 10 aa, Cryptosporidium parvum
LDSSTNNESN

SEQ ID NO: 2219167 - protein, 12 aa, Cryptosporidium parvum
LDSTKTAFKSPT

SEQ ID NO: 2219168 - protein, 7 aa, Cryptosporidium parvum
LDTASKK

SEQ ID NO: 2219169 - protein, 6 aa, Cryptosporidium parvum
LDTEGG

SEQ ID NO: 2219170 - protein, 4 aa, Cryptosporidium parvum
LEAK

SEQ ID NO: 2219171 - protein, 9 aa, Cryptosporidium parvum
LEDEKSQRN

SEQ ID NO: 2219172 - protein, 10 aa, Cryptosporidium parvum
LEDIKEEGKS

SEQ ID NO: 2219173 - protein, 9 aa, Cryptosporidium parvum
LEDKSKIKS

SEQ ID NO: 2219174 - protein, 12 aa, Cryptosporidium parvum
LEDSKKKEFNEE

SEQ ID NO: 2219175 - protein, 9 aa, Cryptosporidium parvum
LEDSKSECY

SEQ ID NO: 2219176 - protein, 7 aa, Cryptosporidium parvum
LEEDPTL

SEQ ID NO: 2219177 - protein, 9 aa, Cryptosporidium parvum
LEEDRESYL

SEQ ID NO: 2219178 - protein, 9 aa, Cryptosporidium parvum
LEEGNDDQD

SEQ ID NO: 2219179 - protein, 8 aa, Cryptosporidium parvum
LEEKSGLS

SEQ ID NO: 2219180 - protein, 14 aa, Cryptosporidium parvum
LEEKVDKSDRDQFT

SEQ ID NO: 2219181 - protein, 5 aa, Cryptosporidium parvum
LEEQE

SEQ ID NO: 2219182 - protein, 5 aa, Cryptosporidium parvum
LEEQT

SEQ ID NO: 2219183 - protein, 7 aa, Cryptosporidium parvum
LEETRKK

SEQ ID NO: 2219184 - protein, 4 aa, Cryptosporidium parvum
LEEV

SEQ ID NO: 2219185 - protein, 9 aa, Cryptosporidium parvum
LEGASESSF

SEQ ID NO: 2219186 - protein, 5 aa, Cryptosporidium parvum
LEGKD

SEQ ID NO: 2219187 - protein, 7 aa, Cryptosporidium parvum
LEGKNIE

SEQ ID NO: 2219188 - protein, 11 aa, Cryptosporidium parvum
LEGNEKNVNET

SEQ ID NO: 2219189 - protein, 5 aa, Cryptosporidium parvum
LEGQE

SEQ ID NO: 2219190 - protein, 22 aa, Cryptosporidium parvum
LEGSGDGTAGNAEPAGMGGSGL

SEQ ID NO: 2219191 - protein, 31 aa, Cryptosporidium parvum
LEGSQSDSTNEQNEADDETKVKVEEADPKEV

SEQ ID NO: 2219192 - protein, 32 aa, Cryptosporidium parvum
LEGTTQNTNNMKETSNQNTPSSPSPELPADQC

SEQ ID NO: 2219193 - protein, 17 aa, Cryptosporidium parvum
LEGVADRSLDSDKQEGM

SEQ ID NO: 2219194 - protein, 20 aa, Cryptosporidium parvum
LEHPTKNNNIDHNDPNISRN

SEQ ID NO: 2219195 - protein, 6 aa, Cryptosporidium parvum
LEKCKS

SEQ ID NO: 2219196 - protein, 16 aa, Cryptosporidium parvum
LEKDPENSLLIQRDTK

SEQ ID NO: 2219197 - protein, 7 aa, Cryptosporidium parvum
LEKEGVN

SEQ ID NO: 2219198 - protein, 19 aa, Cryptosporidium parvum
LEKGNQKEEEIDSDLDKNE

SEQ ID NO: 2219199 - protein, 10 aa, Cryptosporidium parvum
LEKLSKATQR

SEQ ID NO: 2219200 - protein, 8 aa, Cryptosporidium parvum
LEKNNEKI

SEQ ID NO: 2219201 - protein, 10 aa, Cryptosporidium parvum
LEKPTISDQS

SEQ ID NO: 2219202 - protein, 11 aa, Cryptosporidium parvum
LEKRAESKSSL

SEQ ID NO: 2219203 - protein, 14 aa, Cryptosporidium parvum
LEKSQDSNELNNPE

SEQ ID NO: 2219204 - protein, 9 aa, Cryptosporidium parvum
LEKTSNNLQ

SEQ ID NO: 2219205 - protein, 9 aa, Cryptosporidium parvum
LELNTQGLD

SEQ ID NO: 2219206 - protein, 11 aa, Cryptosporidium parvum
LELPSKEEFEK

SEQ ID NO: 2219207 - protein, 5 aa, Cryptosporidium parvum
LENDK

SEQ ID NO: 2219208 - protein, 20 aa, Cryptosporidium parvum
LENEDKVSIGGTSIDGTSIG

SEQ ID NO: 2219209 - protein, 12 aa, Cryptosporidium parvum
LENEKERIDYPK

SEQ ID NO: 2219210 - protein, 19 aa, Cryptosporidium parvum
LENKKHGLKVDENDQSKLE

SEQ ID NO: 2219211 - protein, 11 aa, Cryptosporidium parvum
LENKTTQNKTL

SEQ ID NO: 2219212 - protein, 8 aa, Cryptosporidium parvum
LENNPKSQ

SEQ ID NO: 2219213 - protein, 13 aa, Cryptosporidium parvum
LENNYDLETKQEL

SEQ ID NO: 2219214 - protein, 12 aa, Cryptosporidium parvum
LENRNRYNPATR

SEQ ID NO: 2219215 - protein, 12 aa, Cryptosporidium parvum
LENSENTSKTIE

SEQ ID NO: 2219216 - protein, 9 aa, Cryptosporidium parvum
LENSGSRNN

SEQ ID NO: 2219217 - protein, 10 aa, Cryptosporidium parvum
LENSKSSEIN

SEQ ID NO: 2219218 - protein, 22 aa, Cryptosporidium parvum
LENSPNYDSTKYNSQKDQSSTN

SEQ ID NO: 2219219 - protein, 7 aa, Cryptosporidium parvum
LENSQIA

SEQ ID NO: 2219220 - protein, 9 aa, Cryptosporidium parvum
LENSSNSSW

SEQ ID NO: 2219221 - protein, 7 aa, Cryptosporidium parvum
LENTNSR

SEQ ID NO: 2219222 - protein, 18 aa, Cryptosporidium parvum
LEPDSSNKNNLNNNKNNY

SEQ ID NO: 2219223 - protein, 10 aa, Cryptosporidium parvum
LEPETHQSFD

SEQ ID NO: 2219224 - protein, 6 aa, Cryptosporidium parvum
LEPGRI

SEQ ID NO: 2219225 - protein, 5 aa, Cryptosporidium parvum
LEPIQ

SEQ ID NO: 2219226 - protein, 10 aa, Cryptosporidium parvum
LEPPPPGFDP

SEQ ID NO: 2219227 - protein, 5 aa, Cryptosporidium parvum
LEPQQ

SEQ ID NO: 2219228 - protein, 7 aa, Cryptosporidium parvum
LEPSQAS

SEQ ID NO: 2219229 - protein, 6 aa, Cryptosporidium parvum
LEPSSF

SEQ ID NO: 2219230 - protein, 8 aa, Cryptosporidium parvum
LEPSSQEE

SEQ ID NO: 2219231 - protein, 10 aa, Cryptosporidium parvum
LEPTHSSGNE

SEQ ID NO: 2219232 - protein, 4 aa, Cryptosporidium parvum
LEQE

SEQ ID NO: 2219233 - protein, 5 aa, Cryptosporidium parvum
LEQLS

SEQ ID NO: 2219234 - protein, 15 aa, Cryptosporidium parvum
LEQRTFGSEYGSQEF

SEQ ID NO: 2219235 - protein, 8 aa, Cryptosporidium parvum
LEQTKSQL

SEQ ID NO: 2219236 - protein, 8 aa, Cryptosporidium parvum
LERGSETA

SEQ ID NO: 2219237 - protein, 8 aa, Cryptosporidium parvum
LERNSNGM

SEQ ID NO: 2219238 - protein, 4 aa, Cryptosporidium parvum
LESA

SEQ ID NO: 2219239 - protein, 4 aa, Cryptosporidium parvum
LESD

SEQ ID NO: 2219240 - protein, 8 aa, Cryptosporidium parvum
LESDKSER

SEQ ID NO: 2219241 - protein, 9 aa, Cryptosporidium parvum
LESDPKSSI

SEQ ID NO: 2219242 - protein, 14 aa, Cryptosporidium parvum
LESDSTTSNSDKSF

SEQ ID NO: 2219243 - protein, 5 aa, Cryptosporidium parvum
LESGE

SEQ ID NO: 2219244 - protein, 11 aa, Cryptosporidium parvum
LESGSNTNNNR

SEQ ID NO: 2219245 - protein, 13 aa, Cryptosporidium parvum
LESKSNDLDGHGY

SEQ ID NO: 2219246 - protein, 5 aa, Cryptosporidium parvum
LESLS

SEQ ID NO: 2219247 - protein, 10 aa, Cryptosporidium parvum
LESNKENLTL

SEQ ID NO: 2219248 - protein, 9 aa, Cryptosporidium parvum
LESNTTENV

SEQ ID NO: 2219249 - protein, 9 aa, Cryptosporidium parvum
LESQKEDIS

SEQ ID NO: 2219250 - protein, 10 aa, Cryptosporidium parvum
LESQNENETL

SEQ ID NO: 2219251 - protein, 5 aa, Cryptosporidium parvum
LESQR

SEQ ID NO: 2219252 - protein, 4 aa, Cryptosporidium parvum
LESS

SEQ ID NO: 2219253 - protein, 9 aa, Cryptosporidium parvum
LESYDSKRR

SEQ ID NO: 2219254 - protein, 7 aa, Cryptosporidium parvum
LETGKDT

SEQ ID NO: 2219255 - protein, 16 aa, Cryptosporidium parvum
LETGSSSNNYKSSNDI

SEQ ID NO: 2219256 - protein, 9 aa, Cryptosporidium parvum
LETISNNRK

SEQ ID NO: 2219257 - protein, 5 aa, Cryptosporidium parvum
LETNQ

SEQ ID NO: 2219258 - protein, 5 aa, Cryptosporidium parvum
LETPD

SEQ ID NO: 2219259 - protein, 7 aa, Cryptosporidium parvum
LETSTQE

SEQ ID NO: 2219260 - protein, 8 aa, Cryptosporidium parvum
LETTPSDE

SEQ ID NO: 2219261 - protein, 4 aa, Cryptosporidium parvum
LGDK

SEQ ID NO: 2219262 - protein, 8 aa, Cryptosporidium parvum
LGDMKEKR

SEQ ID NO: 2219263 - protein, 7 aa, Cryptosporidium parvum
LGDNEQT

SEQ ID NO: 2219264 - protein, 10 aa, Cryptosporidium parvum
LGDPDALHTK

SEQ ID NO: 2219265 - protein, 10 aa, Cryptosporidium parvum
LGDTGNITKN

SEQ ID NO: 2219266 - protein, 26 aa, Cryptosporidium parvum
LGFSNQSSTCSHSETENGAPNGACNG

SEQ ID NO: 2219267 - protein, 4 aa, Cryptosporidium parvum
LGGG

SEQ ID NO: 2219268 - protein, 27 aa, Cryptosporidium parvum
LGGGGGGGGGGGGVSGSYSSSSPQSRY

SEQ ID NO: 2219269 - protein, 4 aa, Cryptosporidium parvum
LGGS

SEQ ID NO: 2219270 - protein, 5 aa, Cryptosporidium parvum
LGGSG

SEQ ID NO: 2219271 - protein, 10 aa, Cryptosporidium parvum
LGGVPLSGNE

SEQ ID NO: 2219272 - protein, 16 aa, Cryptosporidium parvum
LGKESDLVDNEECENP

SEQ ID NO: 2219273 - protein, 20 aa, Cryptosporidium parvum
LGKGSSKTEQGANESEEQEG

SEQ ID NO: 2219274 - protein, 7 aa, Cryptosporidium parvum
LGKNSSK

SEQ ID NO: 2219275 - protein, 9 aa, Cryptosporidium parvum
LGKSQVKDI

SEQ ID NO: 2219276 - protein, 29 aa, Cryptosporidium parvum
LGKTSQKSNRKGGTCENNLEKGKNPKLEM

SEQ ID NO: 2219277 - protein, 22 aa, Cryptosporidium parvum
LGLGDGDYELSKNNDNEYNGGN

SEQ ID NO: 2219278 - protein, 4 aa, Cryptosporidium parvum
LGLN

SEQ ID NO: 2219279 - protein, 5 aa, Cryptosporidium parvum
LGMST

SEQ ID NO: 2219280 - protein, 12 aa, Cryptosporidium parvum
LGNIEASGKKLP

SEQ ID NO: 2219281 - protein, 7 aa, Cryptosporidium parvum
LGNIKGN

SEQ ID NO: 2219282 - protein, 12 aa, Cryptosporidium parvum
LGNKEKGREEEL

SEQ ID NO: 2219283 - protein, 6 aa, Cryptosporidium parvum
LGNTED

SEQ ID NO: 2219284 - protein, 14 aa, Cryptosporidium parvum
LGNTNGKKCDGEIE

SEQ ID NO: 2219285 - protein, 8 aa, Cryptosporidium parvum
LGNTSPSQ

SEQ ID NO: 2219286 - protein, 16 aa, Cryptosporidium parvum
LGNVPQPPGSTWNTPN

SEQ ID NO: 2219287 - protein, 7 aa, Cryptosporidium parvum
LGPERNI

SEQ ID NO: 2219288 - protein, 4 aa, Cryptosporidium parvum
LGPF

SEQ ID NO: 2219289 - protein, 8 aa, Cryptosporidium parvum
LGPQATEA

SEQ ID NO: 2219290 - protein, 6 aa, Cryptosporidium parvum
LGPQSP

SEQ ID NO: 2219291 - protein, 5 aa, Cryptosporidium parvum
LGPRE

SEQ ID NO: 2219292 - protein, 5 aa, Cryptosporidium parvum
LGPRT

SEQ ID NO: 2219293 - protein, 4 aa, Cryptosporidium parvum
LGPS

SEQ ID NO: 2219294 - protein, 24 aa, Cryptosporidium parvum
LGPTFGRDENSNDSEVDSATADKV

SEQ ID NO: 2219295 - protein, 7 aa, Cryptosporidium parvum
LGPTSDR

SEQ ID NO: 2219296 - protein, 7 aa, Cryptosporidium parvum
LGPYSND

SEQ ID NO: 2219297 - protein, 6 aa, Cryptosporidium parvum
LGQGQI

SEQ ID NO: 2219298 - protein, 15 aa, Cryptosporidium parvum
LGQKSSSSFSNDSQF

SEQ ID NO: 2219299 - protein, 15 aa, Cryptosporidium parvum
LGQQENITDTDYNKK

SEQ ID NO: 2219300 - protein, 5 aa, Cryptosporidium parvum
LGQSE

SEQ ID NO: 2219301 - protein, 14 aa, Cryptosporidium parvum
LGQSNLDDKNNNKY

SEQ ID NO: 2219302 - protein, 10 aa, Cryptosporidium parvum
LGQSTPSLGS

SEQ ID NO: 2219303 - protein, 11 aa, Cryptosporidium parvum
LGRKRNSNKKF

SEQ ID NO: 2219304 - protein, 6 aa, Cryptosporidium parvum
LGSGAY

SEQ ID NO: 2219305 - protein, 6 aa, Cryptosporidium parvum
LGSNEY

SEQ ID NO: 2219306 - protein, 7 aa, Cryptosporidium parvum
LGSSSKS

SEQ ID NO: 2219307 - protein, 6 aa, Cryptosporidium parvum
LGSYEE

SEQ ID NO: 2219308 - protein, 7 aa, Cryptosporidium parvum
LGTIQSN

SEQ ID NO: 2219309 - protein, 6 aa, Cryptosporidium parvum
LGTKDV

SEQ ID NO: 2219310 - protein, 8 aa, Cryptosporidium parvum
LGTPGEHR

SEQ ID NO: 2219311 - protein, 14 aa, Cryptosporidium parvum
LHGKREYENHQRKT

SEQ ID NO: 2219312 - protein, 7 aa, Cryptosporidium parvum
LHGNDEG

SEQ ID NO: 2219313 - protein, 8 aa, Cryptosporidium parvum
LHGNPNDG

SEQ ID NO: 2219314 - protein, 5 aa, Cryptosporidium parvum
LHGPD

SEQ ID NO: 2219315 - protein, 12 aa, Cryptosporidium parvum
LHKSSTPPSSHN

SEQ ID NO: 2219316 - protein, 12 aa, Cryptosporidium parvum
LHNDSESSVKID

SEQ ID NO: 2219317 - protein, 5 aa, Cryptosporidium parvum
LHNGE

SEQ ID NO: 2219318 - protein, 7 aa, Cryptosporidium parvum
LHNPSHV

SEQ ID NO: 2219319 - protein, 8 aa, Cryptosporidium parvum
LHSKRSSK

SEQ ID NO: 2219320 - protein, 21 aa, Cryptosporidium parvum
LINSNQRSKKVPNNKTRSSIK

SEQ ID NO: 2219321 - protein, 11 aa, Cryptosporidium parvum
LIPENKKYSMD

SEQ ID NO: 2219322 - protein, 34 aa, Cryptosporidium parvum
LISDQDEKDLVKQESEDDFEENKSRIKTLGPPPI

SEQ ID NO: 2219323 - protein, 6 aa, Cryptosporidium parvum
LITSPT

SEQ ID NO: 2219324 - protein, 14 aa, Cryptosporidium parvum
LKADYDSNSRYQEA

SEQ ID NO: 2219325 - protein, 16 aa, Cryptosporidium parvum
LKAKGENHSMNENSDD

SEQ ID NO: 2219326 - protein, 20 aa, Cryptosporidium parvum
LKALKSSTEVKSGEKNDSYT

SEQ ID NO: 2219327 - protein, 7 aa, Cryptosporidium parvum
LKASGHV

SEQ ID NO: 2219328 - protein, 6 aa, Cryptosporidium parvum
LKDGTF

SEQ ID NO: 2219329 - protein, 8 aa, Cryptosporidium parvum
LKDKQQNF

SEQ ID NO: 2219330 - protein, 8 aa, Cryptosporidium parvum
LKDPRKDQ

SEQ ID NO: 2219331 - protein, 6 aa, Cryptosporidium parvum
LKDRPS

SEQ ID NO: 2219332 - protein, 14 aa, Cryptosporidium parvum
LKDSKDGVNPREGC

SEQ ID NO: 2219333 - protein, 8 aa, Cryptosporidium parvum
LKDSSDNN

SEQ ID NO: 2219334 - protein, 11 aa, Cryptosporidium parvum
LKECSGRQNDY

SEQ ID NO: 2219335 - protein, 6 aa, Cryptosporidium parvum
LKEEFQ

SEQ ID NO: 2219336 - protein, 21 aa, Cryptosporidium parvum
LKEENPTKRESLNKSNSTISM

SEQ ID NO: 2219337 - protein, 6 aa, Cryptosporidium parvum
LKEGGL

SEQ ID NO: 2219338 - protein, 8 aa, Cryptosporidium parvum
LKEGNKEE

SEQ ID NO: 2219339 - protein, 8 aa, Cryptosporidium parvum
LKEHNGNN

SEQ ID NO: 2219340 - protein, 19 aa, Cryptosporidium parvum
LKEKSSNPPKSEEEKNELE

SEQ ID NO: 2219341 - protein, 18 aa, Cryptosporidium parvum
LKENGEPGQGNLSNDESA

SEQ ID NO: 2219342 - protein, 9 aa, Cryptosporidium parvum
LKENNNDYK

SEQ ID NO: 2219343 - protein, 9 aa, Cryptosporidium parvum
LKENPNNTD

SEQ ID NO: 2219344 - protein, 9 aa, Cryptosporidium parvum
LKEPSEKKK

SEQ ID NO: 2219345 - protein, 8 aa, Cryptosporidium parvum
LKESGKMH

SEQ ID NO: 2219346 - protein, 6 aa, Cryptosporidium parvum
LKETNE

SEQ ID NO: 2219347 - protein, 15 aa, Cryptosporidium parvum
LKEYNERRTSIQQYQ

SEQ ID NO: 2219348 - protein, 8 aa, Cryptosporidium parvum
LKGGSKRL

SEQ ID NO: 2219349 - protein, 9 aa, Cryptosporidium parvum
LKGKKNKYR

SEQ ID NO: 2219350 - protein, 16 aa, Cryptosporidium parvum
LKGQKNSNNNISNSHR

SEQ ID NO: 2219351 - protein, 7 aa, Cryptosporidium parvum
LKGTKTG

SEQ ID NO: 2219352 - protein, 7 aa, Cryptosporidium parvum
LKGVDSK

SEQ ID NO: 2219353 - protein, 12 aa, Cryptosporidium parvum
LKHSEDKLAELE

SEQ ID NO: 2219354 - protein, 7 aa, Cryptosporidium parvum
LKKADDI

SEQ ID NO: 2219355 - protein, 11 aa, Cryptosporidium parvum
LKKDNSSGRPI

SEQ ID NO: 2219356 - protein, 4 aa, Cryptosporidium parvum
LKKE

SEQ ID NO: 2219357 - protein, 7 aa, Cryptosporidium parvum
LKKGEEI

SEQ ID NO: 2219358 - protein, 26 aa, Cryptosporidium parvum
LKKKGEDGDTFEIQDQDKKLKEEPRM

SEQ ID NO: 2219359 - protein, 19 aa, Cryptosporidium parvum
LKKNKKKKSNYGKKKEEKR

SEQ ID NO: 2219360 - protein, 14 aa, Cryptosporidium parvum
LKKNTQKYKIGNSN

SEQ ID NO: 2219361 - protein, 8 aa, Cryptosporidium parvum
LKKPNGQT

SEQ ID NO: 2219362 - protein, 9 aa, Cryptosporidium parvum
LKKRNQEEI

SEQ ID NO: 2219363 - protein, 10 aa, Cryptosporidium parvum
LKKSDNSDII

SEQ ID NO: 2219364 - protein, 7 aa, Cryptosporidium parvum
LKKSSTR

SEQ ID NO: 2219365 - protein, 7 aa, Cryptosporidium parvum
LKKSTQF

SEQ ID NO: 2219366 - protein, 51 aa, Cryptosporidium parvum
LKLGPGSGVGVGPGPGVGVGPGSGSGQGYESGPRIRSDHSTTKGTQENTRD

SEQ ID NO: 2219367 - protein, 10 aa, Cryptosporidium parvum
LKLPPKTSLS

SEQ ID NO: 2219368 - protein, 9 aa, Cryptosporidium parvum
LKNASVDDA

SEQ ID NO: 2219369 - protein, 9 aa, Cryptosporidium parvum
LKNDSKQAF

SEQ ID NO: 2219370 - protein, 18 aa, Cryptosporidium parvum
LKNDSTSNTTETTDSSNQ

SEQ ID NO: 2219371 - protein, 14 aa, Cryptosporidium parvum
LKNESSNSSNSNQE

SEQ ID NO: 2219372 - protein, 18 aa, Cryptosporidium parvum
LKNGDDKKVITNNTSNRH

SEQ ID NO: 2219373 - protein, 4 aa, Cryptosporidium parvum
LKNK

SEQ ID NO: 2219374 - protein, 10 aa, Cryptosporidium parvum
LKNKEDVASQ

SEQ ID NO: 2219375 - protein, 7 aa, Cryptosporidium parvum
LKNKNKA

SEQ ID NO: 2219376 - protein, 35 aa, Cryptosporidium parvum
LKNKNSKKSNNEVEDDNNNNNNRNIKNNSENDKVN

SEQ ID NO: 2219377 - protein, 8 aa, Cryptosporidium parvum
LKNNISNH

SEQ ID NO: 2219378 - protein, 9 aa, Cryptosporidium parvum
LKNPTDSNS

SEQ ID NO: 2219379 - protein, 13 aa, Cryptosporidium parvum
LKNSQQKTNNNKI

SEQ ID NO: 2219380 - protein, 8 aa, Cryptosporidium parvum
LKPDEELR

SEQ ID NO: 2219381 - protein, 11 aa, Cryptosporidium parvum
LKPEEINNPKI

SEQ ID NO: 2219382 - protein, 4 aa, Cryptosporidium parvum
LKPK

SEQ ID NO: 2219383 - protein, 9 aa, Cryptosporidium parvum
LKPTKKMSN

SEQ ID NO: 2219384 - protein, 6 aa, Cryptosporidium parvum
LKPVQS

SEQ ID NO: 2219385 - protein, 12 aa, Cryptosporidium parvum
LKQAQYKSGGIS

SEQ ID NO: 2219386 - protein, 17 aa, Cryptosporidium parvum
LKQIDEGGSILSKGQKT

SEQ ID NO: 2219387 - protein, 9 aa, Cryptosporidium parvum
LKRSAEEDK

SEQ ID NO: 2219388 - protein, 10 aa, Cryptosporidium parvum
LKRSGSKTKN

SEQ ID NO: 2219389 - protein, 8 aa, Cryptosporidium parvum
LKSENEAL

SEQ ID NO: 2219390 - protein, 8 aa, Cryptosporidium parvum
LKSETNKI

SEQ ID NO: 2219391 - protein, 6 aa, Cryptosporidium parvum
LKSEVN

SEQ ID NO: 2219392 - protein, 12 aa, Cryptosporidium parvum
LKSITPSSEQNE

SEQ ID NO: 2219393 - protein, 12 aa, Cryptosporidium parvum
LKSKSGSNNKYN

SEQ ID NO: 2219394 - protein, 8 aa, Cryptosporidium parvum
LKSMKNKE

SEQ ID NO: 2219395 - protein, 5 aa, Cryptosporidium parvum
LKSNN

SEQ ID NO: 2219396 - protein, 6 aa, Cryptosporidium parvum
LKSNSN

SEQ ID NO: 2219397 - protein, 7 aa, Cryptosporidium parvum
LKSNSND

SEQ ID NO: 2219398 - protein, 7 aa, Cryptosporidium parvum
LKSPQDA

SEQ ID NO: 2219399 - protein, 7 aa, Cryptosporidium parvum
LKSQNTT

SEQ ID NO: 2219400 - protein, 15 aa, Cryptosporidium parvum
LKSRNIQNQINKNDE

SEQ ID NO: 2219401 - protein, 6 aa, Cryptosporidium parvum
LKSRQF

SEQ ID NO: 2219402 - protein, 10 aa, Cryptosporidium parvum
LKSSSSQNEL

SEQ ID NO: 2219403 - protein, 8 aa, Cryptosporidium parvum
LKSTLSQF

SEQ ID NO: 2219404 - protein, 8 aa, Cryptosporidium parvum
LKTDKERI

SEQ ID NO: 2219405 - protein, 6 aa, Cryptosporidium parvum
LKTDSS

SEQ ID NO: 2219406 - protein, 4 aa, Cryptosporidium parvum
LKTE

SEQ ID NO: 2219407 - protein, 7 aa, Cryptosporidium parvum
LKTNETN

SEQ ID NO: 2219408 - protein, 5 aa, Cryptosporidium parvum
LKTNR

SEQ ID NO: 2219409 - protein, 8 aa, Cryptosporidium parvum
LKTNSNKI

SEQ ID NO: 2219410 - protein, 7 aa, Cryptosporidium parvum
LKTNTTH

SEQ ID NO: 2219411 - protein, 6 aa, Cryptosporidium parvum
LKTRSR

SEQ ID NO: 2219412 - protein, 5 aa, Cryptosporidium parvum
LKTTN

SEQ ID NO: 2219413 - protein, 8 aa, Cryptosporidium parvum
LKTTTKDE

SEQ ID NO: 2219414 - protein, 10 aa, Cryptosporidium parvum
LLESPKNYTE

SEQ ID NO: 2219415 - protein, 4 aa, Cryptosporidium parvum
LLKG

SEQ ID NO: 2219416 - protein, 9 aa, Cryptosporidium parvum
LLPPSGDLN

SEQ ID NO: 2219417 - protein, 5 aa, Cryptosporidium parvum
LLRTG

SEQ ID NO: 2219418 - protein, 6 aa, Cryptosporidium parvum
LLSDED

SEQ ID NO: 2219419 - protein, 4 aa, Cryptosporidium parvum
LLSP

SEQ ID NO: 2219420 - protein, 8 aa, Cryptosporidium parvum
LLSSASVT

SEQ ID NO: 2219421 - protein, 7 aa, Cryptosporidium parvum
LLTTPKK

SEQ ID NO: 2219422 - protein, 13 aa, Cryptosporidium parvum
LNANQDSSNVSPM

SEQ ID NO: 2219423 - protein, 57 aa, Cryptosporidium parvum
LNDNRSSHFTGGHGGHGGHGGQSSHRERSKNRERSRNRERSRNRERSGNRESGAKMA

SEQ ID NO: 2219424 - protein, 9 aa, Cryptosporidium parvum
LNDPTQQLE

SEQ ID NO: 2219425 - protein, 15 aa, Cryptosporidium parvum
LNEANSQIDIKDNSR

SEQ ID NO: 2219426 - protein, 8 aa, Cryptosporidium parvum
LNEDPTGT

SEQ ID NO: 2219427 - protein, 6 aa, Cryptosporidium parvum
LNEEEE

SEQ ID NO: 2219428 - protein, 14 aa, Cryptosporidium parvum
LNENSSCDELIDES

SEQ ID NO: 2219429 - protein, 11 aa, Cryptosporidium parvum
LNETGKDRTNP

SEQ ID NO: 2219430 - protein, 7 aa, Cryptosporidium parvum
LNETNDS

SEQ ID NO: 2219431 - protein, 8 aa, Cryptosporidium parvum
LNETNSEN

SEQ ID NO: 2219432 - protein, 13 aa, Cryptosporidium parvum
LNEYKKEASDLTI

SEQ ID NO: 2219433 - protein, 6 aa, Cryptosporidium parvum
LNEYPR

SEQ ID NO: 2219434 - protein, 15 aa, Cryptosporidium parvum
LNGEKTPRKLPPGAE

SEQ ID NO: 2219435 - protein, 5 aa, Cryptosporidium parvum
LNGGE

SEQ ID NO: 2219436 - protein, 9 aa, Cryptosporidium parvum
LNGNNEEVS

SEQ ID NO: 2219437 - protein, 14 aa, Cryptosporidium parvum
LNGTGSSSKKNSIK

SEQ ID NO: 2219438 - protein, 16 aa, Cryptosporidium parvum
LNHKPKKAVDKSNSDY

SEQ ID NO: 2219439 - protein, 6 aa, Cryptosporidium parvum
LNHTGA

SEQ ID NO: 2219440 - protein, 8 aa, Cryptosporidium parvum
LNKDDNKY

SEQ ID NO: 2219441 - protein, 8 aa, Cryptosporidium parvum
LNKDGFES

SEQ ID NO: 2219442 - protein, 16 aa, Cryptosporidium parvum
LNKDGIKKDENGDDIA

SEQ ID NO: 2219443 - protein, 12 aa, Cryptosporidium parvum
LNKNSSGDLNDV

SEQ ID NO: 2219444 - protein, 8 aa, Cryptosporidium parvum
LNKPSTFT

SEQ ID NO: 2219445 - protein, 16 aa, Cryptosporidium parvum
LNKSHSKYDIGSEKNA

SEQ ID NO: 2219446 - protein, 5 aa, Cryptosporidium parvum
LNKSK

SEQ ID NO: 2219447 - protein, 12 aa, Cryptosporidium parvum
LNKSSEKNKSGY

SEQ ID NO: 2219448 - protein, 10 aa, Cryptosporidium parvum
LNNDESNNLD

SEQ ID NO: 2219449 - protein, 15 aa, Cryptosporidium parvum
LNNEDSLSKKQSKSC

SEQ ID NO: 2219450 - protein, 10 aa, Cryptosporidium parvum
LNNEKEKGLK

SEQ ID NO: 2219451 - protein, 8 aa, Cryptosporidium parvum
LNNETLSN

SEQ ID NO: 2219452 - protein, 12 aa, Cryptosporidium parvum
LNNKSKTADRKY

SEQ ID NO: 2219453 - protein, 5 aa, Cryptosporidium parvum
LNNND

SEQ ID NO: 2219454 - protein, 14 aa, Cryptosporidium parvum
LNNNSTKEINQTNH

SEQ ID NO: 2219455 - protein, 4 aa, Cryptosporidium parvum
LNNP

SEQ ID NO: 2219456 - protein, 12 aa, Cryptosporidium parvum
LNNQNKNSNILS

SEQ ID NO: 2219457 - protein, 14 aa, Cryptosporidium parvum
LNNQSSRPEAHYVQ

SEQ ID NO: 2219458 - protein, 4 aa, Cryptosporidium parvum
LNNS

SEQ ID NO: 2219459 - protein, 7 aa, Cryptosporidium parvum
LNNSDTR

SEQ ID NO: 2219460 - protein, 11 aa, Cryptosporidium parvum
LNNSKDKKGLV

SEQ ID NO: 2219461 - protein, 6 aa, Cryptosporidium parvum
LNNSNN

SEQ ID NO: 2219462 - protein, 10 aa, Cryptosporidium parvum
LNNSNPAEWS

SEQ ID NO: 2219463 - protein, 6 aa, Cryptosporidium parvum
LNNTNS

SEQ ID NO: 2219464 - protein, 7 aa, Cryptosporidium parvum
LNPDSSF

SEQ ID NO: 2219465 - protein, 10 aa, Cryptosporidium parvum
LNPKDHDSIY

SEQ ID NO: 2219466 - protein, 5 aa, Cryptosporidium parvum
LNPKV

SEQ ID NO: 2219467 - protein, 7 aa, Cryptosporidium parvum
LNPPQNT

SEQ ID NO: 2219468 - protein, 7 aa, Cryptosporidium parvum
LNPQKNA

SEQ ID NO: 2219469 - protein, 18 aa, Cryptosporidium parvum
LNPSDKNHNTRKKSESIP

SEQ ID NO: 2219470 - protein, 8 aa, Cryptosporidium parvum
LNPSEPSI

SEQ ID NO: 2219471 - protein, 23 aa, Cryptosporidium parvum
LNPSGLSTSSQGGNDSNFTQSSN

SEQ ID NO: 2219472 - protein, 18 aa, Cryptosporidium parvum
LNPTNSIVSSGDQAQNLS

SEQ ID NO: 2219473 - protein, 11 aa, Cryptosporidium parvum
LNQQSNKNADL

SEQ ID NO: 2219474 - protein, 4 aa, Cryptosporidium parvum
LNQS

SEQ ID NO: 2219475 - protein, 7 aa, Cryptosporidium parvum
LNQSNKA

SEQ ID NO: 2219476 - protein, 7 aa, Cryptosporidium parvum
LNQSSEM

SEQ ID NO: 2219477 - protein, 12 aa, Cryptosporidium parvum
LNRAKGGGTFVG

SEQ ID NO: 2219478 - protein, 9 aa, Cryptosporidium parvum
LNREDPNED

SEQ ID NO: 2219479 - protein, 10 aa, Cryptosporidium parvum
LNSAKSSVSS

SEQ ID NO: 2219480 - protein, 5 aa, Cryptosporidium parvum
LNSEG

SEQ ID NO: 2219481 - protein, 7 aa, Cryptosporidium parvum
LNSEKNI

SEQ ID NO: 2219482 - protein, 9 aa, Cryptosporidium parvum
LNSENERQK

SEQ ID NO: 2219483 - protein, 20 aa, Cryptosporidium parvum
LNSEQGHPGLNNTSATGIST

SEQ ID NO: 2219484 - protein, 7 aa, Cryptosporidium parvum
LNSESRK

SEQ ID NO: 2219485 - protein, 11 aa, Cryptosporidium parvum
LNSGSKSQSSI

SEQ ID NO: 2219486 - protein, 10 aa, Cryptosporidium parvum
LNSKSDSALL

SEQ ID NO: 2219487 - protein, 5 aa, Cryptosporidium parvum
LNSNE

SEQ ID NO: 2219488 - protein, 9 aa, Cryptosporidium parvum
LNSNGQKPI

SEQ ID NO: 2219489 - protein, 10 aa, Cryptosporidium parvum
LNSNGSEKAN

SEQ ID NO: 2219490 - protein, 15 aa, Cryptosporidium parvum
LNSNSRKKNSDIEAR

SEQ ID NO: 2219491 - protein, 8 aa, Cryptosporidium parvum
LNSPETAK

SEQ ID NO: 2219492 - protein, 5 aa, Cryptosporidium parvum
LNSPR

SEQ ID NO: 2219493 - protein, 14 aa, Cryptosporidium parvum
LNSPRRQKNNDRQQ

SEQ ID NO: 2219494 - protein, 6 aa, Cryptosporidium parvum
LNSQGK

SEQ ID NO: 2219495 - protein, 12 aa, Cryptosporidium parvum
LNSQNGEKIGPS

SEQ ID NO: 2219496 - protein, 11 aa, Cryptosporidium parvum
LNSSINNKKSL

SEQ ID NO: 2219497 - protein, 6 aa, Cryptosporidium parvum
LNSSNI

SEQ ID NO: 2219498 - protein, 9 aa, Cryptosporidium parvum
LNSSSFSKK

SEQ ID NO: 2219499 - protein, 10 aa, Cryptosporidium parvum
LNSSSSESSV

SEQ ID NO: 2219500 - protein, 7 aa, Cryptosporidium parvum
LNSTPDK

SEQ ID NO: 2219501 - protein, 10 aa, Cryptosporidium parvum
LNTESNKKYK

SEQ ID NO: 2219502 - protein, 12 aa, Cryptosporidium parvum
LNTNDADSNTFN

SEQ ID NO: 2219503 - protein, 12 aa, Cryptosporidium parvum
LNTNTESEIPQK

SEQ ID NO: 2219504 - protein, 4 aa, Cryptosporidium parvum
LNTP

SEQ ID NO: 2219505 - protein, 8 aa, Cryptosporidium parvum
LNTPPDSI

SEQ ID NO: 2219506 - protein, 7 aa, Cryptosporidium parvum
LNTPTNL

SEQ ID NO: 2219507 - protein, 12 aa, Cryptosporidium parvum
LNTSNQSESNLQ

SEQ ID NO: 2219508 - protein, 14 aa, Cryptosporidium parvum
LNTSNSLDTEDEQE

SEQ ID NO: 2219509 - protein, 11 aa, Cryptosporidium parvum
LNTSRSSISSN

SEQ ID NO: 2219510 - protein, 12 aa, Cryptosporidium parvum
LNYNPENNINTY

SEQ ID NO: 2219511 - protein, 14 aa, Cryptosporidium parvum
LPCSSKDRKGNKNN

SEQ ID NO: 2219512 - protein, 16 aa, Cryptosporidium parvum
LPDDESTEDTNNDSSI

SEQ ID NO: 2219513 - protein, 6 aa, Cryptosporidium parvum
LPDQDE

SEQ ID NO: 2219514 - protein, 8 aa, Cryptosporidium parvum
LPDQRKSR

SEQ ID NO: 2219515 - protein, 5 aa, Cryptosporidium parvum
LPEGT

SEQ ID NO: 2219516 - protein, 9 aa, Cryptosporidium parvum
LPEIPSKDD

SEQ ID NO: 2219517 - protein, 6 aa, Cryptosporidium parvum
LPEKSE

SEQ ID NO: 2219518 - protein, 24 aa, Cryptosporidium parvum
LPENKYKSSLGSNDSFLESPNEGM

SEQ ID NO: 2219519 - protein, 5 aa, Cryptosporidium parvum
LPENY

SEQ ID NO: 2219520 - protein, 17 aa, Cryptosporidium parvum
LPEPNNHIPPDGKSTKW

SEQ ID NO: 2219521 - protein, 10 aa, Cryptosporidium parvum
LPETKTTNNY

SEQ ID NO: 2219522 - protein, 13 aa, Cryptosporidium parvum
LPETPKESESNLK

SEQ ID NO: 2219523 - protein, 12 aa, Cryptosporidium parvum
LPFKGKQHRESS

SEQ ID NO: 2219524 - protein, 6 aa, Cryptosporidium parvum
LPGAQQ

SEQ ID NO: 2219525 - protein, 8 aa, Cryptosporidium parvum
LPGESQQI

SEQ ID NO: 2219526 - protein, 11 aa, Cryptosporidium parvum
LPGFSSYSDGI

SEQ ID NO: 2219527 - protein, 5 aa, Cryptosporidium parvum
LPGGK

SEQ ID NO: 2219528 - protein, 62 aa, Cryptosporidium parvum
LPGGSSGGASGGASGGASGGDSGGDSGGASGGASGGASGGDSGGDSGGDSGGPTATQSGYNQ

SEQ ID NO: 2219529 - protein, 6 aa, Cryptosporidium parvum
LPGIPN

SEQ ID NO: 2219530 - protein, 8 aa, Cryptosporidium parvum
LPGNTNSP

SEQ ID NO: 2219531 - protein, 6 aa, Cryptosporidium parvum
LPGSEY

SEQ ID NO: 2219532 - protein, 13 aa, Cryptosporidium parvum
LPGSSIPDDIPKN

SEQ ID NO: 2219533 - protein, 8 aa, Cryptosporidium parvum
LPGSTEDI

SEQ ID NO: 2219534 - protein, 10 aa, Cryptosporidium parvum
LPHPNEEARS

SEQ ID NO: 2219535 - protein, 8 aa, Cryptosporidium parvum
LPIPGSVA

SEQ ID NO: 2219536 - protein, 4 aa, Cryptosporidium parvum
LPKE

SEQ ID NO: 2219537 - protein, 5 aa, Cryptosporidium parvum
LPKEE

SEQ ID NO: 2219538 - protein, 10 aa, Cryptosporidium parvum
LPKEERTKLS

SEQ ID NO: 2219539 - protein, 4 aa, Cryptosporidium parvum
LPKI

SEQ ID NO: 2219540 - protein, 11 aa, Cryptosporidium parvum
LPKKQKKALPK

SEQ ID NO: 2219541 - protein, 9 aa, Cryptosporidium parvum
LPKKTRMDD

SEQ ID NO: 2219542 - protein, 5 aa, Cryptosporidium parvum
LPKNT

SEQ ID NO: 2219543 - protein, 26 aa, Cryptosporidium parvum
LPKTDLSEETSASSSPAPSIPEEGDI

SEQ ID NO: 2219544 - protein, 10 aa, Cryptosporidium parvum
LPKTNNDTSE

SEQ ID NO: 2219545 - protein, 4 aa, Cryptosporidium parvum
LPLD

SEQ ID NO: 2219546 - protein, 47 aa, Cryptosporidium parvum
LPLGNSDSSEDKDQSKLNTKVGQEAEDRSKNKLKEGQIADQDSNRIR

SEQ ID NO: 2219547 - protein, 5 aa, Cryptosporidium parvum
LPNHT

SEQ ID NO: 2219548 - protein, 11 aa, Cryptosporidium parvum
LPNPNYKSPIN

SEQ ID NO: 2219549 - protein, 8 aa, Cryptosporidium parvum
LPNPPLES

SEQ ID NO: 2219550 - protein, 9 aa, Cryptosporidium parvum
LPNPSDIND

SEQ ID NO: 2219551 - protein, 9 aa, Cryptosporidium parvum
LPNQSSQIK

SEQ ID NO: 2219552 - protein, 8 aa, Cryptosporidium parvum
LPNSDGGG

SEQ ID NO: 2219553 - protein, 7 aa, Cryptosporidium parvum
LPNSNNS

SEQ ID NO: 2219554 - protein, 4 aa, Cryptosporidium parvum
LPNT

SEQ ID NO: 2219555 - protein, 5 aa, Cryptosporidium parvum
LPPAP

SEQ ID NO: 2219556 - protein, 5 aa, Cryptosporidium parvum
LPPGK

SEQ ID NO: 2219557 - protein, 6 aa, Cryptosporidium parvum
LPPHPK

SEQ ID NO: 2219558 - protein, 7 aa, Cryptosporidium parvum
LPPPPLR

SEQ ID NO: 2219559 - protein, 7 aa, Cryptosporidium parvum
LPPTGGW

SEQ ID NO: 2219560 - protein, 8 aa, Cryptosporidium parvum
LPQDGFNK

SEQ ID NO: 2219561 - protein, 13 aa, Cryptosporidium parvum
LPQEQNSFEKPNY

SEQ ID NO: 2219562 - protein, 4 aa, Cryptosporidium parvum
LPQG

SEQ ID NO: 2219563 - protein, 4 aa, Cryptosporidium parvum
LPQH

SEQ ID NO: 2219564 - protein, 6 aa, Cryptosporidium parvum
LPQSQR

SEQ ID NO: 2219565 - protein, 5 aa, Cryptosporidium parvum
LPQTK

SEQ ID NO: 2219566 - protein, 16 aa, Cryptosporidium parvum
LPSDDISSKEFRVNYY

SEQ ID NO: 2219567 - protein, 4 aa, Cryptosporidium parvum
LPSE

SEQ ID NO: 2219568 - protein, 8 aa, Cryptosporidium parvum
LPSGEKNK

SEQ ID NO: 2219569 - protein, 30 aa, Cryptosporidium parvum
LPSGTSPGLPSEGPGQDQDGDQAQRSQRAA

SEQ ID NO: 2219570 - protein, 30 aa, Cryptosporidium parvum
LPSNTSSITNFSQSSTSSFQRQNLTEDQTF

SEQ ID NO: 2219571 - protein, 6 aa, Cryptosporidium parvum
LPSPEN

SEQ ID NO: 2219572 - protein, 4 aa, Cryptosporidium parvum
LPSS

SEQ ID NO: 2219573 - protein, 8 aa, Cryptosporidium parvum
LPSSPLKK

SEQ ID NO: 2219574 - protein, 5 aa, Cryptosporidium parvum
LPTDF

SEQ ID NO: 2219575 - protein, 4 aa, Cryptosporidium parvum
LPTE

SEQ ID NO: 2219576 - protein, 10 aa, Cryptosporidium parvum
LPTEIRSTGM

SEQ ID NO: 2219577 - protein, 4 aa, Cryptosporidium parvum
LPTG

SEQ ID NO: 2219578 - protein, 8 aa, Cryptosporidium parvum
LPTNNSTG

SEQ ID NO: 2219579 - protein, 4 aa, Cryptosporidium parvum
LPTQ

SEQ ID NO: 2219580 - protein, 4 aa, Cryptosporidium parvum
LPTS

SEQ ID NO: 2219581 - protein, 25 aa, Cryptosporidium parvum
LPTSNEVNISPRPSSDAVPDRPTNT

SEQ ID NO: 2219582 - protein, 10 aa, Cryptosporidium parvum
LPVDPKTGFP

SEQ ID NO: 2219583 - protein, 11 aa, Cryptosporidium parvum
LPYDPSTGEII

SEQ ID NO: 2219584 - protein, 4 aa, Cryptosporidium parvum
LPYS

SEQ ID NO: 2219585 - protein, 10 aa, Cryptosporidium parvum
LQDDKDKIEE

SEQ ID NO: 2219586 - protein, 6 aa, Cryptosporidium parvum
LQDKDG

SEQ ID NO: 2219587 - protein, 9 aa, Cryptosporidium parvum
LQDKLKPKT

SEQ ID NO: 2219588 - protein, 8 aa, Cryptosporidium parvum
LQDQTGLS

SEQ ID NO: 2219589 - protein, 8 aa, Cryptosporidium parvum
LQDSYNQQ

SEQ ID NO: 2219590 - protein, 10 aa, Cryptosporidium parvum
LQEDPNKSSK

SEQ ID NO: 2219591 - protein, 6 aa, Cryptosporidium parvum
LQEEEK

SEQ ID NO: 2219592 - protein, 7 aa, Cryptosporidium parvum
LQEKGGF

SEQ ID NO: 2219593 - protein, 5 aa, Cryptosporidium parvum
LQELP

SEQ ID NO: 2219594 - protein, 8 aa, Cryptosporidium parvum
LQEPPKNT

SEQ ID NO: 2219595 - protein, 24 aa, Cryptosporidium parvum
LQEYSHQNNSTKRNFSMPPKSNPV

SEQ ID NO: 2219596 - protein, 7 aa, Cryptosporidium parvum
LQGQTDT

SEQ ID NO: 2219597 - protein, 7 aa, Cryptosporidium parvum
LQGSGGI

SEQ ID NO: 2219598 - protein, 11 aa, Cryptosporidium parvum
LQINKDTPSIH

SEQ ID NO: 2219599 - protein, 14 aa, Cryptosporidium parvum
LQKGDYGDDLRDGS

SEQ ID NO: 2219600 - protein, 6 aa, Cryptosporidium parvum
LQKGPK

SEQ ID NO: 2219601 - protein, 7 aa, Cryptosporidium parvum
LQKGSSS

SEQ ID NO: 2219602 - protein, 4 aa, Cryptosporidium parvum
LQKQ

SEQ ID NO: 2219603 - protein, 8 aa, Cryptosporidium parvum
LQKTPTIS

SEQ ID NO: 2219604 - protein, 9 aa, Cryptosporidium parvum
LQNAPSTEI

SEQ ID NO: 2219605 - protein, 6 aa, Cryptosporidium parvum
LQNGRV

SEQ ID NO: 2219606 - protein, 6 aa, Cryptosporidium parvum
LQNNNE

SEQ ID NO: 2219607 - protein, 20 aa, Cryptosporidium parvum
LQPDYNKDEDLNERRHPTND

SEQ ID NO: 2219608 - protein, 10 aa, Cryptosporidium parvum
LQPGKSNSSL

SEQ ID NO: 2219609 - protein, 28 aa, Cryptosporidium parvum
LQQDSISTASTSNENNPPQTENKNKSEL

SEQ ID NO: 2219610 - protein, 10 aa, Cryptosporidium parvum
LQQGSSRGCG

SEQ ID NO: 2219611 - protein, 8 aa, Cryptosporidium parvum
LQQTNNLA

SEQ ID NO: 2219612 - protein, 11 aa, Cryptosporidium parvum
LQREASNVQLE

SEQ ID NO: 2219613 - protein, 6 aa, Cryptosporidium parvum
LQSPDQ

SEQ ID NO: 2219614 - protein, 8 aa, Cryptosporidium parvum
LQSPSEMA

SEQ ID NO: 2219615 - protein, 11 aa, Cryptosporidium parvum
LQTDERPNADN

SEQ ID NO: 2219616 - protein, 7 aa, Cryptosporidium parvum
LQTGTPL

SEQ ID NO: 2219617 - protein, 4 aa, Cryptosporidium parvum
LQTK

SEQ ID NO: 2219618 - protein, 4 aa, Cryptosporidium parvum
LQTP

SEQ ID NO: 2219619 - protein, 4 aa, Cryptosporidium parvum
LQTT

SEQ ID NO: 2219620 - protein, 5 aa, Cryptosporidium parvum
LQVSE

SEQ ID NO: 2219621 - protein, 5 aa, Cryptosporidium parvum
LRDIS

SEQ ID NO: 2219622 - protein, 5 aa, Cryptosporidium parvum
LRDTN

SEQ ID NO: 2219623 - protein, 11 aa, Cryptosporidium parvum
LRESSSEASFD

SEQ ID NO: 2219624 - protein, 9 aa, Cryptosporidium parvum
LRGENETKK

SEQ ID NO: 2219625 - protein, 11 aa, Cryptosporidium parvum
LRGNRACSGNS

SEQ ID NO: 2219626 - protein, 9 aa, Cryptosporidium parvum
LRGRSTRYS

SEQ ID NO: 2219627 - protein, 6 aa, Cryptosporidium parvum
LRGTGG

SEQ ID NO: 2219628 - protein, 7 aa, Cryptosporidium parvum
LRGTSDG

SEQ ID NO: 2219629 - protein, 10 aa, Cryptosporidium parvum
LRKGGEQVRN

SEQ ID NO: 2219630 - protein, 10 aa, Cryptosporidium parvum
LRKKEDSDNN

SEQ ID NO: 2219631 - protein, 10 aa, Cryptosporidium parvum
LRKKQGEKLI

SEQ ID NO: 2219632 - protein, 14 aa, Cryptosporidium parvum
LRKKTKTMKHNDPD

SEQ ID NO: 2219633 - protein, 8 aa, Cryptosporidium parvum
LRKNASVE

SEQ ID NO: 2219634 - protein, 38 aa, Cryptosporidium parvum
LRKSQQFKRTQGKAPSPLISSSSSSPSPSPSPLSSQKN

SEQ ID NO: 2219635 - protein, 7 aa, Cryptosporidium parvum
LRNDPDF

SEQ ID NO: 2219636 - protein, 22 aa, Cryptosporidium parvum
LRNNSSKRDNIPVKSRKDAPTF

SEQ ID NO: 2219637 - protein, 27 aa, Cryptosporidium parvum
LRNSTSSKQRATEENHLNQTTSEEGGH

SEQ ID NO: 2219638 - protein, 6 aa, Cryptosporidium parvum
LRPKTR

SEQ ID NO: 2219639 - protein, 16 aa, Cryptosporidium parvum
LRPNTTKITEKMGNDD

SEQ ID NO: 2219640 - protein, 4 aa, Cryptosporidium parvum
LRQK

SEQ ID NO: 2219641 - protein, 19 aa, Cryptosporidium parvum
LRQLDESDQTLSNGQKSRI

SEQ ID NO: 2219642 - protein, 10 aa, Cryptosporidium parvum
LRQNEENNQS

SEQ ID NO: 2219643 - protein, 10 aa, Cryptosporidium parvum
LRREKSGKTI

SEQ ID NO: 2219644 - protein, 5 aa, Cryptosporidium parvum
LRRKE

SEQ ID NO: 2219645 - protein, 6 aa, Cryptosporidium parvum
LRSGNK

SEQ ID NO: 2219646 - protein, 5 aa, Cryptosporidium parvum
LRSKS

SEQ ID NO: 2219647 - protein, 6 aa, Cryptosporidium parvum
LRSNHG

SEQ ID NO: 2219648 - protein, 17 aa, Cryptosporidium parvum
LRSSSTSITSSDTQSPM

SEQ ID NO: 2219649 - protein, 12 aa, Cryptosporidium parvum
LRSTSDLASKIS

SEQ ID NO: 2219650 - protein, 7 aa, Cryptosporidium parvum
LRTNNRG

SEQ ID NO: 2219651 - protein, 7 aa, Cryptosporidium parvum
LRTPDID

SEQ ID NO: 2219652 - protein, 10 aa, Cryptosporidium parvum
LRTSLERNKN

SEQ ID NO: 2219653 - protein, 7 aa, Cryptosporidium parvum
LRTSTRE

SEQ ID NO: 2219654 - protein, 9 aa, Cryptosporidium parvum
LRTYSDSQC

SEQ ID NO: 2219655 - protein, 53 aa, Cryptosporidium parvum
LSADQKGGDLKERDYNEAEENSDDELDDGLEECEDETESEELDSEDEIYEDNS

SEQ ID NO: 2219656 - protein, 15 aa, Cryptosporidium parvum
LSAESESNDGSSRSL

SEQ ID NO: 2219657 - protein, 7 aa, Cryptosporidium parvum
LSASIST

SEQ ID NO: 2219658 - protein, 5 aa, Cryptosporidium parvum
LSASP

SEQ ID NO: 2219659 - protein, 9 aa, Cryptosporidium parvum
LSDAREYGK

SEQ ID NO: 2219660 - protein, 9 aa, Cryptosporidium parvum
LSDDPQTPL

SEQ ID NO: 2219661 - protein, 9 aa, Cryptosporidium parvum
LSDEEKNEM

SEQ ID NO: 2219662 - protein, 7 aa, Cryptosporidium parvum
LSDELTE

SEQ ID NO: 2219663 - protein, 7 aa, Cryptosporidium parvum
LSDENQK

SEQ ID NO: 2219664 - protein, 7 aa, Cryptosporidium parvum
LSDGIEG

SEQ ID NO: 2219665 - protein, 8 aa, Cryptosporidium parvum
LSDHSPLN

SEQ ID NO: 2219666 - protein, 23 aa, Cryptosporidium parvum
LSDISSSSNSAAGQAGNYPIYKG

SEQ ID NO: 2219667 - protein, 6 aa, Cryptosporidium parvum
LSDKNM

SEQ ID NO: 2219668 - protein, 6 aa, Cryptosporidium parvum
LSDLNR

SEQ ID NO: 2219669 - protein, 23 aa, Cryptosporidium parvum
LSDNDTDKEEGEMSKEKEDYNSG

SEQ ID NO: 2219670 - protein, 9 aa, Cryptosporidium parvum
LSDPGNPGR

SEQ ID NO: 2219671 - protein, 7 aa, Cryptosporidium parvum
LSDQNNG

SEQ ID NO: 2219672 - protein, 11 aa, Cryptosporidium parvum
LSDRHKELNSA

SEQ ID NO: 2219673 - protein, 20 aa, Cryptosporidium parvum
LSDRNTYKLSSDQDSRSNSI

SEQ ID NO: 2219674 - protein, 18 aa, Cryptosporidium parvum
LSDTGKCSPFDESANGFV

SEQ ID NO: 2219675 - protein, 4 aa, Cryptosporidium parvum
LSED

SEQ ID NO: 2219676 - protein, 5 aa, Cryptosporidium parvum
LSEDN

SEQ ID NO: 2219677 - protein, 6 aa, Cryptosporidium parvum
LSEDNL

SEQ ID NO: 2219678 - protein, 21 aa, Cryptosporidium parvum
LSEDNSQDVEEVNPQEEASRL

SEQ ID NO: 2219679 - protein, 7 aa, Cryptosporidium parvum
LSEDYRS

SEQ ID NO: 2219680 - protein, 22 aa, Cryptosporidium parvum
LSEEIKNKEKKSRKKKTRSKRE

SEQ ID NO: 2219681 - protein, 5 aa, Cryptosporidium parvum
LSEES

SEQ ID NO: 2219682 - protein, 8 aa, Cryptosporidium parvum
LSEESQKR

SEQ ID NO: 2219683 - protein, 5 aa, Cryptosporidium parvum
LSEGE

SEQ ID NO: 2219684 - protein, 6 aa, Cryptosporidium parvum
LSEGNI

SEQ ID NO: 2219685 - protein, 16 aa, Cryptosporidium parvum
LSEGSDDVLPYSSTSG

SEQ ID NO: 2219686 - protein, 9 aa, Cryptosporidium parvum
LSEKENDSM

SEQ ID NO: 2219687 - protein, 13 aa, Cryptosporidium parvum
LSENKDVSSSEND

SEQ ID NO: 2219688 - protein, 12 aa, Cryptosporidium parvum
LSEQKTELLEEL

SEQ ID NO: 2219689 - protein, 87 aa, Cryptosporidium parvum
LSESDAGSKKVTHGRKKKKSTKSKKRAEERSKSNEREEEKVSKKKRSRSGSGSKPRKSSSGSTSSDSKEESSMPSGKSKKSTQTDQA

SEQ ID NO: 2219690 - protein, 8 aa, Cryptosporidium parvum
LSESKDVD

SEQ ID NO: 2219691 - protein, 14 aa, Cryptosporidium parvum
LSETENEKNIETNN

SEQ ID NO: 2219692 - protein, 40 aa, Cryptosporidium parvum
LSFSPSSSSMNNNIPRKSPFNISESNNQFGGRSEPSIGGK

SEQ ID NO: 2219693 - protein, 12 aa, Cryptosporidium parvum
LSFSSGKNTPLP

SEQ ID NO: 2219694 - protein, 4 aa, Cryptosporidium parvum
LSGE

SEQ ID NO: 2219695 - protein, 5 aa, Cryptosporidium parvum
LSGGL

SEQ ID NO: 2219696 - protein, 7 aa, Cryptosporidium parvum
LSGGQKT

SEQ ID NO: 2219697 - protein, 9 aa, Cryptosporidium parvum
LSGGQRSRL

SEQ ID NO: 2219698 - protein, 6 aa, Cryptosporidium parvum
LSGGSR

SEQ ID NO: 2219699 - protein, 31 aa, Cryptosporidium parvum
LSGGTGGVEGKGGVGGTGAGGSISSIQGKEQ

SEQ ID NO: 2219700 - protein, 17 aa, Cryptosporidium parvum
LSGINTEKLSSSDSLRR

SEQ ID NO: 2219701 - protein, 6 aa, Cryptosporidium parvum
LSGKGG

SEQ ID NO: 2219702 - protein, 15 aa, Cryptosporidium parvum
LSGKNRENQKNQLRK

SEQ ID NO: 2219703 - protein, 7 aa, Cryptosporidium parvum
LSGQNLE

SEQ ID NO: 2219704 - protein, 17 aa, Cryptosporidium parvum
LSGQNQVESSKDDDDDI

SEQ ID NO: 2219705 - protein, 8 aa, Cryptosporidium parvum
LSGQTSDY

SEQ ID NO: 2219706 - protein, 8 aa, Cryptosporidium parvum
LSGQYSPI

SEQ ID NO: 2219707 - protein, 6 aa, Cryptosporidium parvum
LSGSDS

SEQ ID NO: 2219708 - protein, 12 aa, Cryptosporidium parvum
LSGSSKDILHDL

SEQ ID NO: 2219709 - protein, 23 aa, Cryptosporidium parvum
LSHQNDRKSSPSFSPLGSDTSNW

SEQ ID NO: 2219710 - protein, 8 aa, Cryptosporidium parvum
LSIPSKKK

SEQ ID NO: 2219711 - protein, 6 aa, Cryptosporidium parvum
LSKEEK

SEQ ID NO: 2219712 - protein, 8 aa, Cryptosporidium parvum
LSKGANNH

SEQ ID NO: 2219713 - protein, 10 aa, Cryptosporidium parvum
LSKGSKKKNL

SEQ ID NO: 2219714 - protein, 5 aa, Cryptosporidium parvum
LSKIP

SEQ ID NO: 2219715 - protein, 10 aa, Cryptosporidium parvum
LSKKGGAGNC

SEQ ID NO: 2219716 - protein, 16 aa, Cryptosporidium parvum
LSKKNSNLDLRNSEEC

SEQ ID NO: 2219717 - protein, 19 aa, Cryptosporidium parvum
LSKNSECRSFDKDADGFVR

SEQ ID NO: 2219718 - protein, 18 aa, Cryptosporidium parvum
LSKNSQEDIGNESEKESN

SEQ ID NO: 2219719 - protein, 9 aa, Cryptosporidium parvum
LSKPDPKTY

SEQ ID NO: 2219720 - protein, 18 aa, Cryptosporidium parvum
LSKPIGSEDQDKHPSGHE

SEQ ID NO: 2219721 - protein, 4 aa, Cryptosporidium parvum
LSKQ

SEQ ID NO: 2219722 - protein, 15 aa, Cryptosporidium parvum
LSKQSEDLDNSNNTE

SEQ ID NO: 2219723 - protein, 15 aa, Cryptosporidium parvum
LSKSSKKISPALPSE

SEQ ID NO: 2219724 - protein, 10 aa, Cryptosporidium parvum
LSNDNEDELY

SEQ ID NO: 2219725 - protein, 16 aa, Cryptosporidium parvum
LSNEISSRVSSDKKID

SEQ ID NO: 2219726 - protein, 7 aa, Cryptosporidium parvum
LSNEPPM

SEQ ID NO: 2219727 - protein, 21 aa, Cryptosporidium parvum
LSNESDNNLGSLGKAGGGTGI

SEQ ID NO: 2219728 - protein, 5 aa, Cryptosporidium parvum
LSNGD

SEQ ID NO: 2219729 - protein, 9 aa, Cryptosporidium parvum
LSNGNAGSK

SEQ ID NO: 2219730 - protein, 9 aa, Cryptosporidium parvum
LSNHSNGNN

SEQ ID NO: 2219731 - protein, 22 aa, Cryptosporidium parvum
LSNKGENLKRKFDQSSKGLESE

SEQ ID NO: 2219732 - protein, 5 aa, Cryptosporidium parvum
LSNNE

SEQ ID NO: 2219733 - protein, 9 aa, Cryptosporidium parvum
LSNNKNDQN

SEQ ID NO: 2219734 - protein, 8 aa, Cryptosporidium parvum
LSNPKEKY

SEQ ID NO: 2219735 - protein, 8 aa, Cryptosporidium parvum
LSNPSDAV

SEQ ID NO: 2219736 - protein, 7 aa, Cryptosporidium parvum
LSNQKYR

SEQ ID NO: 2219737 - protein, 7 aa, Cryptosporidium parvum
LSNSDPV

SEQ ID NO: 2219738 - protein, 8 aa, Cryptosporidium parvum
LSNSDTGI

SEQ ID NO: 2219739 - protein, 6 aa, Cryptosporidium parvum
LSNSKA

SEQ ID NO: 2219740 - protein, 10 aa, Cryptosporidium parvum
LSNSKYNEKN

SEQ ID NO: 2219741 - protein, 4 aa, Cryptosporidium parvum
LSPK

SEQ ID NO: 2219742 - protein, 5 aa, Cryptosporidium parvum
LSPKR

SEQ ID NO: 2219743 - protein, 34 aa, Cryptosporidium parvum
LSPKSGKTTVPSHSKLSQDKKDQLKTSKNSNSII

SEQ ID NO: 2219744 - protein, 4 aa, Cryptosporidium parvum
LSPN

SEQ ID NO: 2219745 - protein, 11 aa, Cryptosporidium parvum
LSPNTKTPTPI

SEQ ID NO: 2219746 - protein, 5 aa, Cryptosporidium parvum
LSPPI

SEQ ID NO: 2219747 - protein, 7 aa, Cryptosporidium parvum
LSPPSSY

SEQ ID NO: 2219748 - protein, 5 aa, Cryptosporidium parvum
LSPQY

SEQ ID NO: 2219749 - protein, 5 aa, Cryptosporidium parvum
LSPRG

SEQ ID NO: 2219750 - protein, 7 aa, Cryptosporidium parvum
LSPSEKV

SEQ ID NO: 2219751 - protein, 38 aa, Cryptosporidium parvum
LSPTKKNRKQLNNKDTTNGSNGDFTQNPNLKENNVENN

SEQ ID NO: 2219752 - protein, 9 aa, Cryptosporidium parvum
LSQAETDNQ

SEQ ID NO: 2219753 - protein, 5 aa, Cryptosporidium parvum
LSQDR

SEQ ID NO: 2219754 - protein, 9 aa, Cryptosporidium parvum
LSQDSHSDE

SEQ ID NO: 2219755 - protein, 15 aa, Cryptosporidium parvum
LSQDTRDWESLKDPE

SEQ ID NO: 2219756 - protein, 10 aa, Cryptosporidium parvum
LSQNKEEKKL

SEQ ID NO: 2219757 - protein, 14 aa, Cryptosporidium parvum
LSQQESSLISKNNE

SEQ ID NO: 2219758 - protein, 7 aa, Cryptosporidium parvum
LSQSENA

SEQ ID NO: 2219759 - protein, 7 aa, Cryptosporidium parvum
LSQTPST

SEQ ID NO: 2219760 - protein, 22 aa, Cryptosporidium parvum
LSQYSGNNSNSYEEKVTNESGL

SEQ ID NO: 2219761 - protein, 8 aa, Cryptosporidium parvum
LSRDPKVL

SEQ ID NO: 2219762 - protein, 11 aa, Cryptosporidium parvum
LSREEKIKSTQ

SEQ ID NO: 2219763 - protein, 9 aa, Cryptosporidium parvum
LSREINKDN

SEQ ID NO: 2219764 - protein, 7 aa, Cryptosporidium parvum
LSRPPHV

SEQ ID NO: 2219765 - protein, 9 aa, Cryptosporidium parvum
LSRQNANQY

SEQ ID NO: 2219766 - protein, 11 aa, Cryptosporidium parvum
LSRSTDDFNGA

SEQ ID NO: 2219767 - protein, 14 aa, Cryptosporidium parvum
LSRTNRSSEDSDSL

SEQ ID NO: 2219768 - protein, 5 aa, Cryptosporidium parvum
LSSDY

SEQ ID NO: 2219769 - protein, 4 aa, Cryptosporidium parvum
LSSE

SEQ ID NO: 2219770 - protein, 8 aa, Cryptosporidium parvum
LSSEEIEY

SEQ ID NO: 2219771 - protein, 8 aa, Cryptosporidium parvum
LSSGTISD

SEQ ID NO: 2219772 - protein, 5 aa, Cryptosporidium parvum
LSSGY

SEQ ID NO: 2219773 - protein, 6 aa, Cryptosporidium parvum
LSSKDK

SEQ ID NO: 2219774 - protein, 10 aa, Cryptosporidium parvum
LSSKNTSYGL

SEQ ID NO: 2219775 - protein, 5 aa, Cryptosporidium parvum
LSSKQ

SEQ ID NO: 2219776 - protein, 7 aa, Cryptosporidium parvum
LSSNNNI

SEQ ID NO: 2219777 - protein, 8 aa, Cryptosporidium parvum
LSSNSYSG

SEQ ID NO: 2219778 - protein, 22 aa, Cryptosporidium parvum
LSSPQSNQINENGDQRSNISSA

SEQ ID NO: 2219779 - protein, 13 aa, Cryptosporidium parvum
LSSPVSSQADISR

SEQ ID NO: 2219780 - protein, 38 aa, Cryptosporidium parvum
LSSQNSSCSVSSSSENERESISNTEMPKSNHDDESAWD

SEQ ID NO: 2219781 - protein, 8 aa, Cryptosporidium parvum
LSSQVNGD

SEQ ID NO: 2219782 - protein, 7 aa, Cryptosporidium parvum
LSSRNKK

SEQ ID NO: 2219783 - protein, 10 aa, Cryptosporidium parvum
LSSRSKESLK

SEQ ID NO: 2219784 - protein, 14 aa, Cryptosporidium parvum
LSSSAKVRKKYNGD

SEQ ID NO: 2219785 - protein, 7 aa, Cryptosporidium parvum
LSSSPKL

SEQ ID NO: 2219786 - protein, 7 aa, Cryptosporidium parvum
LSSTEQR

SEQ ID NO: 2219787 - protein, 7 aa, Cryptosporidium parvum
LSSTPSL

SEQ ID NO: 2219788 - protein, 12 aa, Cryptosporidium parvum
LSSVGSKKRVKI

SEQ ID NO: 2219789 - protein, 18 aa, Cryptosporidium parvum
LSTCSTNSTVLNSFITNI

SEQ ID NO: 2219790 - protein, 7 aa, Cryptosporidium parvum
LSTDRAY

SEQ ID NO: 2219791 - protein, 9 aa, Cryptosporidium parvum
LSTEEEKES

SEQ ID NO: 2219792 - protein, 8 aa, Cryptosporidium parvum
LSTEEGDY

SEQ ID NO: 2219793 - protein, 7 aa, Cryptosporidium parvum
LSTGSDV

SEQ ID NO: 2219794 - protein, 14 aa, Cryptosporidium parvum
LSTIDSENKKELKA

SEQ ID NO: 2219795 - protein, 5 aa, Cryptosporidium parvum
LSTKT

SEQ ID NO: 2219796 - protein, 15 aa, Cryptosporidium parvum
LSTNFDQDKQEEIEA

SEQ ID NO: 2219797 - protein, 7 aa, Cryptosporidium parvum
LSTNFDR

SEQ ID NO: 2219798 - protein, 8 aa, Cryptosporidium parvum
LSTNQMGS

SEQ ID NO: 2219799 - protein, 9 aa, Cryptosporidium parvum
LSTNTGEKK

SEQ ID NO: 2219800 - protein, 11 aa, Cryptosporidium parvum
LSTQSNFSLPN

SEQ ID NO: 2219801 - protein, 9 aa, Cryptosporidium parvum
LSTSNSVNL

SEQ ID NO: 2219802 - protein, 5 aa, Cryptosporidium parvum
LSTSP

SEQ ID NO: 2219803 - protein, 11 aa, Cryptosporidium parvum
LSTSQNNGVDL

SEQ ID NO: 2219804 - protein, 8 aa, Cryptosporidium parvum
LSTSSEQI

SEQ ID NO: 2219805 - protein, 6 aa, Cryptosporidium parvum
LSTTPV

SEQ ID NO: 2219806 - protein, 36 aa, Cryptosporidium parvum
LSVGTGSDAFENPLTENGNQNEKQPLIPEDKCEKGQ

SEQ ID NO: 2219807 - protein, 4 aa, Cryptosporidium parvum
LSVT

SEQ ID NO: 2219808 - protein, 5 aa, Cryptosporidium parvum
LSYSE

SEQ ID NO: 2219809 - protein, 10 aa, Cryptosporidium parvum
LSYSGPPNQS

SEQ ID NO: 2219810 - protein, 11 aa, Cryptosporidium parvum
LTANQSGRNEL

SEQ ID NO: 2219811 - protein, 9 aa, Cryptosporidium parvum
LTAPNGVAQ

SEQ ID NO: 2219812 - protein, 12 aa, Cryptosporidium parvum
LTASDSNGRDVN

SEQ ID NO: 2219813 - protein, 4 aa, Cryptosporidium parvum
LTDA

SEQ ID NO: 2219814 - protein, 8 aa, Cryptosporidium parvum
LTDDDYDK

SEQ ID NO: 2219815 - protein, 5 aa, Cryptosporidium parvum
LTDSD

SEQ ID NO: 2219816 - protein, 29 aa, Cryptosporidium parvum
LTDSKKIDTTESHKCTNSEDLQNNQEYNT

SEQ ID NO: 2219817 - protein, 10 aa, Cryptosporidium parvum
LTDSKNEFYE

SEQ ID NO: 2219818 - protein, 6 aa, Cryptosporidium parvum
LTESTA

SEQ ID NO: 2219819 - protein, 10 aa, Cryptosporidium parvum
LTGADGETIT

SEQ ID NO: 2219820 - protein, 6 aa, Cryptosporidium parvum
LTGESV

SEQ ID NO: 2219821 - protein, 5 aa, Cryptosporidium parvum
LTGGN

SEQ ID NO: 2219822 - protein, 9 aa, Cryptosporidium parvum
LTGGPTEDL

SEQ ID NO: 2219823 - protein, 11 aa, Cryptosporidium parvum
LTGGSSALNNR

SEQ ID NO: 2219824 - protein, 14 aa, Cryptosporidium parvum
LTGPINDTTPIKSP

SEQ ID NO: 2219825 - protein, 8 aa, Cryptosporidium parvum
LTGPRQDK

SEQ ID NO: 2219826 - protein, 12 aa, Cryptosporidium parvum
LTGQSTTVTEPV

SEQ ID NO: 2219827 - protein, 13 aa, Cryptosporidium parvum
LTIPTTNHRVSES

SEQ ID NO: 2219828 - protein, 12 aa, Cryptosporidium parvum
LTKESNTSIETN

SEQ ID NO: 2219829 - protein, 12 aa, Cryptosporidium parvum
LTNDSPLSTHSN

SEQ ID NO: 2219830 - protein, 11 aa, Cryptosporidium parvum
LTNNSGGLSSE

SEQ ID NO: 2219831 - protein, 23 aa, Cryptosporidium parvum
LTNSDFTSSSSSSESETSSSGSE

SEQ ID NO: 2219832 - protein, 6 aa, Cryptosporidium parvum
LTPENQ

SEQ ID NO: 2219833 - protein, 4 aa, Cryptosporidium parvum
LTPN

SEQ ID NO: 2219834 - protein, 12 aa, Cryptosporidium parvum
LTPNDIKATRDL

SEQ ID NO: 2219835 - protein, 9 aa, Cryptosporidium parvum
LTPNKKATI

SEQ ID NO: 2219836 - protein, 6 aa, Cryptosporidium parvum
LTPNYS

SEQ ID NO: 2219837 - protein, 10 aa, Cryptosporidium parvum
LTPNYTEDQY

SEQ ID NO: 2219838 - protein, 5 aa, Cryptosporidium parvum
LTPSA

SEQ ID NO: 2219839 - protein, 11 aa, Cryptosporidium parvum
LTQNQNQNQHS

SEQ ID NO: 2219840 - protein, 13 aa, Cryptosporidium parvum
LTQNTGKANFSNK

SEQ ID NO: 2219841 - protein, 5 aa, Cryptosporidium parvum
LTREK

SEQ ID NO: 2219842 - protein, 4 aa, Cryptosporidium parvum
LTSD

SEQ ID NO: 2219843 - protein, 9 aa, Cryptosporidium parvum
LTSEESNCT

SEQ ID NO: 2219844 - protein, 7 aa, Cryptosporidium parvum
LTSEGSL

SEQ ID NO: 2219845 - protein, 5 aa, Cryptosporidium parvum
LTSES

SEQ ID NO: 2219846 - protein, 5 aa, Cryptosporidium parvum
LTSIQ

SEQ ID NO: 2219847 - protein, 8 aa, Cryptosporidium parvum
LTSKFDEK

SEQ ID NO: 2219848 - protein, 9 aa, Cryptosporidium parvum
LTSKNQSKI

SEQ ID NO: 2219849 - protein, 7 aa, Cryptosporidium parvum
LTSNKDG

SEQ ID NO: 2219850 - protein, 5 aa, Cryptosporidium parvum
LTSNQ

SEQ ID NO: 2219851 - protein, 6 aa, Cryptosporidium parvum
LTSNQY

SEQ ID NO: 2219852 - protein, 15 aa, Cryptosporidium parvum
LTSPKSDFTNKTQKY

SEQ ID NO: 2219853 - protein, 10 aa, Cryptosporidium parvum
LTSQEETKEL

SEQ ID NO: 2219854 - protein, 14 aa, Cryptosporidium parvum
LTSRRGRLIIIIFI

SEQ ID NO: 2219855 - protein, 4 aa, Cryptosporidium parvum
LTSS

SEQ ID NO: 2219856 - protein, 13 aa, Cryptosporidium parvum
LTSSQNEGSTRGH

SEQ ID NO: 2219857 - protein, 5 aa, Cryptosporidium parvum
LTSST

SEQ ID NO: 2219858 - protein, 4 aa, Cryptosporidium parvum
LTST

SEQ ID NO: 2219859 - protein, 20 aa, Cryptosporidium parvum
LTTSAEKSSHMESTLSSSGV

SEQ ID NO: 2219860 - protein, 13 aa, Cryptosporidium parvum
LTTSSSKDEEISE

SEQ ID NO: 2219861 - protein, 10 aa, Cryptosporidium parvum
LTVDTDETYG

SEQ ID NO: 2219862 - protein, 14 aa, Cryptosporidium parvum
LVDPSNKKPIPGSH

SEQ ID NO: 2219863 - protein, 7 aa, Cryptosporidium parvum
LVKGGQD

SEQ ID NO: 2219864 - protein, 47 aa, Cryptosporidium parvum
LVNPETNSTVSGSTSGTTKPKPGIPVNGGGVVPDEEAKDQADKGKDG

SEQ ID NO: 2219865 - protein, 7 aa, Cryptosporidium parvum
LVSSPNN

SEQ ID NO: 2219866 - protein, 8 aa, Cryptosporidium parvum
LYDDPKSA

SEQ ID NO: 2219867 - protein, 9 aa, Cryptosporidium parvum
LYNDSSGEL

SEQ ID NO: 2219868 - protein, 6 aa, Cryptosporidium parvum
LYNEKS

SEQ ID NO: 2219869 - protein, 12 aa, Cryptosporidium parvum
LYPDGPNSNINH

SEQ ID NO: 2219870 - protein, 7 aa, Cryptosporidium parvum
LYPSSST

SEQ ID NO: 2219871 - protein, 12 aa, Cryptosporidium parvum
LYSNAGSLSGSQ

SEQ ID NO: 2219872 - protein, 4 aa, Cryptosporidium parvum
MADG

SEQ ID NO: 2219873 - protein, 8 aa, Cryptosporidium parvum
MAGTASQI

SEQ ID NO: 2219874 - protein, 9 aa, Cryptosporidium parvum
MANEQSDST

SEQ ID NO: 2219875 - protein, 11 aa, Cryptosporidium parvum
MANGNQVRKDF

SEQ ID NO: 2219876 - protein, 29 aa, Cryptosporidium parvum
MAPSSEKKVINNKDEKSDNELENSSLSDT

SEQ ID NO: 2219877 - protein, 4 aa, Cryptosporidium parvum
MAQN

SEQ ID NO: 2219878 - protein, 8 aa, Cryptosporidium parvum
MDDTSLSS

SEQ ID NO: 2219879 - protein, 78 aa, Cryptosporidium parvum
MDENEDKQKEEKKQKQEKNVREEEGKGREEEEGKGKGKEEGKEEGKGEEGEQEGEEGEEGEEKGERGAGGKEEEQQEM

SEQ ID NO: 2219880 - protein, 7 aa, Cryptosporidium parvum
MDETPDS

SEQ ID NO: 2219881 - protein, 38 aa, Cryptosporidium parvum
MDKTTTGTTTSTDKSYDQTSNVDTTVQATTMPKQTSKV

SEQ ID NO: 2219882 - protein, 9 aa, Cryptosporidium parvum
MDNTSSKNH

SEQ ID NO: 2219883 - protein, 10 aa, Cryptosporidium parvum
MDPKSPKKPL

SEQ ID NO: 2219884 - protein, 11 aa, Cryptosporidium parvum
MDPTDGNSKLT

SEQ ID NO: 2219885 - protein, 4 aa, Cryptosporidium parvum
MDSG

SEQ ID NO: 2219886 - protein, 18 aa, Cryptosporidium parvum
MDTGTESESEENEKEDLR

SEQ ID NO: 2219887 - protein, 20 aa, Cryptosporidium parvum
MDTSSGKSDQLRGQPPSPIH

SEQ ID NO: 2219888 - protein, 6 aa, Cryptosporidium parvum
MEDPKY

SEQ ID NO: 2219889 - protein, 17 aa, Cryptosporidium parvum
MEEDKEKKMNSTAHPFP

SEQ ID NO: 2219890 - protein, 5 aa, Cryptosporidium parvum
MEEGG

SEQ ID NO: 2219891 - protein, 14 aa, Cryptosporidium parvum
MEEKGSANGGLGGF

SEQ ID NO: 2219892 - protein, 8 aa, Cryptosporidium parvum
MEEKTNSK

SEQ ID NO: 2219893 - protein, 6 aa, Cryptosporidium parvum
MEGETS

SEQ ID NO: 2219894 - protein, 8 aa, Cryptosporidium parvum
MEGKSGQL

SEQ ID NO: 2219895 - protein, 4 aa, Cryptosporidium parvum
MEKD

SEQ ID NO: 2219896 - protein, 9 aa, Cryptosporidium parvum
MEKKQRSVE

SEQ ID NO: 2219897 - protein, 7 aa, Cryptosporidium parvum
MEKNESL

SEQ ID NO: 2219898 - protein, 4 aa, Cryptosporidium parvum
MEKY

SEQ ID NO: 2219899 - protein, 4 aa, Cryptosporidium parvum
MELE

SEQ ID NO: 2219900 - protein, 30 aa, Cryptosporidium parvum
MENDYGNDNMDNNDYGNGINTTSDQTSYEY

SEQ ID NO: 2219901 - protein, 14 aa, Cryptosporidium parvum
MENQKEQEQKQEKQ

SEQ ID NO: 2219902 - protein, 4 aa, Cryptosporidium parvum
MEPG

SEQ ID NO: 2219903 - protein, 14 aa, Cryptosporidium parvum
MEQDEDENKNFDLN

SEQ ID NO: 2219904 - protein, 13 aa, Cryptosporidium parvum
MESEDDDLTDEEF

SEQ ID NO: 2219905 - protein, 7 aa, Cryptosporidium parvum
MESEKEQ

SEQ ID NO: 2219906 - protein, 12 aa, Cryptosporidium parvum
MESIENKSQSTP

SEQ ID NO: 2219907 - protein, 5 aa, Cryptosporidium parvum
MESNS

SEQ ID NO: 2219908 - protein, 4 aa, Cryptosporidium parvum
MESS

SEQ ID NO: 2219909 - protein, 18 aa, Cryptosporidium parvum
MESSAEVSGVSSEKSQAL

SEQ ID NO: 2219910 - protein, 7 aa, Cryptosporidium parvum
METEKKN

SEQ ID NO: 2219911 - protein, 6 aa, Cryptosporidium parvum
METRSK

SEQ ID NO: 2219912 - protein, 9 aa, Cryptosporidium parvum
METTGNDDV

SEQ ID NO: 2219913 - protein, 4 aa, Cryptosporidium parvum
MFGP

SEQ ID NO: 2219914 - protein, 36 aa, Cryptosporidium parvum
MGDSADGFDDDDLDDDFDDEFDSEDVQQSMQPDNGY

SEQ ID NO: 2219915 - protein, 4 aa, Cryptosporidium parvum
MGES

SEQ ID NO: 2219916 - protein, 11 aa, Cryptosporidium parvum
MGGGDRRSSIS

SEQ ID NO: 2219917 - protein, 9 aa, Cryptosporidium parvum
MGGQTDGDK

SEQ ID NO: 2219918 - protein, 12 aa, Cryptosporidium parvum
MGHATSNQKIRG

SEQ ID NO: 2219919 - protein, 8 aa, Cryptosporidium parvum
MGKEGQFE

SEQ ID NO: 2219920 - protein, 8 aa, Cryptosporidium parvum
MGKSSRIK

SEQ ID NO: 2219921 - protein, 10 aa, Cryptosporidium parvum
MGNKKKSLSR

SEQ ID NO: 2219922 - protein, 5 aa, Cryptosporidium parvum
MGQTN

SEQ ID NO: 2219923 - protein, 30 aa, Cryptosporidium parvum
MGSGNRKSKSNIKQTSKSKSRSESSVNLED

SEQ ID NO: 2219924 - protein, 12 aa, Cryptosporidium parvum
MGSVSNKTYGSY

SEQ ID NO: 2219925 - protein, 15 aa, Cryptosporidium parvum
MHQTGARGVGSSGIT

SEQ ID NO: 2219926 - protein, 11 aa, Cryptosporidium parvum
MKDENQDENSF

SEQ ID NO: 2219927 - protein, 15 aa, Cryptosporidium parvum
MKDPNLSDQSNKEYE

SEQ ID NO: 2219928 - protein, 4 aa, Cryptosporidium parvum
MKEI

SEQ ID NO: 2219929 - protein, 5 aa, Cryptosporidium parvum
MKEKE

SEQ ID NO: 2219930 - protein, 8 aa, Cryptosporidium parvum
MKETDQKE

SEQ ID NO: 2219931 - protein, 10 aa, Cryptosporidium parvum
MKKKNRQSPK

SEQ ID NO: 2219932 - protein, 11 aa, Cryptosporidium parvum
MKNEPNNKKEL

SEQ ID NO: 2219933 - protein, 7 aa, Cryptosporidium parvum
MKNNKDG

SEQ ID NO: 2219934 - protein, 31 aa, Cryptosporidium parvum
MKNSSKSNNNNNNNNTNNNITNNKGGDQKVA

SEQ ID NO: 2219935 - protein, 13 aa, Cryptosporidium parvum
MKPEGSSTARPEI

SEQ ID NO: 2219936 - protein, 4 aa, Cryptosporidium parvum
MKPG

SEQ ID NO: 2219937 - protein, 97 aa, Cryptosporidium parvum
MKQEEIKKEEELKRQKEQEKKREEELKKQKELEKKREEELKRQKRREEQERKKQERLQKKQAKEMENEAKENERKNLKEEKSKESVEQNKVKKDPFE

SEQ ID NO: 2219938 - protein, 15 aa, Cryptosporidium parvum
MKQEKALEKKRTKDL

SEQ ID NO: 2219939 - protein, 6 aa, Cryptosporidium parvum
MKREEG

SEQ ID NO: 2219940 - protein, 6 aa, Cryptosporidium parvum
MKRQEN

SEQ ID NO: 2219941 - protein, 4 aa, Cryptosporidium parvum
MKSG

SEQ ID NO: 2219942 - protein, 10 aa, Cryptosporidium parvum
MKSHDSNKRI

SEQ ID NO: 2219943 - protein, 26 aa, Cryptosporidium parvum
MKSPDKSEMSKTKKIQRPSSPESSKF

SEQ ID NO: 2219944 - protein, 31 aa, Cryptosporidium parvum
MKSSEENIERNEEDQNMNGRYEKRNSSEIHG

SEQ ID NO: 2219945 - protein, 9 aa, Cryptosporidium parvum
MKSSSTGLR

SEQ ID NO: 2219946 - protein, 7 aa, Cryptosporidium parvum
MKTSTEV

SEQ ID NO: 2219947 - protein, 12 aa, Cryptosporidium parvum
MLSDDSSSSVSN

SEQ ID NO: 2219948 - protein, 11 aa, Cryptosporidium parvum
MLSKRNQVKDH

SEQ ID NO: 2219949 - protein, 7 aa, Cryptosporidium parvum
MNDEQGV

SEQ ID NO: 2219950 - protein, 11 aa, Cryptosporidium parvum
MNEFTSSGLEE

SEQ ID NO: 2219951 - protein, 15 aa, Cryptosporidium parvum
MNEKSNIETNNNTEA

SEQ ID NO: 2219952 - protein, 17 aa, Cryptosporidium parvum
MNESQQKNSNNSFSQSN

SEQ ID NO: 2219953 - protein, 9 aa, Cryptosporidium parvum
MNISNNSKN

SEQ ID NO: 2219954 - protein, 14 aa, Cryptosporidium parvum
MNKKKRNKKQKKKH

SEQ ID NO: 2219955 - protein, 18 aa, Cryptosporidium parvum
MNKNSDSDSDSDSDSDSE

SEQ ID NO: 2219956 - protein, 14 aa, Cryptosporidium parvum
MNKNSGKLKSFNDE

SEQ ID NO: 2219957 - protein, 18 aa, Cryptosporidium parvum
MNNDEDENEQDNKLNEKT

SEQ ID NO: 2219958 - protein, 4 aa, Cryptosporidium parvum
MNNN

SEQ ID NO: 2219959 - protein, 10 aa, Cryptosporidium parvum
MNNQSQISDT

SEQ ID NO: 2219960 - protein, 13 aa, Cryptosporidium parvum
MNNTENEQNDTDQ

SEQ ID NO: 2219961 - protein, 9 aa, Cryptosporidium parvum
MNQTPKSTM

SEQ ID NO: 2219962 - protein, 13 aa, Cryptosporidium parvum
MNSGEGGEAEKTI

SEQ ID NO: 2219963 - protein, 6 aa, Cryptosporidium parvum
MNSKTS

SEQ ID NO: 2219964 - protein, 9 aa, Cryptosporidium parvum
MNSNDNNIY

SEQ ID NO: 2219965 - protein, 6 aa, Cryptosporidium parvum
MNSNSD

SEQ ID NO: 2219966 - protein, 11 aa, Cryptosporidium parvum
MNSSSSTRKLG

SEQ ID NO: 2219967 - protein, 12 aa, Cryptosporidium parvum
MNTSEQKSNGLL

SEQ ID NO: 2219968 - protein, 9 aa, Cryptosporidium parvum
MNTSSTGYY

SEQ ID NO: 2219969 - protein, 5 aa, Cryptosporidium parvum
MPCEE

SEQ ID NO: 2219970 - protein, 11 aa, Cryptosporidium parvum
MPGNPSSQVYS

SEQ ID NO: 2219971 - protein, 4 aa, Cryptosporidium parvum
MPKN

SEQ ID NO: 2219972 - protein, 12 aa, Cryptosporidium parvum
MPNGDLTEIGEN

SEQ ID NO: 2219973 - protein, 8 aa, Cryptosporidium parvum
MPNTGSYS

SEQ ID NO: 2219974 - protein, 7 aa, Cryptosporidium parvum
MPPPIQS

SEQ ID NO: 2219975 - protein, 6 aa, Cryptosporidium parvum
MPQSGE

SEQ ID NO: 2219976 - protein, 4 aa, Cryptosporidium parvum
MPRD

SEQ ID NO: 2219977 - protein, 5 aa, Cryptosporidium parvum
MPRHN

SEQ ID NO: 2219978 - protein, 10 aa, Cryptosporidium parvum
MPRSAKLPQP

SEQ ID NO: 2219979 - protein, 6 aa, Cryptosporidium parvum
MPSKEM

SEQ ID NO: 2219980 - protein, 4 aa, Cryptosporidium parvum
MPTS

SEQ ID NO: 2219981 - protein, 4 aa, Cryptosporidium parvum
MQIS

SEQ ID NO: 2219982 - protein, 18 aa, Cryptosporidium parvum
MQNRGGNGPGDMNSGMGE

SEQ ID NO: 2219983 - protein, 7 aa, Cryptosporidium parvum
MRAPGNL

SEQ ID NO: 2219984 - protein, 4 aa, Cryptosporidium parvum
MRDA

SEQ ID NO: 2219985 - protein, 24 aa, Cryptosporidium parvum
MRESDDDMGSFQSNSINAYKDTQP

SEQ ID NO: 2219986 - protein, 5 aa, Cryptosporidium parvum
MRPIR

SEQ ID NO: 2219987 - protein, 7 aa, Cryptosporidium parvum
MRQDTDQ

SEQ ID NO: 2219988 - protein, 11 aa, Cryptosporidium parvum
MRTNHSKLEEL

SEQ ID NO: 2219989 - protein, 10 aa, Cryptosporidium parvum
MSAGGTGFRS

SEQ ID NO: 2219990 - protein, 14 aa, Cryptosporidium parvum
MSANSSSNSGSSSQ

SEQ ID NO: 2219991 - protein, 23 aa, Cryptosporidium parvum
MSDNDNTALNKDLEDNDDVNDHS

SEQ ID NO: 2219992 - protein, 7 aa, Cryptosporidium parvum
MSEGEVS

SEQ ID NO: 2219993 - protein, 5 aa, Cryptosporidium parvum
MSEPV

SEQ ID NO: 2219994 - protein, 5 aa, Cryptosporidium parvum
MSGGP

SEQ ID NO: 2219995 - protein, 7 aa, Cryptosporidium parvum
MSHSTGR

SEQ ID NO: 2219996 - protein, 14 aa, Cryptosporidium parvum
MSIGNSGQIEDSDE

SEQ ID NO: 2219997 - protein, 9 aa, Cryptosporidium parvum
MSKEKKRKL

SEQ ID NO: 2219998 - protein, 10 aa, Cryptosporidium parvum
MSKQEGNNKI

SEQ ID NO: 2219999 - protein, 7 aa, Cryptosporidium parvum
MSMGESM

SEQ ID NO: 2220000 - protein, 7 aa, Cryptosporidium parvum
MSNEDRN

SEQ ID NO: 2220001 - protein, 5 aa, Cryptosporidium parvum
MSNID

SEQ ID NO: 2220002 - protein, 8 aa, Cryptosporidium parvum
MSPKNKQT

SEQ ID NO: 2220003 - protein, 8 aa, Cryptosporidium parvum
MSPNNKSE

SEQ ID NO: 2220004 - protein, 7 aa, Cryptosporidium parvum
MSPTHNS

SEQ ID NO: 2220005 - protein, 11 aa, Cryptosporidium parvum
MSQPPSSFTPS

SEQ ID NO: 2220006 - protein, 63 aa, Cryptosporidium parvum
MSSDDDSELSSVEAENALQDQGSSIPKDREDEKKRNKPSISTESSDQSNENSNKPEENYNGDG

SEQ ID NO: 2220007 - protein, 4 aa, Cryptosporidium parvum
MSSP

SEQ ID NO: 2220008 - protein, 6 aa, Cryptosporidium parvum
MSTNTE

SEQ ID NO: 2220009 - protein, 8 aa, Cryptosporidium parvum
MSTRASTF

SEQ ID NO: 2220010 - protein, 10 aa, Cryptosporidium parvum
MTAGTSAATM

SEQ ID NO: 2220011 - protein, 5 aa, Cryptosporidium parvum
MTDDA

SEQ ID NO: 2220012 - protein, 15 aa, Cryptosporidium parvum
MTEGKKLNDKYTQTS

SEQ ID NO: 2220013 - protein, 7 aa, Cryptosporidium parvum
MTEKANS

SEQ ID NO: 2220014 - protein, 12 aa, Cryptosporidium parvum
MTEKKRSIDTHT

SEQ ID NO: 2220015 - protein, 5 aa, Cryptosporidium parvum
MTETG

SEQ ID NO: 2220016 - protein, 7 aa, Cryptosporidium parvum
MTGSSNK

SEQ ID NO: 2220017 - protein, 13 aa, Cryptosporidium parvum
MTKDSESLTPSSD

SEQ ID NO: 2220018 - protein, 25 aa, Cryptosporidium parvum
MTNSNHEKNSPNGTNIQTKSKKKTY

SEQ ID NO: 2220019 - protein, 5 aa, Cryptosporidium parvum
MTPED

SEQ ID NO: 2220020 - protein, 17 aa, Cryptosporidium parvum
MTPPTVQQLSEEDRDPI

SEQ ID NO: 2220021 - protein, 5 aa, Cryptosporidium parvum
MTPSI

SEQ ID NO: 2220022 - protein, 11 aa, Cryptosporidium parvum
MTSNTKNKISK

SEQ ID NO: 2220023 - protein, 4 aa, Cryptosporidium parvum
MTSP

SEQ ID NO: 2220024 - protein, 14 aa, Cryptosporidium parvum
MTSQNKNSDNDTTK

SEQ ID NO: 2220025 - protein, 8 aa, Cryptosporidium parvum
MTTDSSDI

SEQ ID NO: 2220026 - protein, 5 aa, Cryptosporidium parvum
MTTSQ

SEQ ID NO: 2220027 - protein, 8 aa, Cryptosporidium parvum
MTYPSSSI

SEQ ID NO: 2220028 - protein, 11 aa, Cryptosporidium parvum
MYESSSRADPL

SEQ ID NO: 2220029 - protein, 7 aa, Cryptosporidium parvum
NAADKVN

SEQ ID NO: 2220030 - protein, 15 aa, Cryptosporidium parvum
NAAINKTTGESIKPL

SEQ ID NO: 2220031 - protein, 5 aa, Cryptosporidium parvum
NADAL

SEQ ID NO: 2220032 - protein, 8 aa, Cryptosporidium parvum
NADGNNQF

SEQ ID NO: 2220033 - protein, 6 aa, Cryptosporidium parvum
NADSEP

SEQ ID NO: 2220034 - protein, 6 aa, Cryptosporidium parvum
NADSRY

SEQ ID NO: 2220035 - protein, 9 aa, Cryptosporidium parvum
NAEAAANPI

SEQ ID NO: 2220036 - protein, 5 aa, Cryptosporidium parvum
NAEDR

SEQ ID NO: 2220037 - protein, 7 aa, Cryptosporidium parvum
NAEGYTS

SEQ ID NO: 2220038 - protein, 25 aa, Cryptosporidium parvum
NAEKTRINKEESKINELDSKQIKGK

SEQ ID NO: 2220039 - protein, 10 aa, Cryptosporidium parvum
NAELSSESNG

SEQ ID NO: 2220040 - protein, 8 aa, Cryptosporidium parvum
NAENDKET

SEQ ID NO: 2220041 - protein, 4 aa, Cryptosporidium parvum
NAET

SEQ ID NO: 2220042 - protein, 5 aa, Cryptosporidium parvum
NAETI

SEQ ID NO: 2220043 - protein, 14 aa, Cryptosporidium parvum
NAFESEEDSKKTGD

SEQ ID NO: 2220044 - protein, 6 aa, Cryptosporidium parvum
NAGETF

SEQ ID NO: 2220045 - protein, 5 aa, Cryptosporidium parvum
NAGVN

SEQ ID NO: 2220046 - protein, 12 aa, Cryptosporidium parvum
NAHNQDDHEQSS

SEQ ID NO: 2220047 - protein, 18 aa, Cryptosporidium parvum
NAISEKTKSDLEMSNSSS

SEQ ID NO: 2220048 - protein, 12 aa, Cryptosporidium parvum
NAKDFENDEKLA

SEQ ID NO: 2220049 - protein, 16 aa, Cryptosporidium parvum
NAKKYSSYSLNNRQNV

SEQ ID NO: 2220050 - protein, 8 aa, Cryptosporidium parvum
NAKPEENQ

SEQ ID NO: 2220051 - protein, 5 aa, Cryptosporidium parvum
NAKTT

SEQ ID NO: 2220052 - protein, 6 aa, Cryptosporidium parvum
NALNID

SEQ ID NO: 2220053 - protein, 6 aa, Cryptosporidium parvum
NALSEK

SEQ ID NO: 2220054 - protein, 17 aa, Cryptosporidium parvum
NAMNSNNSSAHSSPYQH

SEQ ID NO: 2220055 - protein, 9 aa, Cryptosporidium parvum
NANDEYKRL

SEQ ID NO: 2220056 - protein, 10 aa, Cryptosporidium parvum
NANDKISAES

SEQ ID NO: 2220057 - protein, 10 aa, Cryptosporidium parvum
NANDLKKKNS

SEQ ID NO: 2220058 - protein, 16 aa, Cryptosporidium parvum
NANDNKELNSDSSTSF

SEQ ID NO: 2220059 - protein, 5 aa, Cryptosporidium parvum
NANIT

SEQ ID NO: 2220060 - protein, 6 aa, Cryptosporidium parvum
NANKRR

SEQ ID NO: 2220061 - protein, 9 aa, Cryptosporidium parvum
NANKSDKDI

SEQ ID NO: 2220062 - protein, 14 aa, Cryptosporidium parvum
NANNNYYNSPSISN

SEQ ID NO: 2220063 - protein, 10 aa, Cryptosporidium parvum
NANNSNNISK

SEQ ID NO: 2220064 - protein, 11 aa, Cryptosporidium parvum
NANTDKLKIDG

SEQ ID NO: 2220065 - protein, 18 aa, Cryptosporidium parvum
NANTNSSSNVGYDQNNEE

SEQ ID NO: 2220066 - protein, 7 aa, Cryptosporidium parvum
NANVYEG

SEQ ID NO: 2220067 - protein, 12 aa, Cryptosporidium parvum
NAPCNSENSFEQ

SEQ ID NO: 2220068 - protein, 5 aa, Cryptosporidium parvum
NAPDK

SEQ ID NO: 2220069 - protein, 5 aa, Cryptosporidium parvum
NAPEK

SEQ ID NO: 2220070 - protein, 7 aa, Cryptosporidium parvum
NAPESIT

SEQ ID NO: 2220071 - protein, 8 aa, Cryptosporidium parvum
NAPGGGKT

SEQ ID NO: 2220072 - protein, 10 aa, Cryptosporidium parvum
NAPGWGGETP

SEQ ID NO: 2220073 - protein, 4 aa, Cryptosporidium parvum
NAPK

SEQ ID NO: 2220074 - protein, 5 aa, Cryptosporidium parvum
NAPQV

SEQ ID NO: 2220075 - protein, 7 aa, Cryptosporidium parvum
NAPYQSL

SEQ ID NO: 2220076 - protein, 9 aa, Cryptosporidium parvum
NAPYSSADY

SEQ ID NO: 2220077 - protein, 5 aa, Cryptosporidium parvum
NAQNR

SEQ ID NO: 2220078 - protein, 16 aa, Cryptosporidium parvum
NAQNSQGNKGNPDFRK

SEQ ID NO: 2220079 - protein, 28 aa, Cryptosporidium parvum
NARIGSTGKIDSKGSSGKEGIQITPSNI

SEQ ID NO: 2220080 - protein, 4 aa, Cryptosporidium parvum
NASN

SEQ ID NO: 2220081 - protein, 7 aa, Cryptosporidium parvum
NASNAKV

SEQ ID NO: 2220082 - protein, 8 aa, Cryptosporidium parvum
NASNPNEY

SEQ ID NO: 2220083 - protein, 9 aa, Cryptosporidium parvum
NASPNYSSN

SEQ ID NO: 2220084 - protein, 6 aa, Cryptosporidium parvum
NASSPL

SEQ ID NO: 2220085 - protein, 5 aa, Cryptosporidium parvum
NASTM

SEQ ID NO: 2220086 - protein, 11 aa, Cryptosporidium parvum
NASVKSGAESY

SEQ ID NO: 2220087 - protein, 5 aa, Cryptosporidium parvum
NASYD

SEQ ID NO: 2220088 - protein, 7 aa, Cryptosporidium parvum
NATESIK

SEQ ID NO: 2220089 - protein, 11 aa, Cryptosporidium parvum
NATQQGLKAST

SEQ ID NO: 2220090 - protein, 4 aa, Cryptosporidium parvum
NAWN

SEQ ID NO: 2220091 - protein, 6 aa, Cryptosporidium parvum
NAYEEG

SEQ ID NO: 2220092 - protein, 8 aa, Cryptosporidium parvum
NAYRERQG

SEQ ID NO: 2220093 - protein, 9 aa, Cryptosporidium parvum
NAYSGTGFS

SEQ ID NO: 2220094 - protein, 4 aa, Cryptosporidium parvum
NCAS

SEQ ID NO: 2220095 - protein, 9 aa, Cryptosporidium parvum
NCDDNSASC

SEQ ID NO: 2220096 - protein, 8 aa, Cryptosporidium parvum
NCDQRSTI

SEQ ID NO: 2220097 - protein, 4 aa, Cryptosporidium parvum
NCEC

SEQ ID NO: 2220098 - protein, 5 aa, Cryptosporidium parvum
NCEDE

SEQ ID NO: 2220099 - protein, 8 aa, Cryptosporidium parvum
NCEGGNPF

SEQ ID NO: 2220100 - protein, 7 aa, Cryptosporidium parvum
NCEKKAE

SEQ ID NO: 2220101 - protein, 18 aa, Cryptosporidium parvum
NCKQDSKFDPGKTKFGEY

SEQ ID NO: 2220102 - protein, 6 aa, Cryptosporidium parvum
NCNARS

SEQ ID NO: 2220103 - protein, 11 aa, Cryptosporidium parvum
NCNNDDSSQMA

SEQ ID NO: 2220104 - protein, 19 aa, Cryptosporidium parvum
NCNSGGKSSSQSEVSSENG

SEQ ID NO: 2220105 - protein, 15 aa, Cryptosporidium parvum
NCNSKTQSNSNFENE

SEQ ID NO: 2220106 - protein, 6 aa, Cryptosporidium parvum
NCPEEE

SEQ ID NO: 2220107 - protein, 6 aa, Cryptosporidium parvum
NCPKPS

SEQ ID NO: 2220108 - protein, 5 aa, Cryptosporidium parvum
NCPTE

SEQ ID NO: 2220109 - protein, 6 aa, Cryptosporidium parvum
NCSKST

SEQ ID NO: 2220110 - protein, 31 aa, Cryptosporidium parvum
NCSNKKDDDRITGIGKNDQTNKNADIKTERP

SEQ ID NO: 2220111 - protein, 9 aa, Cryptosporidium parvum
NCSNKKKDL

SEQ ID NO: 2220112 - protein, 51 aa, Cryptosporidium parvum
NCSQDEKSLERKQNQRLSLSSSSSSSSSSSSSSSSSSSSSSSSSSSTSSSV

SEQ ID NO: 2220113 - protein, 30 aa, Cryptosporidium parvum; identical to SEQ ID NO: 2116600

SEQ ID NO: 2220114 - protein, 6 aa, Cryptosporidium parvum
NDASDN

SEQ ID NO: 2220115 - protein, 12 aa, Cryptosporidium parvum
NDDNDNQVKSKS

SEQ ID NO: 2220116 - protein, 10 aa, Cryptosporidium parvum
NDDNESAKEL

SEQ ID NO: 2220117 - protein, 6 aa, Cryptosporidium parvum
NDDPRF

SEQ ID NO: 2220118 - protein, 5 aa, Cryptosporidium parvum
NDDSE

SEQ ID NO: 2220119 - protein, 11 aa, Cryptosporidium parvum
NDDSNNTDNQF

SEQ ID NO: 2220120 - protein, 18 aa, Cryptosporidium parvum
NDDSTVGGGKKANINNEI

SEQ ID NO: 2220121 - protein, 5 aa, Cryptosporidium parvum
NDDTS

SEQ ID NO: 2220122 - protein, 12 aa, Cryptosporidium parvum
NDEDYDQDEELS

SEQ ID NO: 2220123 - protein, 10 aa, Cryptosporidium parvum
NDEEENNDKV

SEQ ID NO: 2220124 - protein, 8 aa, Cryptosporidium parvum
NDEERREK

SEQ ID NO: 2220125 - protein, 15 aa, Cryptosporidium parvum
NDEISDSSSNSSIVS

SEQ ID NO: 2220126 - protein, 5 aa, Cryptosporidium parvum
NDELE

SEQ ID NO: 2220127 - protein, 8 aa, Cryptosporidium parvum
NDEMDEGN

SEQ ID NO: 2220128 - protein, 7 aa, Cryptosporidium parvum
NDENHPK

SEQ ID NO: 2220129 - protein, 16 aa, Cryptosporidium parvum
NDEPIPGSQAGQIADT

SEQ ID NO: 2220130 - protein, 5 aa, Cryptosporidium parvum
NDEQG

SEQ ID NO: 2220131 - protein, 6 aa, Cryptosporidium parvum
NDEQNP

SEQ ID NO: 2220132 - protein, 13 aa, Cryptosporidium parvum
NDESGKQNNFGEE

SEQ ID NO: 2220133 - protein, 16 aa, Cryptosporidium parvum
NDETETELEDSNNIEN

SEQ ID NO: 2220134 - protein, 15 aa, Cryptosporidium parvum
NDFGRAKKHSSQVTK

SEQ ID NO: 2220135 - protein, 6 aa, Cryptosporidium parvum
NDFNSE

SEQ ID NO: 2220136 - protein, 18 aa, Cryptosporidium parvum
NDGEEIKAYNSGLGLGER

SEQ ID NO: 2220137 - protein, 16 aa, Cryptosporidium parvum
NDGFSPRNKSCSSKVT

SEQ ID NO: 2220138 - protein, 7 aa, Cryptosporidium parvum
NDGQSIK

SEQ ID NO: 2220139 - protein, 9 aa, Cryptosporidium parvum
NDGSKKEQQ

SEQ ID NO: 2220140 - protein, 11 aa, Cryptosporidium parvum
NDGTSNITPSP

SEQ ID NO: 2220141 - protein, 6 aa, Cryptosporidium parvum
NDGVQN

SEQ ID NO: 2220142 - protein, 10 aa, Cryptosporidium parvum
NDHHSSTSFE

SEQ ID NO: 2220143 - protein, 20 aa, Cryptosporidium parvum
NDIEDEDEKRELAAEAAKAM

SEQ ID NO: 2220144 - protein, 6 aa, Cryptosporidium parvum
NDIESN

SEQ ID NO: 2220145 - protein, 20 aa, Cryptosporidium parvum
NDIKEEQLSRQDKSSDNNDF

SEQ ID NO: 2220146 - protein, 7 aa, Cryptosporidium parvum
NDIKNDF

SEQ ID NO: 2220147 - protein, 7 aa, Cryptosporidium parvum
NDIKSKS

SEQ ID NO: 2220148 - protein, 4 aa, Cryptosporidium parvum
NDIN

SEQ ID NO: 2220149 - protein, 12 aa, Cryptosporidium parvum
NDINSNKESKIQ

SEQ ID NO: 2220150 - protein, 21 aa, Cryptosporidium parvum
NDIRNSKASGNSNNHISSQSI

SEQ ID NO: 2220151 - protein, 7 aa, Cryptosporidium parvum
NDKDYTK

SEQ ID NO: 2220152 - protein, 8 aa, Cryptosporidium parvum
NDKETDLI

SEQ ID NO: 2220153 - protein, 6 aa, Cryptosporidium parvum
NDKIQR

SEQ ID NO: 2220154 - protein, 4 aa, Cryptosporidium parvum
NDKK

SEQ ID NO: 2220155 - protein, 7 aa, Cryptosporidium parvum
NDKKIEE

SEQ ID NO: 2220156 - protein, 20 aa, Cryptosporidium parvum
NDKKSIGKEKDEKDHPESRV

SEQ ID NO: 2220157 - protein, 19 aa, Cryptosporidium parvum
NDKNEIKYDESSLTEEETK

SEQ ID NO: 2220158 - protein, 8 aa, Cryptosporidium parvum
NDKNPNKE

SEQ ID NO: 2220159 - protein, 7 aa, Cryptosporidium parvum
NDKNVSE

SEQ ID NO: 2220160 - protein, 5 aa, Cryptosporidium parvum
NDKPT

SEQ ID NO: 2220161 - protein, 5 aa, Cryptosporidium parvum
NDKPY

SEQ ID NO: 2220162 - protein, 9 aa, Cryptosporidium parvum
NDKQEEEED

SEQ ID NO: 2220163 - protein, 6 aa, Cryptosporidium parvum
NDKRSL

SEQ ID NO: 2220164 - protein, 12 aa, Cryptosporidium parvum
NDKSFRSTSESN

SEQ ID NO: 2220165 - protein, 9 aa, Cryptosporidium parvum
NDKSGSIST

SEQ ID NO: 2220166 - protein, 6 aa, Cryptosporidium parvum
NDKSPN

SEQ ID NO: 2220167 - protein, 9 aa, Cryptosporidium parvum
NDKSSFKDA

SEQ ID NO: 2220168 - protein, 10 aa, Cryptosporidium parvum
NDKSSNSRLY

SEQ ID NO: 2220169 - protein, 6 aa, Cryptosporidium parvum
NDKTNH

SEQ ID NO: 2220170 - protein, 11 aa, Cryptosporidium parvum
NDKYETNKLPS

SEQ ID NO: 2220171 - protein, 6 aa, Cryptosporidium parvum
NDKYQL

SEQ ID NO: 2220172 - protein, 17 aa, Cryptosporidium parvum
NDKYSNNNEDKDEMNNK

SEQ ID NO: 2220173 - protein, 7 aa, Cryptosporidium parvum
NDLRQRQ

SEQ ID NO: 2220174 - protein, 8 aa, Cryptosporidium parvum
NDLSKSIP

SEQ ID NO: 2220175 - protein, 11 aa, Cryptosporidium parvum
NDNAGSSIPDD

SEQ ID NO: 2220176 - protein, 7 aa, Cryptosporidium parvum
NDNDHKN

SEQ ID NO: 2220177 - protein, 25 aa, Cryptosporidium parvum
NDNDNNINNNNSNNSSNKSIRRKEL

SEQ ID NO: 2220178 - protein, 7 aa, Cryptosporidium parvum
NDNEENP

SEQ ID NO: 2220179 - protein, 6 aa, Cryptosporidium parvum
NDNGDK

SEQ ID NO: 2220180 - protein, 18 aa, Cryptosporidium parvum
NDNGGGTVTGAGDTNESL

SEQ ID NO: 2220181 - protein, 10 aa, Cryptosporidium parvum
NDNKNYQGGI

SEQ ID NO: 2220182 - protein, 20 aa, Cryptosporidium parvum
NDNKRHSGSHHKKRHAPKNT

SEQ ID NO: 2220183 - protein, 13 aa, Cryptosporidium parvum
NDNKSNNISDSNG

SEQ ID NO: 2220184 - protein, 8 aa, Cryptosporidium parvum
NDNMNDSS

SEQ ID NO: 2220185 - protein, 5 aa, Cryptosporidium parvum
NDNNK

SEQ ID NO: 2220186 - protein, 11 aa, Cryptosporidium parvum
NDNPKLNSERS

SEQ ID NO: 2220187 - protein, 6 aa, Cryptosporidium parvum
NDNPNN

SEQ ID NO: 2220188 - protein, 5 aa, Cryptosporidium parvum
NDNPW

SEQ ID NO: 2220189 - protein, 6 aa, Cryptosporidium parvum
NDNQAR

SEQ ID NO: 2220190 - protein, 9 aa, Cryptosporidium parvum
NDNQTNTEL

SEQ ID NO: 2220191 - protein, 5 aa, Cryptosporidium parvum
NDNSF

SEQ ID NO: 2220192 - protein, 11 aa, Cryptosporidium parvum
NDNSHNVASER

SEQ ID NO: 2220193 - protein, 23 aa, Cryptosporidium parvum
NDNSISNSGSSSSSSSSSSSIPN

SEQ ID NO: 2220194 - protein, 7 aa, Cryptosporidium parvum
NDNVQSS

SEQ ID NO: 2220195 - protein, 4 aa, Cryptosporidium parvum
NDNY

SEQ ID NO: 2220196 - protein, 33 aa, Cryptosporidium parvum
NDNYQSYNAPEMNSNGSNGGFGGVNNGGSIPGN

SEQ ID NO: 2220197 - protein, 18 aa, Cryptosporidium parvum
NDPDQNINSNLNTGSNSI

SEQ ID NO: 2220198 - protein, 6 aa, Cryptosporidium parvum
NDPEKQ

SEQ ID NO: 2220199 - protein, 8 aa, Cryptosporidium parvum
NDPFSSTI

SEQ ID NO: 2220200 - protein, 7 aa, Cryptosporidium parvum
NDPRKWS

SEQ ID NO: 2220201 - protein, 5 aa, Cryptosporidium parvum
NDPRR

SEQ ID NO: 2220202 - protein, 7 aa, Cryptosporidium parvum
NDPRYKG

SEQ ID NO: 2220203 - protein, 6 aa, Cryptosporidium parvum
NDPSRN

SEQ ID NO: 2220204 - protein, 6 aa, Cryptosporidium parvum
NDPTGT

SEQ ID NO: 2220205 - protein, 21 aa, Cryptosporidium parvum
NDQDLSLQNDDGSVNVDFDSR

SEQ ID NO: 2220206 - protein, 8 aa, Cryptosporidium parvum
NDQGEAGV

SEQ ID NO: 2220207 - protein, 5 aa, Cryptosporidium parvum
NDQNF

SEQ ID NO: 2220208 - protein, 11 aa, Cryptosporidium parvum
NDQNSGTRNNH

SEQ ID NO: 2220209 - protein, 7 aa, Cryptosporidium parvum
NDQNSYD

SEQ ID NO: 2220210 - protein, 9 aa, Cryptosporidium parvum
NDQPNERNS

SEQ ID NO: 2220211 - protein, 9 aa, Cryptosporidium parvum
NDQSESSDI

SEQ ID NO: 2220212 - protein, 5 aa, Cryptosporidium parvum
NDQSL

SEQ ID NO: 2220213 - protein, 7 aa, Cryptosporidium parvum
NDQTEFQ

SEQ ID NO: 2220214 - protein, 20 aa, Cryptosporidium parvum
NDRASMSNPFTGSNIGSSGG

SEQ ID NO: 2220215 - protein, 4 aa, Cryptosporidium parvum
NDRI

SEQ ID NO: 2220216 - protein, 6 aa, Cryptosporidium parvum
NDRTHT

SEQ ID NO: 2220217 - protein, 8 aa, Cryptosporidium parvum
NDSDKSDR

SEQ ID NO: 2220218 - protein, 7 aa, Cryptosporidium parvum
NDSDPIS

SEQ ID NO: 2220219 - protein, 14 aa, Cryptosporidium parvum
NDSGENNNKNDPKM

SEQ ID NO: 2220220 - protein, 7 aa, Cryptosporidium parvum
NDSITKN

SEQ ID NO: 2220221 - protein, 5 aa, Cryptosporidium parvum
NDSIV

SEQ ID NO: 2220222 - protein, 22 aa, Cryptosporidium parvum
NDSKKNKAVDKKNVDKLTSKLE

SEQ ID NO: 2220223 - protein, 7 aa, Cryptosporidium parvum
NDSKMGL

SEQ ID NO: 2220224 - protein, 6 aa, Cryptosporidium parvum
NDSKTI

SEQ ID NO: 2220225 - protein, 10 aa, Cryptosporidium parvum
NDSNNEDSFE

SEQ ID NO: 2220226 - protein, 8 aa, Cryptosporidium parvum
NDSPHSKS

SEQ ID NO: 2220227 - protein, 5 aa, Cryptosporidium parvum
NDSRL

SEQ ID NO: 2220228 - protein, 8 aa, Cryptosporidium parvum
NDSSNNPN

SEQ ID NO: 2220229 - protein, 10 aa, Cryptosporidium parvum
NDSSSKGESS

SEQ ID NO: 2220230 - protein, 9 aa, Cryptosporidium parvum
NDSVGGKTI

SEQ ID NO: 2220231 - protein, 11 aa, Cryptosporidium parvum
NDSYDKVPEKK

SEQ ID NO: 2220232 - protein, 5 aa, Cryptosporidium parvum
NDTDH

SEQ ID NO: 2220233 - protein, 4 aa, Cryptosporidium parvum
NDTE

SEQ ID NO: 2220234 - protein, 5 aa, Cryptosporidium parvum
NDTFG

SEQ ID NO: 2220235 - protein, 11 aa, Cryptosporidium parvum
NDTIDSKKQTF

SEQ ID NO: 2220236 - protein, 4 aa, Cryptosporidium parvum
NDTK

SEQ ID NO: 2220237 - protein, 31 aa, Cryptosporidium parvum
NDTKEISGNVENYKPISELENDKKGKSDEGI

SEQ ID NO: 2220238 - protein, 4 aa, Cryptosporidium parvum
NDTN

SEQ ID NO: 2220239 - protein, 4 aa, Cryptosporidium parvum
NDTQ

SEQ ID NO: 2220240 - protein, 6 aa, Cryptosporidium parvum
NDTSNI

SEQ ID NO: 2220241 - protein, 9 aa, Cryptosporidium parvum
NDTSSSNYF

SEQ ID NO: 2220242 - protein, 9 aa, Cryptosporidium parvum
NDTTDTYDY

SEQ ID NO: 2220243 - protein, 9 aa, Cryptosporidium parvum
NDVERKAND

SEQ ID NO: 2220244 - protein, 4 aa, Cryptosporidium parvum
NDYF

SEQ ID NO: 2220245 - protein, 6 aa, Cryptosporidium parvum
NDYHRS

SEQ ID NO: 2220246 - protein, 14 aa, Cryptosporidium parvum
NDYPHKKNNDVELN

SEQ ID NO: 2220247 - protein, 8 aa, Cryptosporidium parvum
NDYYSNNN

SEQ ID NO: 2220248 - protein, 6 aa, Cryptosporidium parvum
NEADNK

SEQ ID NO: 2220249 - protein, 7 aa, Cryptosporidium parvum
NEAENTL

SEQ ID NO: 2220250 - protein, 10 aa, Cryptosporidium parvum
NEAGPKSQSI

SEQ ID NO: 2220251 - protein, 7 aa, Cryptosporidium parvum
NEAKNIK

SEQ ID NO: 2220252 - protein, 6 aa, Cryptosporidium parvum
NEALQT

SEQ ID NO: 2220253 - protein, 9 aa, Cryptosporidium parvum
NEARSASGE

SEQ ID NO: 2220254 - protein, 9 aa, Cryptosporidium parvum
NEATNSTGT

SEQ ID NO: 2220255 - protein, 12 aa, Cryptosporidium parvum
NECEKKKSTRNE

SEQ ID NO: 2220256 - protein, 4 aa, Cryptosporidium parvum
NECN

SEQ ID NO: 2220257 - protein, 10 aa, Cryptosporidium parvum
NEDDWNRATR

SEQ ID NO: 2220258 - protein, 4 aa, Cryptosporidium parvum
NEDE

SEQ ID NO: 2220259 - protein, 7 aa, Cryptosporidium parvum
NEDEQSI

SEQ ID NO: 2220260 - protein, 6 aa, Cryptosporidium parvum
NEDEYS

SEQ ID NO: 2220261 - protein, 12 aa, Cryptosporidium parvum
NEDFPKRKQRKF

SEQ ID NO: 2220262 - protein, 10 aa, Cryptosporidium parvum
NEDGKTITQT

SEQ ID NO: 2220263 - protein, 19 aa, Cryptosporidium parvum
NEDIESSNNQLNNSNEVSN

SEQ ID NO: 2220264 - protein, 16 aa, Cryptosporidium parvum
NEDIHNQDQRYNEQES

SEQ ID NO: 2220265 - protein, 4 aa, Cryptosporidium parvum
NEDK

SEQ ID NO: 2220266 - protein, 8 aa, Cryptosporidium parvum
NEDNNSEL

SEQ ID NO: 2220267 - protein, 10 aa, Cryptosporidium parvum
NEDNSFSKPK

SEQ ID NO: 2220268 - protein, 6 aa, Cryptosporidium parvum
NEDPNI

SEQ ID NO: 2220269 - protein, 8 aa, Cryptosporidium parvum
NEDSHGSG

SEQ ID NO: 2220270 - protein, 12 aa, Cryptosporidium parvum
NEDTKDKKYNVP

SEQ ID NO: 2220271 - protein, 10 aa, Cryptosporidium parvum
NEEDSNDEIK

SEQ ID NO: 2220272 - protein, 13 aa, Cryptosporidium parvum
NEEEDDDDYYQGK

SEQ ID NO: 2220273 - protein, 7 aa, Cryptosporidium parvum
NEEEHVD

SEQ ID NO: 2220274 - protein, 8 aa, Cryptosporidium parvum
NEEGRPHG

SEQ ID NO: 2220275 - protein, 4 aa, Cryptosporidium parvum
NEEI

SEQ ID NO: 2220276 - protein, 5 aa, Cryptosporidium parvum
NEEIN

SEQ ID NO: 2220277 - protein, 24 aa, Cryptosporidium parvum
NEEKEKEVKERVKEEDEEEEETHS

SEQ ID NO: 2220278 - protein, 12 aa, Cryptosporidium parvum
NEEKTRNSESTR

SEQ ID NO: 2220279 - protein, 4 aa, Cryptosporidium parvum
NEEN

SEQ ID NO: 2220280 - protein, 5 aa, Cryptosporidium parvum
NEENN

SEQ ID NO: 2220281 - protein, 8 aa, Cryptosporidium parvum
NEENSPYF

SEQ ID NO: 2220282 - protein, 4 aa, Cryptosporidium parvum
NEES

SEQ ID NO: 2220283 - protein, 7 aa, Cryptosporidium parvum
NEESGVN

SEQ ID NO: 2220284 - protein, 7 aa, Cryptosporidium parvum
NEESLVE

SEQ ID NO: 2220285 - protein, 6 aa, Cryptosporidium parvum
NEESSI

SEQ ID NO: 2220286 - protein, 8 aa, Cryptosporidium parvum
NEESSNSF

SEQ ID NO: 2220287 - protein, 5 aa, Cryptosporidium parvum
NEESW

SEQ ID NO: 2220288 - protein, 11 aa, Cryptosporidium parvum
NEEVESSDKIA

SEQ ID NO: 2220289 - protein, 4 aa, Cryptosporidium parvum
NEFK

SEQ ID NO: 2220290 - protein, 11 aa, Cryptosporidium parvum
NEFKGEESSQK

SEQ ID NO: 2220291 - protein, 14 aa, Cryptosporidium parvum
NEFNPEKSNQTELS

SEQ ID NO: 2220292 - protein, 8 aa, Cryptosporidium parvum
NEFRGKKE

SEQ ID NO: 2220293 - protein, 6 aa, Cryptosporidium parvum
NEFRSS

SEQ ID NO: 2220294 - protein, 7 aa, Cryptosporidium parvum
NEFTSKE

SEQ ID NO: 2220295 - protein, 6 aa, Cryptosporidium parvum
NEGASK

SEQ ID NO: 2220296 - protein, 33 aa, Cryptosporidium parvum
NEGDLESNTNETKEDSSIVDSQKCGSYKSSSLN

SEQ ID NO: 2220297 - protein, 7 aa, Cryptosporidium parvum
NEGNYEK

SEQ ID NO: 2220298 - protein, 6 aa, Cryptosporidium parvum
NEGPIN

SEQ ID NO: 2220299 - protein, 4 aa, Cryptosporidium parvum
NEGR

SEQ ID NO: 2220300 - protein, 5 aa, Cryptosporidium parvum
NEGTN

SEQ ID NO: 2220301 - protein, 7 aa, Cryptosporidium parvum
NEHSSEN

SEQ ID NO: 2220302 - protein, 11 aa, Cryptosporidium parvum
NEIEDAKNKAS

SEQ ID NO: 2220303 - protein, 13 aa, Cryptosporidium parvum
NEINKGGRKKRIE

SEQ ID NO: 2220304 - protein, 13 aa, Cryptosporidium parvum
NEIPGNSPINKTK

SEQ ID NO: 2220305 - protein, 6 aa, Cryptosporidium parvum
NEITPS

SEQ ID NO: 2220306 - protein, 6 aa, Cryptosporidium parvum
NEITSA

SEQ ID NO: 2220307 - protein, 11 aa, Cryptosporidium parvum
NEKADKSNKYL

SEQ ID NO: 2220308 - protein, 11 aa, Cryptosporidium parvum
NEKDEKKSQSI

SEQ ID NO: 2220309 - protein, 9 aa, Cryptosporidium parvum
NEKDNENVS

SEQ ID NO: 2220310 - protein, 5 aa, Cryptosporidium parvum
NEKEY

SEQ ID NO: 2220311 - protein, 8 aa, Cryptosporidium parvum
NEKGASFS

SEQ ID NO: 2220312 - protein, 15 aa, Cryptosporidium parvum
NEKGDIVGSSNATQN

SEQ ID NO: 2220313 - protein, 18 aa, Cryptosporidium parvum
NEKGLKDTERLKNASSSN

SEQ ID NO: 2220314 - protein, 17 aa, Cryptosporidium parvum
NEKKAEDIKVEENNEQY

SEQ ID NO: 2220315 - protein, 13 aa, Cryptosporidium parvum
NEKNDNSSDSSSI

SEQ ID NO: 2220316 - protein, 10 aa, Cryptosporidium parvum
NEKQRFSTHR

SEQ ID NO: 2220317 - protein, 26 aa, Cryptosporidium parvum
NEKSERGVVEPTSKESNENKHEKNVE

SEQ ID NO: 2220318 - protein, 10 aa, Cryptosporidium parvum
NEKSHTENNK

SEQ ID NO: 2220319 - protein, 10 aa, Cryptosporidium parvum
NEKSNSDYNS

SEQ ID NO: 2220320 - protein, 13 aa, Cryptosporidium parvum
NEKYGCEKKNSDQ

SEQ ID NO: 2220321 - protein, 4 aa, Cryptosporidium parvum
NELD

SEQ ID NO: 2220322 - protein, 23 aa, Cryptosporidium parvum
NELDSSRTPVNETINNPDDYEEW

SEQ ID NO: 2220323 - protein, 6 aa, Cryptosporidium parvum
NELEDL

SEQ ID NO: 2220324 - protein, 7 aa, Cryptosporidium parvum
NELEQSG

SEQ ID NO: 2220325 - protein, 8 aa, Cryptosporidium parvum
NELKPGDL

SEQ ID NO: 2220326 - protein, 15 aa, Cryptosporidium parvum
NELNDNNNTNTNNKI

SEQ ID NO: 2220327 - protein, 7 aa, Cryptosporidium parvum
NELNRDN

SEQ ID NO: 2220328 - protein, 11 aa, Cryptosporidium parvum
NELNSDSNQKV

SEQ ID NO: 2220329 - protein, 4 aa, Cryptosporidium parvum
NELP

SEQ ID NO: 2220330 - protein, 10 aa, Cryptosporidium parvum
NELRDTSEKL

SEQ ID NO: 2220331 - protein, 10 aa, Cryptosporidium parvum
NELSSSQKFN

SEQ ID NO: 2220332 - protein, 4 aa, Cryptosporidium parvum
NEMD

SEQ ID NO: 2220333 - protein, 20 aa, Cryptosporidium parvum
NEMGTPHNKRVNNKNPSLES

SEQ ID NO: 2220334 - protein, 7 aa, Cryptosporidium parvum
NEMNASR

SEQ ID NO: 2220335 - protein, 8 aa, Cryptosporidium parvum
NEMSDGKV

SEQ ID NO: 2220336 - protein, 8 aa, Cryptosporidium parvum
NENASSHI

SEQ ID NO: 2220337 - protein, 10 aa, Cryptosporidium parvum
NENATEKEIE

SEQ ID NO: 2220338 - protein, 8 aa, Cryptosporidium parvum
NENDHKGS

SEQ ID NO: 2220339 - protein, 6 aa, Cryptosporidium parvum
NENESS

SEQ ID NO: 2220340 - protein, 13 aa, Cryptosporidium parvum
NENIQDDEDQQKM

SEQ ID NO: 2220341 - protein, 8 aa, Cryptosporidium parvum
NENKSPND

SEQ ID NO: 2220342 - protein, 5 aa, Cryptosporidium parvum
NENLS

SEQ ID NO: 2220343 - protein, 5 aa, Cryptosporidium parvum
NENNI

SEQ ID NO: 2220344 - protein, 5 aa, Cryptosporidium parvum
NENNL

SEQ ID NO: 2220345 - protein, 11 aa, Cryptosporidium parvum
NENNLEKKTNL

SEQ ID NO: 2220346 - protein, 11 aa, Cryptosporidium parvum
NENNNDDNNID

SEQ ID NO: 2220347 - protein, 9 aa, Cryptosporidium parvum
NENNNSSRR

SEQ ID NO: 2220348 - protein, 4 aa, Cryptosporidium parvum
NENP

SEQ ID NO: 2220349 - protein, 8 aa, Cryptosporidium parvum
NENPINSA

SEQ ID NO: 2220350 - protein, 10 aa, Cryptosporidium parvum
NENPSKPVIP

SEQ ID NO: 2220351 - protein, 15 aa, Cryptosporidium parvum
NENPTICTMKNSEGF

SEQ ID NO: 2220352 - protein, 12 aa, Cryptosporidium parvum
NENSKFENNSKN

SEQ ID NO: 2220353 - protein, 8 aa, Cryptosporidium parvum
NENSNNNI

SEQ ID NO: 2220354 - protein, 9 aa, Cryptosporidium parvum
NENSPRSRE

SEQ ID NO: 2220355 - protein, 11 aa, Cryptosporidium parvum
NENTDDSNNMD

SEQ ID NO: 2220356 - protein, 9 aa, Cryptosporidium parvum
NENTENNHL

SEQ ID NO: 2220357 - protein, 8 aa, Cryptosporidium parvum
NENVQDSD

SEQ ID NO: 2220358 - protein, 23 aa, Cryptosporidium parvum
NEPKTGLNNYSNTKTNVNNKDNL

SEQ ID NO: 2220359 - protein, 4 aa, Cryptosporidium parvum
NEPL

SEQ ID NO: 2220360 - protein, 6 aa, Cryptosporidium parvum
NEPRQN

SEQ ID NO: 2220361 - protein, 5 aa, Cryptosporidium parvum
NEPSQ

SEQ ID NO: 2220362 - protein, 7 aa, Cryptosporidium parvum
NEQDARK

SEQ ID NO: 2220363 - protein, 5 aa, Cryptosporidium parvum
NEQDQ

SEQ ID NO: 2220364 - protein, 8 aa, Cryptosporidium parvum
NEQENTAS

SEQ ID NO: 2220365 - protein, 14 aa, Cryptosporidium parvum
NEQETNELDGKEGT

SEQ ID NO: 2220366 - protein, 8 aa, Cryptosporidium parvum
NEQGETIQ

SEQ ID NO: 2220367 - protein, 20 aa, Cryptosporidium parvum
NEQLNDQGIANNNSSRDFSE

SEQ ID NO: 2220368 - protein, 4 aa, Cryptosporidium parvum
NEQS

SEQ ID NO: 2220369 - protein, 6 aa, Cryptosporidium parvum
NEQSTS

SEQ ID NO: 2220370 - protein, 6 aa, Cryptosporidium parvum
NEQYSS

SEQ ID NO: 2220371 - protein, 20 aa, Cryptosporidium parvum
NERELEDEDDDDDGDEEESN

SEQ ID NO: 2220372 - protein, 14 aa, Cryptosporidium parvum
NERGTREKLSKMKN

SEQ ID NO: 2220373 - protein, 6 aa, Cryptosporidium parvum
NERKNQ

SEQ ID NO: 2220374 - protein, 5 aa, Cryptosporidium parvum
NERMK

SEQ ID NO: 2220375 - protein, 11 aa, Cryptosporidium parvum
NERNNCTDTYS

SEQ ID NO: 2220376 - protein, 10 aa, Cryptosporidium parvum
NERRPYHGND

SEQ ID NO: 2220377 - protein, 11 aa, Cryptosporidium parvum
NERSARGSERI

SEQ ID NO: 2220378 - protein, 11 aa, Cryptosporidium parvum
NERSGTPNSKE

SEQ ID NO: 2220379 - protein, 14 aa, Cryptosporidium parvum
NERSTAQNTRYGKN

SEQ ID NO: 2220380 - protein, 6 aa, Cryptosporidium parvum
NESANS

SEQ ID NO: 2220381 - protein, 7 aa, Cryptosporidium parvum
NESEENV

SEQ ID NO: 2220382 - protein, 9 aa, Cryptosporidium parvum
NESEGGIGL

SEQ ID NO: 2220383 - protein, 5 aa, Cryptosporidium parvum
NESGQ

SEQ ID NO: 2220384 - protein, 16 aa, Cryptosporidium parvum
NESKNTNTNVSSSTDK

SEQ ID NO: 2220385 - protein, 5 aa, Cryptosporidium parvum
NESKR

SEQ ID NO: 2220386 - protein, 4 aa, Cryptosporidium parvum
NESL

SEQ ID NO: 2220387 - protein, 7 aa, Cryptosporidium parvum
NESNDQL

SEQ ID NO: 2220388 - protein, 7 aa, Cryptosporidium parvum
NESNENH

SEQ ID NO: 2220389 - protein, 6 aa, Cryptosporidium parvum
NESNSL

SEQ ID NO: 2220390 - protein, 14 aa, Cryptosporidium parvum
NESNSWKTRGNMSE

SEQ ID NO: 2220391 - protein, 22 aa, Cryptosporidium parvum
NESPGTGAKESLEEELSKTSKL

SEQ ID NO: 2220392 - protein, 91 aa, Cryptosporidium parvum
NESPSEINKSTENNENFENSIKSNNLNDFDDESDEEYYSTQSHTNSSNVINTNTSNDTNIYNNSSNVNKNNSTHEHDFDNKNNRKINQTTI

SEQ ID NO: 2220393 - protein, 4 aa, Cryptosporidium parvum
NESR

SEQ ID NO: 2220394 - protein, 7 aa, Cryptosporidium parvum
NESSELA

SEQ ID NO: 2220395 - protein, 13 aa, Cryptosporidium parvum
NESSSKLDGNKTF

SEQ ID NO: 2220396 - protein, 11 aa, Cryptosporidium parvum
NETETSTNLSS

SEQ ID NO: 2220397 - protein, 4 aa, Cryptosporidium parvum
NETG

SEQ ID NO: 2220398 - protein, 5 aa, Cryptosporidium parvum
NETGD

SEQ ID NO: 2220399 - protein, 7 aa, Cryptosporidium parvum
NETGKNI

SEQ ID NO: 2220400 - protein, 6 aa, Cryptosporidium parvum
NETKFQ

SEQ ID NO: 2220401 - protein, 8 aa, Cryptosporidium parvum
NETKIKGS

SEQ ID NO: 2220402 - protein, 9 aa, Cryptosporidium parvum
NETKTNSHA

SEQ ID NO: 2220403 - protein, 4 aa, Cryptosporidium parvum
NETL

SEQ ID NO: 2220404 - protein, 7 aa, Cryptosporidium parvum
NETNIPD

SEQ ID NO: 2220405 - protein, 6 aa, Cryptosporidium parvum
NETNPH

SEQ ID NO: 2220406 - protein, 9 aa, Cryptosporidium parvum
NETNSRKTV

SEQ ID NO: 2220407 - protein, 37 aa, Cryptosporidium parvum
NETPNEGSSSSGNKNSEGSSRGGGGGGGGGRGKKKPV

SEQ ID NO: 2220408 - protein, 36 aa, Cryptosporidium parvum
NETPNEGSSSSGNSNKKCSSRGGGRGGGGSGGKKPV

SEQ ID NO: 2220409 - protein, 4 aa, Cryptosporidium parvum
NETQ

SEQ ID NO: 2220410 - protein, 13 aa, Cryptosporidium parvum
NETSDFTYDGENS

SEQ ID NO: 2220411 - protein, 8 aa, Cryptosporidium parvum
NETSENNE

SEQ ID NO: 2220412 - protein, 5 aa, Cryptosporidium parvum
NETSR

SEQ ID NO: 2220413 - protein, 4 aa, Cryptosporidium parvum
NEVD

SEQ ID NO: 2220414 - protein, 7 aa, Cryptosporidium parvum
NEVGNTH

SEQ ID NO: 2220415 - protein, 4 aa, Cryptosporidium parvum
NEYL

SEQ ID NO: 2220416 - protein, 4 aa, Cryptosporidium parvum
NEYN

SEQ ID NO: 2220417 - protein, 22 aa, Cryptosporidium parvum
NEYNDTLNSKYNKENIASRANR

SEQ ID NO: 2220418 - protein, 6 aa, Cryptosporidium parvum
NEYNEV

SEQ ID NO: 2220419 - protein, 8 aa, Cryptosporidium parvum
NEYPNNNK

SEQ ID NO: 2220420 - protein, 17 aa, Cryptosporidium parvum
NEYQNSESISNEGLEGI

SEQ ID NO: 2220421 - protein, 7 aa, Cryptosporidium parvum
NEYSSNL

SEQ ID NO: 2220422 - protein, 5 aa, Cryptosporidium parvum
NEYTQ

SEQ ID NO: 2220423 - protein, 8 aa, Cryptosporidium parvum
NEYTSEEI

SEQ ID NO: 2220424 - protein, 4 aa, Cryptosporidium parvum
NEYY

SEQ ID NO: 2220425 - protein, 11 aa, Cryptosporidium parvum
NFDEKNDEISE

SEQ ID NO: 2220426 - protein, 4 aa, Cryptosporidium parvum
NFEG

SEQ ID NO: 2220427 - protein, 11 aa, Cryptosporidium parvum
NFESSSDFNNI

SEQ ID NO: 2220428 - protein, 5 aa, Cryptosporidium parvum
NFGGG

SEQ ID NO: 2220429 - protein, 6 aa, Cryptosporidium parvum
NFGQNT

SEQ ID NO: 2220430 - protein, 4 aa, Cryptosporidium parvum
NFGS

SEQ ID NO: 2220431 - protein, 11 aa, Cryptosporidium parvum
NFGSSSSKLDT

SEQ ID NO: 2220432 - protein, 10 aa, Cryptosporidium parvum
NFNGNNKEKK

SEQ ID NO: 2220433 - protein, 12 aa, Cryptosporidium parvum
NFNGQPKDLDSQ

SEQ ID NO: 2220434 - protein, 4 aa, Cryptosporidium parvum
NFNS

SEQ ID NO: 2220435 - protein, 11 aa, Cryptosporidium parvum
NFNSDSSYSDS

SEQ ID NO: 2220436 - protein, 8 aa, Cryptosporidium parvum
NFNSKKRL

SEQ ID NO: 2220437 - protein, 5 aa, Cryptosporidium parvum
NFNSR

SEQ ID NO: 2220438 - protein, 16 aa, Cryptosporidium parvum
NFNTGTNNKKRKDDDM

SEQ ID NO: 2220439 - protein, 5 aa, Cryptosporidium parvum
NFPDE

SEQ ID NO: 2220440 - protein, 13 aa, Cryptosporidium parvum
NFPPQASTDKPNL

SEQ ID NO: 2220441 - protein, 5 aa, Cryptosporidium parvum
NFPQV

SEQ ID NO: 2220442 - protein, 5 aa, Cryptosporidium parvum
NFQDN

SEQ ID NO: 2220443 - protein, 7 aa, Cryptosporidium parvum
NFQDQKV

SEQ ID NO: 2220444 - protein, 6 aa, Cryptosporidium parvum
NFQKKQ

SEQ ID NO: 2220445 - protein, 5 aa, Cryptosporidium parvum
NFQNK

SEQ ID NO: 2220446 - protein, 8 aa, Cryptosporidium parvum
NFQPSSSN

SEQ ID NO: 2220447 - protein, 19 aa, Cryptosporidium parvum
NFSESNKFKTKNDKRRREI

SEQ ID NO: 2220448 - protein, 5 aa, Cryptosporidium parvum
NFSKA

SEQ ID NO: 2220449 - protein, 13 aa, Cryptosporidium parvum
NFSNRNNNNNLPD

SEQ ID NO: 2220450 - protein, 17 aa, Cryptosporidium parvum
NFSTPARAKADTFSRNA

SEQ ID NO: 2220451 - protein, 4 aa, Cryptosporidium parvum
NFTE

SEQ ID NO: 2220452 - protein, 6 aa, Cryptosporidium parvum
NGADYN

SEQ ID NO: 2220453 - protein, 28 aa, Cryptosporidium parvum
NGANTGALANENTASGANEAGNPSTANI

SEQ ID NO: 2220454 - protein, 9 aa, Cryptosporidium parvum
NGASTRPWS

SEQ ID NO: 2220455 - protein, 5 aa, Cryptosporidium parvum
NGDDG

SEQ ID NO: 2220456 - protein, 42 aa, Cryptosporidium parvum
NGDETSIDCGGSCGTKNCPKCNDGIKNGDETGIDCGGSQCPT

SEQ ID NO: 2220457 - protein, 4 aa, Cryptosporidium parvum
NGDF

SEQ ID NO: 2220458 - protein, 6 aa, Cryptosporidium parvum
NGDGSI

SEQ ID NO: 2220459 - protein, 19 aa, Cryptosporidium parvum
NGDLNSNIGAAATSVGGAL

SEQ ID NO: 2220460 - protein, 8 aa, Cryptosporidium parvum
NGDLVDKD

SEQ ID NO: 2220461 - protein, 16 aa, Cryptosporidium parvum
NGDNGENNKNSDTCDN

SEQ ID NO: 2220462 - protein, 6 aa, Cryptosporidium parvum
NGDPIP

SEQ ID NO: 2220463 - protein, 8 aa, Cryptosporidium parvum
NGDREKTI

SEQ ID NO: 2220464 - protein, 4 aa, Cryptosporidium parvum
NGDT

SEQ ID NO: 2220465 - protein, 9 aa, Cryptosporidium parvum
NGDVDSEKI

SEQ ID NO: 2220466 - protein, 6 aa, Cryptosporidium parvum
NGECNA

SEQ ID NO: 2220467 - protein, 18 aa, Cryptosporidium parvum
NGEEEEEEGEAYLNEPDN

SEQ ID NO: 2220468 - protein, 4 aa, Cryptosporidium parvum
NGEI

SEQ ID NO: 2220469 - protein, 8 aa, Cryptosporidium parvum
NGEKDETQ

SEQ ID NO: 2220470 - protein, 6 aa, Cryptosporidium parvum
NGEKTI

SEQ ID NO: 2220471 - protein, 8 aa, Cryptosporidium parvum
NGEPPAAA

SEQ ID NO: 2220472 - protein, 6 aa, Cryptosporidium parvum
NGEQRF

SEQ ID NO: 2220473 - protein, 7 aa, Cryptosporidium parvum
NGETVPR

SEQ ID NO: 2220474 - protein, 7 aa, Cryptosporidium parvum
NGEYEEE

SEQ ID NO: 2220475 - protein, 4 aa, Cryptosporidium parvum
NGFR

SEQ ID NO: 2220476 - protein, 5 aa, Cryptosporidium parvum
NGFVP

SEQ ID NO: 2220477 - protein, 7 aa, Cryptosporidium parvum
NGGDPLR

SEQ ID NO: 2220478 - protein, 16 aa, Cryptosporidium parvum
NGGSGKLGHGTQSDCN

SEQ ID NO: 2220479 - protein, 6 aa, Cryptosporidium parvum
NGGSIK

SEQ ID NO: 2220480 - protein, 4 aa, Cryptosporidium parvum
NGGT

SEQ ID NO: 2220481 - protein, 11 aa, Cryptosporidium parvum
NGGTACPSSNQ

SEQ ID NO: 2220482 - protein, 7 aa, Cryptosporidium parvum
NGGTLAE

SEQ ID NO: 2220483 - protein, 11 aa, Cryptosporidium parvum
NGHNSNNNVST

SEQ ID NO: 2220484 - protein, 9 aa, Cryptosporidium parvum
NGHSNKFDS

SEQ ID NO: 2220485 - protein, 21 aa, Cryptosporidium parvum
NGIDDSGKIKYSYQKSDGLPA

SEQ ID NO: 2220486 - protein, 35 aa, Cryptosporidium parvum
NGIDSSNYYGDSGSHTVGQNQSVGAGSGPGAVSGG

SEQ ID NO: 2220487 - protein, 5 aa, Cryptosporidium parvum
NGIES

SEQ ID NO: 2220488 - protein, 4 aa, Cryptosporidium parvum
NGIG

SEQ ID NO: 2220489 - protein, 10 aa, Cryptosporidium parvum
NGINDNEKNT

SEQ ID NO: 2220490 - protein, 8 aa, Cryptosporidium parvum
NGKELDNA

SEQ ID NO: 2220491 - protein, 8 aa, Cryptosporidium parvum
NGKISKSK

SEQ ID NO: 2220492 - protein, 6 aa, Cryptosporidium parvum
NGKKGF

SEQ ID NO: 2220493 - protein, 10 aa, Cryptosporidium parvum
NGKKPFSYSD

SEQ ID NO: 2220494 - protein, 6 aa, Cryptosporidium parvum
NGKSGK

SEQ ID NO: 2220495 - protein, 8 aa, Cryptosporidium parvum
NGLGNLNP

SEQ ID NO: 2220496 - protein, 6 aa, Cryptosporidium parvum
NGLKNF

SEQ ID NO: 2220497 - protein, 10 aa, Cryptosporidium parvum
NGLSATDDPL

SEQ ID NO: 2220498 - protein, 8 aa, Cryptosporidium parvum
NGLTVGGN

SEQ ID NO: 2220499 - protein, 8 aa, Cryptosporidium parvum
NGNEESTI

SEQ ID NO: 2220500 - protein, 13 aa, Cryptosporidium parvum
NGNESNSSIDGSH

SEQ ID NO: 2220501 - protein, 11 aa, Cryptosporidium parvum
NGNGIGNGNVN

SEQ ID NO: 2220502 - protein, 7 aa, Cryptosporidium parvum
NGNHENH

SEQ ID NO: 2220503 - protein, 26 aa, Cryptosporidium parvum
NGNHNPNNSTQVESQLHEKKKTRREV

SEQ ID NO: 2220504 - protein, 8 aa, Cryptosporidium parvum
NGNHSNKD

SEQ ID NO: 2220505 - protein, 7 aa, Cryptosporidium parvum
NGNINGS

SEQ ID NO: 2220506 - protein, 8 aa, Cryptosporidium parvum
NGNKEYLP

SEQ ID NO: 2220507 - protein, 12 aa, Cryptosporidium parvum
NGNKNDQDKYQP

SEQ ID NO: 2220508 - protein, 12 aa, Cryptosporidium parvum
NGNKSSRSQREH

SEQ ID NO: 2220509 - protein, 15 aa, Cryptosporidium parvum
NGNNKSEDNNNRLNR

SEQ ID NO: 2220510 - protein, 8 aa, Cryptosporidium parvum
NGNPSEGI

SEQ ID NO: 2220511 - protein, 4 aa, Cryptosporidium parvum
NGNQ

SEQ ID NO: 2220512 - protein, 9 aa, Cryptosporidium parvum
NGNSASRRV

SEQ ID NO: 2220513 - protein, 8 aa, Cryptosporidium parvum
NGNSTNKS

SEQ ID NO: 2220514 - protein, 10 aa, Cryptosporidium parvum
NGNTCKESEI

SEQ ID NO: 2220515 - protein, 12 aa, Cryptosporidium parvum
NGNYKDAEQELD

SEQ ID NO: 2220516 - protein, 8 aa, Cryptosporidium parvum
NGPNLYPG

SEQ ID NO: 2220517 - protein, 6 aa, Cryptosporidium parvum
NGPPIT

SEQ ID NO: 2220518 - protein, 6 aa, Cryptosporidium parvum
NGPSMT

SEQ ID NO: 2220519 - protein, 12 aa, Cryptosporidium parvum
NGPSSRNEQSFN

SEQ ID NO: 2220520 - protein, 46 aa, Cryptosporidium parvum
NGPTNANGEGAKDISDNESGTSSTSGNPSPNNEFDSDNGKQDKTHS

SEQ ID NO: 2220521 - protein, 5 aa, Cryptosporidium parvum
NGPYI

SEQ ID NO: 2220522 - protein, 7 aa, Cryptosporidium parvum
NGQAKIG

SEQ ID NO: 2220523 - protein, 42 aa, Cryptosporidium parvum
NGQDFSTLSANSSSPTENGGSAGQASSRSRRSLSEETSEAAA

SEQ ID NO: 2220524 - protein, 11 aa, Cryptosporidium parvum
NGQDSPDENQF

SEQ ID NO: 2220525 - protein, 7 aa, Cryptosporidium parvum
NGQETDE

SEQ ID NO: 2220526 - protein, 27 aa, Cryptosporidium parvum
NGQKESNANQNLSENYKNNVKNSQKCS

SEQ ID NO: 2220527 - protein, 7 aa, Cryptosporidium parvum
NGQNDEN

SEQ ID NO: 2220528 - protein, 4 aa, Cryptosporidium parvum
NGQV

SEQ ID NO: 2220529 - protein, 6 aa, Cryptosporidium parvum
NGRERV

SEQ ID NO: 2220530 - protein, 5 aa, Cryptosporidium parvum
NGRMP

SEQ ID NO: 2220531 - protein, 11 aa, Cryptosporidium parvum
NGRNKNNEPIS

SEQ ID NO: 2220532 - protein, 6 aa, Cryptosporidium parvum
NGRNPI

SEQ ID NO: 2220533 - protein, 11 aa, Cryptosporidium parvum
NGRPTENENLE

SEQ ID NO: 2220534 - protein, 6 aa, Cryptosporidium parvum
NGSDYS

SEQ ID NO: 2220535 - protein, 7 aa, Cryptosporidium parvum
NGSFSKS

SEQ ID NO: 2220536 - protein, 7 aa, Cryptosporidium parvum
NGSGKSN

SEQ ID NO: 2220537 - protein, 9 aa, Cryptosporidium parvum
NGSIKGSIN

SEQ ID NO: 2220538 - protein, 41 aa, Cryptosporidium parvum
NGSKPGTEVNSDNNSFNGSSKTTIENSTKSSTNNNREDDFN

SEQ ID NO: 2220539 - protein, 10 aa, Cryptosporidium parvum
NGSKSAKFTY

SEQ ID NO: 2220540 - protein, 7 aa, Cryptosporidium parvum
NGSLGKF

SEQ ID NO: 2220541 - protein, 6 aa, Cryptosporidium parvum
NGSLSS

SEQ ID NO: 2220542 - protein, 17 aa, Cryptosporidium parvum
NGSNSKLKSSNSVLGKG

SEQ ID NO: 2220543 - protein, 7 aa, Cryptosporidium parvum
NGSNTSI

SEQ ID NO: 2220544 - protein, 8 aa, Cryptosporidium parvum
NGSNTTNN

SEQ ID NO: 2220545 - protein, 5 aa, Cryptosporidium parvum
NGSNV

SEQ ID NO: 2220546 - protein, 5 aa, Cryptosporidium parvum
NGSPI

SEQ ID NO: 2220547 - protein, 6 aa, Cryptosporidium parvum
NGSSPL

SEQ ID NO: 2220548 - protein, 8 aa, Cryptosporidium parvum
NGSSRDQG

SEQ ID NO: 2220549 - protein, 8 aa, Cryptosporidium parvum
NGSYSDNQ

SEQ ID NO: 2220550 - protein, 8 aa, Cryptosporidium parvum
NGTEGPEI

SEQ ID NO: 2220551 - protein, 6 aa, Cryptosporidium parvum
NGTNER

SEQ ID NO: 2220552 - protein, 15 aa, Cryptosporidium parvum
NGTNIGNDNYDTLEN

SEQ ID NO: 2220553 - protein, 6 aa, Cryptosporidium parvum
NGTPEL

SEQ ID NO: 2220554 - protein, 12 aa, Cryptosporidium parvum
NGTRIPSCDEKQ

SEQ ID NO: 2220555 - protein, 7 aa, Cryptosporidium parvum
NGTRQTK

SEQ ID NO: 2220556 - protein, 49 aa, Cryptosporidium parvum
NGTSGEQSHEKDPSTGKPLDPNTGLPFDEDSGSLINPETGDKLQGSHSG

SEQ ID NO: 2220557 - protein, 7 aa, Cryptosporidium parvum
NGTSGGS

SEQ ID NO: 2220558 - protein, 4 aa, Cryptosporidium parvum
NGTT

SEQ ID NO: 2220559 - protein, 26 aa, Cryptosporidium parvum
NGVGKKNPVLQSGSKGTNLETSYEDK

SEQ ID NO: 2220560 - protein, 5 aa, Cryptosporidium parvum
NGVGP

SEQ ID NO: 2220561 - protein, 5 aa, Cryptosporidium parvum
NGVPA

SEQ ID NO: 2220562 - protein, 5 aa, Cryptosporidium parvum
NGVTV

SEQ ID NO: 2220563 - protein, 5 aa, Cryptosporidium parvum
NGYDK

SEQ ID NO: 2220564 - protein, 6 aa, Cryptosporidium parvum
NGYDYE

SEQ ID NO: 2220565 - protein, 9 aa, Cryptosporidium parvum
NHARQDENK

SEQ ID NO: 2220566 - protein, 4 aa, Cryptosporidium parvum
NHCS

SEQ ID NO: 2220567 - protein, 8 aa, Cryptosporidium parvum
NHDRDNQY

SEQ ID NO: 2220568 - protein, 5 aa, Cryptosporidium parvum
NHDYN

SEQ ID NO: 2220569 - protein, 7 aa, Cryptosporidium parvum
NHEDGNK

SEQ ID NO: 2220570 - protein, 9 aa, Cryptosporidium parvum
NHEETSTFQ

SEQ ID NO: 2220571 - protein, 5 aa, Cryptosporidium parvum
NHEKI

SEQ ID NO: 2220572 - protein, 5 aa, Cryptosporidium parvum
NHEKK

SEQ ID NO: 2220573 - protein, 16 aa, Cryptosporidium parvum
NHETNTSECLNNPERK

SEQ ID NO: 2220574 - protein, 7 aa, Cryptosporidium parvum
NHGGEGS

SEQ ID NO: 2220575 - protein, 36 aa, Cryptosporidium parvum
NHGKKMEEKQEKKVGNKVEEKIASKVQSGNKQTQAE

SEQ ID NO: 2220576 - protein, 5 aa, Cryptosporidium parvum
NHHPK

SEQ ID NO: 2220577 - protein, 12 aa, Cryptosporidium parvum
NHIDKSSSKPLD

SEQ ID NO: 2220578 - protein, 5 aa, Cryptosporidium parvum
NHIPK

SEQ ID NO: 2220579 - protein, 9 aa, Cryptosporidium parvum
NHKDSNDLI

SEQ ID NO: 2220580 - protein, 6 aa, Cryptosporidium parvum
NHKERR

SEQ ID NO: 2220581 - protein, 12 aa, Cryptosporidium parvum
NHKNQNNNKNNN

SEQ ID NO: 2220582 - protein, 6 aa, Cryptosporidium parvum
NHKRLN

SEQ ID NO: 2220583 - protein, 9 aa, Cryptosporidium parvum
NHKTEHEKV

SEQ ID NO: 2220584 - protein, 6 aa, Cryptosporidium parvum
NHKTGN

SEQ ID NO: 2220585 - protein, 13 aa, Cryptosporidium parvum
NHKTNDEKPRLRT

SEQ ID NO: 2220586 - protein, 5 aa, Cryptosporidium parvum
NHLNS

SEQ ID NO: 2220587 - protein, 10 aa, Cryptosporidium parvum
NHNDNKSTSK

SEQ ID NO: 2220588 - protein, 8 aa, Cryptosporidium parvum
NHNEINQR

SEQ ID NO: 2220589 - protein, 8 aa, Cryptosporidium parvum
NHNNLKSS

SEQ ID NO: 2220590 - protein, 9 aa, Cryptosporidium parvum
NHNRSDSES

SEQ ID NO: 2220591 - protein, 11 aa, Cryptosporidium parvum
NHNSKGESRRL

SEQ ID NO: 2220592 - protein, 6 aa, Cryptosporidium parvum
NHPAGN

SEQ ID NO: 2220593 - protein, 7 aa, Cryptosporidium parvum
NHQDDHK

SEQ ID NO: 2220594 - protein, 10 aa, Cryptosporidium parvum
NHQKYNQNHD

SEQ ID NO: 2220595 - protein, 4 aa, Cryptosporidium parvum
NHQV

SEQ ID NO: 2220596 - protein, 9 aa, Cryptosporidium parvum
NHSFNQKSS

SEQ ID NO: 2220597 - protein, 10 aa, Cryptosporidium parvum
NHSKDDEGEN

SEQ ID NO: 2220598 - protein, 27 aa, Cryptosporidium parvum
NHSKEGMKNVEGEHKNLENNSKYIQNN

SEQ ID NO: 2220599 - protein, 22 aa, Cryptosporidium parvum
NHSMNGNESGVSRTLKQEKDDH

SEQ ID NO: 2220600 - protein, 8 aa, Cryptosporidium parvum
NHSNSSYK

SEQ ID NO: 2220601 - protein, 4 aa, Cryptosporidium parvum
NHSP

SEQ ID NO: 2220602 - protein, 12 aa, Cryptosporidium parvum
NHSRSNNVQKPI

SEQ ID NO: 2220603 - protein, 8 aa, Cryptosporidium parvum
NHSSENHQ

SEQ ID NO: 2220604 - protein, 4 aa, Cryptosporidium parvum
NHTP

SEQ ID NO: 2220605 - protein, 6 aa, Cryptosporidium parvum
NHTPTF

SEQ ID NO: 2220606 - protein, 5 aa, Cryptosporidium parvum
NHTYN

SEQ ID NO: 2220607 - protein, 4 aa, Cryptosporidium parvum
NHVT

SEQ ID NO: 2220608 - protein, 5 aa, Cryptosporidium parvum
NHYEK

SEQ ID NO: 2220609 - protein, 10 aa, Cryptosporidium parvum
NIAQKDNKFN

SEQ ID NO: 2220610 - protein, 6 aa, Cryptosporidium parvum
NIAQSN

SEQ ID NO: 2220611 - protein, 21 aa, Cryptosporidium parvum
NICNGYSSEKYSFKRDSSTYS

SEQ ID NO: 2220612 - protein, 7 aa, Cryptosporidium parvum
NIDGPFE

SEQ ID NO: 2220613 - protein, 7 aa, Cryptosporidium parvum
NIDKSDE

SEQ ID NO: 2220614 - protein, 7 aa, Cryptosporidium parvum
NIDNCGE

SEQ ID NO: 2220615 - protein, 21 aa, Cryptosporidium parvum
NIDNSGNSNNNNNNNNNNNIE

SEQ ID NO: 2220616 - protein, 11 aa, Cryptosporidium parvum
NIDNSSNGFQM

SEQ ID NO: 2220617 - protein, 27 aa, Cryptosporidium parvum
NIDSTRSLPESLAKSGTIKDNREDISK

SEQ ID NO: 2220618 - protein, 5 aa, Cryptosporidium parvum
NIEAA

SEQ ID NO: 2220619 - protein, 10 aa, Cryptosporidium parvum
NIEESRPKSS

SEQ ID NO: 2220620 - protein, 11 aa, Cryptosporidium parvum
NIEGSNSSSEG

SEQ ID NO: 2220621 - protein, 11 aa, Cryptosporidium parvum
NIENNSESYGN

SEQ ID NO: 2220622 - protein, 5 aa, Cryptosporidium parvum
NIENT

SEQ ID NO: 2220623 - protein, 7 aa, Cryptosporidium parvum
NIEPNQK

SEQ ID NO: 2220624 - protein, 10 aa, Cryptosporidium parvum
NIEQESNEAN

SEQ ID NO: 2220625 - protein, 10 aa, Cryptosporidium parvum
NIERKSNESS

SEQ ID NO: 2220626 - protein, 5 aa, Cryptosporidium parvum
NIETA

SEQ ID NO: 2220627 - protein, 5 aa, Cryptosporidium parvum
NIETR

SEQ ID NO: 2220628 - protein, 6 aa, Cryptosporidium parvum
NIGDSQ

SEQ ID NO: 2220629 - protein, 4 aa, Cryptosporidium parvum
NIGL

SEQ ID NO: 2220630 - protein, 6 aa, Cryptosporidium parvum
NIGPQA

SEQ ID NO: 2220631 - protein, 8 aa, Cryptosporidium parvum
NIKENDSE

SEQ ID NO: 2220632 - protein, 5 aa, Cryptosporidium parvum
NIKEQ

SEQ ID NO: 2220633 - protein, 9 aa, Cryptosporidium parvum
NIKEQNTQY

SEQ ID NO: 2220634 - protein, 5 aa, Cryptosporidium parvum
NIKKK

SEQ ID NO: 2220635 - protein, 9 aa, Cryptosporidium parvum
NIKNNKNKN

SEQ ID NO: 2220636 - protein, 10 aa, Cryptosporidium parvum
NIKNTNDQEM

SEQ ID NO: 2220637 - protein, 9 aa, Cryptosporidium parvum
NIKSNKRDK

SEQ ID NO: 2220638 - protein, 5 aa, Cryptosporidium parvum
NINEK

SEQ ID NO: 2220639 - protein, 10 aa, Cryptosporidium parvum
NINGEGGGSD

SEQ ID NO: 2220640 - protein, 27 aa, Cryptosporidium parvum
NINGNDNSKNSSSSHNSVNLKPNNNQN

SEQ ID NO: 2220641 - protein, 10 aa, Cryptosporidium parvum
NINGNSKNIH

SEQ ID NO: 2220642 - protein, 4 aa, Cryptosporidium parvum
NINK

SEQ ID NO: 2220643 - protein, 13 aa, Cryptosporidium parvum
NINKSESSQNNNI

SEQ ID NO: 2220644 - protein, 6 aa, Cryptosporidium parvum
NINNEH

SEQ ID NO: 2220645 - protein, 19 aa, Cryptosporidium parvum
NINNNNNSNNSSNNNNNYN

SEQ ID NO: 2220646 - protein, 13 aa, Cryptosporidium parvum
NINNNSDSDTYTD

SEQ ID NO: 2220647 - protein, 5 aa, Cryptosporidium parvum
NINNP

SEQ ID NO: 2220648 - protein, 15 aa, Cryptosporidium parvum
NINNTEIREIELTRE

SEQ ID NO: 2220649 - protein, 4 aa, Cryptosporidium parvum
NINQ

SEQ ID NO: 2220650 - protein, 8 aa, Cryptosporidium parvum
NINSSYSS

SEQ ID NO: 2220651 - protein, 6 aa, Cryptosporidium parvum
NIPEDS

SEQ ID NO: 2220652 - protein, 9 aa, Cryptosporidium parvum
NIPGEGTNN

SEQ ID NO: 2220653 - protein, 7 aa, Cryptosporidium parvum
NIPHGSA

SEQ ID NO: 2220654 - protein, 5 aa, Cryptosporidium parvum
NIPIS

SEQ ID NO: 2220655 - protein, 11 aa, Cryptosporidium parvum
NIPNKNESIIS

SEQ ID NO: 2220656 - protein, 8 aa, Cryptosporidium parvum
NIPPKTSN

SEQ ID NO: 2220657 - protein, 5 aa, Cryptosporidium parvum
NIPTE

SEQ ID NO: 2220658 - protein, 4 aa, Cryptosporidium parvum
NIQD

SEQ ID NO: 2220659 - protein, 14 aa, Cryptosporidium parvum
NIQGNSPKSIVSDD

SEQ ID NO: 2220660 - protein, 14 aa, Cryptosporidium parvum
NIQNSKDSDKETFK

SEQ ID NO: 2220661 - protein, 37 aa, Cryptosporidium parvum
NIQNSNNNLNSSLHANNSHNSISSTSNSTLNNQPIYP

SEQ ID NO: 2220662 - protein, 14 aa, Cryptosporidium parvum
NIQTGNNKTTQVTD

SEQ ID NO: 2220663 - protein, 4 aa, Cryptosporidium parvum
NIRG

SEQ ID NO: 2220664 - protein, 8 aa, Cryptosporidium parvum
NIRNARSK

SEQ ID NO: 2220665 - protein, 9 aa, Cryptosporidium parvum
NIRNKGSIN

SEQ ID NO: 2220666 - protein, 5 aa, Cryptosporidium parvum
NISDN

SEQ ID NO: 2220667 - protein, 7 aa, Cryptosporidium parvum
NISEKAL

SEQ ID NO: 2220668 - protein, 5 aa, Cryptosporidium parvum
NISEN

SEQ ID NO: 2220669 - protein, 6 aa, Cryptosporidium parvum
NISENS

SEQ ID NO: 2220670 - protein, 21 aa, Cryptosporidium parvum
NISGIREKKEINSSSTEEKPK

SEQ ID NO: 2220671 - protein, 13 aa, Cryptosporidium parvum
NISISSNKGGHIN

SEQ ID NO: 2220672 - protein, 11 aa, Cryptosporidium parvum
NISKDGSDRWN

SEQ ID NO: 2220673 - protein, 161 aa, Cryptosporidium parvum
NISKGSSGDEGLGSNSRSRTSSASRSRSVSSTGSTRPTGSTGPAGSTGPAGSTGPAGSTRQTRSTGRTSSTGSTGQTGSTGSTRQARSTGRTGSTGATRQTNPTGSTSQTRSTRRTGSTGPTRQTNPTGSAGSAGSTGPAGPEERERNTTPENFSESYENE

SEQ ID NO: 2220674 - protein, 11 aa, Cryptosporidium parvum
NISNGHMNSDK

SEQ ID NO: 2220675 - protein, 19 aa, Cryptosporidium parvum
NISNHPSTLTSSNNTTINN

SEQ ID NO: 2220676 - protein, 7 aa, Cryptosporidium parvum
NISNNTM

SEQ ID NO: 2220677 - protein, 5 aa, Cryptosporidium parvum
NISNS

SEQ ID NO: 2220678 - protein, 18 aa, Cryptosporidium parvum
NISPNKFNRKSSTNHEIK

SEQ ID NO: 2220679 - protein, 5 aa, Cryptosporidium parvum
NISPR

SEQ ID NO: 2220680 - protein, 5 aa, Cryptosporidium parvum
NISQA

SEQ ID NO: 2220681 - protein, 6 aa, Cryptosporidium parvum
NISRKK

SEQ ID NO: 2220682 - protein, 19 aa, Cryptosporidium parvum
NISSEGRIEKQQKQEETPL

SEQ ID NO: 2220683 - protein, 13 aa, Cryptosporidium parvum
NISSSSNSRNYTN

SEQ ID NO: 2220684 - protein, 7 aa, Cryptosporidium parvum
NITGGKG

SEQ ID NO: 2220685 - protein, 5 aa, Cryptosporidium parvum
NITKP

SEQ ID NO: 2220686 - protein, 11 aa, Cryptosporidium parvum
NITQGANPVPL

SEQ ID NO: 2220687 - protein, 21 aa, Cryptosporidium parvum
NITSNNEGDHSNNISNSNTIQ

SEQ ID NO: 2220688 - protein, 16 aa, Cryptosporidium parvum
NITSTQPGNKSSSMTN

SEQ ID NO: 2220689 - protein, 26 aa, Cryptosporidium parvum
NITTSTTVENNKKKKNNLNSDDCHDS

SEQ ID NO: 2220690 - protein, 9 aa, Cryptosporidium parvum
NKAARTDTN

SEQ ID NO: 2220691 - protein, 8 aa, Cryptosporidium parvum
NKAAVTKR

SEQ ID NO: 2220692 - protein, 15 aa, Cryptosporidium parvum
NKANHASPEEKTSPF

SEQ ID NO: 2220693 - protein, 26 aa, Cryptosporidium parvum
NKANSNKKTGIYESDTKSSIEAKSKE

SEQ ID NO: 2220694 - protein, 7 aa, Cryptosporidium parvum
NKAQVSK

SEQ ID NO: 2220695 - protein, 5 aa, Cryptosporidium parvum
NKART

SEQ ID NO: 2220696 - protein, 19 aa, Cryptosporidium parvum
NKAYPESQANNNNNNNNIN

SEQ ID NO: 2220697 - protein, 10 aa, Cryptosporidium parvum
NKDDGQEGLK

SEQ ID NO: 2220698 - protein, 10 aa, Cryptosporidium parvum
NKDDNVDSIH

SEQ ID NO: 2220699 - protein, 8 aa, Cryptosporidium parvum
NKDDSKLL

SEQ ID NO: 2220700 - protein, 4 aa, Cryptosporidium parvum
NKDE

SEQ ID NO: 2220701 - protein, 6 aa, Cryptosporidium parvum
NKDGLQ

SEQ ID NO: 2220702 - protein, 8 aa, Cryptosporidium parvum
NKDHNNSK

SEQ ID NO: 2220703 - protein, 5 aa, Cryptosporidium parvum
NKDIT

SEQ ID NO: 2220704 - protein, 7 aa, Cryptosporidium parvum
NKDKLGS

SEQ ID NO: 2220705 - protein, 7 aa, Cryptosporidium parvum
NKDKTQN

SEQ ID NO: 2220706 - protein, 32 aa, Cryptosporidium parvum
NKDNGPHSEEFSNDDDFSYNNNNKYDTTTNNN

SEQ ID NO: 2220707 - protein, 6 aa, Cryptosporidium parvum
NKDNNI

SEQ ID NO: 2220708 - protein, 6 aa, Cryptosporidium parvum
NKDPKH

SEQ ID NO: 2220709 - protein, 8 aa, Cryptosporidium parvum
NKDPKYTV

SEQ ID NO: 2220710 - protein, 9 aa, Cryptosporidium parvum
NKDPSYSTL

SEQ ID NO: 2220711 - protein, 5 aa, Cryptosporidium parvum
NKDPV

SEQ ID NO: 2220712 - protein, 11 aa, Cryptosporidium parvum
NKDSELSNGQI

SEQ ID NO: 2220713 - protein, 8 aa, Cryptosporidium parvum
NKDSGKMA

SEQ ID NO: 2220714 - protein, 6 aa, Cryptosporidium parvum
NKDSSN

SEQ ID NO: 2220715 - protein, 5 aa, Cryptosporidium parvum
NKDTG

SEQ ID NO: 2220716 - protein, 8 aa, Cryptosporidium parvum
NKDTNQSI

SEQ ID NO: 2220717 - protein, 31 aa, Cryptosporidium parvum
NKDYNSESKLGTNEKKENWNNHQNENGDLDE

SEQ ID NO: 2220718 - protein, 10 aa, Cryptosporidium parvum
NKDYSKDGKT

SEQ ID NO: 2220719 - protein, 13 aa, Cryptosporidium parvum
NKEDGSTSFAFIY

SEQ ID NO: 2220720 - protein, 16 aa, Cryptosporidium parvum
NKEDKNEQEQEQDEED

SEQ ID NO: 2220721 - protein, 9 aa, Cryptosporidium parvum
NKEDSSLSH

SEQ ID NO: 2220722 - protein, 7 aa, Cryptosporidium parvum
NKEENGY

SEQ ID NO: 2220723 - protein, 8 aa, Cryptosporidium parvum
NKEERKNR

SEQ ID NO: 2220724 - protein, 4 aa, Cryptosporidium parvum
NKEF

SEQ ID NO: 2220725 - protein, 9 aa, Cryptosporidium parvum
NKEGQKPDI

SEQ ID NO: 2220726 - protein, 7 aa, Cryptosporidium parvum
NKEGRKI

SEQ ID NO: 2220727 - protein, 10 aa, Cryptosporidium parvum
NKEGTNENEF

SEQ ID NO: 2220728 - protein, 9 aa, Cryptosporidium parvum
NKEINSQTF

SEQ ID NO: 2220729 - protein, 8 aa, Cryptosporidium parvum
NKEISTSS

SEQ ID NO: 2220730 - protein, 12 aa, Cryptosporidium parvum
NKEKEKHSKING

SEQ ID NO: 2220731 - protein, 22 aa, Cryptosporidium parvum
NKEKSDPNYGRGSFQDTELSNK

SEQ ID NO: 2220732 - protein, 26 aa, Cryptosporidium parvum
NKELQGSENGIGAQTENNQVSPGSRR

SEQ ID NO: 2220733 - protein, 31 aa, Cryptosporidium parvum; identical to SEQ ID NO: 2116938

SEQ ID NO: 2220734 - protein, 6 aa, Cryptosporidium parvum
NKEPVN

SEQ ID NO: 2220735 - protein, 5 aa, Cryptosporidium parvum
NKEQV

SEQ ID NO: 2220736 - protein, 6 aa, Cryptosporidium parvum
NKEREI

SEQ ID NO: 2220737 - protein, 5 aa, Cryptosporidium parvum
NKESI

SEQ ID NO: 2220738 - protein, 7 aa, Cryptosporidium parvum
NKESSKI

SEQ ID NO: 2220739 - protein, 19 aa, Cryptosporidium parvum
NKESVQKNLRAKRKEYNDR

SEQ ID NO: 2220740 - protein, 13 aa, Cryptosporidium parvum
NKETESKEYNDKG

SEQ ID NO: 2220741 - protein, 6 aa, Cryptosporidium parvum
NKETKS

SEQ ID NO: 2220742 - protein, 4 aa, Cryptosporidium parvum
NKEV

SEQ ID NO: 2220743 - protein, 4 aa, Cryptosporidium parvum
NKEY

SEQ ID NO: 2220744 - protein, 21 aa, Cryptosporidium parvum
NKEYGNNADSIESNNNSGCYD

SEQ ID NO: 2220745 - protein, 7 aa, Cryptosporidium parvum
NKEYIDE

SEQ ID NO: 2220746 - protein, 12 aa, Cryptosporidium parvum
NKEYSKSREGSL

SEQ ID NO: 2220747 - protein, 5 aa, Cryptosporidium parvum
NKEYV

SEQ ID NO: 2220748 - protein, 6 aa, Cryptosporidium parvum
NKFERS

SEQ ID NO: 2220749 - protein, 11 aa, Cryptosporidium parvum
NKFSKSQKKVG

SEQ ID NO: 2220750 - protein, 5 aa, Cryptosporidium parvum
NKGEF

SEQ ID NO: 2220751 - protein, 7 aa, Cryptosporidium parvum
NKGIKKS

SEQ ID NO: 2220752 - protein, 12 aa, Cryptosporidium parvum
NKGINNGKDLPR

SEQ ID NO: 2220753 - protein, 10 aa, Cryptosporidium parvum
NKGKNNGDDV

SEQ ID NO: 2220754 - protein, 7 aa, Cryptosporidium parvum
NKGKPRK

SEQ ID NO: 2220755 - protein, 8 aa, Cryptosporidium parvum
NKGPPGSS

SEQ ID NO: 2220756 - protein, 4 aa, Cryptosporidium parvum
NKGQ

SEQ ID NO: 2220757 - protein, 7 aa, Cryptosporidium parvum
NKGQKIT

SEQ ID NO: 2220758 - protein, 12 aa, Cryptosporidium parvum
NKGRKDISSSFP

SEQ ID NO: 2220759 - protein, 4 aa, Cryptosporidium parvum
NKGS

SEQ ID NO: 2220760 - protein, 14 aa, Cryptosporidium parvum
NKGSKMNGGPSNIP

SEQ ID NO: 2220761 - protein, 7 aa, Cryptosporidium parvum
NKGSLNS

SEQ ID NO: 2220762 - protein, 25 aa, Cryptosporidium parvum
NKGYNDIEQGNNNMESGRGEIKTPS

SEQ ID NO: 2220763 - protein, 19 aa, Cryptosporidium parvum
NKHEKSSFSTDESEDETSI

SEQ ID NO: 2220764 - protein, 5 aa, Cryptosporidium parvum
NKHNS

SEQ ID NO: 2220765 - protein, 6 aa, Cryptosporidium parvum
NKHQNN

SEQ ID NO: 2220766 - protein, 6 aa, Cryptosporidium parvum
NKHTNG

SEQ ID NO: 2220767 - protein, 14 aa, Cryptosporidium parvum
NKIAQENDLEQTKR

SEQ ID NO: 2220768 - protein, 8 aa, Cryptosporidium parvum
NKIKTTNK

SEQ ID NO: 2220769 - protein, 9 aa, Cryptosporidium parvum
NKISKSEDF

SEQ ID NO: 2220770 - protein, 5 aa, Cryptosporidium parvum
NKISS

SEQ ID NO: 2220771 - protein, 8 aa, Cryptosporidium parvum
NKKDARKY

SEQ ID NO: 2220772 - protein, 10 aa, Cryptosporidium parvum
NKKDFSGSSI

SEQ ID NO: 2220773 - protein, 15 aa, Cryptosporidium parvum
NKKEEKQNKKKKNNF

SEQ ID NO: 2220774 - protein, 7 aa, Cryptosporidium parvum
NKKENMS

SEQ ID NO: 2220775 - protein, 8 aa, Cryptosporidium parvum
NKKEYSIE

SEQ ID NO: 2220776 - protein, 7 aa, Cryptosporidium parvum
NKKGDCE

SEQ ID NO: 2220777 - protein, 9 aa, Cryptosporidium parvum
NKKGKKTNS

SEQ ID NO: 2220778 - protein, 5 aa, Cryptosporidium parvum
NKKKD

SEQ ID NO: 2220779 - protein, 7 aa, Cryptosporidium parvum
NKKKDEG

SEQ ID NO: 2220780 - protein, 5 aa, Cryptosporidium parvum
NKKKL

SEQ ID NO: 2220781 - protein, 7 aa, Cryptosporidium parvum
NKKLPND

SEQ ID NO: 2220782 - protein, 9 aa, Cryptosporidium parvum
NKKMKKSVN

SEQ ID NO: 2220783 - protein, 8 aa, Cryptosporidium parvum
NKKNHAVD

SEQ ID NO: 2220784 - protein, 16 aa, Cryptosporidium parvum
NKKNHISNNHHISLFG

SEQ ID NO: 2220785 - protein, 7 aa, Cryptosporidium parvum
NKKNNTL

SEQ ID NO: 2220786 - protein, 10 aa, Cryptosporidium parvum
NKKNQDKLPS

SEQ ID NO: 2220787 - protein, 9 aa, Cryptosporidium parvum
NKKNSEHIK

SEQ ID NO: 2220788 - protein, 15 aa, Cryptosporidium parvum
NKKNSHSKLKSNTIK

SEQ ID NO: 2220789 - protein, 9 aa, Cryptosporidium parvum
NKKNTKEPI

SEQ ID NO: 2220790 - protein, 5 aa, Cryptosporidium parvum
NKKQI

SEQ ID NO: 2220791 - protein, 9 aa, Cryptosporidium parvum
NKKSNNNHI

SEQ ID NO: 2220792 - protein, 7 aa, Cryptosporidium parvum
NKLINPS

SEQ ID NO: 2220793 - protein, 6 aa, Cryptosporidium parvum
NKLPKN

SEQ ID NO: 2220794 - protein, 6 aa, Cryptosporidium parvum
NKLSCE

SEQ ID NO: 2220795 - protein, 8 aa, Cryptosporidium parvum
NKLSDEDS

SEQ ID NO: 2220796 - protein, 9 aa, Cryptosporidium parvum
NKLSQMDQT

SEQ ID NO: 2220797 - protein, 6 aa, Cryptosporidium parvum
NKMKQE

SEQ ID NO: 2220798 - protein, 7 aa, Cryptosporidium parvum
NKNDEKH

SEQ ID NO: 2220799 - protein, 10 aa, Cryptosporidium parvum
NKNDNKDKMV

SEQ ID NO: 2220800 - protein, 14 aa, Cryptosporidium parvum
NKNDSISKSPNYNN

SEQ ID NO: 2220801 - protein, 7 aa, Cryptosporidium parvum
NKNDSYN

SEQ ID NO: 2220802 - protein, 7 aa, Cryptosporidium parvum
NKNESNP

SEQ ID NO: 2220803 - protein, 6 aa, Cryptosporidium parvum
NKNGKL

SEQ ID NO: 2220804 - protein, 9 aa, Cryptosporidium parvum
NKNHSNKWT

SEQ ID NO: 2220805 - protein, 5 aa, Cryptosporidium parvum
NKNIE

SEQ ID NO: 2220806 - protein, 8 aa, Cryptosporidium parvum
NKNKIKKI

SEQ ID NO: 2220807 - protein, 8 aa, Cryptosporidium parvum
NKNKNEPE

SEQ ID NO: 2220808 - protein, 9 aa, Cryptosporidium parvum
NKNKNKLYQ

SEQ ID NO: 2220809 - protein, 35 aa, Cryptosporidium parvum
NKNKNLENQSEYCNNQQEGETQNSNSNSTGIEDSE

SEQ ID NO: 2220810 - protein, 9 aa, Cryptosporidium parvum
NKNKPKDLD

SEQ ID NO: 2220811 - protein, 7 aa, Cryptosporidium parvum
NKNNNIT

SEQ ID NO: 2220812 - protein, 6 aa, Cryptosporidium parvum
NKNNPL

SEQ ID NO: 2220813 - protein, 13 aa, Cryptosporidium parvum
NKNNTGKNCESGN

SEQ ID NO: 2220814 - protein, 9 aa, Cryptosporidium parvum
NKNNVEQKI

SEQ ID NO: 2220815 - protein, 30 aa, Cryptosporidium parvum
NKNPTLSSKKARVNLAENDNGLKAELGKSS

SEQ ID NO: 2220816 - protein, 23 aa, Cryptosporidium parvum
NKNRNAKNSMNKDDQKKKGNGLL

SEQ ID NO: 2220817 - protein, 10 aa, Cryptosporidium parvum
NKNSDSNYSR

SEQ ID NO: 2220818 - protein, 14 aa, Cryptosporidium parvum
NKNSESSKAGESKY

SEQ ID NO: 2220819 - protein, 8 aa, Cryptosporidium parvum
NKNSHLDN

SEQ ID NO: 2220820 - protein, 5 aa, Cryptosporidium parvum
NKNSS

SEQ ID NO: 2220821 - protein, 6 aa, Cryptosporidium parvum
NKNSSH

SEQ ID NO: 2220822 - protein, 5 aa, Cryptosporidium parvum
NKNSW

SEQ ID NO: 2220823 - protein, 10 aa, Cryptosporidium parvum
NKNTKSGYKE

SEQ ID NO: 2220824 - protein, 4 aa, Cryptosporidium parvum
NKNY

SEQ ID NO: 2220825 - protein, 7 aa, Cryptosporidium parvum
NKNYKES

SEQ ID NO: 2220826 - protein, 7 aa, Cryptosporidium parvum
NKPAPQM

SEQ ID NO: 2220827 - protein, 19 aa, Cryptosporidium parvum
NKPFKGRSSIRKKSSQRLR

SEQ ID NO: 2220828 - protein, 9 aa, Cryptosporidium parvum
NKPPRPQVT

SEQ ID NO: 2220829 - protein, 16 aa, Cryptosporidium parvum
NKPSKKKRVLDSSGNI

SEQ ID NO: 2220830 - protein, 6 aa, Cryptosporidium parvum
NKPSPT

SEQ ID NO: 2220831 - protein, 7 aa, Cryptosporidium parvum
NKPYENL

SEQ ID NO: 2220832 - protein, 6 aa, Cryptosporidium parvum
NKPYSL

SEQ ID NO: 2220833 - protein, 9 aa, Cryptosporidium parvum
NKQDTRNSD

SEQ ID NO: 2220834 - protein, 10 aa, Cryptosporidium parvum
NKQEKSSLEQ

SEQ ID NO: 2220835 - protein, 4 aa, Cryptosporidium parvum
NKQF

SEQ ID NO: 2220836 - protein, 7 aa, Cryptosporidium parvum
NKQISDS

SEQ ID NO: 2220837 - protein, 9 aa, Cryptosporidium parvum
NKQKKQLRN

SEQ ID NO: 2220838 - protein, 8 aa, Cryptosporidium parvum
NKQNTELE

SEQ ID NO: 2220839 - protein, 12 aa, Cryptosporidium parvum
NKQQQRQNSQRY

SEQ ID NO: 2220840 - protein, 6 aa, Cryptosporidium parvum
NKQSEL

SEQ ID NO: 2220841 - protein, 7 aa, Cryptosporidium parvum
NKRGLES

SEQ ID NO: 2220842 - protein, 5 aa, Cryptosporidium parvum
NKRIN

SEQ ID NO: 2220843 - protein, 23 aa, Cryptosporidium parvum
NKRKPENNPIPELENSSSGSAEC

SEQ ID NO: 2220844 - protein, 19 aa, Cryptosporidium parvum
NKRSGFKRSFGGDSQKHSH

SEQ ID NO: 2220845 - protein, 20 aa, Cryptosporidium parvum
NKRTDKENFNENLGNTNRSG

SEQ ID NO: 2220846 - protein, 9 aa, Cryptosporidium parvum
NKSAKDKQK

SEQ ID NO: 2220847 - protein, 9 aa, Cryptosporidium parvum
NKSAPISNQ

SEQ ID NO: 2220848 - protein, 10 aa, Cryptosporidium parvum
NKSDANTSRR

SEQ ID NO: 2220849 - protein, 8 aa, Cryptosporidium parvum
NKSDENNP

SEQ ID NO: 2220850 - protein, 7 aa, Cryptosporidium parvum
NKSDLIR

SEQ ID NO: 2220851 - protein, 9 aa, Cryptosporidium parvum
NKSDSEYNK

SEQ ID NO: 2220852 - protein, 6 aa, Cryptosporidium parvum
NKSEHT

SEQ ID NO: 2220853 - protein, 10 aa, Cryptosporidium parvum
NKSEQNKNVT

SEQ ID NO: 2220854 - protein, 9 aa, Cryptosporidium parvum
NKSESQISD

SEQ ID NO: 2220855 - protein, 5 aa, Cryptosporidium parvum
NKSFS

SEQ ID NO: 2220856 - protein, 6 aa, Cryptosporidium parvum
NKSHKV

SEQ ID NO: 2220857 - protein, 21 aa, Cryptosporidium parvum
NKSIGKSRGEGIKHKSKTRID

SEQ ID NO: 2220858 - protein, 6 aa, Cryptosporidium parvum
NKSINI

SEQ ID NO: 2220859 - protein, 13 aa, Cryptosporidium parvum
NKSLKDKSNFDFK

SEQ ID NO: 2220860 - protein, 32 aa, Cryptosporidium parvum
NKSLTKSSSFGYRKNEQEQKQELESVNNHSNL

SEQ ID NO: 2220861 - protein, 4 aa, Cryptosporidium parvum
NKSN

SEQ ID NO: 2220862 - protein, 11 aa, Cryptosporidium parvum
NKSNNERRNHE

SEQ ID NO: 2220863 - protein, 10 aa, Cryptosporidium parvum
NKSPDNKEDD

SEQ ID NO: 2220864 - protein, 16 aa, Cryptosporidium parvum
NKSPNPEIKLGNSGAT

SEQ ID NO: 2220865 - protein, 5 aa, Cryptosporidium parvum
NKSPR

SEQ ID NO: 2220866 - protein, 9 aa, Cryptosporidium parvum
NKSQEETLS

SEQ ID NO: 2220867 - protein, 8 aa, Cryptosporidium parvum
NKSQSSIE

SEQ ID NO: 2220868 - protein, 11 aa, Cryptosporidium parvum
NKSSDAESENK

SEQ ID NO: 2220869 - protein, 49 aa, Cryptosporidium parvum
NKSSDAWNYSEEADSDERINDSKESSEEDKSQSKTSTRKKSDVLKQKKD

SEQ ID NO: 2220870 - protein, 10 aa, Cryptosporidium parvum
NKSSGDNRNI

SEQ ID NO: 2220871 - protein, 6 aa, Cryptosporidium parvum
NKSSGF

SEQ ID NO: 2220872 - protein, 5 aa, Cryptosporidium parvum
NKSSM

SEQ ID NO: 2220873 - protein, 17 aa, Cryptosporidium parvum
NKSTETKSYNEKEDDYY

SEQ ID NO: 2220874 - protein, 5 aa, Cryptosporidium parvum
NKSTQ

SEQ ID NO: 2220875 - protein, 15 aa, Cryptosporidium parvum
NKSYNCNKTQNSIEN

SEQ ID NO: 2220876 - protein, 14 aa, Cryptosporidium parvum
NKTASSSTNSSIHS

SEQ ID NO: 2220877 - protein, 5 aa, Cryptosporidium parvum
NKTDL

SEQ ID NO: 2220878 - protein, 7 aa, Cryptosporidium parvum
NKTERQK

SEQ ID NO: 2220879 - protein, 7 aa, Cryptosporidium parvum
NKTEYND

SEQ ID NO: 2220880 - protein, 15 aa, Cryptosporidium parvum
NKTIESSDKLDSNQE

SEQ ID NO: 2220881 - protein, 16 aa, Cryptosporidium parvum
NKTISKKCHSNQNNYP

SEQ ID NO: 2220882 - protein, 8 aa, Cryptosporidium parvum
NKTISNNK

SEQ ID NO: 2220883 - protein, 14 aa, Cryptosporidium parvum
NKTKNANPKSNSLD

SEQ ID NO: 2220884 - protein, 17 aa, Cryptosporidium parvum
NKTLSRYPKFSNSPNFK

SEQ ID NO: 2220885 - protein, 4 aa, Cryptosporidium parvum
NKTM

SEQ ID NO: 2220886 - protein, 15 aa, Cryptosporidium parvum
NKTNTSTRFSTPSKE

SEQ ID NO: 2220887 - protein, 5 aa, Cryptosporidium parvum
NKTRL

SEQ ID NO: 2220888 - protein, 15 aa, Cryptosporidium parvum
NKTSRKKARKNNPDI

SEQ ID NO: 2220889 - protein, 16 aa, Cryptosporidium parvum
NKTSRLDDSISESEKD

SEQ ID NO: 2220890 - protein, 9 aa, Cryptosporidium parvum
NKTSSIQSK

SEQ ID NO: 2220891 - protein, 13 aa, Cryptosporidium parvum
NKTTNRRNERCPA

SEQ ID NO: 2220892 - protein, 6 aa, Cryptosporidium parvum
NKTYGH

SEQ ID NO: 2220893 - protein, 9 aa, Cryptosporidium parvum
NKVGNSSPT

SEQ ID NO: 2220894 - protein, 8 aa, Cryptosporidium parvum
NKVGTVQT

SEQ ID NO: 2220895 - protein, 7 aa, Cryptosporidium parvum
NKVHQKN

SEQ ID NO: 2220896 - protein, 6 aa, Cryptosporidium parvum
NKVPKS

SEQ ID NO: 2220897 - protein, 7 aa, Cryptosporidium parvum
NKVPRNK

SEQ ID NO: 2220898 - protein, 4 aa, Cryptosporidium parvum
NKYD

SEQ ID NO: 2220899 - protein, 6 aa, Cryptosporidium parvum
NKYDKT

SEQ ID NO: 2220900 - protein, 7 aa, Cryptosporidium parvum
NKYFPGT

SEQ ID NO: 2220901 - protein, 7 aa, Cryptosporidium parvum
NKYLSPP

SEQ ID NO: 2220902 - protein, 14 aa, Cryptosporidium parvum
NKYRQKNNTSFIQN

SEQ ID NO: 2220903 - protein, 10 aa, Cryptosporidium parvum
NLADDDDDIQ

SEQ ID NO: 2220904 - protein, 5 aa, Cryptosporidium parvum
NLCGS

SEQ ID NO: 2220905 - protein, 6 aa, Cryptosporidium parvum
NLDETG

SEQ ID NO: 2220906 - protein, 7 aa, Cryptosporidium parvum
NLDGEEP

SEQ ID NO: 2220907 - protein, 5 aa, Cryptosporidium parvum
NLDNP

SEQ ID NO: 2220908 - protein, 30 aa, Cryptosporidium parvum
NLDNTSINNGNDDGSLGNNNEKCKNYDEFD

SEQ ID NO: 2220909 - protein, 8 aa, Cryptosporidium parvum
NLDPETRT

SEQ ID NO: 2220910 - protein, 12 aa, Cryptosporidium parvum
NLEDDQNTEVKK

SEQ ID NO: 2220911 - protein, 5 aa, Cryptosporidium parvum
NLELE

SEQ ID NO: 2220912 - protein, 7 aa, Cryptosporidium parvum
NLENNGI

SEQ ID NO: 2220913 - protein, 10 aa, Cryptosporidium parvum
NLENPSAATS

SEQ ID NO: 2220914 - protein, 10 aa, Cryptosporidium parvum
NLENVQNKEY

SEQ ID NO: 2220915 - protein, 4 aa, Cryptosporidium parvum
NLES

SEQ ID NO: 2220916 - protein, 73 aa, Cryptosporidium parvum
NLESSEGKDEFERSELTDGEYKEFRESDERSLGSQRTRDQEQSRGQGRGQGQSQNQDQDQNQYYDHGQTQGRD

SEQ ID NO: 2220917 - protein, 5 aa, Cryptosporidium parvum
NLGGG

SEQ ID NO: 2220918 - protein, 10 aa, Cryptosporidium parvum
NLGKSQNNQC

SEQ ID NO: 2220919 - protein, 5 aa, Cryptosporidium parvum
NLGSD

SEQ ID NO: 2220920 - protein, 10 aa, Cryptosporidium parvum
NLGSETSKEK

SEQ ID NO: 2220921 - protein, 8 aa, Cryptosporidium parvum
NLKASKTS

SEQ ID NO: 2220922 - protein, 10 aa, Cryptosporidium parvum
NLKENEACGP

SEQ ID NO: 2220923 - protein, 23 aa, Cryptosporidium parvum
NLKENSKKNENNSISYKEDKSEY

SEQ ID NO: 2220924 - protein, 6 aa, Cryptosporidium parvum
NLKNPG

SEQ ID NO: 2220925 - protein, 7 aa, Cryptosporidium parvum
NLKPPRT

SEQ ID NO: 2220926 - protein, 18 aa, Cryptosporidium parvum
NLKTSTKDSLKSKESPVT

SEQ ID NO: 2220927 - protein, 25 aa, Cryptosporidium parvum
NLLDSNSLNEDSRKETNNKKSKTSD

SEQ ID NO: 2220928 - protein, 6 aa, Cryptosporidium parvum
NLLGPD

SEQ ID NO: 2220929 - protein, 8 aa, Cryptosporidium parvum
NLNEEGST

SEQ ID NO: 2220930 - protein, 10 aa, Cryptosporidium parvum
NLNEKSDSKI

SEQ ID NO: 2220931 - protein, 23 aa, Cryptosporidium parvum
NLNEQNNKKSTIQSSESSSKEQA

SEQ ID NO: 2220932 - protein, 19 aa, Cryptosporidium parvum
NLNEQQETNIDQTNEGKHL

SEQ ID NO: 2220933 - protein, 19 aa, Cryptosporidium parvum
NLNESEKSPFQARKSNSDI

SEQ ID NO: 2220934 - protein, 6 aa, Cryptosporidium parvum
NLNGNI

SEQ ID NO: 2220935 - protein, 8 aa, Cryptosporidium parvum
NLNHNRNA

SEQ ID NO: 2220936 - protein, 5 aa, Cryptosporidium parvum
NLNIG

SEQ ID NO: 2220937 - protein, 6 aa, Cryptosporidium parvum
NLNNNH

SEQ ID NO: 2220938 - protein, 9 aa, Cryptosporidium parvum
NLNNQKGNP

SEQ ID NO: 2220939 - protein, 9 aa, Cryptosporidium parvum
NLNPTNGPI

SEQ ID NO: 2220940 - protein, 16 aa, Cryptosporidium parvum
NLNQDNQDIKDNTGNV

SEQ ID NO: 2220941 - protein, 6 aa, Cryptosporidium parvum
NLNSNS

SEQ ID NO: 2220942 - protein, 19 aa, Cryptosporidium parvum
NLPGKKRSRTFFSMSSRNE

SEQ ID NO: 2220943 - protein, 23 aa, Cryptosporidium parvum
NLPKHSSTVSYSPSSLSSGKNDK

SEQ ID NO: 2220944 - protein, 6 aa, Cryptosporidium parvum
NLPNGK

SEQ ID NO: 2220945 - protein, 19 aa, Cryptosporidium parvum
NLPQENTQVNSGQTSKREI

SEQ ID NO: 2220946 - protein, 12 aa, Cryptosporidium parvum
NLPTTSTSTQAT

SEQ ID NO: 2220947 - protein, 22 aa, Cryptosporidium parvum
NLQDGKNEDYYPGTGIDRNKSR

SEQ ID NO: 2220948 - protein, 8 aa, Cryptosporidium parvum
NLQDSGRR

SEQ ID NO: 2220949 - protein, 20 aa, Cryptosporidium parvum
NLQNSQSTQITNSSSFQTQS

SEQ ID NO: 2220950 - protein, 11 aa, Cryptosporidium parvum
NLRKEEKACQL

SEQ ID NO: 2220951 - protein, 5 aa, Cryptosporidium parvum
NLRPS

SEQ ID NO: 2220952 - protein, 17 aa, Cryptosporidium parvum
NLSAEKEAKSNSNLSSS

SEQ ID NO: 2220953 - protein, 9 aa, Cryptosporidium parvum
NLSGGQRQR

SEQ ID NO: 2220954 - protein, 12 aa, Cryptosporidium parvum
NLSNKDLRDESW

SEQ ID NO: 2220955 - protein, 10 aa, Cryptosporidium parvum
NLSPENTYTE

SEQ ID NO: 2220956 - protein, 13 aa, Cryptosporidium parvum
NLSPYNNSGVYHQ

SEQ ID NO: 2220957 - protein, 9 aa, Cryptosporidium parvum
NLSSTKTSS

SEQ ID NO: 2220958 - protein, 18 aa, Cryptosporidium parvum
NLSTENEKSQLDRSEVRG

SEQ ID NO: 2220959 - protein, 5 aa, Cryptosporidium parvum
NLTDK

SEQ ID NO: 2220960 - protein, 18 aa, Cryptosporidium parvum
NLTKNHGSNYHQKSKSSL

SEQ ID NO: 2220961 - protein, 5 aa, Cryptosporidium parvum
NLTME

SEQ ID NO: 2220962 - protein, 9 aa, Cryptosporidium parvum
NLTNKDDKF

SEQ ID NO: 2220963 - protein, 24 aa, Cryptosporidium parvum
NLTQTKNDQKIAKLGSNNSSRESL

SEQ ID NO: 2220964 - protein, 11 aa, Cryptosporidium parvum
NLTSSPQPEEN

SEQ ID NO: 2220965 - protein, 11 aa, Cryptosporidium parvum
NLTSSPSKRSI

SEQ ID NO: 2220966 - protein, 7 aa, Cryptosporidium parvum
NLVPGGG

SEQ ID NO: 2220967 - protein, 8 aa, Cryptosporidium parvum
NMASKEKP

SEQ ID NO: 2220968 - protein, 11 aa, Cryptosporidium parvum
NMETESMNSGI

SEQ ID NO: 2220969 - protein, 11 aa, Cryptosporidium parvum
NMETTPTHETG

SEQ ID NO: 2220970 - protein, 4 aa, Cryptosporidium parvum
NMIN

SEQ ID NO: 2220971 - protein, 7 aa, Cryptosporidium parvum
NMKGESQ

SEQ ID NO: 2220972 - protein, 20 aa, Cryptosporidium parvum
NMKNHSNQRKQQSSRDISKT

SEQ ID NO: 2220973 - protein, 8 aa, Cryptosporidium parvum
NMKRPSVP

SEQ ID NO: 2220974 - protein, 20 aa, Cryptosporidium parvum
NMNQNTPPIVNSNGNHFNSP

SEQ ID NO: 2220975 - protein, 12 aa, Cryptosporidium parvum
NMNSTSNKKSTL

SEQ ID NO: 2220976 - protein, 8 aa, Cryptosporidium parvum
NMSENTNS

SEQ ID NO: 2220977 - protein, 13 aa, Cryptosporidium parvum
NMSNSTEGIVYEL

SEQ ID NO: 2220978 - protein, 15 aa, Cryptosporidium parvum
NMSSNGSIESPMSNG

SEQ ID NO: 2220979 - protein, 9 aa, Cryptosporidium parvum
NMTQSQRDK

SEQ ID NO: 2220980 - protein, 11 aa, Cryptosporidium parvum
NNADDARDSKK

SEQ ID NO: 2220981 - protein, 4 aa, Cryptosporidium parvum
NNAK

SEQ ID NO: 2220982 - protein, 12 aa, Cryptosporidium parvum
NNANSESVSTAI

SEQ ID NO: 2220983 - protein, 6 aa, Cryptosporidium parvum
NNAQRD

SEQ ID NO: 2220984 - protein, 7 aa, Cryptosporidium parvum
NNASNAL

SEQ ID NO: 2220985 - protein, 16 aa, Cryptosporidium parvum
NNAYNEVSNENATMGK

SEQ ID NO: 2220986 - protein, 14 aa, Cryptosporidium parvum
NNCNNCKKKNDIDS

SEQ ID NO: 2220987 - protein, 9 aa, Cryptosporidium parvum
NNCSESAPN

SEQ ID NO: 2220988 - protein, 11 aa, Cryptosporidium parvum
NNDDDKFNEPA

SEQ ID NO: 2220989 - protein, 22 aa, Cryptosporidium parvum
NNDEEVNEKSKGENNSEIKSES

SEQ ID NO: 2220990 - protein, 11 aa, Cryptosporidium parvum
NNDELKKQAIN

SEQ ID NO: 2220991 - protein, 8 aa, Cryptosporidium parvum
NNDENTKD

SEQ ID NO: 2220992 - protein, 20 aa, Cryptosporidium parvum
NNDKNEQDKSYEDKNENTKL

SEQ ID NO: 2220993 - protein, 4 aa, Cryptosporidium parvum
NNDN

SEQ ID NO: 2220994 - protein, 6 aa, Cryptosporidium parvum
NNDNVN

SEQ ID NO: 2220995 - protein, 8 aa, Cryptosporidium parvum
NNDQSLPS

SEQ ID NO: 2220996 - protein, 17 aa, Cryptosporidium parvum
NNDSEHKNSTKINGKSE

SEQ ID NO: 2220997 - protein, 8 aa, Cryptosporidium parvum
NNDSNSGI

SEQ ID NO: 2220998 - protein, 9 aa, Cryptosporidium parvum
NNDSNYSRA

SEQ ID NO: 2220999 - protein, 7 aa, Cryptosporidium parvum
NNDTETN

SEQ ID NO: 2221000 - protein, 10 aa, Cryptosporidium parvum
NNDYLSSSIN

SEQ ID NO: 2221001 - protein, 4 aa, Cryptosporidium parvum
NNED

SEQ ID NO: 2221002 - protein, 7 aa, Cryptosporidium parvum
NNEDKEE

SEQ ID NO: 2221003 - protein, 5 aa, Cryptosporidium parvum
NNEDL

SEQ ID NO: 2221004 - protein, 6 aa, Cryptosporidium parvum
NNEEYS

SEQ ID NO: 2221005 - protein, 7 aa, Cryptosporidium parvum
NNEGDEA

SEQ ID NO: 2221006 - protein, 6 aa, Cryptosporidium parvum
NNEITS

SEQ ID NO: 2221007 - protein, 13 aa, Cryptosporidium parvum
NNEKETDSAVQHR

SEQ ID NO: 2221008 - protein, 8 aa, Cryptosporidium parvum
NNELGSVK

SEQ ID NO: 2221009 - protein, 13 aa, Cryptosporidium parvum
NNELNKKGEELQI

SEQ ID NO: 2221010 - protein, 9 aa, Cryptosporidium parvum
NNENKGHKD

SEQ ID NO: 2221011 - protein, 8 aa, Cryptosporidium parvum
NNERSNSD

SEQ ID NO: 2221012 - protein, 11 aa, Cryptosporidium parvum
NNESEENISSG

SEQ ID NO: 2221013 - protein, 12 aa, Cryptosporidium parvum
NNESNKVEQTQI

SEQ ID NO: 2221014 - protein, 8 aa, Cryptosporidium parvum
NNETPKME

SEQ ID NO: 2221015 - protein, 4 aa, Cryptosporidium parvum
NNFD

SEQ ID NO: 2221016 - protein, 4 aa, Cryptosporidium parvum
NNFE

SEQ ID NO: 2221017 - protein, 19 aa, Cryptosporidium parvum
NNFEDNKTIEGNKQQHNSI

SEQ ID NO: 2221018 - protein, 17 aa, Cryptosporidium parvum
NNFNDLKESNKIEKDSI

SEQ ID NO: 2221019 - protein, 16 aa, Cryptosporidium parvum
NNFNNSNLDVSMWPVI

SEQ ID NO: 2221020 - protein, 6 aa, Cryptosporidium parvum
NNFSQG

SEQ ID NO: 2221021 - protein, 6 aa, Cryptosporidium parvum
NNGDDH

SEQ ID NO: 2221022 - protein, 11 aa, Cryptosporidium parvum
NNGGGNNRAGI

SEQ ID NO: 2221023 - protein, 5 aa, Cryptosporidium parvum
NNGKD

SEQ ID NO: 2221024 - protein, 11 aa, Cryptosporidium parvum
NNGKERKISEE

SEQ ID NO: 2221025 - protein, 4 aa, Cryptosporidium parvum
NNGL

SEQ ID NO: 2221026 - protein, 7 aa, Cryptosporidium parvum
NNGNENN

SEQ ID NO: 2221027 - protein, 12 aa, Cryptosporidium parvum
NNGNNSNNNNMN

SEQ ID NO: 2221028 - protein, 4 aa, Cryptosporidium parvum
NNGP

SEQ ID NO: 2221029 - protein, 6 aa, Cryptosporidium parvum
NNGQIN

SEQ ID NO: 2221030 - protein, 16 aa, Cryptosporidium parvum
NNGSKLESGSKIKDKF

SEQ ID NO: 2221031 - protein, 6 aa, Cryptosporidium parvum
NNGTRL

SEQ ID NO: 2221032 - protein, 7 aa, Cryptosporidium parvum
NNGTTRY

SEQ ID NO: 2221033 - protein, 5 aa, Cryptosporidium parvum
NNGYD

SEQ ID NO: 2221034 - protein, 5 aa, Cryptosporidium parvum
NNHEN

SEQ ID NO: 2221035 - protein, 8 aa, Cryptosporidium parvum
NNHKTAEN

SEQ ID NO: 2221036 - protein, 4 aa, Cryptosporidium parvum
NNHP

SEQ ID NO: 2221037 - protein, 19 aa, Cryptosporidium parvum
NNHPNSSQTSIITSRTERK

SEQ ID NO: 2221038 - protein, 18 aa, Cryptosporidium parvum
NNHSGMSGTTNNSNTNNV

SEQ ID NO: 2221039 - protein, 34 aa, Cryptosporidium parvum
NNHSRQSNSIKRSSSEHSRLNPANFQANQNNLQQ

SEQ ID NO: 2221040 - protein, 4 aa, Cryptosporidium parvum
NNID

SEQ ID NO: 2221041 - protein, 6 aa, Cryptosporidium parvum
NNIDPS

SEQ ID NO: 2221042 - protein, 4 aa, Cryptosporidium parvum
NNIE

SEQ ID NO: 2221043 - protein, 16 aa, Cryptosporidium parvum
NNIEPKELLSSTTEIN

SEQ ID NO: 2221044 - protein, 16 aa, Cryptosporidium parvum
NNIKNNQRITPDSSGI

SEQ ID NO: 2221045 - protein, 13 aa, Cryptosporidium parvum
NNINLEKKDEAVG

SEQ ID NO: 2221046 - protein, 16 aa, Cryptosporidium parvum
NNINNNHNHDHNTNDN

SEQ ID NO: 2221047 - protein, 14 aa, Cryptosporidium parvum
NNINSGSASNSCSN

SEQ ID NO: 2221048 - protein, 4 aa, Cryptosporidium parvum
NNIP

SEQ ID NO: 2221049 - protein, 13 aa, Cryptosporidium parvum
NNIRTKSRGSSYY

SEQ ID NO: 2221050 - protein, 8 aa, Cryptosporidium parvum
NNISENQP

SEQ ID NO: 2221051 - protein, 7 aa, Cryptosporidium parvum
NNISFSG

SEQ ID NO: 2221052 - protein, 27 aa, Cryptosporidium parvum
NNISSESIQYNTDTCSSPSTIKSITFK

SEQ ID NO: 2221053 - protein, 7 aa, Cryptosporidium parvum
NNITSSS

SEQ ID NO: 2221054 - protein, 5 aa, Cryptosporidium parvum
NNKAL

SEQ ID NO: 2221055 - protein, 11 aa, Cryptosporidium parvum
NNKDLEAESEE

SEQ ID NO: 2221056 - protein, 10 aa, Cryptosporidium parvum
NNKEKIDETF

SEQ ID NO: 2221057 - protein, 11 aa, Cryptosporidium parvum
NNKEQYINEKT

SEQ ID NO: 2221058 - protein, 15 aa, Cryptosporidium parvum
NNKKEISNRKLDNEE

SEQ ID NO: 2221059 - protein, 35 aa, Cryptosporidium parvum
NNKKKETKKDSKLRNESNEINENSNKNKVVNDDFD

SEQ ID NO: 2221060 - protein, 6 aa, Cryptosporidium parvum
NNKKKF

SEQ ID NO: 2221061 - protein, 7 aa, Cryptosporidium parvum
NNKKNKW

SEQ ID NO: 2221062 - protein, 8 aa, Cryptosporidium parvum
NNKKNPSI

SEQ ID NO: 2221063 - protein, 6 aa, Cryptosporidium parvum
NNKKNS

SEQ ID NO: 2221064 - protein, 13 aa, Cryptosporidium parvum
NNKKRERKKSSKL

SEQ ID NO: 2221065 - protein, 6 aa, Cryptosporidium parvum
NNKKRI

SEQ ID NO: 2221066 - protein, 8 aa, Cryptosporidium parvum
NNKKSKGI

SEQ ID NO: 2221067 - protein, 8 aa, Cryptosporidium parvum
NNKKSNHA

SEQ ID NO: 2221068 - protein, 6 aa, Cryptosporidium parvum
NNKMPE

SEQ ID NO: 2221069 - protein, 10 aa, Cryptosporidium parvum
NNKNGMPSSF

SEQ ID NO: 2221070 - protein, 10 aa, Cryptosporidium parvum
NNKNNNYKRP

SEQ ID NO: 2221071 - protein, 8 aa, Cryptosporidium parvum
NNKNPGCP

SEQ ID NO: 2221072 - protein, 8 aa, Cryptosporidium parvum
NNKNSDIK

SEQ ID NO: 2221073 - protein, 6 aa, Cryptosporidium parvum
NNKNTV

SEQ ID NO: 2221074 - protein, 15 aa, Cryptosporidium parvum
NNKPPEDGSDDGKMD

SEQ ID NO: 2221075 - protein, 8 aa, Cryptosporidium parvum
NNKPTKLT

SEQ ID NO: 2221076 - protein, 4 aa, Cryptosporidium parvum
NNKR

SEQ ID NO: 2221077 - protein, 13 aa, Cryptosporidium parvum
NNKSIKISDTTNN

SEQ ID NO: 2221078 - protein, 6 aa, Cryptosporidium parvum
NNKSNI

SEQ ID NO: 2221079 - protein, 12 aa, Cryptosporidium parvum
NNKSSNKNPTSI

SEQ ID NO: 2221080 - protein, 8 aa, Cryptosporidium parvum
NNKSSSQI

SEQ ID NO: 2221081 - protein, 11 aa, Cryptosporidium parvum
NNKSTENAENY

SEQ ID NO: 2221082 - protein, 7 aa, Cryptosporidium parvum
NNKTDNE

SEQ ID NO: 2221083 - protein, 12 aa, Cryptosporidium parvum
NNKYNSSSNHKT

SEQ ID NO: 2221084 - protein, 9 aa, Cryptosporidium parvum
NNKYPNDQF

SEQ ID NO: 2221085 - protein, 18 aa, Cryptosporidium parvum
NNLDTNNDLKNSTASSRS

SEQ ID NO: 2221086 - protein, 10 aa, Cryptosporidium parvum
NNLDTNPTDV

SEQ ID NO: 2221087 - protein, 9 aa, Cryptosporidium parvum
NNLGSSQPL

SEQ ID NO: 2221088 - protein, 9 aa, Cryptosporidium parvum
NNLISNSEN

SEQ ID NO: 2221089 - protein, 9 aa, Cryptosporidium parvum
NNLNDNAEH

SEQ ID NO: 2221090 - protein, 9 aa, Cryptosporidium parvum
NNLRDPDAD

SEQ ID NO: 2221091 - protein, 7 aa, Cryptosporidium parvum
NNLSEGM

SEQ ID NO: 2221092 - protein, 7 aa, Cryptosporidium parvum
NNLSKRK

SEQ ID NO: 2221093 - protein, 10 aa, Cryptosporidium parvum
NNLSNGQRAR

SEQ ID NO: 2221094 - protein, 16 aa, Cryptosporidium parvum
NNLSPCSGCKGSSCTY

SEQ ID NO: 2221095 - protein, 5 aa, Cryptosporidium parvum
NNMEN

SEQ ID NO: 2221096 - protein, 8 aa, Cryptosporidium parvum
NNNATLDE

SEQ ID NO: 2221097 - protein, 33 aa, Cryptosporidium parvum
NNNCSPNERTNYSNIASNRTNFTSRAERRGWRS

SEQ ID NO: 2221098 - protein, 7 aa, Cryptosporidium parvum
NNNDDGN

SEQ ID NO: 2221099 - protein, 52 aa, Cryptosporidium parvum
NNNDINSRQYSSSSSELSKDGELLDPGIGGRINTEDNNNNKNKNEEKSSLIS

SEQ ID NO: 2221100 - protein, 12 aa, Cryptosporidium parvum
NNNDNSNNNSNM

SEQ ID NO: 2221101 - protein, 21 aa, Cryptosporidium parvum
NNNDTKSMDSSGNSDSNNNTD

SEQ ID NO: 2221102 - protein, 10 aa, Cryptosporidium parvum
NNNDTLESSI

SEQ ID NO: 2221103 - protein, 29 aa, Cryptosporidium parvum
NNNFKEEERSENKDTHDKGLDLNTDSDSE

SEQ ID NO: 2221104 - protein, 6 aa, Cryptosporidium parvum
NNNFTR

SEQ ID NO: 2221105 - protein, 18 aa, Cryptosporidium parvum
NNNHEEKENIKDDQLDNK

SEQ ID NO: 2221106 - protein, 41 aa, Cryptosporidium parvum
NNNINNNHNNRNNHHNHDNNKFSNLNNGISSSNISSSISES

SEQ ID NO: 2221107 - protein, 28 aa, Cryptosporidium parvum
NNNIQDTNEDEGVTSNNKKMINKNQDDY

SEQ ID NO: 2221108 - protein, 40 aa, Cryptosporidium parvum
NNNISNNGNSNNNSNNNHINNNNNNINNNTINNNNNSGIG

SEQ ID NO: 2221109 - protein, 9 aa, Cryptosporidium parvum
NNNITGNSH

SEQ ID NO: 2221110 - protein, 5 aa, Cryptosporidium parvum
NNNKG

SEQ ID NO: 2221111 - protein, 6 aa, Cryptosporidium parvum
NNNKLG

SEQ ID NO: 2221112 - protein, 10 aa, Cryptosporidium parvum
NNNKLNNSYK

SEQ ID NO: 2221113 - protein, 24 aa, Cryptosporidium parvum
NNNLNQEKKNMSINNSNQKMVNNG

SEQ ID NO: 2221114 - protein, 6 aa, Cryptosporidium parvum
NNNLNR

SEQ ID NO: 2221115 - protein, 5 aa, Cryptosporidium parvum
NNNMK

SEQ ID NO: 2221116 - protein, 12 aa, Cryptosporidium parvum
NNNMSGQKPQYG

SEQ ID NO: 2221117 - protein, 5 aa, Cryptosporidium parvum
NNNNC

SEQ ID NO: 2221118 - protein, 6 aa, Cryptosporidium parvum
NNNNKD

SEQ ID NO: 2221119 - protein, 6 aa, Cryptosporidium parvum
NNNNMN

SEQ ID NO: 2221120 - protein, 5 aa, Cryptosporidium parvum
NNNNN

SEQ ID NO: 2221121 - protein, 6 aa, Cryptosporidium parvum
NNNNNI

SEQ ID NO: 2221122 - protein, 10 aa, Cryptosporidium parvum
NNNNNNITDE

SEQ ID NO: 2221123 - protein, 8 aa, Cryptosporidium parvum
NNNNNNKY

SEQ ID NO: 2221124 - protein, 9 aa, Cryptosporidium parvum
NNNNNNNID

SEQ ID NO: 2221125 - protein, 9 aa, Cryptosporidium parvum
NNNNNNNNH

SEQ ID NO: 2221126 - protein, 12 aa, Cryptosporidium parvum
NNNNNNNNNDTL

SEQ ID NO: 2221127 - protein, 15 aa, Cryptosporidium parvum
NNNNNNNNNNNITGG

SEQ ID NO: 2221128 - protein, 16 aa, Cryptosporidium parvum
NNNNNNNNNNNNNRRN

SEQ ID NO: 2221129 - protein, 30 aa, Cryptosporidium parvum
NNNNNNNNNNNNTSNHHNKIQNKRNSNMQL

SEQ ID NO: 2221130 - protein, 17 aa, Cryptosporidium parvum
NNNNNSNININNSGNGY

SEQ ID NO: 2221131 - protein, 7 aa, Cryptosporidium parvum
NNNNQNN

SEQ ID NO: 2221132 - protein, 21 aa, Cryptosporidium parvum
NNNNSGTTTTTTLTDKNDEIA

SEQ ID NO: 2221133 - protein, 10 aa, Cryptosporidium parvum
NNNQNNNKKE

SEQ ID NO: 2221134 - protein, 8 aa, Cryptosporidium parvum
NNNQQISR

SEQ ID NO: 2221135 - protein, 17 aa, Cryptosporidium parvum
NNNSGAKTHYKEESDNW

SEQ ID NO: 2221136 - protein, 9 aa, Cryptosporidium parvum
NNNSGTTQD

SEQ ID NO: 2221137 - protein, 8 aa, Cryptosporidium parvum
NNNSHGIG

SEQ ID NO: 2221138 - protein, 12 aa, Cryptosporidium parvum
NNNSINNNVRSK

SEQ ID NO: 2221139 - protein, 9 aa, Cryptosporidium parvum
NNNSNISRS

SEQ ID NO: 2221140 - protein, 7 aa, Cryptosporidium parvum
NNNSQCD

SEQ ID NO: 2221141 - protein, 9 aa, Cryptosporidium parvum
NNNSTSASF

SEQ ID NO: 2221142 - protein, 8 aa, Cryptosporidium parvum
NNNTYPCS

SEQ ID NO: 2221143 - protein, 10 aa, Cryptosporidium parvum
NNNVDNWERT

SEQ ID NO: 2221144 - protein, 16 aa, Cryptosporidium parvum
NNNYSPSTGRSPDTLT

SEQ ID NO: 2221145 - protein, 7 aa, Cryptosporidium parvum
NNPCTEN

SEQ ID NO: 2221146 - protein, 8 aa, Cryptosporidium parvum
NNPESKRI

SEQ ID NO: 2221147 - protein, 5 aa, Cryptosporidium parvum
NNPEY

SEQ ID NO: 2221148 - protein, 8 aa, Cryptosporidium parvum
NNPISNDG

SEQ ID NO: 2221149 - protein, 11 aa, Cryptosporidium parvum
NNPISSDKNNA

SEQ ID NO: 2221150 - protein, 4 aa, Cryptosporidium parvum
NNPK

SEQ ID NO: 2221151 - protein, 16 aa, Cryptosporidium parvum
NNPKIKSREKKVSGWD

SEQ ID NO: 2221152 - protein, 7 aa, Cryptosporidium parvum
NNPNDIS

SEQ ID NO: 2221153 - protein, 14 aa, Cryptosporidium parvum
NNPNLQAPKTPEEI

SEQ ID NO: 2221154 - protein, 6 aa, Cryptosporidium parvum
NNPNSP

SEQ ID NO: 2221155 - protein, 24 aa, Cryptosporidium parvum
NNPNSSVVSKSKITDNISNNPLLA

SEQ ID NO: 2221156 - protein, 9 aa, Cryptosporidium parvum
NNPSEGGLK

SEQ ID NO: 2221157 - protein, 7 aa, Cryptosporidium parvum
NNPSNST

SEQ ID NO: 2221158 - protein, 8 aa, Cryptosporidium parvum
NNPTSTQK

SEQ ID NO: 2221159 - protein, 7 aa, Cryptosporidium parvum
NNPYYKN

SEQ ID NO: 2221160 - protein, 5 aa, Cryptosporidium parvum
NNQAD

SEQ ID NO: 2221161 - protein, 8 aa, Cryptosporidium parvum
NNQDNSQS

SEQ ID NO: 2221162 - protein, 31 aa, Cryptosporidium parvum
NNQEQPPNPAPAAKEVPNRSRNLEKKPKHRL

SEQ ID NO: 2221163 - protein, 4 aa, Cryptosporidium parvum
NNQG

SEQ ID NO: 2221164 - protein, 5 aa, Cryptosporidium parvum
NNQGK

SEQ ID NO: 2221165 - protein, 7 aa, Cryptosporidium parvum
NNQLGGI

SEQ ID NO: 2221166 - protein, 6 aa, Cryptosporidium parvum
NNQNPD

SEQ ID NO: 2221167 - protein, 9 aa, Cryptosporidium parvum
NNQNSQNTV

SEQ ID NO: 2221168 - protein, 8 aa, Cryptosporidium parvum
NNQPISDK

SEQ ID NO: 2221169 - protein, 18 aa, Cryptosporidium parvum
NNQQPQNNNTSVDTQNCS

SEQ ID NO: 2221170 - protein, 11 aa, Cryptosporidium parvum
NNQREIQNQPN

SEQ ID NO: 2221171 - protein, 12 aa, Cryptosporidium parvum
NNQSISNGKYLY

SEQ ID NO: 2221172 - protein, 10 aa, Cryptosporidium parvum
NNQVSEGEYE

SEQ ID NO: 2221173 - protein, 5 aa, Cryptosporidium parvum
NNREL

SEQ ID NO: 2221174 - protein, 7 aa, Cryptosporidium parvum
NNRKSYE

SEQ ID NO: 2221175 - protein, 9 aa, Cryptosporidium parvum
NNRNATKSA

SEQ ID NO: 2221176 - protein, 17 aa, Cryptosporidium parvum
NNRNLQQNNNEKKYDDQ

SEQ ID NO: 2221177 - protein, 6 aa, Cryptosporidium parvum
NNRPSR

SEQ ID NO: 2221178 - protein, 12 aa, Cryptosporidium parvum
NNRQSQSSNIRG

SEQ ID NO: 2221179 - protein, 7 aa, Cryptosporidium parvum
NNRRVNS

SEQ ID NO: 2221180 - protein, 8 aa, Cryptosporidium parvum
NNSAINNS

SEQ ID NO: 2221181 - protein, 38 aa, Cryptosporidium parvum
NNSDISTSKIDTRKIGDEKEFKEENQVKDNTENDGCNS

SEQ ID NO: 2221182 - protein, 6 aa, Cryptosporidium parvum
NNSDKV

SEQ ID NO: 2221183 - protein, 4 aa, Cryptosporidium parvum
NNSE

SEQ ID NO: 2221184 - protein, 8 aa, Cryptosporidium parvum
NNSEDNIE

SEQ ID NO: 2221185 - protein, 6 aa, Cryptosporidium parvum
NNSEGG

SEQ ID NO: 2221186 - protein, 6 aa, Cryptosporidium parvum
NNSENK

SEQ ID NO: 2221187 - protein, 8 aa, Cryptosporidium parvum
NNSENLEK

SEQ ID NO: 2221188 - protein, 7 aa, Cryptosporidium parvum
NNSFGRK

SEQ ID NO: 2221189 - protein, 5 aa, Cryptosporidium parvum
NNSFS

SEQ ID NO: 2221190 - protein, 7 aa, Cryptosporidium parvum
NNSGNDQ

SEQ ID NO: 2221191 - protein, 8 aa, Cryptosporidium parvum
NNSHVENQ

SEQ ID NO: 2221192 - protein, 11 aa, Cryptosporidium parvum
NNSIQEESIQN

SEQ ID NO: 2221193 - protein, 18 aa, Cryptosporidium parvum
NNSKEINNNSHISTTPND

SEQ ID NO: 2221194 - protein, 5 aa, Cryptosporidium parvum
NNSKI

SEQ ID NO: 2221195 - protein, 9 aa, Cryptosporidium parvum
NNSKTSSLN

SEQ ID NO: 2221196 - protein, 31 aa, Cryptosporidium parvum
NNSLNHKSTNTDEKFTKRERRKIDKSKLSMS

SEQ ID NO: 2221197 - protein, 7 aa, Cryptosporidium parvum
NNSLNTE

SEQ ID NO: 2221198 - protein, 5 aa, Cryptosporidium parvum
NNSLQ

SEQ ID NO: 2221199 - protein, 5 aa, Cryptosporidium parvum
NNSLR

SEQ ID NO: 2221200 - protein, 11 aa, Cryptosporidium parvum
NNSNDTGTDFN

SEQ ID NO: 2221201 - protein, 14 aa, Cryptosporidium parvum
NNSNETKKQKSPHS

SEQ ID NO: 2221202 - protein, 9 aa, Cryptosporidium parvum
NNSNKKKQI

SEQ ID NO: 2221203 - protein, 16 aa, Cryptosporidium parvum
NNSNKNEVGENGDSMR

SEQ ID NO: 2221204 - protein, 9 aa, Cryptosporidium parvum
NNSNKNFSK

SEQ ID NO: 2221205 - protein, 10 aa, Cryptosporidium parvum
NNSNLNYSYS

SEQ ID NO: 2221206 - protein, 6 aa, Cryptosporidium parvum
NNSNNK

SEQ ID NO: 2221207 - protein, 11 aa, Cryptosporidium parvum
NNSNNNSNNGC

SEQ ID NO: 2221208 - protein, 6 aa, Cryptosporidium parvum
NNSNNS

SEQ ID NO: 2221209 - protein, 19 aa, Cryptosporidium parvum
NNSNNSKQITSGLGENLSS

SEQ ID NO: 2221210 - protein, 10 aa, Cryptosporidium parvum
NNSNRRNQDF

SEQ ID NO: 2221211 - protein, 12 aa, Cryptosporidium parvum
NNSNSDIGATNY

SEQ ID NO: 2221212 - protein, 5 aa, Cryptosporidium parvum
NNSNV

SEQ ID NO: 2221213 - protein, 9 aa, Cryptosporidium parvum
NNSNYSLEG

SEQ ID NO: 2221214 - protein, 7 aa, Cryptosporidium parvum
NNSPWNK

SEQ ID NO: 2221215 - protein, 14 aa, Cryptosporidium parvum
NNSQENGNNQPNQL

SEQ ID NO: 2221216 - protein, 9 aa, Cryptosporidium parvum
NNSQIQGNV

SEQ ID NO: 2221217 - protein, 12 aa, Cryptosporidium parvum
NNSQSGSSFSTS

SEQ ID NO: 2221218 - protein, 9 aa, Cryptosporidium parvum
NNSRPNINN

SEQ ID NO: 2221219 - protein, 6 aa, Cryptosporidium parvum
NNSRQN

SEQ ID NO: 2221220 - protein, 9 aa, Cryptosporidium parvum
NNSRRATKR

SEQ ID NO: 2221221 - protein, 4 aa, Cryptosporidium parvum
NNSS

SEQ ID NO: 2221222 - protein, 10 aa, Cryptosporidium parvum
NNSSKEIKIN

SEQ ID NO: 2221223 - protein, 17 aa, Cryptosporidium parvum
NNSSNNNDNGNNKNETF

SEQ ID NO: 2221224 - protein, 14 aa, Cryptosporidium parvum
NNSSRRNSSARQSI

SEQ ID NO: 2221225 - protein, 9 aa, Cryptosporidium parvum
NNSSSSDPV

SEQ ID NO: 2221226 - protein, 14 aa, Cryptosporidium parvum
NNSTPLIDSNSNFN

SEQ ID NO: 2221227 - protein, 6 aa, Cryptosporidium parvum
NNSTRK

SEQ ID NO: 2221228 - protein, 7 aa, Cryptosporidium parvum
NNSTSNI

SEQ ID NO: 2221229 - protein, 7 aa, Cryptosporidium parvum
NNSWNED

SEQ ID NO: 2221230 - protein, 22 aa, Cryptosporidium parvum
NNTEAGYLKSNDNGEASSDERS

SEQ ID NO: 2221231 - protein, 5 aa, Cryptosporidium parvum
NNTEQ

SEQ ID NO: 2221232 - protein, 7 aa, Cryptosporidium parvum
NNTEVSS

SEQ ID NO: 2221233 - protein, 30 aa, Cryptosporidium parvum
NNTFGNENFTQNKDHTRNDPSGQERSHQKH

SEQ ID NO: 2221234 - protein, 7 aa, Cryptosporidium parvum
NNTGHEQ

SEQ ID NO: 2221235 - protein, 10 aa, Cryptosporidium parvum
NNTIRSKQSQ

SEQ ID NO: 2221236 - protein, 4 aa, Cryptosporidium parvum
NNTK

SEQ ID NO: 2221237 - protein, 7 aa, Cryptosporidium parvum
NNTKEMK

SEQ ID NO: 2221238 - protein, 8 aa, Cryptosporidium parvum
NNTKLNYN

SEQ ID NO: 2221239 - protein, 5 aa, Cryptosporidium parvum
NNTKT

SEQ ID NO: 2221240 - protein, 4 aa, Cryptosporidium parvum
NNTL

SEQ ID NO: 2221241 - protein, 6 aa, Cryptosporidium parvum
NNTNKK

SEQ ID NO: 2221242 - protein, 12 aa, Cryptosporidium parvum
NNTNSGSCPNGV

SEQ ID NO: 2221243 - protein, 24 aa, Cryptosporidium parvum
NNTNSSLYTHENNTTYISGSPTLN

SEQ ID NO: 2221244 - protein, 34 aa, Cryptosporidium parvum
NNTNSTKGGIKLNSNGTSIVKSNNNGSNNSNLRE

SEQ ID NO: 2221245 - protein, 8 aa, Cryptosporidium parvum
NNTPNSDS

SEQ ID NO: 2221246 - protein, 7 aa, Cryptosporidium parvum
NNTPPPL

SEQ ID NO: 2221247 - protein, 12 aa, Cryptosporidium parvum
NNTQINSDQSKF

SEQ ID NO: 2221248 - protein, 17 aa, Cryptosporidium parvum
NNTQTESNSFKNSPNNL

SEQ ID NO: 2221249 - protein, 4 aa, Cryptosporidium parvum
NNTR

SEQ ID NO: 2221250 - protein, 4 aa, Cryptosporidium parvum
NNTS

SEQ ID NO: 2221251 - protein, 8 aa, Cryptosporidium parvum
NNTSDKID

SEQ ID NO: 2221252 - protein, 6 aa, Cryptosporidium parvum
NNTSDW

SEQ ID NO: 2221253 - protein, 10 aa, Cryptosporidium parvum
NNTSQNNKSC

SEQ ID NO: 2221254 - protein, 6 aa, Cryptosporidium parvum
NNVDAP

SEQ ID NO: 2221255 - protein, 17 aa, Cryptosporidium parvum
NNVEKEKNNLENEEYEK

SEQ ID NO: 2221256 - protein, 4 aa, Cryptosporidium parvum
NNVN

SEQ ID NO: 2221257 - protein, 7 aa, Cryptosporidium parvum
NNVNNST

SEQ ID NO: 2221258 - protein, 4 aa, Cryptosporidium parvum
NNVS

SEQ ID NO: 2221259 - protein, 6 aa, Cryptosporidium parvum
NNVSKA

SEQ ID NO: 2221260 - protein, 9 aa, Cryptosporidium parvum
NNVSPGEYS

SEQ ID NO: 2221261 - protein, 5 aa, Cryptosporidium parvum
NNYDN

SEQ ID NO: 2221262 - protein, 14 aa, Cryptosporidium parvum
NNYDSNSGDRNANS

SEQ ID NO: 2221263 - protein, 8 aa, Cryptosporidium parvum
NNYIDSET

SEQ ID NO: 2221264 - protein, 8 aa, Cryptosporidium parvum
NNYKNNNI

SEQ ID NO: 2221265 - protein, 18 aa, Cryptosporidium parvum
NNYNTNYSKNVNSPGIKG

SEQ ID NO: 2221266 - protein, 4 aa, Cryptosporidium parvum
NNYP

SEQ ID NO: 2221267 - protein, 8 aa, Cryptosporidium parvum
NNYPELNT

SEQ ID NO: 2221268 - protein, 9 aa, Cryptosporidium parvum
NNYRDTSSL

SEQ ID NO: 2221269 - protein, 9 aa, Cryptosporidium parvum
NNYSAYKDN

SEQ ID NO: 2221270 - protein, 14 aa, Cryptosporidium parvum
NNYSGNNGKGMATS

SEQ ID NO: 2221271 - protein, 10 aa, Cryptosporidium parvum
NNYTGKETLG

SEQ ID NO: 2221272 - protein, 23 aa, Cryptosporidium parvum
NNYTNDDKHIRDSPNQNLPQIPD

SEQ ID NO: 2221273 - protein, 5 aa, Cryptosporidium parvum
NNYYN

SEQ ID NO: 2221274 - protein, 5 aa, Cryptosporidium parvum
NPAIS

SEQ ID NO: 2221275 - protein, 6 aa, Cryptosporidium parvum
NPAISK

SEQ ID NO: 2221276 - protein, 19 aa, Cryptosporidium parvum
NPAPKHSVTAAGISSVTNG

SEQ ID NO: 2221277 - protein, 4 aa, Cryptosporidium parvum
NPCK

SEQ ID NO: 2221278 - protein, 9 aa, Cryptosporidium parvum
NPDDPRGHE

SEQ ID NO: 2221279 - protein, 6 aa, Cryptosporidium parvum
NPDEPA

SEQ ID NO: 2221280 - protein, 12 aa, Cryptosporidium parvum
NPDSIKNDSEFP

SEQ ID NO: 2221281 - protein, 8 aa, Cryptosporidium parvum
NPDSKMED

SEQ ID NO: 2221282 - protein, 13 aa, Cryptosporidium parvum
NPEADNSGASASD

SEQ ID NO: 2221283 - protein, 7 aa, Cryptosporidium parvum
NPEAEVK

SEQ ID NO: 2221284 - protein, 18 aa, Cryptosporidium parvum
NPEDPNYTNGVPTSTSID

SEQ ID NO: 2221285 - protein, 4 aa, Cryptosporidium parvum
NPEE

SEQ ID NO: 2221286 - protein, 7 aa, Cryptosporidium parvum
NPEEEPE

SEQ ID NO: 2221287 - protein, 8 aa, Cryptosporidium parvum
NPEGGGGF

SEQ ID NO: 2221288 - protein, 4 aa, Cryptosporidium parvum
NPEH

SEQ ID NO: 2221289 - protein, 8 aa, Cryptosporidium parvum
NPEKDQPN

SEQ ID NO: 2221290 - protein, 8 aa, Cryptosporidium parvum
NPENNLPS

SEQ ID NO: 2221291 - protein, 8 aa, Cryptosporidium parvum
NPENSLNT

SEQ ID NO: 2221292 - protein, 6 aa, Cryptosporidium parvum
NPENWD

SEQ ID NO: 2221293 - protein, 21 aa, Cryptosporidium parvum
NPESAGPRPPGVQATPQTSPF

SEQ ID NO: 2221294 - protein, 6 aa, Cryptosporidium parvum
NPESKI

SEQ ID NO: 2221295 - protein, 7 aa, Cryptosporidium parvum
NPESNYK

SEQ ID NO: 2221296 - protein, 5 aa, Cryptosporidium parvum
NPETG

SEQ ID NO: 2221297 - protein, 5 aa, Cryptosporidium parvum
NPFND

SEQ ID NO: 2221298 - protein, 7 aa, Cryptosporidium parvum
NPFRTTP

SEQ ID NO: 2221299 - protein, 6 aa, Cryptosporidium parvum
NPGQPF

SEQ ID NO: 2221300 - protein, 5 aa, Cryptosporidium parvum
NPGTV

SEQ ID NO: 2221301 - protein, 5 aa, Cryptosporidium parvum
NPGYD

SEQ ID NO: 2221302 - protein, 10 aa, Cryptosporidium parvum
NPGYSEEDSL

SEQ ID NO: 2221303 - protein, 7 aa, Cryptosporidium parvum
NPHRDDR

SEQ ID NO: 2221304 - protein, 5 aa, Cryptosporidium parvum
NPHSH

SEQ ID NO: 2221305 - protein, 8 aa, Cryptosporidium parvum
NPIDESGN

SEQ ID NO: 2221306 - protein, 9 aa, Cryptosporidium parvum
NPIKRQKNQ

SEQ ID NO: 2221307 - protein, 16 aa, Cryptosporidium parvum
NPKANFDSKFPPNSSK

SEQ ID NO: 2221308 - protein, 8 aa, Cryptosporidium parvum
NPKKDSRL

SEQ ID NO: 2221309 - protein, 6 aa, Cryptosporidium parvum
NPKKGR

SEQ ID NO: 2221310 - protein, 6 aa, Cryptosporidium parvum
NPKNVE

SEQ ID NO: 2221311 - protein, 13 aa, Cryptosporidium parvum
NPKRKDFGSSNNL

SEQ ID NO: 2221312 - protein, 5 aa, Cryptosporidium parvum
NPKSI

SEQ ID NO: 2221313 - protein, 5 aa, Cryptosporidium parvum
NPKST

SEQ ID NO: 2221314 - protein, 4 aa, Cryptosporidium parvum
NPKT

SEQ ID NO: 2221315 - protein, 8 aa, Cryptosporidium parvum
NPKTCYGG

SEQ ID NO: 2221316 - protein, 62 aa, Cryptosporidium parvum
NPLAGASPAGAAANPMAAASPGAAIAAAPGAVPGATPGAAAGATPGAVAGATPGAPAAVGGM

SEQ ID NO: 2221317 - protein, 5 aa, Cryptosporidium parvum
NPLKK

SEQ ID NO: 2221318 - protein, 21 aa, Cryptosporidium parvum
NPLLSTNNSPTNRQSKDSSLN

SEQ ID NO: 2221319 - protein, 8 aa, Cryptosporidium parvum
NPLSPGQK

SEQ ID NO: 2221320 - protein, 15 aa, Cryptosporidium parvum
NPMPAGGNEETRQEG

SEQ ID NO: 2221321 - protein, 20 aa, Cryptosporidium parvum
NPNDVPDNSGKKECNKPQLD

SEQ ID NO: 2221322 - protein, 13 aa, Cryptosporidium parvum
NPNESNSNENNYF

SEQ ID NO: 2221323 - protein, 14 aa, Cryptosporidium parvum
NPNETQEANLSDGL

SEQ ID NO: 2221324 - protein, 4 aa, Cryptosporidium parvum
NPNG

SEQ ID NO: 2221325 - protein, 19 aa, Cryptosporidium parvum
NPNGLNKGDLNFSNKKDNN

SEQ ID NO: 2221326 - protein, 4 aa, Cryptosporidium parvum
NPNH

SEQ ID NO: 2221327 - protein, 7 aa, Cryptosporidium parvum
NPNHSKV

SEQ ID NO: 2221328 - protein, 36 aa, Cryptosporidium parvum
NPNINPSQPSSSHNSLQTTSVNNGGVNNSSLSSSSN

SEQ ID NO: 2221329 - protein, 6 aa, Cryptosporidium parvum
NPNISP

SEQ ID NO: 2221330 - protein, 8 aa, Cryptosporidium parvum
NPNKSPGI

SEQ ID NO: 2221331 - protein, 9 aa, Cryptosporidium parvum
NPNMKGENE

SEQ ID NO: 2221332 - protein, 8 aa, Cryptosporidium parvum
NPNPPSPT

SEQ ID NO: 2221333 - protein, 10 aa, Cryptosporidium parvum
NPNPRNKKVD

SEQ ID NO: 2221334 - protein, 5 aa, Cryptosporidium parvum
NPNQI

SEQ ID NO: 2221335 - protein, 9 aa, Cryptosporidium parvum
NPNQNSKIA

SEQ ID NO: 2221336 - protein, 6 aa, Cryptosporidium parvum
NPNQQG

SEQ ID NO: 2221337 - protein, 7 aa, Cryptosporidium parvum
NPNSLNS

SEQ ID NO: 2221338 - protein, 6 aa, Cryptosporidium parvum
NPNYRN

SEQ ID NO: 2221339 - protein, 5 aa, Cryptosporidium parvum
NPPEL

SEQ ID NO: 2221340 - protein, 7 aa, Cryptosporidium parvum
NPPETIS

SEQ ID NO: 2221341 - protein, 5 aa, Cryptosporidium parvum
NPPIL

SEQ ID NO: 2221342 - protein, 8 aa, Cryptosporidium parvum
NPPNYSGN

SEQ ID NO: 2221343 - protein, 4 aa, Cryptosporidium parvum
NPPQ

SEQ ID NO: 2221344 - protein, 6 aa, Cryptosporidium parvum
NPPTVE

SEQ ID NO: 2221345 - protein, 6 aa, Cryptosporidium parvum
NPPVEP

SEQ ID NO: 2221346 - protein, 14 aa, Cryptosporidium parvum
NPQQNTGNLASGGS

SEQ ID NO: 2221347 - protein, 4 aa, Cryptosporidium parvum
NPQY

SEQ ID NO: 2221348 - protein, 5 aa, Cryptosporidium parvum
NPRGS

SEQ ID NO: 2221349 - protein, 25 aa, Cryptosporidium parvum
NPRHTHYSRKSPKNHLSENFNSNNT

SEQ ID NO: 2221350 - protein, 5 aa, Cryptosporidium parvum
NPRIQ

SEQ ID NO: 2221351 - protein, 12 aa, Cryptosporidium parvum
NPRKGRVENRAQ

SEQ ID NO: 2221352 - protein, 6 aa, Cryptosporidium parvum
NPRMPP

SEQ ID NO: 2221353 - protein, 11 aa, Cryptosporidium parvum
NPRNSNDQNSS

SEQ ID NO: 2221354 - protein, 5 aa, Cryptosporidium parvum
NPRNY

SEQ ID NO: 2221355 - protein, 9 aa, Cryptosporidium parvum
NPRPINENS

SEQ ID NO: 2221356 - protein, 4 aa, Cryptosporidium parvum
NPSE

SEQ ID NO: 2221357 - protein, 14 aa, Cryptosporidium parvum
NPSGDYGKRELSPA

SEQ ID NO: 2221358 - protein, 5 aa, Cryptosporidium parvum
NPSIS

SEQ ID NO: 2221359 - protein, 4 aa, Cryptosporidium parvum
NPSK

SEQ ID NO: 2221360 - protein, 5 aa, Cryptosporidium parvum
NPSKF

SEQ ID NO: 2221361 - protein, 8 aa, Cryptosporidium parvum
NPSKHNEQ

SEQ ID NO: 2221362 - protein, 5 aa, Cryptosporidium parvum
NPSKT

SEQ ID NO: 2221363 - protein, 5 aa, Cryptosporidium parvum
NPSLY

SEQ ID NO: 2221364 - protein, 4 aa, Cryptosporidium parvum
NPSM

SEQ ID NO: 2221365 - protein, 6 aa, Cryptosporidium parvum
NPSRKK

SEQ ID NO: 2221366 - protein, 8 aa, Cryptosporidium parvum
NPSRNTPQ

SEQ ID NO: 2221367 - protein, 6 aa, Cryptosporidium parvum
NPSSAI

SEQ ID NO: 2221368 - protein, 10 aa, Cryptosporidium parvum
NPTENRNRED

SEQ ID NO: 2221369 - protein, 4 aa, Cryptosporidium parvum
NPTF

SEQ ID NO: 2221370 - protein, 4 aa, Cryptosporidium parvum
NPTI

SEQ ID NO: 2221371 - protein, 4 aa, Cryptosporidium parvum
NPTL

SEQ ID NO: 2221372 - protein, 13 aa, Cryptosporidium parvum
NPTLDNSLSRKNG

SEQ ID NO: 2221373 - protein, 10 aa, Cryptosporidium parvum
NPTPGGYKAT

SEQ ID NO: 2221374 - protein, 6 aa, Cryptosporidium parvum
NPTPIN

SEQ ID NO: 2221375 - protein, 15 aa, Cryptosporidium parvum
NPTPTPSATSPSKTL

SEQ ID NO: 2221376 - protein, 5 aa, Cryptosporidium parvum
NPTTS

SEQ ID NO: 2221377 - protein, 6 aa, Cryptosporidium parvum
NPVTNT

SEQ ID NO: 2221378 - protein, 10 aa, Cryptosporidium parvum
NPYDHTSTNE

SEQ ID NO: 2221379 - protein, 19 aa, Cryptosporidium parvum
NPYNSINKEKPKFSHQDSE

SEQ ID NO: 2221380 - protein, 13 aa, Cryptosporidium parvum
NPYQNQINSPSSF

SEQ ID NO: 2221381 - protein, 14 aa, Cryptosporidium parvum
NPYQQTQNQGQYHS

SEQ ID NO: 2221382 - protein, 8 aa, Cryptosporidium parvum
NQAEGDVE

SEQ ID NO: 2221383 - protein, 7 aa, Cryptosporidium parvum
NQAESKL

SEQ ID NO: 2221384 - protein, 4 aa, Cryptosporidium parvum
NQAG

SEQ ID NO: 2221385 - protein, 14 aa, Cryptosporidium parvum
NQARMQDGKGLSSS

SEQ ID NO: 2221386 - protein, 4 aa, Cryptosporidium parvum
NQAV

SEQ ID NO: 2221387 - protein, 19 aa, Cryptosporidium parvum
NQDGKTTTLTAPKGPSQVS

SEQ ID NO: 2221388 - protein, 6 aa, Cryptosporidium parvum
NQDGNG

SEQ ID NO: 2221389 - protein, 11 aa, Cryptosporidium parvum
NQDKNLTKSVA

SEQ ID NO: 2221390 - protein, 10 aa, Cryptosporidium parvum
NQDNKKSMKL

SEQ ID NO: 2221391 - protein, 9 aa, Cryptosporidium parvum
NQDPNTLKS

SEQ ID NO: 2221392 - protein, 4 aa, Cryptosporidium parvum
NQDQ

SEQ ID NO: 2221393 - protein, 9 aa, Cryptosporidium parvum
NQDSKVPKL

SEQ ID NO: 2221394 - protein, 4 aa, Cryptosporidium parvum
NQDT

SEQ ID NO: 2221395 - protein, 8 aa, Cryptosporidium parvum
NQEDDESF

SEQ ID NO: 2221396 - protein, 5 aa, Cryptosporidium parvum
NQEFY

SEQ ID NO: 2221397 - protein, 6 aa, Cryptosporidium parvum
NQENFK

SEQ ID NO: 2221398 - protein, 5 aa, Cryptosporidium parvum
NQENI

SEQ ID NO: 2221399 - protein, 6 aa, Cryptosporidium parvum
NQENNS

SEQ ID NO: 2221400 - protein, 23 aa, Cryptosporidium parvum
NQEPSANATNEEKLESENSKSSV

SEQ ID NO: 2221401 - protein, 13 aa, Cryptosporidium parvum
NQEQNNSSGTSFK

SEQ ID NO: 2221402 - protein, 14 aa, Cryptosporidium parvum
NQETKEAKEAQDGN

SEQ ID NO: 2221403 - protein, 5 aa, Cryptosporidium parvum
NQFDN

SEQ ID NO: 2221404 - protein, 5 aa, Cryptosporidium parvum
NQGEF

SEQ ID NO: 2221405 - protein, 5 aa, Cryptosporidium parvum
NQGTL

SEQ ID NO: 2221406 - protein, 6 aa, Cryptosporidium parvum
NQHLKT

SEQ ID NO: 2221407 - protein, 17 aa, Cryptosporidium parvum
NQIEDDNPIQGTTPYIS

SEQ ID NO: 2221408 - protein, 14 aa, Cryptosporidium parvum
NQIEENSSGRIQAY

SEQ ID NO: 2221409 - protein, 5 aa, Cryptosporidium parvum
NQIEL

SEQ ID NO: 2221410 - protein, 6 aa, Cryptosporidium parvum
NQIGSN

SEQ ID NO: 2221411 - protein, 12 aa, Cryptosporidium parvum
NQINGSPSSSFS

SEQ ID NO: 2221412 - protein, 13 aa, Cryptosporidium parvum
NQISNKQEDQQNN

SEQ ID NO: 2221413 - protein, 6 aa, Cryptosporidium parvum
NQISSD

SEQ ID NO: 2221414 - protein, 12 aa, Cryptosporidium parvum
NQKENESSTIES

SEQ ID NO: 2221415 - protein, 11 aa, Cryptosporidium parvum
NQKESNSSKLV

SEQ ID NO: 2221416 - protein, 7 aa, Cryptosporidium parvum
NQKKNSR

SEQ ID NO: 2221417 - protein, 6 aa, Cryptosporidium parvum
NQKNIS

SEQ ID NO: 2221418 - protein, 6 aa, Cryptosporidium parvum
NQKNNK

SEQ ID NO: 2221419 - protein, 10 aa, Cryptosporidium parvum
NQKNSNGDSL

SEQ ID NO: 2221420 - protein, 12 aa, Cryptosporidium parvum
NQLNETKNINKA

SEQ ID NO: 2221421 - protein, 6 aa, Cryptosporidium parvum
NQLNSL

SEQ ID NO: 2221422 - protein, 7 aa, Cryptosporidium parvum
NQLSSNN

SEQ ID NO: 2221423 - protein, 5 aa, Cryptosporidium parvum
NQMSS

SEQ ID NO: 2221424 - protein, 8 aa, Cryptosporidium parvum
NQNDSNNS

SEQ ID NO: 2221425 - protein, 9 aa, Cryptosporidium parvum
NQNESYQSY

SEQ ID NO: 2221426 - protein, 5 aa, Cryptosporidium parvum
NQNFD

SEQ ID NO: 2221427 - protein, 20 aa, Cryptosporidium parvum
NQNKPQDSKSTTTTTTTKKV

SEQ ID NO: 2221428 - protein, 72 aa, Cryptosporidium parvum
NQNKVSKSTRKKRVKDERREEAEREGAGGRGGRGEREGERGGGGERGGGERERRAGAGKEGIGGRGAGKEVE

SEQ ID NO: 2221429 - protein, 17 aa, Cryptosporidium parvum
NQNNQFGGGGGRGFDNQ

SEQ ID NO: 2221430 - protein, 6 aa, Cryptosporidium parvum
NQNNSY

SEQ ID NO: 2221431 - protein, 6 aa, Cryptosporidium parvum
NQNPGS

SEQ ID NO: 2221432 - protein, 5 aa, Cryptosporidium parvum
NQNSF

SEQ ID NO: 2221433 - protein, 23 aa, Cryptosporidium parvum
NQNSSSSNYTNLRSDQETRQIQT

SEQ ID NO: 2221434 - protein, 10 aa, Cryptosporidium parvum
NQNYSREDQE

SEQ ID NO: 2221435 - protein, 4 aa, Cryptosporidium parvum
NQPD

SEQ ID NO: 2221436 - protein, 6 aa, Cryptosporidium parvum
NQPHAA

SEQ ID NO: 2221437 - protein, 49 aa, Cryptosporidium parvum
NQPKTSITSTESTLNIDEENDSDADSSVKTNQSTSSDTSSGKLYDGSSS

SEQ ID NO: 2221438 - protein, 6 aa, Cryptosporidium parvum
NQPNKS

SEQ ID NO: 2221439 - protein, 8 aa, Cryptosporidium parvum
NQPSTNLD

SEQ ID NO: 2221440 - protein, 6 aa, Cryptosporidium parvum
NQQFPA

SEQ ID NO: 2221441 - protein, 4 aa, Cryptosporidium parvum
NQQL

SEQ ID NO: 2221442 - protein, 35 aa, Cryptosporidium parvum
NQQREDQKSNDLMEQTESSDNNSEDRNTSSDSDDD

SEQ ID NO: 2221443 - protein, 20 aa, Cryptosporidium parvum
NQQSQIQNQVSAKSKRSSSI

SEQ ID NO: 2221444 - protein, 44 aa, Cryptosporidium parvum
NQQTQSSSTTTTIATSSSSSPSSSSSSSSSSSSSSSSATTSDHD

SEQ ID NO: 2221445 - protein, 9 aa, Cryptosporidium parvum
NQRENVSDK

SEQ ID NO: 2221446 - protein, 9 aa, Cryptosporidium parvum
NQRNSEYKY

SEQ ID NO: 2221447 - protein, 6 aa, Cryptosporidium parvum
NQSEME

SEQ ID NO: 2221448 - protein, 23 aa, Cryptosporidium parvum
NQSESESNNNNDSASNNVKTNKI

SEQ ID NO: 2221449 - protein, 33 aa, Cryptosporidium parvum
NQSGSGVGPGSGSGAGLGPGSGSGSGSGKDPKV

SEQ ID NO: 2221450 - protein, 7 aa, Cryptosporidium parvum
NQSISKD

SEQ ID NO: 2221451 - protein, 30 aa, Cryptosporidium parvum
NQSKYESEDEGDEYEEDKNINTSKILKNYL

SEQ ID NO: 2221452 - protein, 5 aa, Cryptosporidium parvum
NQSLN

SEQ ID NO: 2221453 - protein, 4 aa, Cryptosporidium parvum
NQSN

SEQ ID NO: 2221454 - protein, 9 aa, Cryptosporidium parvum
NQSNEERMQ

SEQ ID NO: 2221455 - protein, 16 aa, Cryptosporidium parvum
NQSNNTLSQGYSDSKE

SEQ ID NO: 2221456 - protein, 5 aa, Cryptosporidium parvum
NQSNQ

SEQ ID NO: 2221457 - protein, 6 aa, Cryptosporidium parvum
NQSQTE

SEQ ID NO: 2221458 - protein, 10 aa, Cryptosporidium parvum
NQSRDSINAN

SEQ ID NO: 2221459 - protein, 115 aa, Cryptosporidium parvum
NQSSSESSYEETEGSKAEDSASASDLSKPDDKGFTKNEGSVQSTYADDDDEGSGELSSEGEASESEMKEGSKLSEKNSEEIPINQSESQQLNSQTEQKQDVQIQNEEEGGGASLS

SEQ ID NO: 2221460 - protein, 20 aa, Cryptosporidium parvum
NQSTKNSGPLEIEDSGNNIV

SEQ ID NO: 2221461 - protein, 17 aa, Cryptosporidium parvum
NQSTSNTELSSSLYSKE

SEQ ID NO: 2221462 - protein, 29 aa, Cryptosporidium parvum
NQTEAVGLGTNSESPKPPELESENGSNSI

SEQ ID NO: 2221463 - protein, 17 aa, Cryptosporidium parvum
NQTFTSNSNSADPNDLR

SEQ ID NO: 2221464 - protein, 4 aa, Cryptosporidium parvum
NQTK

SEQ ID NO: 2221465 - protein, 17 aa, Cryptosporidium parvum
NQTLSNRSNSLPPRNNN

SEQ ID NO: 2221466 - protein, 5 aa, Cryptosporidium parvum
NQTMS

SEQ ID NO: 2221467 - protein, 8 aa, Cryptosporidium parvum
NQTSPDIE

SEQ ID NO: 2221468 - protein, 7 aa, Cryptosporidium parvum
NQTSSSQ

SEQ ID NO: 2221469 - protein, 12 aa, Cryptosporidium parvum
NQTTDKNEALES

SEQ ID NO: 2221470 - protein, 12 aa, Cryptosporidium parvum
NQTTTSTTTSTI

SEQ ID NO: 2221471 - protein, 9 aa, Cryptosporidium parvum
NQTTTTIEN

SEQ ID NO: 2221472 - protein, 5 aa, Cryptosporidium parvum
NQTVK

SEQ ID NO: 2221473 - protein, 10 aa, Cryptosporidium parvum
NQVDKENSRK

SEQ ID NO: 2221474 - protein, 12 aa, Cryptosporidium parvum
NQVENSEAWETN

SEQ ID NO: 2221475 - protein, 12 aa, Cryptosporidium parvum
NQVKEQDALDPS

SEQ ID NO: 2221476 - protein, 13 aa, Cryptosporidium parvum
NQVVSDPSKVIDS

SEQ ID NO: 2221477 - protein, 5 aa, Cryptosporidium parvum
NQYIP

SEQ ID NO: 2221478 - protein, 7 aa, Cryptosporidium parvum
NRAQDNV

SEQ ID NO: 2221479 - protein, 4 aa, Cryptosporidium parvum
NRAR

SEQ ID NO: 2221480 - protein, 5 aa, Cryptosporidium parvum
NRASN

SEQ ID NO: 2221481 - protein, 4 aa, Cryptosporidium parvum
NRDA

SEQ ID NO: 2221482 - protein, 5 aa, Cryptosporidium parvum
NRDDF

SEQ ID NO: 2221483 - protein, 6 aa, Cryptosporidium parvum
NRDDSV

SEQ ID NO: 2221484 - protein, 6 aa, Cryptosporidium parvum
NRDEEI

SEQ ID NO: 2221485 - protein, 6 aa, Cryptosporidium parvum
NRDGNL

SEQ ID NO: 2221486 - protein, 12 aa, Cryptosporidium parvum
NRDPDKSKHLET

SEQ ID NO: 2221487 - protein, 17 aa, Cryptosporidium parvum
NRDSDYSDSIGLNDQNG

SEQ ID NO: 2221488 - protein, 9 aa, Cryptosporidium parvum
NRDSYQDEL

SEQ ID NO: 2221489 - protein, 5 aa, Cryptosporidium parvum
NRDWG

SEQ ID NO: 2221490 - protein, 14 aa, Cryptosporidium parvum
NREDYNTWIELNPE

SEQ ID NO: 2221491 - protein, 10 aa, Cryptosporidium parvum
NREKDKELSE

SEQ ID NO: 2221492 - protein, 7 aa, Cryptosporidium parvum
NREKRDP

SEQ ID NO: 2221493 - protein, 5 aa, Cryptosporidium parvum
NREQQ

SEQ ID NO: 2221494 - protein, 7 aa, Cryptosporidium parvum
NRERENY

SEQ ID NO: 2221495 - protein, 4 aa, Cryptosporidium parvum
NREY

SEQ ID NO: 2221496 - protein, 4 aa, Cryptosporidium parvum
NRGA

SEQ ID NO: 2221497 - protein, 5 aa, Cryptosporidium parvum
NRGEQ

SEQ ID NO: 2221498 - protein, 8 aa, Cryptosporidium parvum
NRGYSSSE

SEQ ID NO: 2221499 - protein, 4 aa, Cryptosporidium parvum
NRIK

SEQ ID NO: 2221500 - protein, 6 aa, Cryptosporidium parvum
NRINSL

SEQ ID NO: 2221501 - protein, 4 aa, Cryptosporidium parvum
NRKD

SEQ ID NO: 2221502 - protein, 8 aa, Cryptosporidium parvum
NRKDTTTG

SEQ ID NO: 2221503 - protein, 19 aa, Cryptosporidium parvum
NRKNKSKKDTESESCQSVE

SEQ ID NO: 2221504 - protein, 9 aa, Cryptosporidium parvum
NRKRQQELD

SEQ ID NO: 2221505 - protein, 5 aa, Cryptosporidium parvum
NRKSE

SEQ ID NO: 2221506 - protein, 9 aa, Cryptosporidium parvum
NRKTNKDLE

SEQ ID NO: 2221507 - protein, 10 aa, Cryptosporidium parvum
NRLPPKISQQ

SEQ ID NO: 2221508 - protein, 5 aa, Cryptosporidium parvum
NRLTN

SEQ ID NO: 2221509 - protein, 13 aa, Cryptosporidium parvum
NRNAKKQERRDGL

SEQ ID NO: 2221510 - protein, 8 aa, Cryptosporidium parvum
NRNDKEKD

SEQ ID NO: 2221511 - protein, 6 aa, Cryptosporidium parvum
NRNEFN

SEQ ID NO: 2221512 - protein, 4 aa, Cryptosporidium parvum
NRNG

SEQ ID NO: 2221513 - protein, 20 aa, Cryptosporidium parvum
NRNGNDPEGKYSNAGTNSGG

SEQ ID NO: 2221514 - protein, 4 aa, Cryptosporidium parvum
NRNK

SEQ ID NO: 2221515 - protein, 6 aa, Cryptosporidium parvum
NRNKLT

SEQ ID NO: 2221516 - protein, 4 aa, Cryptosporidium parvum
NRNL

SEQ ID NO: 2221517 - protein, 12 aa, Cryptosporidium parvum
NRNNNSSTEGQD

SEQ ID NO: 2221518 - protein, 8 aa, Cryptosporidium parvum
NRNQKSGE

SEQ ID NO: 2221519 - protein, 7 aa, Cryptosporidium parvum
NRNSNAS

SEQ ID NO: 2221520 - protein, 5 aa, Cryptosporidium parvum
NRNSP

SEQ ID NO: 2221521 - protein, 9 aa, Cryptosporidium parvum
NRNSPQNNF

SEQ ID NO: 2221522 - protein, 8 aa, Cryptosporidium parvum
NRNSSTID

SEQ ID NO: 2221523 - protein, 19 aa, Cryptosporidium parvum
NRPIKKNEIKRELTQSQPH

SEQ ID NO: 2221524 - protein, 19 aa, Cryptosporidium parvum
NRPKSTPSRSARRTKEEDV

SEQ ID NO: 2221525 - protein, 6 aa, Cryptosporidium parvum
NRPVPR

SEQ ID NO: 2221526 - protein, 41 aa, Cryptosporidium parvum
NRQKTGGAALNNDPVNLEKNKETPNSSNSALNSNKPRFTND

SEQ ID NO: 2221527 - protein, 14 aa, Cryptosporidium parvum
NRRSIEEDKISQNV

SEQ ID NO: 2221528 - protein, 12 aa, Cryptosporidium parvum
NRSAKNSNPYKP

SEQ ID NO: 2221529 - protein, 6 aa, Cryptosporidium parvum
NRSASL

SEQ ID NO: 2221530 - protein, 20 aa, Cryptosporidium parvum
NRSEEEEKKLIENEKSNLMN

SEQ ID NO: 2221531 - protein, 6 aa, Cryptosporidium parvum
NRSEVG

SEQ ID NO: 2221532 - protein, 6 aa, Cryptosporidium parvum
NRSNLE

SEQ ID NO: 2221533 - protein, 15 aa, Cryptosporidium parvum
NRSNLEKLKNVICSL

SEQ ID NO: 2221534 - protein, 8 aa, Cryptosporidium parvum
NRSRSEIQ

SEQ ID NO: 2221535 - protein, 5 aa, Cryptosporidium parvum
NRSSQ

SEQ ID NO: 2221536 - protein, 15 aa, Cryptosporidium parvum
NRSSSSRVLSSNDSR

SEQ ID NO: 2221537 - protein, 7 aa, Cryptosporidium parvum
NRTGDGV

SEQ ID NO: 2221538 - protein, 7 aa, Cryptosporidium parvum
NRTGEAE

SEQ ID NO: 2221539 - protein, 6 aa, Cryptosporidium parvum
NRTRTS

SEQ ID NO: 2221540 - protein, 10 aa, Cryptosporidium parvum
NRVKPPTKLD

SEQ ID NO: 2221541 - protein, 4 aa, Cryptosporidium parvum
NRVP

SEQ ID NO: 2221542 - protein, 7 aa, Cryptosporidium parvum
NRVSGQD

SEQ ID NO: 2221543 - protein, 8 aa, Cryptosporidium parvum
NRYGKRQE

SEQ ID NO: 2221544 - protein, 6 aa, Cryptosporidium parvum
NRYPKN

SEQ ID NO: 2221545 - protein, 5 aa, Cryptosporidium parvum
NRYPT

SEQ ID NO: 2221546 - protein, 8 aa, Cryptosporidium parvum
NRYRGDKI

SEQ ID NO: 2221547 - protein, 7 aa, Cryptosporidium parvum
NRYSQEQ

SEQ ID NO: 2221548 - protein, 7 aa, Cryptosporidium parvum
NSAFSAN

SEQ ID NO: 2221549 - protein, 8 aa, Cryptosporidium parvum
NSAGKKFQ

SEQ ID NO: 2221550 - protein, 10 aa, Cryptosporidium parvum
NSAKKSREQL

SEQ ID NO: 2221551 - protein, 14 aa, Cryptosporidium parvum
NSANEFDSEKGSHN

SEQ ID NO: 2221552 - protein, 9 aa, Cryptosporidium parvum
NSANHSNDL

SEQ ID NO: 2221553 - protein, 14 aa, Cryptosporidium parvum
NSANNSNNSHGSAL

SEQ ID NO: 2221554 - protein, 7 aa, Cryptosporidium parvum
NSARGLG

SEQ ID NO: 2221555 - protein, 19 aa, Cryptosporidium parvum
NSASGNPSSESEDHESEYL

SEQ ID NO: 2221556 - protein, 12 aa, Cryptosporidium parvum
NSASNTCGRNLD

SEQ ID NO: 2221557 - protein, 20 aa, Cryptosporidium parvum
NSASSQQCEAYDQEASLNPK

SEQ ID NO: 2221558 - protein, 4 aa, Cryptosporidium parvum
NSDD

SEQ ID NO: 2221559 - protein, 8 aa, Cryptosporidium parvum
NSDDELDE

SEQ ID NO: 2221560 - protein, 14 aa, Cryptosporidium parvum
NSDFGKELNKASEL

SEQ ID NO: 2221561 - protein, 8 aa, Cryptosporidium parvum
NSDFSNNN

SEQ ID NO: 2221562 - protein, 8 aa, Cryptosporidium parvum
NSDGDKIY

SEQ ID NO: 2221563 - protein, 6 aa, Cryptosporidium parvum
NSDGDL

SEQ ID NO: 2221564 - protein, 19 aa, Cryptosporidium parvum
NSDHNHSKSGDYNHPPISE

SEQ ID NO: 2221565 - protein, 5 aa, Cryptosporidium parvum
NSDKA

SEQ ID NO: 2221566 - protein, 10 aa, Cryptosporidium parvum
NSDLDGDLTS

SEQ ID NO: 2221567 - protein, 7 aa, Cryptosporidium parvum
NSDLESN

SEQ ID NO: 2221568 - protein, 10 aa, Cryptosporidium parvum
NSDNPSDSAY

SEQ ID NO: 2221569 - protein, 8 aa, Cryptosporidium parvum
NSDPSLKL

SEQ ID NO: 2221570 - protein, 6 aa, Cryptosporidium parvum
NSDPSN

SEQ ID NO: 2221571 - protein, 7 aa, Cryptosporidium parvum
NSDPSSA

SEQ ID NO: 2221572 - protein, 8 aa, Cryptosporidium parvum
NSDQTRND

SEQ ID NO: 2221573 - protein, 7 aa, Cryptosporidium parvum
NSDSLQE

SEQ ID NO: 2221574 - protein, 7 aa, Cryptosporidium parvum
NSDSSLL

SEQ ID NO: 2221575 - protein, 16 aa, Cryptosporidium parvum
NSDSSNDSNKKVPEEH

SEQ ID NO: 2221576 - protein, 7 aa, Cryptosporidium parvum
NSDSSNL

SEQ ID NO: 2221577 - protein, 5 aa, Cryptosporidium parvum
NSDTK

SEQ ID NO: 2221578 - protein, 6 aa, Cryptosporidium parvum
NSEAGI

SEQ ID NO: 2221579 - protein, 7 aa, Cryptosporidium parvum
NSEDEFE

SEQ ID NO: 2221580 - protein, 5 aa, Cryptosporidium parvum
NSEDL

SEQ ID NO: 2221581 - protein, 6 aa, Cryptosporidium parvum
NSEDTG

SEQ ID NO: 2221582 - protein, 7 aa, Cryptosporidium parvum
NSEEEAI

SEQ ID NO: 2221583 - protein, 6 aa, Cryptosporidium parvum
NSEEGI

SEQ ID NO: 2221584 - protein, 10 aa, Cryptosporidium parvum
NSEENPVGGI

SEQ ID NO: 2221585 - protein, 15 aa, Cryptosporidium parvum
NSEETSSESSFRRSD

SEQ ID NO: 2221586 - protein, 14 aa, Cryptosporidium parvum
NSEFSECDETDNTR

SEQ ID NO: 2221587 - protein, 7 aa, Cryptosporidium parvum
NSEKGRA

SEQ ID NO: 2221588 - protein, 4 aa, Cryptosporidium parvum
NSEL

SEQ ID NO: 2221589 - protein, 7 aa, Cryptosporidium parvum
NSELKKD

SEQ ID NO: 2221590 - protein, 12 aa, Cryptosporidium parvum
NSELNSHRRSKT

SEQ ID NO: 2221591 - protein, 8 aa, Cryptosporidium parvum
NSENPNSF

SEQ ID NO: 2221592 - protein, 7 aa, Cryptosporidium parvum
NSENYES

SEQ ID NO: 2221593 - protein, 6 aa, Cryptosporidium parvum
NSENYI

SEQ ID NO: 2221594 - protein, 4 aa, Cryptosporidium parvum
NSEP

SEQ ID NO: 2221595 - protein, 6 aa, Cryptosporidium parvum
NSEREM

SEQ ID NO: 2221596 - protein, 67 aa, Cryptosporidium parvum
NSERNQSQSQSQSQSQSQSQSQSKNQTQYRTQNQTQNQTQNQNLSSRDPENVNYSGSEQPSFENDNA

SEQ ID NO: 2221597 - protein, 20 aa, Cryptosporidium parvum
NSESPDGSSTITSEKAHKDL

SEQ ID NO: 2221598 - protein, 9 aa, Cryptosporidium parvum
NSESSKNFL

SEQ ID NO: 2221599 - protein, 19 aa, Cryptosporidium parvum
NSETENTSQGPPPPPSSGI

SEQ ID NO: 2221600 - protein, 15 aa, Cryptosporidium parvum
NSETLSSSKKKQIDD

SEQ ID NO: 2221601 - protein, 13 aa, Cryptosporidium parvum
NSETNKSRYSQHS

SEQ ID NO: 2221602 - protein, 9 aa, Cryptosporidium parvum
NSETSFSSP

SEQ ID NO: 2221603 - protein, 9 aa, Cryptosporidium parvum
NSEYTPKDD

SEQ ID NO: 2221604 - protein, 6 aa, Cryptosporidium parvum
NSFDNE

SEQ ID NO: 2221605 - protein, 6 aa, Cryptosporidium parvum
NSFEET

SEQ ID NO: 2221606 - protein, 4 aa, Cryptosporidium parvum
NSFK

SEQ ID NO: 2221607 - protein, 18 aa, Cryptosporidium parvum
NSFTGASFSQKTKKNSFL

SEQ ID NO: 2221608 - protein, 18 aa, Cryptosporidium parvum
NSGANSGIVGGGQQGANI

SEQ ID NO: 2221609 - protein, 14 aa, Cryptosporidium parvum
NSGANSLDDTRNIA

SEQ ID NO: 2221610 - protein, 22 aa, Cryptosporidium parvum
NSGDEPIQEVATSGSKDGGDDV

SEQ ID NO: 2221611 - protein, 8 aa, Cryptosporidium parvum
NSGDKNHI

SEQ ID NO: 2221612 - protein, 4 aa, Cryptosporidium parvum
NSGE

SEQ ID NO: 2221613 - protein, 9 aa, Cryptosporidium parvum
NSGGPTETI

SEQ ID NO: 2221614 - protein, 6 aa, Cryptosporidium parvum
NSGGRD

SEQ ID NO: 2221615 - protein, 4 aa, Cryptosporidium parvum
NSGI

SEQ ID NO: 2221616 - protein, 4 aa, Cryptosporidium parvum
NSGK

SEQ ID NO: 2221617 - protein, 10 aa, Cryptosporidium parvum
NSGLEDNSDL

SEQ ID NO: 2221618 - protein, 8 aa, Cryptosporidium parvum
NSGLNSDN

SEQ ID NO: 2221619 - protein, 46 aa, Cryptosporidium parvum
NSGLSNNNSRDNSRSISRASSSRETSPDYSNKDTEIIQSKDENEII

SEQ ID NO: 2221620 - protein, 8 aa, Cryptosporidium parvum
NSGNPIPD

SEQ ID NO: 2221621 - protein, 7 aa, Cryptosporidium parvum
NSGRYGS

SEQ ID NO: 2221622 - protein, 8 aa, Cryptosporidium parvum
NSGSGKRY

SEQ ID NO: 2221623 - protein, 8 aa, Cryptosporidium parvum
NSGSGKST

SEQ ID NO: 2221624 - protein, 10 aa, Cryptosporidium parvum
NSGSSSDPIQ

SEQ ID NO: 2221625 - protein, 39 aa, Cryptosporidium parvum
NSGSSSSSSSSSSSSSSSSSSSSSSSSSSSTSNSNYNSK

SEQ ID NO: 2221626 - protein, 11 aa, Cryptosporidium parvum
NSGSSVPTTPI

SEQ ID NO: 2221627 - protein, 14 aa, Cryptosporidium parvum
NSGTRNRCQICSTR

SEQ ID NO: 2221628 - protein, 6 aa, Cryptosporidium parvum
NSGVER

SEQ ID NO: 2221629 - protein, 13 aa, Cryptosporidium parvum
NSHENNNTENYDI

SEQ ID NO: 2221630 - protein, 7 aa, Cryptosporidium parvum
NSHISSR

SEQ ID NO: 2221631 - protein, 34 aa, Cryptosporidium parvum
NSHLSSISSSTRSNISQNPSTNSQGLNSQHQTIS

SEQ ID NO: 2221632 - protein, 8 aa, Cryptosporidium parvum
NSHLSTKS

SEQ ID NO: 2221633 - protein, 4 aa, Cryptosporidium parvum
NSHN

SEQ ID NO: 2221634 - protein, 9 aa, Cryptosporidium parvum
NSHSASDLA

SEQ ID NO: 2221635 - protein, 12 aa, Cryptosporidium parvum
NSHSLDSSTKDY

SEQ ID NO: 2221636 - protein, 11 aa, Cryptosporidium parvum
NSHSREKTNNE

SEQ ID NO: 2221637 - protein, 9 aa, Cryptosporidium parvum
NSHSYGSTS

SEQ ID NO: 2221638 - protein, 4 aa, Cryptosporidium parvum
NSHY

SEQ ID NO: 2221639 - protein, 6 aa, Cryptosporidium parvum
NSIANP

SEQ ID NO: 2221640 - protein, 21 aa, Cryptosporidium parvum
NSIASKSYSGSNNNNNNIVLA

SEQ ID NO: 2221641 - protein, 7 aa, Cryptosporidium parvum
NSIEDQY

SEQ ID NO: 2221642 - protein, 6 aa, Cryptosporidium parvum
NSIETD

SEQ ID NO: 2221643 - protein, 21 aa, Cryptosporidium parvum
NSINEKNINQTEEGKIVSPSN

SEQ ID NO: 2221644 - protein, 9 aa, Cryptosporidium parvum
NSINETEQT

SEQ ID NO: 2221645 - protein, 19 aa, Cryptosporidium parvum
NSINKENGTDEKNVDSIPS

SEQ ID NO: 2221646 - protein, 15 aa, Cryptosporidium parvum
NSINNNEALNTSNNL

SEQ ID NO: 2221647 - protein, 8 aa, Cryptosporidium parvum
NSINSDSK

SEQ ID NO: 2221648 - protein, 11 aa, Cryptosporidium parvum
NSINSNNNQLP

SEQ ID NO: 2221649 - protein, 5 aa, Cryptosporidium parvum
NSIPE

SEQ ID NO: 2221650 - protein, 6 aa, Cryptosporidium parvum
NSIPSN

SEQ ID NO: 2221651 - protein, 6 aa, Cryptosporidium parvum
NSIQNK

SEQ ID NO: 2221652 - protein, 12 aa, Cryptosporidium parvum
NSIQSSLSPRFG

SEQ ID NO: 2221653 - protein, 6 aa, Cryptosporidium parvum
NSIRRS

SEQ ID NO: 2221654 - protein, 5 aa, Cryptosporidium parvum
NSIRT

SEQ ID NO: 2221655 - protein, 50 aa, Cryptosporidium parvum
NSISDSNSDSSPKSGSRLDSGSSSNSESQGENNKSDLSGYTKLGKETGRE

SEQ ID NO: 2221656 - protein, 9 aa, Cryptosporidium parvum
NSISPEKGD

SEQ ID NO: 2221657 - protein, 6 aa, Cryptosporidium parvum
NSITRE

SEQ ID NO: 2221658 - protein, 10 aa, Cryptosporidium parvum
NSITSSRSGG

SEQ ID NO: 2221659 - protein, 6 aa, Cryptosporidium parvum
NSIYES

SEQ ID NO: 2221660 - protein, 14 aa, Cryptosporidium parvum
NSKAEDAKKRKIEM

SEQ ID NO: 2221661 - protein, 10 aa, Cryptosporidium parvum
NSKAKDSEEV

SEQ ID NO: 2221662 - protein, 8 aa, Cryptosporidium parvum
NSKAPLGF

SEQ ID NO: 2221663 - protein, 10 aa, Cryptosporidium parvum
NSKDDDQANL

SEQ ID NO: 2221664 - protein, 9 aa, Cryptosporidium parvum
NSKDDEKEL

SEQ ID NO: 2221665 - protein, 5 aa, Cryptosporidium parvum
NSKDQ

SEQ ID NO: 2221666 - protein, 6 aa, Cryptosporidium parvum
NSKEFN

SEQ ID NO: 2221667 - protein, 7 aa, Cryptosporidium parvum
NSKEIRK

SEQ ID NO: 2221668 - protein, 14 aa, Cryptosporidium parvum
NSKENNNNNNNNNR

SEQ ID NO: 2221669 - protein, 9 aa, Cryptosporidium parvum
NSKGNEKTI

SEQ ID NO: 2221670 - protein, 8 aa, Cryptosporidium parvum
NSKGQSCG

SEQ ID NO: 2221671 - protein, 4 aa, Cryptosporidium parvum
NSKI

SEQ ID NO: 2221672 - protein, 6 aa, Cryptosporidium parvum
NSKKMN

SEQ ID NO: 2221673 - protein, 4 aa, Cryptosporidium parvum
NSKN

SEQ ID NO: 2221674 - protein, 9 aa, Cryptosporidium parvum
NSKNQKYSL

SEQ ID NO: 2221675 - protein, 7 aa, Cryptosporidium parvum
NSKPEVD

SEQ ID NO: 2221676 - protein, 12 aa, Cryptosporidium parvum
NSKPGESYEDEI

SEQ ID NO: 2221677 - protein, 14 aa, Cryptosporidium parvum
NSKPHSHDSENEDC

SEQ ID NO: 2221678 - protein, 5 aa, Cryptosporidium parvum
NSKRK

SEQ ID NO: 2221679 - protein, 9 aa, Cryptosporidium parvum
NSKSDGSAL

SEQ ID NO: 2221680 - protein, 9 aa, Cryptosporidium parvum
NSKSENYEE

SEQ ID NO: 2221681 - protein, 5 aa, Cryptosporidium parvum
NSKSH

SEQ ID NO: 2221682 - protein, 9 aa, Cryptosporidium parvum
NSKSKTNNV

SEQ ID NO: 2221683 - protein, 25 aa, Cryptosporidium parvum
NSKSPDIGTLNSGSNSEPNSDTNSV

SEQ ID NO: 2221684 - protein, 8 aa, Cryptosporidium parvum
NSKSQTVE

SEQ ID NO: 2221685 - protein, 9 aa, Cryptosporidium parvum
NSKTDSENV

SEQ ID NO: 2221686 - protein, 14 aa, Cryptosporidium parvum
NSKTYNESDSDGSL

SEQ ID NO: 2221687 - protein, 4 aa, Cryptosporidium parvum
NSKV

SEQ ID NO: 2221688 - protein, 11 aa, Cryptosporidium parvum
NSKYNNDNTSI

SEQ ID NO: 2221689 - protein, 9 aa, Cryptosporidium parvum
NSKYSSNER

SEQ ID NO: 2221690 - protein, 13 aa, Cryptosporidium parvum
NSLDDKNTKTTNS

SEQ ID NO: 2221691 - protein, 8 aa, Cryptosporidium parvum
NSLDKRTS

SEQ ID NO: 2221692 - protein, 6 aa, Cryptosporidium parvum
NSLDRT

SEQ ID NO: 2221693 - protein, 4 aa, Cryptosporidium parvum
NSLE

SEQ ID NO: 2221694 - protein, 10 aa, Cryptosporidium parvum
NSLEDSDNWG

SEQ ID NO: 2221695 - protein, 16 aa, Cryptosporidium parvum
NSLGINSRNGSFGDSC

SEQ ID NO: 2221696 - protein, 13 aa, Cryptosporidium parvum
NSLGKNAETKTCD

SEQ ID NO: 2221697 - protein, 9 aa, Cryptosporidium parvum
NSLGNDDEL

SEQ ID NO: 2221698 - protein, 6 aa, Cryptosporidium parvum
NSLGSY

SEQ ID NO: 2221699 - protein, 4 aa, Cryptosporidium parvum
NSLL

SEQ ID NO: 2221700 - protein, 17 aa, Cryptosporidium parvum
NSLLNANDTYKQYGDKL

SEQ ID NO: 2221701 - protein, 21 aa, Cryptosporidium parvum
NSLPQINENSSLSRETNKKTS

SEQ ID NO: 2221702 - protein, 6 aa, Cryptosporidium parvum
NSLQPD

SEQ ID NO: 2221703 - protein, 8 aa, Cryptosporidium parvum
NSLSQEQK

SEQ ID NO: 2221704 - protein, 25 aa, Cryptosporidium parvum
NSMEIQPNNQDNNNNNNNNNNNDKF

SEQ ID NO: 2221705 - protein, 6 aa, Cryptosporidium parvum
NSNAQK

SEQ ID NO: 2221706 - protein, 15 aa, Cryptosporidium parvum
NSNCEIPEYSSENSD

SEQ ID NO: 2221707 - protein, 5 aa, Cryptosporidium parvum
NSNDI

SEQ ID NO: 2221708 - protein, 10 aa, Cryptosporidium parvum
NSNESNVTNV

SEQ ID NO: 2221709 - protein, 8 aa, Cryptosporidium parvum
NSNETETV

SEQ ID NO: 2221710 - protein, 8 aa, Cryptosporidium parvum
NSNETKFK

SEQ ID NO: 2221711 - protein, 15 aa, Cryptosporidium parvum
NSNEVDNSNDIQDTK

SEQ ID NO: 2221712 - protein, 11 aa, Cryptosporidium parvum
NSNEYSYSDSG

SEQ ID NO: 2221713 - protein, 20 aa, Cryptosporidium parvum
NSNGNDLSSQDSGNEDYPNE

SEQ ID NO: 2221714 - protein, 11 aa, Cryptosporidium parvum
NSNGNSNNSNL

SEQ ID NO: 2221715 - protein, 7 aa, Cryptosporidium parvum
NSNGQIN

SEQ ID NO: 2221716 - protein, 9 aa, Cryptosporidium parvum
NSNIKEASQ

SEQ ID NO: 2221717 - protein, 20 aa, Cryptosporidium parvum
NSNINNSNLYNNSNIKQDGQ

SEQ ID NO: 2221718 - protein, 12 aa, Cryptosporidium parvum
NSNIPSNENNYK

SEQ ID NO: 2221719 - protein, 6 aa, Cryptosporidium parvum
NSNIQE

SEQ ID NO: 2221720 - protein, 4 aa, Cryptosporidium parvum
NSNK

SEQ ID NO: 2221721 - protein, 5 aa, Cryptosporidium parvum
NSNKD

SEQ ID NO: 2221722 - protein, 6 aa, Cryptosporidium parvum
NSNKEY

SEQ ID NO: 2221723 - protein, 8 aa, Cryptosporidium parvum
NSNKNHTD

SEQ ID NO: 2221724 - protein, 8 aa, Cryptosporidium parvum
NSNKTNIP

SEQ ID NO: 2221725 - protein, 10 aa, Cryptosporidium parvum
NSNNEFEKTK

SEQ ID NO: 2221726 - protein, 14 aa, Cryptosporidium parvum
NSNNHSKKSISTNK

SEQ ID NO: 2221727 - protein, 47 aa, Cryptosporidium parvum
NSNNNGKNFKPDRSCSKSSISDSTPNQINKNTVKDSLSAQVNNNSCS

SEQ ID NO: 2221728 - protein, 9 aa, Cryptosporidium parvum
NSNNSSTTL

SEQ ID NO: 2221729 - protein, 12 aa, Cryptosporidium parvum
NSNNVRKYQENL

SEQ ID NO: 2221730 - protein, 9 aa, Cryptosporidium parvum
NSNPDNNNY

SEQ ID NO: 2221731 - protein, 7 aa, Cryptosporidium parvum
NSNPISS

SEQ ID NO: 2221732 - protein, 6 aa, Cryptosporidium parvum
NSNPNI

SEQ ID NO: 2221733 - protein, 6 aa, Cryptosporidium parvum
NSNPQI

SEQ ID NO: 2221734 - protein, 5 aa, Cryptosporidium parvum
NSNPY

SEQ ID NO: 2221735 - protein, 6 aa, Cryptosporidium parvum
NSNRAT

SEQ ID NO: 2221736 - protein, 7 aa, Cryptosporidium parvum
NSNRNKT

SEQ ID NO: 2221737 - protein, 6 aa, Cryptosporidium parvum
NSNSDQ

SEQ ID NO: 2221738 - protein, 10 aa, Cryptosporidium parvum
NSNSEEKYKN

SEQ ID NO: 2221739 - protein, 6 aa, Cryptosporidium parvum
NSNSHL

SEQ ID NO: 2221740 - protein, 5 aa, Cryptosporidium parvum
NSNSI

SEQ ID NO: 2221741 - protein, 18 aa, Cryptosporidium parvum
NSNSIESAHSTTSSSRIS

SEQ ID NO: 2221742 - protein, 18 aa, Cryptosporidium parvum
NSNSKSCSELNSNNNQEP

SEQ ID NO: 2221743 - protein, 7 aa, Cryptosporidium parvum
NSNSKSF

SEQ ID NO: 2221744 - protein, 8 aa, Cryptosporidium parvum
NSNSNKEI

SEQ ID NO: 2221745 - protein, 10 aa, Cryptosporidium parvum
NSNSSFANDN

SEQ ID NO: 2221746 - protein, 8 aa, Cryptosporidium parvum
NSNSSQSY

SEQ ID NO: 2221747 - protein, 6 aa, Cryptosporidium parvum
NSNTEL

SEQ ID NO: 2221748 - protein, 22 aa, Cryptosporidium parvum
NSNTHSSNNCNVNAKSNCQRRK

SEQ ID NO: 2221749 - protein, 7 aa, Cryptosporidium parvum
NSNTNID

SEQ ID NO: 2221750 - protein, 8 aa, Cryptosporidium parvum
NSNTNQKQ

SEQ ID NO: 2221751 - protein, 7 aa, Cryptosporidium parvum
NSPEEGI

SEQ ID NO: 2221752 - protein, 19 aa, Cryptosporidium parvum
NSPESPSPLAALSNPDHSA

SEQ ID NO: 2221753 - protein, 5 aa, Cryptosporidium parvum
NSPGI

SEQ ID NO: 2221754 - protein, 12 aa, Cryptosporidium parvum
NSPGRRANGELS

SEQ ID NO: 2221755 - protein, 12 aa, Cryptosporidium parvum
NSPITSETYDSD

SEQ ID NO: 2221756 - protein, 9 aa, Cryptosporidium parvum
NSPKHSDER

SEQ ID NO: 2221757 - protein, 11 aa, Cryptosporidium parvum
NSPLQSNSPMN

SEQ ID NO: 2221758 - protein, 7 aa, Cryptosporidium parvum
NSPNAFD

SEQ ID NO: 2221759 - protein, 9 aa, Cryptosporidium parvum
NSPNTSKKL

SEQ ID NO: 2221760 - protein, 7 aa, Cryptosporidium parvum
NSPQAES

SEQ ID NO: 2221761 - protein, 10 aa, Cryptosporidium parvum
NSPTSKIEGN

SEQ ID NO: 2221762 - protein, 7 aa, Cryptosporidium parvum
NSPTVSV

SEQ ID NO: 2221763 - protein, 5 aa, Cryptosporidium parvum
NSPWT

SEQ ID NO: 2221764 - protein, 8 aa, Cryptosporidium parvum
NSPYGTSY

SEQ ID NO: 2221765 - protein, 8 aa, Cryptosporidium parvum
NSQDNNSI

SEQ ID NO: 2221766 - protein, 6 aa, Cryptosporidium parvum
NSQEIE

SEQ ID NO: 2221767 - protein, 10 aa, Cryptosporidium parvum
NSQELNEEYS

SEQ ID NO: 2221768 - protein, 8 aa, Cryptosporidium parvum
NSQKDPNL

SEQ ID NO: 2221769 - protein, 9 aa, Cryptosporidium parvum
NSQKSLGES

SEQ ID NO: 2221770 - protein, 4 aa, Cryptosporidium parvum
NSQL

SEQ ID NO: 2221771 - protein, 7 aa, Cryptosporidium parvum
NSQLKTK

SEQ ID NO: 2221772 - protein, 6 aa, Cryptosporidium parvum
NSQLQN

SEQ ID NO: 2221773 - protein, 7 aa, Cryptosporidium parvum
NSQNLND

SEQ ID NO: 2221774 - protein, 9 aa, Cryptosporidium parvum
NSQNNQTEI

SEQ ID NO: 2221775 - protein, 5 aa, Cryptosporidium parvum
NSQPA

SEQ ID NO: 2221776 - protein, 5 aa, Cryptosporidium parvum
NSQQA

SEQ ID NO: 2221777 - protein, 7 aa, Cryptosporidium parvum
NSQQNQL

SEQ ID NO: 2221778 - protein, 14 aa, Cryptosporidium parvum
NSQQSNRQTSVKSI

SEQ ID NO: 2221779 - protein, 6 aa, Cryptosporidium parvum
NSQSRN

SEQ ID NO: 2221780 - protein, 7 aa, Cryptosporidium parvum
NSQVGRQ

SEQ ID NO: 2221781 - protein, 5 aa, Cryptosporidium parvum
NSQYA

SEQ ID NO: 2221782 - protein, 8 aa, Cryptosporidium parvum
NSRANPNI

SEQ ID NO: 2221783 - protein, 4 aa, Cryptosporidium parvum
NSRC

SEQ ID NO: 2221784 - protein, 7 aa, Cryptosporidium parvum
NSRDPKS

SEQ ID NO: 2221785 - protein, 6 aa, Cryptosporidium parvum
NSRENR

SEQ ID NO: 2221786 - protein, 17 aa, Cryptosporidium parvum
NSRETNIKEENQQNQVD

SEQ ID NO: 2221787 - protein, 8 aa, Cryptosporidium parvum
NSRIEKSV

SEQ ID NO: 2221788 - protein, 5 aa, Cryptosporidium parvum
NSRKF

SEQ ID NO: 2221789 - protein, 15 aa, Cryptosporidium parvum
NSRLASDDTADRNMK

SEQ ID NO: 2221790 - protein, 5 aa, Cryptosporidium parvum
NSRNK

SEQ ID NO: 2221791 - protein, 7 aa, Cryptosporidium parvum
NSRNRGP

SEQ ID NO: 2221792 - protein, 25 aa, Cryptosporidium parvum
NSRNSNSSSYSRSSSSVSNRDSNSS

SEQ ID NO: 2221793 - protein, 4 aa, Cryptosporidium parvum
NSRP

SEQ ID NO: 2221794 - protein, 6 aa, Cryptosporidium parvum
NSRPYS

SEQ ID NO: 2221795 - protein, 8 aa, Cryptosporidium parvum
NSRQRNGS

SEQ ID NO: 2221796 - protein, 5 aa, Cryptosporidium parvum
NSRSI

SEQ ID NO: 2221797 - protein, 4 aa, Cryptosporidium parvum
NSSC

SEQ ID NO: 2221798 - protein, 4 aa, Cryptosporidium parvum
NSSD

SEQ ID NO: 2221799 - protein, 14 aa, Cryptosporidium parvum
NSSDTPCKKGNYFD

SEQ ID NO: 2221800 - protein, 5 aa, Cryptosporidium parvum
NSSES

SEQ ID NO: 2221801 - protein, 12 aa, Cryptosporidium parvum
NSSESSKMNNDH

SEQ ID NO: 2221802 - protein, 6 aa, Cryptosporidium parvum
NSSFSE

SEQ ID NO: 2221803 - protein, 6 aa, Cryptosporidium parvum
NSSGLK

SEQ ID NO: 2221804 - protein, 6 aa, Cryptosporidium parvum
NSSGQC

SEQ ID NO: 2221805 - protein, 5 aa, Cryptosporidium parvum
NSSIK

SEQ ID NO: 2221806 - protein, 8 aa, Cryptosporidium parvum
NSSIKSPE

SEQ ID NO: 2221807 - protein, 7 aa, Cryptosporidium parvum
NSSINDN

SEQ ID NO: 2221808 - protein, 15 aa, Cryptosporidium parvum
NSSINIASKSNSNPN

SEQ ID NO: 2221809 - protein, 26 aa, Cryptosporidium parvum
NSSKEGEEECKDVKTENQNPNNNDNK

SEQ ID NO: 2221810 - protein, 10 aa, Cryptosporidium parvum
NSSKETQNFN

SEQ ID NO: 2221811 - protein, 13 aa, Cryptosporidium parvum
NSSKFGEKPVNED

SEQ ID NO: 2221812 - protein, 10 aa, Cryptosporidium parvum
NSSKIEQRME

SEQ ID NO: 2221813 - protein, 7 aa, Cryptosporidium parvum
NSSKKYT

SEQ ID NO: 2221814 - protein, 10 aa, Cryptosporidium parvum
NSSKNNYTTR

SEQ ID NO: 2221815 - protein, 9 aa, Cryptosporidium parvum
NSSKSSSFG

SEQ ID NO: 2221816 - protein, 4 aa, Cryptosporidium parvum
NSSL

SEQ ID NO: 2221817 - protein, 16 aa, Cryptosporidium parvum
NSSLDENNVEKIKETE

SEQ ID NO: 2221818 - protein, 19 aa, Cryptosporidium parvum
NSSLDSKRNIQSDTSLDGF

SEQ ID NO: 2221819 - protein, 11 aa, Cryptosporidium parvum
NSSNHSGKEAL

SEQ ID NO: 2221820 - protein, 6 aa, Cryptosporidium parvum
NSSNKG

SEQ ID NO: 2221821 - protein, 11 aa, Cryptosporidium parvum
NSSNNSSGNFQ

SEQ ID NO: 2221822 - protein, 23 aa, Cryptosporidium parvum
NSSNQASSSIRQAQNSSTGLANT

SEQ ID NO: 2221823 - protein, 17 aa, Cryptosporidium parvum
NSSNVNNNNQNDSDSSF

SEQ ID NO: 2221824 - protein, 4 aa, Cryptosporidium parvum
NSSQ

SEQ ID NO: 2221825 - protein, 7 aa, Cryptosporidium parvum
NSSQIDQ

SEQ ID NO: 2221826 - protein, 8 aa, Cryptosporidium parvum
NSSQNGEH

SEQ ID NO: 2221827 - protein, 14 aa, Cryptosporidium parvum
NSSQTTLKKNKLTQ

SEQ ID NO: 2221828 - protein, 7 aa, Cryptosporidium parvum
NSSRSTH

SEQ ID NO: 2221829 - protein, 20 aa, Cryptosporidium parvum
NSSSGNSLEGTSNSSDIKTR

SEQ ID NO: 2221830 - protein, 22 aa, Cryptosporidium parvum
NSSSNQMNQYSSSTSNQQDNYY

SEQ ID NO: 2221831 - protein, 8 aa, Cryptosporidium parvum
NSSSNVSE

SEQ ID NO: 2221832 - protein, 8 aa, Cryptosporidium parvum
NSSSPRTY

SEQ ID NO: 2221833 - protein, 23 aa, Cryptosporidium parvum
NSSSSIHGSITSSGSRVGAVGPG

SEQ ID NO: 2221834 - protein, 9 aa, Cryptosporidium parvum
NSSSSYSSN

SEQ ID NO: 2221835 - protein, 5 aa, Cryptosporidium parvum
NSSST

SEQ ID NO: 2221836 - protein, 36 aa, Cryptosporidium parvum
NSSSTGGSGYGSSENLNFSSNNSSSSSSSSVSIGDE

SEQ ID NO: 2221837 - protein, 5 aa, Cryptosporidium parvum
NSSTE

SEQ ID NO: 2221838 - protein, 6 aa, Cryptosporidium parvum
NSSTSY

SEQ ID NO: 2221839 - protein, 10 aa, Cryptosporidium parvum
NSSTYGDTGL

SEQ ID NO: 2221840 - protein, 5 aa, Cryptosporidium parvum
NSSYF

SEQ ID NO: 2221841 - protein, 9 aa, Cryptosporidium parvum
NSTDPIYGS

SEQ ID NO: 2221842 - protein, 4 aa, Cryptosporidium parvum
NSTE

SEQ ID NO: 2221843 - protein, 6 aa, Cryptosporidium parvum
NSTHAH

SEQ ID NO: 2221844 - protein, 6 aa, Cryptosporidium parvum
NSTISR

SEQ ID NO: 2221845 - protein, 9 aa, Cryptosporidium parvum
NSTKPPAII

SEQ ID NO: 2221846 - protein, 12 aa, Cryptosporidium parvum
NSTLAENSNRDK

SEQ ID NO: 2221847 - protein, 6 aa, Cryptosporidium parvum
NSTLPA

SEQ ID NO: 2221848 - protein, 8 aa, Cryptosporidium parvum
NSTLSSDI

SEQ ID NO: 2221849 - protein, 7 aa, Cryptosporidium parvum
NSTNDNQ

SEQ ID NO: 2221850 - protein, 6 aa, Cryptosporidium parvum
NSTPDF

SEQ ID NO: 2221851 - protein, 5 aa, Cryptosporidium parvum
NSTPE

SEQ ID NO: 2221852 - protein, 9 aa, Cryptosporidium parvum
NSTRKIPAR

SEQ ID NO: 2221853 - protein, 5 aa, Cryptosporidium parvum
NSTRN

SEQ ID NO: 2221854 - protein, 13 aa, Cryptosporidium parvum
NSTRNEKSTFEVT

SEQ ID NO: 2221855 - protein, 7 aa, Cryptosporidium parvum
NSTRNNY

SEQ ID NO: 2221856 - protein, 19 aa, Cryptosporidium parvum
NSTTITTTTTNGNNSTTQV

SEQ ID NO: 2221857 - protein, 7 aa, Cryptosporidium parvum
NSTTKEL

SEQ ID NO: 2221858 - protein, 11 aa, Cryptosporidium parvum
NSVAGGNLPPP

SEQ ID NO: 2221859 - protein, 13 aa, Cryptosporidium parvum
NSVKETTARENRS

SEQ ID NO: 2221860 - protein, 16 aa, Cryptosporidium parvum
NSVPNLGSTETNSKFN

SEQ ID NO: 2221861 - protein, 8 aa, Cryptosporidium parvum
NSVSNNQV

SEQ ID NO: 2221862 - protein, 7 aa, Cryptosporidium parvum
NSVSYPG

SEQ ID NO: 2221863 - protein, 5 aa, Cryptosporidium parvum
NSWQE

SEQ ID NO: 2221864 - protein, 31 aa, Cryptosporidium parvum; identical to SEQ ID NO: 2117580

SEQ ID NO: 2221865 - protein, 23 aa, Cryptosporidium parvum
NSYGIGENKKAEESRPEASGTKA

SEQ ID NO: 2221866 - protein, 17 aa, Cryptosporidium parvum
NSYNSKLNNNNNPSREM

SEQ ID NO: 2221867 - protein, 5 aa, Cryptosporidium parvum
NSYQD

SEQ ID NO: 2221868 - protein, 8 aa, Cryptosporidium parvum
NSYRPTGA

SEQ ID NO: 2221869 - protein, 11 aa, Cryptosporidium parvum
NSYSSGKDKLG

SEQ ID NO: 2221870 - protein, 8 aa, Cryptosporidium parvum
NTAGFSSR

SEQ ID NO: 2221871 - protein, 9 aa, Cryptosporidium parvum
NTAIEEDNR

SEQ ID NO: 2221872 - protein, 23 aa, Cryptosporidium parvum
NTAKYESKSRKSNKNNKKYHRFS

SEQ ID NO: 2221873 - protein, 11 aa, Cryptosporidium parvum
NTANNHSQVSE

SEQ ID NO: 2221874 - protein, 4 aa, Cryptosporidium parvum
NTAR

SEQ ID NO: 2221875 - protein, 8 aa, Cryptosporidium parvum
NTASEPKI

SEQ ID NO: 2221876 - protein, 8 aa, Cryptosporidium parvum
NTASERPD

SEQ ID NO: 2221877 - protein, 11 aa, Cryptosporidium parvum
NTASGSTTLRD

SEQ ID NO: 2221878 - protein, 10 aa, Cryptosporidium parvum
NTASTTETEI

SEQ ID NO: 2221879 - protein, 12 aa, Cryptosporidium parvum
NTATDATNENEY

SEQ ID NO: 2221880 - protein, 6 aa, Cryptosporidium parvum
NTCDRT

SEQ ID NO: 2221881 - protein, 4 aa, Cryptosporidium parvum
NTDF

SEQ ID NO: 2221882 - protein, 17 aa, Cryptosporidium parvum
NTDIQEKSLKKSTAQER

SEQ ID NO: 2221883 - protein, 10 aa, Cryptosporidium parvum
NTDNDTDIDK

SEQ ID NO: 2221884 - protein, 34 aa, Cryptosporidium parvum
NTDSKSNKQTNLQNKVSNSNSQRYSKTVDNLDSG

SEQ ID NO: 2221885 - protein, 7 aa, Cryptosporidium parvum
NTEFHSR

SEQ ID NO: 2221886 - protein, 13 aa, Cryptosporidium parvum
NTEKKSKKEIKQT

SEQ ID NO: 2221887 - protein, 12 aa, Cryptosporidium parvum
NTEKSENNLKDI

SEQ ID NO: 2221888 - protein, 20 aa, Cryptosporidium parvum
NTELEEDAKNYREKEEITNN

SEQ ID NO: 2221889 - protein, 10 aa, Cryptosporidium parvum
NTENISPNYS

SEQ ID NO: 2221890 - protein, 6 aa, Cryptosporidium parvum
NTENKT

SEQ ID NO: 2221891 - protein, 18 aa, Cryptosporidium parvum
NTENSNAGNGVNETGEIT

SEQ ID NO: 2221892 - protein, 7 aa, Cryptosporidium parvum
NTENSPM

SEQ ID NO: 2221893 - protein, 8 aa, Cryptosporidium parvum
NTEPGRVP

SEQ ID NO: 2221894 - protein, 7 aa, Cryptosporidium parvum
NTEPKYE

SEQ ID NO: 2221895 - protein, 6 aa, Cryptosporidium parvum
NTESKS

SEQ ID NO: 2221896 - protein, 8 aa, Cryptosporidium parvum
NTETNVGH

SEQ ID NO: 2221897 - protein, 4 aa, Cryptosporidium parvum
NTEV

SEQ ID NO: 2221898 - protein, 13 aa, Cryptosporidium parvum
NTEYESEHLPTTE

SEQ ID NO: 2221899 - protein, 5 aa, Cryptosporidium parvum
NTEYK

SEQ ID NO: 2221900 - protein, 6 aa, Cryptosporidium parvum
NTFKKK

SEQ ID NO: 2221901 - protein, 5 aa, Cryptosporidium parvum
NTFSG

SEQ ID NO: 2221902 - protein, 4 aa, Cryptosporidium parvum
NTFT

SEQ ID NO: 2221903 - protein, 20 aa, Cryptosporidium parvum
NTGAERSSSDNRKNGPRSGM

SEQ ID NO: 2221904 - protein, 6 aa, Cryptosporidium parvum
NTGELE

SEQ ID NO: 2221905 - protein, 20 aa, Cryptosporidium parvum
NTGGAGGAGGTGGAGTGDVI

SEQ ID NO: 2221906 - protein, 4 aa, Cryptosporidium parvum
NTGL

SEQ ID NO: 2221907 - protein, 5 aa, Cryptosporidium parvum
NTGLR

SEQ ID NO: 2221908 - protein, 12 aa, Cryptosporidium parvum
NTHGGIDQKNYT

SEQ ID NO: 2221909 - protein, 9 aa, Cryptosporidium parvum
NTHKPPISN

SEQ ID NO: 2221910 - protein, 18 aa, Cryptosporidium parvum
NTIEEQNETEVNLTEGNP

SEQ ID NO: 2221911 - protein, 21 aa, Cryptosporidium parvum
NTIENSENKEHASNKDEPDRA

SEQ ID NO: 2221912 - protein, 4 aa, Cryptosporidium parvum
NTII

SEQ ID NO: 2221913 - protein, 4 aa, Cryptosporidium parvum
NTIN

SEQ ID NO: 2221914 - protein, 6 aa, Cryptosporidium parvum
NTINEN

SEQ ID NO: 2221915 - protein, 11 aa, Cryptosporidium parvum
NTIPSSDISNK

SEQ ID NO: 2221916 - protein, 5 aa, Cryptosporidium parvum
NTISE

SEQ ID NO: 2221917 - protein, 10 aa, Cryptosporidium parvum
NTISSSNIQE

SEQ ID NO: 2221918 - protein, 6 aa, Cryptosporidium parvum
NTITSI

SEQ ID NO: 2221919 - protein, 6 aa, Cryptosporidium parvum
NTKGCE

SEQ ID NO: 2221920 - protein, 16 aa, Cryptosporidium parvum
NTKGKNQNNKDIKQDL

SEQ ID NO: 2221921 - protein, 6 aa, Cryptosporidium parvum
NTKHVG

SEQ ID NO: 2221922 - protein, 11 aa, Cryptosporidium parvum
NTKIEGETNKY

SEQ ID NO: 2221923 - protein, 11 aa, Cryptosporidium parvum
NTKKEPNFSKK

SEQ ID NO: 2221924 - protein, 9 aa, Cryptosporidium parvum
NTKNHQQSV

SEQ ID NO: 2221925 - protein, 6 aa, Cryptosporidium parvum
NTKRLS

SEQ ID NO: 2221926 - protein, 6 aa, Cryptosporidium parvum
NTKSRS

SEQ ID NO: 2221927 - protein, 8 aa, Cryptosporidium parvum
NTLKGTNF

SEQ ID NO: 2221928 - protein, 13 aa, Cryptosporidium parvum
NTLNDLNGGDNNE

SEQ ID NO: 2221929 - protein, 15 aa, Cryptosporidium parvum
NTNATTTASTSNAMR

SEQ ID NO: 2221930 - protein, 10 aa, Cryptosporidium parvum
NTNCTQGHES

SEQ ID NO: 2221931 - protein, 9 aa, Cryptosporidium parvum
NTNDHQSNY

SEQ ID NO: 2221932 - protein, 10 aa, Cryptosporidium parvum
NTNHNQPPLV

SEQ ID NO: 2221933 - protein, 8 aa, Cryptosporidium parvum
NTNIGSGS

SEQ ID NO: 2221934 - protein, 5 aa, Cryptosporidium parvum
NTNKE

SEQ ID NO: 2221935 - protein, 20 aa, Cryptosporidium parvum
NTNKEQNNMGYKNNNELIEN

SEQ ID NO: 2221936 - protein, 8 aa, Cryptosporidium parvum
NTNKEVSN

SEQ ID NO: 2221937 - protein, 10 aa, Cryptosporidium parvum
NTNKGDFNTL

SEQ ID NO: 2221938 - protein, 11 aa, Cryptosporidium parvum
NTNKNNPSYQV

SEQ ID NO: 2221939 - protein, 16 aa, Cryptosporidium parvum
NTNLTEQGKGSARTSL

SEQ ID NO: 2221940 - protein, 13 aa, Cryptosporidium parvum
NTNNINNNKLSHP

SEQ ID NO: 2221941 - protein, 11 aa, Cryptosporidium parvum
NTNNKASSVSH

SEQ ID NO: 2221942 - protein, 9 aa, Cryptosporidium parvum
NTNNSSTGL

SEQ ID NO: 2221943 - protein, 6 aa, Cryptosporidium parvum
NTNPDV

SEQ ID NO: 2221944 - protein, 10 aa, Cryptosporidium parvum
NTNPKNIDEN

SEQ ID NO: 2221945 - protein, 6 aa, Cryptosporidium parvum
NTNPTL

SEQ ID NO: 2221946 - protein, 11 aa, Cryptosporidium parvum
NTNSDSVKDSE

SEQ ID NO: 2221947 - protein, 9 aa, Cryptosporidium parvum
NTNSNNPIG

SEQ ID NO: 2221948 - protein, 10 aa, Cryptosporidium parvum
NTNSSEQTRK

SEQ ID NO: 2221949 - protein, 5 aa, Cryptosporidium parvum
NTPDC

SEQ ID NO: 2221950 - protein, 7 aa, Cryptosporidium parvum
NTPEEYP

SEQ ID NO: 2221951 - protein, 4 aa, Cryptosporidium parvum
NTPG

SEQ ID NO: 2221952 - protein, 5 aa, Cryptosporidium parvum
NTPIS

SEQ ID NO: 2221953 - protein, 10 aa, Cryptosporidium parvum
NTPKSHGGSE

SEQ ID NO: 2221954 - protein, 7 aa, Cryptosporidium parvum
NTPKSQF

SEQ ID NO: 2221955 - protein, 4 aa, Cryptosporidium parvum
NTPL

SEQ ID NO: 2221956 - protein, 6 aa, Cryptosporidium parvum
NTPLEQ

SEQ ID NO: 2221957 - protein, 5 aa, Cryptosporidium parvum
NTPLR

SEQ ID NO: 2221958 - protein, 5 aa, Cryptosporidium parvum
NTPNL

SEQ ID NO: 2221959 - protein, 4 aa, Cryptosporidium parvum
NTPS

SEQ ID NO: 2221960 - protein, 6 aa, Cryptosporidium parvum
NTPSEL

SEQ ID NO: 2221961 - protein, 5 aa, Cryptosporidium parvum
NTPYN

SEQ ID NO: 2221962 - protein, 4 aa, Cryptosporidium parvum
NTQC

SEQ ID NO: 2221963 - protein, 10 aa, Cryptosporidium parvum
NTQEFSGQQN

SEQ ID NO: 2221964 - protein, 6 aa, Cryptosporidium parvum
NTQEQR

SEQ ID NO: 2221965 - protein, 6 aa, Cryptosporidium parvum
NTQFKD

SEQ ID NO: 2221966 - protein, 5 aa, Cryptosporidium parvum
NTQGE

SEQ ID NO: 2221967 - protein, 44 aa, Cryptosporidium parvum
NTQGSHGAVGGIGSVSSSSIVGSNGNSGNSVGIGNSGNGGSMSR

SEQ ID NO: 2221968 - protein, 11 aa, Cryptosporidium parvum
NTQNKTFNNSI

SEQ ID NO: 2221969 - protein, 29 aa, Cryptosporidium parvum
NTQNPGQTSSFGSQNLHSSSSSSSSSYYS

SEQ ID NO: 2221970 - protein, 8 aa, Cryptosporidium parvum
NTQRNTYN

SEQ ID NO: 2221971 - protein, 6 aa, Cryptosporidium parvum
NTQRSL

SEQ ID NO: 2221972 - protein, 16 aa, Cryptosporidium parvum
NTQSNTKNSREQSHEK

SEQ ID NO: 2221973 - protein, 7 aa, Cryptosporidium parvum
NTQSVKD

SEQ ID NO: 2221974 - protein, 10 aa, Cryptosporidium parvum
NTRENDKSRD

SEQ ID NO: 2221975 - protein, 5 aa, Cryptosporidium parvum
NTRHA

SEQ ID NO: 2221976 - protein, 8 aa, Cryptosporidium parvum
NTRLPSAS

SEQ ID NO: 2221977 - protein, 12 aa, Cryptosporidium parvum
NTRNNEEDLNVS

SEQ ID NO: 2221978 - protein, 11 aa, Cryptosporidium parvum
NTRNSIPGGVY

SEQ ID NO: 2221979 - protein, 10 aa, Cryptosporidium parvum
NTRRASDNTI

SEQ ID NO: 2221980 - protein, 23 aa, Cryptosporidium parvum
NTSGNWTSKTYLSSNSSAPKTVI

SEQ ID NO: 2221981 - protein, 7 aa, Cryptosporidium parvum
NTSKSGK

SEQ ID NO: 2221982 - protein, 9 aa, Cryptosporidium parvum
NTSKTKKKI

SEQ ID NO: 2221983 - protein, 4 aa, Cryptosporidium parvum
NTSL

SEQ ID NO: 2221984 - protein, 5 aa, Cryptosporidium parvum
NTSND

SEQ ID NO: 2221985 - protein, 11 aa, Cryptosporidium parvum
NTSNLNPPSNN

SEQ ID NO: 2221986 - protein, 72 aa, Cryptosporidium parvum
NTSNNTATGSANIGPANTMNSGNNSNVNTTSGNTTGNNTTTGTSGGLISSSGNLSNSNNNSATGNTNSQANS

SEQ ID NO: 2221987 - protein, 8 aa, Cryptosporidium parvum
NTSPLSLS

SEQ ID NO: 2221988 - protein, 21 aa, Cryptosporidium parvum
NTSQSEHGPAFEPLPGKNSLN

SEQ ID NO: 2221989 - protein, 8 aa, Cryptosporidium parvum
NTSSDPKF

SEQ ID NO: 2221990 - protein, 6 aa, Cryptosporidium parvum
NTSSDY

SEQ ID NO: 2221991 - protein, 9 aa, Cryptosporidium parvum
NTSSGGHGV

SEQ ID NO: 2221992 - protein, 16 aa, Cryptosporidium parvum
NTSSKTQIKPSNTKDD

SEQ ID NO: 2221993 - protein, 44 aa, Cryptosporidium parvum
NTSSMVKEERSHSESAPLVKTEQEEEIGQNKRHTYDDATQVNNV

SEQ ID NO: 2221994 - protein, 5 aa, Cryptosporidium parvum
NTSSN

SEQ ID NO: 2221995 - protein, 8 aa, Cryptosporidium parvum
NTSSQNTF

SEQ ID NO: 2221996 - protein, 6 aa, Cryptosporidium parvum
NTSSQY

SEQ ID NO: 2221997 - protein, 4 aa, Cryptosporidium parvum
NTST

SEQ ID NO: 2221998 - protein, 6 aa, Cryptosporidium parvum
NTSTQY

SEQ ID NO: 2221999 - protein, 5 aa, Cryptosporidium parvum
NTSTR

SEQ ID NO: 2222000 - protein, 10 aa, Cryptosporidium parvum
NTSTSKKRRL

SEQ ID NO: 2222001 - protein, 8 aa, Cryptosporidium parvum
NTSTSNAI

SEQ ID NO: 2222002 - protein, 8 aa, Cryptosporidium parvum
NTSVSDGA

SEQ ID NO: 2222003 - protein, 12 aa, Cryptosporidium parvum
NTTDNQKLNNSL

SEQ ID NO: 2222004 - protein, 6 aa, Cryptosporidium parvum
NTTEFA

SEQ ID NO: 2222005 - protein, 18 aa, Cryptosporidium parvum
NTTFNEKVKSSSSVEGSI

SEQ ID NO: 2222006 - protein, 10 aa, Cryptosporidium parvum
NTTKHNRNYS

SEQ ID NO: 2222007 - protein, 5 aa, Cryptosporidium parvum
NTTKP

SEQ ID NO: 2222008 - protein, 4 aa, Cryptosporidium parvum
NTTL

SEQ ID NO: 2222009 - protein, 7 aa, Cryptosporidium parvum
NTTPDDF

SEQ ID NO: 2222010 - protein, 7 aa, Cryptosporidium parvum
NTTSDED

SEQ ID NO: 2222011 - protein, 9 aa, Cryptosporidium parvum
NTTSSITPS

SEQ ID NO: 2222012 - protein, 5 aa, Cryptosporidium parvum
NTTVK

SEQ ID NO: 2222013 - protein, 6 aa, Cryptosporidium parvum
NTVSFS

SEQ ID NO: 2222014 - protein, 5 aa, Cryptosporidium parvum
NTVSG

SEQ ID NO: 2222015 - protein, 32 aa, Cryptosporidium parvum; identical to SEQ ID NO: 2117695

SEQ ID NO: 2222016 - protein, 6 aa, Cryptosporidium parvum
NVASGL

SEQ ID NO: 2222017 - protein, 8 aa, Cryptosporidium parvum
NVDDQQGF

SEQ ID NO: 2222018 - protein, 4 aa, Cryptosporidium parvum
NVDE

SEQ ID NO: 2222019 - protein, 12 aa, Cryptosporidium parvum
NVEDASKRDKYS

SEQ ID NO: 2222020 - protein, 39 aa, Cryptosporidium parvum
NVEDGNQSGNRIERGSEYGEEEYEARSLSSRSEASEESQ

SEQ ID NO: 2222021 - protein, 5 aa, Cryptosporidium parvum
NVEPN

SEQ ID NO: 2222022 - protein, 8 aa, Cryptosporidium parvum
NVETKKGF

SEQ ID NO: 2222023 - protein, 5 aa, Cryptosporidium parvum
NVGGV

SEQ ID NO: 2222024 - protein, 6 aa, Cryptosporidium parvum
NVGPND

SEQ ID NO: 2222025 - protein, 5 aa, Cryptosporidium parvum
NVGQK

SEQ ID NO: 2222026 - protein, 4 aa, Cryptosporidium parvum
NVGS

SEQ ID NO: 2222027 - protein, 15 aa, Cryptosporidium parvum
NVKGKTNEKEKNDDL

SEQ ID NO: 2222028 - protein, 18 aa, Cryptosporidium parvum
NVKKDGDHEIEEKRDGNT

SEQ ID NO: 2222029 - protein, 8 aa, Cryptosporidium parvum
NVKSKGQV

SEQ ID NO: 2222030 - protein, 5 aa, Cryptosporidium parvum
NVKVQ

SEQ ID NO: 2222031 - protein, 6 aa, Cryptosporidium parvum
NVKYDN

SEQ ID NO: 2222032 - protein, 4 aa, Cryptosporidium parvum
NVLS

SEQ ID NO: 2222033 - protein, 16 aa, Cryptosporidium parvum
NVNDTSKNDPNTPEDF

SEQ ID NO: 2222034 - protein, 8 aa, Cryptosporidium parvum
NVNNNEKI

SEQ ID NO: 2222035 - protein, 16 aa, Cryptosporidium parvum
NVNNNNNNNSKSSIID

SEQ ID NO: 2222036 - protein, 5 aa, Cryptosporidium parvum
NVNQR

SEQ ID NO: 2222037 - protein, 8 aa, Cryptosporidium parvum
NVNQTQKD

SEQ ID NO: 2222038 - protein, 4 aa, Cryptosporidium parvum
NVNY

SEQ ID NO: 2222039 - protein, 4 aa, Cryptosporidium parvum
NVPG

SEQ ID NO: 2222040 - protein, 14 aa, Cryptosporidium parvum
NVPSSIKSIKDSND

SEQ ID NO: 2222041 - protein, 12 aa, Cryptosporidium parvum
NVPTSLSVPKTQ

SEQ ID NO: 2222042 - protein, 14 aa, Cryptosporidium parvum
NVQGKKTIVFLLKS

SEQ ID NO: 2222043 - protein, 8 aa, Cryptosporidium parvum
NVQPKDVK

SEQ ID NO: 2222044 - protein, 7 aa, Cryptosporidium parvum
NVSDEND

SEQ ID NO: 2222045 - protein, 12 aa, Cryptosporidium parvum
NVSSEYSSDEDS

SEQ ID NO: 2222046 - protein, 41 aa, Cryptosporidium parvum
NVSSIGGKNTNLLTTPSNVNISNTNYGSGGIGIGGGGGGVG

SEQ ID NO: 2222047 - protein, 11 aa, Cryptosporidium parvum
NVSSKNSKSFD

SEQ ID NO: 2222048 - protein, 7 aa, Cryptosporidium parvum
NVSSSRR

SEQ ID NO: 2222049 - protein, 8 aa, Cryptosporidium parvum
NVSSTSLN

SEQ ID NO: 2222050 - protein, 7 aa, Cryptosporidium parvum
NVSTISS

SEQ ID NO: 2222051 - protein, 15 aa, Cryptosporidium parvum
NVTKDRRKKKKKQLL

SEQ ID NO: 2222052 - protein, 9 aa, Cryptosporidium parvum
NVTKKDNDH

SEQ ID NO: 2222053 - protein, 17 aa, Cryptosporidium parvum
NVTPAGIESPKNNKRDV

SEQ ID NO: 2222054 - protein, 8 aa, Cryptosporidium parvum
NVTSEDDF

SEQ ID NO: 2222055 - protein, 8 aa, Cryptosporidium parvum
NVTYDSNN

SEQ ID NO: 2222056 - protein, 36 aa, Cryptosporidium parvum
NVYSGSSKYTLSNDYPAEGYEGISGGSSTSRTQQQA

SEQ ID NO: 2222057 - protein, 14 aa, Cryptosporidium parvum
NWKGSEKKFSNIED

SEQ ID NO: 2222058 - protein, 12 aa, Cryptosporidium parvum
NWNSEKAEQDED

SEQ ID NO: 2222059 - protein, 10 aa, Cryptosporidium parvum
NWRRPSNNSF

SEQ ID NO: 2222060 - protein, 17 aa, Cryptosporidium parvum
NWTQDDNFTRPANTDSS

SEQ ID NO: 2222061 - protein, 12 aa, Cryptosporidium parvum
NYCTTNEKLKNG

SEQ ID NO: 2222062 - protein, 23 aa, Cryptosporidium parvum
NYDEDDEDIDEDVDEDHHEDEEL

SEQ ID NO: 2222063 - protein, 6 aa, Cryptosporidium parvum
NYDTLN

SEQ ID NO: 2222064 - protein, 9 aa, Cryptosporidium parvum
NYENPAVGN

SEQ ID NO: 2222065 - protein, 19 aa, Cryptosporidium parvum
NYEQNTHTHPRASSLNNRI

SEQ ID NO: 2222066 - protein, 11 aa, Cryptosporidium parvum
NYETKRSGSHS

SEQ ID NO: 2222067 - protein, 10 aa, Cryptosporidium parvum
NYGITEGRSS

SEQ ID NO: 2222068 - protein, 14 aa, Cryptosporidium parvum
NYGNEQSAANNSYY

SEQ ID NO: 2222069 - protein, 15 aa, Cryptosporidium parvum
NYGNQENVGRDGNTI

SEQ ID NO: 2222070 - protein, 6 aa, Cryptosporidium parvum
NYGNYS

SEQ ID NO: 2222071 - protein, 14 aa, Cryptosporidium parvum
NYGSYSQQPSSGYM

SEQ ID NO: 2222072 - protein, 5 aa, Cryptosporidium parvum
NYISG

SEQ ID NO: 2222073 - protein, 11 aa, Cryptosporidium parvum
NYKSGNVSNEM

SEQ ID NO: 2222074 - protein, 4 aa, Cryptosporidium parvum
NYND

SEQ ID NO: 2222075 - protein, 5 aa, Cryptosporidium parvum
NYNDF

SEQ ID NO: 2222076 - protein, 5 aa, Cryptosporidium parvum
NYNDR

SEQ ID NO: 2222077 - protein, 10 aa, Cryptosporidium parvum
NYNDSNINNN

SEQ ID NO: 2222078 - protein, 10 aa, Cryptosporidium parvum
NYNGGESFSN

SEQ ID NO: 2222079 - protein, 11 aa, Cryptosporidium parvum
NYNGSDNKNSF

SEQ ID NO: 2222080 - protein, 11 aa, Cryptosporidium parvum
NYNIGQSNVPP

SEQ ID NO: 2222081 - protein, 4 aa, Cryptosporidium parvum
NYNN

SEQ ID NO: 2222082 - protein, 15 aa, Cryptosporidium parvum
NYNNEENTISQNQNV

SEQ ID NO: 2222083 - protein, 107 aa, Cryptosporidium parvum
NYNNTGGGNVGNNTSTSTNTGGVNTNPNNAGTSNANAGGNNINGNVNNNIGGGGSIVGNNSNGVINSGSGGPSTSSNMPNHTQGNSGTQMGGGAQLGSSNFTPLPSG

SEQ ID NO: 2222084 - protein, 10 aa, Cryptosporidium parvum
NYPDKSSEIL

SEQ ID NO: 2222085 - protein, 13 aa, Cryptosporidium parvum
NYPKHRKAIVPFF

SEQ ID NO: 2222086 - protein, 4 aa, Cryptosporidium parvum
NYPN

SEQ ID NO: 2222087 - protein, 5 aa, Cryptosporidium parvum
NYQDD

SEQ ID NO: 2222088 - protein, 9 aa, Cryptosporidium parvum
NYQNSSEYK

SEQ ID NO: 2222089 - protein, 12 aa, Cryptosporidium parvum
NYQPSKKKHIEP

SEQ ID NO: 2222090 - protein, 14 aa, Cryptosporidium parvum
NYQSQNNGKKLPPR

SEQ ID NO: 2222091 - protein, 7 aa, Cryptosporidium parvum
NYRDTIK

SEQ ID NO: 2222092 - protein, 7 aa, Cryptosporidium parvum
NYRKSES

SEQ ID NO: 2222093 - protein, 11 aa, Cryptosporidium parvum
NYRQKANPHSE

SEQ ID NO: 2222094 - protein, 6 aa, Cryptosporidium parvum
NYSDNI

SEQ ID NO: 2222095 - protein, 45 aa, Cryptosporidium parvum
  misc_feature (18)..(18): Xaa can be any naturally occurring amino acid
  misc_feature (30)..(30): Xaa can be any naturally occurring amino acid
NYSDPYSESNNNNNYDEXKSVYFFKKAKIXWANIIQKIMLILINL

SEQ ID NO: 2222096 - protein, 7 aa, Cryptosporidium parvum
NYSEEYG

SEQ ID NO: 2222097 - protein, 5 aa, Cryptosporidium parvum
NYSEM

SEQ ID NO: 2222098 - protein, 6 aa, Cryptosporidium parvum
NYSERN

SEQ ID NO: 2222099 - protein, 9 aa, Cryptosporidium parvum
NYSKNSRSK

SEQ ID NO: 2222100 - protein, 5 aa, Cryptosporidium parvum
NYSKT

SEQ ID NO: 2222101 - protein, 15 aa, Cryptosporidium parvum
NYSNANDPNSSTYQN

SEQ ID NO: 2222102 - protein, 24 aa, Cryptosporidium parvum
NYSNPIKSDGAKSERSKMNSKSKV

SEQ ID NO: 2222103 - protein, 7 aa, Cryptosporidium parvum
NYSNPTE

SEQ ID NO: 2222104 - protein, 7 aa, Cryptosporidium parvum
NYSNSAV

SEQ ID NO: 2222105 - protein, 7 aa, Cryptosporidium parvum
NYSPNSG

SEQ ID NO: 2222106 - protein, 8 aa, Cryptosporidium parvum
NYSRISSE

SEQ ID NO: 2222107 - protein, 8 aa, Cryptosporidium parvum
NYSSDRIN

SEQ ID NO: 2222108 - protein, 22 aa, Cryptosporidium parvum
NYSSGNNNKSEKKEDFKEQNSC

SEQ ID NO: 2222109 - protein, 14 aa, Cryptosporidium parvum
NYSSNSRSIEVEAQ

SEQ ID NO: 2222110 - protein, 8 aa, Cryptosporidium parvum
NYSSRDLK

SEQ ID NO: 2222111 - protein, 15 aa, Cryptosporidium parvum
NYSTNHLKSSKNTIS

SEQ ID NO: 2222112 - protein, 9 aa, Cryptosporidium parvum
NYTDKNDEL

SEQ ID NO: 2222113 - protein, 4 aa, Cryptosporidium parvum
NYTE

SEQ ID NO: 2222114 - protein, 9 aa, Cryptosporidium parvum
NYTNNNSGV

SEQ ID NO: 2222115 - protein, 18 aa, Cryptosporidium parvum
NYTPSTIKNNNNNSNLTF

SEQ ID NO: 2222116 - protein, 8 aa, Cryptosporidium parvum
NYTSENKA

SEQ ID NO: 2222117 - protein, 7 aa, Cryptosporidium parvum
PACRPTA

SEQ ID NO: 2222118 - protein, 11 aa, Cryptosporidium parvum
PADPNNSSQVD

SEQ ID NO: 2222119 - protein, 5 aa, Cryptosporidium parvum
PAGKG

SEQ ID NO: 2222120 - protein, 10 aa, Cryptosporidium parvum
PAKVKDSQNC

SEQ ID NO: 2222121 - protein, 6 aa, Cryptosporidium parvum
PALNKN

SEQ ID NO: 2222122 - protein, 7 aa, Cryptosporidium parvum
PALPATI

SEQ ID NO: 2222123 - protein, 9 aa, Cryptosporidium parvum
PAMTTPGIA

SEQ ID NO: 2222124 - protein, 27 aa, Cryptosporidium parvum
PANINKGGYGEMGNQGQSLTVNRPKNE

SEQ ID NO: 2222125 - protein, 6 aa, Cryptosporidium parvum
PANNYN

SEQ ID NO: 2222126 - protein, 5 aa, Cryptosporidium parvum
PANPI

SEQ ID NO: 2222127 - protein, 10 aa, Cryptosporidium parvum
PANRKDNDPI

SEQ ID NO: 2222128 - protein, 10 aa, Cryptosporidium parvum
PAPITETPVT

SEQ ID NO: 2222129 - protein, 6 aa, Cryptosporidium parvum
PAPKHN

SEQ ID NO: 2222130 - protein, 7 aa, Cryptosporidium parvum
PAPPIPL

SEQ ID NO: 2222131 - protein, 4 aa, Cryptosporidium parvum
PAPR

SEQ ID NO: 2222132 - protein, 5 aa, Cryptosporidium parvum
PAPRG

SEQ ID NO: 2222133 - protein, 25 aa, Cryptosporidium parvum
PAQVGTQSNHQNLQNVNQSKTQYPH

SEQ ID NO: 2222134 - protein, 7 aa, Cryptosporidium parvum
PASESLG

SEQ ID NO: 2222135 - protein, 6 aa, Cryptosporidium parvum
PASGYV

SEQ ID NO: 2222136 - protein, 6 aa, Cryptosporidium parvum
PASLRD

SEQ ID NO: 2222137 - protein, 8 aa, Cryptosporidium parvum
PATNLEEA

SEQ ID NO: 2222138 - protein, 4 aa, Cryptosporidium parvum
PATQ

SEQ ID NO: 2222139 - protein, 8 aa, Cryptosporidium parvum
PCEAPDRL

SEQ ID NO: 2222140 - protein, 7 aa, Cryptosporidium parvum
PCETNNK

SEQ ID NO: 2222141 - protein, 20 aa, Cryptosporidium parvum
PCFPPNNSKIENTNNTNAQN

SEQ ID NO: 2222142 - protein, 6 aa, Cryptosporidium parvum
PCSSDG

SEQ ID NO: 2222143 - protein, 14 aa, Cryptosporidium parvum
PDANESTNSDESQY

SEQ ID NO: 2222144 - protein, 8 aa, Cryptosporidium parvum
PDATQSAI

SEQ ID NO: 2222145 - protein, 11 aa, Cryptosporidium parvum
PDENGVSSYEQ

SEQ ID NO: 2222146 - protein, 8 aa, Cryptosporidium parvum
PDENIGSE

SEQ ID NO: 2222147 - protein, 5 aa, Cryptosporidium parvum
PDESH

SEQ ID NO: 2222148 - protein, 5 aa, Cryptosporidium parvum
PDESW

SEQ ID NO: 2222149 - protein, 5 aa, Cryptosporidium parvum
PDFNK

SEQ ID NO: 2222150 - protein, 6 aa, Cryptosporidium parvum
PDGINT

SEQ ID NO: 2222151 - protein, 14 aa, Cryptosporidium parvum
PDHEKSNSEEIESQ

SEQ ID NO: 2222152 - protein, 5 aa, Cryptosporidium parvum
PDIIS

SEQ ID NO: 2222153 - protein, 95 aa, Cryptosporidium parvum
PDIQAEKRSKSSKRDRSDDLERHEEDDEDDDDELASGNQSDPYTGSDSQSETRSNLDSSSDAEEKKRQHASKSSKNKEKKSRKDKKKKKKQEDRI

SEQ ID NO: 2222154 - protein, 18 aa, Cryptosporidium parvum
PDIQRNNNTYSKSDQGLN

SEQ ID NO: 2222155 - protein, 4 aa, Cryptosporidium parvum
PDIS

SEQ ID NO: 2222156 - protein, 10 aa, Cryptosporidium parvum
PDKNSDLSAR

SEQ ID NO: 2222157 - protein, 7 aa, Cryptosporidium parvum
PDLEGGF

SEQ ID NO: 2222158 - protein, 9 aa, Cryptosporidium parvum
PDNEFQGEG

SEQ ID NO: 2222159 - protein, 14 aa, Cryptosporidium parvum
PDNGIDESEKSIKD

SEQ ID NO: 2222160 - protein, 9 aa, Cryptosporidium parvum
PDNNSNSNT

SEQ ID NO: 2222161 - protein, 10 aa, Cryptosporidium parvum
PDNQKKNSNI

SEQ ID NO: 2222162 - protein, 28 aa, Cryptosporidium parvum
PDNSSGATYNSNNISENSIKTEQKSKMT

SEQ ID NO: 2222163 - protein, 5 aa, Cryptosporidium parvum
PDPDQ

SEQ ID NO: 2222164 - protein, 10 aa, Cryptosporidium parvum
PDPEQETKDR

SEQ ID NO: 2222165 - protein, 4 aa, Cryptosporidium parvum
PDPL

SEQ ID NO: 2222166 - protein, 5 aa, Cryptosporidium parvum
PDPPT

SEQ ID NO: 2222167 - protein, 5 aa, Cryptosporidium parvum
PDPSV

SEQ ID NO: 2222168 - protein, 13 aa, Cryptosporidium parvum
PDQGDGGYYGDSI

SEQ ID NO: 2222169 - protein, 13 aa, Cryptosporidium parvum
PDQIKDELKQNEI

SEQ ID NO: 2222170 - protein, 9 aa, Cryptosporidium parvum
PDQQNNNDN

SEQ ID NO: 2222171 - protein, 5 aa, Cryptosporidium parvum
PDRHD

SEQ ID NO: 2222172 - protein, 21 aa, Cryptosporidium parvum
PDSANKVEHREIGDSDKTKIN

SEQ ID NO: 2222173 - protein, 4 aa, Cryptosporidium parvum
PDSE

SEQ ID NO: 2222174 - protein, 4 aa, Cryptosporidium parvum
PDSF

SEQ ID NO: 2222175 - protein, 13 aa, Cryptosporidium parvum
PDSILGSTAAQDV

SEQ ID NO: 2222176 - protein, 5 aa, Cryptosporidium parvum
PDSNN

SEQ ID NO: 2222177 - protein, 9 aa, Cryptosporidium parvum
PDSSYSLYD

SEQ ID NO: 2222178 - protein, 10 aa, Cryptosporidium parvum
PDTDPTRRGR

SEQ ID NO: 2222179 - protein, 13 aa, Cryptosporidium parvum
PDTSESKSSIDAL

SEQ ID NO: 2222180 - protein, 10 aa, Cryptosporidium parvum
PDYPTSEGRQ

SEQ ID NO: 2222181 - protein, 9 aa, Cryptosporidium parvum
PEASDKEKI

SEQ ID NO: 2222182 - protein, 7 aa, Cryptosporidium parvum
PEDATQT

SEQ ID NO: 2222183 - protein, 6 aa, Cryptosporidium parvum
PEDKTI

SEQ ID NO: 2222184 - protein, 8 aa, Cryptosporidium parvum
PEDPNKLE

SEQ ID NO: 2222185 - protein, 14 aa, Cryptosporidium parvum
PEDPSSSIQMTKDQ

SEQ ID NO: 2222186 - protein, 5 aa, Cryptosporidium parvum
PEDVR

SEQ ID NO: 2222187 - protein, 5 aa, Cryptosporidium parvum
PEEDG

SEQ ID NO: 2222188 - protein, 14 aa, Cryptosporidium parvum
PEEDKERTNEKREH

SEQ ID NO: 2222189 - protein, 11 aa, Cryptosporidium parvum
PEEKNVNKSRI

SEQ ID NO: 2222190 - protein, 12 aa, Cryptosporidium parvum
PEENLRTPTPDL

SEQ ID NO: 2222191 - protein, 5 aa, Cryptosporidium parvum
PEEQC

SEQ ID NO: 2222192 - protein, 7 aa, Cryptosporidium parvum
PEEQSKT

SEQ ID NO: 2222193 - protein, 7 aa, Cryptosporidium parvum
PEERSCK

SEQ ID NO: 2222194 - protein, 4 aa, Cryptosporidium parvum
PEFE

SEQ ID NO: 2222195 - protein, 16 aa, Cryptosporidium parvum
PEFGSQDEKKVQAPGP

SEQ ID NO: 2222196 - protein, 7 aa, Cryptosporidium parvum
PEFPDRD

SEQ ID NO: 2222197 - protein, 4 aa, Cryptosporidium parvum
PEFS

SEQ ID NO: 2222198 - protein, 4 aa, Cryptosporidium parvum
PEGD

SEQ ID NO: 2222199 - protein, 6 aa, Cryptosporidium parvum
PEGENR

SEQ ID NO: 2222200 - protein, 9 aa, Cryptosporidium parvum
PEGETIPDE

SEQ ID NO: 2222201 - protein, 4 aa, Cryptosporidium parvum
PEGF

SEQ ID NO: 2222202 - protein, 10 aa, Cryptosporidium parvum
PEGPGYNKIG

SEQ ID NO: 2222203 - protein, 79 aa, Cryptosporidium parvum
PEGSKPPVSLGSTWSSSLNQEDTRSEYSDSGSESGKEPDSYNSGDSDNQEEGSISSSQQSNESKKRKKNTETKNKSSAK

SEQ ID NO: 2222204 - protein, 11 aa, Cryptosporidium parvum
PEGSREDSTNE

SEQ ID NO: 2222205 - protein, 7 aa, Cryptosporidium parvum
PEGTRSK

SEQ ID NO: 2222206 - protein, 6 aa, Cryptosporidium parvum
PEGTSS

SEQ ID NO: 2222207 - protein, 29 aa, Cryptosporidium parvum
PEIDPYEQKSLNVSSQKIKKKNKDNQANI

SEQ ID NO: 2222208 - protein, 4 aa, Cryptosporidium parvum
PEIG

SEQ ID NO: 2222209 - protein, 19 aa, Cryptosporidium parvum
PEIKEQSQTLSQQKHSKRV

SEQ ID NO: 2222210 - protein, 6 aa, Cryptosporidium parvum
PEISDN

SEQ ID NO: 2222211 - protein, 4 aa, Cryptosporidium parvum
PEIT

SEQ ID NO: 2222212 - protein, 16 aa, Cryptosporidium parvum
PEKLSSSLDSTESVRE

SEQ ID NO: 2222213 - protein, 6 aa, Cryptosporidium parvum
PEKNPL

SEQ ID NO: 2222214 - protein, 8 aa, Cryptosporidium parvum
PEKNVPKS

SEQ ID NO: 2222215 - protein, 7 aa, Cryptosporidium parvum
PEKQSDH

SEQ ID NO: 2222216 - protein, 7 aa, Cryptosporidium parvum
PEKSPPS

SEQ ID NO: 2222217 - protein, 6 aa, Cryptosporidium parvum
PELPDN

SEQ ID NO: 2222218 - protein, 31 aa, Cryptosporidium parvum
PELSKETTDIKNCSNKKKLGHNLSSSNSLNT

SEQ ID NO: 2222219 - protein, 4 aa, Cryptosporidium parvum
PEMK

SEQ ID NO: 2222220 - protein, 4 aa, Cryptosporidium parvum
PENI

SEQ ID NO: 2222221 - protein, 11 aa, Cryptosporidium parvum
PENNASSSKSR

SEQ ID NO: 2222222 - protein, 15 aa, Cryptosporidium parvum
PENPQNNTKPEERGR

SEQ ID NO: 2222223 - protein, 8 aa, Cryptosporidium parvum
PENSNKQE

SEQ ID NO: 2222224 - protein, 7 aa, Cryptosporidium parvum
PENSRQI

SEQ ID NO: 2222225 - protein, 8 aa, Cryptosporidium parvum
PENYNPTD

SEQ ID NO: 2222226 - protein, 6 aa, Cryptosporidium parvum
PEPQRQ

SEQ ID NO: 2222227 - protein, 21 aa, Cryptosporidium parvum
PEPTKSFQEELGESKDVPQQG

SEQ ID NO: 2222228 - protein, 17 aa, Cryptosporidium parvum
PEQIESGNQEKKIKGKR

SEQ ID NO: 2222229 - protein, 9 aa, Cryptosporidium parvum
PEQKAKNEH

SEQ ID NO: 2222230 - protein, 10 aa, Cryptosporidium parvum
PEQNGGKCDH

SEQ ID NO: 2222231 - protein, 16 aa, Cryptosporidium parvum
PEQTSSINSKESGKKM

SEQ ID NO: 2222232 - protein, 8 aa, Cryptosporidium parvum
PERSSNYG

SEQ ID NO: 2222233 - protein, 8 aa, Cryptosporidium parvum
PESGTSPN

SEQ ID NO: 2222234 - protein, 6 aa, Cryptosporidium parvum
PESIPN

SEQ ID NO: 2222235 - protein, 7 aa, Cryptosporidium parvum
PESRQKC

SEQ ID NO: 2222236 - protein, 25 aa, Cryptosporidium parvum
PESTDSYQDKNQNKKIKNNTLKEED

SEQ ID NO: 2222237 - protein, 4 aa, Cryptosporidium parvum
PETC

SEQ ID NO: 2222238 - protein, 4 aa, Cryptosporidium parvum
PETY

SEQ ID NO: 2222239 - protein, 5 aa, Cryptosporidium parvum
PEYPK

SEQ ID NO: 2222240 - protein, 6 aa, Cryptosporidium parvum
PFENYS

SEQ ID NO: 2222241 - protein, 4 aa, Cryptosporidium parvum
PFES

SEQ ID NO: 2222242 - protein, 6 aa, Cryptosporidium parvum
PFESSY

SEQ ID NO: 2222243 - protein, 7 aa, Cryptosporidium parvum
PFNPPTG

SEQ ID NO: 2222244 - protein, 54 aa, Cryptosporidium parvum
PFNSTTGELVDPSTGKPINNSTAGIVSGKPGLPPIEDENGNLFDPSTNLPIDGN

SEQ ID NO: 2222245 - protein, 6 aa, Cryptosporidium parvum
PFPEEA

SEQ ID NO: 2222246 - protein, 15 aa, Cryptosporidium parvum
PFQNKEDGLKPSNES

SEQ ID NO: 2222247 - protein, 6 aa, Cryptosporidium parvum
PFSETE

SEQ ID NO: 2222248 - protein, 5 aa, Cryptosporidium parvum
PFSGF

SEQ ID NO: 2222249 - protein, 7 aa, Cryptosporidium parvum
PFSNGQD

SEQ ID NO: 2222250 - protein, 7 aa, Cryptosporidium parvum
PFSPNES

SEQ ID NO: 2222251 - protein, 4 aa, Cryptosporidium parvum
PFTN

SEQ ID NO: 2222252 - protein, 7 aa, Cryptosporidium parvum
PFTPGSS

SEQ ID NO: 2222253 - protein, 6 aa, Cryptosporidium parvum
PGCGKS

SEQ ID NO: 2222254 - protein, 7 aa, Cryptosporidium parvum
PGDGRNR

SEQ ID NO: 2222255 - protein, 8 aa, Cryptosporidium parvum
PGDNFPGG

SEQ ID NO: 2222256 - protein, 11 aa, Cryptosporidium parvum
PGDPGEPGSDF

SEQ ID NO: 2222257 - protein, 13 aa, Cryptosporidium parvum
PGDPGKPGSDFSG

SEQ ID NO: 2222258 - protein, 10 aa, Cryptosporidium parvum
PGDPGPPCSD

SEQ ID NO: 2222259 - protein, 32 aa, Cryptosporidium parvum; identical to SEQ ID NO: 2117852

SEQ ID NO: 2222260 - protein, 6 aa, Cryptosporidium parvum
PGDTLN

SEQ ID NO: 2222261 - protein, 5 aa, Cryptosporidium parvum
PGEAQ

SEQ ID NO: 2222262 - protein, 6 aa, Cryptosporidium parvum
PGEEET

SEQ ID NO: 2222263 - protein, 4 aa, Cryptosporidium parvum
PGER

SEQ ID NO: 2222264 - protein, 9 aa, Cryptosporidium parvum
PGESDQDHF

SEQ ID NO: 2222265 - protein, 7 aa, Cryptosporidium parvum
PGFSSNN

SEQ ID NO: 2222266 - protein, 6 aa, Cryptosporidium parvum
PGGSHY

SEQ ID NO: 2222267 - protein, 4 aa, Cryptosporidium parvum
PGGY

SEQ ID NO: 2222268 - protein, 11 aa, Cryptosporidium parvum
PGHPGYVTPPQ

SEQ ID NO: 2222269 - protein, 15 aa, Cryptosporidium parvum
PGIQSNEQLKSHSTN

SEQ ID NO: 2222270 - protein, 26 aa, Cryptosporidium parvum
PGIRQKTQSYKYKRSQYSKKPKAKNK

SEQ ID NO: 2222271 - protein, 4 aa, Cryptosporidium parvum
PGIS

SEQ ID NO: 2222272 - protein, 16 aa, Cryptosporidium parvum
PGKATRTTHGKKCESY

SEQ ID NO: 2222273 - protein, 11 aa, Cryptosporidium parvum
PGKINATGTLS

SEQ ID NO: 2222274 - protein, 11 aa, Cryptosporidium parvum
PGKPQGENGGI

SEQ ID NO: 2222275 - protein, 8 aa, Cryptosporidium parvum
PGKPSPKI

SEQ ID NO: 2222276 - protein, 5 aa, Cryptosporidium parvum
PGLGK

SEQ ID NO: 2222277 - protein, 4 aa, Cryptosporidium parvum
PGLS

SEQ ID NO: 2222278 - protein, 27 aa, Cryptosporidium parvum
PGMPGGMPGMPGGMPGGMPGMPGGMPM

SEQ ID NO: 2222279 - protein, 13 aa, Cryptosporidium parvum
PGNEGEEVGSSKI

SEQ ID NO: 2222280 - protein, 9 aa, Cryptosporidium parvum
PGNKPVNND

SEQ ID NO: 2222281 - protein, 12 aa, Cryptosporidium parvum
PGNKTETSEEEV

SEQ ID NO: 2222282 - protein, 7 aa, Cryptosporidium parvum
PGNSESE

SEQ ID NO: 2222283 - protein, 4 aa, Cryptosporidium parvum
PGPS

SEQ ID NO: 2222284 - protein, 7 aa, Cryptosporidium parvum
PGPVKAE

SEQ ID NO: 2222285 - protein, 5 aa, Cryptosporidium parvum
PGQCQ

SEQ ID NO: 2222286 - protein, 19 aa, Cryptosporidium parvum
PGQGGIPGAMGGAATPSAL

SEQ ID NO: 2222287 - protein, 7 aa, Cryptosporidium parvum
PGQIYGS

SEQ ID NO: 2222288 - protein, 6 aa, Cryptosporidium parvum
PGQTSD

SEQ ID NO: 2222289 - protein, 9 aa, Cryptosporidium parvum
PGRDESETF

SEQ ID NO: 2222290 - protein, 6 aa, Cryptosporidium parvum
PGRGSS

SEQ ID NO: 2222291 - protein, 10 aa, Cryptosporidium parvum
PGRKKNLEID

SEQ ID NO: 2222292 - protein, 8 aa, Cryptosporidium parvum
PGRNRETR

SEQ ID NO: 2222293 - protein, 12 aa, Cryptosporidium parvum
PGSADRTSSTYN

SEQ ID NO: 2222294 - protein, 4 aa, Cryptosporidium parvum
PGSI

SEQ ID NO: 2222295 - protein, 6 aa, Cryptosporidium parvum
PGSLES

SEQ ID NO: 2222296 - protein, 4 aa, Cryptosporidium parvum
PGSS

SEQ ID NO: 2222297 - protein, 10 aa, Cryptosporidium parvum
PGSTKNLTGC

SEQ ID NO: 2222298 - protein, 14 aa, Cryptosporidium parvum
PGTAAPKKGGVIPE

SEQ ID NO: 2222299 - protein, 11 aa, Cryptosporidium parvum
PGTSEASSDEV

SEQ ID NO: 2222300 - protein, 6 aa, Cryptosporidium parvum
PGVGPN

SEQ ID NO: 2222301 - protein, 14 aa, Cryptosporidium parvum
PGVNTDDLPRLPAN

SEQ ID NO: 2222302 - protein, 19 aa, Cryptosporidium parvum
PGVPSNPAYTSGHSPGSAI

SEQ ID NO: 2222303 - protein, 5 aa, Cryptosporidium parvum
PGVSK

SEQ ID NO: 2222304 - protein, 14 aa, Cryptosporidium parvum
PGYRHPNENKMNSE

SEQ ID NO: 2222305 - protein, 7 aa, Cryptosporidium parvum
PGYSSKK

SEQ ID NO: 2222306 - protein, 5 aa, Cryptosporidium parvum
PHGHG

SEQ ID NO: 2222307 - protein, 20 aa, Cryptosporidium parvum
PHKTFESEELTDNQGRPISN

SEQ ID NO: 2222308 - protein, 8 aa, Cryptosporidium parvum
PHKTGNNQ

SEQ ID NO: 2222309 - protein, 17 aa, Cryptosporidium parvum
PHMGGAGQGIPQPHSHP

SEQ ID NO: 2222310 - protein, 20 aa, Cryptosporidium parvum
PHMSTKKSKKWKQLTEKTKE

SEQ ID NO: 2222311 - protein, 6 aa, Cryptosporidium parvum
PHPRTA

SEQ ID NO: 2222312 - protein, 7 aa, Cryptosporidium parvum
PHSERAL

SEQ ID NO: 2222313 - protein, 8 aa, Cryptosporidium parvum
PHTNKAIK

SEQ ID NO: 2222314 - protein, 11 aa, Cryptosporidium parvum
PIAPLTKGPAG

SEQ ID NO: 2222315 - protein, 14 aa, Cryptosporidium parvum
PIAPSPSVSGFKPT

SEQ ID NO: 2222316 - protein, 25 aa, Cryptosporidium parvum
PIASEAKVETENPLLSSTEDCSNNP

SEQ ID NO: 2222317 - protein, 10 aa, Cryptosporidium parvum
PIDGSETAIE

SEQ ID NO: 2222318 - protein, 5 aa, Cryptosporidium parvum
PIDLN

SEQ ID NO: 2222319 - protein, 5 aa, Cryptosporidium parvum
PIDME

SEQ ID NO: 2222320 - protein, 8 aa, Cryptosporidium parvum
PIEEEEEN

SEQ ID NO: 2222321 - protein, 24 aa, Cryptosporidium parvum
PIEEKSNNINNDSGLEQNSDTGMD

SEQ ID NO: 2222322 - protein, 4 aa, Cryptosporidium parvum
PIEG

SEQ ID NO: 2222323 - protein, 4 aa, Cryptosporidium parvum
PIGE

SEQ ID NO: 2222324 - protein, 10 aa, Cryptosporidium parvum
PIGRKEYNED

SEQ ID NO: 2222325 - protein, 12 aa, Cryptosporidium parvum
PIISDDNDLERN

SEQ ID NO: 2222326 - protein, 10 aa, Cryptosporidium parvum
PIKPPPDISK

SEQ ID NO: 2222327 - protein, 8 aa, Cryptosporidium parvum
PIKQRSTS

SEQ ID NO: 2222328 - protein, 4 aa, Cryptosporidium parvum
PIKS

SEQ ID NO: 2222329 - protein, 56 aa, Cryptosporidium parvum
PINENDHRQINSKRSGLRSGKDSNNNNDNNNNDNNNNNNNNVNNNNNNNFNSGVEE

SEQ ID NO: 2222330 - protein, 10 aa, Cryptosporidium parvum
PINGGGLRSL

SEQ ID NO: 2222331 - protein, 6 aa, Cryptosporidium parvum
PINSPE

SEQ ID NO: 2222332 - protein, 6 aa, Cryptosporidium parvum
PIPKYS

SEQ ID NO: 2222333 - protein, 4 aa, Cryptosporidium parvum
PIPS

SEQ ID NO: 2222334 - protein, 10 aa, Cryptosporidium parvum
PIPSSSQDQF

SEQ ID NO: 2222335 - protein, 10 aa, Cryptosporidium parvum
PIRDKSESNK

SEQ ID NO: 2222336 - protein, 30 aa, Cryptosporidium parvum
PIRRNKDKNTNINHNTQTHPNPTSNPQNNW

SEQ ID NO: 2222337 - protein, 11 aa, Cryptosporidium parvum
PIRSTKNNLPE

SEQ ID NO: 2222338 - protein, 9 aa, Cryptosporidium parvum
PISAKGELD

SEQ ID NO: 2222339 - protein, 7 aa, Cryptosporidium parvum
PISEEKS

SEQ ID NO: 2222340 - protein, 8 aa, Cryptosporidium parvum
PISGGTGK

SEQ ID NO: 2222341 - protein, 10 aa, Cryptosporidium parvum
PISNQNSYKS

SEQ ID NO: 2222342 - protein, 6 aa, Cryptosporidium parvum
PISQTK

SEQ ID NO: 2222343 - protein, 11 aa, Cryptosporidium parvum
PISSNIGSKSR

SEQ ID NO: 2222344 - protein, 10 aa, Cryptosporidium parvum
PISTGSIQSH

SEQ ID NO: 2222345 - protein, 8 aa, Cryptosporidium parvum
PISTKNSS

SEQ ID NO: 2222346 - protein, 21 aa, Cryptosporidium parvum
PITAPKDCSPLGPDDSETGKI

SEQ ID NO: 2222347 - protein, 5 aa, Cryptosporidium parvum
PITSK

SEQ ID NO: 2222348 - protein, 5 aa, Cryptosporidium parvum
PKAQE

SEQ ID NO: 2222349 - protein, 20 aa, Cryptosporidium parvum
PKATDRSSDRISKPLTDKEE

SEQ ID NO: 2222350 - protein, 40 aa, Cryptosporidium parvum
PKDLAQDTRHQGPTASRDGPSYSKKGENNPGSSAGGGSLP

SEQ ID NO: 2222351 - protein, 5 aa, Cryptosporidium parvum
PKDPL

SEQ ID NO: 2222352 - protein, 13 aa, Cryptosporidium parvum
PKDSPRRNRKGVY

SEQ ID NO: 2222353 - protein, 14 aa, Cryptosporidium parvum
PKDTGESDEKSENI

SEQ ID NO: 2222354 - protein, 9 aa, Cryptosporidium parvum
PKEDQNKKN

SEQ ID NO: 2222355 - protein, 11 aa, Cryptosporidium parvum
PKEEDFTKKED

SEQ ID NO: 2222356 - protein, 7 aa, Cryptosporidium parvum
PKEEPFT

SEQ ID NO: 2222357 - protein, 4 aa, Cryptosporidium parvum
PKEI

SEQ ID NO: 2222358 - protein, 7 aa, Cryptosporidium parvum
PKEKDYK

SEQ ID NO: 2222359 - protein, 27 aa, Cryptosporidium parvum
PKENTNIPNQINNPQIPTPKQSKSQIN

SEQ ID NO: 2222360 - protein, 7 aa, Cryptosporidium parvum
PKETPLD

SEQ ID NO: 2222361 - protein, 11 aa, Cryptosporidium parvum
PKFDQDQKNMA

SEQ ID NO: 2222362 - protein, 5 aa, Cryptosporidium parvum
PKFVN

SEQ ID NO: 2222363 - protein, 13 aa, Cryptosporidium parvum
PKGDKDTNNNNSV

SEQ ID NO: 2222364 - protein, 8 aa, Cryptosporidium parvum
PKGVGTEL

SEQ ID NO: 2222365 - protein, 9 aa, Cryptosporidium parvum
PKHKKIPKT

SEQ ID NO: 2222366 - protein, 9 aa, Cryptosporidium parvum
PKHNKNSAP

SEQ ID NO: 2222367 - protein, 12 aa, Cryptosporidium parvum
PKHYNNRNEDDF

SEQ ID NO: 2222368 - protein, 11 aa, Cryptosporidium parvum
PKIEDDNKTDF

SEQ ID NO: 2222369 - protein, 6 aa, Cryptosporidium parvum
PKIEDS

SEQ ID NO: 2222370 - protein, 5 aa, Cryptosporidium parvum
PKIES

SEQ ID NO: 2222371 - protein, 5 aa, Cryptosporidium parvum
PKIRD

SEQ ID NO: 2222372 - protein, 11 aa, Cryptosporidium parvum
PKISGHDEKDG

SEQ ID NO: 2222373 - protein, 13 aa, Cryptosporidium parvum
PKISGSDNLSHPS

SEQ ID NO: 2222374 - protein, 12 aa, Cryptosporidium parvum
PKISNTNNRLTG

SEQ ID NO: 2222375 - protein, 5 aa, Cryptosporidium parvum
PKITG

SEQ ID NO: 2222376 - protein, 6 aa, Cryptosporidium parvum
PKITPE

SEQ ID NO: 2222377 - protein, 27 aa, Cryptosporidium parvum
PKKCSTNQNPNSSERSKKHDPNHSPAS

SEQ ID NO: 2222378 - protein, 14 aa, Cryptosporidium parvum
PKKEFDNKDEDYRE

SEQ ID NO: 2222379 - protein, 5 aa, Cryptosporidium parvum
PKKHL

SEQ ID NO: 2222380 - protein, 7 aa, Cryptosporidium parvum
PKKLPSR

SEQ ID NO: 2222381 - protein, 7 aa, Cryptosporidium parvum
PKKTVEG

SEQ ID NO: 2222382 - protein, 4 aa, Cryptosporidium parvum
PKLE

SEQ ID NO: 2222383 - protein, 6 aa, Cryptosporidium parvum
PKLGGR

SEQ ID NO: 2222384 - protein, 22 aa, Cryptosporidium parvum
PKLKKDSNNKSKTDNKEQDISE

SEQ ID NO: 2222385 - protein, 6 aa, Cryptosporidium parvum
PKMNGT

SEQ ID NO: 2222386 - protein, 5 aa, Cryptosporidium parvum
PKNCN

SEQ ID NO: 2222387 - protein, 10 aa, Cryptosporidium parvum
PKNDQSDFNS

SEQ ID NO: 2222388 - protein, 6 aa, Cryptosporidium parvum
PKNISK

SEQ ID NO: 2222389 - protein, 9 aa, Cryptosporidium parvum
PKNLQSSTD

SEQ ID NO: 2222390 - protein, 9 aa, Cryptosporidium parvum
PKNSPNSSG

SEQ ID NO: 2222391 - protein, 7 aa, Cryptosporidium parvum
PKNSVEY

SEQ ID NO: 2222392 - protein, 6 aa, Cryptosporidium parvum
PKNTNT

SEQ ID NO: 2222393 - protein, 17 aa, Cryptosporidium parvum
PKNTTKTPKNQHENNYS

SEQ ID NO: 2222394 - protein, 18 aa, Cryptosporidium parvum
PKPETNIQYKNTKDSKVK

SEQ ID NO: 2222395 - protein, 5 aa, Cryptosporidium parvum
PKPNF

SEQ ID NO: 2222396 - protein, 4 aa, Cryptosporidium parvum
PKPT

SEQ ID NO: 2222397 - protein, 9 aa, Cryptosporidium parvum
PKQNHNESK

SEQ ID NO: 2222398 - protein, 7 aa, Cryptosporidium parvum
PKQPFRY

SEQ ID NO: 2222399 - protein, 5 aa, Cryptosporidium parvum
PKQVD

SEQ ID NO: 2222400 - protein, 32 aa, Cryptosporidium parvum
PKRINKEEKEKEKEKEKNINDYNEEDNNDENA

SEQ ID NO: 2222401 - protein, 7 aa, Cryptosporidium parvum
PKRKSRF

SEQ ID NO: 2222402 - protein, 5 aa, Cryptosporidium parvum
PKSCS

SEQ ID NO: 2222403 - protein, 19 aa, Cryptosporidium parvum
PKSESKVNVASSNTIQPVE

SEQ ID NO: 2222404 - protein, 11 aa, Cryptosporidium parvum
PKSFKTKSGLP

SEQ ID NO: 2222405 - protein, 10 aa, Cryptosporidium parvum
PKSHENKSSY

SEQ ID NO: 2222406 - protein, 17 aa, Cryptosporidium parvum
PKSIPTQNELAQILTSY

SEQ ID NO: 2222407 - protein, 8 aa, Cryptosporidium parvum
PKSKDGHN

SEQ ID NO: 2222408 - protein, 5 aa, Cryptosporidium parvum
PKSLH

SEQ ID NO: 2222409 - protein, 4 aa, Cryptosporidium parvum
PKSN

SEQ ID NO: 2222410 - protein, 8 aa, Cryptosporidium parvum
PKSNQRSL

SEQ ID NO: 2222411 - protein, 13 aa, Cryptosporidium parvum
PKSQSLSSSITTE

SEQ ID NO: 2222412 - protein, 9 aa, Cryptosporidium parvum
PKSSKQKWV

SEQ ID NO: 2222413 - protein, 9 aa, Cryptosporidium parvum
PKTEPEQDY

SEQ ID NO: 2222414 - protein, 10 aa, Cryptosporidium parvum
PKTGKRPDYS

SEQ ID NO: 2222415 - protein, 9 aa, Cryptosporidium parvum
PKTIEESQA

SEQ ID NO: 2222416 - protein, 7 aa, Cryptosporidium parvum
PKTKEEY

SEQ ID NO: 2222417 - protein, 6 aa, Cryptosporidium parvum
PKTNTT

SEQ ID NO: 2222418 - protein, 10 aa, Cryptosporidium parvum
PKTQNSPVSV

SEQ ID NO: 2222419 - protein, 9 aa, Cryptosporidium parvum
PKTQTEHNS

SEQ ID NO: 2222420 - protein, 4 aa, Cryptosporidium parvum
PKTS

SEQ ID NO: 2222421 - protein, 17 aa, Cryptosporidium parvum
PKVNKKSKMLGKQNDRN

SEQ ID NO: 2222422 - protein, 10 aa, Cryptosporidium parvum
PKVRNQKESV

SEQ ID NO: 2222423 - protein, 8 aa, Cryptosporidium parvum
PKYKANTD

SEQ ID NO: 2222424 - protein, 8 aa, Cryptosporidium parvum
PKYRQSKS

SEQ ID NO: 2222425 - protein, 6 aa, Cryptosporidium parvum
PKYVGG

SEQ ID NO: 2222426 - protein, 10 aa, Cryptosporidium parvum
PLDPSNARGI

SEQ ID NO: 2222427 - protein, 9 aa, Cryptosporidium parvum
PLDSELKPE

SEQ ID NO: 2222428 - protein, 5 aa, Cryptosporidium parvum
PLEEP

SEQ ID NO: 2222429 - protein, 5 aa, Cryptosporidium parvum
PLEYR

SEQ ID NO: 2222430 - protein, 12 aa, Cryptosporidium parvum
PLFSGKGSKEYR

SEQ ID NO: 2222431 - protein, 4 aa, Cryptosporidium parvum
PLGE

SEQ ID NO: 2222432 - protein, 7 aa, Cryptosporidium parvum
PLKEEQN

SEQ ID NO: 2222433 - protein, 8 aa, Cryptosporidium parvum
PLKENNKC

SEQ ID NO: 2222434 - protein, 4 aa, Cryptosporidium parvum
PLKK

SEQ ID NO: 2222435 - protein, 5 aa, Cryptosporidium parvum
PLKSI

SEQ ID NO: 2222436 - protein, 8 aa, Cryptosporidium parvum
PLLPNKAK

SEQ ID NO: 2222437 - protein, 4 aa, Cryptosporidium parvum
PLNK

SEQ ID NO: 2222438 - protein, 73 aa, Cryptosporidium parvum
PLNKSEKSNYTSQVESEDEDDEPEALSNKVKSDKHFSEKDDGEDDYNSNIESSEIESSRNHSQSKKISKEEVN

SEQ ID NO: 2222439 - protein, 4 aa, Cryptosporidium parvum
PLNN

SEQ ID NO: 2222440 - protein, 16 aa, Cryptosporidium parvum
PLNNGTGKEKKDSSFT

SEQ ID NO: 2222441 - protein, 9 aa, Cryptosporidium parvum
PLNPSSRLK

SEQ ID NO: 2222442 - protein, 4 aa, Cryptosporidium parvum
PLNS

SEQ ID NO: 2222443 - protein, 5 aa, Cryptosporidium parvum
PLNSQ

SEQ ID NO: 2222444 - protein, 17 aa, Cryptosporidium parvum
PLPTSKPSPILLFTDNK

SEQ ID NO: 2222445 - protein, 5 aa, Cryptosporidium parvum
PLQLT

SEQ ID NO: 2222446 - protein, 7 aa, Cryptosporidium parvum
PLRSEDV

SEQ ID NO: 2222447 - protein, 5 aa, Cryptosporidium parvum
PLSDY

SEQ ID NO: 2222448 - protein, 6 aa, Cryptosporidium parvum
PLSEDS

SEQ ID NO: 2222449 - protein, 5 aa, Cryptosporidium parvum
PLSNS

SEQ ID NO: 2222450 - protein, 11 aa, Cryptosporidium parvum
PLSRGRKPSRS

SEQ ID NO: 2222451 - protein, 9 aa, Cryptosporidium parvum
PLTKPTDFP

SEQ ID NO: 2222452 - protein, 4 aa, Cryptosporidium parvum
PLTT

SEQ ID NO: 2222453 - protein, 11 aa, Cryptosporidium parvum
PLVNRDPSEYY

SEQ ID NO: 2222454 - protein, 4 aa, Cryptosporidium parvum
PMNG

SEQ ID NO: 2222455 - protein, 17 aa, Cryptosporidium parvum
PMNTSSEEVEEDGGENI

SEQ ID NO: 2222456 - protein, 5 aa, Cryptosporidium parvum
PMPDV

SEQ ID NO: 2222457 - protein, 11 aa, Cryptosporidium parvum
PMPLNDASKVN

SEQ ID NO: 2222458 - protein, 6 aa, Cryptosporidium parvum
PMPPVT

SEQ ID NO: 2222459 - protein, 4 aa, Cryptosporidium parvum
PMYS

SEQ ID NO: 2222460 - protein, 7 aa, Cryptosporidium parvum
PNASPSI

SEQ ID NO: 2222461 - protein, 6 aa, Cryptosporidium parvum
PNDFGK

SEQ ID NO: 2222462 - protein, 7 aa, Cryptosporidium parvum
PNEANLS

SEQ ID NO: 2222463 - protein, 7 aa, Cryptosporidium parvum
PNEDPTS

SEQ ID NO: 2222464 - protein, 8 aa, Cryptosporidium parvum
PNEESINT

SEQ ID NO: 2222465 - protein, 13 aa, Cryptosporidium parvum
PNEKSTENEISQS

SEQ ID NO: 2222466 - protein, 14 aa, Cryptosporidium parvum
PNEPGQPRSYLSTE

SEQ ID NO: 2222467 - protein, 4 aa, Cryptosporidium parvum
PNFG

SEQ ID NO: 2222468 - protein, 12 aa, Cryptosporidium parvum
PNFRKKSNALNN

SEQ ID NO: 2222469 - protein, 4 aa, Cryptosporidium parvum
PNGD

SEQ ID NO: 2222470 - protein, 4 aa, Cryptosporidium parvum
PNGF

SEQ ID NO: 2222471 - protein, 9 aa, Cryptosporidium parvum
PNGHCKDGN

SEQ ID NO: 2222472 - protein, 11 aa, Cryptosporidium parvum
PNGKNQTVDSD

SEQ ID NO: 2222473 - protein, 13 aa, Cryptosporidium parvum
PNHPNSDQDLSNQ

SEQ ID NO: 2222474 - protein, 17 aa, Cryptosporidium parvum
PNIANPGFDDNDNNNIN

SEQ ID NO: 2222475 - protein, 4 aa, Cryptosporidium parvum
PNIE

SEQ ID NO: 2222476 - protein, 12 aa, Cryptosporidium parvum
PNIGKDKASKII

SEQ ID NO: 2222477 - protein, 12 aa, Cryptosporidium parvum
PNINNSIGNKND

SEQ ID NO: 2222478 - protein, 11 aa, Cryptosporidium parvum
PNISGGEGARI

SEQ ID NO: 2222479 - protein, 8 aa, Cryptosporidium parvum
PNKDVSNN

SEQ ID NO: 2222480 - protein, 5 aa, Cryptosporidium parvum
PNKEY

SEQ ID NO: 2222481 - protein, 20 aa, Cryptosporidium parvum
PNKKRINNEFNSESNISKSL

SEQ ID NO: 2222482 - protein, 5 aa, Cryptosporidium parvum
PNKPL

SEQ ID NO: 2222483 - protein, 6 aa, Cryptosporidium parvum
PNKRLD

SEQ ID NO: 2222484 - protein, 11 aa, Cryptosporidium parvum
PNKSKPADSSL

SEQ ID NO: 2222485 - protein, 4 aa, Cryptosporidium parvum
PNLN

SEQ ID NO: 2222486 - protein, 12 aa, Cryptosporidium parvum
PNLNSDEYNHYN

SEQ ID NO: 2222487 - protein, 5 aa, Cryptosporidium parvum
PNLRP

SEQ ID NO: 2222488 - protein, 10 aa, Cryptosporidium parvum
PNLSQDCSNE

SEQ ID NO: 2222489 - protein, 9 aa, Cryptosporidium parvum
PNNEISSTD

SEQ ID NO: 2222490 - protein, 4 aa, Cryptosporidium parvum
PNNN

SEQ ID NO: 2222491 - protein, 13 aa, Cryptosporidium parvum
PNNPESSQNSQNL

SEQ ID NO: 2222492 - protein, 5 aa, Cryptosporidium parvum
PNNQT

SEQ ID NO: 2222493 - protein, 6 aa, Cryptosporidium parvum
PNNSAN

SEQ ID NO: 2222494 - protein, 12 aa, Cryptosporidium parvum
PNNYSSQSSTKL

SEQ ID NO: 2222495 - protein, 4 aa, Cryptosporidium parvum
PNPE

SEQ ID NO: 2222496 - protein, 4 aa, Cryptosporidium parvum
PNPG

SEQ ID NO: 2222497 - protein, 10 aa, Cryptosporidium parvum
PNPGQLQNGQ

SEQ ID NO: 2222498 - protein, 5 aa, Cryptosporidium parvum
PNPLD

SEQ ID NO: 2222499 - protein, 11 aa, Cryptosporidium parvum
PNPNDTRPRNS

SEQ ID NO: 2222500 - protein, 5 aa, Cryptosporidium parvum
PNPNI

SEQ ID NO: 2222501 - protein, 6 aa, Cryptosporidium parvum
PNPNPS

SEQ ID NO: 2222502 - protein, 9 aa, Cryptosporidium parvum
PNPPSVVNS

SEQ ID NO: 2222503 - protein, 10 aa, Cryptosporidium parvum
PNPQNYGLPE

SEQ ID NO: 2222504 - protein, 8 aa, Cryptosporidium parvum
PNPQSQDD

SEQ ID NO: 2222505 - protein, 6 aa, Cryptosporidium parvum
PNPRNK

SEQ ID NO: 2222506 - protein, 5 aa, Cryptosporidium parvum
PNQGQ

SEQ ID NO: 2222507 - protein, 7 aa, Cryptosporidium parvum
PNQISGR

SEQ ID NO: 2222508 - protein, 7 aa, Cryptosporidium parvum
PNQNVDI

SEQ ID NO: 2222509 - protein, 5 aa, Cryptosporidium parvum
PNQSL

SEQ ID NO: 2222510 - protein, 9 aa, Cryptosporidium parvum
PNQSNLPPI

SEQ ID NO: 2222511 - protein, 9 aa, Cryptosporidium parvum
PNQTPAEVT

SEQ ID NO: 2222512 - protein, 4 aa, Cryptosporidium parvum
PNRE

SEQ ID NO: 2222513 - protein, 5 aa, Cryptosporidium parvum
PNSDS

SEQ ID NO: 2222514 - protein, 4 aa, Cryptosporidium parvum
PNSF

SEQ ID NO: 2222515 - protein, 10 aa, Cryptosporidium parvum
PNSFSGTNIT

SEQ ID NO: 2222516 - protein, 4 aa, Cryptosporidium parvum
PNSG

SEQ ID NO: 2222517 - protein, 25 aa, Cryptosporidium parvum
PNSGVSRNKDQNQHQDDDYQMRKQD

SEQ ID NO: 2222518 - protein, 15 aa, Cryptosporidium parvum
PNSKYYSNSSNFNKV

SEQ ID NO: 2222519 - protein, 15 aa, Cryptosporidium parvum
PNSLDQSGSNRRNNH

SEQ ID NO: 2222520 - protein, 6 aa, Cryptosporidium parvum
PNSNFE

SEQ ID NO: 2222521 - protein, 7 aa, Cryptosporidium parvum
PNSNFQS

SEQ ID NO: 2222522 - protein, 34 aa, Cryptosporidium parvum
PNSNVNRAGSSYNPFSGNSAQPRAFSGRGFRLGS

SEQ ID NO: 2222523 - protein, 6 aa, Cryptosporidium parvum
PNSRVA

SEQ ID NO: 2222524 - protein, 5 aa, Cryptosporidium parvum
PNSSD

SEQ ID NO: 2222525 - protein, 5 aa, Cryptosporidium parvum
PNSSI

SEQ ID NO: 2222526 - protein, 5 aa, Cryptosporidium parvum
PNSSN

SEQ ID NO: 2222527 - protein, 7 aa, Cryptosporidium parvum
PNSSNFG

SEQ ID NO: 2222528 - protein, 5 aa, Cryptosporidium parvum
PNSSS

SEQ ID NO: 2222529 - protein, 6 aa, Cryptosporidium parvum
PNSTET

SEQ ID NO: 2222530 - protein, 8 aa, Cryptosporidium parvum
PNTKYTND

SEQ ID NO: 2222531 - protein, 15 aa, Cryptosporidium parvum
PNTMDPSYAGDGDYA

SEQ ID NO: 2222532 - protein, 28 aa, Cryptosporidium parvum
PNTNKRTSVHSEKNEINSPVSSSSYSNL

SEQ ID NO: 2222533 - protein, 10 aa, Cryptosporidium parvum
PNTNNTVYNE

SEQ ID NO: 2222534 - protein, 4 aa, Cryptosporidium parvum
PNTP

SEQ ID NO: 2222535 - protein, 4 aa, Cryptosporidium parvum
PNTS

SEQ ID NO: 2222536 - protein, 5 aa, Cryptosporidium parvum
PNTTG

SEQ ID NO: 2222537 - protein, 76 aa, Cryptosporidium parvum
PNTTTSSDNDFTKNNPANSSKHTSTSTTTNTTTTTTRTTTTTTTTTTTTTTTTTTTTETTTTKKSTTATKNTTTTL

SEQ ID NO: 2222538 - protein, 4 aa, Cryptosporidium parvum
PNTY

SEQ ID NO: 2222539 - protein, 4 aa, Cryptosporidium parvum
PNVD

SEQ ID NO: 2222540 - protein, 5 aa, Cryptosporidium parvum
PNYNV

SEQ ID NO: 2222541 - protein, 8 aa, Cryptosporidium parvum
PNYQESNQ

SEQ ID NO: 2222542 - protein, 8 aa, Cryptosporidium parvum
PPANFDSE

SEQ ID NO: 2222543 - protein, 52 aa, Cryptosporidium parvum
PPASSDERKNVPKKFQSRGRDLTESEFPHSNKPGEKRTSTSLYSKAGGAVLG

SEQ ID NO: 2222544 - protein, 7 aa, Cryptosporidium parvum
PPDPIKV

SEQ ID NO: 2222545 - protein, 10 aa, Cryptosporidium parvum
PPDRTALSQD

SEQ ID NO: 2222546 - protein, 23 aa, Cryptosporidium parvum
PPDSASLSSPTPASTLHAKTNAG

SEQ ID NO: 2222547 - protein, 7 aa, Cryptosporidium parvum
PPDYSRN

SEQ ID NO: 2222548 - protein, 5 aa, Cryptosporidium parvum
PPEFP

SEQ ID NO: 2222549 - protein, 12 aa, Cryptosporidium parvum
PPEINKNNEESF

SEQ ID NO: 2222550 - protein, 4 aa, Cryptosporidium parvum
PPEQ

SEQ ID NO: 2222551 - protein, 6 aa, Cryptosporidium parvum
PPEYDS

SEQ ID NO: 2222552 - protein, 10 aa, Cryptosporidium parvum
PPFGGQTDQE

SEQ ID NO: 2222553 - protein, 10 aa, Cryptosporidium parvum
PPFPKSSDEW

SEQ ID NO: 2222554 - protein, 4 aa, Cryptosporidium parvum
PPGR

SEQ ID NO: 2222555 - protein, 7 aa, Cryptosporidium parvum
PPGTNAK

SEQ ID NO: 2222556 - protein, 6 aa, Cryptosporidium parvum
PPGVTK

SEQ ID NO: 2222557 - protein, 5 aa, Cryptosporidium parvum
PPHQS

SEQ ID NO: 2222558 - protein, 5 aa, Cryptosporidium parvum
PPISN

SEQ ID NO: 2222559 - protein, 4 aa, Cryptosporidium parvum
PPKI

SEQ ID NO: 2222560 - protein, 5 aa, Cryptosporidium parvum
PPKIS

SEQ ID NO: 2222561 - protein, 10 aa, Cryptosporidium parvum
PPKMDDDEEF

SEQ ID NO: 2222562 - protein, 9 aa, Cryptosporidium parvum
PPKNAKKGE

SEQ ID NO: 2222563 - protein, 7 aa, Cryptosporidium parvum
PPKQYSR

SEQ ID NO: 2222564 - protein, 6 aa, Cryptosporidium parvum
PPLPPN

SEQ ID NO: 2222565 - protein, 13 aa, Cryptosporidium parvum
PPNETSKRSEEYT

SEQ ID NO: 2222566 - protein, 4 aa, Cryptosporidium parvum
PPNF

SEQ ID NO: 2222567 - protein, 5 aa, Cryptosporidium parvum
PPNHS

SEQ ID NO: 2222568 - protein, 11 aa, Cryptosporidium parvum
PPNLKKTPPVE

SEQ ID NO: 2222569 - protein, 6 aa, Cryptosporidium parvum
PPNLNK

SEQ ID NO: 2222570 - protein, 4 aa, Cryptosporidium parvum
PPNS

SEQ ID NO: 2222571 - protein, 6 aa, Cryptosporidium parvum
PPPAHE

SEQ ID NO: 2222572 - protein, 5 aa, Cryptosporidium parvum
PPPDW

SEQ ID NO: 2222573 - protein, 4 aa, Cryptosporidium parvum
PPPE

SEQ ID NO: 2222574 - protein, 6 aa, Cryptosporidium parvum
PPPFST

SEQ ID NO: 2222575 - protein, 12 aa, Cryptosporidium parvum
PPPIPHPPQPQF

SEQ ID NO: 2222576 - protein, 9 aa, Cryptosporidium parvum
PPPKRKSNN

SEQ ID NO: 2222577 - protein, 16 aa, Cryptosporidium parvum
PPPNSIVTNSSSSSTS

SEQ ID NO: 2222578 - protein, 5 aa, Cryptosporidium parvum
PPPPL

SEQ ID NO: 2222579 - protein, 12 aa, Cryptosporidium parvum
PPPPNKSPDLDF

SEQ ID NO: 2222580 - protein, 9 aa, Cryptosporidium parvum
PPPPPMQPE

SEQ ID NO: 2222581 - protein, 4 aa, Cryptosporidium parvum
PPPQ

SEQ ID NO: 2222582 - protein, 7 aa, Cryptosporidium parvum
PPPSSFI

SEQ ID NO: 2222583 - protein, 7 aa, Cryptosporidium parvum
PPQGNHT

SEQ ID NO: 2222584 - protein, 4 aa, Cryptosporidium parvum
PPQN

SEQ ID NO: 2222585 - protein, 11 aa, Cryptosporidium parvum
PPRKDRKNSYK

SEQ ID NO: 2222586 - protein, 7 aa, Cryptosporidium parvum
PPRPGVE

SEQ ID NO: 2222587 - protein, 7 aa, Cryptosporidium parvum
PPRSGLH

SEQ ID NO: 2222588 - protein, 10 aa, Cryptosporidium parvum
PPSESLSDEA

SEQ ID NO: 2222589 - protein, 4 aa, Cryptosporidium parvum
PPSF

SEQ ID NO: 2222590 - protein, 13 aa, Cryptosporidium parvum
PPSGTTKHNEYQH

SEQ ID NO: 2222591 - protein, 8 aa, Cryptosporidium parvum
PPSNDQYS

SEQ ID NO: 2222592 - protein, 5 aa, Cryptosporidium parvum
PPSPL

SEQ ID NO: 2222593 - protein, 6 aa, Cryptosporidium parvum
PPSTNC

SEQ ID NO: 2222594 - protein, 5 aa, Cryptosporidium parvum
PPSTV

SEQ ID NO: 2222595 - protein, 22 aa, Cryptosporidium parvum
PPTETPGKKTTKPASPKSLSRG

SEQ ID NO: 2222596 - protein, 4 aa, Cryptosporidium parvum
PPTI

SEQ ID NO: 2222597 - protein, 8 aa, Cryptosporidium parvum
PPTNGRYT

SEQ ID NO: 2222598 - protein, 41 aa, Cryptosporidium parvum
PPTNSINKDPVTNTQYSNTTGNIINPETGKVIPGSLPGSLN

SEQ ID NO: 2222599 - protein, 7 aa, Cryptosporidium parvum
PPTSNKP

SEQ ID NO: 2222600 - protein, 4 aa, Cryptosporidium parvum
PPVS

SEQ ID NO: 2222601 - protein, 7 aa, Cryptosporidium parvum
PQAESER

SEQ ID NO: 2222602 - protein, 12 aa, Cryptosporidium parvum
PQANNTNSSVTC

SEQ ID NO: 2222603 - protein, 5 aa, Cryptosporidium parvum
PQDES

SEQ ID NO: 2222604 - protein, 13 aa, Cryptosporidium parvum
PQEAKSHTKQGRG

SEQ ID NO: 2222605 - protein, 5 aa, Cryptosporidium parvum
PQELK

SEQ ID NO: 2222606 - protein, 5 aa, Cryptosporidium parvum
PQELS

SEQ ID NO: 2222607 - protein, 12 aa, Cryptosporidium parvum
PQENTENQIQEN

SEQ ID NO: 2222608 - protein, 9 aa, Cryptosporidium parvum
PQGTHTGSL

SEQ ID NO: 2222609 - protein, 6 aa, Cryptosporidium parvum
PQHKSL

SEQ ID NO: 2222610 - protein, 16 aa, Cryptosporidium parvum
PQINNKRNTTEDEKYK

SEQ ID NO: 2222611 - protein, 5 aa, Cryptosporidium parvum
PQIVT

SEQ ID NO: 2222612 - protein, 13 aa, Cryptosporidium parvum
PQLEKKKKLTSIQ

SEQ ID NO: 2222613 - protein, 6 aa, Cryptosporidium parvum
PQNDEI

SEQ ID NO: 2222614 - protein, 13 aa, Cryptosporidium parvum
PQNEIPDDVGPKT

SEQ ID NO: 2222615 - protein, 9 aa, Cryptosporidium parvum
PQNETRYPQ

SEQ ID NO: 2222616 - protein, 4 aa, Cryptosporidium parvum
PQNF

SEQ ID NO: 2222617 - protein, 10 aa, Cryptosporidium parvum
PQNISPESQI

SEQ ID NO: 2222618 - protein, 15 aa, Cryptosporidium parvum
PQNRSNITNKNTPGL

SEQ ID NO: 2222619 - protein, 14 aa, Cryptosporidium parvum
PQNSSKETPNADDY

SEQ ID NO: 2222620 - protein, 6 aa, Cryptosporidium parvum
PQPPLP

SEQ ID NO: 2222621 - protein, 22 aa, Cryptosporidium parvum
PQPPPMPQPPPMPQPQPSSHPQ

SEQ ID NO: 2222622 - protein, 7 aa, Cryptosporidium parvum
PQRENET

SEQ ID NO: 2222623 - protein, 10 aa, Cryptosporidium parvum
PQRNSSKNLL

SEQ ID NO: 2222624 - protein, 9 aa, Cryptosporidium parvum
PQSDEYSHE

SEQ ID NO: 2222625 - protein, 6 aa, Cryptosporidium parvum
PQSNEE

SEQ ID NO: 2222626 - protein, 9 aa, Cryptosporidium parvum
PQSNERSEG

SEQ ID NO: 2222627 - protein, 13 aa, Cryptosporidium parvum
PQSRSKQSYDNEL

SEQ ID NO: 2222628 - protein, 12 aa, Cryptosporidium parvum
PQSSDIHKKTDQ

SEQ ID NO: 2222629 - protein, 7 aa, Cryptosporidium parvum
PQSSSNY

SEQ ID NO: 2222630 - protein, 10 aa, Cryptosporidium parvum
PQTGEQIKGS

SEQ ID NO: 2222631 - protein, 18 aa, Cryptosporidium parvum
PQTQKKAKVDSKNDDNLE

SEQ ID NO: 2222632 - protein, 5 aa, Cryptosporidium parvum
PRAMR

SEQ ID NO: 2222633 - protein, 4 aa, Cryptosporidium parvum
PRCP

SEQ ID NO: 2222634 - protein, 4 aa, Cryptosporidium parvum
PRDK

SEQ ID NO: 2222635 - protein, 7 aa, Cryptosporidium parvum
PRDLSPN

SEQ ID NO: 2222636 - protein, 16 aa, Cryptosporidium parvum
PREDNGKVDGTPGGAE

SEQ ID NO: 2222637 - protein, 4 aa, Cryptosporidium parvum
PREL

SEQ ID NO: 2222638 - protein, 9 aa, Cryptosporidium parvum
PREQLENKS

SEQ ID NO: 2222639 - protein, 5 aa, Cryptosporidium parvum
PRETN

SEQ ID NO: 2222640 - protein, 6 aa, Cryptosporidium parvum
PRGDKN

SEQ ID NO: 2222641 - protein, 8 aa, Cryptosporidium parvum
PRGSSSPP

SEQ ID NO: 2222642 - protein, 5 aa, Cryptosporidium parvum
PRINS

SEQ ID NO: 2222643 - protein, 4 aa, Cryptosporidium parvum
PRIS

SEQ ID NO: 2222644 - protein, 6 aa, Cryptosporidium parvum
PRKKSY

SEQ ID NO: 2222645 - protein, 5 aa, Cryptosporidium parvum
PRKVS

SEQ ID NO: 2222646 - protein, 4 aa, Cryptosporidium parvum
PRLE

SEQ ID NO: 2222647 - protein, 4 aa, Cryptosporidium parvum
PRLK

SEQ ID NO: 2222648 - protein, 20 aa, Cryptosporidium parvum
PRMEYTKTEDEKERSIVGGG

SEQ ID NO: 2222649 - protein, 12 aa, Cryptosporidium parvum
PRNDTSSNSDGL

SEQ ID NO: 2222650 - protein, 4 aa, Cryptosporidium parvum
PRQE

SEQ ID NO: 2222651 - protein, 4 aa, Cryptosporidium parvum
PRQK

SEQ ID NO: 2222652 - protein, 5 aa, Cryptosporidium parvum
PRSSK

SEQ ID NO: 2222653 - protein, 28 aa, Cryptosporidium parvum
PRSSMEEKTTKSKDMPTGTKSNRKEEKL

SEQ ID NO: 2222654 - protein, 6 aa, Cryptosporidium parvum
PRSSSS

SEQ ID NO: 2222655 - protein, 9 aa, Cryptosporidium parvum
PRTEWPSTV

SEQ ID NO: 2222656 - protein, 4 aa, Cryptosporidium parvum
PRTI

SEQ ID NO: 2222657 - protein, 6 aa, Cryptosporidium parvum
PRTPEC

SEQ ID NO: 2222658 - protein, 16 aa, Cryptosporidium parvum
PRWTSSEVNNDGFGGG

SEQ ID NO: 2222659 - protein, 4 aa, Cryptosporidium parvum
PRYD

SEQ ID NO: 2222660 - protein, 9 aa, Cryptosporidium parvum
PSAKKKKEK

SEQ ID NO: 2222661 - protein, 5 aa, Cryptosporidium parvum
PSAPG

SEQ ID NO: 2222662 - protein, 5 aa, Cryptosporidium parvum
PSCPN

SEQ ID NO: 2222663 - protein, 5 aa, Cryptosporidium parvum
PSDEN

SEQ ID NO: 2222664 - protein, 4 aa, Cryptosporidium parvum
PSDK

SEQ ID NO: 2222665 - protein, 6 aa, Cryptosporidium parvum
PSDLDP

SEQ ID NO: 2222666 - protein, 9 aa, Cryptosporidium parvum
PSDPDPPEF

SEQ ID NO: 2222667 - protein, 13 aa, Cryptosporidium parvum
PSDTKNPKEDTNA

SEQ ID NO: 2222668 - protein, 4 aa, Cryptosporidium parvum
PSDV

SEQ ID NO: 2222669 - protein, 12 aa, Cryptosporidium parvum
PSEEFNNNINNQ

SEQ ID NO: 2222670 - protein, 4 aa, Cryptosporidium parvum
PSEG

SEQ ID NO: 2222671 - protein, 10 aa, Cryptosporidium parvum
PSEGESLRKE

SEQ ID NO: 2222672 - protein, 9 aa, Cryptosporidium parvum
PSEGNSDSN

SEQ ID NO: 2222673 - protein, 4 aa, Cryptosporidium parvum
PSEI

SEQ ID NO: 2222674 - protein, 5 aa, Cryptosporidium parvum
PSEKL

SEQ ID NO: 2222675 - protein, 11 aa, Cryptosporidium parvum
PSELNNNSTEI

SEQ ID NO: 2222676 - protein, 25 aa, Cryptosporidium parvum
PSENNKKKRNNNNNSNNKEDESQDF

SEQ ID NO: 2222677 - protein, 18 aa, Cryptosporidium parvum
PSESDYNYTTSKHSNTGY

SEQ ID NO: 2222678 - protein, 9 aa, Cryptosporidium parvum
PSFEVKSND

SEQ ID NO: 2222679 - protein, 34 aa, Cryptosporidium parvum
PSFSSSNKRSRLQSTYNEDEFSSSSANSSVINSD

SEQ ID NO: 2222680 - protein, 5 aa, Cryptosporidium parvum
PSFTR

SEQ ID NO: 2222681 - protein, 5 aa, Cryptosporidium parvum
PSGIN

SEQ ID NO: 2222682 - protein, 4 aa, Cryptosporidium parvum
PSGL

SEQ ID NO: 2222683 - protein, 9 aa, Cryptosporidium parvum
PSGNVGRTT

SEQ ID NO: 2222684 - protein, 7 aa, Cryptosporidium parvum
PSGQALS

SEQ ID NO: 2222685 - protein, 7 aa, Cryptosporidium parvum
PSHPPSF

SEQ ID NO: 2222686 - protein, 8 aa, Cryptosporidium parvum
PSHVNSET

SEQ ID NO: 2222687 - protein, 6 aa, Cryptosporidium parvum
PSIEQL

SEQ ID NO: 2222688 - protein, 11 aa, Cryptosporidium parvum
PSIKANSKNEG

SEQ ID NO: 2222689 - protein, 5 aa, Cryptosporidium parvum
PSIPF

SEQ ID NO: 2222690 - protein, 6 aa, Cryptosporidium parvum
PSIPKA

SEQ ID NO: 2222691 - protein, 13 aa, Cryptosporidium parvum
PSIPPPESTDEEK

SEQ ID NO: 2222692 - protein, 10 aa, Cryptosporidium parvum
PSISGNNEFR

SEQ ID NO: 2222693 - protein, 17 aa, Cryptosporidium parvum
PSISTKENNKDVSYTVS

SEQ ID NO: 2222694 - protein, 4 aa, Cryptosporidium parvum
PSIT

SEQ ID NO: 2222695 - protein, 4 aa, Cryptosporidium parvum
PSKD

SEQ ID NO: 2222696 - protein, 6 aa, Cryptosporidium parvum
PSKDEI

SEQ ID NO: 2222697 - protein, 4 aa, Cryptosporidium parvum
PSKG

SEQ ID NO: 2222698 - protein, 5 aa, Cryptosporidium parvum
PSKIK

SEQ ID NO: 2222699 - protein, 4 aa, Cryptosporidium parvum
PSKL

SEQ ID NO: 2222700 - protein, 4 aa, Cryptosporidium parvum
PSKN

SEQ ID NO: 2222701 - protein, 17 aa, Cryptosporidium parvum
PSKSAHYSSESSSNEKS

SEQ ID NO: 2222702 - protein, 9 aa, Cryptosporidium parvum
PSKSGEREI

SEQ ID NO: 2222703 - protein, 34 aa, Cryptosporidium parvum
PSKSHRSRSESYQKLKEEKDFATTSFESDTDDGL

SEQ ID NO: 2222704 - protein, 6 aa, Cryptosporidium parvum
PSKSVK

SEQ ID NO: 2222705 - protein, 4 aa, Cryptosporidium parvum
PSLG

SEQ ID NO: 2222706 - protein, 7 aa, Cryptosporidium parvum
PSLGLDP

SEQ ID NO: 2222707 - protein, 8 aa, Cryptosporidium parvum
PSLPSGVH

SEQ ID NO: 2222708 - protein, 4 aa, Cryptosporidium parvum
PSLS

SEQ ID NO: 2222709 - protein, 25 aa, Cryptosporidium parvum
PSNHYSSSSLDYNQRHSENKSICDS

SEQ ID NO: 2222710 - protein, 4 aa, Cryptosporidium parvum
PSNI

SEQ ID NO: 2222711 - protein, 5 aa, Cryptosporidium parvum
PSNID

SEQ ID NO: 2222712 - protein, 7 aa, Cryptosporidium parvum
PSNNNPR

SEQ ID NO: 2222713 - protein, 13 aa, Cryptosporidium parvum
PSNNQLKSKNEER

SEQ ID NO: 2222714 - protein, 4 aa, Cryptosporidium parvum
PSNP

SEQ ID NO: 2222715 - protein, 4 aa, Cryptosporidium parvum
PSNS

SEQ ID NO: 2222716 - protein, 8 aa, Cryptosporidium parvum
PSNSRIKS

SEQ ID NO: 2222717 - protein, 10 aa, Cryptosporidium parvum
PSNSSLLGRT

SEQ ID NO: 2222718 - protein, 6 aa, Cryptosporidium parvum
PSPIGI

SEQ ID NO: 2222719 - protein, 6 aa, Cryptosporidium parvum
PSPIKQ

SEQ ID NO: 2222720 - protein, 7 aa, Cryptosporidium parvum
PSPISSS

SEQ ID NO: 2222721 - protein, 6 aa, Cryptosporidium parvum
PSPRKN

SEQ ID NO: 2222722 - protein, 6 aa, Cryptosporidium parvum
PSPSLR

SEQ ID NO: 2222723 - protein, 14 aa, Cryptosporidium parvum
PSQNKKQSNGSFNP

SEQ ID NO: 2222724 - protein, 19 aa, Cryptosporidium parvum
PSRGYTESLQQNKSENKTT

SEQ ID NO: 2222725 - protein, 8 aa, Cryptosporidium parvum
PSRRSTER

SEQ ID NO: 2222726 - protein, 14 aa, Cryptosporidium parvum
PSRSTIRKSSKESF

SEQ ID NO: 2222727 - protein, 4 aa, Cryptosporidium parvum
PSSC

SEQ ID NO: 2222728 - protein, 5 aa, Cryptosporidium parvum
PSSDI

SEQ ID NO: 2222729 - protein, 6 aa, Cryptosporidium parvum
PSSESF

SEQ ID NO: 2222730 - protein, 4 aa, Cryptosporidium parvum
PSSG

SEQ ID NO: 2222731 - protein, 12 aa, Cryptosporidium parvum
PSSGEERRLTGA

SEQ ID NO: 2222732 - protein, 26 aa, Cryptosporidium parvum
PSSGNTNSTNSNNSGNTLGGQYSEGG

SEQ ID NO: 2222733 - protein, 5 aa, Cryptosporidium parvum
PSSGS

SEQ ID NO: 2222734 - protein, 5 aa, Cryptosporidium parvum
PSSGT

SEQ ID NO: 2222735 - protein, 16 aa, Cryptosporidium parvum
PSSIETQGLQNTGSTF

SEQ ID NO: 2222736 - protein, 5 aa, Cryptosporidium parvum
PSSIS

SEQ ID NO: 2222737 - protein, 15 aa, Cryptosporidium parvum
PSSITERAGSISSDQ

SEQ ID NO: 2222738 - protein, 7 aa, Cryptosporidium parvum
PSSPAIS

SEQ ID NO: 2222739 - protein, 13 aa, Cryptosporidium parvum
PSSPAQGIPPADH

SEQ ID NO: 2222740 - protein, 5 aa, Cryptosporidium parvum
PSSQD

SEQ ID NO: 2222741 - protein, 13 aa, Cryptosporidium parvum
PSSRPFSGPNGSN

SEQ ID NO: 2222742 - protein, 8 aa, Cryptosporidium parvum
PSSSLEDV

SEQ ID NO: 2222743 - protein, 10 aa, Cryptosporidium parvum
PSSSSRTLNT

SEQ ID NO: 2222744 - protein, 4 aa, Cryptosporidium parvum
PSSY

SEQ ID NO: 2222745 - protein, 23 aa, Cryptosporidium parvum
PSTETLDENPTVSTECSNSEISP

SEQ ID NO: 2222746 - protein, 9 aa, Cryptosporidium parvum
PSTMPSQAS

SEQ ID NO: 2222747 - protein, 9 aa, Cryptosporidium parvum
PSTNNSNSI

SEQ ID NO: 2222748 - protein, 8 aa, Cryptosporidium parvum
PSTSLGSI

SEQ ID NO: 2222749 - protein, 4 aa, Cryptosporidium parvum
PSVA

SEQ ID NO: 2222750 - protein, 5 aa, Cryptosporidium parvum
PSVGR

SEQ ID NO: 2222751 - protein, 9 aa, Cryptosporidium parvum
PSVSGDDIG

SEQ ID NO: 2222752 - protein, 9 aa, Cryptosporidium parvum
PSYENETIH

SEQ ID NO: 2222753 - protein, 5 aa, Cryptosporidium parvum
PSYKQ

SEQ ID NO: 2222754 - protein, 8 aa, Cryptosporidium parvum
PTANEEEM

SEQ ID NO: 2222755 - protein, 10 aa, Cryptosporidium parvum
PTAPIGHDSN

SEQ ID NO: 2222756 - protein, 5 aa, Cryptosporidium parvum
PTDDR

SEQ ID NO: 2222757 - protein, 14 aa, Cryptosporidium parvum
PTDQQGQPQGGPRT

SEQ ID NO: 2222758 - protein, 16 aa, Cryptosporidium parvum
PTDVEVGHSKSQFEET

SEQ ID NO: 2222759 - protein, 15 aa, Cryptosporidium parvum
PTEAPTTKYSGIESW

SEQ ID NO: 2222760 - protein, 22 aa, Cryptosporidium parvum
PTEDPNVQKASDSIKDGISGNA

SEQ ID NO: 2222761 - protein, 7 aa, Cryptosporidium parvum
PTEEEEK

SEQ ID NO: 2222762 - protein, 12 aa, Cryptosporidium parvum
PTEELDNTKSIS

SEQ ID NO: 2222763 - protein, 11 aa, Cryptosporidium parvum
PTEQNSPQGQV

SEQ ID NO: 2222764 - protein, 5 aa, Cryptosporidium parvum
PTFKS

SEQ ID NO: 2222765 - protein, 5 aa, Cryptosporidium parvum
PTGER

SEQ ID NO: 2222766 - protein, 16 aa, Cryptosporidium parvum
PTIDSRGNRINCDESD

SEQ ID NO: 2222767 - protein, 10 aa, Cryptosporidium parvum
PTIKQESFSA

SEQ ID NO: 2222768 - protein, 4 aa, Cryptosporidium parvum
PTIS

SEQ ID NO: 2222769 - protein, 6 aa, Cryptosporidium parvum
PTISQT

SEQ ID NO: 2222770 - protein, 7 aa, Cryptosporidium parvum
PTISSKK

SEQ ID NO: 2222771 - protein, 5 aa, Cryptosporidium parvum
PTIYE

SEQ ID NO: 2222772 - protein, 16 aa, Cryptosporidium parvum
PTKDSENIPENKAMLA

SEQ ID NO: 2222773 - protein, 5 aa, Cryptosporidium parvum
PTKEG

SEQ ID NO: 2222774 - protein, 11 aa, Cryptosporidium parvum
PTKNEHSNSIN

SEQ ID NO: 2222775 - protein, 9 aa, Cryptosporidium parvum
PTKSSKPDI

SEQ ID NO: 2222776 - protein, 8 aa, Cryptosporidium parvum
PTKSYGNT

SEQ ID NO: 2222777 - protein, 6 aa, Cryptosporidium parvum
PTLECP

SEQ ID NO: 2222778 - protein, 10 aa, Cryptosporidium parvum
PTLGASPTSC

SEQ ID NO: 2222779 - protein, 10 aa, Cryptosporidium parvum
PTLSSQSSAV

SEQ ID NO: 2222780 - protein, 10 aa, Cryptosporidium parvum
PTLTPSLNTA

SEQ ID NO: 2222781 - protein, 8 aa, Cryptosporidium parvum
PTNIEENS

SEQ ID NO: 2222782 - protein, 10 aa, Cryptosporidium parvum
PTNNGKSDLG

SEQ ID NO: 2222783 - protein, 11 aa, Cryptosporidium parvum
PTNNNTMDSSF

SEQ ID NO: 2222784 - protein, 5 aa, Cryptosporidium parvum
PTPFS

SEQ ID NO: 2222785 - protein, 7 aa, Cryptosporidium parvum
PTPGEGA

SEQ ID NO: 2222786 - protein, 10 aa, Cryptosporidium parvum
PTPRFSTPGE

SEQ ID NO: 2222787 - protein, 9 aa, Cryptosporidium parvum
PTPSRDGED

SEQ ID NO: 2222788 - protein, 9 aa, Cryptosporidium parvum
PTPTNKELR

SEQ ID NO: 2222789 - protein, 5 aa, Cryptosporidium parvum
PTRRP

SEQ ID NO: 2222790 - protein, 4 aa, Cryptosporidium parvum
PTSA

SEQ ID NO: 2222791 - protein, 7 aa, Cryptosporidium parvum
PTSDKYV

SEQ ID NO: 2222792 - protein, 9 aa, Cryptosporidium parvum
PTSESSFSS

SEQ ID NO: 2222793 - protein, 16 aa, Cryptosporidium parvum
PTSGGEPTISQRQGGD

SEQ ID NO: 2222794 - protein, 5 aa, Cryptosporidium parvum
PTSGL

SEQ ID NO: 2222795 - protein, 4 aa, Cryptosporidium parvum
PTSI

SEQ ID NO: 2222796 - protein, 15 aa, Cryptosporidium parvum
PTSKGKREKKQSKDD

SEQ ID NO: 2222797 - protein, 17 aa, Cryptosporidium parvum
PTSMGGSSSSGSAASLD

SEQ ID NO: 2222798 - protein, 4 aa, Cryptosporidium parvum
PTSP

SEQ ID NO: 2222799 - protein, 15 aa, Cryptosporidium parvum
PTSSITEDNTNSEEN

SEQ ID NO: 2222800 - protein, 11 aa, Cryptosporidium parvum
PTSSSNQESLS

SEQ ID NO: 2222801 - protein, 10 aa, Cryptosporidium parvum
PTSTYTENSS

SEQ ID NO: 2222802 - protein, 15 aa, Cryptosporidium parvum
PTSVSRTSTSRGMST

SEQ ID NO: 2222803 - protein, 5 aa, Cryptosporidium parvum
PTTFP

SEQ ID NO: 2222804 - protein, 8 aa, Cryptosporidium parvum
PTTGLDAA

SEQ ID NO: 2222805 - protein, 13 aa, Cryptosporidium parvum
PTTINTGRGTEFE

SEQ ID NO: 2222806 - protein, 9 aa, Cryptosporidium parvum
PTTSGIKNQ

SEQ ID NO: 2222807 - protein, 27 aa, Cryptosporidium parvum
PTVDGGESKRQLGPDPSVRPKTTRPQL

SEQ ID NO: 2222808 - protein, 7 aa, Cryptosporidium parvum
PTVESNS

SEQ ID NO: 2222809 - protein, 6 aa, Cryptosporidium parvum
PTWSGE

SEQ ID NO: 2222810 - protein, 14 aa, Cryptosporidium parvum
PVDDSDSSKKNGMD

SEQ ID NO: 2222811 - protein, 6 aa, Cryptosporidium parvum
PVENKD

SEQ ID NO: 2222812 - protein, 8 aa, Cryptosporidium parvum
PVENQELA

SEQ ID NO: 2222813 - protein, 9 aa, Cryptosporidium parvum
PVENSTSSL

SEQ ID NO: 2222814 - protein, 59 aa, Cryptosporidium parvum
PVGEGIQEGETRSEGRVSQAGIGNGTGLETGARADVGSGANQTVASDRTSGNTTSQDVR

SEQ ID NO: 2222815 - protein, 8 aa, Cryptosporidium parvum
PVGSGKSG

SEQ ID NO: 2222816 - protein, 9 aa, Cryptosporidium parvum
PVGTQTDLE

SEQ ID NO: 2222817 - protein, 14 aa, Cryptosporidium parvum
PVKIGSSGRKGLPQ

SEQ ID NO: 2222818 - protein, 4 aa, Cryptosporidium parvum
PVKS

SEQ ID NO: 2222819 - protein, 6 aa, Cryptosporidium parvum
PVNIKN

SEQ ID NO: 2222820 - protein, 19 aa, Cryptosporidium parvum
PVPKPTIRRNQKNQEKSRG

SEQ ID NO: 2222821 - protein, 9 aa, Cryptosporidium parvum
PVPQNYDSN

SEQ ID NO: 2222822 - protein, 8 aa, Cryptosporidium parvum
PVPQPKPA

SEQ ID NO: 2222823 - protein, 6 aa, Cryptosporidium parvum
PVPQPS

SEQ ID NO: 2222824 - protein, 4 aa, Cryptosporidium parvum
PVRR

SEQ ID NO: 2222825 - protein, 14 aa, Cryptosporidium parvum
PVSEPENLPTTEEN

SEQ ID NO: 2222826 - protein, 9 aa, Cryptosporidium parvum
PVSESSNTP

SEQ ID NO: 2222827 - protein, 18 aa, Cryptosporidium parvum
PVSEVKTKSVQMKQTSAI

SEQ ID NO: 2222828 - protein, 11 aa, Cryptosporidium parvum
PVSLDEDASAQ

SEQ ID NO: 2222829 - protein, 16 aa, Cryptosporidium parvum
PVSSEAQRALKDKNVS

SEQ ID NO: 2222830 - protein, 14 aa, Cryptosporidium parvum
PVSSPGNQSNMDTS

SEQ ID NO: 2222831 - protein, 7 aa, Cryptosporidium parvum
PVTESSL

SEQ ID NO: 2222832 - protein, 11 aa, Cryptosporidium parvum
PVTKKGSAEDE

SEQ ID NO: 2222833 - protein, 6 aa, Cryptosporidium parvum
PVTSTQ

SEQ ID NO: 2222834 - protein, 6 aa, Cryptosporidium parvum
PVVTSN

SEQ ID NO: 2222835 - protein, 13 aa, Cryptosporidium parvum
PWAAGNKLGQDPY

SEQ ID NO: 2222836 - protein, 5 aa, Cryptosporidium parvum
PWSTN

SEQ ID NO: 2222837 - protein, 10 aa, Cryptosporidium parvum
PYDEASANFE

SEQ ID NO: 2222838 - protein, 7 aa, Cryptosporidium parvum
PYENNNR

SEQ ID NO: 2222839 - protein, 5 aa, Cryptosporidium parvum
PYETA

SEQ ID NO: 2222840 - protein, 5 aa, Cryptosporidium parvum
PYGSG

SEQ ID NO: 2222841 - protein, 13 aa, Cryptosporidium parvum
PYKPHSYSNAGSS

SEQ ID NO: 2222842 - protein, 7 aa, Cryptosporidium parvum
PYNQGDR

SEQ ID NO: 2222843 - protein, 12 aa, Cryptosporidium parvum
PYPISSSSSQNY

SEQ ID NO: 2222844 - protein, 8 aa, Cryptosporidium parvum
PYRDDPKI

SEQ ID NO: 2222845 - protein, 4 aa, Cryptosporidium parvum
PYSA

SEQ ID NO: 2222846 - protein, 6 aa, Cryptosporidium parvum
PYSISN

SEQ ID NO: 2222847 - protein, 10 aa, Cryptosporidium parvum
PYSNQKIQRE

SEQ ID NO: 2222848 - protein, 7 aa, Cryptosporidium parvum
PYSPAYT

SEQ ID NO: 2222849 - protein, 5 aa, Cryptosporidium parvum
PYSRR

SEQ ID NO: 2222850 - protein, 5 aa, Cryptosporidium parvum
PYSYS

SEQ ID NO: 2222851 - protein, 15 aa, Cryptosporidium parvum
PYTLNNNPTCEGCPK

SEQ ID NO: 2222852 - protein, 7 aa, Cryptosporidium parvum
PYVPPYG

SEQ ID NO: 2222853 - protein, 9 aa, Cryptosporidium parvum
QAASRYEDS

SEQ ID NO: 2222854 - protein, 7 aa, Cryptosporidium parvum
QAEKRIE

SEQ ID NO: 2222855 - protein, 4 aa, Cryptosporidium parvum
QAGT

SEQ ID NO: 2222856 - protein, 10 aa, Cryptosporidium parvum
QAHPHSQNDC

SEQ ID NO: 2222857 - protein, 19 aa, Cryptosporidium parvum
QAHTTNNNIKKKNDTEHIQ

SEQ ID NO: 2222858 - protein, 11 aa, Cryptosporidium parvum
QALASTKKAGV

SEQ ID NO: 2222859 - protein, 4 aa, Cryptosporidium parvum
QANE

SEQ ID NO: 2222860 - protein, 10 aa, Cryptosporidium parvum
QANKLGKNSS

SEQ ID NO: 2222861 - protein, 7 aa, Cryptosporidium parvum
QANNEKL

SEQ ID NO: 2222862 - protein, 10 aa, Cryptosporidium parvum
QANSNSMGNN

SEQ ID NO: 2222863 - protein, 8 aa, Cryptosporidium parvum
QANYSAAN

SEQ ID NO: 2222864 - protein, 6 aa, Cryptosporidium parvum
QAQTHF

SEQ ID NO: 2222865 - protein, 29 aa, Cryptosporidium parvum
QARPERSWDTPSKKRSKRSNKISSAGPVN

SEQ ID NO: 2222866 - protein, 7 aa, Cryptosporidium parvum
QASAYTR

SEQ ID NO: 2222867 - protein, 15 aa, Cryptosporidium parvum
QASEGTIGPPPGHQP

SEQ ID NO: 2222868 - protein, 5 aa, Cryptosporidium parvum
QASIQ

SEQ ID NO: 2222869 - protein, 5 aa, Cryptosporidium parvum
QATND

SEQ ID NO: 2222870 - protein, 7 aa, Cryptosporidium parvum
QAVENNK

SEQ ID NO: 2222871 - protein, 5 aa, Cryptosporidium parvum
QAVGE

SEQ ID NO: 2222872 - protein, 8 aa, Cryptosporidium parvum
QDDARSGN

SEQ ID NO: 2222873 - protein, 16 aa, Cryptosporidium parvum
QDDVDPESGIVQNENE

SEQ ID NO: 2222874 - protein, 14 aa, Cryptosporidium parvum
QDENSEKNESNNKI

SEQ ID NO: 2222875 - protein, 7 aa, Cryptosporidium parvum
QDESLKS

SEQ ID NO: 2222876 - protein, 7 aa, Cryptosporidium parvum
QDETGFN

SEQ ID NO: 2222877 - protein, 17 aa, Cryptosporidium parvum
QDETIEDDENNDNNNKN

SEQ ID NO: 2222878 - protein, 5 aa, Cryptosporidium parvum
QDEVP

SEQ ID NO: 2222879 - protein, 19 aa, Cryptosporidium parvum
QDEYPKNLKEKQSSYKNKK

SEQ ID NO: 2222880 - protein, 23 aa, Cryptosporidium parvum
QDFDNEQDKDFEDEFNKSNVNER

SEQ ID NO: 2222881 - protein, 6 aa, Cryptosporidium parvum
QDFTEK

SEQ ID NO: 2222882 - protein, 7 aa, Cryptosporidium parvum
QDGFESS

SEQ ID NO: 2222883 - protein, 5 aa, Cryptosporidium parvum
QDGVP

SEQ ID NO: 2222884 - protein, 9 aa, Cryptosporidium parvum
QDHKEGDRK

SEQ ID NO: 2222885 - protein, 7 aa, Cryptosporidium parvum
QDINENE

SEQ ID NO: 2222886 - protein, 15 aa, Cryptosporidium parvum
QDKDYHKNPKIGSKI

SEQ ID NO: 2222887 - protein, 36 aa, Cryptosporidium parvum
QDKEQEEETTKEVHENESRDFAEENEEVDENNRNKM

SEQ ID NO: 2222888 - protein, 15 aa, Cryptosporidium parvum
QDKNNPDSKNSSYND

SEQ ID NO: 2222889 - protein, 6 aa, Cryptosporidium parvum
QDKQGD

SEQ ID NO: 2222890 - protein, 5 aa, Cryptosporidium parvum
QDKSA

SEQ ID NO: 2222891 - protein, 5 aa, Cryptosporidium parvum
QDKSL

SEQ ID NO: 2222892 - protein, 5 aa, Cryptosporidium parvum
QDKSV

SEQ ID NO: 2222893 - protein, 7 aa, Cryptosporidium parvum
QDLNKHD

SEQ ID NO: 2222894 - protein, 7 aa, Cryptosporidium parvum
QDLSENK

SEQ ID NO: 2222895 - protein, 7 aa, Cryptosporidium parvum
QDLSERR

SEQ ID NO: 2222896 - protein, 9 aa, Cryptosporidium parvum
QDNKKVSTF

SEQ ID NO: 2222897 - protein, 10 aa, Cryptosporidium parvum
QDNKPYDKSN

SEQ ID NO: 2222898 - protein, 11 aa, Cryptosporidium parvum
QDNKSKNLTSK

SEQ ID NO: 2222899 - protein, 9 aa, Cryptosporidium parvum
QDNQKYSSS

SEQ ID NO: 2222900 - protein, 15 aa, Cryptosporidium parvum
QDNSKDQKLETTNKS

SEQ ID NO: 2222901 - protein, 6 aa, Cryptosporidium parvum
QDNTRE

SEQ ID NO: 2222902 - protein, 9 aa, Cryptosporidium parvum
QDPANRKGL

SEQ ID NO: 2222903 - protein, 6 aa, Cryptosporidium parvum
QDPDNL

SEQ ID NO: 2222904 - protein, 13 aa, Cryptosporidium parvum
QDPEFRPSAENTY

SEQ ID NO: 2222905 - protein, 10 aa, Cryptosporidium parvum
QDPFKKTSIS

SEQ ID NO: 2222906 - protein, 9 aa, Cryptosporidium parvum
QDPSNRKTY

SEQ ID NO: 2222907 - protein, 12 aa, Cryptosporidium parvum
QDPTKDDLNQIN

SEQ ID NO: 2222908 - protein, 7 aa, Cryptosporidium parvum
QDQDQDH

SEQ ID NO: 2222909 - protein, 9 aa, Cryptosporidium parvum
QDQNEGGME

SEQ ID NO: 2222910 - protein, 9 aa, Cryptosporidium parvum
QDQNNRELG

SEQ ID NO: 2222911 - protein, 4 aa, Cryptosporidium parvum
QDQS

SEQ ID NO: 2222912 - protein, 6 aa, Cryptosporidium parvum
QDQSFS

SEQ ID NO: 2222913 - protein, 18 aa, Cryptosporidium parvum
QDQSYSSETNFKEQVPSS

SEQ ID NO: 2222914 - protein, 5 aa, Cryptosporidium parvum
QDQTS

SEQ ID NO: 2222915 - protein, 9 aa, Cryptosporidium parvum
QDREKDENY

SEQ ID NO: 2222916 - protein, 9 aa, Cryptosporidium parvum
QDSKNNTFS

SEQ ID NO: 2222917 - protein, 4 aa, Cryptosporidium parvum
QDSM

SEQ ID NO: 2222918 - protein, 6 aa, Cryptosporidium parvum
QDSPKD

SEQ ID NO: 2222919 - protein, 16 aa, Cryptosporidium parvum
QDSPNGYEGDHESEMD

SEQ ID NO: 2222920 - protein, 8 aa, Cryptosporidium parvum
QDSQSEDL

SEQ ID NO: 2222921 - protein, 24 aa, Cryptosporidium parvum
QDSSANTANTVNTASSSNNSNSSI

SEQ ID NO: 2222922 - protein, 7 aa, Cryptosporidium parvum
QDSTSPC

SEQ ID NO: 2222923 - protein, 56 aa, Cryptosporidium parvum; identical to SEQ ID NO: 2118272

SEQ ID NO: 2222924 - protein, 24 aa, Cryptosporidium parvum
QDTSNIHRRESGKSEKRSPKLPKG

SEQ ID NO: 2222925 - protein, 9 aa, Cryptosporidium parvum
QDTSVEINT

SEQ ID NO: 2222926 - protein, 12 aa, Cryptosporidium parvum
QDVHKSQEETTE

SEQ ID NO: 2222927 - protein, 15 aa, Cryptosporidium parvum
QDYPKNEANFETQGK

SEQ ID NO: 2222928 - protein, 6 aa, Cryptosporidium parvum
QDYTGR

SEQ ID NO: 2222929 - protein, 25 aa, Cryptosporidium parvum
QEADEESNEELEDEENWNTFVNQYI

SEQ ID NO: 2222930 - protein, 5 aa, Cryptosporidium parvum
QEAGE

SEQ ID NO: 2222931 - protein, 4 aa, Cryptosporidium parvum
QEDL

SEQ ID NO: 2222932 - protein, 4 aa, Cryptosporidium parvum
QEDP

SEQ ID NO: 2222933 - protein, 25 aa, Cryptosporidium parvum
QEDYNNERHGNDGSNTIREYKKGDT

SEQ ID NO: 2222934 - protein, 7 aa, Cryptosporidium parvum
QEEANSL

SEQ ID NO: 2222935 - protein, 7 aa, Cryptosporidium parvum
QEEEEGD

SEQ ID NO: 2222936 - protein, 20 aa, Cryptosporidium parvum
QEEEGNKGICNSNSISSNEQ

SEQ ID NO: 2222937 - protein, 16 aa, Cryptosporidium parvum
QEEIGNQREKQDSRSG

SEQ ID NO: 2222938 - protein, 6 aa, Cryptosporidium parvum
QEENFN

SEQ ID NO: 2222939 - protein, 13 aa, Cryptosporidium parvum
QEENINSNSQQTL

SEQ ID NO: 2222940 - protein, 19 aa, Cryptosporidium parvum
QEESLSNNDSKNNSGNKKR

SEQ ID NO: 2222941 - protein, 16 aa, Cryptosporidium parvum
QEETLESDTRSNLGSR

SEQ ID NO: 2222942 - protein, 8 aa, Cryptosporidium parvum
QEETTEET

SEQ ID NO: 2222943 - protein, 17 aa, Cryptosporidium parvum
QEEYNSFDEDSIEENSH

SEQ ID NO: 2222944 - protein, 4 aa, Cryptosporidium parvum
QEFN

SEQ ID NO: 2222945 - protein, 5 aa, Cryptosporidium parvum
QEHDS

SEQ ID NO: 2222946 - protein, 10 aa, Cryptosporidium parvum
QEIEKSDLKH

SEQ ID NO: 2222947 - protein, 7 aa, Cryptosporidium parvum
QEIGGAT

SEQ ID NO: 2222948 - protein, 7 aa, Cryptosporidium parvum
QEIRGKG

SEQ ID NO: 2222949 - protein, 7 aa, Cryptosporidium parvum
QEKDKYI

SEQ ID NO: 2222950 - protein, 8 aa, Cryptosporidium parvum
QEKEKIPE

SEQ ID NO: 2222951 - protein, 19 aa, Cryptosporidium parvum
QEKKEDGENTDLNGNSNND

SEQ ID NO: 2222952 - protein, 28 aa, Cryptosporidium parvum
QEKNDRALQEAGSSSNSGTNQGSSNSIG

SEQ ID NO: 2222953 - protein, 6 aa, Cryptosporidium parvum
QEKNNL

SEQ ID NO: 2222954 - protein, 19 aa, Cryptosporidium parvum
QEKNQNRGSFGRVNQEKEE

SEQ ID NO: 2222955 - protein, 4 aa, Cryptosporidium parvum
QEKP

SEQ ID NO: 2222956 - protein, 9 aa, Cryptosporidium parvum
QEKSAITKN

SEQ ID NO: 2222957 - protein, 12 aa, Cryptosporidium parvum
QEKVGGEIEGGS

SEQ ID NO: 2222958 - protein, 11 aa, Cryptosporidium parvum
QENDKSESSGM

SEQ ID NO: 2222959 - protein, 8 aa, Cryptosporidium parvum
QENDSYSD

SEQ ID NO: 2222960 - protein, 21 aa, Cryptosporidium parvum
QENGKNEEIKSIENKKKLPNE

SEQ ID NO: 2222961 - protein, 5 aa, Cryptosporidium parvum
QENIK

SEQ ID NO: 2222962 - protein, 7 aa, Cryptosporidium parvum
QENPSPN

SEQ ID NO: 2222963 - protein, 4 aa, Cryptosporidium parvum
QENS

SEQ ID NO: 2222964 - protein, 10 aa, Cryptosporidium parvum
QEPETPNTTE

SEQ ID NO: 2222965 - protein, 6 aa, Cryptosporidium parvum
QEPTQS

SEQ ID NO: 2222966 - protein, 5 aa, Cryptosporidium parvum
QEQID

SEQ ID NO: 2222967 - protein, 8 aa, Cryptosporidium parvum
QEQPPTIE

SEQ ID NO: 2222968 - protein, 14 aa, Cryptosporidium parvum
QEQSKGGNVVNGPQ

SEQ ID NO: 2222969 - protein, 4 aa, Cryptosporidium parvum
QEQY

SEQ ID NO: 2222970 - protein, 15 aa, Cryptosporidium parvum
QEQYQQKKSHELISD

SEQ ID NO: 2222971 - protein, 4 aa, Cryptosporidium parvum
QERA

SEQ ID NO: 2222972 - protein, 5 aa, Cryptosporidium parvum
QERAT

SEQ ID NO: 2222973 - protein, 6 aa, Cryptosporidium parvum
QERKKE

SEQ ID NO: 2222974 - protein, 8 aa, Cryptosporidium parvum
QESDDELT

SEQ ID NO: 2222975 - protein, 13 aa, Cryptosporidium parvum
QESDEGFSLSSTD

SEQ ID NO: 2222976 - protein, 5 aa, Cryptosporidium parvum
QESDL

SEQ ID NO: 2222977 - protein, 16 aa, Cryptosporidium parvum
QESEDEQNKQEEYENF

SEQ ID NO: 2222978 - protein, 7 aa, Cryptosporidium parvum
QESETES

SEQ ID NO: 2222979 - protein, 29 aa, Cryptosporidium parvum
QESKSETESPKSNQDDAEKYEPSNQFNRE

SEQ ID NO: 2222980 - protein, 5 aa, Cryptosporidium parvum
QESMK

SEQ ID NO: 2222981 - protein, 7 aa, Cryptosporidium parvum
QESTFNK

SEQ ID NO: 2222982 - protein, 5 aa, Cryptosporidium parvum
QETEN

SEQ ID NO: 2222983 - protein, 11 aa, Cryptosporidium parvum
QETINTNTDPI

SEQ ID NO: 2222984 - protein, 4 aa, Cryptosporidium parvum
QETN

SEQ ID NO: 2222985 - protein, 8 aa, Cryptosporidium parvum
QETNINND

SEQ ID NO: 2222986 - protein, 7 aa, Cryptosporidium parvum
QETNRNI

SEQ ID NO: 2222987 - protein, 5 aa, Cryptosporidium parvum
QETRA

SEQ ID NO: 2222988 - protein, 8 aa, Cryptosporidium parvum
QETSKHNG

SEQ ID NO: 2222989 - protein, 21 aa, Cryptosporidium parvum
QEVENEVNPEAKLKTGNTNVI

SEQ ID NO: 2222990 - protein, 14 aa, Cryptosporidium parvum
QEYRSKDGIKISEK

SEQ ID NO: 2222991 - protein, 8 aa, Cryptosporidium parvum
QFAKTNTL

SEQ ID NO: 2222992 - protein, 16 aa, Cryptosporidium parvum
QFGESTRKFDLKIHLN

SEQ ID NO: 2222993 - protein, 6 aa, Cryptosporidium parvum
QFGTPE

SEQ ID NO: 2222994 - protein, 10 aa, Cryptosporidium parvum
QFNNGTESEL

SEQ ID NO: 2222995 - protein, 6 aa, Cryptosporidium parvum
QFSAGQ

SEQ ID NO: 2222996 - protein, 13 aa, Cryptosporidium parvum
QFSNSNLSRVSSG

SEQ ID NO: 2222997 - protein, 5 aa, Cryptosporidium parvum
QFSRI

SEQ ID NO: 2222998 - protein, 9 aa, Cryptosporidium parvum
QFSSEKKKF

SEQ ID NO: 2222999 - protein, 16 aa, Cryptosporidium parvum
QFSSQVKPKAYTTSKG

SEQ ID NO: 2223000 - protein, 18 aa, Cryptosporidium parvum
QFSTKGSSCSSTNTYSRS

SEQ ID NO: 2223001 - protein, 20 aa, Cryptosporidium parvum
QGDDSQNIQIKSTSGKKDLP

SEQ ID NO: 2223002 - protein, 16 aa, Cryptosporidium parvum
QGDFTSLDNQTLDKHP

SEQ ID NO: 2223003 - protein, 7 aa, Cryptosporidium parvum
QGDLSSK

SEQ ID NO: 2223004 - protein, 8 aa, Cryptosporidium parvum
QGDQGNSD

SEQ ID NO: 2223005 - protein, 36 aa, Cryptosporidium parvum
QGDSDDTSNSSTSAHSPVSLTSKNSPPVTMTPNPGL

SEQ ID NO: 2223006 - protein, 11 aa, Cryptosporidium parvum
QGDSSQPSPLK

SEQ ID NO: 2223007 - protein, 11 aa, Cryptosporidium parvum
QGENNDEDNRI

SEQ ID NO: 2223008 - protein, 24 aa, Cryptosporidium parvum
QGGEEKDREEERRVEKEKEIEEKE

SEQ ID NO: 2223009 - protein, 4 aa, Cryptosporidium parvum
QGGG

SEQ ID NO: 2223010 - protein, 7 aa, Cryptosporidium parvum
QGGWQPP

SEQ ID NO: 2223011 - protein, 4 aa, Cryptosporidium parvum
QGHL

SEQ ID NO: 2223012 - protein, 10 aa, Cryptosporidium parvum
QGHPFTTPLS

SEQ ID NO: 2223013 - protein, 8 aa, Cryptosporidium parvum
QGHTQVDT

SEQ ID NO: 2223014 - protein, 4 aa, Cryptosporidium parvum
QGIS

SEQ ID NO: 2223015 - protein, 5 aa, Cryptosporidium parvum
QGITG

SEQ ID NO: 2223016 - protein, 5 aa, Cryptosporidium parvum
QGKNQ

SEQ ID NO: 2223017 - protein, 6 aa, Cryptosporidium parvum
QGKTRL

SEQ ID NO: 2223018 - protein, 5 aa, Cryptosporidium parvum
QGLAK

SEQ ID NO: 2223019 - protein, 4 aa, Cryptosporidium parvum
QGMA

SEQ ID NO: 2223020 - protein, 5 aa, Cryptosporidium parvum
QGNAS

SEQ ID NO: 2223021 - protein, 12 aa, Cryptosporidium parvum
QGNNIGSNTGKT

SEQ ID NO: 2223022 - protein, 12 aa, Cryptosporidium parvum
QGNTSDKTKRME

SEQ ID NO: 2223023 - protein, 16 aa, Cryptosporidium parvum
QGPGIVDKQNNKTFPI

SEQ ID NO: 2223024 - protein, 8 aa, Cryptosporidium parvum
QGQITSSD

SEQ ID NO: 2223025 - protein, 22 aa, Cryptosporidium parvum
QGQQNHNPYGQQYPYYNQQYRG

SEQ ID NO: 2223026 - protein, 15 aa, Cryptosporidium parvum
QGRDGSLGTGSYEDS

SEQ ID NO: 2223027 - protein, 6 aa, Cryptosporidium parvum
QGRDTT

SEQ ID NO: 2223028 - protein, 6 aa, Cryptosporidium parvum
QGSHVN

SEQ ID NO: 2223029 - protein, 8 aa, Cryptosporidium parvum
QGSKSPSH

SEQ ID NO: 2223030 - protein, 4 aa, Cryptosporidium parvum
QGSP

SEQ ID NO: 2223031 - protein, 7 aa, Cryptosporidium parvum
QGSRYDA

SEQ ID NO: 2223032 - protein, 11 aa, Cryptosporidium parvum
QGSSRRRSSLS

SEQ ID NO: 2223033 - protein, 5 aa, Cryptosporidium parvum
QGTLI

SEQ ID NO: 2223034 - protein, 4 aa, Cryptosporidium parvum
QGTM

SEQ ID NO: 2223035 - protein, 7 aa, Cryptosporidium parvum
QGVESSR

SEQ ID NO: 2223036 - protein, 5 aa, Cryptosporidium parvum
QGVGT

SEQ ID NO: 2223037 - protein, 18 aa, Cryptosporidium parvum
QGVNEQNGNSKNDEEMSS

SEQ ID NO: 2223038 - protein, 11 aa, Cryptosporidium parvum
QGVTNNQNSIT

SEQ ID NO: 2223039 - protein, 5 aa, Cryptosporidium parvum
QGWNE

SEQ ID NO: 2223040 - protein, 10 aa, Cryptosporidium parvum
QHATSNASNR

SEQ ID NO: 2223041 - protein, 8 aa, Cryptosporidium parvum
QHESELSK

SEQ ID NO: 2223042 - protein, 4 aa, Cryptosporidium parvum
QHNH

SEQ ID NO: 2223043 - protein, 10 aa, Cryptosporidium parvum
QHNSNNENYE

SEQ ID NO: 2223044 - protein, 12 aa, Cryptosporidium parvum
QHQPTDSNSIYQ

SEQ ID NO: 2223045 - protein, 6 aa, Cryptosporidium parvum
QHQTNI

SEQ ID NO: 2223046 - protein, 8 aa, Cryptosporidium parvum
QHSAEGMD

SEQ ID NO: 2223047 - protein, 15 aa, Cryptosporidium parvum
QHSDRKTASESTIPS

SEQ ID NO: 2223048 - protein, 14 aa, Cryptosporidium parvum
QHSRLESQGNSNFD

SEQ ID NO: 2223049 - protein, 12 aa, Cryptosporidium parvum
QHYPGSKSETRL

SEQ ID NO: 2223050 - protein, 7 aa, Cryptosporidium parvum
QIDPEEE

SEQ ID NO: 2223051 - protein, 13 aa, Cryptosporidium parvum
QIEDNENEDDCES

SEQ ID NO: 2223052 - protein, 20 aa, Cryptosporidium parvum
QIEEQKKLSYSSPEKNSGVG

SEQ ID NO: 2223053 - protein, 10 aa, Cryptosporidium parvum
QIENEDDKTM

SEQ ID NO: 2223054 - protein, 7 aa, Cryptosporidium parvum
QIGPTAD

SEQ ID NO: 2223055 - protein, 10 aa, Cryptosporidium parvum
QIGSNSTESN

SEQ ID NO: 2223056 - protein, 7 aa, Cryptosporidium parvum
QIHNSSN

SEQ ID NO: 2223057 - protein, 8 aa, Cryptosporidium parvum
QIKENPQI

SEQ ID NO: 2223058 - protein, 49 aa, Cryptosporidium parvum
QIKKQSSQKKQTKKSKKITSKKKKSRHNDESDSNFDSEFEDEKENNFSG

SEQ ID NO: 2223059 - protein, 5 aa, Cryptosporidium parvum
QIKSK

SEQ ID NO: 2223060 - protein, 7 aa, Cryptosporidium parvum
QIKSSDD

SEQ ID NO: 2223061 - protein, 10 aa, Cryptosporidium parvum
QINDNNSSLL

SEQ ID NO: 2223062 - protein, 14 aa, Cryptosporidium parvum
QINPRDNYQKPISE

SEQ ID NO: 2223063 - protein, 14 aa, Cryptosporidium parvum
QINPTNNLNNIEPK

SEQ ID NO: 2223064 - protein, 10 aa, Cryptosporidium parvum
QINQQEKNGN

SEQ ID NO: 2223065 - protein, 18 aa, Cryptosporidium parvum
QINTSNSQANINKKENNF

SEQ ID NO: 2223066 - protein, 6 aa, Cryptosporidium parvum
QIPTGN

SEQ ID NO: 2223067 - protein, 10 aa, Cryptosporidium parvum
QIQNDKKDPF

SEQ ID NO: 2223068 - protein, 6 aa, Cryptosporidium parvum
QISDEV

SEQ ID NO: 2223069 - protein, 5 aa, Cryptosporidium parvum
QISEP

SEQ ID NO: 2223070 - protein, 6 aa, Cryptosporidium parvum
QISESE

SEQ ID NO: 2223071 - protein, 4 aa, Cryptosporidium parvum
QISG

SEQ ID NO: 2223072 - protein, 5 aa, Cryptosporidium parvum
QISGI

SEQ ID NO: 2223073 - protein, 7 aa, Cryptosporidium parvum
QISHPRN

SEQ ID NO: 2223074 - protein, 5 aa, Cryptosporidium parvum
QISKE

SEQ ID NO: 2223075 - protein, 5 aa, Cryptosporidium parvum
QISKS

SEQ ID NO: 2223076 - protein, 11 aa, Cryptosporidium parvum
QISPDPRRRYA

SEQ ID NO: 2223077 - protein, 7 aa, Cryptosporidium parvum
QISPGEA

SEQ ID NO: 2223078 - protein, 25 aa, Cryptosporidium parvum
QISPLSSSSFHSTKSQEQDIGRDQS

SEQ ID NO: 2223079 - protein, 7 aa, Cryptosporidium parvum
QISSGSI

SEQ ID NO: 2223080 - protein, 21 aa, Cryptosporidium parvum
QITNDQANSLISTEKSYLSNE

SEQ ID NO: 2223081 - protein, 11 aa, Cryptosporidium parvum
QITSGSGSQIY

SEQ ID NO: 2223082 - protein, 4 aa, Cryptosporidium parvum
QITY

SEQ ID NO: 2223083 - protein, 4 aa, Cryptosporidium parvum
QKAD

SEQ ID NO: 2223084 - protein, 9 aa, Cryptosporidium parvum
QKDENTRNG

SEQ ID NO: 2223085 - protein, 15 aa, Cryptosporidium parvum
QKDETEEIEQDGIQG

SEQ ID NO: 2223086 - protein, 18 aa, Cryptosporidium parvum
QKDNSERLITPTQGEQDD

SEQ ID NO: 2223087 - protein, 7 aa, Cryptosporidium parvum
QKDPTTC

SEQ ID NO: 2223088 - protein, 4 aa, Cryptosporidium parvum
QKEE

SEQ ID NO: 2223089 - protein, 24 aa, Cryptosporidium parvum
QKEKFKPYEERTPKISKQSELSEF

SEQ ID NO: 2223090 - protein, 9 aa, Cryptosporidium parvum
QKENEKYKF

SEQ ID NO: 2223091 - protein, 8 aa, Cryptosporidium parvum
QKENGYSN

SEQ ID NO: 2223092 - protein, 5 aa, Cryptosporidium parvum
QKEQQ

SEQ ID NO: 2223093 - protein, 7 aa, Cryptosporidium parvum
QKESHDF

SEQ ID NO: 2223094 - protein, 7 aa, Cryptosporidium parvum
QKESNGL

SEQ ID NO: 2223095 - protein, 7 aa, Cryptosporidium parvum
QKESQDI

SEQ ID NO: 2223096 - protein, 8 aa, Cryptosporidium parvum
QKESSSKG

SEQ ID NO: 2223097 - protein, 9 aa, Cryptosporidium parvum
QKETKSPYR

SEQ ID NO: 2223098 - protein, 12 aa, Cryptosporidium parvum
QKETSESPCKPN

SEQ ID NO: 2223099 - protein, 7 aa, Cryptosporidium parvum
QKGFESK

SEQ ID NO: 2223100 - protein, 10 aa, Cryptosporidium parvum
QKGSGKETYS

SEQ ID NO: 2223101 - protein, 8 aa, Cryptosporidium parvum
QKIQPHNP

SEQ ID NO: 2223102 - protein, 6 aa, Cryptosporidium parvum
QKISDC

SEQ ID NO: 2223103 - protein, 11 aa, Cryptosporidium parvum
QKISKKSENMD

SEQ ID NO: 2223104 - protein, 15 aa, Cryptosporidium parvum
QKKKGSNNKIGEKNK

SEQ ID NO: 2223105 - protein, 5 aa, Cryptosporidium parvum
QKKRR

SEQ ID NO: 2223106 - protein, 13 aa, Cryptosporidium parvum
QKKSPKNSPFQTS

SEQ ID NO: 2223107 - protein, 22 aa, Cryptosporidium parvum
QKLEQEAEKEIRDIENDDNDQI

SEQ ID NO: 2223108 - protein, 8 aa, Cryptosporidium parvum
QKLESITK

SEQ ID NO: 2223109 - protein, 13 aa, Cryptosporidium parvum
QKLGDNNNSNNNN

SEQ ID NO: 2223110 - protein, 5 aa, Cryptosporidium parvum
QKLPT

SEQ ID NO: 2223111 - protein, 4 aa, Cryptosporidium parvum
QKLT

SEQ ID NO: 2223112 - protein, 7 aa, Cryptosporidium parvum
QKNKKTM

SEQ ID NO: 2223113 - protein, 5 aa, Cryptosporidium parvum
QKNLL

SEQ ID NO: 2223114 - protein, 5 aa, Cryptosporidium parvum
QKNNI

SEQ ID NO: 2223115 - protein, 11 aa, Cryptosporidium parvum
QKNNSLVEEDN

SEQ ID NO: 2223116 - protein, 8 aa, Cryptosporidium parvum
QKNPLIKD

SEQ ID NO: 2223117 - protein, 14 aa, Cryptosporidium parvum
QKNPNKKLDNSGDK

SEQ ID NO: 2223118 - protein, 11 aa, Cryptosporidium parvum
QKNRKGRRNDE

SEQ ID NO: 2223119 - protein, 8 aa, Cryptosporidium parvum
QKNSITNG

SEQ ID NO: 2223120 - protein, 10 aa, Cryptosporidium parvum
QKNSQKNTNL

SEQ ID NO: 2223121 - protein, 7 aa, Cryptosporidium parvum
QKPENDS

SEQ ID NO: 2223122 - protein, 8 aa, Cryptosporidium parvum
QKPENIEG

SEQ ID NO: 2223123 - protein, 5 aa, Cryptosporidium parvum
QKPFN

SEQ ID NO: 2223124 - protein, 12 aa, Cryptosporidium parvum
QKPIKKKLPKLS

SEQ ID NO: 2223125 - protein, 16 aa, Cryptosporidium parvum
QKPTDEEISQMKSGQT

SEQ ID NO: 2223126 - protein, 18 aa, Cryptosporidium parvum
QKPTIGQKISENKNSNTI

SEQ ID NO: 2223127 - protein, 9 aa, Cryptosporidium parvum
QKQEQGQRI

SEQ ID NO: 2223128 - protein, 8 aa, Cryptosporidium parvum
QKQESTSK

SEQ ID NO: 2223129 - protein, 16 aa, Cryptosporidium parvum
QKQHDKNKDKFTRNGS

SEQ ID NO: 2223130 - protein, 11 aa, Cryptosporidium parvum
QKRNEERSEDS

SEQ ID NO: 2223131 - protein, 8 aa, Cryptosporidium parvum
QKRQNGLP

SEQ ID NO: 2223132 - protein, 9 aa, Cryptosporidium parvum
QKRSCQGGF

SEQ ID NO: 2223133 - protein, 10 aa, Cryptosporidium parvum
QKSDSSSGEK

SEQ ID NO: 2223134 - protein, 6 aa, Cryptosporidium parvum
QKSFKG

SEQ ID NO: 2223135 - protein, 6 aa, Cryptosporidium parvum
QKSGSI

SEQ ID NO: 2223136 - protein, 8 aa, Cryptosporidium parvum
QKSKESNL

SEQ ID NO: 2223137 - protein, 9 aa, Cryptosporidium parvum
QKSKSTLDK

SEQ ID NO: 2223138 - protein, 4 aa, Cryptosporidium parvum
QKSN

SEQ ID NO: 2223139 - protein, 8 aa, Cryptosporidium parvum
QKSNSSQS

SEQ ID NO: 2223140 - protein, 12 aa, Cryptosporidium parvum
QKSVNESYTQDR

SEQ ID NO: 2223141 - protein, 14 aa, Cryptosporidium parvum
QKSYGTTSAGHAYG

SEQ ID NO: 2223142 - protein, 8 aa, Cryptosporidium parvum
QKSYPNKN

SEQ ID NO: 2223143 - protein, 23 aa, Cryptosporidium parvum
QKTAQGIQKASTVDRVGNTNRTR

SEQ ID NO: 2223144 - protein, 28 aa, Cryptosporidium parvum
QKTDPDQKLREETMNSQNYTLNKERAEI

SEQ ID NO: 2223145 - protein, 9 aa, Cryptosporidium parvum
QKTLNSDEI

SEQ ID NO: 2223146 - protein, 4 aa, Cryptosporidium parvum
QKTN

SEQ ID NO: 2223147 - protein, 33 aa, Cryptosporidium parvum
QKTSSKLNTPITSQTNSPGKENLSPNSINSKLG

SEQ ID NO: 2223148 - protein, 13 aa, Cryptosporidium parvum
QKTTSQDSKHVDT

SEQ ID NO: 2223149 - protein, 12 aa, Cryptosporidium parvum
QKVQDTTETLNP

SEQ ID NO: 2223150 - protein, 9 aa, Cryptosporidium parvum
QKYEKSVPK

SEQ ID NO: 2223151 - protein, 11 aa, Cryptosporidium parvum
QLAENQEQIGG

SEQ ID NO: 2223152 - protein, 5 aa, Cryptosporidium parvum
QLAER

SEQ ID NO: 2223153 - protein, 5 aa, Cryptosporidium parvum
QLDES

SEQ ID NO: 2223154 - protein, 8 aa, Cryptosporidium parvum
QLDGETDW

SEQ ID NO: 2223155 - protein, 5 aa, Cryptosporidium parvum
QLDMP

SEQ ID NO: 2223156 - protein, 19 aa, Cryptosporidium parvum
QLDPSEGEFDYEADSNTVG

SEQ ID NO: 2223157 - protein, 19 aa, Cryptosporidium parvum
QLDSEEEEEGEENESGNTS

SEQ ID NO: 2223158 - protein, 4 aa, Cryptosporidium parvum
QLDY

SEQ ID NO: 2223159 - protein, 9 aa, Cryptosporidium parvum
QLEDNSLST

SEQ ID NO: 2223160 - protein, 10 aa, Cryptosporidium parvum
QLEDRNDDLE

SEQ ID NO: 2223161 - protein, 11 aa, Cryptosporidium parvum
QLEDSNQEQYY

SEQ ID NO: 2223162 - protein, 6 aa, Cryptosporidium parvum
QLEGKY

SEQ ID NO: 2223163 - protein, 10 aa, Cryptosporidium parvum
QLEKNKENLY

SEQ ID NO: 2223164 - protein, 5 aa, Cryptosporidium parvum
QLETN

SEQ ID NO: 2223165 - protein, 12 aa, Cryptosporidium parvum
QLKAERKNNPQL

SEQ ID NO: 2223166 - protein, 5 aa, Cryptosporidium parvum
QLKPN

SEQ ID NO: 2223167 - protein, 6 aa, Cryptosporidium parvum
QLKQHA

SEQ ID NO: 2223168 - protein, 8 aa, Cryptosporidium parvum
QLKTNSKQ

SEQ ID NO: 2223169 - protein, 45 aa, Cryptosporidium parvum
QLNANSNGSFNDKEENGNKLKNKKNKKAKKHTKNKDNGLNTKDRD

SEQ ID NO: 2223170 - protein, 6 aa, Cryptosporidium parvum
QLNENQ

SEQ ID NO: 2223171 - protein, 9 aa, Cryptosporidium parvum
QLNNDSKIK

SEQ ID NO: 2223172 - protein, 4 aa, Cryptosporidium parvum
QLNS

SEQ ID NO: 2223173 - protein, 10 aa, Cryptosporidium parvum
QLRSDSALSS

SEQ ID NO: 2223174 - protein, 12 aa, Cryptosporidium parvum
QLSGNSKKVGTT

SEQ ID NO: 2223175 - protein, 9 aa, Cryptosporidium parvum
QLSNTGNVS

SEQ ID NO: 2223176 - protein, 6 aa, Cryptosporidium parvum
QLSPNQ

SEQ ID NO: 2223177 - protein, 7 aa, Cryptosporidium parvum
QLSSEEE

SEQ ID NO: 2223178 - protein, 5 aa, Cryptosporidium parvum
QMAQV

SEQ ID NO: 2223179 - protein, 10 aa, Cryptosporidium parvum
QMENTGPGGM

SEQ ID NO: 2223180 - protein, 8 aa, Cryptosporidium parvum
QMGSNGEL

SEQ ID NO: 2223181 - protein, 11 aa, Cryptosporidium parvum
QMKSNKNYQDS

SEQ ID NO: 2223182 - protein, 8 aa, Cryptosporidium parvum
QMPSSTKR

SEQ ID NO: 2223183 - protein, 5 aa, Cryptosporidium parvum
QMRTK

SEQ ID NO: 2223184 - protein, 12 aa, Cryptosporidium parvum
QMSNMEQNKTGS

SEQ ID NO: 2223185 - protein, 5 aa, Cryptosporidium parvum
QMSRK

SEQ ID NO: 2223186 - protein, 7 aa, Cryptosporidium parvum
QNAPRKT

SEQ ID NO: 2223187 - protein, 14 aa, Cryptosporidium parvum
QNASTGISHNPSEF

SEQ ID NO: 2223188 - protein, 6 aa, Cryptosporidium parvum
QNATLR

SEQ ID NO: 2223189 - protein, 22 aa, Cryptosporidium parvum
QNDGSSTYTQLPKSQSTQSDSH

SEQ ID NO: 2223190 - protein, 11 aa, Cryptosporidium parvum
QNDINNENNYS

SEQ ID NO: 2223191 - protein, 9 aa, Cryptosporidium parvum
QNDKNKEAT

SEQ ID NO: 2223192 - protein, 7 aa, Cryptosporidium parvum
QNDPIEI

SEQ ID NO: 2223193 - protein, 6 aa, Cryptosporidium parvum
QNDQIE

SEQ ID NO: 2223194 - protein, 6 aa, Cryptosporidium parvum
QNDQKK

SEQ ID NO: 2223195 - protein, 5 aa, Cryptosporidium parvum
QNDSK

SEQ ID NO: 2223196 - protein, 6 aa, Cryptosporidium parvum
QNDSME

SEQ ID NO: 2223197 - protein, 10 aa, Cryptosporidium parvum
QNDTPNSSPN

SEQ ID NO: 2223198 - protein, 12 aa, Cryptosporidium parvum
QNEESKDVPNSI

SEQ ID NO: 2223199 - protein, 5 aa, Cryptosporidium parvum
QNEKE

SEQ ID NO: 2223200 - protein, 7 aa, Cryptosporidium parvum
QNEKLTS

SEQ ID NO: 2223201 - protein, 20 aa, Cryptosporidium parvum
QNENEFNEEKTQPPSSIGGL

SEQ ID NO: 2223202 - protein, 14 aa, Cryptosporidium parvum
QNENNQQEQTFSDE

SEQ ID NO: 2223203 - protein, 12 aa, Cryptosporidium parvum
QNESSNDKLSCT

SEQ ID NO: 2223204 - protein, 18 aa, Cryptosporidium parvum
QNETDTNNANTQSQSDQC

SEQ ID NO: 2223205 - protein, 7 aa, Cryptosporidium parvum
QNEYSQI

SEQ ID NO: 2223206 - protein, 11 aa, Cryptosporidium parvum
QNFSNGSEFKD

SEQ ID NO: 2223207 - protein, 4 aa, Cryptosporidium parvum
QNGD

SEQ ID NO: 2223208 - protein, 9 aa, Cryptosporidium parvum
QNGGNPENI

SEQ ID NO: 2223209 - protein, 9 aa, Cryptosporidium parvum
QNGITRGNI

SEQ ID NO: 2223210 - protein, 38 aa, Cryptosporidium parvum
QNGNSLSKSSHDGNKRLSDTFKQTNSFSGSGSTEISGL

SEQ ID NO: 2223211 - protein, 6 aa, Cryptosporidium parvum
QNGTPS

SEQ ID NO: 2223212 - protein, 8 aa, Cryptosporidium parvum
QNHEDGIP

SEQ ID NO: 2223213 - protein, 16 aa, Cryptosporidium parvum
QNHSSRKTNIGTDDNS

SEQ ID NO: 2223214 - protein, 7 aa, Cryptosporidium parvum
QNIGRKS

SEQ ID NO: 2223215 - protein, 4 aa, Cryptosporidium parvum
QNIP

SEQ ID NO: 2223216 - protein, 24 aa, Cryptosporidium parvum
QNISIDEKGNISRNTKKKAELEDI

SEQ ID NO: 2223217 - protein, 5 aa, Cryptosporidium parvum
QNISS

SEQ ID NO: 2223218 - protein, 4 aa, Cryptosporidium parvum
QNKD

SEQ ID NO: 2223219 - protein, 48 aa, Cryptosporidium parvum
QNKGSSTNQNIGSSALGGTNANTNASNTGNTVGSSSKSSSNNSAITKY

SEQ ID NO: 2223220 - protein, 4 aa, Cryptosporidium parvum
QNKK

SEQ ID NO: 2223221 - protein, 8 aa, Cryptosporidium parvum
QNKNEIST

SEQ ID NO: 2223222 - protein, 7 aa, Cryptosporidium parvum
QNKNLND

SEQ ID NO: 2223223 - protein, 10 aa, Cryptosporidium parvum
QNKNNSNRIS

SEQ ID NO: 2223224 - protein, 10 aa, Cryptosporidium parvum
QNKNTDCNGK

SEQ ID NO: 2223225 - protein, 11 aa, Cryptosporidium parvum
QNKPKGSPNIW

SEQ ID NO: 2223226 - protein, 10 aa, Cryptosporidium parvum
QNKQENAVKS

SEQ ID NO: 2223227 - protein, 8 aa, Cryptosporidium parvum
QNKSENNL

SEQ ID NO: 2223228 - protein, 14 aa, Cryptosporidium parvum
QNKSSNLQVTNTNT

SEQ ID NO: 2223229 - protein, 6 aa, Cryptosporidium parvum
QNKYIT

SEQ ID NO: 2223230 - protein, 4 aa, Cryptosporidium parvum
QNLD

SEQ ID NO: 2223231 - protein, 13 aa, Cryptosporidium parvum
QNLQSSKVNSTIT

SEQ ID NO: 2223232 - protein, 15 aa, Cryptosporidium parvum
QNMDDPDFSDFESER

SEQ ID NO: 2223233 - protein, 4 aa, Cryptosporidium parvum
QNND

SEQ ID NO: 2223234 - protein, 8 aa, Cryptosporidium parvum
QNNDENQI

SEQ ID NO: 2223235 - protein, 7 aa, Cryptosporidium parvum
QNNENVE

SEQ ID NO: 2223236 - protein, 29 aa, Cryptosporidium parvum
QNNGSLKYSGFGNGESLKDEISKNKISQK

SEQ ID NO: 2223237 - protein, 5 aa, Cryptosporidium parvum
QNNIG

SEQ ID NO: 2223238 - protein, 5 aa, Cryptosporidium parvum
QNNKH

SEQ ID NO: 2223239 - protein, 9 aa, Cryptosporidium parvum
QNNNEQNHY

SEQ ID NO: 2223240 - protein, 19 aa, Cryptosporidium parvum
QNNNFQSNRKVDQDKQEDK

SEQ ID NO: 2223241 - protein, 13 aa, Cryptosporidium parvum
QNNNVESKFHEDS

SEQ ID NO: 2223242 - protein, 5 aa, Cryptosporidium parvum
QNNQG

SEQ ID NO: 2223243 - protein, 11 aa, Cryptosporidium parvum
QNNQKDDDQPC

SEQ ID NO: 2223244 - protein, 7 aa, Cryptosporidium parvum
QNNQNEN

SEQ ID NO: 2223245 - protein, 9 aa, Cryptosporidium parvum
QNNQNQNYY

SEQ ID NO: 2223246 - protein, 12 aa, Cryptosporidium parvum
QNNSDFSADTGD

SEQ ID NO: 2223247 - protein, 10 aa, Cryptosporidium parvum
QNNSGSDSWN

SEQ ID NO: 2223248 - protein, 8 aa, Cryptosporidium parvum
QNNSLTPY

SEQ ID NO: 2223249 - protein, 13 aa, Cryptosporidium parvum
QNNSSGYATPPTL

SEQ ID NO: 2223250 - protein, 13 aa, Cryptosporidium parvum
QNNSYSQLKPHPD

SEQ ID NO: 2223251 - protein, 9 aa, Cryptosporidium parvum
QNPAGSIYG

SEQ ID NO: 2223252 - protein, 7 aa, Cryptosporidium parvum
QNPDSLP

SEQ ID NO: 2223253 - protein, 4 aa, Cryptosporidium parvum
QNPF

SEQ ID NO: 2223254 - protein, 5 aa, Cryptosporidium parvum
QNPKL

SEQ ID NO: 2223255 - protein, 4 aa, Cryptosporidium parvum
QNPL

SEQ ID NO: 2223256 - protein, 23 aa, Cryptosporidium parvum
QNPNPNPNPNLNQVTTGNSNYTY

SEQ ID NO: 2223257 - protein, 6 aa, Cryptosporidium parvum
QNPQHE

SEQ ID NO: 2223258 - protein, 6 aa, Cryptosporidium parvum
QNPQTV

SEQ ID NO: 2223259 - protein, 5 aa, Cryptosporidium parvum
QNPSL

SEQ ID NO: 2223260 - protein, 6 aa, Cryptosporidium parvum
QNPTNS

SEQ ID NO: 2223261 - protein, 7 aa, Cryptosporidium parvum
QNQDNNQ

SEQ ID NO: 2223262 - protein, 6 aa, Cryptosporidium parvum
QNQDTC

SEQ ID NO: 2223263 - protein, 6 aa, Cryptosporidium parvum
QNQGNN

SEQ ID NO: 2223264 - protein, 8 aa, Cryptosporidium parvum
QNQGSDTL

SEQ ID NO: 2223265 - protein, 8 aa, Cryptosporidium parvum
QNQNGAKN

SEQ ID NO: 2223266 - protein, 23 aa, Cryptosporidium parvum
QNQNNNNQSIIQNDDQNYHQNNG

SEQ ID NO: 2223267 - protein, 14 aa, Cryptosporidium parvum
QNQNNQENSTILTQ

SEQ ID NO: 2223268 - protein, 24 aa, Cryptosporidium parvum
QNQQTSSNPINPLKSSNNNNNSIQ

SEQ ID NO: 2223269 - protein, 4 aa, Cryptosporidium parvum
QNQS

SEQ ID NO: 2223270 - protein, 34 aa, Cryptosporidium parvum
QNQSSNEISSFKSSSVSNSYSNERSQSEQTEKTY

SEQ ID NO: 2223271 - protein, 21 aa, Cryptosporidium parvum
QNQTDLNDREQLNKNKDTNQI

SEQ ID NO: 2223272 - protein, 6 aa, Cryptosporidium parvum
QNRDLN

SEQ ID NO: 2223273 - protein, 5 aa, Cryptosporidium parvum
QNRFS

SEQ ID NO: 2223274 - protein, 6 aa, Cryptosporidium parvum
QNRNSW

SEQ ID NO: 2223275 - protein, 8 aa, Cryptosporidium parvum
QNRRRSVK

SEQ ID NO: 2223276 - protein, 5 aa, Cryptosporidium parvum
QNRVK

SEQ ID NO: 2223277 - protein, 4 aa, Cryptosporidium parvum
QNSD

SEQ ID NO: 2223278 - protein, 13 aa, Cryptosporidium parvum
QNSENLSEISKDT

SEQ ID NO: 2223279 - protein, 7 aa, Cryptosporidium parvum
QNSIQSS

SEQ ID NO: 2223280 - protein, 7 aa, Cryptosporidium parvum
QNSITST

SEQ ID NO: 2223281 - protein, 14 aa, Cryptosporidium parvum
QNSKDDFPSRKQIN

SEQ ID NO: 2223282 - protein, 18 aa, Cryptosporidium parvum
QNSKDGREPKCTKSCQTN

SEQ ID NO: 2223283 - protein, 12 aa, Cryptosporidium parvum
QNSLNEYNNGEF

SEQ ID NO: 2223284 - protein, 9 aa, Cryptosporidium parvum
QNSNLNQDG

SEQ ID NO: 2223285 - protein, 6 aa, Cryptosporidium parvum
QNSNRR

SEQ ID NO: 2223286 - protein, 6 aa, Cryptosporidium parvum
QNSNTY

SEQ ID NO: 2223287 - protein, 7 aa, Cryptosporidium parvum
QNSQKLA

SEQ ID NO: 2223288 - protein, 9 aa, Cryptosporidium parvum
QNSSRSKLA

SEQ ID NO: 2223289 - protein, 25 aa, Cryptosporidium parvum
QNSTLNNDNTCNIGRSRSDLGNSRK

SEQ ID NO: 2223290 - protein, 5 aa, Cryptosporidium parvum
QNSTQ

SEQ ID NO: 2223291 - protein, 5 aa, Cryptosporidium parvum
QNSTV

SEQ ID NO: 2223292 - protein, 6 aa, Cryptosporidium parvum
QNSVNN

SEQ ID NO: 2223293 - protein, 4 aa, Cryptosporidium parvum
QNSY

SEQ ID NO: 2223294 - protein, 5 aa, Cryptosporidium parvum
QNTAQ

SEQ ID NO: 2223295 - protein, 5 aa, Cryptosporidium parvum
QNTIQ

SEQ ID NO: 2223296 - protein, 10 aa, Cryptosporidium parvum
QNTKKQDRVK

SEQ ID NO: 2223297 - protein, 13 aa, Cryptosporidium parvum
QNTNCSKNDSEYN

SEQ ID NO: 2223298 - protein, 9 aa, Cryptosporidium parvum
QNTNDNYNT

SEQ ID NO: 2223299 - protein, 6 aa, Cryptosporidium parvum
QNTTSI

SEQ ID NO: 2223300 - protein, 24 aa, Cryptosporidium parvum
QNVDKQGIEGANNGQPKKKSERQL

SEQ ID NO: 2223301 - protein, 10 aa, Cryptosporidium parvum
QNVKTGSSQE

SEQ ID NO: 2223302 - protein, 14 aa, Cryptosporidium parvum
QNYDEIRDEENTCL

SEQ ID NO: 2223303 - protein, 6 aa, Cryptosporidium parvum
QNYGSN

SEQ ID NO: 2223304 - protein, 14 aa, Cryptosporidium parvum
QNYQEKPIQKDSIH

SEQ ID NO: 2223305 - protein, 8 aa, Cryptosporidium parvum
QPDFTGES

SEQ ID NO: 2223306 - protein, 4 aa, Cryptosporidium parvum
QPDI

SEQ ID NO: 2223307 - protein, 7 aa, Cryptosporidium parvum
QPDSDTN

SEQ ID NO: 2223308 - protein, 5 aa, Cryptosporidium parvum
QPDSS

SEQ ID NO: 2223309 - protein, 5 aa, Cryptosporidium parvum
QPEDK

SEQ ID NO: 2223310 - protein, 6 aa, Cryptosporidium parvum
QPENSL

SEQ ID NO: 2223311 - protein, 15 aa, Cryptosporidium parvum
QPERNDAQNFTNGNQ

SEQ ID NO: 2223312 - protein, 8 aa, Cryptosporidium parvum
QPESIPSN

SEQ ID NO: 2223313 - protein, 6 aa, Cryptosporidium parvum
QPFSSQ

SEQ ID NO: 2223314 - protein, 11 aa, Cryptosporidium parvum
QPGASTGRGTH

SEQ ID NO: 2223315 - protein, 6 aa, Cryptosporidium parvum
QPGFTP

SEQ ID NO: 2223316 - protein, 5 aa, Cryptosporidium parvum
QPGHS

SEQ ID NO: 2223317 - protein, 12 aa, Cryptosporidium parvum
QPIQSKRETSKF

SEQ ID NO: 2223318 - protein, 9 aa, Cryptosporidium parvum
QPKTTEESS

SEQ ID NO: 2223319 - protein, 7 aa, Cryptosporidium parvum
QPNEEYS

SEQ ID NO: 2223320 - protein, 8 aa, Cryptosporidium parvum
QPNHSSLS

SEQ ID NO: 2223321 - protein, 8 aa, Cryptosporidium parvum
QPNSGTTC

SEQ ID NO: 2223322 - protein, 12 aa, Cryptosporidium parvum
QPPGTLPQPSGI

SEQ ID NO: 2223323 - protein, 5 aa, Cryptosporidium parvum
QPPTT

SEQ ID NO: 2223324 - protein, 7 aa, Cryptosporidium parvum
QPPYGGA

SEQ ID NO: 2223325 - protein, 16 aa, Cryptosporidium parvum
QPQVTHSKRSETRNNT

SEQ ID NO: 2223326 - protein, 11 aa, Cryptosporidium parvum
QPRETKSPIAY

SEQ ID NO: 2223327 - protein, 6 aa, Cryptosporidium parvum
QPSGSI

SEQ ID NO: 2223328 - protein, 20 aa, Cryptosporidium parvum
QPSNSTTPVNSINSKSPEIR

SEQ ID NO: 2223329 - protein, 6 aa, Cryptosporidium parvum
QPSPSY

SEQ ID NO: 2223330 - protein, 23 aa, Cryptosporidium parvum
QPSRPTSISSPSFKSGNSYGSPV

SEQ ID NO: 2223331 - protein, 8 aa, Cryptosporidium parvum
QPSTEEKQ

SEQ ID NO: 2223332 - protein, 6 aa, Cryptosporidium parvum
QPSTEK

SEQ ID NO: 2223333 - protein, 5 aa, Cryptosporidium parvum
QPTGS

SEQ ID NO: 2223334 - protein, 4 aa, Cryptosporidium parvum
QPVP

SEQ ID NO: 2223335 - protein, 5 aa, Cryptosporidium parvum
QPVST

SEQ ID NO: 2223336 - protein, 8 aa, Cryptosporidium parvum
QPWSNGKV

SEQ ID NO: 2223337 - protein, 5 aa, Cryptosporidium parvum
QPYSD

SEQ ID NO: 2223338 - protein, 13 aa, Cryptosporidium parvum
QQADAKASGDVEA

SEQ ID NO: 2223339 - protein, 5 aa, Cryptosporidium parvum
QQASN

SEQ ID NO: 2223340 - protein, 6 aa, Cryptosporidium parvum
QQDLAT

SEQ ID NO: 2223341 - protein, 6 aa, Cryptosporidium parvum
QQEENI

SEQ ID NO: 2223342 - protein, 9 aa, Cryptosporidium parvum
QQEHASDDS

SEQ ID NO: 2223343 - protein, 13 aa, Cryptosporidium parvum
QQEKKENKELSEK

SEQ ID NO: 2223344 - protein, 7 aa, Cryptosporidium parvum
QQENDDQ

SEQ ID NO: 2223345 - protein, 10 aa, Cryptosporidium parvum
QQEPIQQENY

SEQ ID NO: 2223346 - protein, 6 aa, Cryptosporidium parvum
QQEVRS

SEQ ID NO: 2223347 - protein, 13 aa, Cryptosporidium parvum
QQGFPSSGGYYQS

SEQ ID NO: 2223348 - protein, 6 aa, Cryptosporidium parvum
QQHDHH

SEQ ID NO: 2223349 - protein, 8 aa, Cryptosporidium parvum
QQIPPNSP

SEQ ID NO: 2223350 - protein, 16 aa, Cryptosporidium parvum
QQIYGNETNNTGGTYE

SEQ ID NO: 2223351 - protein, 8 aa, Cryptosporidium parvum
QQKGGKTL

SEQ ID NO: 2223352 - protein, 23 aa, Cryptosporidium parvum
QQKYNQYHSQQVTPQAQSSHQQH

SEQ ID NO: 2223353 - protein, 4 aa, Cryptosporidium parvum
QQMH

SEQ ID NO: 2223354 - protein, 5 aa, Cryptosporidium parvum
QQNEA

SEQ ID NO: 2223355 - protein, 22 aa, Cryptosporidium parvum
QQNQKKDLSKNNLDSDKHLSEN

SEQ ID NO: 2223356 - protein, 11 aa, Cryptosporidium parvum
QQNQNRDNYGE

SEQ ID NO: 2223357 - protein, 28 aa, Cryptosporidium parvum
QQNSKKNGILSNSSNNNGVNITNEKKEE

SEQ ID NO: 2223358 - protein, 8 aa, Cryptosporidium parvum
QQNSSSKV

SEQ ID NO: 2223359 - protein, 7 aa, Cryptosporidium parvum
QQNYNNS

SEQ ID NO: 2223360 - protein, 22 aa, Cryptosporidium parvum
QQPIQGQTHTQHTSSHPSLGNS

SEQ ID NO: 2223361 - protein, 18 aa, Cryptosporidium parvum
QQPPANVKTSQSTAASKG

SEQ ID NO: 2223362 - protein, 7 aa, Cryptosporidium parvum
QQQFNSK

SEQ ID NO: 2223363 - protein, 9 aa, Cryptosporidium parvum
QQQQIEEQE

SEQ ID NO: 2223364 - protein, 19 aa, Cryptosporidium parvum
QQQQPGSSSQLQPQQYQAQ

SEQ ID NO: 2223365 - protein, 4 aa, Cryptosporidium parvum
QQSD

SEQ ID NO: 2223366 - protein, 8 aa, Cryptosporidium parvum
QQSGDKKK

SEQ ID NO: 2223367 - protein, 5 aa, Cryptosporidium parvum
QQSGF

SEQ ID NO: 2223368 - protein, 5 aa, Cryptosporidium parvum
QQSPR

SEQ ID NO: 2223369 - protein, 8 aa, Cryptosporidium parvum
QQSTENKY

SEQ ID NO: 2223370 - protein, 5 aa, Cryptosporidium parvum
QQSYL

SEQ ID NO: 2223371 - protein, 7 aa, Cryptosporidium parvum
QQTPNLS

SEQ ID NO: 2223372 - protein, 7 aa, Cryptosporidium parvum
QQTQQPI

SEQ ID NO: 2223373 - protein, 5 aa, Cryptosporidium parvum
QQTVD

SEQ ID NO: 2223374 - protein, 4 aa, Cryptosporidium parvum
QQVG

SEQ ID NO: 2223375 - protein, 9 aa, Cryptosporidium parvum
QQVKESNDL

SEQ ID NO: 2223376 - protein, 12 aa, Cryptosporidium parvum
QQVTDPSNYVRV

SEQ ID NO: 2223377 - protein, 7 aa, Cryptosporidium parvum
QQYPYPS

SEQ ID NO: 2223378 - protein, 5 aa, Cryptosporidium parvum
QQYTD

SEQ ID NO: 2223379 - protein, 5 aa, Cryptosporidium parvum
QRDLG

SEQ ID NO: 2223380 - protein, 10 aa, Cryptosporidium parvum
QRERTDDNTC

SEQ ID NO: 2223381 - protein, 5 aa, Cryptosporidium parvum
QRESA

SEQ ID NO: 2223382 - protein, 6 aa, Cryptosporidium parvum
QRGTQS

SEQ ID NO: 2223383 - protein, 5 aa, Cryptosporidium parvum
QRIDP

SEQ ID NO: 2223384 - protein, 4 aa, Cryptosporidium parvum
QRIP

SEQ ID NO: 2223385 - protein, 6 aa, Cryptosporidium parvum
QRIQED

SEQ ID NO: 2223386 - protein, 6 aa, Cryptosporidium parvum
QRISRD

SEQ ID NO: 2223387 - protein, 5 aa, Cryptosporidium parvum
QRKPR

SEQ ID NO: 2223388 - protein, 9 aa, Cryptosporidium parvum
QRMDNTTTN

SEQ ID NO: 2223389 - protein, 6 aa, Cryptosporidium parvum
QRPSTT

SEQ ID NO: 2223390 - protein, 5 aa, Cryptosporidium parvum
QRPSY

SEQ ID NO: 2223391 - protein, 7 aa, Cryptosporidium parvum
QRPTKEQ

SEQ ID NO: 2223392 - protein, 4 aa, Cryptosporidium parvum
QRRG

SEQ ID NO: 2223393 - protein, 98 aa, Cryptosporidium parvum
QRRLESQSTRLVDNDSADLSGLRGRDQGQDHDQDLDHDRSQGQNQNQDQGQGQGQAQDHDQDQDQHSNQYNEEESKQDNKGNEKRKEGHKEKDVERSD

SEQ ID NO: 2223394 - protein, 5 aa, Cryptosporidium parvum
QRRSK

SEQ ID NO: 2223395 - protein, 4 aa, Cryptosporidium parvum
QRSE

SEQ ID NO: 2223396 - protein, 7 aa, Cryptosporidium parvum
QRSSSRD

SEQ ID NO: 2223397 - protein, 5 aa, Cryptosporidium parvum
QRSST

SEQ ID NO: 2223398 - protein, 4 aa, Cryptosporidium parvum
QRST

SEQ ID NO: 2223399 - protein, 12 aa, Cryptosporidium parvum
QSAEEDGFETEI

SEQ ID NO: 2223400 - protein, 7 aa, Cryptosporidium parvum
QSAEKLS

SEQ ID NO: 2223401 - protein, 7 aa, Cryptosporidium parvum
QSAFPSN

SEQ ID NO: 2223402 - protein, 5 aa, Cryptosporidium parvum
QSAPK

SEQ ID NO: 2223403 - protein, 7 aa, Cryptosporidium parvum
QSASPIK

SEQ ID NO: 2223404 - protein, 9 aa, Cryptosporidium parvum
QSATGSTTG

SEQ ID NO: 2223405 - protein, 8 aa, Cryptosporidium parvum
QSAYAAAN

SEQ ID NO: 2223406 - protein, 5 aa, Cryptosporidium parvum
QSCEP

SEQ ID NO: 2223407 - protein, 5 aa, Cryptosporidium parvum
QSDDQ

SEQ ID NO: 2223408 - protein, 5 aa, Cryptosporidium parvum
QSDEE

SEQ ID NO: 2223409 - protein, 11 aa, Cryptosporidium parvum
QSDESKDSENI

SEQ ID NO: 2223410 - protein, 6 aa, Cryptosporidium parvum
QSDKPD

SEQ ID NO: 2223411 - protein, 10 aa, Cryptosporidium parvum
QSDNGSSRYN

SEQ ID NO: 2223412 - protein, 12 aa, Cryptosporidium parvum
QSDRKRSLYDST

SEQ ID NO: 2223413 - protein, 4 aa, Cryptosporidium parvum
QSEA

SEQ ID NO: 2223414 - protein, 13 aa, Cryptosporidium parvum
QSEANSKKVGMGR

SEQ ID NO: 2223415 - protein, 5 aa, Cryptosporidium parvum
QSEEA

SEQ ID NO: 2223416 - protein, 12 aa, Cryptosporidium parvum
QSEEESRRSTFS

SEQ ID NO: 2223417 - protein, 8 aa, Cryptosporidium parvum
QSEFNEES

SEQ ID NO: 2223418 - protein, 8 aa, Cryptosporidium parvum
QSEKNNKR

SEQ ID NO: 2223419 - protein, 5 aa, Cryptosporidium parvum
QSEKS

SEQ ID NO: 2223420 - protein, 7 aa, Cryptosporidium parvum
QSEQDVF

SEQ ID NO: 2223421 - protein, 13 aa, Cryptosporidium parvum
QSERKSAALTAPI

SEQ ID NO: 2223422 - protein, 6 aa, Cryptosporidium parvum
QSESSS

SEQ ID NO: 2223423 - protein, 8 aa, Cryptosporidium parvum
QSESTKNS

SEQ ID NO: 2223424 - protein, 11 aa, Cryptosporidium parvum
QSEVNTEIHGS

SEQ ID NO: 2223425 - protein, 7 aa, Cryptosporidium parvum
QSEYKTE

SEQ ID NO: 2223426 - protein, 38 aa, Cryptosporidium parvum
QSFGDRNSDENIKSEENGDSNEKSIQSPKSNSSSNHSE

SEQ ID NO: 2223427 - protein, 4 aa, Cryptosporidium parvum
QSFP

SEQ ID NO: 2223428 - protein, 7 aa, Cryptosporidium parvum
QSFQEDQ

SEQ ID NO: 2223429 - protein, 36 aa, Cryptosporidium parvum
QSGDLNTESLENGIGGGRSSSVSGSNNGNNNTGESG

SEQ ID NO: 2223430 - protein, 9 aa, Cryptosporidium parvum
QSGKTTALI

SEQ ID NO: 2223431 - protein, 4 aa, Cryptosporidium parvum
QSGP

SEQ ID NO: 2223432 - protein, 7 aa, Cryptosporidium parvum
QSGSASF

SEQ ID NO: 2223433 - protein, 6 aa, Cryptosporidium parvum
QSGSNR

SEQ ID NO: 2223434 - protein, 15 aa, Cryptosporidium parvum
QSGTTGIEKDEQKIR

SEQ ID NO: 2223435 - protein, 8 aa, Cryptosporidium parvum
QSHEDKTT

SEQ ID NO: 2223436 - protein, 4 aa, Cryptosporidium parvum
QSIK

SEQ ID NO: 2223437 - protein, 9 aa, Cryptosporidium parvum
QSIKEDTKL

SEQ ID NO: 2223438 - protein, 4 aa, Cryptosporidium parvum
QSIL

SEQ ID NO: 2223439 - protein, 5 aa, Cryptosporidium parvum
QSINN

SEQ ID NO: 2223440 - protein, 4 aa, Cryptosporidium parvum
QSIP

SEQ ID NO: 2223441 - protein, 5 aa, Cryptosporidium parvum
QSIQQ

SEQ ID NO: 2223442 - protein, 4 aa, Cryptosporidium parvum
QSIR

SEQ ID NO: 2223443 - protein, 4 aa, Cryptosporidium parvum
QSIS

SEQ ID NO: 2223444 - protein, 34 aa, Cryptosporidium parvum
QSKGTQESLSNSSTNISNQNRVNNSTNSQNLNNG

SEQ ID NO: 2223445 - protein, 4 aa, Cryptosporidium parvum
QSKI

SEQ ID NO: 2223446 - protein, 5 aa, Cryptosporidium parvum
QSKKL

SEQ ID NO: 2223447 - protein, 12 aa, Cryptosporidium parvum
QSKQQDENESET

SEQ ID NO: 2223448 - protein, 20 aa, Cryptosporidium parvum
QSKRTSGKNSPRASSGYGNK

SEQ ID NO: 2223449 - protein, 7 aa, Cryptosporidium parvum
QSKSIYP

SEQ ID NO: 2223450 - protein, 9 aa, Cryptosporidium parvum
QSKSRDARK

SEQ ID NO: 2223451 - protein, 22 aa, Cryptosporidium parvum
QSLDSSSYDIEGASQNSNKSFS

SEQ ID NO: 2223452 - protein, 19 aa, Cryptosporidium parvum
QSLEGSSNNVNNMNDGIPH

SEQ ID NO: 2223453 - protein, 7 aa, Cryptosporidium parvum
QSLPDSH

SEQ ID NO: 2223454 - protein, 7 aa, Cryptosporidium parvum
QSLSSPS

SEQ ID NO: 2223455 - protein, 7 aa, Cryptosporidium parvum
QSNCKKT

SEQ ID NO: 2223456 - protein, 14 aa, Cryptosporidium parvum
QSNDNSLESYNKGR

SEQ ID NO: 2223457 - protein, 11 aa, Cryptosporidium parvum
QSNDSSGSRLA

SEQ ID NO: 2223458 - protein, 5 aa, Cryptosporidium parvum
QSNGV

SEQ ID NO: 2223459 - protein, 17 aa, Cryptosporidium parvum
QSNHGPYTYESSESDDD

SEQ ID NO: 2223460 - protein, 5 aa, Cryptosporidium parvum
QSNKK

SEQ ID NO: 2223461 - protein, 5 aa, Cryptosporidium parvum
QSNNF

SEQ ID NO: 2223462 - protein, 12 aa, Cryptosporidium parvum
QSNNFKGRIKRD

SEQ ID NO: 2223463 - protein, 7 aa, Cryptosporidium parvum
QSNSINE

SEQ ID NO: 2223464 - protein, 20 aa, Cryptosporidium parvum
QSNSNTEDKGDLKDIQETRN

SEQ ID NO: 2223465 - protein, 5 aa, Cryptosporidium parvum
QSNSY

SEQ ID NO: 2223466 - protein, 9 aa, Cryptosporidium parvum
QSNVHNSTS

SEQ ID NO: 2223467 - protein, 27 aa, Cryptosporidium parvum
QSNYGANQHNNAVRQNNGAKPQQNSPL

SEQ ID NO: 2223468 - protein, 5 aa, Cryptosporidium parvum
QSPKE

SEQ ID NO: 2223469 - protein, 22 aa, Cryptosporidium parvum
QSPLGSSGQQIKPSEDIGSRIG

SEQ ID NO: 2223470 - protein, 9 aa, Cryptosporidium parvum
QSPNRKENY

SEQ ID NO: 2223471 - protein, 8 aa, Cryptosporidium parvum
QSPRSLST

SEQ ID NO: 2223472 - protein, 5 aa, Cryptosporidium parvum
QSPSA

SEQ ID NO: 2223473 - protein, 7 aa, Cryptosporidium parvum
QSPSTVQ

SEQ ID NO: 2223474 - protein, 20 aa, Cryptosporidium parvum
QSQLTGESTGVLKDSNSLDI

SEQ ID NO: 2223475 - protein, 14 aa, Cryptosporidium parvum
QSQNNNNNNNNIDD

SEQ ID NO: 2223476 - protein, 9 aa, Cryptosporidium parvum
QSQNSIATE

SEQ ID NO: 2223477 - protein, 9 aa, Cryptosporidium parvum
QSQSPSRHR

SEQ ID NO: 2223478 - protein, 11 aa, Cryptosporidium parvum
QSQSSASPKSG

SEQ ID NO: 2223479 - protein, 6 aa, Cryptosporidium parvum
QSQSSS

SEQ ID NO: 2223480 - protein, 12 aa, Cryptosporidium parvum
QSQTNAHCQSQT

SEQ ID NO: 2223481 - protein, 12 aa, Cryptosporidium parvum
QSRNQKLTNDDF

SEQ ID NO: 2223482 - protein, 6 aa, Cryptosporidium parvum
QSRPSD

SEQ ID NO: 2223483 - protein, 6 aa, Cryptosporidium parvum
QSSDSI

SEQ ID NO: 2223484 - protein, 7 aa, Cryptosporidium parvum
QSSEEEF

SEQ ID NO: 2223485 - protein, 9 aa, Cryptosporidium parvum
QSSGKCENA

SEQ ID NO: 2223486 - protein, 8 aa, Cryptosporidium parvum
QSSIYSSS

SEQ ID NO: 2223487 - protein, 9 aa, Cryptosporidium parvum
QSSKGPDEA

SEQ ID NO: 2223488 - protein, 6 aa, Cryptosporidium parvum
QSSMGG

SEQ ID NO: 2223489 - protein, 15 aa, Cryptosporidium parvum
QSSNESLGNVEQDDN

SEQ ID NO: 2223490 - protein, 10 aa, Cryptosporidium parvum
QSSPYKGVNS

SEQ ID NO: 2223491 - protein, 63 aa, Cryptosporidium parvum
QSSQQDQDQVQAQGQAQGQAQGQAQGQDQKQSQNQNNQLNDNRTSENHNQQEDYAGNEENDQD

SEQ ID NO: 2223492 - protein, 13 aa, Cryptosporidium parvum
QSSRKKNRNQMST

SEQ ID NO: 2223493 - protein, 7 aa, Cryptosporidium parvum
QSSSAEK

SEQ ID NO: 2223494 - protein, 7 aa, Cryptosporidium parvum
QSSSPDE

SEQ ID NO: 2223495 - protein, 10 aa, Cryptosporidium parvum
QSSSSDRLVS

SEQ ID NO: 2223496 - protein, 8 aa, Cryptosporidium parvum
QSSTEISG

SEQ ID NO: 2223497 - protein, 4 aa, Cryptosporidium parvum
QSTA

SEQ ID NO: 2223498 - protein, 6 aa, Cryptosporidium parvum
QSTASG

SEQ ID NO: 2223499 - protein, 7 aa, Cryptosporidium parvum
QSTGKST

SEQ ID NO: 2223500 - protein, 9 aa, Cryptosporidium parvum
QSTGRQPQN

SEQ ID NO: 2223501 - protein, 4 aa, Cryptosporidium parvum
QSTL

SEQ ID NO: 2223502 - protein, 7 aa, Cryptosporidium parvum
QSVDSSF

SEQ ID NO: 2223503 - protein, 11 aa, Cryptosporidium parvum
QSVGGKRIRAE

SEQ ID NO: 2223504 - protein, 10 aa, Cryptosporidium parvum
QSYKSSNEKI

SEQ ID NO: 2223505 - protein, 5 aa, Cryptosporidium parvum
QSYLE

SEQ ID NO: 2223506 - protein, 7 aa, Cryptosporidium parvum
QTARDND

SEQ ID NO: 2223507 - protein, 7 aa, Cryptosporidium parvum
QTASCTN

SEQ ID NO: 2223508 - protein, 8 aa, Cryptosporidium parvum
QTCESNNY

SEQ ID NO: 2223509 - protein, 27 aa, Cryptosporidium parvum
QTEDTSIKKDIGKGNSDQESDEINKEN

SEQ ID NO: 2223510 - protein, 7 aa, Cryptosporidium parvum
QTEGTNE

SEQ ID NO: 2223511 - protein, 5 aa, Cryptosporidium parvum
QTENV

SEQ ID NO: 2223512 - protein, 5 aa, Cryptosporidium parvum
QTEPF

SEQ ID NO: 2223513 - protein, 5 aa, Cryptosporidium parvum
QTESR

SEQ ID NO: 2223514 - protein, 4 aa, Cryptosporidium parvum
QTEV

SEQ ID NO: 2223515 - protein, 6 aa, Cryptosporidium parvum
QTFQPD

SEQ ID NO: 2223516 - protein, 14 aa, Cryptosporidium parvum
QTGASQDSKEIEER

SEQ ID NO: 2223517 - protein, 9 aa, Cryptosporidium parvum
QTGGDSKTP

SEQ ID NO: 2223518 - protein, 6 aa, Cryptosporidium parvum
QTGRID

SEQ ID NO: 2223519 - protein, 7 aa, Cryptosporidium parvum
QTGSGAT

SEQ ID NO: 2223520 - protein, 5 aa, Cryptosporidium parvum
QTHGN

SEQ ID NO: 2223521 - protein, 19 aa, Cryptosporidium parvum
QTHTKSKKTSKVTISRDDK

SEQ ID NO: 2223522 - protein, 5 aa, Cryptosporidium parvum
QTIHN

SEQ ID NO: 2223523 - protein, 4 aa, Cryptosporidium parvum
QTIR

SEQ ID NO: 2223524 - protein, 12 aa, Cryptosporidium parvum
QTKEQNHQRNDQ

SEQ ID NO: 2223525 - protein, 5 aa, Cryptosporidium parvum
QTNGG

SEQ ID NO: 2223526 - protein, 6 aa, Cryptosporidium parvum
QTNING

SEQ ID NO: 2223527 - protein, 4 aa, Cryptosporidium parvum
QTNN

SEQ ID NO: 2223528 - protein, 14 aa, Cryptosporidium parvum
QTNNCSGSSSLDNN

SEQ ID NO: 2223529 - protein, 6 aa, Cryptosporidium parvum
QTNQTK

SEQ ID NO: 2223530 - protein, 17 aa, Cryptosporidium parvum
QTNSISQNNKTSKIPTN

SEQ ID NO: 2223531 - protein, 6 aa, Cryptosporidium parvum
QTNTGD

SEQ ID NO: 2223532 - protein, 4 aa, Cryptosporidium parvum
QTPM

SEQ ID NO: 2223533 - protein, 6 aa, Cryptosporidium parvum
QTPNRD

SEQ ID NO: 2223534 - protein, 7 aa, Cryptosporidium parvum
QTPPETM

SEQ ID NO: 2223535 - protein, 8 aa, Cryptosporidium parvum
QTPPKRNE

SEQ ID NO: 2223536 - protein, 9 aa, Cryptosporidium parvum
QTPQQIPSS

SEQ ID NO: 2223537 - protein, 4 aa, Cryptosporidium parvum
QTPT

SEQ ID NO: 2223538 - protein, 4 aa, Cryptosporidium parvum
QTQF

SEQ ID NO: 2223539 - protein, 4 aa, Cryptosporidium parvum
QTQS

SEQ ID NO: 2223540 - protein, 8 aa, Cryptosporidium parvum
QTSGDLQY

SEQ ID NO: 2223541 - protein, 9 aa, Cryptosporidium parvum
QTSNSGSLT

SEQ ID NO: 2223542 - protein, 10 aa, Cryptosporidium parvum
QTSSTRSTDS

SEQ ID NO: 2223543 - protein, 9 aa, Cryptosporidium parvum
QTSTRSKER

SEQ ID NO: 2223544 - protein, 9 aa, Cryptosporidium parvum
QTSWIPQGT

SEQ ID NO: 2223545 - protein, 8 aa, Cryptosporidium parvum
QTTTNSLS

SEQ ID NO: 2223546 - protein, 11 aa, Cryptosporidium parvum
QTTTSGGNPLD

SEQ ID NO: 2223547 - protein, 22 aa, Cryptosporidium parvum
QTYGDITKGKPTINKKTSLGGI

SEQ ID NO: 2223548 - protein, 14 aa, Cryptosporidium parvum
QTYGGEKKKKPMTR

SEQ ID NO: 2223549 - protein, 9 aa, Cryptosporidium parvum
QVAAASDGA

SEQ ID NO: 2223550 - protein, 11 aa, Cryptosporidium parvum
QVDPSSIAANN

SEQ ID NO: 2223551 - protein, 11 aa, Cryptosporidium parvum
QVENDEKQSES

SEQ ID NO: 2223552 - protein, 54 aa, Cryptosporidium parvum
QVKEQTEDRAVDQENSDLPKSQINSSNGVSEDEPSQEVPQNEDFDDGSSVISTH

SEQ ID NO: 2223553 - protein, 8 aa, Cryptosporidium parvum
QVNEIGGE

SEQ ID NO: 2223554 - protein, 7 aa, Cryptosporidium parvum
QVNKEDT

SEQ ID NO: 2223555 - protein, 7 aa, Cryptosporidium parvum
QVNLGTK

SEQ ID NO: 2223556 - protein, 18 aa, Cryptosporidium parvum
QVNNSSGGSSMGSYGTNK

SEQ ID NO: 2223557 - protein, 23 aa, Cryptosporidium parvum
QVNSNSNSNKVGVHSQSGSGLAP

SEQ ID NO: 2223558 - protein, 11 aa, Cryptosporidium parvum
QVNTNDNKKSI

SEQ ID NO: 2223559 - protein, 9 aa, Cryptosporidium parvum
QVPATGGGR

SEQ ID NO: 2223560 - protein, 4 aa, Cryptosporidium parvum
QVPM

SEQ ID NO: 2223561 - protein, 11 aa, Cryptosporidium parvum
QVSAKKAADYG

SEQ ID NO: 2223562 - protein, 9 aa, Cryptosporidium parvum
QVSNKGQLS

SEQ ID NO: 2223563 - protein, 10 aa, Cryptosporidium parvum
QVSQKKQYKY

SEQ ID NO: 2223564 - protein, 8 aa, Cryptosporidium parvum
QVSQVSPT

SEQ ID NO: 2223565 - protein, 7 aa, Cryptosporidium parvum
QVSSNEQ

SEQ ID NO: 2223566 - protein, 11 aa, Cryptosporidium parvum
QVTGSSVQQNI

SEQ ID NO: 2223567 - protein, 10 aa, Cryptosporidium parvum
QVTPSKQNGP

SEQ ID NO: 2223568 - protein, 10 aa, Cryptosporidium parvum
QVTVSSDSLG

SEQ ID NO: 2223569 - protein, 4 aa, Cryptosporidium parvum
QVYQ

SEQ ID NO: 2223570 - protein, 7 aa, Cryptosporidium parvum
QYAEKSE

SEQ ID NO: 2223571 - protein, 13 aa, Cryptosporidium parvum
QYDENGKKIPAKE

SEQ ID NO: 2223572 - protein, 12 aa, Cryptosporidium parvum
QYEKNNDHDQSL

SEQ ID NO: 2223573 - protein, 12 aa, Cryptosporidium parvum
QYGPNKKAVSTY

SEQ ID NO: 2223574 - protein, 4 aa, Cryptosporidium parvum
QYGQ

SEQ ID NO: 2223575 - protein, 6 aa, Cryptosporidium parvum
QYKPGE

SEQ ID NO: 2223576 - protein, 4 aa, Cryptosporidium parvum
QYPD

SEQ ID NO: 2223577 - protein, 7 aa, Cryptosporidium parvum
QYPGDES

SEQ ID NO: 2223578 - protein, 11 aa, Cryptosporidium parvum
QYQDQNSQIPH

SEQ ID NO: 2223579 - protein, 35 aa, Cryptosporidium parvum
QYQQQQQQQQQQQQQQQQQQQQQQQHQQQQHPHSH

SEQ ID NO: 2223580 - protein, 5 aa, Cryptosporidium parvum
QYRAS

SEQ ID NO: 2223581 - protein, 7 aa, Cryptosporidium parvum
QYSDNEV

SEQ ID NO: 2223582 - protein, 6 aa, Cryptosporidium parvum
QYSDQN

SEQ ID NO: 2223583 - protein, 5 aa, Cryptosporidium parvum
QYSPF

SEQ ID NO: 2223584 - protein, 4 aa, Cryptosporidium parvum
QYSR

SEQ ID NO: 2223585 - protein, 10 aa, Cryptosporidium parvum
QYSRNNGSKN

SEQ ID NO: 2223586 - protein, 4 aa, Cryptosporidium parvum
QYST

SEQ ID NO: 2223587 - protein, 12 aa, Cryptosporidium parvum
QYSVPKSGEPLR

SEQ ID NO: 2223588 - protein, 4 aa, Cryptosporidium parvum
QYTE

SEQ ID NO: 2223589 - protein, 11 aa, Cryptosporidium parvum
QYTEKGSTQEI

SEQ ID NO: 2223590 - protein, 5 aa, Cryptosporidium parvum
QYTNP

SEQ ID NO: 2223591 - protein, 9 aa, Cryptosporidium parvum
QYYSNNNNK

SEQ ID NO: 2223592 - protein, 4 aa, Cryptosporidium parvum
RAAS

SEQ ID NO: 2223593 - protein, 7 aa, Cryptosporidium parvum
RADIQTS

SEQ ID NO: 2223594 - protein, 5 aa, Cryptosporidium parvum
RADPD

SEQ ID NO: 2223595 - protein, 20 aa, Cryptosporidium parvum
RADQTNSYKTVTPMGTSDDL

SEQ ID NO: 2223596 - protein, 8 aa, Cryptosporidium parvum
RADVNAAT

SEQ ID NO: 2223597 - protein, 5 aa, Cryptosporidium parvum
RAENH

SEQ ID NO: 2223598 - protein, 6 aa, Cryptosporidium parvum
RAEPPF

SEQ ID NO: 2223599 - protein, 10 aa, Cryptosporidium parvum
RAGEEIPDSL

SEQ ID NO: 2223600 - protein, 14 aa, Cryptosporidium parvum
RAGENDFDTAQNAR

SEQ ID NO: 2223601 - protein, 4 aa, Cryptosporidium parvum
RAGL

SEQ ID NO: 2223602 - protein, 10 aa, Cryptosporidium parvum
RAGRRGLDDR

SEQ ID NO: 2223603 - protein, 8 aa, Cryptosporidium parvum
RAKDTEDK

SEQ ID NO: 2223604 - protein, 11 aa, Cryptosporidium parvum
RAKEDRKNINR

SEQ ID NO: 2223605 - protein, 7 aa, Cryptosporidium parvum
RAKHPGR

SEQ ID NO: 2223606 - protein, 14 aa, Cryptosporidium parvum
RAKLDKNEGSTKNC

SEQ ID NO: 2223607 - protein, 20 aa, Cryptosporidium parvum
RAKSAAKKVANAQGNQENGY

SEQ ID NO: 2223608 - protein, 12 aa, Cryptosporidium parvum
RALETKEPISYN

SEQ ID NO: 2223609 - protein, 15 aa, Cryptosporidium parvum
RANKEREQALQSQGQ

SEQ ID NO: 2223610 - protein, 4 aa, Cryptosporidium parvum
RAQD

SEQ ID NO: 2223611 - protein, 10 aa, Cryptosporidium parvum
RAQQSEKKEF

SEQ ID NO: 2223612 - protein, 4 aa, Cryptosporidium parvum
RASE

SEQ ID NO: 2223613 - protein, 8 aa, Cryptosporidium parvum
RASKEEKI

SEQ ID NO: 2223614 - protein, 11 aa, Cryptosporidium parvum
RASKEKNNHST

SEQ ID NO: 2223615 - protein, 7 aa, Cryptosporidium parvum
RASRGNS

SEQ ID NO: 2223616 - protein, 7 aa, Cryptosporidium parvum
RATENNS

SEQ ID NO: 2223617 - protein, 4 aa, Cryptosporidium parvum
RATF

SEQ ID NO: 2223618 - protein, 21 aa, Cryptosporidium parvum
RATGSVHTSNNSLKNDDSLSV

SEQ ID NO: 2223619 - protein, 14 aa, Cryptosporidium parvum
RAYQRSTRLDKREG

SEQ ID NO: 2223620 - protein, 7 aa, Cryptosporidium parvum
RDAGTKG

SEQ ID NO: 2223621 - protein, 17 aa, Cryptosporidium parvum
RDAKKENKEDVEKLQKG

SEQ ID NO: 2223622 - protein, 8 aa, Cryptosporidium parvum
RDCDSKRV

SEQ ID NO: 2223623 - protein, 5 aa, Cryptosporidium parvum
RDDLY

SEQ ID NO: 2223624 - protein, 24 aa, Cryptosporidium parvum
RDDNASSTQKTNESKGINNNESQE

SEQ ID NO: 2223625 - protein, 5 aa, Cryptosporidium parvum
RDDTR

SEQ ID NO: 2223626 - protein, 11 aa, Cryptosporidium parvum
RDDYSSSDIEN

SEQ ID NO: 2223627 - protein, 73 aa, Cryptosporidium parvum
RDEEPEHSATTAEEDNNSPQIPEDQDETNDIKDPTSSDQAKPNINSEPTSAPSSSAFNSNESGSSTDVSSDSF

SEQ ID NO: 2223628 - protein, 4 aa, Cryptosporidium parvum
RDEG

SEQ ID NO: 2223629 - protein, 19 aa, Cryptosporidium parvum
RDESTKDLRSSSFDPSSQT

SEQ ID NO: 2223630 - protein, 4 aa, Cryptosporidium parvum
RDET

SEQ ID NO: 2223631 - protein, 5 aa, Cryptosporidium parvum
RDETS

SEQ ID NO: 2223632 - protein, 7 aa, Cryptosporidium parvum
RDEYGNS

SEQ ID NO: 2223633 - protein, 5 aa, Cryptosporidium parvum
RDFTD

SEQ ID NO: 2223634 - protein, 10 aa, Cryptosporidium parvum
RDGGNSPEHI

SEQ ID NO: 2223635 - protein, 5 aa, Cryptosporidium parvum
RDGSL

SEQ ID NO: 2223636 - protein, 7 aa, Cryptosporidium parvum
RDHGSFG

SEQ ID NO: 2223637 - protein, 9 aa, Cryptosporidium parvum
RDIPPTNEE

SEQ ID NO: 2223638 - protein, 13 aa, Cryptosporidium parvum
RDKESQEQGKTDI

SEQ ID NO: 2223639 - protein, 7 aa, Cryptosporidium parvum
RDKKIGN

SEQ ID NO: 2223640 - protein, 6 aa, Cryptosporidium parvum
RDKQQF

SEQ ID NO: 2223641 - protein, 5 aa, Cryptosporidium parvum
RDKRK

SEQ ID NO: 2223642 - protein, 10 aa, Cryptosporidium parvum
RDKRSGKSIL

SEQ ID NO: 2223643 - protein, 9 aa, Cryptosporidium parvum
RDKSKYKNI

SEQ ID NO: 2223644 - protein, 9 aa, Cryptosporidium parvum
RDNDCGSVS

SEQ ID NO: 2223645 - protein, 13 aa, Cryptosporidium parvum
RDNNKIESQGDTL

SEQ ID NO: 2223646 - protein, 8 aa, Cryptosporidium parvum
RDNPNQKI

SEQ ID NO: 2223647 - protein, 10 aa, Cryptosporidium parvum
RDNRKSSTFS

SEQ ID NO: 2223648 - protein, 9 aa, Cryptosporidium parvum
RDNSKNDMN

SEQ ID NO: 2223649 - protein, 4 aa, Cryptosporidium parvum
RDPA

SEQ ID NO: 2223650 - protein, 8 aa, Cryptosporidium parvum
RDPEKPEN

SEQ ID NO: 2223651 - protein, 7 aa, Cryptosporidium parvum
RDPTNSF

SEQ ID NO: 2223652 - protein, 9 aa, Cryptosporidium parvum
RDQETGDED

SEQ ID NO: 2223653 - protein, 4 aa, Cryptosporidium parvum
RDQL

SEQ ID NO: 2223654 - protein, 7 aa, Cryptosporidium parvum
RDQVHRQ

SEQ ID NO: 2223655 - protein, 6 aa, Cryptosporidium parvum
RDRDEK

SEQ ID NO: 2223656 - protein, 13 aa, Cryptosporidium parvum
RDRGTKKRGIPYG

SEQ ID NO: 2223657 - protein, 6 aa, Cryptosporidium parvum
RDRSYS

SEQ ID NO: 2223658 - protein, 10 aa, Cryptosporidium parvum
RDRTSTPLGL

SEQ ID NO: 2223659 - protein, 7 aa, Cryptosporidium parvum
RDSIESS

SEQ ID NO: 2223660 - protein, 17 aa, Cryptosporidium parvum
RDSKPITDKTKLNEKEK

SEQ ID NO: 2223661 - protein, 14 aa, Cryptosporidium parvum
RDSLGSKQKEPGYF

SEQ ID NO: 2223662 - protein, 7 aa, Cryptosporidium parvum
RDSNRRE

SEQ ID NO: 2223663 - protein, 4 aa, Cryptosporidium parvum
RDSP

SEQ ID NO: 2223664 - protein, 15 aa, Cryptosporidium parvum
RDSQSYRRSVYNSNG

SEQ ID NO: 2223665 - protein, 15 aa, Cryptosporidium parvum
RDSSEEEFDSNEDQL

SEQ ID NO: 2223666 - protein, 8 aa, Cryptosporidium parvum
RDSSKTLS

SEQ ID NO: 2223667 - protein, 8 aa, Cryptosporidium parvum
RDSSSFGF

SEQ ID NO: 2223668 - protein, 10 aa, Cryptosporidium parvum
RDSSTPGSIS

SEQ ID NO: 2223669 - protein, 11 aa, Cryptosporidium parvum
RDTPKVPFSPY

SEQ ID NO: 2223670 - protein, 7 aa, Cryptosporidium parvum
RDTRASI

SEQ ID NO: 2223671 - protein, 9 aa, Cryptosporidium parvum
RDTSPTDIS

SEQ ID NO: 2223672 - protein, 27 aa, Cryptosporidium parvum
RDVSSDEISVSSSQSSKSLRSSNSMQE

SEQ ID NO: 2223673 - protein, 8 aa, Cryptosporidium parvum
RDYDQDSW

SEQ ID NO: 2223674 - protein, 16 aa, Cryptosporidium parvum
REAGGEDEKEQGREMS

SEQ ID NO: 2223675 - protein, 17 aa, Cryptosporidium parvum
REATDGETNLKETPKEL

SEQ ID NO: 2223676 - protein, 7 aa, Cryptosporidium parvum
RECRSGS

SEQ ID NO: 2223677 - protein, 5 aa, Cryptosporidium parvum
RECSP

SEQ ID NO: 2223678 - protein, 5 aa, Cryptosporidium parvum
REDEV

SEQ ID NO: 2223679 - protein, 8 aa, Cryptosporidium parvum
REDGATEN

SEQ ID NO: 2223680 - protein, 5 aa, Cryptosporidium parvum
REDGT

SEQ ID NO: 2223681 - protein, 10 aa, Cryptosporidium parvum
REDKMDEKSK

SEQ ID NO: 2223682 - protein, 17 aa, Cryptosporidium parvum
REDKQELSERKEIPWKS

SEQ ID NO: 2223683 - protein, 24 aa, Cryptosporidium parvum
REDSNDDKSEKMKENNSKLNTRRE

SEQ ID NO: 2223684 - protein, 13 aa, Cryptosporidium parvum
REEDKSLEKLGSE

SEQ ID NO: 2223685 - protein, 4 aa, Cryptosporidium parvum
REEE

SEQ ID NO: 2223686 - protein, 9 aa, Cryptosporidium parvum
REELQGKKS

SEQ ID NO: 2223687 - protein, 8 aa, Cryptosporidium parvum
REENERES

SEQ ID NO: 2223688 - protein, 4 aa, Cryptosporidium parvum
REES

SEQ ID NO: 2223689 - protein, 5 aa, Cryptosporidium parvum
REEYL

SEQ ID NO: 2223690 - protein, 28 aa, Cryptosporidium parvum
REGGGMGGIEGGRAGGGGGGGGGGIGQK

SEQ ID NO: 2223691 - protein, 9 aa, Cryptosporidium parvum
REGKEKPFR

SEQ ID NO: 2223692 - protein, 22 aa, Cryptosporidium parvum
REGRSNISNPMGSNKRKDGSPR

SEQ ID NO: 2223693 - protein, 29 aa, Cryptosporidium parvum
REGTNKKNRSNSKNIKGFTNDSSNNSIPH

SEQ ID NO: 2223694 - protein, 17 aa, Cryptosporidium parvum
REIASKQDDNEIEWDVV

SEQ ID NO: 2223695 - protein, 4 aa, Cryptosporidium parvum
REIE

SEQ ID NO: 2223696 - protein, 6 aa, Cryptosporidium parvum
REINGE

SEQ ID NO: 2223697 - protein, 6 aa, Cryptosporidium parvum
REINQK

SEQ ID NO: 2223698 - protein, 12 aa, Cryptosporidium parvum
REIPNYNNKNKF

SEQ ID NO: 2223699 - protein, 4 aa, Cryptosporidium parvum
REKA

SEQ ID NO: 2223700 - protein, 26 aa, Cryptosporidium parvum
REKDKDKDKDKDKDKDKESDKNLSNR

SEQ ID NO: 2223701 - protein, 7 aa, Cryptosporidium parvum
REKDQAI

SEQ ID NO: 2223702 - protein, 11 aa, Cryptosporidium parvum
REKEEERESKR

SEQ ID NO: 2223703 - protein, 11 aa, Cryptosporidium parvum
REKGKTRRNTA

SEQ ID NO: 2223704 - protein, 8 aa, Cryptosporidium parvum
REKKDFEK

SEQ ID NO: 2223705 - protein, 9 aa, Cryptosporidium parvum
REKKPTLGC

SEQ ID NO: 2223706 - protein, 4 aa, Cryptosporidium parvum
REKL

SEQ ID NO: 2223707 - protein, 7 aa, Cryptosporidium parvum
REKSQTD

SEQ ID NO: 2223708 - protein, 5 aa, Cryptosporidium parvum
REKYN

SEQ ID NO: 2223709 - protein, 15 aa, Cryptosporidium parvum
RELENEGLNNNSTSI

SEQ ID NO: 2223710 - protein, 23 aa, Cryptosporidium parvum
RELERGSPYNPSFSRSSEKDRLL

SEQ ID NO: 2223711 - protein, 6 aa, Cryptosporidium parvum
RELGDT

SEQ ID NO: 2223712 - protein, 6 aa, Cryptosporidium parvum
RELQDK

SEQ ID NO: 2223713 - protein, 5 aa, Cryptosporidium parvum
REMRN

SEQ ID NO: 2223714 - protein, 4 aa, Cryptosporidium parvum
RENE

SEQ ID NO: 2223715 - protein, 6 aa, Cryptosporidium parvum
RENGSF

SEQ ID NO: 2223716 - protein, 13 aa, Cryptosporidium parvum
RENKKTYTITIDK

SEQ ID NO: 2223717 - protein, 4 aa, Cryptosporidium parvum
RENN

SEQ ID NO: 2223718 - protein, 5 aa, Cryptosporidium parvum
RENNI

SEQ ID NO: 2223719 - protein, 26 aa, Cryptosporidium parvum
RENREKQRGNIRSSEIPDEYKNEESI

SEQ ID NO: 2223720 - protein, 7 aa, Cryptosporidium parvum
RENRNEL

SEQ ID NO: 2223721 - protein, 8 aa, Cryptosporidium parvum
RENTTLSG

SEQ ID NO: 2223722 - protein, 5 aa, Cryptosporidium parvum
REPFP

SEQ ID NO: 2223723 - protein, 11 aa, Cryptosporidium parvum
REPKRNYKPSN

SEQ ID NO: 2223724 - protein, 63 aa, Cryptosporidium parvum
REQEKEQESEQEQEQEQEQEQEQENEEEQGQEQDEDDEDQEHIDDKDQEQEDQEQIEKESQIK

SEQ ID NO: 2223725 - protein, 7 aa, Cryptosporidium parvum
REQKLND

SEQ ID NO: 2223726 - protein, 6 aa, Cryptosporidium parvum
RERKSV

SEQ ID NO: 2223727 - protein, 6 aa, Cryptosporidium parvum
RERNYA

SEQ ID NO: 2223728 - protein, 8 aa, Cryptosporidium parvum
RESELNSE

SEQ ID NO: 2223729 - protein, 12 aa, Cryptosporidium parvum
RESITSDNSKIK

SEQ ID NO: 2223730 - protein, 5 aa, Cryptosporidium parvum
RESIV

SEQ ID NO: 2223731 - protein, 7 aa, Cryptosporidium parvum
RESNGDG

SEQ ID NO: 2223732 - protein, 7 aa, Cryptosporidium parvum
RESSNSK

SEQ ID NO: 2223733 - protein, 10 aa, Cryptosporidium parvum
RESTDVPKSQ

SEQ ID NO: 2223734 - protein, 8 aa, Cryptosporidium parvum
RETENTEF

SEQ ID NO: 2223735 - protein, 28 aa, Cryptosporidium parvum
RETKGRTNSNKKNVSNYNTDLKVFKDPY

SEQ ID NO: 2223736 - protein, 6 aa, Cryptosporidium parvum
RETNDK

SEQ ID NO: 2223737 - protein, 11 aa, Cryptosporidium parvum
RETNKTARGNL

SEQ ID NO: 2223738 - protein, 7 aa, Cryptosporidium parvum
RETVKGV

SEQ ID NO: 2223739 - protein, 4 aa, Cryptosporidium parvum
REVL

SEQ ID NO: 2223740 - protein, 4 aa, Cryptosporidium parvum
REYN

SEQ ID NO: 2223741 - protein, 7 aa, Cryptosporidium parvum
REYPRGT

SEQ ID NO: 2223742 - protein, 4 aa, Cryptosporidium parvum
RFGD

SEQ ID NO: 2223743 - protein, 5 aa, Cryptosporidium parvum
RFGDE

SEQ ID NO: 2223744 - protein, 6 aa, Cryptosporidium parvum
RFGSAG

SEQ ID NO: 2223745 - protein, 26 aa, Cryptosporidium parvum
RFKDESSSSSKTKKQTSKKHSSQSAV

SEQ ID NO: 2223746 - protein, 32 aa, Cryptosporidium parvum; identical to SEQ ID NO: 2118758

SEQ ID NO: 2223747 - protein, 31 aa, Cryptosporidium parvum
RFPTQGPPQVPPQVPPQAPQMPPQTRDNGDF

SEQ ID NO: 2223748 - protein, 6 aa, Cryptosporidium parvum
RFQDTE

SEQ ID NO: 2223749 - protein, 5 aa, Cryptosporidium parvum
RFSEA

SEQ ID NO: 2223750 - protein, 11 aa, Cryptosporidium parvum
RFSEVNSPLGK

SEQ ID NO: 2223751 - protein, 8 aa, Cryptosporidium parvum
RGAKGEVG

SEQ ID NO: 2223752 - protein, 8 aa, Cryptosporidium parvum
RGATNESS

SEQ ID NO: 2223753 - protein, 9 aa, Cryptosporidium parvum
RGDCQSSSM

SEQ ID NO: 2223754 - protein, 10 aa, Cryptosporidium parvum
RGDRGQLGTG

SEQ ID NO: 2223755 - protein, 13 aa, Cryptosporidium parvum
RGDTQSDKEKRQA

SEQ ID NO: 2223756 - protein, 5 aa, Cryptosporidium parvum
RGEIE

SEQ ID NO: 2223757 - protein, 10 aa, Cryptosporidium parvum
RGEKLTKAQI

SEQ ID NO: 2223758 - protein, 15 aa, Cryptosporidium parvum
RGERADCNSSSNITR

SEQ ID NO: 2223759 - protein, 5 aa, Cryptosporidium parvum
RGERY

SEQ ID NO: 2223760 - protein, 7 aa, Cryptosporidium parvum
RGGEEAD

SEQ ID NO: 2223761 - protein, 6 aa, Cryptosporidium parvum
RGGESA

SEQ ID NO: 2223762 - protein, 11 aa, Cryptosporidium parvum
RGGSCNDSESS

SEQ ID NO: 2223763 - protein, 11 aa, Cryptosporidium parvum
RGGSEEVPENT

SEQ ID NO: 2223764 - protein, 10 aa, Cryptosporidium parvum
RGGTSENEGE

SEQ ID NO: 2223765 - protein, 4 aa, Cryptosporidium parvum
RGGV

SEQ ID NO: 2223766 - protein, 4 aa, Cryptosporidium parvum
RGHP

SEQ ID NO: 2223767 - protein, 6 aa, Cryptosporidium parvum
RGHSKN

SEQ ID NO: 2223768 - protein, 4 aa, Cryptosporidium parvum
RGIG

SEQ ID NO: 2223769 - protein, 27 aa, Cryptosporidium parvum
RGKEHAEKRLEEENSNKKKDEKEKKGL

SEQ ID NO: 2223770 - protein, 8 aa, Cryptosporidium parvum
RGKNVSPS

SEQ ID NO: 2223771 - protein, 8 aa, Cryptosporidium parvum
RGKSRRIQ

SEQ ID NO: 2223772 - protein, 23 aa, Cryptosporidium parvum
RGKSSNNISNNIRGGVGNSSKHT

SEQ ID NO: 2223773 - protein, 6 aa, Cryptosporidium parvum
RGLNSR

SEQ ID NO: 2223774 - protein, 7 aa, Cryptosporidium parvum
RGLPGSK

SEQ ID NO: 2223775 - protein, 12 aa, Cryptosporidium parvum
RGLSSNTSSCGN

SEQ ID NO: 2223776 - protein, 20 aa, Cryptosporidium parvum
RGLTEDDKEQRKESKQRLGP

SEQ ID NO: 2223777 - protein, 4 aa, Cryptosporidium parvum
RGNF

SEQ ID NO: 2223778 - protein, 9 aa, Cryptosporidium parvum
RGNQNTEKQ

SEQ ID NO: 2223779 - protein, 9 aa, Cryptosporidium parvum
RGNSEVSNK

SEQ ID NO: 2223780 - protein, 4 aa, Cryptosporidium parvum
RGNY

SEQ ID NO: 2223781 - protein, 15 aa, Cryptosporidium parvum
RGPEGISDSSSNSGL

SEQ ID NO: 2223782 - protein, 9 aa, Cryptosporidium parvum
RGPSHKSIE

SEQ ID NO: 2223783 - protein, 5 aa, Cryptosporidium parvum
RGPTL

SEQ ID NO: 2223784 - protein, 6 aa, Cryptosporidium parvum
RGPTNE

SEQ ID NO: 2223785 - protein, 9 aa, Cryptosporidium parvum
RGQISPPSL

SEQ ID NO: 2223786 - protein, 4 aa, Cryptosporidium parvum
RGQR

SEQ ID NO: 2223787 - protein, 7 aa, Cryptosporidium parvum
RGRDLGS

SEQ ID NO: 2223788 - protein, 7 aa, Cryptosporidium parvum
RGRKDDE

SEQ ID NO: 2223789 - protein, 15 aa, Cryptosporidium parvum
RGSKKSESKKEQVEE

SEQ ID NO: 2223790 - protein, 14 aa, Cryptosporidium parvum
RGSNINEKGEGKNQ

SEQ ID NO: 2223791 - protein, 6 aa, Cryptosporidium parvum
RGSNQA

SEQ ID NO: 2223792 - protein, 7 aa, Cryptosporidium parvum
RGTEGTF

SEQ ID NO: 2223793 - protein, 6 aa, Cryptosporidium parvum
RGTVPQ

SEQ ID NO: 2223794 - protein, 4 aa, Cryptosporidium parvum
RGVN

SEQ ID NO: 2223795 - protein, 6 aa, Cryptosporidium parvum
RHAGTH

SEQ ID NO: 2223796 - protein, 6 aa, Cryptosporidium parvum
RHEEPV

SEQ ID NO: 2223797 - protein, 5 aa, Cryptosporidium parvum
RHGPE

SEQ ID NO: 2223798 - protein, 4 aa, Cryptosporidium parvum
RHHR

SEQ ID NO: 2223799 - protein, 32 aa, Cryptosporidium parvum
RHKRGSGKNRKRNSSGLKPHTDSGNDADCEST

SEQ ID NO: 2223800 - protein, 6 aa, Cryptosporidium parvum
RHLKPE

SEQ ID NO: 2223801 - protein, 5 aa, Cryptosporidium parvum
RHPSL

SEQ ID NO: 2223802 - protein, 5 aa, Cryptosporidium parvum
RHQGP

SEQ ID NO: 2223803 - protein, 10 aa, Cryptosporidium parvum
RHQNDRIENE

SEQ ID NO: 2223804 - protein, 5 aa, Cryptosporidium parvum
RHQRK

SEQ ID NO: 2223805 - protein, 11 aa, Cryptosporidium parvum
RHQSGNNKSLK

SEQ ID NO: 2223806 - protein, 4 aa, Cryptosporidium parvum
RHRS

SEQ ID NO: 2223807 - protein, 5 aa, Cryptosporidium parvum
RIAET

SEQ ID NO: 2223808 - protein, 8 aa, Cryptosporidium parvum
RIDDNTRE

SEQ ID NO: 2223809 - protein, 10 aa, Cryptosporidium parvum
RIDRSYEKHR

SEQ ID NO: 2223810 - protein, 5 aa, Cryptosporidium parvum
RIGES

SEQ ID NO: 2223811 - protein, 13 aa, Cryptosporidium parvum
RIGSSGPLSSKEE

SEQ ID NO: 2223812 - protein, 10 aa, Cryptosporidium parvum
RIKKETNTIQ

SEQ ID NO: 2223813 - protein, 20 aa, Cryptosporidium parvum
RIKNTKDNEIDSEKKYSNVS

SEQ ID NO: 2223814 - protein, 10 aa, Cryptosporidium parvum
RIKSYGSKLP

SEQ ID NO: 2223815 - protein, 10 aa, Cryptosporidium parvum
RIKTSNSINY

SEQ ID NO: 2223816 - protein, 6 aa, Cryptosporidium parvum
RINELK

SEQ ID NO: 2223817 - protein, 9 aa, Cryptosporidium parvum
RINSNNDHD

SEQ ID NO: 2223818 - protein, 22 aa, Cryptosporidium parvum
RIPKTRGVKNYSSRSKKELSGD

SEQ ID NO: 2223819 - protein, 20 aa, Cryptosporidium parvum
RIPNPTPIKTSAQPVEIPKT

SEQ ID NO: 2223820 - protein, 7 aa, Cryptosporidium parvum
RIPPNGT

SEQ ID NO: 2223821 - protein, 5 aa, Cryptosporidium parvum
RIQTQ

SEQ ID NO: 2223822 - protein, 6 aa, Cryptosporidium parvum
RIQTRE

SEQ ID NO: 2223823 - protein, 5 aa, Cryptosporidium parvum
RIREE

SEQ ID NO: 2223824 - protein, 15 aa, Cryptosporidium parvum
RISNGDVDADCPYRT

SEQ ID NO: 2223825 - protein, 10 aa, Cryptosporidium parvum
RISSATKIER

SEQ ID NO: 2223826 - protein, 27 aa, Cryptosporidium parvum
RISSDSKYYSNNNYSFKGKRKSRNSLV

SEQ ID NO: 2223827 - protein, 4 aa, Cryptosporidium parvum
RIYN

SEQ ID NO: 2223828 - protein, 15 aa, Cryptosporidium parvum
RKARLKKESRRRRRR

SEQ ID NO: 2223829 - protein, 7 aa, Cryptosporidium parvum
RKATNTM

SEQ ID NO: 2223830 - protein, 18 aa, Cryptosporidium parvum
RKDDQTGEDDLKDDPQNY

SEQ ID NO: 2223831 - protein, 9 aa, Cryptosporidium parvum
RKDDSNNIK

SEQ ID NO: 2223832 - protein, 10 aa, Cryptosporidium parvum
RKDGNHSNSQ

SEQ ID NO: 2223833 - protein, 7 aa, Cryptosporidium parvum
RKDHPKF

SEQ ID NO: 2223834 - protein, 7 aa, Cryptosporidium parvum
RKDINNR

SEQ ID NO: 2223835 - protein, 8 aa, Cryptosporidium parvum
RKDNRIKS

SEQ ID NO: 2223836 - protein, 10 aa, Cryptosporidium parvum
RKDQSNTEIQ

SEQ ID NO: 2223837 - protein, 5 aa, Cryptosporidium parvum
RKDQV

SEQ ID NO: 2223838 - protein, 16 aa, Cryptosporidium parvum
RKDRGRRPNSLKNQGC

SEQ ID NO: 2223839 - protein, 10 aa, Cryptosporidium parvum
RKDSEDEDPV

SEQ ID NO: 2223840 - protein, 10 aa, Cryptosporidium parvum
RKDTESRKKA

SEQ ID NO: 2223841 - protein, 6 aa, Cryptosporidium parvum
RKEAET

SEQ ID NO: 2223842 - protein, 5 aa, Cryptosporidium parvum
RKEAS

SEQ ID NO: 2223843 - protein, 9 aa, Cryptosporidium parvum
RKEASNSGL

SEQ ID NO: 2223844 - protein, 11 aa, Cryptosporidium parvum
RKEGNNNNEEN

SEQ ID NO: 2223845 - protein, 15 aa, Cryptosporidium parvum
RKEKSWNDSSSCQKK

SEQ ID NO: 2223846 - protein, 10 aa, Cryptosporidium parvum
RKENDKRQYE

SEQ ID NO: 2223847 - protein, 28 aa, Cryptosporidium parvum
RKENTNESSIEGEDSSKTGKGTKTIKEE

SEQ ID NO: 2223848 - protein, 7 aa, Cryptosporidium parvum
RKERRKL

SEQ ID NO: 2223849 - protein, 8 aa, Cryptosporidium parvum
RKESKEYS

SEQ ID NO: 2223850 - protein, 17 aa, Cryptosporidium parvum
RKESQETTGKKSEGEIN

SEQ ID NO: 2223851 - protein, 9 aa, Cryptosporidium parvum
RKETESSCK

SEQ ID NO: 2223852 - protein, 8 aa, Cryptosporidium parvum
RKEVQEKR

SEQ ID NO: 2223853 - protein, 17 aa, Cryptosporidium parvum
RKFDQSFEAKSPKSPSV

SEQ ID NO: 2223854 - protein, 9 aa, Cryptosporidium parvum
RKFGTGNKE

SEQ ID NO: 2223855 - protein, 11 aa, Cryptosporidium parvum
RKGAGKLEFPD

SEQ ID NO: 2223856 - protein, 4 aa, Cryptosporidium parvum
RKGD

SEQ ID NO: 2223857 - protein, 7 aa, Cryptosporidium parvum
RKGEEIE

SEQ ID NO: 2223858 - protein, 4 aa, Cryptosporidium parvum
RKGL

SEQ ID NO: 2223859 - protein, 7 aa, Cryptosporidium parvum
RKGNYKK

SEQ ID NO: 2223860 - protein, 7 aa, Cryptosporidium parvum
RKGQKIK

SEQ ID NO: 2223861 - protein, 5 aa, Cryptosporidium parvum
RKHAT

SEQ ID NO: 2223862 - protein, 19 aa, Cryptosporidium parvum
RKHSPSGKKMNKFSRKSRL

SEQ ID NO: 2223863 - protein, 17 aa, Cryptosporidium parvum
RKHTASVNNQQQSGNLR

SEQ ID NO: 2223864 - protein, 13 aa, Cryptosporidium parvum
RKIEKRNAKIAEQ

SEQ ID NO: 2223865 - protein, 11 aa, Cryptosporidium parvum
RKISNNGNNPN

SEQ ID NO: 2223866 - protein, 5 aa, Cryptosporidium parvum
RKITR

SEQ ID NO: 2223867 - protein, 9 aa, Cryptosporidium parvum
RKKCNERNK

SEQ ID NO: 2223868 - protein, 19 aa, Cryptosporidium parvum
RKKDKDKKTALEKKESILD

SEQ ID NO: 2223869 - protein, 10 aa, Cryptosporidium parvum
RKKDQSENLR

SEQ ID NO: 2223870 - protein, 13 aa, Cryptosporidium parvum
RKKEKSQEEKRGR

SEQ ID NO: 2223871 - protein, 8 aa, Cryptosporidium parvum
RKKKQKVL

SEQ ID NO: 2223872 - protein, 10 aa, Cryptosporidium parvum
RKKLSKQQRV

SEQ ID NO: 2223873 - protein, 8 aa, Cryptosporidium parvum
RKKNDVEV

SEQ ID NO: 2223874 - protein, 16 aa, Cryptosporidium parvum
RKKNLSSENIGSTSTD

SEQ ID NO: 2223875 - protein, 10 aa, Cryptosporidium parvum
RKKQTAECYN

SEQ ID NO: 2223876 - protein, 8 aa, Cryptosporidium parvum
RKKRKLTN

SEQ ID NO: 2223877 - protein, 7 aa, Cryptosporidium parvum
RKKRKSV

SEQ ID NO: 2223878 - protein, 8 aa, Cryptosporidium parvum
RKKSAEVE

SEQ ID NO: 2223879 - protein, 6 aa, Cryptosporidium parvum
RKMKSG

SEQ ID NO: 2223880 - protein, 4 aa, Cryptosporidium parvum
RKND

SEQ ID NO: 2223881 - protein, 8 aa, Cryptosporidium parvum
RKNEGNDT

SEQ ID NO: 2223882 - protein, 11 aa, Cryptosporidium parvum
RKNEPSTSNIK

SEQ ID NO: 2223883 - protein, 8 aa, Cryptosporidium parvum
RKNGGENN

SEQ ID NO: 2223884 - protein, 7 aa, Cryptosporidium parvum
RKNGRKS

SEQ ID NO: 2223885 - protein, 17 aa, Cryptosporidium parvum
RKNINDAATIQNNIENN

SEQ ID NO: 2223886 - protein, 12 aa, Cryptosporidium parvum
RKNKNPNQNSID

SEQ ID NO: 2223887 - protein, 7 aa, Cryptosporidium parvum
RKNLPSE

SEQ ID NO: 2223888 - protein, 8 aa, Cryptosporidium parvum
RKNNNDPW

SEQ ID NO: 2223889 - protein, 27 aa, Cryptosporidium parvum
RKNPEGNKQIEGKSKITFSKGEQVRRG

SEQ ID NO: 2223890 - protein, 7 aa, Cryptosporidium parvum
RKNQEID

SEQ ID NO: 2223891 - protein, 12 aa, Cryptosporidium parvum
RKNQEKENVEKS

SEQ ID NO: 2223892 - protein, 6 aa, Cryptosporidium parvum
RKNQHQ

SEQ ID NO: 2223893 - protein, 6 aa, Cryptosporidium parvum
RKNRND

SEQ ID NO: 2223894 - protein, 5 aa, Cryptosporidium parvum
RKNSD

SEQ ID NO: 2223895 - protein, 17 aa, Cryptosporidium parvum
RKNSHNKLSDPNLENPN

SEQ ID NO: 2223896 - protein, 8 aa, Cryptosporidium parvum
RKNSNLDR

SEQ ID NO: 2223897 - protein, 21 aa, Cryptosporidium parvum
RKNSSNPVNAIEKTKKKESHH

SEQ ID NO: 2223898 - protein, 11 aa, Cryptosporidium parvum
RKNTSGSTEHK

SEQ ID NO: 2223899 - protein, 4 aa, Cryptosporidium parvum
RKPC

SEQ ID NO: 2223900 - protein, 4 aa, Cryptosporidium parvum
RKPF

SEQ ID NO: 2223901 - protein, 7 aa, Cryptosporidium parvum
RKPNAIS

SEQ ID NO: 2223902 - protein, 8 aa, Cryptosporidium parvum
RKPNGLKG

SEQ ID NO: 2223903 - protein, 10 aa, Cryptosporidium parvum
RKQEKAKQLN

SEQ ID NO: 2223904 - protein, 14 aa, Cryptosporidium parvum
RKQKKASEEESRIR

SEQ ID NO: 2223905 - protein, 8 aa, Cryptosporidium parvum
RKQNIERN

SEQ ID NO: 2223906 - protein, 6 aa, Cryptosporidium parvum
RKQSFS

SEQ ID NO: 2223907 - protein, 4 aa, Cryptosporidium parvum
RKRG

SEQ ID NO: 2223908 - protein, 22 aa, Cryptosporidium parvum
RKRSIDDGEEPKSSKYLPTPTC

SEQ ID NO: 2223909 - protein, 9 aa, Cryptosporidium parvum
RKRSSNQSF

SEQ ID NO: 2223910 - protein, 14 aa, Cryptosporidium parvum
RKRTRGGDLTGDSI

SEQ ID NO: 2223911 - protein, 11 aa, Cryptosporidium parvum
RKSAESPHTHN

SEQ ID NO: 2223912 - protein, 7 aa, Cryptosporidium parvum
RKSEIEI

SEQ ID NO: 2223913 - protein, 7 aa, Cryptosporidium parvum
RKSHMGS

SEQ ID NO: 2223914 - protein, 7 aa, Cryptosporidium parvum
RKSNGIS

SEQ ID NO: 2223915 - protein, 9 aa, Cryptosporidium parvum
RKSRETGHQ

SEQ ID NO: 2223916 - protein, 6 aa, Cryptosporidium parvum
RKSSEL

SEQ ID NO: 2223917 - protein, 27 aa, Cryptosporidium parvum
RKSSKILRKGKTSSTLSKNNANHLQSE

SEQ ID NO: 2223918 - protein, 18 aa, Cryptosporidium parvum
RKSSNSAVKNKQHNNESI

SEQ ID NO: 2223919 - protein, 25 aa, Cryptosporidium parvum
RKSSQTRQKHTRARTNSSNKNLNGS

SEQ ID NO: 2223920 - protein, 7 aa, Cryptosporidium parvum
RKSSSNY

SEQ ID NO: 2223921 - protein, 5 aa, Cryptosporidium parvum
RKSTE

SEQ ID NO: 2223922 - protein, 8 aa, Cryptosporidium parvum
RKTEESNL

SEQ ID NO: 2223923 - protein, 7 aa, Cryptosporidium parvum
RKTSEMR

SEQ ID NO: 2223924 - protein, 19 aa, Cryptosporidium parvum
RKTVSEKSELRRKFGKFFL

SEQ ID NO: 2223925 - protein, 12 aa, Cryptosporidium parvum
RKVEGDQLSSGV

SEQ ID NO: 2223926 - protein, 11 aa, Cryptosporidium parvum
RKYKRTESMNQ

SEQ ID NO: 2223927 - protein, 14 aa, Cryptosporidium parvum
RKYPRIKEKQEQYI

SEQ ID NO: 2223928 - protein, 25 aa, Cryptosporidium parvum
RLAKEKELEEKKAKEKEKTESNLAN

SEQ ID NO: 2223929 - protein, 5 aa, Cryptosporidium parvum
RLDNR

SEQ ID NO: 2223930 - protein, 28 aa, Cryptosporidium parvum
RLEDDSGTEEYHDENDFENDDDDDDEDN

SEQ ID NO: 2223931 - protein, 13 aa, Cryptosporidium parvum
RLESNGSDTLSNR

SEQ ID NO: 2223932 - protein, 13 aa, Cryptosporidium parvum
RLGTNSTKSHSNP

SEQ ID NO: 2223933 - protein, 6 aa, Cryptosporidium parvum
RLNKKN

SEQ ID NO: 2223934 - protein, 17 aa, Cryptosporidium parvum
RLPESSSSSIDDSEKID

SEQ ID NO: 2223935 - protein, 22 aa, Cryptosporidium parvum
RLPLSSGGYDTSSSSSDEERYD

SEQ ID NO: 2223936 - protein, 6 aa, Cryptosporidium parvum
RLPRQI

SEQ ID NO: 2223937 - protein, 8 aa, Cryptosporidium parvum
RLPSKGAQ

SEQ ID NO: 2223938 - protein, 9 aa, Cryptosporidium parvum
RLPTGKEKG

SEQ ID NO: 2223939 - protein, 9 aa, Cryptosporidium parvum
RLQEETTYT

SEQ ID NO: 2223940 - protein, 6 aa, Cryptosporidium parvum
RLRDGT

SEQ ID NO: 2223941 - protein, 9 aa, Cryptosporidium parvum
RLRPSGSTN

SEQ ID NO: 2223942 - protein, 9 aa, Cryptosporidium parvum
RLSEDISGL

SEQ ID NO: 2223943 - protein, 20 aa, Cryptosporidium parvum
RLSPEDQDTASKESLTHSEN

SEQ ID NO: 2223944 - protein, 6 aa, Cryptosporidium parvum
RLSPPE

SEQ ID NO: 2223945 - protein, 17 aa, Cryptosporidium parvum
RLSRPLNNNSINNNKAM

SEQ ID NO: 2223946 - protein, 10 aa, Cryptosporidium parvum
RLSSNSSSLG

SEQ ID NO: 2223947 - protein, 9 aa, Cryptosporidium parvum
RLSSTGNKL

SEQ ID NO: 2223948 - protein, 8 aa, Cryptosporidium parvum
RMKSSTSM

SEQ ID NO: 2223949 - protein, 4 aa, Cryptosporidium parvum
RMNN

SEQ ID NO: 2223950 - protein, 29 aa, Cryptosporidium parvum
RMNRNSGDISELKDDDKSPENQRNRELST

SEQ ID NO: 2223951 - protein, 27 aa, Cryptosporidium parvum
RMSPKEQKKYQEKKDKQQARSRIKLKK

SEQ ID NO: 2223952 - protein, 6 aa, Cryptosporidium parvum
RMYPSQ

SEQ ID NO: 2223953 - protein, 4 aa, Cryptosporidium parvum
RNAA

SEQ ID NO: 2223954 - protein, 16 aa, Cryptosporidium parvum
RNAKPATLVGKTNQNF

SEQ ID NO: 2223955 - protein, 12 aa, Cryptosporidium parvum
RNANSQVNTSNM

SEQ ID NO: 2223956 - protein, 10 aa, Cryptosporidium parvum
RNDETNKQSV

SEQ ID NO: 2223957 - protein, 18 aa, Cryptosporidium parvum
RNDLSESKSFKEELGSKS

SEQ ID NO: 2223958 - protein, 28 aa, Cryptosporidium parvum
RNDNNNNNNNNNNNNNNNNNNNSNSNSF

SEQ ID NO: 2223959 - protein, 15 aa, Cryptosporidium parvum
RNDNNTLKYNTSEYD

SEQ ID NO: 2223960 - protein, 7 aa, Cryptosporidium parvum
RNDPDLG

SEQ ID NO: 2223961 - protein, 5 aa, Cryptosporidium parvum
RNDRY

SEQ ID NO: 2223962 - protein, 6 aa, Cryptosporidium parvum
RNEDNL

SEQ ID NO: 2223963 - protein, 46 aa, Cryptosporidium parvum
RNEEKEEQEDEEEKEKDSKVSEVQANNSEGRRSRQNGSQAIGKSGL

SEQ ID NO: 2223964 - protein, 18 aa, Cryptosporidium parvum
RNEELSTFNSENTIGNSQ

SEQ ID NO: 2223965 - protein, 7 aa, Cryptosporidium parvum
RNEFENA

SEQ ID NO: 2223966 - protein, 8 aa, Cryptosporidium parvum
RNEGPKLS

SEQ ID NO: 2223967 - protein, 15 aa, Cryptosporidium parvum
RNEIRTVNQSNTHIK

SEQ ID NO: 2223968 - protein, 15 aa, Cryptosporidium parvum
RNEKEDEDSGDKTEI

SEQ ID NO: 2223969 - protein, 12 aa, Cryptosporidium parvum
RNENDTVKAKMK

SEQ ID NO: 2223970 - protein, 5 aa, Cryptosporidium parvum
RNETG

SEQ ID NO: 2223971 - protein, 9 aa, Cryptosporidium parvum
RNETNPQSR

SEQ ID NO: 2223972 - protein, 7 aa, Cryptosporidium parvum
RNEYYKS

SEQ ID NO: 2223973 - protein, 5 aa, Cryptosporidium parvum
RNFEE

SEQ ID NO: 2223974 - protein, 34 aa, Cryptosporidium parvum
RNFNKNKFGQNNHSQNSTRNDSNIQSKKKENEKH

SEQ ID NO: 2223975 - protein, 8 aa, Cryptosporidium parvum
RNFSKTQL

SEQ ID NO: 2223976 - protein, 5 aa, Cryptosporidium parvum
RNGFR

SEQ ID NO: 2223977 - protein, 6 aa, Cryptosporidium parvum
RNGNDQ

SEQ ID NO: 2223978 - protein, 7 aa, Cryptosporidium parvum
RNGPTSL

SEQ ID NO: 2223979 - protein, 14 aa, Cryptosporidium parvum
RNGSNNNMTQNNHQ

SEQ ID NO: 2223980 - protein, 5 aa, Cryptosporidium parvum
RNHHE

SEQ ID NO: 2223981 - protein, 15 aa, Cryptosporidium parvum
RNHLSQESSPNSSSL

SEQ ID NO: 2223982 - protein, 13 aa, Cryptosporidium parvum
RNHSETTNTSTSW

SEQ ID NO: 2223983 - protein, 12 aa, Cryptosporidium parvum
RNINSTDEALPR

SEQ ID NO: 2223984 - protein, 24 aa, Cryptosporidium parvum
RNISTSQVSLKQESNIQKSKTNST

SEQ ID NO: 2223985 - protein, 7 aa, Cryptosporidium parvum
RNITDST

SEQ ID NO: 2223986 - protein, 28 aa, Cryptosporidium parvum
RNKEIQTNPSKKPRNYSSSYTKYKARYD

SEQ ID NO: 2223987 - protein, 7 aa, Cryptosporidium parvum
RNKEYNH

SEQ ID NO: 2223988 - protein, 4 aa, Cryptosporidium parvum
RNKN

SEQ ID NO: 2223989 - protein, 8 aa, Cryptosporidium parvum
RNKNEKFV

SEQ ID NO: 2223990 - protein, 6 aa, Cryptosporidium parvum
RNKPNC

SEQ ID NO: 2223991 - protein, 8 aa, Cryptosporidium parvum
RNKQNRKI

SEQ ID NO: 2223992 - protein, 5 aa, Cryptosporidium parvum
RNKRR

SEQ ID NO: 2223993 - protein, 18 aa, Cryptosporidium parvum
RNKTDNNDKEKQLNDENI

SEQ ID NO: 2223994 - protein, 11 aa, Cryptosporidium parvum
RNKYTTKSTGL

SEQ ID NO: 2223995 - protein, 7 aa, Cryptosporidium parvum
RNLENGK

SEQ ID NO: 2223996 - protein, 18 aa, Cryptosporidium parvum
RNLGDPDDEQDTEESDDF

SEQ ID NO: 2223997 - protein, 6 aa, Cryptosporidium parvum
RNLLPQ

SEQ ID NO: 2223998 - protein, 4 aa, Cryptosporidium parvum
RNMG

SEQ ID NO: 2223999 - protein, 11 aa, Cryptosporidium parvum
RNNEKIRHSED

SEQ ID NO: 2224000 - protein, 13 aa, Cryptosporidium parvum
RNNGHVGAPIPSS

SEQ ID NO: 2224001 - protein, 18 aa, Cryptosporidium parvum
RNNNGGYGEKFDQKETNI

SEQ ID NO: 2224002 - protein, 5 aa, Cryptosporidium parvum
RNNNK

SEQ ID NO: 2224003 - protein, 9 aa, Cryptosporidium parvum
RNNQKEIKG

SEQ ID NO: 2224004 - protein, 8 aa, Cryptosporidium parvum
RNNQQSEN

SEQ ID NO: 2224005 - protein, 11 aa, Cryptosporidium parvum
RNNTPNNETDI

SEQ ID NO: 2224006 - protein, 16 aa, Cryptosporidium parvum
RNPENCKPENIDQDDE

SEQ ID NO: 2224007 - protein, 6 aa, Cryptosporidium parvum
RNPSAR

SEQ ID NO: 2224008 - protein, 13 aa, Cryptosporidium parvum
RNPTSREPYERTI

SEQ ID NO: 2224009 - protein, 5 aa, Cryptosporidium parvum
RNQAR

SEQ ID NO: 2224010 - protein, 4 aa, Cryptosporidium parvum
RNQN

SEQ ID NO: 2224011 - protein, 14 aa, Cryptosporidium parvum
RNQNINKNRNESEY

SEQ ID NO: 2224012 - protein, 19 aa, Cryptosporidium parvum
RNQNLSNNHSTSSLPNTKY

SEQ ID NO: 2224013 - protein, 6 aa, Cryptosporidium parvum
RNQQKM

SEQ ID NO: 2224014 - protein, 27 aa, Cryptosporidium parvum
RNQRNEGSAQPASESRSRASGTGGNAA

SEQ ID NO: 2224015 - protein, 6 aa, Cryptosporidium parvum
RNQRRN

SEQ ID NO: 2224016 - protein, 7 aa, Cryptosporidium parvum
RNQRYQP

SEQ ID NO: 2224017 - protein, 6 aa, Cryptosporidium parvum
RNRDPL

SEQ ID NO: 2224018 - protein, 6 aa, Cryptosporidium parvum
RNREDP

SEQ ID NO: 2224019 - protein, 16 aa, Cryptosporidium parvum
RNRQEGEDDDDYADGF

SEQ ID NO: 2224020 - protein, 5 aa, Cryptosporidium parvum
RNRQH

SEQ ID NO: 2224021 - protein, 17 aa, Cryptosporidium parvum
RNRRNDLNKEKESKVSV

SEQ ID NO: 2224022 - protein, 17 aa, Cryptosporidium parvum
RNRTERKFNTNKELPKS

SEQ ID NO: 2224023 - protein, 5 aa, Cryptosporidium parvum
RNSCS

SEQ ID NO: 2224024 - protein, 9 aa, Cryptosporidium parvum
RNSDLNEDL

SEQ ID NO: 2224025 - protein, 10 aa, Cryptosporidium parvum
RNSESENQNQ

SEQ ID NO: 2224026 - protein, 15 aa, Cryptosporidium parvum
RNSGINRKNSKLPHN

SEQ ID NO: 2224027 - protein, 18 aa, Cryptosporidium parvum
RNSGNASNMIDSEADEDI

SEQ ID NO: 2224028 - protein, 10 aa, Cryptosporidium parvum
RNSGRSELDN

SEQ ID NO: 2224029 - protein, 7 aa, Cryptosporidium parvum
RNSGSLV

SEQ ID NO: 2224030 - protein, 7 aa, Cryptosporidium parvum
RNSIRKR

SEQ ID NO: 2224031 - protein, 9 aa, Cryptosporidium parvum
RNSKGSLES

SEQ ID NO: 2224032 - protein, 7 aa, Cryptosporidium parvum
RNSKNKQ

SEQ ID NO: 2224033 - protein, 8 aa, Cryptosporidium parvum
RNSKSNNA

SEQ ID NO: 2224034 - protein, 7 aa, Cryptosporidium parvum
RNSKVDP

SEQ ID NO: 2224035 - protein, 129 aa, Cryptosporidium parvum
RNSNRSKTTTSNNRVKRDKYSDDECEDHEEEEEEEEEEEEEEEEEEEEEEEEEEEEEEEEEEEEEEEEEEEEEEEEEEEEEEEEEEEEAPKQLKTPQRGRRAAENIAKEDDRLNNTYNTSVRRSNRLKK

SEQ ID NO: 2224036 - protein, 12 aa, Cryptosporidium parvum
RNSPESTGRRAR

SEQ ID NO: 2224037 - protein, 10 aa, Cryptosporidium parvum
RNSSGFSSGQ

SEQ ID NO: 2224038 - protein, 6 aa, Cryptosporidium parvum
RNSSNL

SEQ ID NO: 2224039 - protein, 9 aa, Cryptosporidium parvum
RNSSSNKRS

SEQ ID NO: 2224040 - protein, 9 aa, Cryptosporidium parvum
RNSSSSSSV

SEQ ID NO: 2224041 - protein, 7 aa, Cryptosporidium parvum
RNSYSNG

SEQ ID NO: 2224042 - protein, 8 aa, Cryptosporidium parvum
RNTDENSS

SEQ ID NO: 2224043 - protein, 5 aa, Cryptosporidium parvum
RNTDV

SEQ ID NO: 2224044 - protein, 12 aa, Cryptosporidium parvum
RNTGDQDNWDNK

SEQ ID NO: 2224045 - protein, 4 aa, Cryptosporidium parvum
RNTK

SEQ ID NO: 2224046 - protein, 4 aa, Cryptosporidium parvum
RNTL

SEQ ID NO: 2224047 - protein, 15 aa, Cryptosporidium parvum
RNTPSPDADPNHKEN

SEQ ID NO: 2224048 - protein, 7 aa, Cryptosporidium parvum
RNTRTKA

SEQ ID NO: 2224049 - protein, 4 aa, Cryptosporidium parvum
RNTT

SEQ ID NO: 2224050 - protein, 10 aa, Cryptosporidium parvum
RNVQSGFNEQ

SEQ ID NO: 2224051 - protein, 7 aa, Cryptosporidium parvum
RNVRGGK

SEQ ID NO: 2224052 - protein, 8 aa, Cryptosporidium parvum
RNVSKPRI

SEQ ID NO: 2224053 - protein, 7 aa, Cryptosporidium parvum
RNYPEYG

SEQ ID NO: 2224054 - protein, 7 aa, Cryptosporidium parvum
RNYQSEH

SEQ ID NO: 2224055 - protein, 11 aa, Cryptosporidium parvum
RNYSNNSNLQQ

SEQ ID NO: 2224056 - protein, 9 aa, Cryptosporidium parvum
RPAATVSPN

SEQ ID NO: 2224057 - protein, 6 aa, Cryptosporidium parvum
RPAPSL

SEQ ID NO: 2224058 - protein, 5 aa, Cryptosporidium parvum
RPDKE

SEQ ID NO: 2224059 - protein, 14 aa, Cryptosporidium parvum
RPDTGGADSDTQSV

SEQ ID NO: 2224060 - protein, 4 aa, Cryptosporidium parvum
RPEI

SEQ ID NO: 2224061 - protein, 8 aa, Cryptosporidium parvum
RPEKLQKV

SEQ ID NO: 2224062 - protein, 12 aa, Cryptosporidium parvum
RPENNIYEKGNN

SEQ ID NO: 2224063 - protein, 6 aa, Cryptosporidium parvum
RPERKL

SEQ ID NO: 2224064 - protein, 4 aa, Cryptosporidium parvum
RPES

SEQ ID NO: 2224065 - protein, 4 aa, Cryptosporidium parvum
RPFG

SEQ ID NO: 2224066 - protein, 7 aa, Cryptosporidium parvum
RPGSSSP

SEQ ID NO: 2224067 - protein, 6 aa, Cryptosporidium parvum
RPIEGE

SEQ ID NO: 2224068 - protein, 4 aa, Cryptosporidium parvum
RPIG

SEQ ID NO: 2224069 - protein, 4 aa, Cryptosporidium parvum
RPIN

SEQ ID NO: 2224070 - protein, 4 aa, Cryptosporidium parvum
RPKA

SEQ ID NO: 2224071 - protein, 5 aa, Cryptosporidium parvum
RPKEY

SEQ ID NO: 2224072 - protein, 11 aa, Cryptosporidium parvum
RPKKDIREIDR

SEQ ID NO: 2224073 - protein, 7 aa, Cryptosporidium parvum
RPKKPSD

SEQ ID NO: 2224074 - protein, 10 aa, Cryptosporidium parvum
RPKNNAETPT

SEQ ID NO: 2224075 - protein, 12 aa, Cryptosporidium parvum
RPKSVQSSNPDS

SEQ ID NO: 2224076 - protein, 6 aa, Cryptosporidium parvum
RPKTTA

SEQ ID NO: 2224077 - protein, 11 aa, Cryptosporidium parvum
RPLKNDKKISN

SEQ ID NO: 2224078 - protein, 6 aa, Cryptosporidium parvum
RPLSGE

SEQ ID NO: 2224079 - protein, 10 aa, Cryptosporidium parvum
RPLVKKTPRP

SEQ ID NO: 2224080 - protein, 11 aa, Cryptosporidium parvum
RPNDSNLKDSR

SEQ ID NO: 2224081 - protein, 11 aa, Cryptosporidium parvum
RPNKSKKKNLI

SEQ ID NO: 2224082 - protein, 6 aa, Cryptosporidium parvum
RPPDLK

SEQ ID NO: 2224083 - protein, 7 aa, Cryptosporidium parvum
RPPFTTS

SEQ ID NO: 2224084 - protein, 5 aa, Cryptosporidium parvum
RPPNM

SEQ ID NO: 2224085 - protein, 9 aa, Cryptosporidium parvum
RPPRRKDDN

SEQ ID NO: 2224086 - protein, 26 aa, Cryptosporidium parvum
RPQGHNSATSQCTDLEASKNNNNNTI

SEQ ID NO: 2224087 - protein, 9 aa, Cryptosporidium parvum
RPRLNTNYS

SEQ ID NO: 2224088 - protein, 7 aa, Cryptosporidium parvum
RPSCGHK

SEQ ID NO: 2224089 - protein, 9 aa, Cryptosporidium parvum
RPSDEDTKI

SEQ ID NO: 2224090 - protein, 9 aa, Cryptosporidium parvum
RPSEESDSS

SEQ ID NO: 2224091 - protein, 9 aa, Cryptosporidium parvum
RPSEKEAKC

SEQ ID NO: 2224092 - protein, 5 aa, Cryptosporidium parvum
RPSHS

SEQ ID NO: 2224093 - protein, 6 aa, Cryptosporidium parvum
RPSIKQ

SEQ ID NO: 2224094 - protein, 6 aa, Cryptosporidium parvum
RPSNQL

SEQ ID NO: 2224095 - protein, 8 aa, Cryptosporidium parvum
RPSPPLPM

SEQ ID NO: 2224096 - protein, 9 aa, Cryptosporidium parvum
RPSPPLPMS

SEQ ID NO: 2224097 - protein, 4 aa, Cryptosporidium parvum
RPST

SEQ ID NO: 2224098 - protein, 5 aa, Cryptosporidium parvum
RPSTN

SEQ ID NO: 2224099 - protein, 5 aa, Cryptosporidium parvum
RQARD

SEQ ID NO: 2224100 - protein, 10 aa, Cryptosporidium parvum
RQDHSSPGIE

SEQ ID NO: 2224101 - protein, 9 aa, Cryptosporidium parvum
RQDPYSGKP

SEQ ID NO: 2224102 - protein, 6 aa, Cryptosporidium parvum
RQDSSQ

SEQ ID NO: 2224103 - protein, 10 aa, Cryptosporidium parvum
RQEENPITQS

SEQ ID NO: 2224104 - protein, 14 aa, Cryptosporidium parvum
RQEPERLDEYKPKD

SEQ ID NO: 2224105 - protein, 16 aa, Cryptosporidium parvum
RQGPLDEPAVGGDIED

SEQ ID NO: 2224106 - protein, 16 aa, Cryptosporidium parvum
RQKDKNHANSEFGEEA

SEQ ID NO: 2224107 - protein, 4 aa, Cryptosporidium parvum
RQKK

SEQ ID NO: 2224108 - protein, 8 aa, Cryptosporidium parvum
RQKRRDNE

SEQ ID NO: 2224109 - protein, 7 aa, Cryptosporidium parvum
RQKTEQA

SEQ ID NO: 2224110 - protein, 13 aa, Cryptosporidium parvum
RQLNKNEPEQDRF

SEQ ID NO: 2224111 - protein, 29 aa, Cryptosporidium parvum
RQNKKEKKRGISGVTNESQNSNFKSKSSI

SEQ ID NO: 2224112 - protein, 6 aa, Cryptosporidium parvum
RQNREG

SEQ ID NO: 2224113 - protein, 18 aa, Cryptosporidium parvum
RQNTSEVDTEFDSSKEKK

SEQ ID NO: 2224114 - protein, 5 aa, Cryptosporidium parvum
RQPRS

SEQ ID NO: 2224115 - protein, 8 aa, Cryptosporidium parvum
RQQAENNL

SEQ ID NO: 2224116 - protein, 28 aa, Cryptosporidium parvum
RQQSQRRVNQLNSSQTTNQRVSNPIDIS

SEQ ID NO: 2224117 - protein, 6 aa, Cryptosporidium parvum
RQRGDT

SEQ ID NO: 2224118 - protein, 4 aa, Cryptosporidium parvum
RQRK

SEQ ID NO: 2224119 - protein, 5 aa, Cryptosporidium parvum
RQSRI

SEQ ID NO: 2224120 - protein, 8 aa, Cryptosporidium parvum
RQSSSLKK

SEQ ID NO: 2224121 - protein, 12 aa, Cryptosporidium parvum
RQSTMGGRYGGT

SEQ ID NO: 2224122 - protein, 7 aa, Cryptosporidium parvum
RQTASNG

SEQ ID NO: 2224123 - protein, 8 aa, Cryptosporidium parvum
RQTSGPPI

SEQ ID NO: 2224124 - protein, 10 aa, Cryptosporidium parvum
RQVSDSNSSC

SEQ ID NO: 2224125 - protein, 6 aa, Cryptosporidium parvum
RQYSSK

SEQ ID NO: 2224126 - protein, 7 aa, Cryptosporidium parvum
RRAASGT

SEQ ID NO: 2224127 - protein, 10 aa, Cryptosporidium parvum
RRANSEEYGI

SEQ ID NO: 2224128 - protein, 8 aa, Cryptosporidium parvum
RRASSNQL

SEQ ID NO: 2224129 - protein, 8 aa, Cryptosporidium parvum
RRDEQDSR

SEQ ID NO: 2224130 - protein, 7 aa, Cryptosporidium parvum
RRDSVTQ

SEQ ID NO: 2224131 - protein, 6 aa, Cryptosporidium parvum
RREERD

SEQ ID NO: 2224132 - protein, 4 aa, Cryptosporidium parvum
RREK

SEQ ID NO: 2224133 - protein, 5 aa, Cryptosporidium parvum
RRESP

SEQ ID NO: 2224134 - protein, 6 aa, Cryptosporidium parvum
RRESSK

SEQ ID NO: 2224135 - protein, 4 aa, Cryptosporidium parvum
RRGP

SEQ ID NO: 2224136 - protein, 11 aa, Cryptosporidium parvum
RRGPGGKESQF

SEQ ID NO: 2224137 - protein, 6 aa, Cryptosporidium parvum
RRHSAS

SEQ ID NO: 2224138 - protein, 6 aa, Cryptosporidium parvum
RRIDED

SEQ ID NO: 2224139 - protein, 6 aa, Cryptosporidium parvum
RRISAQ

SEQ ID NO: 2224140 - protein, 20 aa, Cryptosporidium parvum
RRKGGTSNPSFKEILMDDLH

SEQ ID NO: 2224141 - protein, 10 aa, Cryptosporidium parvum
RRKGRPRKTP

SEQ ID NO: 2224142 - protein, 10 aa, Cryptosporidium parvum
RRKNRDRPQL

SEQ ID NO: 2224143 - protein, 7 aa, Cryptosporidium parvum
RRKSNSN

SEQ ID NO: 2224144 - protein, 9 aa, Cryptosporidium parvum
RRKSNSSTL

SEQ ID NO: 2224145 - protein, 24 aa, Cryptosporidium parvum
RRNGNRKESSEKNGHKEGNKNGII

SEQ ID NO: 2224146 - protein, 6 aa, Cryptosporidium parvum
RRNNYQ

SEQ ID NO: 2224147 - protein, 37 aa, Cryptosporidium parvum
RRNQTKDHLKSNSSSKSLNIDSGDKADINNEKKNKDL

SEQ ID NO: 2224148 - protein, 5 aa, Cryptosporidium parvum
RRNRS

SEQ ID NO: 2224149 - protein, 4 aa, Cryptosporidium parvum
RRPD

SEQ ID NO: 2224150 - protein, 9 aa, Cryptosporidium parvum
RRPKKKKIP

SEQ ID NO: 2224151 - protein, 5 aa, Cryptosporidium parvum
RRPKL

SEQ ID NO: 2224152 - protein, 19 aa, Cryptosporidium parvum
RRPLPAKDLPDLPETDSTN

SEQ ID NO: 2224153 - protein, 13 aa, Cryptosporidium parvum
RRPNSNPADNPDE

SEQ ID NO: 2224154 - protein, 4 aa, Cryptosporidium parvum
RRPR

SEQ ID NO: 2224155 - protein, 6 aa, Cryptosporidium parvum
RRPSSN

SEQ ID NO: 2224156 - protein, 4 aa, Cryptosporidium parvum
RRQE

SEQ ID NO: 2224157 - protein, 4 aa, Cryptosporidium parvum
RRRE

SEQ ID NO: 2224158 - protein, 39 aa, Cryptosporidium parvum
RRRFASASNTNTDELSENNDYNDDYQNLNQGNNINDYNN

SEQ ID NO: 2224159 - protein, 8 aa, Cryptosporidium parvum
RRRKPNNG

SEQ ID NO: 2224160 - protein, 12 aa, Cryptosporidium parvum
RRRNKKENETNL

SEQ ID NO: 2224161 - protein, 8 aa, Cryptosporidium parvum
RRRQSQME

SEQ ID NO: 2224162 - protein, 7 aa, Cryptosporidium parvum
RRSCSPS

SEQ ID NO: 2224163 - protein, 4 aa, Cryptosporidium parvum
RRSL

SEQ ID NO: 2224164 - protein, 59 aa, Cryptosporidium parvum
RRSRLSEGSYHSEGFSDASGTDRGKRSSVQRHTSAESRDNAAHISDGHSQSSSSAANNV

SEQ ID NO: 2224165 - protein, 16 aa, Cryptosporidium parvum
RRSRYSQLAKDELNDI

SEQ ID NO: 2224166 - protein, 13 aa, Cryptosporidium parvum
RRSSSNGDISSTQ

SEQ ID NO: 2224167 - protein, 23 aa, Cryptosporidium parvum
RRSTNDNLLPDESNSNRRNSKLR

SEQ ID NO: 2224168 - protein, 5 aa, Cryptosporidium parvum
RRSTR

SEQ ID NO: 2224169 - protein, 4 aa, Cryptosporidium parvum
RRTC

SEQ ID NO: 2224170 - protein, 58 aa, Cryptosporidium parvum
RRTPNMSKMNKDSSENSGDSTNPRKENETRKVNATSTNCTSNENISAKELEAGSNRSI

SEQ ID NO: 2224171 - protein, 7 aa, Cryptosporidium parvum
RRTQSHN

SEQ ID NO: 2224172 - protein, 5 aa, Cryptosporidium parvum
RRTSH

SEQ ID NO: 2224173 - protein, 8 aa, Cryptosporidium parvum
RRTSTSEM

SEQ ID NO: 2224174 - protein, 4 aa, Cryptosporidium parvum
RRVA

SEQ ID NO: 2224175 - protein, 6 aa, Cryptosporidium parvum
RRYPSK

SEQ ID NO: 2224176 - protein, 5 aa, Cryptosporidium parvum
RSAEI

SEQ ID NO: 2224177 - protein, 8 aa, Cryptosporidium parvum
RSAKNHSV

SEQ ID NO: 2224178 - protein, 6 aa, Cryptosporidium parvum
RSAKTN

SEQ ID NO: 2224179 - protein, 7 aa, Cryptosporidium parvum
RSAPHKM

SEQ ID NO: 2224180 - protein, 18 aa, Cryptosporidium parvum
RSDDTESAQNVDNSNKEI

SEQ ID NO: 2224181 - protein, 21 aa, Cryptosporidium parvum
RSDPNSESEQEPLEQQEQSEF

SEQ ID NO: 2224182 - protein, 10 aa, Cryptosporidium parvum
RSDRENNSGF

SEQ ID NO: 2224183 - protein, 6 aa, Cryptosporidium parvum
RSDRIR

SEQ ID NO: 2224184 - protein, 6 aa, Cryptosporidium parvum
RSDSLN

SEQ ID NO: 2224185 - protein, 5 aa, Cryptosporidium parvum
RSDSQ

SEQ ID NO: 2224186 - protein, 9 aa, Cryptosporidium parvum
RSDVNDPRP

SEQ ID NO: 2224187 - protein, 13 aa, Cryptosporidium parvum
RSECDDDSRLQPG

SEQ ID NO: 2224188 - protein, 6 aa, Cryptosporidium parvum
RSEEQI

SEQ ID NO: 2224189 - protein, 28 aa, Cryptosporidium parvum
RSEERKYQSSIKNLSQAKYTKTSNNVPD

SEQ ID NO: 2224190 - protein, 7 aa, Cryptosporidium parvum
RSEINQN

SEQ ID NO: 2224191 - protein, 5 aa, Cryptosporidium parvum
RSEKE

SEQ ID NO: 2224192 - protein, 4 aa, Cryptosporidium parvum
RSEN

SEQ ID NO: 2224193 - protein, 7 aa, Cryptosporidium parvum
RSENQEK

SEQ ID NO: 2224194 - protein, 5 aa, Cryptosporidium parvum
RSEVT

SEQ ID NO: 2224195 - protein, 9 aa, Cryptosporidium parvum
RSFNNNSPS

SEQ ID NO: 2224196 - protein, 10 aa, Cryptosporidium parvum
RSFSGTGDSV

SEQ ID NO: 2224197 - protein, 18 aa, Cryptosporidium parvum
RSFSPNSKASKGQLTNDR

SEQ ID NO: 2224198 - protein, 12 aa, Cryptosporidium parvum
RSGDQEEDETNY

SEQ ID NO: 2224199 - protein, 5 aa, Cryptosporidium parvum
RSGKH

SEQ ID NO: 2224200 - protein, 6 aa, Cryptosporidium parvum
RSGPEI

SEQ ID NO: 2224201 - protein, 7 aa, Cryptosporidium parvum
RSGSGKT

SEQ ID NO: 2224202 - protein, 4 aa, Cryptosporidium parvum
RSIE

SEQ ID NO: 2224203 - protein, 5 aa, Cryptosporidium parvum
RSIND

SEQ ID NO: 2224204 - protein, 7 aa, Cryptosporidium parvum
RSINDKS

SEQ ID NO: 2224205 - protein, 8 aa, Cryptosporidium parvum
RSIPDGVS

SEQ ID NO: 2224206 - protein, 8 aa, Cryptosporidium parvum
RSIPNTNN

SEQ ID NO: 2224207 - protein, 17 aa, Cryptosporidium parvum
RSISGSATQGGPSTTER

SEQ ID NO: 2224208 - protein, 7 aa, Cryptosporidium parvum
RSISSLK

SEQ ID NO: 2224209 - protein, 8 aa, Cryptosporidium parvum
RSKEERRG

SEQ ID NO: 2224210 - protein, 7 aa, Cryptosporidium parvum
RSKFSKN

SEQ ID NO: 2224211 - protein, 6 aa, Cryptosporidium parvum
RSKITP

SEQ ID NO: 2224212 - protein, 14 aa, Cryptosporidium parvum
RSKLEESKKVRSSD

SEQ ID NO: 2224213 - protein, 6 aa, Cryptosporidium parvum
RSKNGE

SEQ ID NO: 2224214 - protein, 13 aa, Cryptosporidium parvum
RSKNKSNTGNIEE

SEQ ID NO: 2224215 - protein, 10 aa, Cryptosporidium parvum
RSKNVKGDYE

SEQ ID NO: 2224216 - protein, 8 aa, Cryptosporidium parvum
RSKNVNED

SEQ ID NO: 2224217 - protein, 6 aa, Cryptosporidium parvum
RSKQYL

SEQ ID NO: 2224218 - protein, 6 aa, Cryptosporidium parvum
RSKSGW

SEQ ID NO: 2224219 - protein, 6 aa, Cryptosporidium parvum
RSKSSH

SEQ ID NO: 2224220 - protein, 8 aa, Cryptosporidium parvum
RSKTIQKK

SEQ ID NO: 2224221 - protein, 7 aa, Cryptosporidium parvum
RSKTNTF

SEQ ID NO: 2224222 - protein, 7 aa, Cryptosporidium parvum
RSKYAKD

SEQ ID NO: 2224223 - protein, 8 aa, Cryptosporidium parvum
RSLGKGYA

SEQ ID NO: 2224224 - protein, 5 aa, Cryptosporidium parvum
RSLGN

SEQ ID NO: 2224225 - protein, 6 aa, Cryptosporidium parvum
RSLNKE

SEQ ID NO: 2224226 - protein, 7 aa, Cryptosporidium parvum
RSLPGGK

SEQ ID NO: 2224227 - protein, 4 aa, Cryptosporidium parvum
RSLS

SEQ ID NO: 2224228 - protein, 6 aa, Cryptosporidium parvum
RSNENM

SEQ ID NO: 2224229 - protein, 14 aa, Cryptosporidium parvum
RSNETKTTEPSANT

SEQ ID NO: 2224230 - protein, 5 aa, Cryptosporidium parvum
RSNHE

SEQ ID NO: 2224231 - protein, 5 aa, Cryptosporidium parvum
RSNKA

SEQ ID NO: 2224232 - protein, 6 aa, Cryptosporidium parvum
RSNPEH

SEQ ID NO: 2224233 - protein, 15 aa, Cryptosporidium parvum
RSNSSSSYIQGKLIS

SEQ ID NO: 2224234 - protein, 4 aa, Cryptosporidium parvum
RSPI

SEQ ID NO: 2224235 - protein, 14 aa, Cryptosporidium parvum
RSPKTIPSETKQNK

SEQ ID NO: 2224236 - protein, 7 aa, Cryptosporidium parvum
RSPLKSS

SEQ ID NO: 2224237 - protein, 11 aa, Cryptosporidium parvum
RSPNKLKNINQ

SEQ ID NO: 2224238 - protein, 21 aa, Cryptosporidium parvum
RSPNWTSDNHLGSNSKEVVSS

SEQ ID NO: 2224239 - protein, 6 aa, Cryptosporidium parvum
RSPRIR

SEQ ID NO: 2224240 - protein, 4 aa, Cryptosporidium parvum
RSPS

SEQ ID NO: 2224241 - protein, 6 aa, Cryptosporidium parvum
RSPSDH

SEQ ID NO: 2224242 - protein, 11 aa, Cryptosporidium parvum
RSPSNSGKKLD

SEQ ID NO: 2224243 - protein, 7 aa, Cryptosporidium parvum
RSQASEN

SEQ ID NO: 2224244 - protein, 4 aa, Cryptosporidium parvum
RSQD

SEQ ID NO: 2224245 - protein, 9 aa, Cryptosporidium parvum
RSQLEDNAD

SEQ ID NO: 2224246 - protein, 21 aa, Cryptosporidium parvum
RSQPSFSSNSYSTNPKPSGSC

SEQ ID NO: 2224247 - protein, 5 aa, Cryptosporidium parvum
RSQVS

SEQ ID NO: 2224248 - protein, 5 aa, Cryptosporidium parvum
RSQYN

SEQ ID NO: 2224249 - protein, 15 aa, Cryptosporidium parvum
RSRDDELKASTSENS

SEQ ID NO: 2224250 - protein, 14 aa, Cryptosporidium parvum
RSRPANKIKKYPVD

SEQ ID NO: 2224251 - protein, 13 aa, Cryptosporidium parvum
RSRSGYSQSNQVQ

SEQ ID NO: 2224252 - protein, 4 aa, Cryptosporidium parvum
RSRT

SEQ ID NO: 2224253 - protein, 14 aa, Cryptosporidium parvum
RSRTKIKSERKDAN

SEQ ID NO: 2224254 - protein, 8 aa, Cryptosporidium parvum
RSSALNSK

SEQ ID NO: 2224255 - protein, 4 aa, Cryptosporidium parvum
RSSD

SEQ ID NO: 2224256 - protein, 12 aa, Cryptosporidium parvum
RSSGETDTYENS

SEQ ID NO: 2224257 - protein, 4 aa, Cryptosporidium parvum
RSSK

SEQ ID NO: 2224258 - protein, 5 aa, Cryptosporidium parvum
RSSKT

SEQ ID NO: 2224259 - protein, 6 aa, Cryptosporidium parvum
RSSMTD

SEQ ID NO: 2224260 - protein, 8 aa, Cryptosporidium parvum
RSSNEIEN

SEQ ID NO: 2224261 - protein, 5 aa, Cryptosporidium parvum
RSSNM

SEQ ID NO: 2224262 - protein, 6 aa, Cryptosporidium parvum
RSSNRF

SEQ ID NO: 2224263 - protein, 7 aa, Cryptosporidium parvum
RSSPPKR

SEQ ID NO: 2224264 - protein, 6 aa, Cryptosporidium parvum
RSSREL

SEQ ID NO: 2224265 - protein, 9 aa, Cryptosporidium parvum
RSSRRTSFP

SEQ ID NO: 2224266 - protein, 7 aa, Cryptosporidium parvum
RSSSRQV

SEQ ID NO: 2224267 - protein, 6 aa, Cryptosporidium parvum
RSSTHN

SEQ ID NO: 2224268 - protein, 8 aa, Cryptosporidium parvum
RSSVTSSK

SEQ ID NO: 2224269 - protein, 12 aa, Cryptosporidium parvum
RSTGNNNNNSGL

SEQ ID NO: 2224270 - protein, 4 aa, Cryptosporidium parvum
RSTI

SEQ ID NO: 2224271 - protein, 4 aa, Cryptosporidium parvum
RSTL

SEQ ID NO: 2224272 - protein, 7 aa, Cryptosporidium parvum
RSTNDLN

SEQ ID NO: 2224273 - protein, 9 aa, Cryptosporidium parvum
RSTPSRASM

SEQ ID NO: 2224274 - protein, 6 aa, Cryptosporidium parvum
RSTQLR

SEQ ID NO: 2224275 - protein, 7 aa, Cryptosporidium parvum
RSTSEEE

SEQ ID NO: 2224276 - protein, 13 aa, Cryptosporidium parvum
RSVNENQGSFEDR

SEQ ID NO: 2224277 - protein, 7 aa, Cryptosporidium parvum
RSYENGD

SEQ ID NO: 2224278 - protein, 8 aa, Cryptosporidium parvum
RSYNSNYT

SEQ ID NO: 2224279 - protein, 8 aa, Cryptosporidium parvum
RTAENNDL

SEQ ID NO: 2224280 - protein, 4 aa, Cryptosporidium parvum
RTAI

SEQ ID NO: 2224281 - protein, 9 aa, Cryptosporidium parvum
RTAQDRPKP

SEQ ID NO: 2224282 - protein, 4 aa, Cryptosporidium parvum
RTAS

SEQ ID NO: 2224283 - protein, 7 aa, Cryptosporidium parvum
RTATGEC

SEQ ID NO: 2224284 - protein, 4 aa, Cryptosporidium parvum
RTAY

SEQ ID NO: 2224285 - protein, 5 aa, Cryptosporidium parvum
RTCST

SEQ ID NO: 2224286 - protein, 4 aa, Cryptosporidium parvum
RTDY

SEQ ID NO: 2224287 - protein, 6 aa, Cryptosporidium parvum
RTENEN

SEQ ID NO: 2224288 - protein, 6 aa, Cryptosporidium parvum
RTEPRH

SEQ ID NO: 2224289 - protein, 6 aa, Cryptosporidium parvum
RTETGK

SEQ ID NO: 2224290 - protein, 9 aa, Cryptosporidium parvum
RTGAGKSSL

SEQ ID NO: 2224291 - protein, 5 aa, Cryptosporidium parvum
RTGPY

SEQ ID NO: 2224292 - protein, 7 aa, Cryptosporidium parvum
RTGSATL

SEQ ID NO: 2224293 - protein, 8 aa, Cryptosporidium parvum
RTGSGKSS

SEQ ID NO: 2224294 - protein, 9 aa, Cryptosporidium parvum
RTGSGKSSL

SEQ ID NO: 2224295 - protein, 8 aa, Cryptosporidium parvum
RTGSGKST

SEQ ID NO: 2224296 - protein, 14 aa, Cryptosporidium parvum
RTGSSNRNFKTSSS

SEQ ID NO: 2224297 - protein, 5 aa, Cryptosporidium parvum
RTGYE

SEQ ID NO: 2224298 - protein, 4 aa, Cryptosporidium parvum
RTHH

SEQ ID NO: 2224299 - protein, 4 aa, Cryptosporidium parvum
RTHT

SEQ ID NO: 2224300 - protein, 13 aa, Cryptosporidium parvum
RTISRNNISNSIN

SEQ ID NO: 2224301 - protein, 4 aa, Cryptosporidium parvum
RTKL

SEQ ID NO: 2224302 - protein, 14 aa, Cryptosporidium parvum
RTLKEQKVKENDTH

SEQ ID NO: 2224303 - protein, 5 aa, Cryptosporidium parvum
RTLPS

SEQ ID NO: 2224304 - protein, 5 aa, Cryptosporidium parvum
RTLRR

SEQ ID NO: 2224305 - protein, 7 aa, Cryptosporidium parvum
RTMDPQQ

SEQ ID NO: 2224306 - protein, 6 aa, Cryptosporidium parvum
RTMRKK

SEQ ID NO: 2224307 - protein, 6 aa, Cryptosporidium parvum
RTNGRS

SEQ ID NO: 2224308 - protein, 11 aa, Cryptosporidium parvum
RTNIENSNTTI

SEQ ID NO: 2224309 - protein, 5 aa, Cryptosporidium parvum
RTNKS

SEQ ID NO: 2224310 - protein, 15 aa, Cryptosporidium parvum
RTNSFSKGNALKVML

SEQ ID NO: 2224311 - protein, 7 aa, Cryptosporidium parvum
RTNSQSS

SEQ ID NO: 2224312 - protein, 4 aa, Cryptosporidium parvum
RTNT

SEQ ID NO: 2224313 - protein, 7 aa, Cryptosporidium parvum
RTPLPED

SEQ ID NO: 2224314 - protein, 6 aa, Cryptosporidium parvum
RTPPGA

SEQ ID NO: 2224315 - protein, 6 aa, Cryptosporidium parvum
RTPPSL

SEQ ID NO: 2224316 - protein, 10 aa, Cryptosporidium parvum
RTPRKASNNI

SEQ ID NO: 2224317 - protein, 13 aa, Cryptosporidium parvum
RTPSISTVSHPSA

SEQ ID NO: 2224318 - protein, 16 aa, Cryptosporidium parvum
RTPVKKRYNKEYSFTQ

SEQ ID NO: 2224319 - protein, 4 aa, Cryptosporidium parvum
RTRN

SEQ ID NO: 2224320 - protein, 5 aa, Cryptosporidium parvum
RTRSG

SEQ ID NO: 2224321 - protein, 11 aa, Cryptosporidium parvum
RTSDKKETTSS

SEQ ID NO: 2224322 - protein, 5 aa, Cryptosporidium parvum
RTSEA

SEQ ID NO: 2224323 - protein, 16 aa, Cryptosporidium parvum
RTSHSDSQATGGGSGS

SEQ ID NO: 2224324 - protein, 25 aa, Cryptosporidium parvum
RTSKETLGSKSSCSEYTRKHKANGE

SEQ ID NO: 2224325 - protein, 6 aa, Cryptosporidium parvum
RTSLGQ

SEQ ID NO: 2224326 - protein, 7 aa, Cryptosporidium parvum
RTSPTSK

SEQ ID NO: 2224327 - protein, 16 aa, Cryptosporidium parvum
RTSTKKNDNQKKRRQH

SEQ ID NO: 2224328 - protein, 12 aa, Cryptosporidium parvum
RTTIGKSSLERY

SEQ ID NO: 2224329 - protein, 7 aa, Cryptosporidium parvum
RTTIQSR

SEQ ID NO: 2224330 - protein, 17 aa, Cryptosporidium parvum
RTTTTTTTTSDNDKITS

SEQ ID NO: 2224331 - protein, 9 aa, Cryptosporidium parvum
RVDTGPLDE

SEQ ID NO: 2224332 - protein, 11 aa, Cryptosporidium parvum
RVEKEEDYEEL

SEQ ID NO: 2224333 - protein, 29 aa, Cryptosporidium parvum
RVEQSTNDENISGFSENKTKQYSTELSEG

SEQ ID NO: 2224334 - protein, 4 aa, Cryptosporidium parvum
RVEY

SEQ ID NO: 2224335 - protein, 10 aa, Cryptosporidium parvum
RVKHTPGSEI

SEQ ID NO: 2224336 - protein, 19 aa, Cryptosporidium parvum
RVLGQEKETVKQKTSSVAA

SEQ ID NO: 2224337 - protein, 5 aa, Cryptosporidium parvum
RVPDQ

SEQ ID NO: 2224338 - protein, 5 aa, Cryptosporidium parvum
RVPGM

SEQ ID NO: 2224339 - protein, 7 aa, Cryptosporidium parvum
RVPPRKV

SEQ ID NO: 2224340 - protein, 5 aa, Cryptosporidium parvum
RVPVT

SEQ ID NO: 2224341 - protein, 30 aa, Cryptosporidium parvum
RVQRGGGGIGSGSSSGLRSDDGQKETSGSF

SEQ ID NO: 2224342 - protein, 14 aa, Cryptosporidium parvum
RVRSEKKVTKGASI

SEQ ID NO: 2224343 - protein, 6 aa, Cryptosporidium parvum
RVSEGS

SEQ ID NO: 2224344 - protein, 10 aa, Cryptosporidium parvum
RVTYNKGTKL

SEQ ID NO: 2224345 - protein, 5 aa, Cryptosporidium parvum
RWSEP

SEQ ID NO: 2224346 - protein, 4 aa, Cryptosporidium parvum
RYAS

SEQ ID NO: 2224347 - protein, 4 aa, Cryptosporidium parvum
RYEE

SEQ ID NO: 2224348 - protein, 9 aa, Cryptosporidium parvum
RYEQQEKAP

SEQ ID NO: 2224349 - protein, 35 aa, Cryptosporidium parvum
RYGESSKSKPISEYESSINETNSRKISKNDTFSDF

SEQ ID NO: 2224350 - protein, 5 aa, Cryptosporidium parvum
RYGWG

SEQ ID NO: 2224351 - protein, 19 aa, Cryptosporidium parvum
RYNNSSGANRSEKEKPKRY

SEQ ID NO: 2224352 - protein, 9 aa, Cryptosporidium parvum
RYSHGQSSA

SEQ ID NO: 2224353 - protein, 11 aa, Cryptosporidium parvum
RYTTSNKGNHL

SEQ ID NO: 2224354 - protein, 7 aa, Cryptosporidium parvum
SAAANSV

SEQ ID NO: 2224355 - protein, 4 aa, Cryptosporidium parvum
SAAS

SEQ ID NO: 2224356 - protein, 9 aa, Cryptosporidium parvum
SADHNLGPI

SEQ ID NO: 2224357 - protein, 20 aa, Cryptosporidium parvum
SADTIEQVNNNKESDKPTVN

SEQ ID NO: 2224358 - protein, 7 aa, Cryptosporidium parvum
SAEDNLS

SEQ ID NO: 2224359 - protein, 7 aa, Cryptosporidium parvum
SAEGGRT

SEQ ID NO: 2224360 - protein, 7 aa, Cryptosporidium parvum
SAEKLAQ

SEQ ID NO: 2224361 - protein, 5 aa, Cryptosporidium parvum
SAEKR

SEQ ID NO: 2224362 - protein, 7 aa, Cryptosporidium parvum
SAENKMP

SEQ ID NO: 2224363 - protein, 4 aa, Cryptosporidium parvum
SAEQ

SEQ ID NO: 2224364 - protein, 9 aa, Cryptosporidium parvum
SAESAIPQD

SEQ ID NO: 2224365 - protein, 4 aa, Cryptosporidium parvum
SAFS

SEQ ID NO: 2224366 - protein, 10 aa, Cryptosporidium parvum
SAFSTGSYTS

SEQ ID NO: 2224367 - protein, 11 aa, Cryptosporidium parvum
SAGAPIAGSAV

SEQ ID NO: 2224368 - protein, 6 aa, Cryptosporidium parvum
SAGFPN

SEQ ID NO: 2224369 - protein, 6 aa, Cryptosporidium parvum
SAGGEY

SEQ ID NO: 2224370 - protein, 8 aa, Cryptosporidium parvum
SAGGGGGI

SEQ ID NO: 2224371 - protein, 5 aa, Cryptosporidium parvum
SAGGN

SEQ ID NO: 2224372 - protein, 13 aa, Cryptosporidium parvum
SAGGVASAGSFSL

SEQ ID NO: 2224373 - protein, 6 aa, Cryptosporidium parvum
SAGKST

SEQ ID NO: 2224374 - protein, 10 aa, Cryptosporidium parvum
SAGQKELGSE

SEQ ID NO: 2224375 - protein, 4 aa, Cryptosporidium parvum
SAGS

SEQ ID NO: 2224376 - protein, 6 aa, Cryptosporidium parvum
SAGSLS

SEQ ID NO: 2224377 - protein, 6 aa, Cryptosporidium parvum
SAGVPQ

SEQ ID NO: 2224378 - protein, 9 aa, Cryptosporidium parvum
SAHDSSSGD

SEQ ID NO: 2224379 - protein, 7 aa, Cryptosporidium parvum
SAIGGKD

SEQ ID NO: 2224380 - protein, 9 aa, Cryptosporidium parvum
SAIGKSARK

SEQ ID NO: 2224381 - protein, 4 aa, Cryptosporidium parvum
SAIM

SEQ ID NO: 2224382 - protein, 10 aa, Cryptosporidium parvum
SAIPGHGGIT

SEQ ID NO: 2224383 - protein, 5 aa, Cryptosporidium parvum
SAISN

SEQ ID NO: 2224384 - protein, 12 aa, Cryptosporidium parvum
SAISQSDRESVE

SEQ ID NO: 2224385 - protein, 80 aa, Cryptosporidium parvum
SAISSQLSSGSSSGSSSSAPPPPTPSSPSSSSSSPSSKPQKPSKKPEKPKKSPKASSPKVKKKKEEPDYTQGDSESYSME

SEQ ID NO: 2224386 - protein, 7 aa, Cryptosporidium parvum
SAITSKA

SEQ ID NO: 2224387 - protein, 15 aa, Cryptosporidium parvum
SAKEVTSNYNESYEN

SEQ ID NO: 2224388 - protein, 6 aa, Cryptosporidium parvum
SAKNVY

SEQ ID NO: 2224389 - protein, 9 aa, Cryptosporidium parvum
SAKSSSKIH

SEQ ID NO: 2224390 - protein, 5 aa, Cryptosporidium parvum
SAKVS

SEQ ID NO: 2224391 - protein, 5 aa, Cryptosporidium parvum
SAKYS

SEQ ID NO: 2224392 - protein, 6 aa, Cryptosporidium parvum
SALEGA

SEQ ID NO: 2224393 - protein, 6 aa, Cryptosporidium parvum
SALTGL

SEQ ID NO: 2224394 - protein, 20 aa, Cryptosporidium parvum
SANDSANANNSVSANINGSI

SEQ ID NO: 2224395 - protein, 10 aa, Cryptosporidium parvum
SANKNEKAVG

SEQ ID NO: 2224396 - protein, 6 aa, Cryptosporidium parvum
SANNTD

SEQ ID NO: 2224397 - protein, 4 aa, Cryptosporidium parvum
SANR

SEQ ID NO: 2224398 - protein, 11 aa, Cryptosporidium parvum
SANSKTASKDK

SEQ ID NO: 2224399 - protein, 10 aa, Cryptosporidium parvum
SANSSNCKLS

SEQ ID NO: 2224400 - protein, 4 aa, Cryptosporidium parvum
SAPE

SEQ ID NO: 2224401 - protein, 5 aa, Cryptosporidium parvum
SAPLR

SEQ ID NO: 2224402 - protein, 16 aa, Cryptosporidium parvum
SAPNHCSKNCTEKGKC

SEQ ID NO: 2224403 - protein, 6 aa, Cryptosporidium parvum
SAPQVP

SEQ ID NO: 2224404 - protein, 21 aa, Cryptosporidium parvum
SAPSGDNNNNNSQNQSSKEYC

SEQ ID NO: 2224405 - protein, 16 aa, Cryptosporidium parvum
SAPSKQSYENSDITPE

SEQ ID NO: 2224406 - protein, 12 aa, Cryptosporidium parvum
SAQESEDTGNDI

SEQ ID NO: 2224407 - protein, 12 aa, Cryptosporidium parvum
SAQRTTSEEGRF

SEQ ID NO: 2224408 - protein, 5 aa, Cryptosporidium parvum
SAQTS

SEQ ID NO: 2224409 - protein, 8 aa, Cryptosporidium parvum
SAQTTLKE

SEQ ID NO: 2224410 - protein, 10 aa, Cryptosporidium parvum
SARKGAPLSE

SEQ ID NO: 2224411 - protein, 13 aa, Cryptosporidium parvum
SARLPSDRARETE

SEQ ID NO: 2224412 - protein, 9 aa, Cryptosporidium parvum
SARRNSVPR

SEQ ID NO: 2224413 - protein, 21 aa, Cryptosporidium parvum
SARRNTESRATVTSIPGPSRR

SEQ ID NO: 2224414 - protein, 12 aa, Cryptosporidium parvum
SASASPSVSTSL

SEQ ID NO: 2224415 - protein, 8 aa, Cryptosporidium parvum
SASCDGGL

SEQ ID NO: 2224416 - protein, 4 aa, Cryptosporidium parvum
SASE

SEQ ID NO: 2224417 - protein, 16 aa, Cryptosporidium parvum
SASELTTKVTLNTSNS

SEQ ID NO: 2224418 - protein, 17 aa, Cryptosporidium parvum
SASESLLSQKSAPIDPA

SEQ ID NO: 2224419 - protein, 16 aa, Cryptosporidium parvum
SASGTIPKQSSLYPGN

SEQ ID NO: 2224420 - protein, 7 aa, Cryptosporidium parvum
SASKAYE

SEQ ID NO: 2224421 - protein, 17 aa, Cryptosporidium parvum
SASNNAKTSRGEDNDLS

SEQ ID NO: 2224422 - protein, 7 aa, Cryptosporidium parvum
SASSASA

SEQ ID NO: 2224423 - protein, 5 aa, Cryptosporidium parvum
SASSI

SEQ ID NO: 2224424 - protein, 24 aa, Cryptosporidium parvum
SASSTSPKTNTSFSSNKRNSTLYE

SEQ ID NO: 2224425 - protein, 6 aa, Cryptosporidium parvum
SASSVY

SEQ ID NO: 2224426 - protein, 19 aa, Cryptosporidium parvum
SASYSSSQLGAQPASGSKH

SEQ ID NO: 2224427 - protein, 5 aa, Cryptosporidium parvum
SATDP

SEQ ID NO: 2224428 - protein, 5 aa, Cryptosporidium parvum
SATEV

SEQ ID NO: 2224429 - protein, 16 aa, Cryptosporidium parvum
SATKSIGNDDLEKKLK

SEQ ID NO: 2224430 - protein, 11 aa, Cryptosporidium parvum
SATNKQLENNH

SEQ ID NO: 2224431 - protein, 5 aa, Cryptosporidium parvum
SATNS

SEQ ID NO: 2224432 - protein, 6 aa, Cryptosporidium parvum
SATNSG

SEQ ID NO: 2224433 - protein, 7 aa, Cryptosporidium parvum
SATNYCT

SEQ ID NO: 2224434 - protein, 34 aa, Cryptosporidium parvum
SATSLTSSQISKVEEQPDTSKDEENIANSGKYIP

SEQ ID NO: 2224435 - protein, 8 aa, Cryptosporidium parvum
SAVEETQS

SEQ ID NO: 2224436 - protein, 22 aa, Cryptosporidium parvum
SAVNQDGRSASLTAPNGPAQQK

SEQ ID NO: 2224437 - protein, 7 aa, Cryptosporidium parvum
SAVSGSP

SEQ ID NO: 2224438 - protein, 45 aa, Cryptosporidium parvum
SAVSTDQSTFGNSSYVSPPINSTKASRNDTSSSDSSDTDDEKNPL

SEQ ID NO: 2224439 - protein, 16 aa, Cryptosporidium parvum
SAVSTGIQSATGSPLV

SEQ ID NO: 2224440 - protein, 8 aa, Cryptosporidium parvum
SAVTGDKN

SEQ ID NO: 2224441 - protein, 5 aa, Cryptosporidium parvum
SAYEH

SEQ ID NO: 2224442 - protein, 5 aa, Cryptosporidium parvum
SAYEK

SEQ ID NO: 2224443 - protein, 5 aa, Cryptosporidium parvum
SAYGA

SEQ ID NO: 2224444 - protein, 8 aa, Cryptosporidium parvum
SCASQNHS

SEQ ID NO: 2224445 - protein, 28 aa, Cryptosporidium parvum
SCDDSMYSTSTGFPSCDGSSKSSRNYNS

SEQ ID NO: 2224446 - protein, 10 aa, Cryptosporidium parvum
SCDKEYSYEN

SEQ ID NO: 2224447 - protein, 7 aa, Cryptosporidium parvum
SCDNNDE

SEQ ID NO: 2224448 - protein, 4 aa, Cryptosporidium parvum
SCDP

SEQ ID NO: 2224449 - protein, 11 aa, Cryptosporidium parvum
SCDRESGSCKN

SEQ ID NO: 2224450 - protein, 8 aa, Cryptosporidium parvum
SCENGKEY

SEQ ID NO: 2224451 - protein, 5 aa, Cryptosporidium parvum
SCGDS

SEQ ID NO: 2224452 - protein, 9 aa, Cryptosporidium parvum
SCGGGARSR

SEQ ID NO: 2224453 - protein, 8 aa, Cryptosporidium parvum
SCGNTKKR

SEQ ID NO: 2224454 - protein, 9 aa, Cryptosporidium parvum
SCGTPGNIT

SEQ ID NO: 2224455 - protein, 6 aa, Cryptosporidium parvum
SCHNSK

SEQ ID NO: 2224456 - protein, 4 aa, Cryptosporidium parvum
SCKE

SEQ ID NO: 2224457 - protein, 5 aa, Cryptosporidium parvum
SCKEY

SEQ ID NO: 2224458 - protein, 5 aa, Cryptosporidium parvum
SCKKT

SEQ ID NO: 2224459 - protein, 21 aa, Cryptosporidium parvum
SCKTCKEAFGRKEKCKTISNT

SEQ ID NO: 2224460 - protein, 22 aa, Cryptosporidium parvum
SCNDGIKNGDETGIDCGGSSCR

SEQ ID NO: 2224461 - protein, 5 aa, Cryptosporidium parvum
SCNPV

SEQ ID NO: 2224462 - protein, 4 aa, Cryptosporidium parvum
SCPK

SEQ ID NO: 2224463 - protein, 13 aa, Cryptosporidium parvum
SCPSTKLKPVDKI

SEQ ID NO: 2224464 - protein, 6 aa, Cryptosporidium parvum
SCQDRN

SEQ ID NO: 2224465 - protein, 17 aa, Cryptosporidium parvum
SCSNTEWHEPKNNNNFV

SEQ ID NO: 2224466 - protein, 4 aa, Cryptosporidium parvum
SCSS

SEQ ID NO: 2224467 - protein, 5 aa, Cryptosporidium parvum
SCTQT

SEQ ID NO: 2224468 - protein, 25 aa, Cryptosporidium parvum
SDAEKRKNYDTFGEDGPPMHSASGD

SEQ ID NO: 2224469 - protein, 37 aa, Cryptosporidium parvum
SDAKESESNLTEVKNTQDSEDSSKKPESLDDGASSEA

SEQ ID NO: 2224470 - protein, 18 aa, Cryptosporidium parvum
SDALHSSGYNPKNISNSN

SEQ ID NO: 2224471 - protein, 11 aa, Cryptosporidium parvum
SDCESKSSDCT

SEQ ID NO: 2224472 - protein, 11 aa, Cryptosporidium parvum
SDDDLSPEEVN

SEQ ID NO: 2224473 - protein, 19 aa, Cryptosporidium parvum
SDDGSGRGAAILASTTVNT

SEQ ID NO: 2224474 - protein, 4 aa, Cryptosporidium parvum
SDDI

SEQ ID NO: 2224475 - protein, 7 aa, Cryptosporidium parvum
SDDNKRA

SEQ ID NO: 2224476 - protein, 5 aa, Cryptosporidium parvum
SDDNL

SEQ ID NO: 2224477 - protein, 4 aa, Cryptosporidium parvum
SDDP

SEQ ID NO: 2224478 - protein, 10 aa, Cryptosporidium parvum
SDDQSGTNVD

SEQ ID NO: 2224479 - protein, 9 aa, Cryptosporidium parvum
SDDRTEYPD

SEQ ID NO: 2224480 - protein, 12 aa, Cryptosporidium parvum
SDDSGFQPSDST

SEQ ID NO: 2224481 - protein, 8 aa, Cryptosporidium parvum
SDDSQKSL

SEQ ID NO: 2224482 - protein, 8 aa, Cryptosporidium parvum
SDDVTNYD

SEQ ID NO: 2224483 - protein, 8 aa, Cryptosporidium parvum
SDEDISHN

SEQ ID NO: 2224484 - protein, 10 aa, Cryptosporidium parvum
SDEDLQKRLN

SEQ ID NO: 2224485 - protein, 13 aa, Cryptosporidium parvum
SDEEPELEEPRKE

SEQ ID NO: 2224486 - protein, 11 aa, Cryptosporidium parvum
SDEIKQDISEE

SEQ ID NO: 2224487 - protein, 4 aa, Cryptosporidium parvum
SDEK

SEQ ID NO: 2224488 - protein, 8 aa, Cryptosporidium parvum
SDEKKQNT

SEQ ID NO: 2224489 - protein, 17 aa, Cryptosporidium parvum
SDENDSSGTCTEKPTGQ

SEQ ID NO: 2224490 - protein, 13 aa, Cryptosporidium parvum
SDENSVKSNPDVP

SEQ ID NO: 2224491 - protein, 19 aa, Cryptosporidium parvum
SDEQENEGEGMEFDGDKND

SEQ ID NO: 2224492 - protein, 10 aa, Cryptosporidium parvum
SDESIENQTI

SEQ ID NO: 2224493 - protein, 4 aa, Cryptosporidium parvum
SDET

SEQ ID NO: 2224494 - protein, 7 aa, Cryptosporidium parvum
SDEVPDF

SEQ ID NO: 2224495 - protein, 6 aa, Cryptosporidium parvum
SDFPPF

SEQ ID NO: 2224496 - protein, 5 aa, Cryptosporidium parvum
SDFSN

SEQ ID NO: 2224497 - protein, 11 aa, Cryptosporidium parvum
SDFSQDLGPQM

SEQ ID NO: 2224498 - protein, 8 aa, Cryptosporidium parvum
SDFSTEAS

SEQ ID NO: 2224499 - protein, 12 aa, Cryptosporidium parvum
SDGENNSVDGLS

SEQ ID NO: 2224500 - protein, 5 aa, Cryptosporidium parvum
SDGIN

SEQ ID NO: 2224501 - protein, 7 aa, Cryptosporidium parvum
SDGNSSI

SEQ ID NO: 2224502 - protein, 8 aa, Cryptosporidium parvum
SDGPTISP

SEQ ID NO: 2224503 - protein, 4 aa, Cryptosporidium parvum
SDGS

SEQ ID NO: 2224504 - protein, 5 aa, Cryptosporidium parvum
SDGSS

SEQ ID NO: 2224505 - protein, 23 aa, Cryptosporidium parvum
SDGSSDSCKITTRPRSSSSLPSV

SEQ ID NO: 2224506 - protein, 16 aa, Cryptosporidium parvum
SDHSEGAKESCEQKNL

SEQ ID NO: 2224507 - protein, 6 aa, Cryptosporidium parvum
SDIDTT

SEQ ID NO: 2224508 - protein, 8 aa, Cryptosporidium parvum
SDIEIPQE

SEQ ID NO: 2224509 - protein, 10 aa, Cryptosporidium parvum
SDIKDKSRKG

SEQ ID NO: 2224510 - protein, 7 aa, Cryptosporidium parvum
SDISGQS

SEQ ID NO: 2224511 - protein, 11 aa, Cryptosporidium parvum
SDISVSEKKNK

SEQ ID NO: 2224512 - protein, 8 aa, Cryptosporidium parvum
SDKDESTV

SEQ ID NO: 2224513 - protein, 8 aa, Cryptosporidium parvum
SDKEAENS

SEQ ID NO: 2224514 - protein, 7 aa, Cryptosporidium parvum
SDKISNN

SEQ ID NO: 2224515 - protein, 14 aa, Cryptosporidium parvum
SDKNNLKKYSTIEK

SEQ ID NO: 2224516 - protein, 5 aa, Cryptosporidium parvum
SDKSM

SEQ ID NO: 2224517 - protein, 5 aa, Cryptosporidium parvum
SDKTY

SEQ ID NO: 2224518 - protein, 13 aa, Cryptosporidium parvum
SDKYSGRHQIDNP

SEQ ID NO: 2224519 - protein, 6 aa, Cryptosporidium parvum
SDLETK

SEQ ID NO: 2224520 - protein, 4 aa, Cryptosporidium parvum
SDLG

SEQ ID NO: 2224521 - protein, 8 aa, Cryptosporidium parvum
SDLRKGNL

SEQ ID NO: 2224522 - protein, 4 aa, Cryptosporidium parvum
SDLS

SEQ ID NO: 2224523 - protein, 8 aa, Cryptosporidium parvum
SDLSKSNY

SEQ ID NO: 2224524 - protein, 8 aa, Cryptosporidium parvum
SDLSSSTM

SEQ ID NO: 2224525 - protein, 6 aa, Cryptosporidium parvum
SDLTSF

SEQ ID NO: 2224526 - protein, 5 aa, Cryptosporidium parvum
SDNER

SEQ ID NO: 2224527 - protein, 8 aa, Cryptosporidium parvum
SDNETNKL

SEQ ID NO: 2224528 - protein, 8 aa, Cryptosporidium parvum
SDNFEKSK

SEQ ID NO: 2224529 - protein, 12 aa, Cryptosporidium parvum
SDNGEEVIIDDQ

SEQ ID NO: 2224530 - protein, 4 aa, Cryptosporidium parvum
SDNI

SEQ ID NO: 2224531 - protein, 8 aa, Cryptosporidium parvum
SDNKNKRT

SEQ ID NO: 2224532 - protein, 7 aa, Cryptosporidium parvum
SDNKRYL

SEQ ID NO: 2224533 - protein, 11 aa, Cryptosporidium parvum
SDNLTSNRNAE

SEQ ID NO: 2224534 - protein, 6 aa, Cryptosporidium parvum
SDNNGS

SEQ ID NO: 2224535 - protein, 20 aa, Cryptosporidium parvum
SDNNRESFSEYNGSDTEMEG

SEQ ID NO: 2224536 - protein, 7 aa, Cryptosporidium parvum
SDNPYQT

SEQ ID NO: 2224537 - protein, 4 aa, Cryptosporidium parvum
SDNS

SEQ ID NO: 2224538 - protein, 11 aa, Cryptosporidium parvum
SDNSNKAKKVT

SEQ ID NO: 2224539 - protein, 11 aa, Cryptosporidium parvum
SDNSNNKEQTE

SEQ ID NO: 2224540 - protein, 14 aa, Cryptosporidium parvum
SDNTSELNDTLNSN

SEQ ID NO: 2224541 - protein, 7 aa, Cryptosporidium parvum
SDNYSSS

SEQ ID NO: 2224542 - protein, 8 aa, Cryptosporidium parvum
SDNYSTNH

SEQ ID NO: 2224543 - protein, 4 aa, Cryptosporidium parvum
SDPH

SEQ ID NO: 2224544 - protein, 7 aa, Cryptosporidium parvum
SDPLTSF

SEQ ID NO: 2224545 - protein, 12 aa, Cryptosporidium parvum
SDPNSLPEYHDE

SEQ ID NO: 2224546 - protein, 5 aa, Cryptosporidium parvum
SDPQG

SEQ ID NO: 2224547 - protein, 7 aa, Cryptosporidium parvum
SDPRDYS

SEQ ID NO: 2224548 - protein, 31 aa, Cryptosporidium parvum
SDPSTNSIESASKLDQTPNIKSDQLETFEDP

SEQ ID NO: 2224549 - protein, 6 aa, Cryptosporidium parvum
SDQDKM

SEQ ID NO: 2224550 - protein, 7 aa, Cryptosporidium parvum
SDQESVC

SEQ ID NO: 2224551 - protein, 17 aa, Cryptosporidium parvum
SDQGTNSSKCGQKQKRN

SEQ ID NO: 2224552 - protein, 6 aa, Cryptosporidium parvum
SDQSKI

SEQ ID NO: 2224553 - protein, 4 aa, Cryptosporidium parvum
SDRE

SEQ ID NO: 2224554 - protein, 4 aa, Cryptosporidium parvum
SDRH

SEQ ID NO: 2224555 - protein, 9 aa, Cryptosporidium parvum
SDRLHGENS

SEQ ID NO: 2224556 - protein, 5 aa, Cryptosporidium parvum
SDRPR

SEQ ID NO: 2224557 - protein, 5 aa, Cryptosporidium parvum
SDRTS

SEQ ID NO: 2224558 - protein, 10 aa, Cryptosporidium parvum
SDRVKSGTVS

SEQ ID NO: 2224559 - protein, 25 aa, Cryptosporidium parvum
SDSAAKLPPPFGNPAVKNEQKFPEY

SEQ ID NO: 2224560 - protein, 6 aa, Cryptosporidium parvum
SDSAEH

SEQ ID NO: 2224561 - protein, 5 aa, Cryptosporidium parvum
SDSAR

SEQ ID NO: 2224562 - protein, 6 aa, Cryptosporidium parvum
SDSDFG

SEQ ID NO: 2224563 - protein, 32 aa, Cryptosporidium parvum
SDSDLGLNSESDSELDSDSGLVTDSETSSRFE

SEQ ID NO: 2224564 - protein, 4 aa, Cryptosporidium parvum
SDSE

SEQ ID NO: 2224565 - protein, 8 aa, Cryptosporidium parvum
SDSEEALK

SEQ ID NO: 2224566 - protein, 8 aa, Cryptosporidium parvum
SDSEKAFN

SEQ ID NO: 2224567 - protein, 7 aa, Cryptosporidium parvum
SDSENYS

SEQ ID NO: 2224568 - protein, 9 aa, Cryptosporidium parvum
SDSFNNGDN

SEQ ID NO: 2224569 - protein, 12 aa, Cryptosporidium parvum
SDSGNSSDVKEY

SEQ ID NO: 2224570 - protein, 4 aa, Cryptosporidium parvum
SDSI

SEQ ID NO: 2224571 - protein, 9 aa, Cryptosporidium parvum
SDSIQGNSI

SEQ ID NO: 2224572 - protein, 9 aa, Cryptosporidium parvum
SDSKAKKLS

SEQ ID NO: 2224573 - protein, 5 aa, Cryptosporidium parvum
SDSKN

SEQ ID NO: 2224574 - protein, 10 aa, Cryptosporidium parvum
SDSKNKIDPT

SEQ ID NO: 2224575 - protein, 10 aa, Cryptosporidium parvum
SDSKQNNEFG

SEQ ID NO: 2224576 - protein, 8 aa, Cryptosporidium parvum
SDSKRTGV

SEQ ID NO: 2224577 - protein, 7 aa, Cryptosporidium parvum
SDSNDSF

SEQ ID NO: 2224578 - protein, 9 aa, Cryptosporidium parvum
SDSNDSRID

SEQ ID NO: 2224579 - protein, 10 aa, Cryptosporidium parvum
SDSNSLRESI

SEQ ID NO: 2224580 - protein, 12 aa, Cryptosporidium parvum
SDSNYSKSEIRE

SEQ ID NO: 2224581 - protein, 8 aa, Cryptosporidium parvum
SDSPLKKN

SEQ ID NO: 2224582 - protein, 6 aa, Cryptosporidium parvum
SDSQLA

SEQ ID NO: 2224583 - protein, 7 aa, Cryptosporidium parvum
SDSTKQT

SEQ ID NO: 2224584 - protein, 17 aa, Cryptosporidium parvum
SDSTNSGIKTCSDGTKC

SEQ ID NO: 2224585 - protein, 5 aa, Cryptosporidium parvum
SDSTR

SEQ ID NO: 2224586 - protein, 19 aa, Cryptosporidium parvum
SDSTSENGLSSRKKSTDFL

SEQ ID NO: 2224587 - protein, 11 aa, Cryptosporidium parvum
SDSVTKDAKEN

SEQ ID NO: 2224588 - protein, 16 aa, Cryptosporidium parvum
SDTCESGTKYRTRRVN

SEQ ID NO: 2224589 - protein, 11 aa, Cryptosporidium parvum
SDTDDQASINP

SEQ ID NO: 2224590 - protein, 4 aa, Cryptosporidium parvum
SDTG

SEQ ID NO: 2224591 - protein, 20 aa, Cryptosporidium parvum
SDTINGKQEKTEENPTSKLS

SEQ ID NO: 2224592 - protein, 6 aa, Cryptosporidium parvum
SDTNNV

SEQ ID NO: 2224593 - protein, 14 aa, Cryptosporidium parvum
SDTPPHAFPLYAIG

SEQ ID NO: 2224594 - protein, 8 aa, Cryptosporidium parvum
SDTRQDHR

SEQ ID NO: 2224595 - protein, 11 aa, Cryptosporidium parvum
SDTSNSNVQAV

SEQ ID NO: 2224596 - protein, 17 aa, Cryptosporidium parvum
SDTVTSQQQASGLSRTG

SEQ ID NO: 2224597 - protein, 5 aa, Cryptosporidium parvum
SDVHP

SEQ ID NO: 2224598 - protein, 4 aa, Cryptosporidium parvum
SDVR

SEQ ID NO: 2224599 - protein, 12 aa, Cryptosporidium parvum
SDVRYSEDSETG

SEQ ID NO: 2224600 - protein, 11 aa, Cryptosporidium parvum
SDVTCKKQTKL

SEQ ID NO: 2224601 - protein, 4 aa, Cryptosporidium parvum
SDVY

SEQ ID NO: 2224602 - protein, 8 aa, Cryptosporidium parvum
SDYGNSEG

SEQ ID NO: 2224603 - protein, 4 aa, Cryptosporidium parvum
SDYP

SEQ ID NO: 2224604 - protein, 5 aa, Cryptosporidium parvum
SDYPN

SEQ ID NO: 2224605 - protein, 5 aa, Cryptosporidium parvum
SEADE

SEQ ID NO: 2224606 - protein, 5 aa, Cryptosporidium parvum
SEAGA

SEQ ID NO: 2224607 - protein, 24 aa, Cryptosporidium parvum
SEAQEGLEKENGIQDTGADLDSRI

SEQ ID NO: 2224608 - protein, 4 aa, Cryptosporidium parvum
SEAS

SEQ ID NO: 2224609 - protein, 6 aa, Cryptosporidium parvum
SEASQS

SEQ ID NO: 2224610 - protein, 6 aa, Cryptosporidium parvum
SECSDE

SEQ ID NO: 2224611 - protein, 7 aa, Cryptosporidium parvum
SECSGRS

SEQ ID NO: 2224612 - protein, 11 aa, Cryptosporidium parvum
SEDDELAQKAM

SEQ ID NO: 2224613 - protein, 4 aa, Cryptosporidium parvum
SEDE

SEQ ID NO: 2224614 - protein, 8 aa, Cryptosporidium parvum
SEDETNYE

SEQ ID NO: 2224615 - protein, 6 aa, Cryptosporidium parvum
SEDEYN

SEQ ID NO: 2224616 - protein, 4 aa, Cryptosporidium parvum
SEDG

SEQ ID NO: 2224617 - protein, 16 aa, Cryptosporidium parvum
SEDIEDEQEYENGDSY

SEQ ID NO: 2224618 - protein, 9 aa, Cryptosporidium parvum
SEDKSKQEI

SEQ ID NO: 2224619 - protein, 8 aa, Cryptosporidium parvum
SEDNEFPK

SEQ ID NO: 2224620 - protein, 5 aa, Cryptosporidium parvum
SEDNF

SEQ ID NO: 2224621 - protein, 7 aa, Cryptosporidium parvum
SEDNKYK

SEQ ID NO: 2224622 - protein, 10 aa, Cryptosporidium parvum
SEDNNKTNAI

SEQ ID NO: 2224623 - protein, 8 aa, Cryptosporidium parvum
SEDPCENE

SEQ ID NO: 2224624 - protein, 4 aa, Cryptosporidium parvum
SEDV

SEQ ID NO: 2224625 - protein, 6 aa, Cryptosporidium parvum
SEDYDG

SEQ ID NO: 2224626 - protein, 7 aa, Cryptosporidium parvum
SEECRSG

SEQ ID NO: 2224627 - protein, 4 aa, Cryptosporidium parvum
SEEE

SEQ ID NO: 2224628 - protein, 23 aa, Cryptosporidium parvum
SEEEPEPPNQEIDIPEKKYGEME

SEQ ID NO: 2224629 - protein, 24 aa, Cryptosporidium parvum
SEEGHQNKDDNGIADSDSNTEVTK

SEQ ID NO: 2224630 - protein, 11 aa, Cryptosporidium parvum
SEEIPENSEKK

SEQ ID NO: 2224631 - protein, 18 aa, Cryptosporidium parvum
SEEKSLKAEAKLKNPSFE

SEQ ID NO: 2224632 - protein, 4 aa, Cryptosporidium parvum
SEEM

SEQ ID NO: 2224633 - protein, 17 aa, Cryptosporidium parvum
SEENASFASGKDSKEVK

SEQ ID NO: 2224634 - protein, 8 aa, Cryptosporidium parvum
SEENSRLK

SEQ ID NO: 2224635 - protein, 6 aa, Cryptosporidium parvum
SEEQPY

SEQ ID NO: 2224636 - protein, 6 aa, Cryptosporidium parvum
SEERQN

SEQ ID NO: 2224637 - protein, 11 aa, Cryptosporidium parvum
SEESKLRSSHI

SEQ ID NO: 2224638 - protein, 6 aa, Cryptosporidium parvum
SEESLS

SEQ ID NO: 2224639 - protein, 6 aa, Cryptosporidium parvum
SEESMS

SEQ ID NO: 2224640 - protein, 15 aa, Cryptosporidium parvum
SEESQGGDPNLPKSN

SEQ ID NO: 2224641 - protein, 19 aa, Cryptosporidium parvum
SEESQGNITNNNQGTEYLT

SEQ ID NO: 2224642 - protein, 8 aa, Cryptosporidium parvum
SEETMGST

SEQ ID NO: 2224643 - protein, 6 aa, Cryptosporidium parvum
SEEYYE

SEQ ID NO: 2224644 - protein, 14 aa, Cryptosporidium parvum
SEFEKNKSEGSESL

SEQ ID NO: 2224645 - protein, 12 aa, Cryptosporidium parvum
SEFENKNDSIIQ

SEQ ID NO: 2224646 - protein, 4 aa, Cryptosporidium parvum
SEFG

SEQ ID NO: 2224647 - protein, 6 aa, Cryptosporidium parvum
SEFNPK

SEQ ID NO: 2224648 - protein, 4 aa, Cryptosporidium parvum
SEFQ

SEQ ID NO: 2224649 - protein, 13 aa, Cryptosporidium parvum
SEFSAKENFSEKT

SEQ ID NO: 2224650 - protein, 5 aa, Cryptosporidium parvum
SEFTQ

SEQ ID NO: 2224651 - protein, 26 aa, Cryptosporidium parvum
SEGDTNLQNKNLNASVQGGTEYRQSM

SEQ ID NO: 2224652 - protein, 5 aa, Cryptosporidium parvum
SEGGL

SEQ ID NO: 2224653 - protein, 11 aa, Cryptosporidium parvum
SEGGMKYSEGN

SEQ ID NO: 2224654 - protein, 20 aa, Cryptosporidium parvum
SEGGSHDDEANISNTPPTYI

SEQ ID NO: 2224655 - protein, 6 aa, Cryptosporidium parvum
SEGMNN

SEQ ID NO: 2224656 - protein, 8 aa, Cryptosporidium parvum
SEGNYNNP

SEQ ID NO: 2224657 - protein, 6 aa, Cryptosporidium parvum
SEGPTT

SEQ ID NO: 2224658 - protein, 4 aa, Cryptosporidium parvum
SEGS

SEQ ID NO: 2224659 - protein, 7 aa, Cryptosporidium parvum
SEGVECE

SEQ ID NO: 2224660 - protein, 26 aa, Cryptosporidium parvum
SEHEKENSDESINKDTDENDSMSNSF

SEQ ID NO: 2224661 - protein, 4 aa, Cryptosporidium parvum
SEHN

SEQ ID NO: 2224662 - protein, 5 aa, Cryptosporidium parvum
SEHNN

SEQ ID NO: 2224663 - protein, 8 aa, Cryptosporidium parvum
SEHSTCDA

SEQ ID NO: 2224664 - protein, 6 aa, Cryptosporidium parvum
SEIDES

SEQ ID NO: 2224665 - protein, 6 aa, Cryptosporidium parvum
SEIING

SEQ ID NO: 2224666 - protein, 4 aa, Cryptosporidium parvum
SEIP

SEQ ID NO: 2224667 - protein, 4 aa, Cryptosporidium parvum
SEIQ

SEQ ID NO: 2224668 - protein, 13 aa, Cryptosporidium parvum
SEIRRGKKAPYKI

SEQ ID NO: 2224669 - protein, 10 aa, Cryptosporidium parvum
SEISNSSQID

SEQ ID NO: 2224670 - protein, 33 aa, Cryptosporidium parvum
SEISSQYISSSQKKHSRQSHSSRSKNKAHRKKS

SEQ ID NO: 2224671 - protein, 5 aa, Cryptosporidium parvum
SEKAI

SEQ ID NO: 2224672 - protein, 7 aa, Cryptosporidium parvum
SEKASKA

SEQ ID NO: 2224673 - protein, 4 aa, Cryptosporidium parvum
SEKE

SEQ ID NO: 2224674 - protein, 8 aa, Cryptosporidium parvum
SEKEGNNK

SEQ ID NO: 2224675 - protein, 8 aa, Cryptosporidium parvum
SEKEGSEI

SEQ ID NO: 2224676 - protein, 7 aa, Cryptosporidium parvum
SEKEYDT

SEQ ID NO: 2224677 - protein, 7 aa, Cryptosporidium parvum
SEKEYGY

SEQ ID NO: 2224678 - protein, 12 aa, Cryptosporidium parvum
SEKHRNDNSQSQ

SEQ ID NO: 2224679 - protein, 13 aa, Cryptosporidium parvum
SEKHSSVYSEASN

SEQ ID NO: 2224680 - protein, 6 aa, Cryptosporidium parvum
SEKIKD

SEQ ID NO: 2224681 - protein, 5 aa, Cryptosporidium parvum
SEKIP

SEQ ID NO: 2224682 - protein, 6 aa, Cryptosporidium parvum
SEKKLN

SEQ ID NO: 2224683 - protein, 4 aa, Cryptosporidium parvum
SEKL

SEQ ID NO: 2224684 - protein, 18 aa, Cryptosporidium parvum
SEKLDNKTEITREITEED

SEQ ID NO: 2224685 - protein, 7 aa, Cryptosporidium parvum
SEKNYGS

SEQ ID NO: 2224686 - protein, 26 aa, Cryptosporidium parvum
SEKQNSSSSKSQTSSSSSQSLSPSHS

SEQ ID NO: 2224687 - protein, 7 aa, Cryptosporidium parvum
SEKQRYA

SEQ ID NO: 2224688 - protein, 24 aa, Cryptosporidium parvum
SEKSIDESKSEIKDAQIERDDATN

SEQ ID NO: 2224689 - protein, 10 aa, Cryptosporidium parvum
SEKSNQGHAN

SEQ ID NO: 2224690 - protein, 15 aa, Cryptosporidium parvum
SEKVENSKLKKKSTI

SEQ ID NO: 2224691 - protein, 16 aa, Cryptosporidium parvum
SEKYDETNIGTNNNNN

SEQ ID NO: 2224692 - protein, 8 aa, Cryptosporidium parvum
SELAHGSK

SEQ ID NO: 2224693 - protein, 13 aa, Cryptosporidium parvum
SELASQEYSNSPM

SEQ ID NO: 2224694 - protein, 14 aa, Cryptosporidium parvum
SELEDENNEEIQKK

SEQ ID NO: 2224695 - protein, 11 aa, Cryptosporidium parvum
SELEESSPEHI

SEQ ID NO: 2224696 - protein, 8 aa, Cryptosporidium parvum
SELEVDGK

SEQ ID NO: 2224697 - protein, 12 aa, Cryptosporidium parvum
SELNGGANTECS

SEQ ID NO: 2224698 - protein, 8 aa, Cryptosporidium parvum
SELPGNQK

SEQ ID NO: 2224699 - protein, 7 aa, Cryptosporidium parvum
SELSGEI

SEQ ID NO: 2224700 - protein, 7 aa, Cryptosporidium parvum
SELSGPE

SEQ ID NO: 2224701 - protein, 9 aa, Cryptosporidium parvum
SELSNNSNY

SEQ ID NO: 2224702 - protein, 15 aa, Cryptosporidium parvum
SELSYTKSNDDEDDV

SEQ ID NO: 2224703 - protein, 4 aa, Cryptosporidium parvum
SELT

SEQ ID NO: 2224704 - protein, 5 aa, Cryptosporidium parvum
SELTN

SEQ ID NO: 2224705 - protein, 6 aa, Cryptosporidium parvum
SELTPS

SEQ ID NO: 2224706 - protein, 5 aa, Cryptosporidium parvum
SEMES

SEQ ID NO: 2224707 - protein, 11 aa, Cryptosporidium parvum
SEMKDHRKTNS

SEQ ID NO: 2224708 - protein, 6 aa, Cryptosporidium parvum
SEMSLK

SEQ ID NO: 2224709 - protein, 9 aa, Cryptosporidium parvum
SENAENIKE

SEQ ID NO: 2224710 - protein, 5 aa, Cryptosporidium parvum
SENAR

SEQ ID NO: 2224711 - protein, 8 aa, Cryptosporidium parvum
SENARESQ

SEQ ID NO: 2224712 - protein, 4 aa, Cryptosporidium parvum
SEND

SEQ ID NO: 2224713 - protein, 11 aa, Cryptosporidium parvum
SENDKQSNTSH

SEQ ID NO: 2224714 - protein, 6 aa, Cryptosporidium parvum
SENDLE

SEQ ID NO: 2224715 - protein, 13 aa, Cryptosporidium parvum
SENDSNSNINKKD

SEQ ID NO: 2224716 - protein, 4 aa, Cryptosporidium parvum
SENF

SEQ ID NO: 2224717 - protein, 21 aa, Cryptosporidium parvum
SENFNSSDFENQNKNQSTTQV

SEQ ID NO: 2224718 - protein, 5 aa, Cryptosporidium parvum
SENGE

SEQ ID NO: 2224719 - protein, 5 aa, Cryptosporidium parvum
SENIK

SEQ ID NO: 2224720 - protein, 4 aa, Cryptosporidium parvum
SENK

SEQ ID NO: 2224721 - protein, 10 aa, Cryptosporidium parvum
SENKQKSPLL

SEQ ID NO: 2224722 - protein, 8 aa, Cryptosporidium parvum
SENLNENN

SEQ ID NO: 2224723 - protein, 5 aa, Cryptosporidium parvum
SENLT

SEQ ID NO: 2224724 - protein, 13 aa, Cryptosporidium parvum
SENMSEKEKNRVS

SEQ ID NO: 2224725 - protein, 7 aa, Cryptosporidium parvum
SENNTFT

SEQ ID NO: 2224726 - protein, 7 aa, Cryptosporidium parvum
SENNYHN

SEQ ID NO: 2224727 - protein, 10 aa, Cryptosporidium parvum
SENPKESCRD

SEQ ID NO: 2224728 - protein, 7 aa, Cryptosporidium parvum
SENPQQF

SEQ ID NO: 2224729 - protein, 5 aa, Cryptosporidium parvum
SENPR

SEQ ID NO: 2224730 - protein, 33 aa, Cryptosporidium parvum
SENRIEGNGYKKSSKYSSSSRSTDNKNNFEKDQ

SEQ ID NO: 2224731 - protein, 5 aa, Cryptosporidium parvum
SENRQ

SEQ ID NO: 2224732 - protein, 4 aa, Cryptosporidium parvum
SENS

SEQ ID NO: 2224733 - protein, 24 aa, Cryptosporidium parvum
SENSLTNNIGSSSNIGSKTLSQSQ

SEQ ID NO: 2224734 - protein, 7 aa, Cryptosporidium parvum
SENSNIN

SEQ ID NO: 2224735 - protein, 8 aa, Cryptosporidium parvum
SENSSSFA

SEQ ID NO: 2224736 - protein, 6 aa, Cryptosporidium parvum
SENTDI

SEQ ID NO: 2224737 - protein, 11 aa, Cryptosporidium parvum
SENTSKRKCPL

SEQ ID NO: 2224738 - protein, 19 aa, Cryptosporidium parvum
SEPDYSQNDENDKETSSEV

SEQ ID NO: 2224739 - protein, 10 aa, Cryptosporidium parvum
SEPNATGSCP

SEQ ID NO: 2224740 - protein, 7 aa, Cryptosporidium parvum
SEPSTGS

SEQ ID NO: 2224741 - protein, 7 aa, Cryptosporidium parvum
SEPVPTE

SEQ ID NO: 2224742 - protein, 5 aa, Cryptosporidium parvum
SEQAF

SEQ ID NO: 2224743 - protein, 7 aa, Cryptosporidium parvum
SEQDISS

SEQ ID NO: 2224744 - protein, 9 aa, Cryptosporidium parvum
SEQELSPEL

SEQ ID NO: 2224745 - protein, 7 aa, Cryptosporidium parvum
SEQEREK

SEQ ID NO: 2224746 - protein, 15 aa, Cryptosporidium parvum
SEQGQNDGRAAKVDQ

SEQ ID NO: 2224747 - protein, 4 aa, Cryptosporidium parvum
SEQI

SEQ ID NO: 2224748 - protein, 7 aa, Cryptosporidium parvum
SEQKQGN

SEQ ID NO: 2224749 - protein, 4 aa, Cryptosporidium parvum
SEQL

SEQ ID NO: 2224750 - protein, 10 aa, Cryptosporidium parvum
SEQTTNCSGR

SEQ ID NO: 2224751 - protein, 5 aa, Cryptosporidium parvum
SEQVE

SEQ ID NO: 2224752 - protein, 7 aa, Cryptosporidium parvum
SEQYGST

SEQ ID NO: 2224753 - protein, 7 aa, Cryptosporidium parvum
SERDETY

SEQ ID NO: 2224754 - protein, 6 aa, Cryptosporidium parvum
SERDGY

SEQ ID NO: 2224755 - protein, 6 aa, Cryptosporidium parvum
SERDKH

SEQ ID NO: 2224756 - protein, 7 aa, Cryptosporidium parvum
SERFTSS

SEQ ID NO: 2224757 - protein, 5 aa, Cryptosporidium parvum
SERGF

SEQ ID NO: 2224758 - protein, 17 aa, Cryptosporidium parvum
SERGKRRSNQAFKDPRP

SEQ ID NO: 2224759 - protein, 8 aa, Cryptosporidium parvum
SERIKEEY

SEQ ID NO: 2224760 - protein, 4 aa, Cryptosporidium parvum
SERN

SEQ ID NO: 2224761 - protein, 19 aa, Cryptosporidium parvum
SERQTNQDLSGVSDQEADV

SEQ ID NO: 2224762 - protein, 6 aa, Cryptosporidium parvum
SERSHE

SEQ ID NO: 2224763 - protein, 7 aa, Cryptosporidium parvum
SERSNKQ

SEQ ID NO: 2224764 - protein, 24 aa, Cryptosporidium parvum
SERTRKSKFNTRKEKYKQDKSLEN

SEQ ID NO: 2224765 - protein, 8 aa, Cryptosporidium parvum
SERVTNRS

SEQ ID NO: 2224766 - protein, 4 aa, Cryptosporidium parvum
SESE

SEQ ID NO: 2224767 - protein, 8 aa, Cryptosporidium parvum
SESEDKDI

SEQ ID NO: 2224768 - protein, 5 aa, Cryptosporidium parvum
SESEL

SEQ ID NO: 2224769 - protein, 7 aa, Cryptosporidium parvum
SESENEQ

SEQ ID NO: 2224770 - protein, 7 aa, Cryptosporidium parvum
SESEQHP

SEQ ID NO: 2224771 - protein, 5 aa, Cryptosporidium parvum
SESGH

SEQ ID NO: 2224772 - protein, 8 aa, Cryptosporidium parvum
SESGRPNY

SEQ ID NO: 2224773 - protein, 6 aa, Cryptosporidium parvum
SESGTV

SEQ ID NO: 2224774 - protein, 5 aa, Cryptosporidium parvum
SESKD

SEQ ID NO: 2224775 - protein, 9 aa, Cryptosporidium parvum
SESKFEKSY

SEQ ID NO: 2224776 - protein, 7 aa, Cryptosporidium parvum
SESKNGT

SEQ ID NO: 2224777 - protein, 11 aa, Cryptosporidium parvum
SESKSPENMER

SEQ ID NO: 2224778 - protein, 10 aa, Cryptosporidium parvum
SESLNVEAGD

SEQ ID NO: 2224779 - protein, 9 aa, Cryptosporidium parvum
SESLSETLS

SEQ ID NO: 2224780 - protein, 4 aa, Cryptosporidium parvum
SESN

SEQ ID NO: 2224781 - protein, 5 aa, Cryptosporidium parvum
SESNE

SEQ ID NO: 2224782 - protein, 6 aa, Cryptosporidium parvum
SESNRL

SEQ ID NO: 2224783 - protein, 7 aa, Cryptosporidium parvum
SESNTRT

SEQ ID NO: 2224784 - protein, 5 aa, Cryptosporidium parvum
SESPN

SEQ ID NO: 2224785 - protein, 20 aa, Cryptosporidium parvum
SESPQSNTELSSRASKARLS

SEQ ID NO: 2224786 - protein, 7 aa, Cryptosporidium parvum
SESPSIP

SEQ ID NO: 2224787 - protein, 6 aa, Cryptosporidium parvum
SESPYT

SEQ ID NO: 2224788 - protein, 22 aa, Cryptosporidium parvum
SESQQEITNNIKDTNSEPQTVR

SEQ ID NO: 2224789 - protein, 10 aa, Cryptosporidium parvum
SESSSYNNSN

SEQ ID NO: 2224790 - protein, 4 aa, Cryptosporidium parvum
SEST

SEQ ID NO: 2224791 - protein, 7 aa, Cryptosporidium parvum
SESTQYD

SEQ ID NO: 2224792 - protein, 6 aa, Cryptosporidium parvum
SESTSR

SEQ ID NO: 2224793 - protein, 17 aa, Cryptosporidium parvum
SESTTLPPEEGNNENAV

SEQ ID NO: 2224794 - protein, 6 aa, Cryptosporidium parvum
SESYSD

SEQ ID NO: 2224795 - protein, 19 aa, Cryptosporidium parvum
SETDSTDGGSNTASQPNGR

SEQ ID NO: 2224796 - protein, 6 aa, Cryptosporidium parvum
SETENN

SEQ ID NO: 2224797 - protein, 12 aa, Cryptosporidium parvum
SETEYENSPYKE

SEQ ID NO: 2224798 - protein, 8 aa, Cryptosporidium parvum
SETGSKIG

SEQ ID NO: 2224799 - protein, 42 aa, Cryptosporidium parvum
SETKTSPETDQRKCTQSSLEISKGDLDSVDNLNSSLSPSSFQ

SEQ ID NO: 2224800 - protein, 5 aa, Cryptosporidium parvum
SETNI

SEQ ID NO: 2224801 - protein, 8 aa, Cryptosporidium parvum
SETNKQIN

SEQ ID NO: 2224802 - protein, 10 aa, Cryptosporidium parvum
SETPRENASF

SEQ ID NO: 2224803 - protein, 6 aa, Cryptosporidium parvum
SETSNE

SEQ ID NO: 2224804 - protein, 11 aa, Cryptosporidium parvum
SETTELANKET

SEQ ID NO: 2224805 - protein, 15 aa, Cryptosporidium parvum
SETTNNGNHSNYNNN

SEQ ID NO: 2224806 - protein, 4 aa, Cryptosporidium parvum
SETY

SEQ ID NO: 2224807 - protein, 7 aa, Cryptosporidium parvum
SEVAEGR

SEQ ID NO: 2224808 - protein, 8 aa, Cryptosporidium parvum
SEVQETRN

SEQ ID NO: 2224809 - protein, 7 aa, Cryptosporidium parvum
SEVRGNK

SEQ ID NO: 2224810 - protein, 29 aa, Cryptosporidium parvum
SEVSQENPENHEGIQNGENISEDWNPVEG

SEQ ID NO: 2224811 - protein, 7 aa, Cryptosporidium parvum
SEYCKDE

SEQ ID NO: 2224812 - protein, 6 aa, Cryptosporidium parvum
SEYDNS

SEQ ID NO: 2224813 - protein, 15 aa, Cryptosporidium parvum
SEYKDPNSNKSLQKL

SEQ ID NO: 2224814 - protein, 4 aa, Cryptosporidium parvum
SEYQ

SEQ ID NO: 2224815 - protein, 7 aa, Cryptosporidium parvum
SEYSDNK

SEQ ID NO: 2224816 - protein, 6 aa, Cryptosporidium parvum
SEYSHE

SEQ ID NO: 2224817 - protein, 30 aa, Cryptosporidium parvum
SEYTSANSKNESSLEEDQKEENKQKKKSKL

SEQ ID NO: 2224818 - protein, 5 aa, Cryptosporidium parvum
SFDGS

SEQ ID NO: 2224819 - protein, 12 aa, Cryptosporidium parvum
SFENSKKNTGNH

SEQ ID NO: 2224820 - protein, 6 aa, Cryptosporidium parvum
SFFESS

SEQ ID NO: 2224821 - protein, 15 aa, Cryptosporidium parvum
SFGSDSSAKERISKE

SEQ ID NO: 2224822 - protein, 6 aa, Cryptosporidium parvum
SFGSTN

SEQ ID NO: 2224823 - protein, 10 aa, Cryptosporidium parvum
SFKKSQTTSG

SEQ ID NO: 2224824 - protein, 10 aa, Cryptosporidium parvum
SFKSSQSIDN

SEQ ID NO: 2224825 - protein, 4 aa, Cryptosporidium parvum
SFLG

SEQ ID NO: 2224826 - protein, 4 aa, Cryptosporidium parvum
SFLS

SEQ ID NO: 2224827 - protein, 6 aa, Cryptosporidium parvum
SFNDRI

SEQ ID NO: 2224828 - protein, 12 aa, Cryptosporidium parvum
SFNKDDSNNIQN

SEQ ID NO: 2224829 - protein, 12 aa, Cryptosporidium parvum
SFNKKDDWNNVN

SEQ ID NO: 2224830 - protein, 19 aa, Cryptosporidium parvum
SFNTPQQTDEITGKPVDTV

SEQ ID NO: 2224831 - protein, 6 aa, Cryptosporidium parvum
SFPGNK

SEQ ID NO: 2224832 - protein, 11 aa, Cryptosporidium parvum
SFPNSNQIDPF

SEQ ID NO: 2224833 - protein, 14 aa, Cryptosporidium parvum
SFPNSSKSRSNSDL

SEQ ID NO: 2224834 - protein, 10 aa, Cryptosporidium parvum
SFPPNSGPKS

SEQ ID NO: 2224835 - protein, 8 aa, Cryptosporidium parvum
SFPSNNLG

SEQ ID NO: 2224836 - protein, 6 aa, Cryptosporidium parvum
SFPSNS

SEQ ID NO: 2224837 - protein, 5 aa, Cryptosporidium parvum
SFPSY

SEQ ID NO: 2224838 - protein, 5 aa, Cryptosporidium parvum
SFQGP

SEQ ID NO: 2224839 - protein, 9 aa, Cryptosporidium parvum
SFSCPSGSK

SEQ ID NO: 2224840 - protein, 5 aa, Cryptosporidium parvum
SFSKN

SEQ ID NO: 2224841 - protein, 10 aa, Cryptosporidium parvum
SFSNEDNSQI

SEQ ID NO: 2224842 - protein, 28 aa, Cryptosporidium parvum
SFSRKSKALRKSIKSSGKNTIQLPSQDN

SEQ ID NO: 2224843 - protein, 21 aa, Cryptosporidium parvum
SFSSDSNDLNKDDENEKLETN

SEQ ID NO: 2224844 - protein, 6 aa, Cryptosporidium parvum
SFSSSK

SEQ ID NO: 2224845 - protein, 6 aa, Cryptosporidium parvum
SFSSSS

SEQ ID NO: 2224846 - protein, 6 aa, Cryptosporidium parvum
SFSTHS

SEQ ID NO: 2224847 - protein, 6 aa, Cryptosporidium parvum
SFSTPS

SEQ ID NO: 2224848 - protein, 20 aa, Cryptosporidium parvum
SFTNSSKKISRSKSNLLSED

SEQ ID NO: 2224849 - protein, 5 aa, Cryptosporidium parvum
SFTSG

SEQ ID NO: 2224850 - protein, 6 aa, Cryptosporidium parvum
SFTSKN

SEQ ID NO: 2224851 - protein, 7 aa, Cryptosporidium parvum
SGAEEAQ

SEQ ID NO: 2224852 - protein, 44 aa, Cryptosporidium parvum
SGAGTGTGTGTGTGTGTGAGAGTSGASGSGGEMGSGLTASAQPF

SEQ ID NO: 2224853 - protein, 17 aa, Cryptosporidium parvum
SGAGTKSQFDDQKYENA

SEQ ID NO: 2224854 - protein, 4 aa, Cryptosporidium parvum
SGAN

SEQ ID NO: 2224855 - protein, 20 aa, Cryptosporidium parvum
SGARHGLNSNEKDSHSNDWS

SEQ ID NO: 2224856 - protein, 8 aa, Cryptosporidium parvum
SGAYPIDE

SEQ ID NO: 2224857 - protein, 10 aa, Cryptosporidium parvum
SGDALTKEEK

SEQ ID NO: 2224858 - protein, 8 aa, Cryptosporidium parvum
SGDSDNVN

SEQ ID NO: 2224859 - protein, 5 aa, Cryptosporidium parvum
SGDSF

SEQ ID NO: 2224860 - protein, 8 aa, Cryptosporidium parvum
SGDVDDET

SEQ ID NO: 2224861 - protein, 19 aa, Cryptosporidium parvum
SGDVTPKENCSPTASQKIK

SEQ ID NO: 2224862 - protein, 24 aa, Cryptosporidium parvum
SGEAGTFSSCSSQVPDEAEFQPGS

SEQ ID NO: 2224863 - protein, 13 aa, Cryptosporidium parvum
SGEDAEGSSTKDR

SEQ ID NO: 2224864 - protein, 9 aa, Cryptosporidium parvum
SGEGNTKLK

SEQ ID NO: 2224865 - protein, 13 aa, Cryptosporidium parvum
SGEHGMDQGGTEF

SEQ ID NO: 2224866 - protein, 16 aa, Cryptosporidium parvum
SGEKKQSRDKKSTNKS

SEQ ID NO: 2224867 - protein, 5 aa, Cryptosporidium parvum
SGEKN

SEQ ID NO: 2224868 - protein, 6 aa, Cryptosporidium parvum
SGEKSL

SEQ ID NO: 2224869 - protein, 20 aa, Cryptosporidium parvum
SGELKDPNKQATISGSRSCG

SEQ ID NO: 2224870 - protein, 6 aa, Cryptosporidium parvum
SGENPG

SEQ ID NO: 2224871 - protein, 5 aa, Cryptosporidium parvum
SGEPY

SEQ ID NO: 2224872 - protein, 4 aa, Cryptosporidium parvum
SGEQ

SEQ ID NO: 2224873 - protein, 7 aa, Cryptosporidium parvum
SGEREEY

SEQ ID NO: 2224874 - protein, 5 aa, Cryptosporidium parvum
SGERK

SEQ ID NO: 2224875 - protein, 4 aa, Cryptosporidium parvum
SGES

SEQ ID NO: 2224876 - protein, 6 aa, Cryptosporidium parvum
SGESCK

SEQ ID NO: 2224877 - protein, 12 aa, Cryptosporidium parvum
SGESFEKGELVS

SEQ ID NO: 2224878 - protein, 4 aa, Cryptosporidium parvum
SGEY

SEQ ID NO: 2224879 - protein, 7 aa, Cryptosporidium parvum
SGFQGDE

SEQ ID NO: 2224880 - protein, 15 aa, Cryptosporidium parvum
SGFQKNSQNLNYGGP

SEQ ID NO: 2224881 - protein, 4 aa, Cryptosporidium parvum
SGFS

SEQ ID NO: 2224882 - protein, 8 aa, Cryptosporidium parvum
SGGDAYRA

SEQ ID NO: 2224883 - protein, 4 aa, Cryptosporidium parvum
SGGF

SEQ ID NO: 2224884 - protein, 60 aa, Cryptosporidium parvum
SGGFSGSGAANANSDTDSNSGIQDASDSITDVTAGAASTAELTKEEKKKQKKQDKKDEKE

SEQ ID NO: 2224885 - protein, 10 aa, Cryptosporidium parvum
SGGGAKGSFS

SEQ ID NO: 2224886 - protein, 12 aa, Cryptosporidium parvum
SGGGGGKDYGIE

SEQ ID NO: 2224887 - protein, 13 aa, Cryptosporidium parvum
SGGGVSSSPLNQV

SEQ ID NO: 2224888 - protein, 5 aa, Cryptosporidium parvum
SGGHT

SEQ ID NO: 2224889 - protein, 9 aa, Cryptosporidium parvum
SGGISTHGN

SEQ ID NO: 2224890 - protein, 10 aa, Cryptosporidium parvum
SGGKDNNSSF

SEQ ID NO: 2224891 - protein, 7 aa, Cryptosporidium parvum
SGGLNKE

SEQ ID NO: 2224892 - protein, 13 aa, Cryptosporidium parvum
SGGMISGSSSHES

SEQ ID NO: 2224893 - protein, 7 aa, Cryptosporidium parvum
SGGRNVK

SEQ ID NO: 2224894 - protein, 9 aa, Cryptosporidium parvum
SGGSSMNMS

SEQ ID NO: 2224895 - protein, 5 aa, Cryptosporidium parvum
SGGTA

SEQ ID NO: 2224896 - protein, 4 aa, Cryptosporidium parvum
SGGY

SEQ ID NO: 2224897 - protein, 6 aa, Cryptosporidium parvum
SGHTGA

SEQ ID NO: 2224898 - protein, 13 aa, Cryptosporidium parvum
SGIEQKKQEPKRK

SEQ ID NO: 2224899 - protein, 5 aa, Cryptosporidium parvum
SGIFS

SEQ ID NO: 2224900 - protein, 13 aa, Cryptosporidium parvum
SGIGEADQNIDQK

SEQ ID NO: 2224901 - protein, 13 aa, Cryptosporidium parvum
SGINGGAETVSDY

SEQ ID NO: 2224902 - protein, 38 aa, Cryptosporidium parvum
SGINQHEETTEDDTNAGGFTSKPKKNKKIKSSEISGHG

SEQ ID NO: 2224903 - protein, 7 aa, Cryptosporidium parvum
SGIPGLN

SEQ ID NO: 2224904 - protein, 8 aa, Cryptosporidium parvum
SGIPNSAF

SEQ ID NO: 2224905 - protein, 8 aa, Cryptosporidium parvum
SGIPPFPS

SEQ ID NO: 2224906 - protein, 5 aa, Cryptosporidium parvum
SGIQS

SEQ ID NO: 2224907 - protein, 6 aa, Cryptosporidium parvum
SGISSN

SEQ ID NO: 2224908 - protein, 9 aa, Cryptosporidium parvum
SGKAKTDKD

SEQ ID NO: 2224909 - protein, 10 aa, Cryptosporidium parvum
SGKDSGPMRN

SEQ ID NO: 2224910 - protein, 18 aa, Cryptosporidium parvum
SGKIRTGDFRGPTSTNYP

SEQ ID NO: 2224911 - protein, 8 aa, Cryptosporidium parvum
SGKKAYIS

SEQ ID NO: 2224912 - protein, 7 aa, Cryptosporidium parvum
SGKKGTC

SEQ ID NO: 2224913 - protein, 9 aa, Cryptosporidium parvum
SGKLTSERL

SEQ ID NO: 2224914 - protein, 8 aa, Cryptosporidium parvum
SGKMYTES

SEQ ID NO: 2224915 - protein, 7 aa, Cryptosporidium parvum
SGKQIKD

SEQ ID NO: 2224916 - protein, 16 aa, Cryptosporidium parvum
SGKSEFEVSKSSLESL

SEQ ID NO: 2224917 - protein, 7 aa, Cryptosporidium parvum
SGKSNFA

SEQ ID NO: 2224918 - protein, 4 aa, Cryptosporidium parvum
SGKT

SEQ ID NO: 2224919 - protein, 5 aa, Cryptosporidium parvum
SGKTT

SEQ ID NO: 2224920 - protein, 7 aa, Cryptosporidium parvum
SGLEPGT

SEQ ID NO: 2224921 - protein, 5 aa, Cryptosporidium parvum
SGLGE

SEQ ID NO: 2224922 - protein, 8 aa, Cryptosporidium parvum
SGLGSIGD

SEQ ID NO: 2224923 - protein, 8 aa, Cryptosporidium parvum
SGLPSKRC

SEQ ID NO: 2224924 - protein, 4 aa, Cryptosporidium parvum
SGLY

SEQ ID NO: 2224925 - protein, 7 aa, Cryptosporidium parvum
SGMDTGG

SEQ ID NO: 2224926 - protein, 16 aa, Cryptosporidium parvum
SGMNKKDAKKKVKELK

SEQ ID NO: 2224927 - protein, 12 aa, Cryptosporidium parvum
SGMNNNDNNPVI

SEQ ID NO: 2224928 - protein, 24 aa, Cryptosporidium parvum
SGMPYSTSSSISSQRIHTDPSGSY

SEQ ID NO: 2224929 - protein, 73 aa, Cryptosporidium parvum
SGMSPPGMGPPGMGPPGMGPPGMGPPGMGPPGMGPPGMGPPGMGPPGMGPPGMGPPGMGPPGMGPPGMGPRGM

SEQ ID NO: 2224930 - protein, 6 aa, Cryptosporidium parvum
SGMTHS

SEQ ID NO: 2224931 - protein, 4 aa, Cryptosporidium parvum
SGND

SEQ ID NO: 2224932 - protein, 8 aa, Cryptosporidium parvum
SGNDITGE

SEQ ID NO: 2224933 - protein, 11 aa, Cryptosporidium parvum
SGNEKSYENKN

SEQ ID NO: 2224934 - protein, 6 aa, Cryptosporidium parvum
SGNETE

SEQ ID NO: 2224935 - protein, 4 aa, Cryptosporidium parvum
SGNF

SEQ ID NO: 2224936 - protein, 14 aa, Cryptosporidium parvum
SGNFTTAPTIPSKI

SEQ ID NO: 2224937 - protein, 4 aa, Cryptosporidium parvum
SGNG

SEQ ID NO: 2224938 - protein, 5 aa, Cryptosporidium parvum
SGNGE

SEQ ID NO: 2224939 - protein, 8 aa, Cryptosporidium parvum
SGNKDADS

SEQ ID NO: 2224940 - protein, 14 aa, Cryptosporidium parvum
SGNKNTRDADCDTG

SEQ ID NO: 2224941 - protein, 9 aa, Cryptosporidium parvum
SGNLDSNSV

SEQ ID NO: 2224942 - protein, 7 aa, Cryptosporidium parvum
SGNLGEH

SEQ ID NO: 2224943 - protein, 9 aa, Cryptosporidium parvum
SGNNNNKLP

SEQ ID NO: 2224944 - protein, 11 aa, Cryptosporidium parvum
SGNNTNGALGS

SEQ ID NO: 2224945 - protein, 6 aa, Cryptosporidium parvum
SGNPYN

SEQ ID NO: 2224946 - protein, 8 aa, Cryptosporidium parvum
SGNRDNDL

SEQ ID NO: 2224947 - protein, 6 aa, Cryptosporidium parvum
SGNRNI

SEQ ID NO: 2224948 - protein, 19 aa, Cryptosporidium parvum
SGNSTTKSDKINSVNDDPD

SEQ ID NO: 2224949 - protein, 5 aa, Cryptosporidium parvum
SGNSV

SEQ ID NO: 2224950 - protein, 5 aa, Cryptosporidium parvum
SGPGA

SEQ ID NO: 2224951 - protein, 5 aa, Cryptosporidium parvum
SGPKH

SEQ ID NO: 2224952 - protein, 7 aa, Cryptosporidium parvum
SGPYEQR

SEQ ID NO: 2224953 - protein, 5 aa, Cryptosporidium parvum
SGPYY

SEQ ID NO: 2224954 - protein, 7 aa, Cryptosporidium parvum
SGQADRE

SEQ ID NO: 2224955 - protein, 9 aa, Cryptosporidium parvum
SGQAQSKVK

SEQ ID NO: 2224956 - protein, 29 aa, Cryptosporidium parvum
SGQDNSSSSSSSSYGGASTQQGGNDDDYD

SEQ ID NO: 2224957 - protein, 9 aa, Cryptosporidium parvum
SGQESSTRS

SEQ ID NO: 2224958 - protein, 11 aa, Cryptosporidium parvum
SGQKGVGMDEE

SEQ ID NO: 2224959 - protein, 4 aa, Cryptosporidium parvum
SGQL

SEQ ID NO: 2224960 - protein, 7 aa, Cryptosporidium parvum
SGQNTIS

SEQ ID NO: 2224961 - protein, 7 aa, Cryptosporidium parvum
SGQPKDA

SEQ ID NO: 2224962 - protein, 7 aa, Cryptosporidium parvum
SGQSSYL

SEQ ID NO: 2224963 - protein, 7 aa, Cryptosporidium parvum
SGRGDKD

SEQ ID NO: 2224964 - protein, 25 aa, Cryptosporidium parvum
SGRRGSLESGRGDSLGKNSNESNPG

SEQ ID NO: 2224965 - protein, 13 aa, Cryptosporidium parvum
SGRRRTIEDNPKN

SEQ ID NO: 2224966 - protein, 5 aa, Cryptosporidium parvum
SGRSG

SEQ ID NO: 2224967 - protein, 4 aa, Cryptosporidium parvum
SGSA

SEQ ID NO: 2224968 - protein, 9 aa, Cryptosporidium parvum
SGSDDQGSM

SEQ ID NO: 2224969 - protein, 6 aa, Cryptosporidium parvum
SGSDHQ

SEQ ID NO: 2224970 - protein, 11 aa, Cryptosporidium parvum
SGSEENKELQR

SEQ ID NO: 2224971 - protein, 7 aa, Cryptosporidium parvum
SGSEPIR

SEQ ID NO: 2224972 - protein, 19 aa, Cryptosporidium parvum
SGSFNGQANYQQEEPLNSG

SEQ ID NO: 2224973 - protein, 4 aa, Cryptosporidium parvum
SGSG

SEQ ID NO: 2224974 - protein, 6 aa, Cryptosporidium parvum
SGSGDK

SEQ ID NO: 2224975 - protein, 10 aa, Cryptosporidium parvum
SGSKHASIYS

SEQ ID NO: 2224976 - protein, 20 aa, Cryptosporidium parvum
SGSKKINQADTLNDQQSEFQ

SEQ ID NO: 2224977 - protein, 10 aa, Cryptosporidium parvum
SGSKNDHSSS

SEQ ID NO: 2224978 - protein, 22 aa, Cryptosporidium parvum
SGSLSDKIEQKNNKKNVSTKVS

SEQ ID NO: 2224979 - protein, 10 aa, Cryptosporidium parvum
SGSNDNENKK

SEQ ID NO: 2224980 - protein, 7 aa, Cryptosporidium parvum
SGSNSNQ

SEQ ID NO: 2224981 - protein, 12 aa, Cryptosporidium parvum
SGSSAKDVAKQL

SEQ ID NO: 2224982 - protein, 8 aa, Cryptosporidium parvum
SGSSDQSA

SEQ ID NO: 2224983 - protein, 8 aa, Cryptosporidium parvum
SGSSENID

SEQ ID NO: 2224984 - protein, 9 aa, Cryptosporidium parvum
SGSSGKSFT

SEQ ID NO: 2224985 - protein, 6 aa, Cryptosporidium parvum
SGSSIS

SEQ ID NO: 2224986 - protein, 8 aa, Cryptosporidium parvum
SGSSKALQ

SEQ ID NO: 2224987 - protein, 11 aa, Cryptosporidium parvum
SGSSKDGQVQS

SEQ ID NO: 2224988 - protein, 7 aa, Cryptosporidium parvum
SGSSLQD

SEQ ID NO: 2224989 - protein, 15 aa, Cryptosporidium parvum
SGSSQSKKKDQLESP

SEQ ID NO: 2224990 - protein, 8 aa, Cryptosporidium parvum
SGSTGHPK

SEQ ID NO: 2224991 - protein, 16 aa, Cryptosporidium parvum
SGSTSQNDKTSENVDA

SEQ ID NO: 2224992 - protein, 5 aa, Cryptosporidium parvum
SGSVK

SEQ ID NO: 2224993 - protein, 4 aa, Cryptosporidium parvum
SGSY

SEQ ID NO: 2224994 - protein, 12 aa, Cryptosporidium parvum
SGSYSSYKENDL

SEQ ID NO: 2224995 - protein, 6 aa, Cryptosporidium parvum
SGTADP

SEQ ID NO: 2224996 - protein, 14 aa, Cryptosporidium parvum
SGTEHDDHDDQDHH

SEQ ID NO: 2224997 - protein, 26 aa, Cryptosporidium parvum
SGTFSNKETNSCTACGEGKYSFPGSY

SEQ ID NO: 2224998 - protein, 9 aa, Cryptosporidium parvum
SGTGASPSI

SEQ ID NO: 2224999 - protein, 34 aa, Cryptosporidium parvum
SGTGFEDDSEISRIGKSQSNNDSCYDPLSSDSAS

SEQ ID NO: 2225000 - protein, 9 aa, Cryptosporidium parvum
SGTGNAKSI

SEQ ID NO: 2225001 - protein, 4 aa, Cryptosporidium parvum
SGTI

SEQ ID NO: 2225002 - protein, 7 aa, Cryptosporidium parvum
SGTINKK

SEQ ID NO: 2225003 - protein, 7 aa, Cryptosporidium parvum
SGTKTRK

SEQ ID NO: 2225004 - protein, 10 aa, Cryptosporidium parvum
SGTNHSETLN

SEQ ID NO: 2225005 - protein, 7 aa, Cryptosporidium parvum
SGTNNEI

SEQ ID NO: 2225006 - protein, 18 aa, Cryptosporidium parvum
SGTNQSHINDSSTKVSNK

SEQ ID NO: 2225007 - protein, 11 aa, Cryptosporidium parvum
SGTNSKLNQKY

SEQ ID NO: 2225008 - protein, 8 aa, Cryptosporidium parvum
SGTPDPQS

SEQ ID NO: 2225009 - protein, 8 aa, Cryptosporidium parvum
SGTRNNDF

SEQ ID NO: 2225010 - protein, 10 aa, Cryptosporidium parvum
SGTTPEDPVI

SEQ ID NO: 2225011 - protein, 6 aa, Cryptosporidium parvum
SGTVGK

SEQ ID NO: 2225012 - protein, 5 aa, Cryptosporidium parvum
SGVGI

SEQ ID NO: 2225013 - protein, 10 aa, Cryptosporidium parvum
SGVGTSEHDL

SEQ ID NO: 2225014 - protein, 6 aa, Cryptosporidium parvum
SGVPSR

SEQ ID NO: 2225015 - protein, 33 aa, Cryptosporidium parvum
SGVSGTKKSSLGNEVGHSKSKMSGVPSGVSKGV

SEQ ID NO: 2225016 - protein, 6 aa, Cryptosporidium parvum
SGYCQT

SEQ ID NO: 2225017 - protein, 10 aa, Cryptosporidium parvum
SGYDGLEKTD

SEQ ID NO: 2225018 - protein, 6 aa, Cryptosporidium parvum
SGYEGS

SEQ ID NO: 2225019 - protein, 4 aa, Cryptosporidium parvum
SGYF

SEQ ID NO: 2225020 - protein, 10 aa, Cryptosporidium parvum
SGYGGNVETA

SEQ ID NO: 2225021 - protein, 7 aa, Cryptosporidium parvum
SGYGNEE

SEQ ID NO: 2225022 - protein, 7 aa, Cryptosporidium parvum
SGYPKEY

SEQ ID NO: 2225023 - protein, 5 aa, Cryptosporidium parvum
SGYPN

SEQ ID NO: 2225024 - protein, 4 aa, Cryptosporidium parvum
SGYQ

SEQ ID NO: 2225025 - protein, 7 aa, Cryptosporidium parvum
SGYQTSA

SEQ ID NO: 2225026 - protein, 7 aa, Cryptosporidium parvum
SGYSNKQ

SEQ ID NO: 2225027 - protein, 13 aa, Cryptosporidium parvum
SGYSSSDKQDSVE

SEQ ID NO: 2225028 - protein, 5 aa, Cryptosporidium parvum
SGYTF

SEQ ID NO: 2225029 - protein, 8 aa, Cryptosporidium parvum
SHAPTSSH

SEQ ID NO: 2225030 - protein, 5 aa, Cryptosporidium parvum
SHDRD

SEQ ID NO: 2225031 - protein, 11 aa, Cryptosporidium parvum
SHGTGTQLGDP

SEQ ID NO: 2225032 - protein, 5 aa, Cryptosporidium parvum
SHHSS

SEQ ID NO: 2225033 - protein, 47 aa, Cryptosporidium parvum; identical to SEQ ID NO: 2119592

SEQ ID NO: 2225034 - protein, 9 aa, Cryptosporidium parvum
SHKDEEYKN

SEQ ID NO: 2225035 - protein, 8 aa, Cryptosporidium parvum
SHKESTKM

SEQ ID NO: 2225036 - protein, 10 aa, Cryptosporidium parvum
SHKRNSNYNS

SEQ ID NO: 2225037 - protein, 40 aa, Cryptosporidium parvum
SHLKGDQSSQIGNSNSISISDAYQSNNFSATSSSYSSNLG

SEQ ID NO: 2225038 - protein, 11 aa, Cryptosporidium parvum
SHNGCDSEISN

SEQ ID NO: 2225039 - protein, 9 aa, Cryptosporidium parvum
SHNHSNNTN

SEQ ID NO: 2225040 - protein, 7 aa, Cryptosporidium parvum
SHNPGGH

SEQ ID NO: 2225041 - protein, 5 aa, Cryptosporidium parvum
SHNTE

SEQ ID NO: 2225042 - protein, 10 aa, Cryptosporidium parvum
SHQEADSYLP

SEQ ID NO: 2225043 - protein, 9 aa, Cryptosporidium parvum
SHQKRDSKI

SEQ ID NO: 2225044 - protein, 5 aa, Cryptosporidium parvum
SHREN

SEQ ID NO: 2225045 - protein, 13 aa, Cryptosporidium parvum
SHRYEKKSNDKIP

SEQ ID NO: 2225046 - protein, 13 aa, Cryptosporidium parvum
SHSIDTKHKPQKI

SEQ ID NO: 2225047 - protein, 24 aa, Cryptosporidium parvum
SHSNFQQNGSIDSALSSRRSNEFN

SEQ ID NO: 2225048 - protein, 12 aa, Cryptosporidium parvum
SHSNIGSGIPHG

SEQ ID NO: 2225049 - protein, 12 aa, Cryptosporidium parvum
SHSPRSDRGSSD

SEQ ID NO: 2225050 - protein, 17 aa, Cryptosporidium parvum
SHSQSKSCEDEERSRIE

SEQ ID NO: 2225051 - protein, 8 aa, Cryptosporidium parvum
SHTEPSGL

SEQ ID NO: 2225052 - protein, 8 aa, Cryptosporidium parvum
SHTSDSSL

SEQ ID NO: 2225053 - protein, 14 aa, Cryptosporidium parvum
SHYRKESDSHFSES

SEQ ID NO: 2225054 - protein, 11 aa, Cryptosporidium parvum
SIAEGKEIQSE

SEQ ID NO: 2225055 - protein, 6 aa, Cryptosporidium parvum
SIDKNI

SEQ ID NO: 2225056 - protein, 7 aa, Cryptosporidium parvum
SIDKSQV

SEQ ID NO: 2225057 - protein, 8 aa, Cryptosporidium parvum
SIDNGHDR

SEQ ID NO: 2225058 - protein, 10 aa, Cryptosporidium parvum
SIDNNNNNNH

SEQ ID NO: 2225059 - protein, 4 aa, Cryptosporidium parvum
SIDS

SEQ ID NO: 2225060 - protein, 20 aa, Cryptosporidium parvum
SIDSTGSFSRENTNERFNRL

SEQ ID NO: 2225061 - protein, 7 aa, Cryptosporidium parvum
SIEESSF

SEQ ID NO: 2225062 - protein, 18 aa, Cryptosporidium parvum
SIENNEIGNEDDQVSENN

SEQ ID NO: 2225063 - protein, 9 aa, Cryptosporidium parvum
SIENTKNHN

SEQ ID NO: 2225064 - protein, 4 aa, Cryptosporidium parvum
SIER

SEQ ID NO: 2225065 - protein, 7 aa, Cryptosporidium parvum
SIGDSSK

SEQ ID NO: 2225066 - protein, 8 aa, Cryptosporidium parvum
SIGEPATQ

SEQ ID NO: 2225067 - protein, 13 aa, Cryptosporidium parvum
SIGGTVSPKENPI

SEQ ID NO: 2225068 - protein, 12 aa, Cryptosporidium parvum
SIGKNSNVGSKD

SEQ ID NO: 2225069 - protein, 10 aa, Cryptosporidium parvum
SIGPNSSKSF

SEQ ID NO: 2225070 - protein, 8 aa, Cryptosporidium parvum
SIGQGRNY

SEQ ID NO: 2225071 - protein, 11 aa, Cryptosporidium parvum
SIGRNSGVEEV

SEQ ID NO: 2225072 - protein, 15 aa, Cryptosporidium parvum
SIGSPISTNLSPTSM

SEQ ID NO: 2225073 - protein, 6 aa, Cryptosporidium parvum
SIGTEF

SEQ ID NO: 2225074 - protein, 4 aa, Cryptosporidium parvum
SIIG

SEQ ID NO: 2225075 - protein, 6 aa, Cryptosporidium parvum
SIKDEK

SEQ ID NO: 2225076 - protein, 12 aa, Cryptosporidium parvum
SIKDKESITSND

SEQ ID NO: 2225077 - protein, 5 aa, Cryptosporidium parvum
SIKDL

SEQ ID NO: 2225078 - protein, 8 aa, Cryptosporidium parvum
SIKDSKKN

SEQ ID NO: 2225079 - protein, 16 aa, Cryptosporidium parvum
SIKERSNQVEADSREY

SEQ ID NO: 2225080 - protein, 24 aa, Cryptosporidium parvum
SIKNSEPNLTADEETNSNQCTSTL

SEQ ID NO: 2225081 - protein, 6 aa, Cryptosporidium parvum
SIKPTL

SEQ ID NO: 2225082 - protein, 7 aa, Cryptosporidium parvum
SIKSDSK

SEQ ID NO: 2225083 - protein, 32 aa, Cryptosporidium parvum
SILSSNGNNSPSAYLTKNSSNNSLKTQSNPNI

SEQ ID NO: 2225084 - protein, 25 aa, Cryptosporidium parvum
SINAQSTSSSTSSNSNSSSKSSSAM

SEQ ID NO: 2225085 - protein, 4 aa, Cryptosporidium parvum
SIND

SEQ ID NO: 2225086 - protein, 15 aa, Cryptosporidium parvum
SINDDAAQKDCTQQC

SEQ ID NO: 2225087 - protein, 13 aa, Cryptosporidium parvum
SINDNENSIKNTD

SEQ ID NO: 2225088 - protein, 7 aa, Cryptosporidium parvum
SINDQSF

SEQ ID NO: 2225089 - protein, 16 aa, Cryptosporidium parvum
SINEEENELDNEKKDY

SEQ ID NO: 2225090 - protein, 22 aa, Cryptosporidium parvum
SINGNNSNIEGSITESTCENRF

SEQ ID NO: 2225091 - protein, 13 aa, Cryptosporidium parvum
SINKGSSLNKNPK

SEQ ID NO: 2225092 - protein, 5 aa, Cryptosporidium parvum
SINKI

SEQ ID NO: 2225093 - protein, 6 aa, Cryptosporidium parvum
SINKQN

SEQ ID NO: 2225094 - protein, 24 aa, Cryptosporidium parvum
SINQNEVNIGNKEKTLTKGTFGEE

SEQ ID NO: 2225095 - protein, 13 aa, Cryptosporidium parvum
SINRDDYKLQDST

SEQ ID NO: 2225096 - protein, 52 aa, Cryptosporidium parvum
SINSDSLSSSSSSSLSSSSSSSSSSSSSSLSSSSSSSSSSSSSFQNPTNNYE

SEQ ID NO: 2225097 - protein, 7 aa, Cryptosporidium parvum
SINSPKR

SEQ ID NO: 2225098 - protein, 23 aa, Cryptosporidium parvum
SINTGATSSNSSVSSGTSNSQVL

SEQ ID NO: 2225099 - protein, 4 aa, Cryptosporidium parvum
SIPA

SEQ ID NO: 2225100 - protein, 14 aa, Cryptosporidium parvum
SIPESAEYVSTSGY

SEQ ID NO: 2225101 - protein, 14 aa, Cryptosporidium parvum
SIPGAKTYGLPDGT

SEQ ID NO: 2225102 - protein, 5 aa, Cryptosporidium parvum
SIPHS

SEQ ID NO: 2225103 - protein, 10 aa, Cryptosporidium parvum
SIPPKEDLES

SEQ ID NO: 2225104 - protein, 5 aa, Cryptosporidium parvum
SIPPW

SEQ ID NO: 2225105 - protein, 13 aa, Cryptosporidium parvum
SIPSNSESPNNSF

SEQ ID NO: 2225106 - protein, 6 aa, Cryptosporidium parvum
SIPTPR

SEQ ID NO: 2225107 - protein, 7 aa, Cryptosporidium parvum
SIPTSSL

SEQ ID NO: 2225108 - protein, 10 aa, Cryptosporidium parvum
SIQDKSSLSQ

SEQ ID NO: 2225109 - protein, 8 aa, Cryptosporidium parvum
SIQDNSPI

SEQ ID NO: 2225110 - protein, 6 aa, Cryptosporidium parvum
SIQEKN

SEQ ID NO: 2225111 - protein, 18 aa, Cryptosporidium parvum
SIQNSNKSEISNPSEHDL

SEQ ID NO: 2225112 - protein, 14 aa, Cryptosporidium parvum
SIQQSGNLYNMLVK

SEQ ID NO: 2225113 - protein, 4 aa, Cryptosporidium parvum
SIRQ

SEQ ID NO: 2225114 - protein, 5 aa, Cryptosporidium parvum
SISAI

SEQ ID NO: 2225115 - protein, 4 aa, Cryptosporidium parvum
SISD

SEQ ID NO: 2225116 - protein, 23 aa, Cryptosporidium parvum
SISEGTTLAPNTPLGKLTTDFIL

SEQ ID NO: 2225117 - protein, 8 aa, Cryptosporidium parvum
SISEKNDI

SEQ ID NO: 2225118 - protein, 6 aa, Cryptosporidium parvum
SISESD

SEQ ID NO: 2225119 - protein, 10 aa, Cryptosporidium parvum
SISGNNYRGR

SEQ ID NO: 2225120 - protein, 6 aa, Cryptosporidium parvum
SISGRG

SEQ ID NO: 2225121 - protein, 13 aa, Cryptosporidium parvum
SISKDEKNNQSIC

SEQ ID NO: 2225122 - protein, 9 aa, Cryptosporidium parvum
SISKKKGFK

SEQ ID NO: 2225123 - protein, 8 aa, Cryptosporidium parvum
SISKNPVS

SEQ ID NO: 2225124 - protein, 4 aa, Cryptosporidium parvum
SISL

SEQ ID NO: 2225125 - protein, 4 aa, Cryptosporidium parvum
SISN

SEQ ID NO: 2225126 - protein, 5 aa, Cryptosporidium parvum
SISNG

SEQ ID NO: 2225127 - protein, 5 aa, Cryptosporidium parvum
SISNH

SEQ ID NO: 2225128 - protein, 7 aa, Cryptosporidium parvum
SISNKLE

SEQ ID NO: 2225129 - protein, 5 aa, Cryptosporidium parvum
SISNN

SEQ ID NO: 2225130 - protein, 21 aa, Cryptosporidium parvum
SISNNVSSPSSSLNESDNKNP

SEQ ID NO: 2225131 - protein, 10 aa, Cryptosporidium parvum
SISNSSDENS

SEQ ID NO: 2225132 - protein, 9 aa, Cryptosporidium parvum
SISNSTGET

SEQ ID NO: 2225133 - protein, 6 aa, Cryptosporidium parvum
SISPYN

SEQ ID NO: 2225134 - protein, 6 aa, Cryptosporidium parvum
SISQND

SEQ ID NO: 2225135 - protein, 6 aa, Cryptosporidium parvum
SISRRD

SEQ ID NO: 2225136 - protein, 5 aa, Cryptosporidium parvum
SISSG

SEQ ID NO: 2225137 - protein, 6 aa, Cryptosporidium parvum
SISSID

SEQ ID NO: 2225138 - protein, 25 aa, Cryptosporidium parvum
SISSQSSKSASNNSSNTKQKPKSNF

SEQ ID NO: 2225139 - protein, 6 aa, Cryptosporidium parvum
SISSSI

SEQ ID NO: 2225140 - protein, 10 aa, Cryptosporidium parvum
SISSSSQDLT

SEQ ID NO: 2225141 - protein, 7 aa, Cryptosporidium parvum
SISTSTN

SEQ ID NO: 2225142 - protein, 15 aa, Cryptosporidium parvum
SISYDSNIAPPEKKS

SEQ ID NO: 2225143 - protein, 7 aa, Cryptosporidium parvum
SITARFG

SEQ ID NO: 2225144 - protein, 12 aa, Cryptosporidium parvum
SITESCGGELQR

SEQ ID NO: 2225145 - protein, 7 aa, Cryptosporidium parvum
SITNSQD

SEQ ID NO: 2225146 - protein, 11 aa, Cryptosporidium parvum
SITQEDGLETE

SEQ ID NO: 2225147 - protein, 5 aa, Cryptosporidium parvum
SITSA

SEQ ID NO: 2225148 - protein, 9 aa, Cryptosporidium parvum
SITSCRQNT

SEQ ID NO: 2225149 - protein, 8 aa, Cryptosporidium parvum
SITTAPGQ

SEQ ID NO: 2225150 - protein, 5 aa, Cryptosporidium parvum
SITTR

SEQ ID NO: 2225151 - protein, 9 aa, Cryptosporidium parvum
SIYPKSNED

SEQ ID NO: 2225152 - protein, 13 aa, Cryptosporidium parvum
SIYSNSKISGNTF

SEQ ID NO: 2225153 - protein, 10 aa, Cryptosporidium parvum
SKAANRGDHI

SEQ ID NO: 2225154 - protein, 8 aa, Cryptosporidium parvum
SKAEENLR

SEQ ID NO: 2225155 - protein, 7 aa, Cryptosporidium parvum
SKANQEE

SEQ ID NO: 2225156 - protein, 6 aa, Cryptosporidium parvum
SKAPYI

SEQ ID NO: 2225157 - protein, 6 aa, Cryptosporidium parvum
SKASFS

SEQ ID NO: 2225158 - protein, 9 aa, Cryptosporidium parvum
SKASIKHSE

SEQ ID NO: 2225159 - protein, 8 aa, Cryptosporidium parvum
SKASNRAY

SEQ ID NO: 2225160 - protein, 8 aa, Cryptosporidium parvum
SKASTTFT

SEQ ID NO: 2225161 - protein, 8 aa, Cryptosporidium parvum
SKATKTDL

SEQ ID NO: 2225162 - protein, 12 aa, Cryptosporidium parvum
SKAVDLHDSYIN

SEQ ID NO: 2225163 - protein, 27 aa, Cryptosporidium parvum
SKCKSNGTNNFKKPKNLNGDDENNAIN

SEQ ID NO: 2225164 - protein, 25 aa, Cryptosporidium parvum
SKCQQRTNVSKKTISNRENDTNNNW

SEQ ID NO: 2225165 - protein, 5 aa, Cryptosporidium parvum
SKDAD

SEQ ID NO: 2225166 - protein, 16 aa, Cryptosporidium parvum
SKDASNKMDQPHLPYK

SEQ ID NO: 2225167 - protein, 5 aa, Cryptosporidium parvum
SKDCD

SEQ ID NO: 2225168 - protein, 8 aa, Cryptosporidium parvum
SKDDGFLS

SEQ ID NO: 2225169 - protein, 10 aa, Cryptosporidium parvum
SKDDNSEMRD

SEQ ID NO: 2225170 - protein, 20 aa, Cryptosporidium parvum
SKDKKEETTNNVEVNQEDEN

SEQ ID NO: 2225171 - protein, 8 aa, Cryptosporidium parvum
SKDKLESA

SEQ ID NO: 2225172 - protein, 7 aa, Cryptosporidium parvum
SKDKNNR

SEQ ID NO: 2225173 - protein, 12 aa, Cryptosporidium parvum
SKDNCENKETAS

SEQ ID NO: 2225174 - protein, 23 aa, Cryptosporidium parvum
SKDNNNSNNSEELKKSPQNSSNC

SEQ ID NO: 2225175 - protein, 7 aa, Cryptosporidium parvum
SKDPNIK

SEQ ID NO: 2225176 - protein, 15 aa, Cryptosporidium parvum
SKDRNGILPKTTNNF

SEQ ID NO: 2225177 - protein, 9 aa, Cryptosporidium parvum
SKDTSRLSD

SEQ ID NO: 2225178 - protein, 4 aa, Cryptosporidium parvum
SKDY

SEQ ID NO: 2225179 - protein, 25 aa, Cryptosporidium parvum
SKEAQSRISDEKNKKIKRNQVDSDS

SEQ ID NO: 2225180 - protein, 5 aa, Cryptosporidium parvum
SKECS

SEQ ID NO: 2225181 - protein, 19 aa, Cryptosporidium parvum
SKEEEGEKEEEEEDIEEEV

SEQ ID NO: 2225182 - protein, 16 aa, Cryptosporidium parvum
SKEEKDQDQAKSLNEF

SEQ ID NO: 2225183 - protein, 9 aa, Cryptosporidium parvum
SKEEKQSKD

SEQ ID NO: 2225184 - protein, 16 aa, Cryptosporidium parvum
SKEELEEIERKDKNGK

SEQ ID NO: 2225185 - protein, 14 aa, Cryptosporidium parvum
SKEENFRSTAKGTL

SEQ ID NO: 2225186 - protein, 5 aa, Cryptosporidium parvum
SKEEW

SEQ ID NO: 2225187 - protein, 12 aa, Cryptosporidium parvum
SKEGNSKELDIT

SEQ ID NO: 2225188 - protein, 12 aa, Cryptosporidium parvum
SKEIEDSEARFK

SEQ ID NO: 2225189 - protein, 6 aa, Cryptosporidium parvum
SKEKDA

SEQ ID NO: 2225190 - protein, 5 aa, Cryptosporidium parvum
SKEKE

SEQ ID NO: 2225191 - protein, 31 aa, Cryptosporidium parvum
SKEKRVSEKIEEEEDDDSTTYNERDRENKGW

SEQ ID NO: 2225192 - protein, 7 aa, Cryptosporidium parvum
SKELESS

SEQ ID NO: 2225193 - protein, 9 aa, Cryptosporidium parvum
SKENELNIG

SEQ ID NO: 2225194 - protein, 8 aa, Cryptosporidium parvum
SKENEVQE

SEQ ID NO: 2225195 - protein, 21 aa, Cryptosporidium parvum
SKENNDSKTSCSNSRRNSLST

SEQ ID NO: 2225196 - protein, 10 aa, Cryptosporidium parvum
SKENREIEKY

SEQ ID NO: 2225197 - protein, 11 aa, Cryptosporidium parvum
SKENSNENPNN

SEQ ID NO: 2225198 - protein, 12 aa, Cryptosporidium parvum
SKENSNKLPSME

SEQ ID NO: 2225199 - protein, 8 aa, Cryptosporidium parvum
SKENSSSL

SEQ ID NO: 2225200 - protein, 8 aa, Cryptosporidium parvum
SKEPENID

SEQ ID NO: 2225201 - protein, 4 aa, Cryptosporidium parvum
SKEQ

SEQ ID NO: 2225202 - protein, 7 aa, Cryptosporidium parvum
SKEQKPI

SEQ ID NO: 2225203 - protein, 9 aa, Cryptosporidium parvum
SKEQSNNFE

SEQ ID NO: 2225204 - protein, 5 aa, Cryptosporidium parvum
SKERM

SEQ ID NO: 2225205 - protein, 9 aa, Cryptosporidium parvum
SKERSKTTN

SEQ ID NO: 2225206 - protein, 11 aa, Cryptosporidium parvum
SKESLDSPEEY

SEQ ID NO: 2225207 - protein, 6 aa, Cryptosporidium parvum
SKESNI

SEQ ID NO: 2225208 - protein, 31 aa, Cryptosporidium parvum
SKETEPDTKNIENKTKSSVKETEDDKTKEID

SEQ ID NO: 2225209 - protein, 5 aa, Cryptosporidium parvum
SKETY

SEQ ID NO: 2225210 - protein, 7 aa, Cryptosporidium parvum
SKEVSSK

SEQ ID NO: 2225211 - protein, 4 aa, Cryptosporidium parvum
SKEY

SEQ ID NO: 2225212 - protein, 4 aa, Cryptosporidium parvum
SKFD

SEQ ID NO: 2225213 - protein, 10 aa, Cryptosporidium parvum
SKFEQSTSTC

SEQ ID NO: 2225214 - protein, 4 aa, Cryptosporidium parvum
SKFK

SEQ ID NO: 2225215 - protein, 5 aa, Cryptosporidium parvum
SKFPD

SEQ ID NO: 2225216 - protein, 9 aa, Cryptosporidium parvum
SKFSSTSRF

SEQ ID NO: 2225217 - protein, 8 aa, Cryptosporidium parvum
SKFTSENN

SEQ ID NO: 2225218 - protein, 9 aa, Cryptosporidium parvum
SKGDPSEFK

SEQ ID NO: 2225219 - protein, 4 aa, Cryptosporidium parvum
SKGE

SEQ ID NO: 2225220 - protein, 5 aa, Cryptosporidium parvum
SKGER

SEQ ID NO: 2225221 - protein, 7 aa, Cryptosporidium parvum
SKGGESF

SEQ ID NO: 2225222 - protein, 7 aa, Cryptosporidium parvum
SKGIESE

SEQ ID NO: 2225223 - protein, 5 aa, Cryptosporidium parvum
SKGLR

SEQ ID NO: 2225224 - protein, 12 aa, Cryptosporidium parvum
SKGLSQLKSQTI

SEQ ID NO: 2225225 - protein, 8 aa, Cryptosporidium parvum
SKGNEVSD

SEQ ID NO: 2225226 - protein, 10 aa, Cryptosporidium parvum
SKGPENTKIY

SEQ ID NO: 2225227 - protein, 16 aa, Cryptosporidium parvum
SKGSGGGINRQASTIT

SEQ ID NO: 2225228 - protein, 17 aa, Cryptosporidium parvum
SKGSSAQPKRTVFGYDF

SEQ ID NO: 2225229 - protein, 7 aa, Cryptosporidium parvum
SKGTKIE

SEQ ID NO: 2225230 - protein, 8 aa, Cryptosporidium parvum
SKGTNEKN

SEQ ID NO: 2225231 - protein, 7 aa, Cryptosporidium parvum
SKHLGQK

SEQ ID NO: 2225232 - protein, 11 aa, Cryptosporidium parvum
SKHNHSSKTGD

SEQ ID NO: 2225233 - protein, 8 aa, Cryptosporidium parvum
SKHNQGSR

SEQ ID NO: 2225234 - protein, 21 aa, Cryptosporidium parvum
SKHPENDLDYPEGESSKDGFL

SEQ ID NO: 2225235 - protein, 13 aa, Cryptosporidium parvum
SKHPETERLSKKN

SEQ ID NO: 2225236 - protein, 10 aa, Cryptosporidium parvum
SKHRTSDNGQ

SEQ ID NO: 2225237 - protein, 7 aa, Cryptosporidium parvum
SKIAQNA

SEQ ID NO: 2225238 - protein, 7 aa, Cryptosporidium parvum
SKIESND

SEQ ID NO: 2225239 - protein, 6 aa, Cryptosporidium parvum
SKIGGN

SEQ ID NO: 2225240 - protein, 6 aa, Cryptosporidium parvum
SKIGRH

SEQ ID NO: 2225241 - protein, 14 aa, Cryptosporidium parvum
SKINSANESQPIQW

SEQ ID NO: 2225242 - protein, 23 aa, Cryptosporidium parvum
SKINSDIENADSKNTNSGEEESL

SEQ ID NO: 2225243 - protein, 23 aa, Cryptosporidium parvum
SKINSKKKVKTQKTGRSNSNKTL

SEQ ID NO: 2225244 - protein, 10 aa, Cryptosporidium parvum
SKIPQQLNRA

SEQ ID NO: 2225245 - protein, 8 aa, Cryptosporidium parvum
SKIPSTQR

SEQ ID NO: 2225246 - protein, 8 aa, Cryptosporidium parvum
SKIRSKNL

SEQ ID NO: 2225247 - protein, 7 aa, Cryptosporidium parvum
SKIRSYG

SEQ ID NO: 2225248 - protein, 4 aa, Cryptosporidium parvum
SKIS

SEQ ID NO: 2225249 - protein, 9 aa, Cryptosporidium parvum
SKISQKDPM

SEQ ID NO: 2225250 - protein, 5 aa, Cryptosporidium parvum
SKITE

SEQ ID NO: 2225251 - protein, 7 aa, Cryptosporidium parvum
SKITEGE

SEQ ID NO: 2225252 - protein, 6 aa, Cryptosporidium parvum
SKITQT

SEQ ID NO: 2225253 - protein, 8 aa, Cryptosporidium parvum
SKKASEKS

SEQ ID NO: 2225254 - protein, 6 aa, Cryptosporidium parvum
SKKDEN

SEQ ID NO: 2225255 - protein, 7 aa, Cryptosporidium parvum
SKKDKNN

SEQ ID NO: 2225256 - protein, 15 aa, Cryptosporidium parvum
SKKEKSQDGIQGEND

SEQ ID NO: 2225257 - protein, 6 aa, Cryptosporidium parvum
SKKENI

SEQ ID NO: 2225258 - protein, 8 aa, Cryptosporidium parvum
SKKENINI

SEQ ID NO: 2225259 - protein, 9 aa, Cryptosporidium parvum
SKKESGIEL

SEQ ID NO: 2225260 - protein, 10 aa, Cryptosporidium parvum
SKKGISGGEM

SEQ ID NO: 2225261 - protein, 14 aa, Cryptosporidium parvum
SKKGNKALSSSSKR

SEQ ID NO: 2225262 - protein, 8 aa, Cryptosporidium parvum
SKKINDES

SEQ ID NO: 2225263 - protein, 8 aa, Cryptosporidium parvum
SKKKPNVS

SEQ ID NO: 2225264 - protein, 34 aa, Cryptosporidium parvum
SKKKSKKKLNKFSKSSNSELEKQQNDKKEYYPTK

SEQ ID NO: 2225265 - protein, 7 aa, Cryptosporidium parvum
SKKLQGP

SEQ ID NO: 2225266 - protein, 8 aa, Cryptosporidium parvum
SKKLRKTN

SEQ ID NO: 2225267 - protein, 4 aa, Cryptosporidium parvum
SKKM

SEQ ID NO: 2225268 - protein, 4 aa, Cryptosporidium parvum
SKKN

SEQ ID NO: 2225269 - protein, 6 aa, Cryptosporidium parvum
SKKNGW

SEQ ID NO: 2225270 - protein, 19 aa, Cryptosporidium parvum
SKKNRVKCTKDRNARRSEI

SEQ ID NO: 2225271 - protein, 5 aa, Cryptosporidium parvum
SKKNT

SEQ ID NO: 2225272 - protein, 5 aa, Cryptosporidium parvum
SKKPL

SEQ ID NO: 2225273 - protein, 8 aa, Cryptosporidium parvum
SKKPRNLS

SEQ ID NO: 2225274 - protein, 8 aa, Cryptosporidium parvum
SKKPSSCR

SEQ ID NO: 2225275 - protein, 9 aa, Cryptosporidium parvum
SKKPSSSGM

SEQ ID NO: 2225276 - protein, 7 aa, Cryptosporidium parvum
SKKQNSN

SEQ ID NO: 2225277 - protein, 6 aa, Cryptosporidium parvum
SKKRNI

SEQ ID NO: 2225278 - protein, 19 aa, Cryptosporidium parvum
SKKRNKKQTIYKGKQKETL

SEQ ID NO: 2225279 - protein, 12 aa, Cryptosporidium parvum
SKKRSKKKDDCH

SEQ ID NO: 2225280 - protein, 13 aa, Cryptosporidium parvum
SKKSEALNASEEQ

SEQ ID NO: 2225281 - protein, 5 aa, Cryptosporidium parvum
SKKSK

SEQ ID NO: 2225282 - protein, 8 aa, Cryptosporidium parvum
SKKSWQAR

SEQ ID NO: 2225283 - protein, 6 aa, Cryptosporidium parvum
SKKTLE

SEQ ID NO: 2225284 - protein, 11 aa, Cryptosporidium parvum
SKLENSNGTQL

SEQ ID NO: 2225285 - protein, 6 aa, Cryptosporidium parvum
SKLGDQ

SEQ ID NO: 2225286 - protein, 4 aa, Cryptosporidium parvum
SKLK

SEQ ID NO: 2225287 - protein, 5 aa, Cryptosporidium parvum
SKLKA

SEQ ID NO: 2225288 - protein, 4 aa, Cryptosporidium parvum
SKLN

SEQ ID NO: 2225289 - protein, 13 aa, Cryptosporidium parvum
SKLPYSSKHEKAH

SEQ ID NO: 2225290 - protein, 7 aa, Cryptosporidium parvum
SKLRKEK

SEQ ID NO: 2225291 - protein, 4 aa, Cryptosporidium parvum
SKLS

SEQ ID NO: 2225292 - protein, 12 aa, Cryptosporidium parvum
SKLSSALSTNTL

SEQ ID NO: 2225293 - protein, 12 aa, Cryptosporidium parvum
SKLSSLNNTENN

SEQ ID NO: 2225294 - protein, 7 aa, Cryptosporidium parvum
SKLSSSG

SEQ ID NO: 2225295 - protein, 12 aa, Cryptosporidium parvum
SKLTASTLSESA

SEQ ID NO: 2225296 - protein, 5 aa, Cryptosporidium parvum
SKLTG

SEQ ID NO: 2225297 - protein, 6 aa, Cryptosporidium parvum
SKMQED

SEQ ID NO: 2225298 - protein, 6 aa, Cryptosporidium parvum
SKNCVG

SEQ ID NO: 2225299 - protein, 11 aa, Cryptosporidium parvum
SKNDDDLPNTY

SEQ ID NO: 2225300 - protein, 15 aa, Cryptosporidium parvum
SKNDEDKNQSDSSSW

SEQ ID NO: 2225301 - protein, 6 aa, Cryptosporidium parvum
SKNEEE

SEQ ID NO: 2225302 - protein, 7 aa, Cryptosporidium parvum
SKNEELD

SEQ ID NO: 2225303 - protein, 13 aa, Cryptosporidium parvum
SKNEFNYSKETQT

SEQ ID NO: 2225304 - protein, 7 aa, Cryptosporidium parvum
SKNENNP

SEQ ID NO: 2225305 - protein, 9 aa, Cryptosporidium parvum
SKNEQTEGL

SEQ ID NO: 2225306 - protein, 7 aa, Cryptosporidium parvum
SKNESIL

SEQ ID NO: 2225307 - protein, 13 aa, Cryptosporidium parvum
SKNIEPTKREDCS

SEQ ID NO: 2225308 - protein, 5 aa, Cryptosporidium parvum
SKNKD

SEQ ID NO: 2225309 - protein, 11 aa, Cryptosporidium parvum
SKNKGKKNKLV

SEQ ID NO: 2225310 - protein, 12 aa, Cryptosporidium parvum
SKNKKDKKEHSF

SEQ ID NO: 2225311 - protein, 9 aa, Cryptosporidium parvum
SKNKKRKDV

SEQ ID NO: 2225312 - protein, 15 aa, Cryptosporidium parvum
SKNKSLNKLSKQKRR

SEQ ID NO: 2225313 - protein, 11 aa, Cryptosporidium parvum
SKNLSQSSKNN

SEQ ID NO: 2225314 - protein, 30 aa, Cryptosporidium parvum
SKNNEKKQKEKKISQVNQQEQLNNNVTSEK

SEQ ID NO: 2225315 - protein, 5 aa, Cryptosporidium parvum
SKNNL

SEQ ID NO: 2225316 - protein, 8 aa, Cryptosporidium parvum
SKNNNDDF

SEQ ID NO: 2225317 - protein, 19 aa, Cryptosporidium parvum
SKNNNTNSSIMDDNEKSNI

SEQ ID NO: 2225318 - protein, 12 aa, Cryptosporidium parvum
SKNNQKNNTYGD

SEQ ID NO: 2225319 - protein, 7 aa, Cryptosporidium parvum
SKNPENS

SEQ ID NO: 2225320 - protein, 7 aa, Cryptosporidium parvum
SKNPIEE

SEQ ID NO: 2225321 - protein, 21 aa, Cryptosporidium parvum
SKNPSSNQNLNGLSASGSTNI

SEQ ID NO: 2225322 - protein, 15 aa, Cryptosporidium parvum
SKNPTVVSRTGNNDM

SEQ ID NO: 2225323 - protein, 16 aa, Cryptosporidium parvum
SKNQGSSSGSNSAPFT

SEQ ID NO: 2225324 - protein, 8 aa, Cryptosporidium parvum
SKNQKDRF

SEQ ID NO: 2225325 - protein, 4 aa, Cryptosporidium parvum
SKNR

SEQ ID NO: 2225326 - protein, 6 aa, Cryptosporidium parvum
SKNSAL

SEQ ID NO: 2225327 - protein, 9 aa, Cryptosporidium parvum
SKNSNFEYS

SEQ ID NO: 2225328 - protein, 9 aa, Cryptosporidium parvum
SKNSSMNEQ

SEQ ID NO: 2225329 - protein, 9 aa, Cryptosporidium parvum
SKNSTEKSK

SEQ ID NO: 2225330 - protein, 15 aa, Cryptosporidium parvum
SKNSTRDCNIEGNSQ

SEQ ID NO: 2225331 - protein, 8 aa, Cryptosporidium parvum
SKNTGSVE

SEQ ID NO: 2225332 - protein, 6 aa, Cryptosporidium parvum
SKNTNN

SEQ ID NO: 2225333 - protein, 5 aa, Cryptosporidium parvum
SKNTP

SEQ ID NO: 2225334 - protein, 5 aa, Cryptosporidium parvum
SKNTR

SEQ ID NO: 2225335 - protein, 7 aa, Cryptosporidium parvum
SKNTYYS

SEQ ID NO: 2225336 - protein, 8 aa, Cryptosporidium parvum
SKPELEVS

SEQ ID NO: 2225337 - protein, 12 aa, Cryptosporidium parvum
SKPENDDKSESY

SEQ ID NO: 2225338 - protein, 19 aa, Cryptosporidium parvum
SKPGLEDSDINSDEKYSDI

SEQ ID NO: 2225339 - protein, 5 aa, Cryptosporidium parvum
SKPLG

SEQ ID NO: 2225340 - protein, 5 aa, Cryptosporidium parvum
SKPLL

SEQ ID NO: 2225341 - protein, 6 aa, Cryptosporidium parvum
SKPRNI

SEQ ID NO: 2225342 - protein, 9 aa, Cryptosporidium parvum
SKPSMSPSE

SEQ ID NO: 2225343 - protein, 10 aa, Cryptosporidium parvum
SKPSQDADFR

SEQ ID NO: 2225344 - protein, 4 aa, Cryptosporidium parvum
SKPY

SEQ ID NO: 2225345 - protein, 12 aa, Cryptosporidium parvum
SKPYNDSFTKST

SEQ ID NO: 2225346 - protein, 16 aa, Cryptosporidium parvum
SKQECKVKDENEKSIS

SEQ ID NO: 2225347 - protein, 7 aa, Cryptosporidium parvum
SKQIGTS

SEQ ID NO: 2225348 - protein, 15 aa, Cryptosporidium parvum
SKQIKEKEIKKNRSI

SEQ ID NO: 2225349 - protein, 8 aa, Cryptosporidium parvum
SKQKPKKI

SEQ ID NO: 2225350 - protein, 11 aa, Cryptosporidium parvum
SKQNEGGIKQP

SEQ ID NO: 2225351 - protein, 10 aa, Cryptosporidium parvum
SKQNNEDKNL

SEQ ID NO: 2225352 - protein, 6 aa, Cryptosporidium parvum
SKQPAN

SEQ ID NO: 2225353 - protein, 6 aa, Cryptosporidium parvum
SKQPLR

SEQ ID NO: 2225354 - protein, 7 aa, Cryptosporidium parvum
SKQRIDT

SEQ ID NO: 2225355 - protein, 8 aa, Cryptosporidium parvum
SKRSSENC

SEQ ID NO: 2225356 - protein, 6 aa, Cryptosporidium parvum
SKRSTR

SEQ ID NO: 2225357 - protein, 4 aa, Cryptosporidium parvum
SKRT

SEQ ID NO: 2225358 - protein, 7 aa, Cryptosporidium parvum
SKRTRAK

SEQ ID NO: 2225359 - protein, 10 aa, Cryptosporidium parvum
SKRVSSQRVS

SEQ ID NO: 2225360 - protein, 8 aa, Cryptosporidium parvum
SKSASSQL

SEQ ID NO: 2225361 - protein, 12 aa, Cryptosporidium parvum
SKSCGEGFQNRS

SEQ ID NO: 2225362 - protein, 6 aa, Cryptosporidium parvum
SKSDLV

SEQ ID NO: 2225363 - protein, 10 aa, Cryptosporidium parvum
SKSDSTTIEN

SEQ ID NO: 2225364 - protein, 30 aa, Cryptosporidium parvum
SKSEKSNSRSSKKKNEHNKAKHENQSQGKK

SEQ ID NO: 2225365 - protein, 24 aa, Cryptosporidium parvum
SKSENSEDSNDNDDNGTNNNGKDV

SEQ ID NO: 2225366 - protein, 10 aa, Cryptosporidium parvum
SKSERSGRKL

SEQ ID NO: 2225367 - protein, 6 aa, Cryptosporidium parvum
SKSETI

SEQ ID NO: 2225368 - protein, 7 aa, Cryptosporidium parvum
SKSIDNN

SEQ ID NO: 2225369 - protein, 7 aa, Cryptosporidium parvum
SKSIEKK

SEQ ID NO: 2225370 - protein, 20 aa, Cryptosporidium parvum
SKSIKNSYSGIKNSKSNNFK

SEQ ID NO: 2225371 - protein, 9 aa, Cryptosporidium parvum
SKSIQDDSN

SEQ ID NO: 2225372 - protein, 8 aa, Cryptosporidium parvum
SKSKEFSN

SEQ ID NO: 2225373 - protein, 5 aa, Cryptosporidium parvum
SKSKK

SEQ ID NO: 2225374 - protein, 10 aa, Cryptosporidium parvum
SKSKTKSLRA

SEQ ID NO: 2225375 - protein, 4 aa, Cryptosporidium parvum
SKSL

SEQ ID NO: 2225376 - protein, 7 aa, Cryptosporidium parvum
SKSNGVI

SEQ ID NO: 2225377 - protein, 7 aa, Cryptosporidium parvum
SKSNLKP

SEQ ID NO: 2225378 - protein, 7 aa, Cryptosporidium parvum
SKSNSRK

SEQ ID NO: 2225379 - protein, 4 aa, Cryptosporidium parvum
SKSP

SEQ ID NO: 2225380 - protein, 5 aa, Cryptosporidium parvum
SKSPM

SEQ ID NO: 2225381 - protein, 13 aa, Cryptosporidium parvum
SKSPNGKEKKSKV

SEQ ID NO: 2225382 - protein, 10 aa, Cryptosporidium parvum
SKSRERLSSV

SEQ ID NO: 2225383 - protein, 7 aa, Cryptosporidium parvum
SKSRSIK

SEQ ID NO: 2225384 - protein, 4 aa, Cryptosporidium parvum
SKSS

SEQ ID NO: 2225385 - protein, 11 aa, Cryptosporidium parvum
SKSSITAAGRV

SEQ ID NO: 2225386 - protein, 13 aa, Cryptosporidium parvum
SKSSPTYDAEASN

SEQ ID NO: 2225387 - protein, 9 aa, Cryptosporidium parvum
SKSSRISKS

SEQ ID NO: 2225388 - protein, 9 aa, Cryptosporidium parvum
SKSSRKNAV

SEQ ID NO: 2225389 - protein, 9 aa, Cryptosporidium parvum
SKSSSHYNN

SEQ ID NO: 2225390 - protein, 18 aa, Cryptosporidium parvum
SKSSSNGNNSYKGSNTST

SEQ ID NO: 2225391 - protein, 16 aa, Cryptosporidium parvum
SKSTWNISENQSSNFT

SEQ ID NO: 2225392 - protein, 4 aa, Cryptosporidium parvum
SKSV

SEQ ID NO: 2225393 - protein, 23 aa, Cryptosporidium parvum
SKSVDKDAMRNGERAGKIKPTGI

SEQ ID NO: 2225394 - protein, 5 aa, Cryptosporidium parvum
SKTAN

SEQ ID NO: 2225395 - protein, 20 aa, Cryptosporidium parvum
SKTDNPREDEEGSEGEDGIS

SEQ ID NO: 2225396 - protein, 20 aa, Cryptosporidium parvum
SKTEEIEEKTIQTTNNTRTA

SEQ ID NO: 2225397 - protein, 8 aa, Cryptosporidium parvum
SKTESIDK

SEQ ID NO: 2225398 - protein, 4 aa, Cryptosporidium parvum
SKTI

SEQ ID NO: 2225399 - protein, 6 aa, Cryptosporidium parvum
SKTKKL

SEQ ID NO: 2225400 - protein, 38 aa, Cryptosporidium parvum
SKTKSRSKTRSRSKTRSGSKTRSRSESRSRSGSRSRPI

SEQ ID NO: 2225401 - protein, 9 aa, Cryptosporidium parvum
SKTKTQRYI

SEQ ID NO: 2225402 - protein, 4 aa, Cryptosporidium parvum
SKTL

SEQ ID NO: 2225403 - protein, 8 aa, Cryptosporidium parvum
SKTLPSSS

SEQ ID NO: 2225404 - protein, 9 aa, Cryptosporidium parvum
SKTNKNHSN

SEQ ID NO: 2225405 - protein, 30 aa, Cryptosporidium parvum
SKTNNKYNNSNNSIRDSSVRESQGYETLEQ

SEQ ID NO: 2225406 - protein, 7 aa, Cryptosporidium parvum
SKTNPNI

SEQ ID NO: 2225407 - protein, 5 aa, Cryptosporidium parvum
SKTPY

SEQ ID NO: 2225408 - protein, 11 aa, Cryptosporidium parvum
SKTQLNNGEIE

SEQ ID NO: 2225409 - protein, 13 aa, Cryptosporidium parvum
SKTRGKSSSDITE

SEQ ID NO: 2225410 - protein, 8 aa, Cryptosporidium parvum
SKTSTSIS

SEQ ID NO: 2225411 - protein, 8 aa, Cryptosporidium parvum
SKTTDSKI

SEQ ID NO: 2225412 - protein, 6 aa, Cryptosporidium parvum
SKTTLR

SEQ ID NO: 2225413 - protein, 6 aa, Cryptosporidium parvum
SKVGSV

SEQ ID NO: 2225414 - protein, 7 aa, Cryptosporidium parvum
SKVNESM

SEQ ID NO: 2225415 - protein, 6 aa, Cryptosporidium parvum
SKVNNN

SEQ ID NO: 2225416 - protein, 23 aa, Cryptosporidium parvum
SKVPFKERKSLKGITSSNSQEGK

SEQ ID NO: 2225417 - protein, 13 aa, Cryptosporidium parvum
SKVSKNEVKHANK

SEQ ID NO: 2225418 - protein, 10 aa, Cryptosporidium parvum
SKVSSFPKTG

SEQ ID NO: 2225419 - protein, 21 aa, Cryptosporidium parvum
SKVTYDGSGSRCARGGSSKEP

SEQ ID NO: 2225420 - protein, 35 aa, Cryptosporidium parvum
SKWRSTKFSSEASEFSNRNGSINPIESKSPKFQYP

SEQ ID NO: 2225421 - protein, 11 aa, Cryptosporidium parvum
SKWSNKNKFEL

SEQ ID NO: 2225422 - protein, 8 aa, Cryptosporidium parvum
SKYDQEES

SEQ ID NO: 2225423 - protein, 4 aa, Cryptosporidium parvum
SKYG

SEQ ID NO: 2225424 - protein, 4 aa, Cryptosporidium parvum
SKYK

SEQ ID NO: 2225425 - protein, 6 aa, Cryptosporidium parvum
SKYQTN

SEQ ID NO: 2225426 - protein, 6 aa, Cryptosporidium parvum
SKYRKV

SEQ ID NO: 2225427 - protein, 18 aa, Cryptosporidium parvum
SKYSETMDSQDLRNYQNS

SEQ ID NO: 2225428 - protein, 7 aa, Cryptosporidium parvum
SKYSGNA

SEQ ID NO: 2225429 - protein, 5 aa, Cryptosporidium parvum
SKYSS

SEQ ID NO: 2225430 - protein, 7 aa, Cryptosporidium parvum
SKYTNSQ

SEQ ID NO: 2225431 - protein, 15 aa, Cryptosporidium parvum
SLADSRCDSNTNDLN

SEQ ID NO: 2225432 - protein, 14 aa, Cryptosporidium parvum
SLAEGRAKHSAGVS

SEQ ID NO: 2225433 - protein, 8 aa, Cryptosporidium parvum
SLAEKQDE

SEQ ID NO: 2225434 - protein, 7 aa, Cryptosporidium parvum
SLASNGQ

SEQ ID NO: 2225435 - protein, 13 aa, Cryptosporidium parvum
SLASPTSSKSSSI

SEQ ID NO: 2225436 - protein, 5 aa, Cryptosporidium parvum
SLDDQ

SEQ ID NO: 2225437 - protein, 9 aa, Cryptosporidium parvum
SLDDSSHED

SEQ ID NO: 2225438 - protein, 7 aa, Cryptosporidium parvum
SLDEDGE

SEQ ID NO: 2225439 - protein, 6 aa, Cryptosporidium parvum
SLDEEH

SEQ ID NO: 2225440 - protein, 6 aa, Cryptosporidium parvum
SLDPGL

SEQ ID NO: 2225441 - protein, 12 aa, Cryptosporidium parvum
SLDQDGNGVLTP

SEQ ID NO: 2225442 - protein, 17 aa, Cryptosporidium parvum
SLDSSQQSSNKNSFTQP

SEQ ID NO: 2225443 - protein, 7 aa, Cryptosporidium parvum
SLDTSTL

SEQ ID NO: 2225444 - protein, 28 aa, Cryptosporidium parvum
SLEDGDKNTSESKQNLGSFDKSQSENPL

SEQ ID NO: 2225445 - protein, 9 aa, Cryptosporidium parvum
SLEEGPDGL

SEQ ID NO: 2225446 - protein, 9 aa, Cryptosporidium parvum
SLEEPEKTS

SEQ ID NO: 2225447 - protein, 8 aa, Cryptosporidium parvum
SLEKTGNK

SEQ ID NO: 2225448 - protein, 14 aa, Cryptosporidium parvum
SLENGKNKSNNTCK

SEQ ID NO: 2225449 - protein, 5 aa, Cryptosporidium parvum
SLEPD

SEQ ID NO: 2225450 - protein, 4 aa, Cryptosporidium parvum
SLER

SEQ ID NO: 2225451 - protein, 26 aa, Cryptosporidium parvum
SLERVNKGHTGLGADAGSLKDESKQV

SEQ ID NO: 2225452 - protein, 5 aa, Cryptosporidium parvum
SLEYE

SEQ ID NO: 2225453 - protein, 9 aa, Cryptosporidium parvum
SLGESSYSK

SEQ ID NO: 2225454 - protein, 6 aa, Cryptosporidium parvum
SLGGSE

SEQ ID NO: 2225455 - protein, 27 aa, Cryptosporidium parvum
SLGKTGKLVNRKGNKDINQKLDDKINN

SEQ ID NO: 2225456 - protein, 15 aa, Cryptosporidium parvum
SLGPSEQTPFSPEIE

SEQ ID NO: 2225457 - protein, 7 aa, Cryptosporidium parvum
SLGSSTT

SEQ ID NO: 2225458 - protein, 32 aa, Cryptosporidium parvum
SLIGGTGVAGTSGGGSKKKKKASKKLPGIPSL

SEQ ID NO: 2225459 - protein, 5 aa, Cryptosporidium parvum
SLKED

SEQ ID NO: 2225460 - protein, 22 aa, Cryptosporidium parvum
SLKENIKDKKSMNTIKTTKSNL

SEQ ID NO: 2225461 - protein, 5 aa, Cryptosporidium parvum
SLKKE

SEQ ID NO: 2225462 - protein, 8 aa, Cryptosporidium parvum
SLKKGSKI

SEQ ID NO: 2225463 - protein, 6 aa, Cryptosporidium parvum
SLKNNE

SEQ ID NO: 2225464 - protein, 4 aa, Cryptosporidium parvum
SLKS

SEQ ID NO: 2225465 - protein, 11 aa, Cryptosporidium parvum
SLKSDSESENI

SEQ ID NO: 2225466 - protein, 32 aa, Cryptosporidium parvum
SLKSGTDQGNSLNQAEKGNHSVTGVSNETTSI

SEQ ID NO: 2225467 - protein, 5 aa, Cryptosporidium parvum
SLKSR

SEQ ID NO: 2225468 - protein, 16 aa, Cryptosporidium parvum
SLKTGKNFEKLGGNPG

SEQ ID NO: 2225469 - protein, 8 aa, Cryptosporidium parvum
SLLSNSER

SEQ ID NO: 2225470 - protein, 4 aa, Cryptosporidium parvum
SLLT

SEQ ID NO: 2225471 - protein, 14 aa, Cryptosporidium parvum
SLNDSDLTDYKKGD

SEQ ID NO: 2225472 - protein, 12 aa, Cryptosporidium parvum
SLNEDNDDNLEK

SEQ ID NO: 2225473 - protein, 5 aa, Cryptosporidium parvum
SLNEG

SEQ ID NO: 2225474 - protein, 6 aa, Cryptosporidium parvum
SLNEGL

SEQ ID NO: 2225475 - protein, 11 aa, Cryptosporidium parvum
SLNKAQSKCRM

SEQ ID NO: 2225476 - protein, 10 aa, Cryptosporidium parvum
SLNKQTDNLP

SEQ ID NO: 2225477 - protein, 5 aa, Cryptosporidium parvum
SLNQD

SEQ ID NO: 2225478 - protein, 9 aa, Cryptosporidium parvum
SLNQETDRS

SEQ ID NO: 2225479 - protein, 9 aa, Cryptosporidium parvum
SLNRSQNSH

SEQ ID NO: 2225480 - protein, 7 aa, Cryptosporidium parvum
SLNSKDK

SEQ ID NO: 2225481 - protein, 21 aa, Cryptosporidium parvum
SLNTTGKSNLGKEKRSKAFDE

SEQ ID NO: 2225482 - protein, 5 aa, Cryptosporidium parvum
SLPCG

SEQ ID NO: 2225483 - protein, 9 aa, Cryptosporidium parvum
SLPGNKDKT

SEQ ID NO: 2225484 - protein, 8 aa, Cryptosporidium parvum
SLPGSTSV

SEQ ID NO: 2225485 - protein, 8 aa, Cryptosporidium parvum
SLPGYSPT

SEQ ID NO: 2225486 - protein, 7 aa, Cryptosporidium parvum
SLPNDYD

SEQ ID NO: 2225487 - protein, 5 aa, Cryptosporidium parvum
SLPPA

SEQ ID NO: 2225488 - protein, 4 aa, Cryptosporidium parvum
SLPQ

SEQ ID NO: 2225489 - protein, 5 aa, Cryptosporidium parvum
SLPRS

SEQ ID NO: 2225490 - protein, 4 aa, Cryptosporidium parvum
SLPS

SEQ ID NO: 2225491 - protein, 17 aa, Cryptosporidium parvum
SLPSPSDSKRNSSCDNP

SEQ ID NO: 2225492 - protein, 11 aa, Cryptosporidium parvum
SLQGATGSFGM

SEQ ID NO: 2225493 - protein, 4 aa, Cryptosporidium parvum
SLQI

SEQ ID NO: 2225494 - protein, 7 aa, Cryptosporidium parvum
SLQSNQI

SEQ ID NO: 2225495 - protein, 10 aa, Cryptosporidium parvum
SLREEVPNHG

SEQ ID NO: 2225496 - protein, 4 aa, Cryptosporidium parvum
SLRR

SEQ ID NO: 2225497 - protein, 15 aa, Cryptosporidium parvum
SLRYGPNVKRKTPRK

SEQ ID NO: 2225498 - protein, 11 aa, Cryptosporidium parvum
SLSAGNYNSEL

SEQ ID NO: 2225499 - protein, 9 aa, Cryptosporidium parvum
SLSHSPTNF

SEQ ID NO: 2225500 - protein, 20 aa, Cryptosporidium parvum
SLSKEKKEFNEDQEKKIIDE

SEQ ID NO: 2225501 - protein, 13 aa, Cryptosporidium parvum
SLSKRSQLSRNSD

SEQ ID NO: 2225502 - protein, 9 aa, Cryptosporidium parvum
SLSNPAGMN

SEQ ID NO: 2225503 - protein, 37 aa, Cryptosporidium parvum
SLSNQNSKSQNNNLNETGQNTNRSFDDKKKGSEDRYT

SEQ ID NO: 2225504 - protein, 10 aa, Cryptosporidium parvum
SLSPGTNKLT

SEQ ID NO: 2225505 - protein, 5 aa, Cryptosporidium parvum
SLSPK

SEQ ID NO: 2225506 - protein, 19 aa, Cryptosporidium parvum
SLSPKSMHQRSEVDSETTE

SEQ ID NO: 2225507 - protein, 11 aa, Cryptosporidium parvum
SLSPQSPEYGR

SEQ ID NO: 2225508 - protein, 7 aa, Cryptosporidium parvum
SLSPTSE

SEQ ID NO: 2225509 - protein, 9 aa, Cryptosporidium parvum
SLSQKNNGI

SEQ ID NO: 2225510 - protein, 8 aa, Cryptosporidium parvum
SLSRSSPL

SEQ ID NO: 2225511 - protein, 38 aa, Cryptosporidium parvum
SLSSASSSSPSSSSSSSSSSSSSSSFTQSSQSSSYSSL

SEQ ID NO: 2225512 - protein, 10 aa, Cryptosporidium parvum
SLSSSNSKPL

SEQ ID NO: 2225513 - protein, 9 aa, Cryptosporidium parvum
SLSTNQIQN

SEQ ID NO: 2225514 - protein, 9 aa, Cryptosporidium parvum
SLTDNPQFT

SEQ ID NO: 2225515 - protein, 14 aa, Cryptosporidium parvum
SLTKGKLRKKEDLD

SEQ ID NO: 2225516 - protein, 10 aa, Cryptosporidium parvum
SLTNTNTKGQ

SEQ ID NO: 2225517 - protein, 4 aa, Cryptosporidium parvum
SLTP

SEQ ID NO: 2225518 - protein, 11 aa, Cryptosporidium parvum
SLTQEKIESAL

SEQ ID NO: 2225519 - protein, 5 aa, Cryptosporidium parvum
SLTSK

SEQ ID NO: 2225520 - protein, 7 aa, Cryptosporidium parvum
SLTVSAD

SEQ ID NO: 2225521 - protein, 8 aa, Cryptosporidium parvum
SLVNQSNS

SEQ ID NO: 2225522 - protein, 5 aa, Cryptosporidium parvum
SLVPR

SEQ ID NO: 2225523 - protein, 13 aa, Cryptosporidium parvum
SLVSNSDSNPIIS

SEQ ID NO: 2225524 - protein, 4 aa, Cryptosporidium parvum
SLWS

SEQ ID NO: 2225525 - protein, 14 aa, Cryptosporidium parvum
SLYTPKTENVRTSA

SEQ ID NO: 2225526 - protein, 8 aa, Cryptosporidium parvum
SMASNTPI

SEQ ID NO: 2225527 - protein, 7 aa, Cryptosporidium parvum
SMDGETN

SEQ ID NO: 2225528 - protein, 7 aa, Cryptosporidium parvum
SMEEENQ

SEQ ID NO: 2225529 - protein, 6 aa, Cryptosporidium parvum
SMETQN

SEQ ID NO: 2225530 - protein, 4 aa, Cryptosporidium parvum
SMIP

SEQ ID NO: 2225531 - protein, 8 aa, Cryptosporidium parvum
SMNGTEND

SEQ ID NO: 2225532 - protein, 6 aa, Cryptosporidium parvum
SMNKDS

SEQ ID NO: 2225533 - protein, 10 aa, Cryptosporidium parvum
SMNNTNNSQY

SEQ ID NO: 2225534 - protein, 9 aa, Cryptosporidium parvum
SMPKSQPKT

SEQ ID NO: 2225535 - protein, 6 aa, Cryptosporidium parvum
SMSKDE

SEQ ID NO: 2225536 - protein, 10 aa, Cryptosporidium parvum
SMSKSTYNRE

SEQ ID NO: 2225537 - protein, 9 aa, Cryptosporidium parvum
SMSPKNSAS

SEQ ID NO: 2225538 - protein, 4 aa, Cryptosporidium parvum
SMSR

SEQ ID NO: 2225539 - protein, 14 aa, Cryptosporidium parvum
SMSSSSSSSSSPSF

SEQ ID NO: 2225540 - protein, 21 aa, Cryptosporidium parvum
SMTKKSDDSKTASNSDKKAIK

SEQ ID NO: 2225541 - protein, 9 aa, Cryptosporidium parvum
SNAEKGVAQ

SEQ ID NO: 2225542 - protein, 7 aa, Cryptosporidium parvum
SNAERTV

SEQ ID NO: 2225543 - protein, 5 aa, Cryptosporidium parvum
SNAKG

SEQ ID NO: 2225544 - protein, 10 aa, Cryptosporidium parvum
SNAKNLCESN

SEQ ID NO: 2225545 - protein, 4 aa, Cryptosporidium parvum
SNAL

SEQ ID NO: 2225546 - protein, 9 aa, Cryptosporidium parvum
SNALRTDPC

SEQ ID NO: 2225547 - protein, 22 aa, Cryptosporidium parvum
SNANENSQKSSSAQVNNNLNSD

SEQ ID NO: 2225548 - protein, 9 aa, Cryptosporidium parvum
SNANSSVNM

SEQ ID NO: 2225549 - protein, 4 aa, Cryptosporidium parvum
SNAT

SEQ ID NO: 2225550 - protein, 7 aa, Cryptosporidium parvum
SNCENGS

SEQ ID NO: 2225551 - protein, 10 aa, Cryptosporidium parvum
SNDDDSSSIE

SEQ ID NO: 2225552 - protein, 17 aa, Cryptosporidium parvum
SNDDGNNSSIFESSEET

SEQ ID NO: 2225553 - protein, 14 aa, Cryptosporidium parvum
SNDEGANNTLNEPI

SEQ ID NO: 2225554 - protein, 6 aa, Cryptosporidium parvum
SNDEYS

SEQ ID NO: 2225555 - protein, 28 aa, Cryptosporidium parvum
SNDISDKDKKINGDYDSKSVKDKNNDKV

SEQ ID NO: 2225556 - protein, 8 aa, Cryptosporidium parvum
SNDISNIE

SEQ ID NO: 2225557 - protein, 12 aa, Cryptosporidium parvum
SNDISNKYGSNG

SEQ ID NO: 2225558 - protein, 17 aa, Cryptosporidium parvum
SNDKKDQNELKNSPKIQ

SEQ ID NO: 2225559 - protein, 14 aa, Cryptosporidium parvum
SNDNNNNNNNNNSL

SEQ ID NO: 2225560 - protein, 6 aa, Cryptosporidium parvum
SNDNNV

SEQ ID NO: 2225561 - protein, 7 aa, Cryptosporidium parvum
SNDNSKV

SEQ ID NO: 2225562 - protein, 12 aa, Cryptosporidium parvum
SNDPERPPNHNN

SEQ ID NO: 2225563 - protein, 5 aa, Cryptosporidium parvum
SNDPI

SEQ ID NO: 2225564 - protein, 6 aa, Cryptosporidium parvum
SNDQEE

SEQ ID NO: 2225565 - protein, 11 aa, Cryptosporidium parvum
SNDQKSIVDQH

SEQ ID NO: 2225566 - protein, 10 aa, Cryptosporidium parvum
SNDQVSKKES

SEQ ID NO: 2225567 - protein, 6 aa, Cryptosporidium parvum
SNDRNV

SEQ ID NO: 2225568 - protein, 5 aa, Cryptosporidium parvum
SNDSC

SEQ ID NO: 2225569 - protein, 6 aa, Cryptosporidium parvum
SNDSGE

SEQ ID NO: 2225570 - protein, 15 aa, Cryptosporidium parvum
SNDSNSNNNSNNNCE

SEQ ID NO: 2225571 - protein, 5 aa, Cryptosporidium parvum
SNEAQ

SEQ ID NO: 2225572 - protein, 8 aa, Cryptosporidium parvum
SNEEIGPH

SEQ ID NO: 2225573 - protein, 10 aa, Cryptosporidium parvum
SNEEQNQYTS

SEQ ID NO: 2225574 - protein, 8 aa, Cryptosporidium parvum
SNEERKKT

SEQ ID NO: 2225575 - protein, 4 aa, Cryptosporidium parvum
SNEF

SEQ ID NO: 2225576 - protein, 20 aa, Cryptosporidium parvum
SNEGGNDTFSYKSSQGNDQF

SEQ ID NO: 2225577 - protein, 6 aa, Cryptosporidium parvum
SNEHYN

SEQ ID NO: 2225578 - protein, 7 aa, Cryptosporidium parvum
SNEKKYS

SEQ ID NO: 2225579 - protein, 14 aa, Cryptosporidium parvum
SNEKLERKSNCGEK

SEQ ID NO: 2225580 - protein, 14 aa, Cryptosporidium parvum
SNEKNNTNTSLKGS

SEQ ID NO: 2225581 - protein, 8 aa, Cryptosporidium parvum
SNEKSIKQ

SEQ ID NO: 2225582 - protein, 7 aa, Cryptosporidium parvum
SNENDYL

SEQ ID NO: 2225583 - protein, 11 aa, Cryptosporidium parvum
SNENFDQNNGE

SEQ ID NO: 2225584 - protein, 48 aa, Cryptosporidium parvum
SNENGYLSESESNFEDSSNESNEFDDNDVDDNNNNKDNNENKYQTNKQ

SEQ ID NO: 2225585 - protein, 7 aa, Cryptosporidium parvum
SNENNYF

SEQ ID NO: 2225586 - protein, 8 aa, Cryptosporidium parvum
SNENREKY

SEQ ID NO: 2225587 - protein, 6 aa, Cryptosporidium parvum
SNENVK

SEQ ID NO: 2225588 - protein, 22 aa, Cryptosporidium parvum
SNEQELSSTGRMNNKSSSGRIS

SEQ ID NO: 2225589 - protein, 10 aa, Cryptosporidium parvum
SNERGRDTSC

SEQ ID NO: 2225590 - protein, 4 aa, Cryptosporidium parvum
SNES

SEQ ID NO: 2225591 - protein, 6 aa, Cryptosporidium parvum
SNESET

SEQ ID NO: 2225592 - protein, 12 aa, Cryptosporidium parvum
SNESKKDKLGPT

SEQ ID NO: 2225593 - protein, 20 aa, Cryptosporidium parvum
SNESSSDSNNKDNNNSPFNI

SEQ ID NO: 2225594 - protein, 8 aa, Cryptosporidium parvum
SNESTDNI

SEQ ID NO: 2225595 - protein, 12 aa, Cryptosporidium parvum
SNESVENDFEGK

SEQ ID NO: 2225596 - protein, 6 aa, Cryptosporidium parvum
SNETIE

SEQ ID NO: 2225597 - protein, 14 aa, Cryptosporidium parvum
SNETKSKVFKKIKH

SEQ ID NO: 2225598 - protein, 11 aa, Cryptosporidium parvum
SNETKTRARGL

SEQ ID NO: 2225599 - protein, 7 aa, Cryptosporidium parvum
SNETSNY

SEQ ID NO: 2225600 - protein, 4 aa, Cryptosporidium parvum
SNEY

SEQ ID NO: 2225601 - protein, 10 aa, Cryptosporidium parvum
SNEYTSTSGV

SEQ ID NO: 2225602 - protein, 5 aa, Cryptosporidium parvum
SNFDP

SEQ ID NO: 2225603 - protein, 17 aa, Cryptosporidium parvum
SNFEEEDLKSKTQNPHS

SEQ ID NO: 2225604 - protein, 7 aa, Cryptosporidium parvum
SNFKSQD

SEQ ID NO: 2225605 - protein, 12 aa, Cryptosporidium parvum
SNFKTKSSPDIY

SEQ ID NO: 2225606 - protein, 4 aa, Cryptosporidium parvum
SNFQ

SEQ ID NO: 2225607 - protein, 6 aa, Cryptosporidium parvum
SNFSAK

SEQ ID NO: 2225608 - protein, 5 aa, Cryptosporidium parvum
SNFSQ

SEQ ID NO: 2225609 - protein, 8 aa, Cryptosporidium parvum
SNFTSEQL

SEQ ID NO: 2225610 - protein, 18 aa, Cryptosporidium parvum
SNGESKRTSVSSKGSEEF

SEQ ID NO: 2225611 - protein, 9 aa, Cryptosporidium parvum
SNGGNNQKY

SEQ ID NO: 2225612 - protein, 6 aa, Cryptosporidium parvum
SNGGQE

SEQ ID NO: 2225613 - protein, 7 aa, Cryptosporidium parvum
SNGGTSL

SEQ ID NO: 2225614 - protein, 12 aa, Cryptosporidium parvum
SNGIEKIKKENQ

SEQ ID NO: 2225615 - protein, 7 aa, Cryptosporidium parvum
SNGIEQD

SEQ ID NO: 2225616 - protein, 7 aa, Cryptosporidium parvum
SNGIKTD

SEQ ID NO: 2225617 - protein, 9 aa, Cryptosporidium parvum
SNGNNGIVG

SEQ ID NO: 2225618 - protein, 8 aa, Cryptosporidium parvum
SNGNTGIN

SEQ ID NO: 2225619 - protein, 6 aa, Cryptosporidium parvum
SNGPLT

SEQ ID NO: 2225620 - protein, 5 aa, Cryptosporidium parvum
SNGPT

SEQ ID NO: 2225621 - protein, 5 aa, Cryptosporidium parvum
SNGQK

SEQ ID NO: 2225622 - protein, 7 aa, Cryptosporidium parvum
SNGQVEQ

SEQ ID NO: 2225623 - protein, 4 aa, Cryptosporidium parvum
SNGR

SEQ ID NO: 2225624 - protein, 24 aa, Cryptosporidium parvum
SNGRQESQYTGNTLTTKSSEQKDL

SEQ ID NO: 2225625 - protein, 5 aa, Cryptosporidium parvum
SNGSG

SEQ ID NO: 2225626 - protein, 33 aa, Cryptosporidium parvum
SNGVIESSSKVNRGRKSKRKTRMKKKASRSKSL

SEQ ID NO: 2225627 - protein, 14 aa, Cryptosporidium parvum
SNGVPYPDDRPPEA

SEQ ID NO: 2225628 - protein, 6 aa, Cryptosporidium parvum
SNHAAS

SEQ ID NO: 2225629 - protein, 5 aa, Cryptosporidium parvum
SNHDL

SEQ ID NO: 2225630 - protein, 13 aa, Cryptosporidium parvum
SNHFSSSSTIPST

SEQ ID NO: 2225631 - protein, 7 aa, Cryptosporidium parvum
SNHPGKN

SEQ ID NO: 2225632 - protein, 5 aa, Cryptosporidium parvum
SNHQR

SEQ ID NO: 2225633 - protein, 7 aa, Cryptosporidium parvum
SNHTPPI

SEQ ID NO: 2225634 - protein, 15 aa, Cryptosporidium parvum
SNHYTSKHSSEQESL

SEQ ID NO: 2225635 - protein, 5 aa, Cryptosporidium parvum
SNIDD

SEQ ID NO: 2225636 - protein, 11 aa, Cryptosporidium parvum
SNIDRKKSIEI

SEQ ID NO: 2225637 - protein, 5 aa, Cryptosporidium parvum
SNIEE

SEQ ID NO: 2225638 - protein, 5 aa, Cryptosporidium parvum
SNIEK

SEQ ID NO: 2225639 - protein, 4 aa, Cryptosporidium parvum
SNIH

SEQ ID NO: 2225640 - protein, 9 aa, Cryptosporidium parvum
SNIKNRGEL

SEQ ID NO: 2225641 - protein, 12 aa, Cryptosporidium parvum
SNIMPPTTSKYY

SEQ ID NO: 2225642 - protein, 4 aa, Cryptosporidium parvum
SNIN

SEQ ID NO: 2225643 - protein, 11 aa, Cryptosporidium parvum
SNINGDFPELS

SEQ ID NO: 2225644 - protein, 7 aa, Cryptosporidium parvum
SNIPEKP

SEQ ID NO: 2225645 - protein, 17 aa, Cryptosporidium parvum
SNIPGSPPGTKKNNYTT

SEQ ID NO: 2225646 - protein, 5 aa, Cryptosporidium parvum
SNIPK

SEQ ID NO: 2225647 - protein, 5 aa, Cryptosporidium parvum
SNIPV

SEQ ID NO: 2225648 - protein, 8 aa, Cryptosporidium parvum
SNIQNDIE

SEQ ID NO: 2225649 - protein, 11 aa, Cryptosporidium parvum
SNISESLNDDI

SEQ ID NO: 2225650 - protein, 6 aa, Cryptosporidium parvum
SNISEY

SEQ ID NO: 2225651 - protein, 16 aa, Cryptosporidium parvum
SNISKESKKELNSESN

SEQ ID NO: 2225652 - protein, 8 aa, Cryptosporidium parvum
SNITTKSI

SEQ ID NO: 2225653 - protein, 73 aa, Cryptosporidium parvum
SNITTNPPSSITTNPPSSIKTNPPSSIVTTPSSNIATNTPSNITTTTTTSPSRTPRASNPPLTENKEEEYGHY

SEQ ID NO: 2225654 - protein, 10 aa, Cryptosporidium parvum
SNKDSVIDTK

SEQ ID NO: 2225655 - protein, 9 aa, Cryptosporidium parvum
SNKDYQQSQ

SEQ ID NO: 2225656 - protein, 4 aa, Cryptosporidium parvum
SNKE

SEQ ID NO: 2225657 - protein, 13 aa, Cryptosporidium parvum
SNKEEKSRSTPIQ

SEQ ID NO: 2225658 - protein, 6 aa, Cryptosporidium parvum
SNKESD

SEQ ID NO: 2225659 - protein, 14 aa, Cryptosporidium parvum
SNKEVKTEEVNREK

SEQ ID NO: 2225660 - protein, 4 aa, Cryptosporidium parvum
SNKF

SEQ ID NO: 2225661 - protein, 8 aa, Cryptosporidium parvum
SNKFDTTS

SEQ ID NO: 2225662 - protein, 7 aa, Cryptosporidium parvum
SNKGNDS

SEQ ID NO: 2225663 - protein, 4 aa, Cryptosporidium parvum
SNKI

SEQ ID NO: 2225664 - protein, 5 aa, Cryptosporidium parvum
SNKIT

SEQ ID NO: 2225665 - protein, 17 aa, Cryptosporidium parvum
SNKITNRHCNDDDGTVE

SEQ ID NO: 2225666 - protein, 20 aa, Cryptosporidium parvum
SNKKDTIDEDNLGSSVGIDD

SEQ ID NO: 2225667 - protein, 12 aa, Cryptosporidium parvum
SNKKKLSKNRNE

SEQ ID NO: 2225668 - protein, 6 aa, Cryptosporidium parvum
SNKLQS

SEQ ID NO: 2225669 - protein, 4 aa, Cryptosporidium parvum
SNKN

SEQ ID NO: 2225670 - protein, 8 aa, Cryptosporidium parvum
SNKNIETL

SEQ ID NO: 2225671 - protein, 15 aa, Cryptosporidium parvum
SNKNISSFSSKEEKV

SEQ ID NO: 2225672 - protein, 24 aa, Cryptosporidium parvum
SNKNNSNNSVSQITNSNNSPISYQ

SEQ ID NO: 2225673 - protein, 11 aa, Cryptosporidium parvum
SNKNSGKEFNP

SEQ ID NO: 2225674 - protein, 10 aa, Cryptosporidium parvum
SNKNYQEDSI

SEQ ID NO: 2225675 - protein, 7 aa, Cryptosporidium parvum
SNKRNNQ

SEQ ID NO: 2225676 - protein, 4 aa, Cryptosporidium parvum
SNKS

SEQ ID NO: 2225677 - protein, 6 aa, Cryptosporidium parvum
SNKTDF

SEQ ID NO: 2225678 - protein, 8 aa, Cryptosporidium parvum
SNKTHRLS

SEQ ID NO: 2225679 - protein, 13 aa, Cryptosporidium parvum
SNKTTCPLCISLM

SEQ ID NO: 2225680 - protein, 8 aa, Cryptosporidium parvum
SNKYYPTS

SEQ ID NO: 2225681 - protein, 6 aa, Cryptosporidium parvum
SNLANI

SEQ ID NO: 2225682 - protein, 5 aa, Cryptosporidium parvum
SNLEI

SEQ ID NO: 2225683 - protein, 5 aa, Cryptosporidium parvum
SNLGD

SEQ ID NO: 2225684 - protein, 10 aa, Cryptosporidium parvum
SNLGDGGEIA

SEQ ID NO: 2225685 - protein, 8 aa, Cryptosporidium parvum
SNLGNTNS

SEQ ID NO: 2225686 - protein, 9 aa, Cryptosporidium parvum
SNLKNTNNI

SEQ ID NO: 2225687 - protein, 9 aa, Cryptosporidium parvum
SNLKSNNTF

SEQ ID NO: 2225688 - protein, 47 aa, Cryptosporidium parvum
SNLNGKPKDSEQPKSPQRTIRGPSYTLRDTSSSQKPPSGAHQTVGST

SEQ ID NO: 2225689 - protein, 10 aa, Cryptosporidium parvum
SNLNNPSKSR

SEQ ID NO: 2225690 - protein, 13 aa, Cryptosporidium parvum
SNLNNTATTSTTT

SEQ ID NO: 2225691 - protein, 9 aa, Cryptosporidium parvum
SNLNPNSNN

SEQ ID NO: 2225692 - protein, 10 aa, Cryptosporidium parvum
SNLNSNVQNG

SEQ ID NO: 2225693 - protein, 10 aa, Cryptosporidium parvum
SNLPESASRN

SEQ ID NO: 2225694 - protein, 13 aa, Cryptosporidium parvum
SNLQNTSNSTPGY

SEQ ID NO: 2225695 - protein, 11 aa, Cryptosporidium parvum
SNLSDTKASDI

SEQ ID NO: 2225696 - protein, 5 aa, Cryptosporidium parvum
SNLSP

SEQ ID NO: 2225697 - protein, 47 aa, Cryptosporidium parvum
SNLSTKKRKQDERKTKNENRREREERERLEEREREMEKEKKKRERIE

SEQ ID NO: 2225698 - protein, 10 aa, Cryptosporidium parvum
SNLTNEPSEL

SEQ ID NO: 2225699 - protein, 8 aa, Cryptosporidium parvum
SNLTRNNK

SEQ ID NO: 2225700 - protein, 6 aa, Cryptosporidium parvum
SNMDVG

SEQ ID NO: 2225701 - protein, 17 aa, Cryptosporidium parvum
SNMGSNEHIGERNLSNE

SEQ ID NO: 2225702 - protein, 23 aa, Cryptosporidium parvum
SNMNEQSGDPISSLNSNNISKIN

SEQ ID NO: 2225703 - protein, 13 aa, Cryptosporidium parvum
SNNDASNLSPQFE

SEQ ID NO: 2225704 - protein, 10 aa, Cryptosporidium parvum
SNNDSETKKQ

SEQ ID NO: 2225705 - protein, 8 aa, Cryptosporidium parvum
SNNEDNYN

SEQ ID NO: 2225706 - protein, 6 aa, Cryptosporidium parvum
SNNEEL

SEQ ID NO: 2225707 - protein, 18 aa, Cryptosporidium parvum
SNNEEQTDSQSNNASQTT

SEQ ID NO: 2225708 - protein, 5 aa, Cryptosporidium parvum
SNNEI

SEQ ID NO: 2225709 - protein, 15 aa, Cryptosporidium parvum
SNNETETQDKNATND

SEQ ID NO: 2225710 - protein, 6 aa, Cryptosporidium parvum
SNNFSG

SEQ ID NO: 2225711 - protein, 8 aa, Cryptosporidium parvum
SNNGGIED

SEQ ID NO: 2225712 - protein, 6 aa, Cryptosporidium parvum
SNNISK

SEQ ID NO: 2225713 - protein, 10 aa, Cryptosporidium parvum
SNNKAGLEKP

SEQ ID NO: 2225714 - protein, 7 aa, Cryptosporidium parvum
SNNKKSR

SEQ ID NO: 2225715 - protein, 9 aa, Cryptosporidium parvum
SNNKSFGDN

SEQ ID NO: 2225716 - protein, 12 aa, Cryptosporidium parvum
SNNKSSKDNLTP

SEQ ID NO: 2225717 - protein, 7 aa, Cryptosporidium parvum
SNNKTQA

SEQ ID NO: 2225718 - protein, 6 aa, Cryptosporidium parvum
SNNKTY

SEQ ID NO: 2225719 - protein, 14 aa, Cryptosporidium parvum
SNNLRGGPSTNRES

SEQ ID NO: 2225720 - protein, 6 aa, Cryptosporidium parvum
SNNLSE

SEQ ID NO: 2225721 - protein, 8 aa, Cryptosporidium parvum
SNNNIENQ

SEQ ID NO: 2225722 - protein, 9 aa, Cryptosporidium parvum
SNNNKEVNN

SEQ ID NO: 2225723 - protein, 6 aa, Cryptosporidium parvum
SNNNKW

SEQ ID NO: 2225724 - protein, 5 aa, Cryptosporidium parvum
SNNNM

SEQ ID NO: 2225725 - protein, 8 aa, Cryptosporidium parvum
SNNNNGQF

SEQ ID NO: 2225726 - protein, 9 aa, Cryptosporidium parvum
SNNNNKDDD

SEQ ID NO: 2225727 - protein, 10 aa, Cryptosporidium parvum
SNNNYLSDEE

SEQ ID NO: 2225728 - protein, 13 aa, Cryptosporidium parvum
SNNPFHGNSAGTT

SEQ ID NO: 2225729 - protein, 7 aa, Cryptosporidium parvum
SNNPNIR

SEQ ID NO: 2225730 - protein, 10 aa, Cryptosporidium parvum
SNNQASKANS

SEQ ID NO: 2225731 - protein, 6 aa, Cryptosporidium parvum
SNNQKN

SEQ ID NO: 2225732 - protein, 23 aa, Cryptosporidium parvum
SNNQSNFSQENGSNKDYKENTAL

SEQ ID NO: 2225733 - protein, 20 aa, Cryptosporidium parvum
SNNQSNSNTISTSNSNMNSN

SEQ ID NO: 2225734 - protein, 12 aa, Cryptosporidium parvum
SNNQSSGKSNRI

SEQ ID NO: 2225735 - protein, 7 aa, Cryptosporidium parvum
SNNQVKR

SEQ ID NO: 2225736 - protein, 8 aa, Cryptosporidium parvum
SNNQYYKD

SEQ ID NO: 2225737 - protein, 4 aa, Cryptosporidium parvum
SNNR

SEQ ID NO: 2225738 - protein, 18 aa, Cryptosporidium parvum
SNNRNSINSMEYQDLENR

SEQ ID NO: 2225739 - protein, 6 aa, Cryptosporidium parvum
SNNSFP

SEQ ID NO: 2225740 - protein, 8 aa, Cryptosporidium parvum
SNNSKLKE

SEQ ID NO: 2225741 - protein, 13 aa, Cryptosporidium parvum
SNNSKNNLKQSNT

SEQ ID NO: 2225742 - protein, 7 aa, Cryptosporidium parvum
SNNSNYE

SEQ ID NO: 2225743 - protein, 7 aa, Cryptosporidium parvum
SNNSSEC

SEQ ID NO: 2225744 - protein, 15 aa, Cryptosporidium parvum
SNNTNNSINSNSTNP

SEQ ID NO: 2225745 - protein, 9 aa, Cryptosporidium parvum
SNNTSNENK

SEQ ID NO: 2225746 - protein, 28 aa, Cryptosporidium parvum
SNNVRSKTENHLESNSGSNNDNSTGSSI

SEQ ID NO: 2225747 - protein, 7 aa, Cryptosporidium parvum
SNNYKYE

SEQ ID NO: 2225748 - protein, 10 aa, Cryptosporidium parvum
SNNYNSTNYN

SEQ ID NO: 2225749 - protein, 9 aa, Cryptosporidium parvum
SNNYSDTEN

SEQ ID NO: 2225750 - protein, 6 aa, Cryptosporidium parvum
SNPDEL

SEQ ID NO: 2225751 - protein, 6 aa, Cryptosporidium parvum
SNPDRK

SEQ ID NO: 2225752 - protein, 4 aa, Cryptosporidium parvum
SNPE

SEQ ID NO: 2225753 - protein, 5 aa, Cryptosporidium parvum
SNPEF

SEQ ID NO: 2225754 - protein, 6 aa, Cryptosporidium parvum
SNPERK

SEQ ID NO: 2225755 - protein, 9 aa, Cryptosporidium parvum
SNPERKKEF

SEQ ID NO: 2225756 - protein, 7 aa, Cryptosporidium parvum
SNPFTPN

SEQ ID NO: 2225757 - protein, 4 aa, Cryptosporidium parvum
SNPG

SEQ ID NO: 2225758 - protein, 6 aa, Cryptosporidium parvum
SNPGVS

SEQ ID NO: 2225759 - protein, 6 aa, Cryptosporidium parvum
SNPNEK

SEQ ID NO: 2225760 - protein, 10 aa, Cryptosporidium parvum
SNPNIPDRNG

SEQ ID NO: 2225761 - protein, 5 aa, Cryptosporidium parvum
SNPPA

SEQ ID NO: 2225762 - protein, 6 aa, Cryptosporidium parvum
SNPPIF

SEQ ID NO: 2225763 - protein, 8 aa, Cryptosporidium parvum
SNPSTSIC

SEQ ID NO: 2225764 - protein, 6 aa, Cryptosporidium parvum
SNQAND

SEQ ID NO: 2225765 - protein, 9 aa, Cryptosporidium parvum
SNQDPESLL

SEQ ID NO: 2225766 - protein, 7 aa, Cryptosporidium parvum
SNQEEIR

SEQ ID NO: 2225767 - protein, 12 aa, Cryptosporidium parvum
SNQEEVLPSGSS

SEQ ID NO: 2225768 - protein, 19 aa, Cryptosporidium parvum
SNQEHLSEKGTYSDPDTCS

SEQ ID NO: 2225769 - protein, 5 aa, Cryptosporidium parvum
SNQEK

SEQ ID NO: 2225770 - protein, 28 aa, Cryptosporidium parvum
SNQEQNHSESPTKKSRTSLNKSNSQGNQ

SEQ ID NO: 2225771 - protein, 7 aa, Cryptosporidium parvum
SNQIGGE

SEQ ID NO: 2225772 - protein, 6 aa, Cryptosporidium parvum
SNQIPK

SEQ ID NO: 2225773 - protein, 11 aa, Cryptosporidium parvum
SNQKGSISSHQ

SEQ ID NO: 2225774 - protein, 7 aa, Cryptosporidium parvum
SNQLQNS

SEQ ID NO: 2225775 - protein, 9 aa, Cryptosporidium parvum
SNQNSNPET

SEQ ID NO: 2225776 - protein, 9 aa, Cryptosporidium parvum
SNQPDSPLK

SEQ ID NO: 2225777 - protein, 8 aa, Cryptosporidium parvum
SNQPPECQ

SEQ ID NO: 2225778 - protein, 8 aa, Cryptosporidium parvum
SNQPQDYK

SEQ ID NO: 2225779 - protein, 8 aa, Cryptosporidium parvum
SNQRTKID

SEQ ID NO: 2225780 - protein, 17 aa, Cryptosporidium parvum
SNQSINREARAPNYSSG

SEQ ID NO: 2225781 - protein, 7 aa, Cryptosporidium parvum
SNQVKNE

SEQ ID NO: 2225782 - protein, 8 aa, Cryptosporidium parvum
SNRDEFPR

SEQ ID NO: 2225783 - protein, 9 aa, Cryptosporidium parvum
SNRDGKSSL

SEQ ID NO: 2225784 - protein, 9 aa, Cryptosporidium parvum
SNRDSYQPK

SEQ ID NO: 2225785 - protein, 6 aa, Cryptosporidium parvum
SNREAT

SEQ ID NO: 2225786 - protein, 23 aa, Cryptosporidium parvum
SNRKKEDSSSHISETFSDSNNRS

SEQ ID NO: 2225787 - protein, 4 aa, Cryptosporidium parvum
SNRN

SEQ ID NO: 2225788 - protein, 8 aa, Cryptosporidium parvum
SNRNEEIN

SEQ ID NO: 2225789 - protein, 7 aa, Cryptosporidium parvum
SNRNNEG

SEQ ID NO: 2225790 - protein, 7 aa, Cryptosporidium parvum
SNRNPPN

SEQ ID NO: 2225791 - protein, 7 aa, Cryptosporidium parvum
SNRRTDL

SEQ ID NO: 2225792 - protein, 7 aa, Cryptosporidium parvum
SNRSNDL

SEQ ID NO: 2225793 - protein, 7 aa, Cryptosporidium parvum
SNRTEKK

SEQ ID NO: 2225794 - protein, 4 aa, Cryptosporidium parvum
SNSD

SEQ ID NO: 2225795 - protein, 5 aa, Cryptosporidium parvum
SNSDS

SEQ ID NO: 2225796 - protein, 12 aa, Cryptosporidium parvum
SNSDSNKDSDSI

SEQ ID NO: 2225797 - protein, 10 aa, Cryptosporidium parvum
SNSDYNSNIQ

SEQ ID NO: 2225798 - protein, 9 aa, Cryptosporidium parvum
SNSEDSTKI

SEQ ID NO: 2225799 - protein, 11 aa, Cryptosporidium parvum
SNSEGSPNSNL

SEQ ID NO: 2225800 - protein, 23 aa, Cryptosporidium parvum
SNSENLSKDNLKSPARNQISQER

SEQ ID NO: 2225801 - protein, 6 aa, Cryptosporidium parvum
SNSEPS

SEQ ID NO: 2225802 - protein, 9 aa, Cryptosporidium parvum
SNSESEYSK

SEQ ID NO: 2225803 - protein, 6 aa, Cryptosporidium parvum
SNSESV

SEQ ID NO: 2225804 - protein, 7 aa, Cryptosporidium parvum
SNSEYSQ

SEQ ID NO: 2225805 - protein, 22 aa, Cryptosporidium parvum
SNSEYSQISSQSNQSLDQEREV

SEQ ID NO: 2225806 - protein, 5 aa, Cryptosporidium parvum
SNSGH

SEQ ID NO: 2225807 - protein, 6 aa, Cryptosporidium parvum
SNSGIG

SEQ ID NO: 2225808 - protein, 9 aa, Cryptosporidium parvum
SNSGSKEKE

SEQ ID NO: 2225809 - protein, 17 aa, Cryptosporidium parvum
SNSHSNKEELNKDKENE

SEQ ID NO: 2225810 - protein, 5 aa, Cryptosporidium parvum
SNSIQ

SEQ ID NO: 2225811 - protein, 45 aa, Cryptosporidium parvum
SNSLDTPDVTPLDTPQSKNNNEHNTIGGRQQSSGHTHTNKKNTIS

SEQ ID NO: 2225812 - protein, 8 aa, Cryptosporidium parvum
SNSLPDEL

SEQ ID NO: 2225813 - protein, 6 aa, Cryptosporidium parvum
SNSLPP

SEQ ID NO: 2225814 - protein, 38 aa, Cryptosporidium parvum
SNSLSCSNEQNLSTIPKSCSNSSSPSSLSSSPIDNNSS

SEQ ID NO: 2225815 - protein, 6 aa, Cryptosporidium parvum
SNSNDY

SEQ ID NO: 2225816 - protein, 14 aa, Cryptosporidium parvum
SNSNGRLGTGGSYG

SEQ ID NO: 2225817 - protein, 14 aa, Cryptosporidium parvum
SNSNLNNGSSSSFI

SEQ ID NO: 2225818 - protein, 6 aa, Cryptosporidium parvum
SNSNLS

SEQ ID NO: 2225819 - protein, 6 aa, Cryptosporidium parvum
SNSNMD

SEQ ID NO: 2225820 - protein, 11 aa, Cryptosporidium parvum
SNSNNQNYGEK

SEQ ID NO: 2225821 - protein, 19 aa, Cryptosporidium parvum
SNSNQNISSVGKNQKNNAN

SEQ ID NO: 2225822 - protein, 13 aa, Cryptosporidium parvum
SNSNSNNNQNRNS

SEQ ID NO: 2225823 - protein, 6 aa, Cryptosporidium parvum
SNSNSW

SEQ ID NO: 2225824 - protein, 5 aa, Cryptosporidium parvum
SNSNY

SEQ ID NO: 2225825 - protein, 24 aa, Cryptosporidium parvum
SNSPFTSATKPNSGIEKKPPLTHG

SEQ ID NO: 2225826 - protein, 5 aa, Cryptosporidium parvum
SNSPK

SEQ ID NO: 2225827 - protein, 17 aa, Cryptosporidium parvum
SNSPKARKSYKNRKYFK

SEQ ID NO: 2225828 - protein, 21 aa, Cryptosporidium parvum
SNSQINSTNTQKKPNGQAGNY

SEQ ID NO: 2225829 - protein, 5 aa, Cryptosporidium parvum
SNSQS

SEQ ID NO: 2225830 - protein, 14 aa, Cryptosporidium parvum
SNSRRDFTSESISS

SEQ ID NO: 2225831 - protein, 10 aa, Cryptosporidium parvum
SNSSERKGTA

SEQ ID NO: 2225832 - protein, 9 aa, Cryptosporidium parvum
SNSSNNIYP

SEQ ID NO: 2225833 - protein, 8 aa, Cryptosporidium parvum
SNSSSASL

SEQ ID NO: 2225834 - protein, 5 aa, Cryptosporidium parvum
SNSST

SEQ ID NO: 2225835 - protein, 7 aa, Cryptosporidium parvum
SNSSTIG

SEQ ID NO: 2225836 - protein, 7 aa, Cryptosporidium parvum
SNSSTLQ

SEQ ID NO: 2225837 - protein, 8 aa, Cryptosporidium parvum
SNSTNTHK

SEQ ID NO: 2225838 - protein, 6 aa, Cryptosporidium parvum
SNSTQI

SEQ ID NO: 2225839 - protein, 12 aa, Cryptosporidium parvum
SNSTQNYSQEGI

SEQ ID NO: 2225840 - protein, 15 aa, Cryptosporidium parvum
SNSTTLPSSPSSSLS

SEQ ID NO: 2225841 - protein, 6 aa, Cryptosporidium parvum
SNSTVS

SEQ ID NO: 2225842 - protein, 9 aa, Cryptosporidium parvum
SNSVDGTEK

SEQ ID NO: 2225843 - protein, 8 aa, Cryptosporidium parvum
SNSYGNTF

SEQ ID NO: 2225844 - protein, 4 aa, Cryptosporidium parvum
SNTA

SEQ ID NO: 2225845 - protein, 4 aa, Cryptosporidium parvum
SNTD

SEQ ID NO: 2225846 - protein, 18 aa, Cryptosporidium parvum
SNTEVNKKNNTSENKEND

SEQ ID NO: 2225847 - protein, 6 aa, Cryptosporidium parvum
SNTHSN

SEQ ID NO: 2225848 - protein, 6 aa, Cryptosporidium parvum
SNTINS

SEQ ID NO: 2225849 - protein, 11 aa, Cryptosporidium parvum
SNTKAPKIDRM

SEQ ID NO: 2225850 - protein, 10 aa, Cryptosporidium parvum
SNTKDTQAIS

SEQ ID NO: 2225851 - protein, 6 aa, Cryptosporidium parvum
SNTKQN

SEQ ID NO: 2225852 - protein, 6 aa, Cryptosporidium parvum
SNTKSN

SEQ ID NO: 2225853 - protein, 8 aa, Cryptosporidium parvum
SNTLLTDQ

SEQ ID NO: 2225854 - protein, 4 aa, Cryptosporidium parvum
SNTN

SEQ ID NO: 2225855 - protein, 10 aa, Cryptosporidium parvum
SNTNNSFNVG

SEQ ID NO: 2225856 - protein, 8 aa, Cryptosporidium parvum
SNTNSDIT

SEQ ID NO: 2225857 - protein, 18 aa, Cryptosporidium parvum
SNTNTLAKAAETKNSNSR

SEQ ID NO: 2225858 - protein, 13 aa, Cryptosporidium parvum
SNTPEYNNKPPEI

SEQ ID NO: 2225859 - protein, 4 aa, Cryptosporidium parvum
SNTR

SEQ ID NO: 2225860 - protein, 10 aa, Cryptosporidium parvum
SNTRESSSNR

SEQ ID NO: 2225861 - protein, 5 aa, Cryptosporidium parvum
SNTRI

SEQ ID NO: 2225862 - protein, 9 aa, Cryptosporidium parvum
SNTSAPSPV

SEQ ID NO: 2225863 - protein, 8 aa, Cryptosporidium parvum
SNTSDLSR

SEQ ID NO: 2225864 - protein, 9 aa, Cryptosporidium parvum
SNTSSESKL

SEQ ID NO: 2225865 - protein, 6 aa, Cryptosporidium parvum
SNTTDV

SEQ ID NO: 2225866 - protein, 10 aa, Cryptosporidium parvum
SNTTQTTTDL

SEQ ID NO: 2225867 - protein, 7 aa, Cryptosporidium parvum
SNTTSNN

SEQ ID NO: 2225868 - protein, 4 aa, Cryptosporidium parvum
SNTV

SEQ ID NO: 2225869 - protein, 5 aa, Cryptosporidium parvum
SNTYN

SEQ ID NO: 2225870 - protein, 7 aa, Cryptosporidium parvum
SNVASTT

SEQ ID NO: 2225871 - protein, 9 aa, Cryptosporidium parvum
SNVENKKEH

SEQ ID NO: 2225872 - protein, 5 aa, Cryptosporidium parvum
SNVGR

SEQ ID NO: 2225873 - protein, 10 aa, Cryptosporidium parvum
SNVPQTPRQS

SEQ ID NO: 2225874 - protein, 4 aa, Cryptosporidium parvum
SNVQ

SEQ ID NO: 2225875 - protein, 4 aa, Cryptosporidium parvum
SNVS

SEQ ID NO: 2225876 - protein, 10 aa, Cryptosporidium parvum
SNVSKDKINS

SEQ ID NO: 2225877 - protein, 4 aa, Cryptosporidium parvum
SNWG

SEQ ID NO: 2225878 - protein, 4 aa, Cryptosporidium parvum
SNYC

SEQ ID NO: 2225879 - protein, 12 aa, Cryptosporidium parvum
SNYDQVANLESE

SEQ ID NO: 2225880 - protein, 4 aa, Cryptosporidium parvum
SNYE

SEQ ID NO: 2225881 - protein, 28 aa, Cryptosporidium parvum
SNYENEPKKDKLITSASNRGQKNSYNKH

SEQ ID NO: 2225882 - protein, 5 aa, Cryptosporidium parvum
SNYEV

SEQ ID NO: 2225883 - protein, 4 aa, Cryptosporidium parvum
SNYI

SEQ ID NO: 2225884 - protein, 6 aa, Cryptosporidium parvum
SNYIKK

SEQ ID NO: 2225885 - protein, 4 aa, Cryptosporidium parvum
SNYL

SEQ ID NO: 2225886 - protein, 11 aa, Cryptosporidium parvum
SNYQMNSEREN

SEQ ID NO: 2225887 - protein, 19 aa, Cryptosporidium parvum
SPADIRSDNVSVEASEPIP

SEQ ID NO: 2225888 - protein, 5 aa, Cryptosporidium parvum
SPADN

SEQ ID NO: 2225889 - protein, 6 aa, Cryptosporidium parvum
SPALSD

SEQ ID NO: 2225890 - protein, 6 aa, Cryptosporidium parvum
SPAPNN

SEQ ID NO: 2225891 - protein, 5 aa, Cryptosporidium parvum
SPASE

SEQ ID NO: 2225892 - protein, 5 aa, Cryptosporidium parvum
SPCPN

SEQ ID NO: 2225893 - protein, 16 aa, Cryptosporidium parvum
SPDKYSSSSKGPGFSD

SEQ ID NO: 2225894 - protein, 18 aa, Cryptosporidium parvum
SPDLDNPRPPPNDAPEEE

SEQ ID NO: 2225895 - protein, 7 aa, Cryptosporidium parvum
SPDSNKI

SEQ ID NO: 2225896 - protein, 9 aa, Cryptosporidium parvum
SPDYGSHAT

SEQ ID NO: 2225897 - protein, 5 aa, Cryptosporidium parvum
SPEFY

SEQ ID NO: 2225898 - protein, 9 aa, Cryptosporidium parvum
SPEISEEDE

SEQ ID NO: 2225899 - protein, 4 aa, Cryptosporidium parvum
SPEK

SEQ ID NO: 2225900 - protein, 4 aa, Cryptosporidium parvum
SPEN

SEQ ID NO: 2225901 - protein, 9 aa, Cryptosporidium parvum
SPENEENKT

SEQ ID NO: 2225902 - protein, 9 aa, Cryptosporidium parvum
SPENESDKS

SEQ ID NO: 2225903 - protein, 5 aa, Cryptosporidium parvum
SPENF

SEQ ID NO: 2225904 - protein, 7 aa, Cryptosporidium parvum
SPEPLND

SEQ ID NO: 2225905 - protein, 4 aa, Cryptosporidium parvum
SPEQ

SEQ ID NO: 2225906 - protein, 33 aa, Cryptosporidium parvum; identical to SEQ ID NO: 2120087

SEQ ID NO: 2225907 - protein, 5 aa, Cryptosporidium parvum
SPESI

SEQ ID NO: 2225908 - protein, 6 aa, Cryptosporidium parvum
SPESKY

SEQ ID NO: 2225909 - protein, 17 aa, Cryptosporidium parvum
SPFEAYKSSKSNDNEKL

SEQ ID NO: 2225910 - protein, 12 aa, Cryptosporidium parvum
SPFPKETTLPSK

SEQ ID NO: 2225911 - protein, 4 aa, Cryptosporidium parvum
SPFS

SEQ ID NO: 2225912 - protein, 6 aa, Cryptosporidium parvum
SPGSGK

SEQ ID NO: 2225913 - protein, 8 aa, Cryptosporidium parvum
SPGSGKTS

SEQ ID NO: 2225914 - protein, 4 aa, Cryptosporidium parvum
SPGT

SEQ ID NO: 2225915 - protein, 19 aa, Cryptosporidium parvum
SPGYSSKNYEEDEYIPEDN

SEQ ID NO: 2225916 - protein, 4 aa, Cryptosporidium parvum
SPHH

SEQ ID NO: 2225917 - protein, 5 aa, Cryptosporidium parvum
SPHPK

SEQ ID NO: 2225918 - protein, 4 aa, Cryptosporidium parvum
SPIE

SEQ ID NO: 2225919 - protein, 5 aa, Cryptosporidium parvum
SPIET

SEQ ID NO: 2225920 - protein, 9 aa, Cryptosporidium parvum
SPIKGNKES

SEQ ID NO: 2225921 - protein, 6 aa, Cryptosporidium parvum
SPINNK

SEQ ID NO: 2225922 - protein, 5 aa, Cryptosporidium parvum
SPINS

SEQ ID NO: 2225923 - protein, 5 aa, Cryptosporidium parvum
SPIPG

SEQ ID NO: 2225924 - protein, 5 aa, Cryptosporidium parvum
SPIQT

SEQ ID NO: 2225925 - protein, 6 aa, Cryptosporidium parvum
SPIRPE

SEQ ID NO: 2225926 - protein, 5 aa, Cryptosporidium parvum
SPISD

SEQ ID NO: 2225927 - protein, 5 aa, Cryptosporidium parvum
SPITN

SEQ ID NO: 2225928 - protein, 4 aa, Cryptosporidium parvum
SPKC

SEQ ID NO: 2225929 - protein, 5 aa, Cryptosporidium parvum
SPKDL

SEQ ID NO: 2225930 - protein, 4 aa, Cryptosporidium parvum
SPKE

SEQ ID NO: 2225931 - protein, 9 aa, Cryptosporidium parvum
SPKEMTSDQ

SEQ ID NO: 2225932 - protein, 15 aa, Cryptosporidium parvum
SPKGRSTEGYNSRSE

SEQ ID NO: 2225933 - protein, 4 aa, Cryptosporidium parvum
SPKH

SEQ ID NO: 2225934 - protein, 6 aa, Cryptosporidium parvum
SPKHRR

SEQ ID NO: 2225935 - protein, 6 aa, Cryptosporidium parvum
SPKPQI

SEQ ID NO: 2225936 - protein, 9 aa, Cryptosporidium parvum
SPKQRNNYL

SEQ ID NO: 2225937 - protein, 4 aa, Cryptosporidium parvum
SPLE

SEQ ID NO: 2225938 - protein, 12 aa, Cryptosporidium parvum
SPLGGLSPISQS

SEQ ID NO: 2225939 - protein, 14 aa, Cryptosporidium parvum
SPLLRKDDQKTPYG

SEQ ID NO: 2225940 - protein, 6 aa, Cryptosporidium parvum
SPLNSN

SEQ ID NO: 2225941 - protein, 6 aa, Cryptosporidium parvum
SPLNTS

SEQ ID NO: 2225942 - protein, 10 aa, Cryptosporidium parvum
SPLSNFPSTV

SEQ ID NO: 2225943 - protein, 9 aa, Cryptosporidium parvum
SPLSSSSTL

SEQ ID NO: 2225944 - protein, 7 aa, Cryptosporidium parvum
SPLSSTE

SEQ ID NO: 2225945 - protein, 4 aa, Cryptosporidium parvum
SPMD

SEQ ID NO: 2225946 - protein, 21 aa, Cryptosporidium parvum
SPMNGGSAKLGASSSSSMSSN

SEQ ID NO: 2225947 - protein, 8 aa, Cryptosporidium parvum
SPNDESLP

SEQ ID NO: 2225948 - protein, 6 aa, Cryptosporidium parvum
SPNELE

SEQ ID NO: 2225949 - protein, 8 aa, Cryptosporidium parvum
SPNIASNT

SEQ ID NO: 2225950 - protein, 6 aa, Cryptosporidium parvum
SPNKNY

SEQ ID NO: 2225951 - protein, 15 aa, Cryptosporidium parvum
SPNLGSSTISANPAL

SEQ ID NO: 2225952 - protein, 7 aa, Cryptosporidium parvum
SPNNKNV

SEQ ID NO: 2225953 - protein, 6 aa, Cryptosporidium parvum
SPNNNT

SEQ ID NO: 2225954 - protein, 13 aa, Cryptosporidium parvum
SPNNNYDPAVQNS

SEQ ID NO: 2225955 - protein, 12 aa, Cryptosporidium parvum
SPNNSSESNTEL

SEQ ID NO: 2225956 - protein, 5 aa, Cryptosporidium parvum
SPNPL

SEQ ID NO: 2225957 - protein, 8 aa, Cryptosporidium parvum
SPNPNNKL

SEQ ID NO: 2225958 - protein, 6 aa, Cryptosporidium parvum
SPNSGG

SEQ ID NO: 2225959 - protein, 11 aa, Cryptosporidium parvum
SPNSSLPINPN

SEQ ID NO: 2225960 - protein, 5 aa, Cryptosporidium parvum
SPPDL

SEQ ID NO: 2225961 - protein, 5 aa, Cryptosporidium parvum
SPPKD

SEQ ID NO: 2225962 - protein, 20 aa, Cryptosporidium parvum
SPPLPKKPPVGDPYNPERSA

SEQ ID NO: 2225963 - protein, 5 aa, Cryptosporidium parvum
SPPLS

SEQ ID NO: 2225964 - protein, 5 aa, Cryptosporidium parvum
SPPNS

SEQ ID NO: 2225965 - protein, 18 aa, Cryptosporidium parvum
SPPPKQLQKYTRIKPMPF

SEQ ID NO: 2225966 - protein, 10 aa, Cryptosporidium parvum
SPPPQKTVRE

SEQ ID NO: 2225967 - protein, 21 aa, Cryptosporidium parvum
SPPSSLNSSNRRGSNSDSSNS

SEQ ID NO: 2225968 - protein, 8 aa, Cryptosporidium parvum
SPPVKATP

SEQ ID NO: 2225969 - protein, 5 aa, Cryptosporidium parvum
SPQEE

SEQ ID NO: 2225970 - protein, 6 aa, Cryptosporidium parvum
SPQKTI

SEQ ID NO: 2225971 - protein, 6 aa, Cryptosporidium parvum
SPQNKD

SEQ ID NO: 2225972 - protein, 5 aa, Cryptosporidium parvum
SPQRH

SEQ ID NO: 2225973 - protein, 6 aa, Cryptosporidium parvum
SPQSME

SEQ ID NO: 2225974 - protein, 6 aa, Cryptosporidium parvum
SPQSNM

SEQ ID NO: 2225975 - protein, 5 aa, Cryptosporidium parvum
SPQVK

SEQ ID NO: 2225976 - protein, 11 aa, Cryptosporidium parvum
SPRKKKSRNSI

SEQ ID NO: 2225977 - protein, 4 aa, Cryptosporidium parvum
SPRN

SEQ ID NO: 2225978 - protein, 10 aa, Cryptosporidium parvum
SPRNGGETCG

SEQ ID NO: 2225979 - protein, 9 aa, Cryptosporidium parvum
SPRPPNSAC

SEQ ID NO: 2225980 - protein, 21 aa, Cryptosporidium parvum
SPRSKEIRSKKEESNFSKTDV

SEQ ID NO: 2225981 - protein, 6 aa, Cryptosporidium parvum
SPSEAT

SEQ ID NO: 2225982 - protein, 7 aa, Cryptosporidium parvum
SPSESMK

SEQ ID NO: 2225983 - protein, 4 aa, Cryptosporidium parvum
SPSF

SEQ ID NO: 2225984 - protein, 5 aa, Cryptosporidium parvum
SPSIK

SEQ ID NO: 2225985 - protein, 6 aa, Cryptosporidium parvum
SPSKKL

SEQ ID NO: 2225986 - protein, 7 aa, Cryptosporidium parvum
SPSLSEE

SEQ ID NO: 2225987 - protein, 8 aa, Cryptosporidium parvum
SPSPSSAE

SEQ ID NO: 2225988 - protein, 6 aa, Cryptosporidium parvum
SPSQKK

SEQ ID NO: 2225989 - protein, 4 aa, Cryptosporidium parvum
SPSR

SEQ ID NO: 2225990 - protein, 8 aa, Cryptosporidium parvum
SPSRQREN

SEQ ID NO: 2225991 - protein, 28 aa, Cryptosporidium parvum
SPSSEYSLTGPINNKKDNIKDSGKSMIN

SEQ ID NO: 2225992 - protein, 7 aa, Cryptosporidium parvum
SPSTLTV

SEQ ID NO: 2225993 - protein, 8 aa, Cryptosporidium parvum
SPSVPSQA

SEQ ID NO: 2225994 - protein, 5 aa, Cryptosporidium parvum
SPSVS

SEQ ID NO: 2225995 - protein, 4 aa, Cryptosporidium parvum
SPTE

SEQ ID NO: 2225996 - protein, 6 aa, Cryptosporidium parvum
SPTENI

SEQ ID NO: 2225997 - protein, 9 aa, Cryptosporidium parvum
SPTKNWTER

SEQ ID NO: 2225998 - protein, 9 aa, Cryptosporidium parvum
SPTNNKNEV

SEQ ID NO: 2225999 - protein, 16 aa, Cryptosporidium parvum
SPTNNSLDTKTPLLKA

SEQ ID NO: 2226000 - protein, 6 aa, Cryptosporidium parvum
SPTRNI

SEQ ID NO: 2226001 - protein, 21 aa, Cryptosporidium parvum
SPTSINSDSNHLDSKNTNSIP

SEQ ID NO: 2226002 - protein, 7 aa, Cryptosporidium parvum
SPTSNDE

SEQ ID NO: 2226003 - protein, 5 aa, Cryptosporidium parvum
SPTSV

SEQ ID NO: 2226004 - protein, 7 aa, Cryptosporidium parvum
SPTVQNV

SEQ ID NO: 2226005 - protein, 5 aa, Cryptosporidium parvum
SPVDN

SEQ ID NO: 2226006 - protein, 10 aa, Cryptosporidium parvum
SPVNNNATYA

SEQ ID NO: 2226007 - protein, 9 aa, Cryptosporidium parvum
SPVQGYSSI

SEQ ID NO: 2226008 - protein, 7 aa, Cryptosporidium parvum
SPYGSKD

SEQ ID NO: 2226009 - protein, 4 aa, Cryptosporidium parvum
SPYI

SEQ ID NO: 2226010 - protein, 13 aa, Cryptosporidium parvum
SPYKNGISPDIST

SEQ ID NO: 2226011 - protein, 4 aa, Cryptosporidium parvum
SPYS

SEQ ID NO: 2226012 - protein, 4 aa, Cryptosporidium parvum
SPYT

SEQ ID NO: 2226013 - protein, 6 aa, Cryptosporidium parvum
SPYTGT

SEQ ID NO: 2226014 - protein, 18 aa, Cryptosporidium parvum
SPYYDTQEQEINSKDEHQ

SEQ ID NO: 2226015 - protein, 4 aa, Cryptosporidium parvum
SQAG

SEQ ID NO: 2226016 - protein, 13 aa, Cryptosporidium parvum
SQAHNYDSKSPHI

SEQ ID NO: 2226017 - protein, 5 aa, Cryptosporidium parvum
SQANT

SEQ ID NO: 2226018 - protein, 20 aa, Cryptosporidium parvum
SQATNTSQVSQGGGKRTFSF

SEQ ID NO: 2226019 - protein, 7 aa, Cryptosporidium parvum
SQDAYHP

SEQ ID NO: 2226020 - protein, 15 aa, Cryptosporidium parvum
SQDDDSESHQEEENN

SEQ ID NO: 2226021 - protein, 4 aa, Cryptosporidium parvum
SQDE

SEQ ID NO: 2226022 - protein, 6 aa, Cryptosporidium parvum
SQDIPH

SEQ ID NO: 2226023 - protein, 16 aa, Cryptosporidium parvum
SQDSGNLSSTNSNPRE

SEQ ID NO: 2226024 - protein, 6 aa, Cryptosporidium parvum
SQDSQS

SEQ ID NO: 2226025 - protein, 7 aa, Cryptosporidium parvum
SQDSSSI

SEQ ID NO: 2226026 - protein, 5 aa, Cryptosporidium parvum
SQEDE

SEQ ID NO: 2226027 - protein, 5 aa, Cryptosporidium parvum
SQEDN

SEQ ID NO: 2226028 - protein, 4 aa, Cryptosporidium parvum
SQEE

SEQ ID NO: 2226029 - protein, 6 aa, Cryptosporidium parvum
SQEEIN

SEQ ID NO: 2226030 - protein, 29 aa, Cryptosporidium parvum
SQEEKINQEKIQKSLKQQQQDKKKRNTGY

SEQ ID NO: 2226031 - protein, 6 aa, Cryptosporidium parvum
SQEESM

SEQ ID NO: 2226032 - protein, 32 aa, Cryptosporidium parvum
SQEFQSKDSLGEDSEMNNGELDSQRGEAPDPI

SEQ ID NO: 2226033 - protein, 6 aa, Cryptosporidium parvum
SQEGNS

SEQ ID NO: 2226034 - protein, 7 aa, Cryptosporidium parvum
SQEGNSI

SEQ ID NO: 2226035 - protein, 12 aa, Cryptosporidium parvum
SQELEDAGSLTY

SEQ ID NO: 2226036 - protein, 7 aa, Cryptosporidium parvum
SQEMNST

SEQ ID NO: 2226037 - protein, 6 aa, Cryptosporidium parvum
SQENDI

SEQ ID NO: 2226038 - protein, 8 aa, Cryptosporidium parvum
SQENPNPV

SEQ ID NO: 2226039 - protein, 12 aa, Cryptosporidium parvum
SQENTSLETYDK

SEQ ID NO: 2226040 - protein, 6 aa, Cryptosporidium parvum
SQESEF

SEQ ID NO: 2226041 - protein, 8 aa, Cryptosporidium parvum
SQESFDNH

SEQ ID NO: 2226042 - protein, 5 aa, Cryptosporidium parvum
SQESV

SEQ ID NO: 2226043 - protein, 9 aa, Cryptosporidium parvum
SQETTSTEN

SEQ ID NO: 2226044 - protein, 4 aa, Cryptosporidium parvum
SQFS

SEQ ID NO: 2226045 - protein, 11 aa, Cryptosporidium parvum
SQGAANSLKEN

SEQ ID NO: 2226046 - protein, 9 aa, Cryptosporidium parvum
SQGGVNTNS

SEQ ID NO: 2226047 - protein, 4 aa, Cryptosporidium parvum
SQGL

SEQ ID NO: 2226048 - protein, 14 aa, Cryptosporidium parvum
SQHDENNDTRYEHE

SEQ ID NO: 2226049 - protein, 5 aa, Cryptosporidium parvum
SQHPL

SEQ ID NO: 2226050 - protein, 6 aa, Cryptosporidium parvum
SQHSLK

SEQ ID NO: 2226051 - protein, 4 aa, Cryptosporidium parvum
SQIN

SEQ ID NO: 2226052 - protein, 6 aa, Cryptosporidium parvum
SQINQE

SEQ ID NO: 2226053 - protein, 4 aa, Cryptosporidium parvum
SQIQ

SEQ ID NO: 2226054 - protein, 5 aa, Cryptosporidium parvum
SQIQE

SEQ ID NO: 2226055 - protein, 4 aa, Cryptosporidium parvum
SQIS

SEQ ID NO: 2226056 - protein, 12 aa, Cryptosporidium parvum
SQISGKDDSLIG

SEQ ID NO: 2226057 - protein, 5 aa, Cryptosporidium parvum
SQKCP

SEQ ID NO: 2226058 - protein, 4 aa, Cryptosporidium parvum
SQKD

SEQ ID NO: 2226059 - protein, 6 aa, Cryptosporidium parvum
SQKENQ

SEQ ID NO: 2226060 - protein, 6 aa, Cryptosporidium parvum
SQKIAS

SEQ ID NO: 2226061 - protein, 13 aa, Cryptosporidium parvum
SQKIGRKGKFQSK

SEQ ID NO: 2226062 - protein, 7 aa, Cryptosporidium parvum
SQKKSNH

SEQ ID NO: 2226063 - protein, 8 aa, Cryptosporidium parvum
SQKKYNNT

SEQ ID NO: 2226064 - protein, 4 aa, Cryptosporidium parvum
SQKL

SEQ ID NO: 2226065 - protein, 6 aa, Cryptosporidium parvum
SQKLDS

SEQ ID NO: 2226066 - protein, 6 aa, Cryptosporidium parvum
SQKNEQ

SEQ ID NO: 2226067 - protein, 7 aa, Cryptosporidium parvum
SQKPIKN

SEQ ID NO: 2226068 - protein, 16 aa, Cryptosporidium parvum
SQKTELANDDNKMQEN

SEQ ID NO: 2226069 - protein, 6 aa, Cryptosporidium parvum
SQLPRE

SEQ ID NO: 2226070 - protein, 7 aa, Cryptosporidium parvum
SQMSHSE

SEQ ID NO: 2226071 - protein, 4 aa, Cryptosporidium parvum
SQNK

SEQ ID NO: 2226072 - protein, 13 aa, Cryptosporidium parvum
SQNNALSAQESQN

SEQ ID NO: 2226073 - protein, 11 aa, Cryptosporidium parvum
SQNQDGTENIP

SEQ ID NO: 2226074 - protein, 19 aa, Cryptosporidium parvum
SQNSELGLSSSISDEISSR

SEQ ID NO: 2226075 - protein, 5 aa, Cryptosporidium parvum
SQNSI

SEQ ID NO: 2226076 - protein, 15 aa, Cryptosporidium parvum
SQNSNSISINNNNNH

SEQ ID NO: 2226077 - protein, 4 aa, Cryptosporidium parvum
SQPI

SEQ ID NO: 2226078 - protein, 7 aa, Cryptosporidium parvum
SQPKPIK

SEQ ID NO: 2226079 - protein, 9 aa, Cryptosporidium parvum
SQPNEGKEC

SEQ ID NO: 2226080 - protein, 5 aa, Cryptosporidium parvum
SQPNF

SEQ ID NO: 2226081 - protein, 5 aa, Cryptosporidium parvum
SQPPL

SEQ ID NO: 2226082 - protein, 7 aa, Cryptosporidium parvum
SQPSRGN

SEQ ID NO: 2226083 - protein, 5 aa, Cryptosporidium parvum
SQQAV

SEQ ID NO: 2226084 - protein, 8 aa, Cryptosporidium parvum
SQQEEMEE

SEQ ID NO: 2226085 - protein, 8 aa, Cryptosporidium parvum
SQQKKVHN

SEQ ID NO: 2226086 - protein, 7 aa, Cryptosporidium parvum
SQQTRLS

SEQ ID NO: 2226087 - protein, 7 aa, Cryptosporidium parvum
SQQYGEK

SEQ ID NO: 2226088 - protein, 11 aa, Cryptosporidium parvum
SQRFSSSEKIK

SEQ ID NO: 2226089 - protein, 16 aa, Cryptosporidium parvum
SQRNDDSKNSTYLPSS

SEQ ID NO: 2226090 - protein, 5 aa, Cryptosporidium parvum
SQRPE

SEQ ID NO: 2226091 - protein, 10 aa, Cryptosporidium parvum
SQRSKSPVCS

SEQ ID NO: 2226092 - protein, 9 aa, Cryptosporidium parvum
SQSDTWPHE

SEQ ID NO: 2226093 - protein, 10 aa, Cryptosporidium parvum
SQSGETADTV

SEQ ID NO: 2226094 - protein, 4 aa, Cryptosporidium parvum
SQSI

SEQ ID NO: 2226095 - protein, 4 aa, Cryptosporidium parvum
SQSN

SEQ ID NO: 2226096 - protein, 8 aa, Cryptosporidium parvum
SQSNNFNQ

SEQ ID NO: 2226097 - protein, 4 aa, Cryptosporidium parvum
SQSP

SEQ ID NO: 2226098 - protein, 9 aa, Cryptosporidium parvum
SQSQSYELS

SEQ ID NO: 2226099 - protein, 9 aa, Cryptosporidium parvum
SQSSNTVAS

SEQ ID NO: 2226100 - protein, 6 aa, Cryptosporidium parvum
SQSSYY

SEQ ID NO: 2226101 - protein, 15 aa, Cryptosporidium parvum
SQSTGNIRGYPRKSK

SEQ ID NO: 2226102 - protein, 36 aa, Cryptosporidium parvum
SQSVGERSNKSLRKKKSKKGRKDQKNHNIEDSPIEQ

SEQ ID NO: 2226103 - protein, 6 aa, Cryptosporidium parvum
SQTGGN

SEQ ID NO: 2226104 - protein, 10 aa, Cryptosporidium parvum
SQTGKSERLS

SEQ ID NO: 2226105 - protein, 7 aa, Cryptosporidium parvum
SQTGNKE

SEQ ID NO: 2226106 - protein, 11 aa, Cryptosporidium parvum
SQTGRSYEENY

SEQ ID NO: 2226107 - protein, 79 aa, Cryptosporidium parvum
SQTLTAPNTSANQAAPAPAPAPTPAPTPAPTPAPTPAPTPAPTPAPAPIPAPAPTPAPKPTPAPVPTLGPGLSKDSAPI

SEQ ID NO: 2226108 - protein, 9 aa, Cryptosporidium parvum
SQTNASQEI

SEQ ID NO: 2226109 - protein, 7 aa, Cryptosporidium parvum
SQTPGEN

SEQ ID NO: 2226110 - protein, 11 aa, Cryptosporidium parvum
SQTPNQEIGGL

SEQ ID NO: 2226111 - protein, 4 aa, Cryptosporidium parvum
SQTQ

SEQ ID NO: 2226112 - protein, 10 aa, Cryptosporidium parvum
SQTSKDGNTT

SEQ ID NO: 2226113 - protein, 8 aa, Cryptosporidium parvum
SQTSTEIN

SEQ ID NO: 2226114 - protein, 9 aa, Cryptosporidium parvum
SQVNSGKPF

SEQ ID NO: 2226115 - protein, 12 aa, Cryptosporidium parvum
SQVPEGSTKKGL

SEQ ID NO: 2226116 - protein, 8 aa, Cryptosporidium parvum
SQVPPSND

SEQ ID NO: 2226117 - protein, 11 aa, Cryptosporidium parvum
SQWTENNQIQK

SEQ ID NO: 2226118 - protein, 5 aa, Cryptosporidium parvum
SQYKT

SEQ ID NO: 2226119 - protein, 7 aa, Cryptosporidium parvum
SRAISKS

SEQ ID NO: 2226120 - protein, 4 aa, Cryptosporidium parvum
SRAK

SEQ ID NO: 2226121 - protein, 6 aa, Cryptosporidium parvum
SRAKHS

SEQ ID NO: 2226122 - protein, 5 aa, Cryptosporidium parvum
SRASF

SEQ ID NO: 2226123 - protein, 4 aa, Cryptosporidium parvum
SRDI

SEQ ID NO: 2226124 - protein, 39 aa, Cryptosporidium parvum
SRDIKDKEVKAGDATTTTTTNVNTKNNIDSDNNLAIVIK

SEQ ID NO: 2226125 - protein, 8 aa, Cryptosporidium parvum
SRDSESCS

SEQ ID NO: 2226126 - protein, 9 aa, Cryptosporidium parvum
SRDSKRLNQ

SEQ ID NO: 2226127 - protein, 7 aa, Cryptosporidium parvum
SREAGTE

SEQ ID NO: 2226128 - protein, 4 aa, Cryptosporidium parvum
SREE

SEQ ID NO: 2226129 - protein, 9 aa, Cryptosporidium parvum
SREEGQRDS

SEQ ID NO: 2226130 - protein, 4 aa, Cryptosporidium parvum
SREF

SEQ ID NO: 2226131 - protein, 15 aa, Cryptosporidium parvum
SREGEEFKDQNNNIR

SEQ ID NO: 2226132 - protein, 5 aa, Cryptosporidium parvum
SREGS

SEQ ID NO: 2226133 - protein, 8 aa, Cryptosporidium parvum
SRELNKEN

SEQ ID NO: 2226134 - protein, 8 aa, Cryptosporidium parvum
SREPAGLT

SEQ ID NO: 2226135 - protein, 8 aa, Cryptosporidium parvum
SREPNSLK

SEQ ID NO: 2226136 - protein, 7 aa, Cryptosporidium parvum
SRERTGR

SEQ ID NO: 2226137 - protein, 6 aa, Cryptosporidium parvum
SRETKE

SEQ ID NO: 2226138 - protein, 5 aa, Cryptosporidium parvum
SRETL

SEQ ID NO: 2226139 - protein, 6 aa, Cryptosporidium parvum
SRETNK

SEQ ID NO: 2226140 - protein, 7 aa, Cryptosporidium parvum
SREVGQS

SEQ ID NO: 2226141 - protein, 4 aa, Cryptosporidium parvum
SREW

SEQ ID NO: 2226142 - protein, 22 aa, Cryptosporidium parvum
SRFDGQGDNNNNNNNNNEKERN

SEQ ID NO: 2226143 - protein, 8 aa, Cryptosporidium parvum
SRFGESGK

SEQ ID NO: 2226144 - protein, 9 aa, Cryptosporidium parvum
SRFKSESRM

SEQ ID NO: 2226145 - protein, 13 aa, Cryptosporidium parvum
SRFPNTTNSNSRY

SEQ ID NO: 2226146 - protein, 5 aa, Cryptosporidium parvum
SRGDA

SEQ ID NO: 2226147 - protein, 4 aa, Cryptosporidium parvum
SRGE

SEQ ID NO: 2226148 - protein, 13 aa, Cryptosporidium parvum
SRGEIENIDTRQK

SEQ ID NO: 2226149 - protein, 5 aa, Cryptosporidium parvum
SRGFN

SEQ ID NO: 2226150 - protein, 11 aa, Cryptosporidium parvum
SRGINNSGGLN

SEQ ID NO: 2226151 - protein, 9 aa, Cryptosporidium parvum
SRGIQDSEA

SEQ ID NO: 2226152 - protein, 6 aa, Cryptosporidium parvum
SRGKSG

SEQ ID NO: 2226153 - protein, 12 aa, Cryptosporidium parvum
SRGPNKSSTNQF

SEQ ID NO: 2226154 - protein, 4 aa, Cryptosporidium parvum
SRGY

SEQ ID NO: 2226155 - protein, 18 aa, Cryptosporidium parvum
SRHDQSGRHLKTNGEFGY

SEQ ID NO: 2226156 - protein, 6 aa, Cryptosporidium parvum
SRHYKG

SEQ ID NO: 2226157 - protein, 4 aa, Cryptosporidium parvum
SRID

SEQ ID NO: 2226158 - protein, 13 aa, Cryptosporidium parvum
SRIDNSNKLSNSV

SEQ ID NO: 2226159 - protein, 7 aa, Cryptosporidium parvum
SRIEDSK

SEQ ID NO: 2226160 - protein, 5 aa, Cryptosporidium parvum
SRKAP

SEQ ID NO: 2226161 - protein, 4 aa, Cryptosporidium parvum
SRKL

SEQ ID NO: 2226162 - protein, 8 aa, Cryptosporidium parvum
SRKNGPSL

SEQ ID NO: 2226163 - protein, 8 aa, Cryptosporidium parvum
SRKNPDIQ

SEQ ID NO: 2226164 - protein, 13 aa, Cryptosporidium parvum
SRKNSAKSNNKQM

SEQ ID NO: 2226165 - protein, 9 aa, Cryptosporidium parvum
SRKPDYSRP

SEQ ID NO: 2226166 - protein, 4 aa, Cryptosporidium parvum
SRKS

SEQ ID NO: 2226167 - protein, 20 aa, Cryptosporidium parvum
SRKSIDINKKKRKADETVRP

SEQ ID NO: 2226168 - protein, 11 aa, Cryptosporidium parvum
SRKVDTSGHER

SEQ ID NO: 2226169 - protein, 9 aa, Cryptosporidium parvum
SRLESATKH

SEQ ID NO: 2226170 - protein, 9 aa, Cryptosporidium parvum
SRLPTKTEF

SEQ ID NO: 2226171 - protein, 6 aa, Cryptosporidium parvum
SRLSSK

SEQ ID NO: 2226172 - protein, 12 aa, Cryptosporidium parvum
SRLTDNSNDINE

SEQ ID NO: 2226173 - protein, 20 aa, Cryptosporidium parvum
SRLTSQNSTVVRNSDLNDEL

SEQ ID NO: 2226174 - protein, 6 aa, Cryptosporidium parvum
SRMERK

SEQ ID NO: 2226175 - protein, 6 aa, Cryptosporidium parvum
SRMQEE

SEQ ID NO: 2226176 - protein, 4 aa, Cryptosporidium parvum
SRNA

SEQ ID NO: 2226177 - protein, 7 aa, Cryptosporidium parvum
SRNEAEE

SEQ ID NO: 2226178 - protein, 15 aa, Cryptosporidium parvum
SRNEFREQEYSQTKG

SEQ ID NO: 2226179 - protein, 6 aa, Cryptosporidium parvum
SRNETT

SEQ ID NO: 2226180 - protein, 6 aa, Cryptosporidium parvum
SRNGDQ

SEQ ID NO: 2226181 - protein, 13 aa, Cryptosporidium parvum
SRNGESLRPQSAA

SEQ ID NO: 2226182 - protein, 7 aa, Cryptosporidium parvum
SRNNSND

SEQ ID NO: 2226183 - protein, 10 aa, Cryptosporidium parvum
SRNQTYSPNY

SEQ ID NO: 2226184 - protein, 6 aa, Cryptosporidium parvum
SRNREK

SEQ ID NO: 2226185 - protein, 7 aa, Cryptosporidium parvum
SRNSQSI

SEQ ID NO: 2226186 - protein, 15 aa, Cryptosporidium parvum
SRPPLPTRKPYSGSL

SEQ ID NO: 2226187 - protein, 9 aa, Cryptosporidium parvum
SRPSESTIR

SEQ ID NO: 2226188 - protein, 10 aa, Cryptosporidium parvum
SRPTNDSSAD

SEQ ID NO: 2226189 - protein, 10 aa, Cryptosporidium parvum
SRQDIGNNSQ

SEQ ID NO: 2226190 - protein, 14 aa, Cryptosporidium parvum
SRQELDKPSSISDN

SEQ ID NO: 2226191 - protein, 6 aa, Cryptosporidium parvum
SRQENE

SEQ ID NO: 2226192 - protein, 22 aa, Cryptosporidium parvum
SRQISADEIPNNRTVEASNDNI

SEQ ID NO: 2226193 - protein, 4 aa, Cryptosporidium parvum
SRQM

SEQ ID NO: 2226194 - protein, 18 aa, Cryptosporidium parvum
SRQNTESDKLISNNNSSI

SEQ ID NO: 2226195 - protein, 7 aa, Cryptosporidium parvum
SRRDEVP

SEQ ID NO: 2226196 - protein, 4 aa, Cryptosporidium parvum
SRRK

SEQ ID NO: 2226197 - protein, 7 aa, Cryptosporidium parvum
SRRKIKR

SEQ ID NO: 2226198 - protein, 5 aa, Cryptosporidium parvum
SRRNS

SEQ ID NO: 2226199 - protein, 5 aa, Cryptosporidium parvum
SRSCN

SEQ ID NO: 2226200 - protein, 7 aa, Cryptosporidium parvum
SRSGRQK

SEQ ID NO: 2226201 - protein, 17 aa, Cryptosporidium parvum
SRSIGNNVKKERSGTNI

SEQ ID NO: 2226202 - protein, 6 aa, Cryptosporidium parvum
SRSKDL

SEQ ID NO: 2226203 - protein, 7 aa, Cryptosporidium parvum
SRSKGAG

SEQ ID NO: 2226204 - protein, 8 aa, Cryptosporidium parvum
SRSKKGDH

SEQ ID NO: 2226205 - protein, 9 aa, Cryptosporidium parvum
SRSKSSLSI

SEQ ID NO: 2226206 - protein, 4 aa, Cryptosporidium parvum
SRSM

SEQ ID NO: 2226207 - protein, 6 aa, Cryptosporidium parvum
SRSNKL

SEQ ID NO: 2226208 - protein, 8 aa, Cryptosporidium parvum
SRSNKSSL

SEQ ID NO: 2226209 - protein, 25 aa, Cryptosporidium parvum
SRSNNSQGQDPNANYNMQGGAPGMM

SEQ ID NO: 2226210 - protein, 9 aa, Cryptosporidium parvum
SRSNSSISV

SEQ ID NO: 2226211 - protein, 7 aa, Cryptosporidium parvum
SRSQKEE

SEQ ID NO: 2226212 - protein, 10 aa, Cryptosporidium parvum
SRSQNENFQV

SEQ ID NO: 2226213 - protein, 7 aa, Cryptosporidium parvum
SRSQQDV

SEQ ID NO: 2226214 - protein, 14 aa, Cryptosporidium parvum
SRSSISSYKTMNRT

SEQ ID NO: 2226215 - protein, 8 aa, Cryptosporidium parvum
SRSTQGIS

SEQ ID NO: 2226216 - protein, 12 aa, Cryptosporidium parvum
SRSTSKEEAESC

SEQ ID NO: 2226217 - protein, 8 aa, Cryptosporidium parvum
SRSTSNGK

SEQ ID NO: 2226218 - protein, 7 aa, Cryptosporidium parvum
SRTDPQF

SEQ ID NO: 2226219 - protein, 5 aa, Cryptosporidium parvum
SRTEK

SEQ ID NO: 2226220 - protein, 15 aa, Cryptosporidium parvum
SRTENVEKDSSSDCL

SEQ ID NO: 2226221 - protein, 15 aa, Cryptosporidium parvum
SRTFDTELGNPSSIP

SEQ ID NO: 2226222 - protein, 4 aa, Cryptosporidium parvum
SRTG

SEQ ID NO: 2226223 - protein, 6 aa, Cryptosporidium parvum
SRTGNN

SEQ ID NO: 2226224 - protein, 7 aa, Cryptosporidium parvum
SRTPNQI

SEQ ID NO: 2226225 - protein, 6 aa, Cryptosporidium parvum
SRTPPF

SEQ ID NO: 2226226 - protein, 7 aa, Cryptosporidium parvum
SRTQSGR

SEQ ID NO: 2226227 - protein, 4 aa, Cryptosporidium parvum
SRTY

SEQ ID NO: 2226228 - protein, 8 aa, Cryptosporidium parvum
SRVKKGAD

SEQ ID NO: 2226229 - protein, 15 aa, Cryptosporidium parvum
SRVSASESEEEFVPP

SEQ ID NO: 2226230 - protein, 6 aa, Cryptosporidium parvum
SRVTDP

SEQ ID NO: 2226231 - protein, 10 aa, Cryptosporidium parvum
SRWNSGSAQF

SEQ ID NO: 2226232 - protein, 6 aa, Cryptosporidium parvum
SRYFGS

SEQ ID NO: 2226233 - protein, 5 aa, Cryptosporidium parvum
SRYKG

SEQ ID NO: 2226234 - protein, 4 aa, Cryptosporidium parvum
SRYL

SEQ ID NO: 2226235 - protein, 11 aa, Cryptosporidium parvum
SRYSKQYSSYE

SEQ ID NO: 2226236 - protein, 10 aa, Cryptosporidium parvum
SRYSKSKESI

SEQ ID NO: 2226237 - protein, 24 aa, Cryptosporidium parvum
SSAAGSSSSNTAQAGSMDSEFKNK

SEQ ID NO: 2226238 - protein, 7 aa, Cryptosporidium parvum
SSAHEQA

SEQ ID NO: 2226239 - protein, 13 aa, Cryptosporidium parvum
SSAIDNKKNNFQD

SEQ ID NO: 2226240 - protein, 5 aa, Cryptosporidium parvum
SSAIE

SEQ ID NO: 2226241 - protein, 7 aa, Cryptosporidium parvum
SSALESG

SEQ ID NO: 2226242 - protein, 7 aa, Cryptosporidium parvum
SSALSTS

SEQ ID NO: 2226243 - protein, 5 aa, Cryptosporidium parvum
SSANT

SEQ ID NO: 2226244 - protein, 5 aa, Cryptosporidium parvum
SSANY

SEQ ID NO: 2226245 - protein, 18 aa, Cryptosporidium parvum
SSAQQGIDKAREYADYEK

SEQ ID NO: 2226246 - protein, 7 aa, Cryptosporidium parvum
SSASKNT

SEQ ID NO: 2226247 - protein, 11 aa, Cryptosporidium parvum
SSATLDQDSEY

SEQ ID NO: 2226248 - protein, 10 aa, Cryptosporidium parvum
SSCNAPPPSG

SEQ ID NO: 2226249 - protein, 36 aa, Cryptosporidium parvum
SSCPNLGPISSSRSNSSSNHNSNSEIKSRSKSEPWL

SEQ ID NO: 2226250 - protein, 4 aa, Cryptosporidium parvum
SSCS

SEQ ID NO: 2226251 - protein, 10 aa, Cryptosporidium parvum
SSCSSGDFNE

SEQ ID NO: 2226252 - protein, 10 aa, Cryptosporidium parvum
SSCSTSCGLG

SEQ ID NO: 2226253 - protein, 10 aa, Cryptosporidium parvum
SSDCNNDKFN

SEQ ID NO: 2226254 - protein, 19 aa, Cryptosporidium parvum
SSDEDFDDDLDDSLEDDFS

SEQ ID NO: 2226255 - protein, 10 aa, Cryptosporidium parvum
SSDENNPDNI

SEQ ID NO: 2226256 - protein, 6 aa, Cryptosporidium parvum
SSDEPS

SEQ ID NO: 2226257 - protein, 33 aa, Cryptosporidium parvum
SSDEYSNEDSDERKDLDETNRNRVSANNNTKKS

SEQ ID NO: 2226258 - protein, 6 aa, Cryptosporidium parvum
SSDGDP

SEQ ID NO: 2226259 - protein, 9 aa, Cryptosporidium parvum
SSDGGDSIA

SEQ ID NO: 2226260 - protein, 7 aa, Cryptosporidium parvum
SSDGISI

SEQ ID NO: 2226261 - protein, 7 aa, Cryptosporidium parvum
SSDGTRE

SEQ ID NO: 2226262 - protein, 10 aa, Cryptosporidium parvum
SSDIENSTKL

SEQ ID NO: 2226263 - protein, 15 aa, Cryptosporidium parvum
SSDLNEKYNSTIKNS

SEQ ID NO: 2226264 - protein, 6 aa, Cryptosporidium parvum
SSDNFE

SEQ ID NO: 2226265 - protein, 42 aa, Cryptosporidium parvum; identical to SEQ ID NO: 2120330

SEQ ID NO: 2226266 - protein, 11 aa, Cryptosporidium parvum
SSDNNEIENTN

SEQ ID NO: 2226267 - protein, 8 aa, Cryptosporidium parvum
SSDNNSDQ

SEQ ID NO: 2226268 - protein, 4 aa, Cryptosporidium parvum
SSDS

SEQ ID NO: 2226269 - protein, 9 aa, Cryptosporidium parvum
SSDSKKKKI

SEQ ID NO: 2226270 - protein, 6 aa, Cryptosporidium parvum
SSDTTD

SEQ ID NO: 2226271 - protein, 20 aa, Cryptosporidium parvum
SSEAENNFPTSSTTSKNNYN

SEQ ID NO: 2226272 - protein, 6 aa, Cryptosporidium parvum
SSEASS

SEQ ID NO: 2226273 - protein, 6 aa, Cryptosporidium parvum
SSEAYT

SEQ ID NO: 2226274 - protein, 45 aa, Cryptosporidium parvum
SSEDDENDEELANNNTSKENSNTIPNESSSQIIQGKRNKGLRSKG

SEQ ID NO: 2226275 - protein, 20 aa, Cryptosporidium parvum
SSEDSTNSEEVEIESEGNIN

SEQ ID NO: 2226276 - protein, 4 aa, Cryptosporidium parvum
SSEE

SEQ ID NO: 2226277 - protein, 8 aa, Cryptosporidium parvum
SSEEGDLR

SEQ ID NO: 2226278 - protein, 17 aa, Cryptosporidium parvum
SSEEGTDNWSAEEAVES

SEQ ID NO: 2226279 - protein, 7 aa, Cryptosporidium parvum
SSEELSS

SEQ ID NO: 2226280 - protein, 4 aa, Cryptosporidium parvum
SSEF

SEQ ID NO: 2226281 - protein, 8 aa, Cryptosporidium parvum
SSEFNEND

SEQ ID NO: 2226282 - protein, 11 aa, Cryptosporidium parvum
SSEHKKSQLKS

SEQ ID NO: 2226283 - protein, 12 aa, Cryptosporidium parvum
SSEIKSKSTIDV

SEQ ID NO: 2226284 - protein, 6 aa, Cryptosporidium parvum
SSEKGN

SEQ ID NO: 2226285 - protein, 8 aa, Cryptosporidium parvum
SSEKTAYR

SEQ ID NO: 2226286 - protein, 10 aa, Cryptosporidium parvum
SSENEMSEEK

SEQ ID NO: 2226287 - protein, 9 aa, Cryptosporidium parvum
SSENEQISM

SEQ ID NO: 2226288 - protein, 9 aa, Cryptosporidium parvum
SSENGNSVS

SEQ ID NO: 2226289 - protein, 31 aa, Cryptosporidium parvum
SSENSLSNSNEESDVEQIGSKMRDSGSESDI

SEQ ID NO: 2226290 - protein, 6 aa, Cryptosporidium parvum
SSEQGY

SEQ ID NO: 2226291 - protein, 4 aa, Cryptosporidium parvum
SSER

SEQ ID NO: 2226292 - protein, 14 aa, Cryptosporidium parvum
SSERKESNNKVKEN

SEQ ID NO: 2226293 - protein, 6 aa, Cryptosporidium parvum
SSERKS

SEQ ID NO: 2226294 - protein, 35 aa, Cryptosporidium parvum
SSESKINGNKENSIGNKQNSNSITKNKRSSCDHSK

SEQ ID NO: 2226295 - protein, 11 aa, Cryptosporidium parvum
SSESLPDKCTG

SEQ ID NO: 2226296 - protein, 7 aa, Cryptosporidium parvum
SSESNSI

SEQ ID NO: 2226297 - protein, 22 aa, Cryptosporidium parvum
SSESSNSIDSISESNSSMNKEK

SEQ ID NO: 2226298 - protein, 8 aa, Cryptosporidium parvum
SSETASNN

SEQ ID NO: 2226299 - protein, 15 aa, Cryptosporidium parvum
SSETKRNNYNKYGDF

SEQ ID NO: 2226300 - protein, 7 aa, Cryptosporidium parvum
SSEVGNL

SEQ ID NO: 2226301 - protein, 7 aa, Cryptosporidium parvum
SSEVQPY

SEQ ID NO: 2226302 - protein, 4 aa, Cryptosporidium parvum
SSEY

SEQ ID NO: 2226303 - protein, 10 aa, Cryptosporidium parvum
SSEYKRDQQS

SEQ ID NO: 2226304 - protein, 6 aa, Cryptosporidium parvum
SSEYSK

SEQ ID NO: 2226305 - protein, 6 aa, Cryptosporidium parvum
SSFADG

SEQ ID NO: 2226306 - protein, 4 aa, Cryptosporidium parvum
SSFE

SEQ ID NO: 2226307 - protein, 5 aa, Cryptosporidium parvum
SSFGE

SEQ ID NO: 2226308 - protein, 11 aa, Cryptosporidium parvum
SSFNPDDSGSF

SEQ ID NO: 2226309 - protein, 35 aa, Cryptosporidium parvum
SSFRSSNASDGSGDSSYSSRFTGTGTRGSQGGVGS

SEQ ID NO: 2226310 - protein, 7 aa, Cryptosporidium parvum
SSFSDNR

SEQ ID NO: 2226311 - protein, 19 aa, Cryptosporidium parvum
SSFSKDTINPPSGTKSNDH

SEQ ID NO: 2226312 - protein, 7 aa, Cryptosporidium parvum
SSFSKSK

SEQ ID NO: 2226313 - protein, 5 aa, Cryptosporidium parvum
SSFSP

SEQ ID NO: 2226314 - protein, 10 aa, Cryptosporidium parvum
SSGALNTGRT

SEQ ID NO: 2226315 - protein, 7 aa, Cryptosporidium parvum
SSGAVSN

SEQ ID NO: 2226316 - protein, 8 aa, Cryptosporidium parvum
SSGCGKTS

SEQ ID NO: 2226317 - protein, 4 aa, Cryptosporidium parvum
SSGE

SEQ ID NO: 2226318 - protein, 6 aa, Cryptosporidium parvum
SSGEIS

SEQ ID NO: 2226319 - protein, 7 aa, Cryptosporidium parvum
SSGEMDS

SEQ ID NO: 2226320 - protein, 5 aa, Cryptosporidium parvum
SSGFY

SEQ ID NO: 2226321 - protein, 4 aa, Cryptosporidium parvum
SSGG

SEQ ID NO: 2226322 - protein, 4 aa, Cryptosporidium parvum
SSGI

SEQ ID NO: 2226323 - protein, 9 aa, Cryptosporidium parvum
SSGINSGDV

SEQ ID NO: 2226324 - protein, 4 aa, Cryptosporidium parvum
SSGL

SEQ ID NO: 2226325 - protein, 11 aa, Cryptosporidium parvum
SSGNEKNESNF

SEQ ID NO: 2226326 - protein, 20 aa, Cryptosporidium parvum
SSGNNVNLEKEGEGKSSSQL

SEQ ID NO: 2226327 - protein, 43 aa, Cryptosporidium parvum
SSGNRKSNIGISSTGRITSRQTESKNKETNQDSIKSKSPNTEI

SEQ ID NO: 2226328 - protein, 15 aa, Cryptosporidium parvum
SSGNSIESIKNTDTG

SEQ ID NO: 2226329 - protein, 5 aa, Cryptosporidium parvum
SSGPP

SEQ ID NO: 2226330 - protein, 4 aa, Cryptosporidium parvum
SSGS

SEQ ID NO: 2226331 - protein, 11 aa, Cryptosporidium parvum
SSGSEAGKESE

SEQ ID NO: 2226332 - protein, 35 aa, Cryptosporidium parvum
SSGSKSSALSSRFGQKPSSSHSTSTGTRALQSGVG

SEQ ID NO: 2226333 - protein, 12 aa, Cryptosporidium parvum
SSGTKKSDKTRR

SEQ ID NO: 2226334 - protein, 15 aa, Cryptosporidium parvum
SSGTSFQSTEFGSPL

SEQ ID NO: 2226335 - protein, 5 aa, Cryptosporidium parvum
SSGVK

SEQ ID NO: 2226336 - protein, 12 aa, Cryptosporidium parvum
SSHEKQSKNKGF

SEQ ID NO: 2226337 - protein, 5 aa, Cryptosporidium parvum
SSHES

SEQ ID NO: 2226338 - protein, 15 aa, Cryptosporidium parvum
SSHESSDSEKPEETN

SEQ ID NO: 2226339 - protein, 14 aa, Cryptosporidium parvum
SSHSETPDDERYLS

SEQ ID NO: 2226340 - protein, 8 aa, Cryptosporidium parvum
SSHSNNSL

SEQ ID NO: 2226341 - protein, 5 aa, Cryptosporidium parvum
SSIDD

SEQ ID NO: 2226342 - protein, 5 aa, Cryptosporidium parvum
SSIDE

SEQ ID NO: 2226343 - protein, 5 aa, Cryptosporidium parvum
SSIDH

SEQ ID NO: 2226344 - protein, 6 aa, Cryptosporidium parvum
SSIEER

SEQ ID NO: 2226345 - protein, 11 aa, Cryptosporidium parvum
SSIGGGQSNKK

SEQ ID NO: 2226346 - protein, 4 aa, Cryptosporidium parvum
SSII

SEQ ID NO: 2226347 - protein, 9 aa, Cryptosporidium parvum
SSIKQNSQS

SEQ ID NO: 2226348 - protein, 17 aa, Cryptosporidium parvum
SSIKTENKNIKGHDKYS

SEQ ID NO: 2226349 - protein, 14 aa, Cryptosporidium parvum
SSINNHDQVKQESN

SEQ ID NO: 2226350 - protein, 8 aa, Cryptosporidium parvum
SSINNQAT

SEQ ID NO: 2226351 - protein, 7 aa, Cryptosporidium parvum
SSIPEEL

SEQ ID NO: 2226352 - protein, 6 aa, Cryptosporidium parvum
SSIPNK

SEQ ID NO: 2226353 - protein, 10 aa, Cryptosporidium parvum
SSIQEDGQEV

SEQ ID NO: 2226354 - protein, 9 aa, Cryptosporidium parvum
SSIRKEDYS

SEQ ID NO: 2226355 - protein, 13 aa, Cryptosporidium parvum
SSISDKEAPEDSI

SEQ ID NO: 2226356 - protein, 13 aa, Cryptosporidium parvum
SSISNNSDESKDK

SEQ ID NO: 2226357 - protein, 5 aa, Cryptosporidium parvum
SSISS

SEQ ID NO: 2226358 - protein, 8 aa, Cryptosporidium parvum
SSISSKSA

SEQ ID NO: 2226359 - protein, 12 aa, Cryptosporidium parvum
SSITEEEDDFSS

SEQ ID NO: 2226360 - protein, 4 aa, Cryptosporidium parvum
SSKA

SEQ ID NO: 2226361 - protein, 8 aa, Cryptosporidium parvum
SSKAKEEL

SEQ ID NO: 2226362 - protein, 13 aa, Cryptosporidium parvum
SSKCNEKASLGGT

SEQ ID NO: 2226363 - protein, 7 aa, Cryptosporidium parvum
SSKDIAE

SEQ ID NO: 2226364 - protein, 9 aa, Cryptosporidium parvum
SSKDKNPQV

SEQ ID NO: 2226365 - protein, 9 aa, Cryptosporidium parvum
SSKDSYQVK

SEQ ID NO: 2226366 - protein, 5 aa, Cryptosporidium parvum
SSKFL

SEQ ID NO: 2226367 - protein, 6 aa, Cryptosporidium parvum
SSKGIL

SEQ ID NO: 2226368 - protein, 16 aa, Cryptosporidium parvum
SSKGKVSDSSGEVDLE

SEQ ID NO: 2226369 - protein, 7 aa, Cryptosporidium parvum
SSKHSSC

SEQ ID NO: 2226370 - protein, 5 aa, Cryptosporidium parvum
SSKID

SEQ ID NO: 2226371 - protein, 9 aa, Cryptosporidium parvum
SSKKATDLK

SEQ ID NO: 2226372 - protein, 12 aa, Cryptosporidium parvum
SSKKLKNKIESL

SEQ ID NO: 2226373 - protein, 4 aa, Cryptosporidium parvum
SSKL

SEQ ID NO: 2226374 - protein, 11 aa, Cryptosporidium parvum
SSKNKSTEYHS

SEQ ID NO: 2226375 - protein, 12 aa, Cryptosporidium parvum
SSKNNQPQVGSN

SEQ ID NO: 2226376 - protein, 16 aa, Cryptosporidium parvum
SSKNRSKEKPMNKGDS

SEQ ID NO: 2226377 - protein, 7 aa, Cryptosporidium parvum
SSKPENI

SEQ ID NO: 2226378 - protein, 13 aa, Cryptosporidium parvum
SSKQESGKIRDDS

SEQ ID NO: 2226379 - protein, 12 aa, Cryptosporidium parvum
SSKQLSGSTSNY

SEQ ID NO: 2226380 - protein, 41 aa, Cryptosporidium parvum
SSKQRKSSKTSGNVSSRSKKAGGAETETEKVSMSANKGSKK

SEQ ID NO: 2226381 - protein, 4 aa, Cryptosporidium parvum
SSKR

SEQ ID NO: 2226382 - protein, 4 aa, Cryptosporidium parvum
SSKS

SEQ ID NO: 2226383 - protein, 15 aa, Cryptosporidium parvum
SSKSCNFPGLSKRQR

SEQ ID NO: 2226384 - protein, 6 aa, Cryptosporidium parvum
SSKSKT

SEQ ID NO: 2226385 - protein, 7 aa, Cryptosporidium parvum
SSKSSDP

SEQ ID NO: 2226386 - protein, 6 aa, Cryptosporidium parvum
SSKSSK

SEQ ID NO: 2226387 - protein, 8 aa, Cryptosporidium parvum
SSKSYKKL

SEQ ID NO: 2226388 - protein, 10 aa, Cryptosporidium parvum
SSKTENSTSC

SEQ ID NO: 2226389 - protein, 23 aa, Cryptosporidium parvum
SSKTLKSSISTGGNDYKDDVEDA

SEQ ID NO: 2226390 - protein, 14 aa, Cryptosporidium parvum
SSKTRLSISSDESF

SEQ ID NO: 2226391 - protein, 8 aa, Cryptosporidium parvum
SSKTRQLA

SEQ ID NO: 2226392 - protein, 11 aa, Cryptosporidium parvum
SSKVSGAALPQ

SEQ ID NO: 2226393 - protein, 11 aa, Cryptosporidium parvum
SSKYDFKTGNI

SEQ ID NO: 2226394 - protein, 5 aa, Cryptosporidium parvum
SSKYS

SEQ ID NO: 2226395 - protein, 25 aa, Cryptosporidium parvum
SSLAKASKKNGSRQIPESTEVRDPG

SEQ ID NO: 2226396 - protein, 16 aa, Cryptosporidium parvum
SSLATDSDRDNEITNT

SEQ ID NO: 2226397 - protein, 9 aa, Cryptosporidium parvum
SSLDGESNL

SEQ ID NO: 2226398 - protein, 13 aa, Cryptosporidium parvum
SSLEKEALPSPNL

SEQ ID NO: 2226399 - protein, 5 aa, Cryptosporidium parvum
SSLES

SEQ ID NO: 2226400 - protein, 12 aa, Cryptosporidium parvum
SSLGNLGNPEKK

SEQ ID NO: 2226401 - protein, 17 aa, Cryptosporidium parvum
SSLGNTGSFKATGYKDN

SEQ ID NO: 2226402 - protein, 5 aa, Cryptosporidium parvum
SSLGS

SEQ ID NO: 2226403 - protein, 9 aa, Cryptosporidium parvum
SSLKEKDRK

SEQ ID NO: 2226404 - protein, 5 aa, Cryptosporidium parvum
SSLKY

SEQ ID NO: 2226405 - protein, 7 aa, Cryptosporidium parvum
SSLLNSQ

SEQ ID NO: 2226406 - protein, 7 aa, Cryptosporidium parvum
SSLNDRS

SEQ ID NO: 2226407 - protein, 8 aa, Cryptosporidium parvum
SSLNQSAG

SEQ ID NO: 2226408 - protein, 5 aa, Cryptosporidium parvum
SSLNT

SEQ ID NO: 2226409 - protein, 5 aa, Cryptosporidium parvum
SSLNY

SEQ ID NO: 2226410 - protein, 8 aa, Cryptosporidium parvum
SSLRNNSE

SEQ ID NO: 2226411 - protein, 36 aa, Cryptosporidium parvum
SSLRSSSPSILSNPISSKQSSSSNGSNNSYNTKNRQ

SEQ ID NO: 2226412 - protein, 6 aa, Cryptosporidium parvum
SSLSGS

SEQ ID NO: 2226413 - protein, 5 aa, Cryptosporidium parvum
SSLSN

SEQ ID NO: 2226414 - protein, 7 aa, Cryptosporidium parvum
SSLSPTY

SEQ ID NO: 2226415 - protein, 12 aa, Cryptosporidium parvum
SSLSSEQEMNQE

SEQ ID NO: 2226416 - protein, 6 aa, Cryptosporidium parvum
SSLSTR

SEQ ID NO: 2226417 - protein, 9 aa, Cryptosporidium parvum
SSLTGEATP

SEQ ID NO: 2226418 - protein, 7 aa, Cryptosporidium parvum
SSLVDSN

SEQ ID NO: 2226419 - protein, 5 aa, Cryptosporidium parvum
SSMRN

SEQ ID NO: 2226420 - protein, 4 aa, Cryptosporidium parvum
SSNC

SEQ ID NO: 2226421 - protein, 7 aa, Cryptosporidium parvum
SSNDSPL

SEQ ID NO: 2226422 - protein, 4 aa, Cryptosporidium parvum
SSNE

SEQ ID NO: 2226423 - protein, 8 aa, Cryptosporidium parvum
SSNEKKPR

SEQ ID NO: 2226424 - protein, 6 aa, Cryptosporidium parvum
SSNESF

SEQ ID NO: 2226425 - protein, 8 aa, Cryptosporidium parvum
SSNESKIY

SEQ ID NO: 2226426 - protein, 7 aa, Cryptosporidium parvum
SSNFKRD

SEQ ID NO: 2226427 - protein, 21 aa, Cryptosporidium parvum
SSNFNQSNQLQHNSHQTNVNQ

SEQ ID NO: 2226428 - protein, 8 aa, Cryptosporidium parvum
SSNGEVLK

SEQ ID NO: 2226429 - protein, 12 aa, Cryptosporidium parvum
SSNGFSANGGGV

SEQ ID NO: 2226430 - protein, 5 aa, Cryptosporidium parvum
SSNGI

SEQ ID NO: 2226431 - protein, 6 aa, Cryptosporidium parvum
SSNGLV

SEQ ID NO: 2226432 - protein, 16 aa, Cryptosporidium parvum
SSNHKQNDNDKRKSIE

SEQ ID NO: 2226433 - protein, 4 aa, Cryptosporidium parvum
SSNI

SEQ ID NO: 2226434 - protein, 20 aa, Cryptosporidium parvum
SSNIGRNSLTSSQVSSGQYT

SEQ ID NO: 2226435 - protein, 6 aa, Cryptosporidium parvum
SSNITG

SEQ ID NO: 2226436 - protein, 10 aa, Cryptosporidium parvum
SSNKDKNQSL

SEQ ID NO: 2226437 - protein, 20 aa, Cryptosporidium parvum
SSNKGIEASNTCYKESSENE

SEQ ID NO: 2226438 - protein, 5 aa, Cryptosporidium parvum
SSNKN

SEQ ID NO: 2226439 - protein, 10 aa, Cryptosporidium parvum
SSNKNIQEVS

SEQ ID NO: 2226440 - protein, 12 aa, Cryptosporidium parvum
SSNKSNKDNTED

SEQ ID NO: 2226441 - protein, 7 aa, Cryptosporidium parvum
SSNKYYH

SEQ ID NO: 2226442 - protein, 7 aa, Cryptosporidium parvum
SSNLDHN

SEQ ID NO: 2226443 - protein, 7 aa, Cryptosporidium parvum
SSNLDNK

SEQ ID NO: 2226444 - protein, 5 aa, Cryptosporidium parvum
SSNLN

SEQ ID NO: 2226445 - protein, 9 aa, Cryptosporidium parvum
SSNMSIPNV

SEQ ID NO: 2226446 - protein, 16 aa, Cryptosporidium parvum
SSNNELKETNHYKEKN

SEQ ID NO: 2226447 - protein, 8 aa, Cryptosporidium parvum
SSNNERRK

SEQ ID NO: 2226448 - protein, 5 aa, Cryptosporidium parvum
SSNNF

SEQ ID NO: 2226449 - protein, 20 aa, Cryptosporidium parvum
SSNNNSNKSNQISDNKCPPG

SEQ ID NO: 2226450 - protein, 8 aa, Cryptosporidium parvum
SSNNSSLS

SEQ ID NO: 2226451 - protein, 11 aa, Cryptosporidium parvum
SSNNYASNLPG

SEQ ID NO: 2226452 - protein, 5 aa, Cryptosporidium parvum
SSNPD

SEQ ID NO: 2226453 - protein, 7 aa, Cryptosporidium parvum
SSNQENY

SEQ ID NO: 2226454 - protein, 7 aa, Cryptosporidium parvum
SSNQLST

SEQ ID NO: 2226455 - protein, 19 aa, Cryptosporidium parvum
SSNQNNFLDSSNQHQYSNS

SEQ ID NO: 2226456 - protein, 12 aa, Cryptosporidium parvum
SSNQQYYSSSSL

SEQ ID NO: 2226457 - protein, 4 aa, Cryptosporidium parvum
SSNR

SEQ ID NO: 2226458 - protein, 12 aa, Cryptosporidium parvum
SSNRKEKTKLKT

SEQ ID NO: 2226459 - protein, 6 aa, Cryptosporidium parvum
SSNRNK

SEQ ID NO: 2226460 - protein, 7 aa, Cryptosporidium parvum
SSNSIKE

SEQ ID NO: 2226461 - protein, 6 aa, Cryptosporidium parvum
SSNSKK

SEQ ID NO: 2226462 - protein, 9 aa, Cryptosporidium parvum
SSNSLQNDA

SEQ ID NO: 2226463 - protein, 5 aa, Cryptosporidium parvum
SSNSM

SEQ ID NO: 2226464 - protein, 17 aa, Cryptosporidium parvum
SSNSNGNESEIADSQTH

SEQ ID NO: 2226465 - protein, 10 aa, Cryptosporidium parvum
SSNSPNNSAF

SEQ ID NO: 2226466 - protein, 5 aa, Cryptosporidium parvum
SSNST

SEQ ID NO: 2226467 - protein, 10 aa, Cryptosporidium parvum
SSNTSGCSHP

SEQ ID NO: 2226468 - protein, 6 aa, Cryptosporidium parvum
SSNVSQ

SEQ ID NO: 2226469 - protein, 11 aa, Cryptosporidium parvum
SSNVTTFGSRS

SEQ ID NO: 2226470 - protein, 6 aa, Cryptosporidium parvum
SSNYNY

SEQ ID NO: 2226471 - protein, 8 aa, Cryptosporidium parvum
SSPASGLS

SEQ ID NO: 2226472 - protein, 31 aa, Cryptosporidium parvum
SSPCDRTKQDRNSSSSNTNSHCASNSTLNPR

SEQ ID NO: 2226473 - protein, 6 aa, Cryptosporidium parvum
SSPCNA

SEQ ID NO: 2226474 - protein, 5 aa, Cryptosporidium parvum
SSPET

SEQ ID NO: 2226475 - protein, 5 aa, Cryptosporidium parvum
SSPHD

SEQ ID NO: 2226476 - protein, 9 aa, Cryptosporidium parvum
SSPISTSHN

SEQ ID NO: 2226477 - protein, 29 aa, Cryptosporidium parvum
SSPITFKPQQQQQQFQKQSSRNETGSSDP

SEQ ID NO: 2226478 - protein, 7 aa, Cryptosporidium parvum
SSPNQTY

SEQ ID NO: 2226479 - protein, 7 aa, Cryptosporidium parvum
SSPNSNV

SEQ ID NO: 2226480 - protein, 9 aa, Cryptosporidium parvum
SSPQSSNSF

SEQ ID NO: 2226481 - protein, 5 aa, Cryptosporidium parvum
SSPRN

SEQ ID NO: 2226482 - protein, 25 aa, Cryptosporidium parvum
SSPRNQSSMSSGKRSRNTEYNETLS

SEQ ID NO: 2226483 - protein, 6 aa, Cryptosporidium parvum
SSPRRM

SEQ ID NO: 2226484 - protein, 12 aa, Cryptosporidium parvum
SSPSANNLCVPI

SEQ ID NO: 2226485 - protein, 9 aa, Cryptosporidium parvum
SSPSDQSEL

SEQ ID NO: 2226486 - protein, 26 aa, Cryptosporidium parvum
SSPSDTLLEGQTSDMNTRLGSGPGAG

SEQ ID NO: 2226487 - protein, 26 aa, Cryptosporidium parvum
SSPSNNNGSAKYNETPNSKEFDSSTL

SEQ ID NO: 2226488 - protein, 20 aa, Cryptosporidium parvum
SSPSNWDHSGLSNDPSRNNN

SEQ ID NO: 2226489 - protein, 7 aa, Cryptosporidium parvum
SSPSPMD

SEQ ID NO: 2226490 - protein, 60 aa, Cryptosporidium parvum
SSPSSSCSSSCSSSSSSSSSSSSSSSSSSSFPPSTECTSSPVEKRINTNKSEKDCQNEKE

SEQ ID NO: 2226491 - protein, 27 aa, Cryptosporidium parvum
SSPSSSSSNFNNPTVSSTSFSGGRQSS

SEQ ID NO: 2226492 - protein, 5 aa, Cryptosporidium parvum
SSPTE

SEQ ID NO: 2226493 - protein, 5 aa, Cryptosporidium parvum
SSPTL

SEQ ID NO: 2226494 - protein, 6 aa, Cryptosporidium parvum
SSPTVK

SEQ ID NO: 2226495 - protein, 9 aa, Cryptosporidium parvum
SSQAREIQP

SEQ ID NO: 2226496 - protein, 6 aa, Cryptosporidium parvum
SSQDCS

SEQ ID NO: 2226497 - protein, 19 aa, Cryptosporidium parvum
SSQFGNNDTNNLNATSQTT

SEQ ID NO: 2226498 - protein, 17 aa, Cryptosporidium parvum
SSQIQYESDNKENSYNY

SEQ ID NO: 2226499 - protein, 11 aa, Cryptosporidium parvum
SSQKLSSRNKS

SEQ ID NO: 2226500 - protein, 8 aa, Cryptosporidium parvum
SSQKSNFT

SEQ ID NO: 2226501 - protein, 6 aa, Cryptosporidium parvum
SSQLYQ

SEQ ID NO: 2226502 - protein, 12 aa, Cryptosporidium parvum
SSQMRSGKIPSG

SEQ ID NO: 2226503 - protein, 7 aa, Cryptosporidium parvum
SSQNDNR

SEQ ID NO: 2226504 - protein, 9 aa, Cryptosporidium parvum
SSQNNNKYG

SEQ ID NO: 2226505 - protein, 7 aa, Cryptosporidium parvum
SSQNNNS

SEQ ID NO: 2226506 - protein, 18 aa, Cryptosporidium parvum
SSQSLDSSLSNKNEYSPE

SEQ ID NO: 2226507 - protein, 16 aa, Cryptosporidium parvum
SSQSSLKDVNSYSPNI

SEQ ID NO: 2226508 - protein, 29 aa, Cryptosporidium parvum
SSQSTSSSVFTSSTGYGTSNNYKSMSHGS

SEQ ID NO: 2226509 - protein, 6 aa, Cryptosporidium parvum
SSQTTA

SEQ ID NO: 2226510 - protein, 16 aa, Cryptosporidium parvum
SSQTTNSSAEVQVSQE

SEQ ID NO: 2226511 - protein, 5 aa, Cryptosporidium parvum
SSQVS

SEQ ID NO: 2226512 - protein, 10 aa, Cryptosporidium parvum
SSQYSNKYDQ

SEQ ID NO: 2226513 - protein, 12 aa, Cryptosporidium parvum
SSRANEDDLTND

SEQ ID NO: 2226514 - protein, 8 aa, Cryptosporidium parvum
SSRDYTKF

SEQ ID NO: 2226515 - protein, 6 aa, Cryptosporidium parvum
SSREAS

SEQ ID NO: 2226516 - protein, 5 aa, Cryptosporidium parvum
SSRED

SEQ ID NO: 2226517 - protein, 6 aa, Cryptosporidium parvum
SSRELE

SEQ ID NO: 2226518 - protein, 6 aa, Cryptosporidium parvum
SSRESD

SEQ ID NO: 2226519 - protein, 6 aa, Cryptosporidium parvum
SSREYR

SEQ ID NO: 2226520 - protein, 10 aa, Cryptosporidium parvum
SSRGRESSFE

SEQ ID NO: 2226521 - protein, 5 aa, Cryptosporidium parvum
SSRIT

SEQ ID NO: 2226522 - protein, 4 aa, Cryptosporidium parvum
SSRK

SEQ ID NO: 2226523 - protein, 19 aa, Cryptosporidium parvum
SSRKKLRNISSEAKSLQME

SEQ ID NO: 2226524 - protein, 41 aa, Cryptosporidium parvum
SSRLSSSNASGGLGQSSSSSRFTSTGPQGPYGTSGVGTPLG

SEQ ID NO: 2226525 - protein, 5 aa, Cryptosporidium parvum
SSRNI

SEQ ID NO: 2226526 - protein, 9 aa, Cryptosporidium parvum
SSRNSSKPP

SEQ ID NO: 2226527 - protein, 10 aa, Cryptosporidium parvum
SSRPEVTKNS

SEQ ID NO: 2226528 - protein, 4 aa, Cryptosporidium parvum
SSRQ

SEQ ID NO: 2226529 - protein, 4 aa, Cryptosporidium parvum
SSRR

SEQ ID NO: 2226530 - protein, 6 aa, Cryptosporidium parvum
SSRSGY

SEQ ID NO: 2226531 - protein, 5 aa, Cryptosporidium parvum
SSRSK

SEQ ID NO: 2226532 - protein, 8 aa, Cryptosporidium parvum
SSRSKEEK

SEQ ID NO: 2226533 - protein, 6 aa, Cryptosporidium parvum
SSRSTI

SEQ ID NO: 2226534 - protein, 11 aa, Cryptosporidium parvum
SSRVKSKQNDH

SEQ ID NO: 2226535 - protein, 5 aa, Cryptosporidium parvum
SSRVQ

SEQ ID NO: 2226536 - protein, 8 aa, Cryptosporidium parvum
SSRYESDN

SEQ ID NO: 2226537 - protein, 12 aa, Cryptosporidium parvum
SSSAEKISSNSL

SEQ ID NO: 2226538 - protein, 9 aa, Cryptosporidium parvum
SSSAESNID

SEQ ID NO: 2226539 - protein, 6 aa, Cryptosporidium parvum
SSSASI

SEQ ID NO: 2226540 - protein, 4 aa, Cryptosporidium parvum
SSSD

SEQ ID NO: 2226541 - protein, 6 aa, Cryptosporidium parvum
SSSDHK

SEQ ID NO: 2226542 - protein, 10 aa, Cryptosporidium parvum
SSSDLESSAV

SEQ ID NO: 2226543 - protein, 8 aa, Cryptosporidium parvum
SSSDLNHS

SEQ ID NO: 2226544 - protein, 9 aa, Cryptosporidium parvum
SSSDSATPI

SEQ ID NO: 2226545 - protein, 9 aa, Cryptosporidium parvum
SSSEDPEGL

SEQ ID NO: 2226546 - protein, 10 aa, Cryptosporidium parvum
SSSESNQELT

SEQ ID NO: 2226547 - protein, 14 aa, Cryptosporidium parvum
SSSGEKVKKDSLEK

SEQ ID NO: 2226548 - protein, 6 aa, Cryptosporidium parvum
SSSGFN

SEQ ID NO: 2226549 - protein, 10 aa, Cryptosporidium parvum
SSSGIKPIYN

SEQ ID NO: 2226550 - protein, 23 aa, Cryptosporidium parvum
SSSGSNIQLQSKDQRASNRASNK

SEQ ID NO: 2226551 - protein, 17 aa, Cryptosporidium parvum
SSSHTNPDSIQNEVANP

SEQ ID NO: 2226552 - protein, 49 aa, Cryptosporidium parvum
SSSIGQTGRNSSSNGTFAKDDTDPSSHNFDTSHRNSKQDLDTNLENSMG

SEQ ID NO: 2226553 - protein, 24 aa, Cryptosporidium parvum
SSSILGKKNRKNSDSKTDNYPDPL

SEQ ID NO: 2226554 - protein, 15 aa, Cryptosporidium parvum
SSSKCKEKRKCRKVS

SEQ ID NO: 2226555 - protein, 8 aa, Cryptosporidium parvum
SSSKGEDW

SEQ ID NO: 2226556 - protein, 12 aa, Cryptosporidium parvum
SSSKISNEKRVE

SEQ ID NO: 2226557 - protein, 6 aa, Cryptosporidium parvum
SSSKKK

SEQ ID NO: 2226558 - protein, 5 aa, Cryptosporidium parvum
SSSKP

SEQ ID NO: 2226559 - protein, 10 aa, Cryptosporidium parvum
SSSKTIEGGV

SEQ ID NO: 2226560 - protein, 5 aa, Cryptosporidium parvum
SSSLL

SEQ ID NO: 2226561 - protein, 9 aa, Cryptosporidium parvum
SSSLPKSAN

SEQ ID NO: 2226562 - protein, 10 aa, Cryptosporidium parvum
SSSLSSSQNF

SEQ ID NO: 2226563 - protein, 14 aa, Cryptosporidium parvum
SSSMSSSSSSINPY

SEQ ID NO: 2226564 - protein, 10 aa, Cryptosporidium parvum
SSSNASVTSY

SEQ ID NO: 2226565 - protein, 7 aa, Cryptosporidium parvum
SSSNECK

SEQ ID NO: 2226566 - protein, 6 aa, Cryptosporidium parvum
SSSNLE

SEQ ID NO: 2226567 - protein, 13 aa, Cryptosporidium parvum
SSSNNIQANEDDF

SEQ ID NO: 2226568 - protein, 9 aa, Cryptosporidium parvum
SSSNQGSHI

SEQ ID NO: 2226569 - protein, 9 aa, Cryptosporidium parvum
SSSNSLQME

SEQ ID NO: 2226570 - protein, 15 aa, Cryptosporidium parvum
SSSNSNNSDFNNDKQ

SEQ ID NO: 2226571 - protein, 11 aa, Cryptosporidium parvum
SSSNSPNSNTM

SEQ ID NO: 2226572 - protein, 7 aa, Cryptosporidium parvum
SSSNTIG

SEQ ID NO: 2226573 - protein, 8 aa, Cryptosporidium parvum
SSSNYPKS

SEQ ID NO: 2226574 - protein, 65 aa, Cryptosporidium parvum
SSSPIQSGTSFSSTTVSSSSATSSSYQPTTNKPNSIGKTANYAQALKSKESTAKPANENESKPKG

SEQ ID NO: 2226575 - protein, 6 aa, Cryptosporidium parvum
SSSPPI

SEQ ID NO: 2226576 - protein, 14 aa, Cryptosporidium parvum
SSSPWLKNSPRTDW

SEQ ID NO: 2226577 - protein, 8 aa, Cryptosporidium parvum
SSSQINGT

SEQ ID NO: 2226578 - protein, 8 aa, Cryptosporidium parvum
SSSQKNEW

SEQ ID NO: 2226579 - protein, 8 aa, Cryptosporidium parvum
SSSQPMDT

SEQ ID NO: 2226580 - protein, 18 aa, Cryptosporidium parvum
SSSQTLNKVTKSNENTEV

SEQ ID NO: 2226581 - protein, 6 aa, Cryptosporidium parvum
SSSRDH

SEQ ID NO: 2226582 - protein, 5 aa, Cryptosporidium parvum
SSSRG

SEQ ID NO: 2226583 - protein, 6 aa, Cryptosporidium parvum
SSSRRS

SEQ ID NO: 2226584 - protein, 9 aa, Cryptosporidium parvum
SSSRYKTTY

SEQ ID NO: 2226585 - protein, 4 aa, Cryptosporidium parvum
SSSS

SEQ ID NO: 2226586 - protein, 16 aa, Cryptosporidium parvum
SSSSDQSNSSLINRPQ

SEQ ID NO: 2226587 - protein, 15 aa, Cryptosporidium parvum
SSSSESNEASSKQQL

SEQ ID NO: 2226588 - protein, 11 aa, Cryptosporidium parvum
SSSSKNNKNAA

SEQ ID NO: 2226589 - protein, 8 aa, Cryptosporidium parvum
SSSSKSST

SEQ ID NO: 2226590 - protein, 7 aa, Cryptosporidium parvum
SSSSNLS

SEQ ID NO: 2226591 - protein, 20 aa, Cryptosporidium parvum
SSSSNSQSRSNSRGNNLDSK

SEQ ID NO: 2226592 - protein, 23 aa, Cryptosporidium parvum
SSSSPSSYNKRQEENNEDSEITG

SEQ ID NO: 2226593 - protein, 8 aa, Cryptosporidium parvum
SSSSQNDI

SEQ ID NO: 2226594 - protein, 7 aa, Cryptosporidium parvum
SSSSRKE

SEQ ID NO: 2226595 - protein, 10 aa, Cryptosporidium parvum
SSSSSSALSF

SEQ ID NO: 2226596 - protein, 7 aa, Cryptosporidium parvum
SSSSSSP

SEQ ID NO: 2226597 - protein, 10 aa, Cryptosporidium parvum
SSSSSSSPPL

SEQ ID NO: 2226598 - protein, 40 aa, Cryptosporidium parvum
SSSSSSSSSSSSSSSSSSSSSSSSSSSSSSSNQGDAMTQS

SEQ ID NO: 2226599 - protein, 6 aa, Cryptosporidium parvum
SSSTEL

SEQ ID NO: 2226600 - protein, 7 aa, Cryptosporidium parvum
SSSTGEE

SEQ ID NO: 2226601 - protein, 5 aa, Cryptosporidium parvum
SSSTN

SEQ ID NO: 2226602 - protein, 19 aa, Cryptosporidium parvum
SSSVEEDDELGEDEGNSLM

SEQ ID NO: 2226603 - protein, 5 aa, Cryptosporidium parvum
SSSYD

SEQ ID NO: 2226604 - protein, 21 aa, Cryptosporidium parvum
SSSYGSSSKSKSKASSFNGSL

SEQ ID NO: 2226605 - protein, 5 aa, Cryptosporidium parvum
SSSYL

SEQ ID NO: 2226606 - protein, 5 aa, Cryptosporidium parvum
SSSYN

SEQ ID NO: 2226607 - protein, 12 aa, Cryptosporidium parvum
SSTCEEGKITRT

SEQ ID NO: 2226608 - protein, 8 aa, Cryptosporidium parvum
SSTCRKPQ

SEQ ID NO: 2226609 - protein, 10 aa, Cryptosporidium parvum
SSTDEDSSVV

SEQ ID NO: 2226610 - protein, 10 aa, Cryptosporidium parvum
SSTDKSDKWD

SEQ ID NO: 2226611 - protein, 15 aa, Cryptosporidium parvum
SSTDNNFSENTSESE

SEQ ID NO: 2226612 - protein, 8 aa, Cryptosporidium parvum
SSTDNSYP

SEQ ID NO: 2226613 - protein, 97 aa, Cryptosporidium parvum
SSTERSNQESLSSNTDANRTTTSASTGATANNSANSSATVTGTEGRRSSNTNGANMNRSGSNTDSRLNNNSAQAQGNFRGGNGEGIRGDPMNSNPIG

SEQ ID NO: 2226614 - protein, 12 aa, Cryptosporidium parvum
SSTESSIKSTRM

SEQ ID NO: 2226615 - protein, 4 aa, Cryptosporidium parvum
SSTF

SEQ ID NO: 2226616 - protein, 5 aa, Cryptosporidium parvum
SSTGQ

SEQ ID NO: 2226617 - protein, 8 aa, Cryptosporidium parvum
SSTGTPFL

SEQ ID NO: 2226618 - protein, 4 aa, Cryptosporidium parvum
SSTH

SEQ ID NO: 2226619 - protein, 6 aa, Cryptosporidium parvum
SSTITS

SEQ ID NO: 2226620 - protein, 13 aa, Cryptosporidium parvum
SSTKKLGDENNNS

SEQ ID NO: 2226621 - protein, 6 aa, Cryptosporidium parvum
SSTKTQ

SEQ ID NO: 2226622 - protein, 6 aa, Cryptosporidium parvum
SSTKYS

SEQ ID NO: 2226623 - protein, 17 aa, Cryptosporidium parvum
SSTNDQNSKDDPSKRVN

SEQ ID NO: 2226624 - protein, 7 aa, Cryptosporidium parvum
SSTNGIP

SEQ ID NO: 2226625 - protein, 10 aa, Cryptosporidium parvum
SSTNHSGRSI

SEQ ID NO: 2226626 - protein, 5 aa, Cryptosporidium parvum
SSTNL

SEQ ID NO: 2226627 - protein, 6 aa, Cryptosporidium parvum
SSTNLN

SEQ ID NO: 2226628 - protein, 7 aa, Cryptosporidium parvum
SSTNRRV

SEQ ID NO: 2226629 - protein, 7 aa, Cryptosporidium parvum
SSTNTRL

SEQ ID NO: 2226630 - protein, 7 aa, Cryptosporidium parvum
SSTPESY

SEQ ID NO: 2226631 - protein, 5 aa, Cryptosporidium parvum
SSTPQ

SEQ ID NO: 2226632 - protein, 87 aa, Cryptosporidium parvum
SSTPQTRDPSNLSSDPFDEPLDGPYQNSNNKNDNKEDEEEEEEEEEEEEEDHNRNENRQKGKKTDSNKKQRNGNNKKKKRRGGKDDL

SEQ ID NO: 2226633 - protein, 9 aa, Cryptosporidium parvum
SSTPTSSNF

SEQ ID NO: 2226634 - protein, 9 aa, Cryptosporidium parvum
SSTQDPQLS

SEQ ID NO: 2226635 - protein, 5 aa, Cryptosporidium parvum
SSTQH

SEQ ID NO: 2226636 - protein, 7 aa, Cryptosporidium parvum
SSTRGNK

SEQ ID NO: 2226637 - protein, 7 aa, Cryptosporidium parvum
SSTSFSP

SEQ ID NO: 2226638 - protein, 11 aa, Cryptosporidium parvum
SSTSNSDSNLE

SEQ ID NO: 2226639 - protein, 7 aa, Cryptosporidium parvum
SSTSSSR

SEQ ID NO: 2226640 - protein, 5 aa, Cryptosporidium parvum
SSTTK

SEQ ID NO: 2226641 - protein, 32 aa, Cryptosporidium parvum
SSVGPDSDSGSKPPAGSASASNLASTSNSGSG

SEQ ID NO: 2226642 - protein, 14 aa, Cryptosporidium parvum
SSVLADTGQFTNNK

SEQ ID NO: 2226643 - protein, 9 aa, Cryptosporidium parvum
SSVLSSDGN

SEQ ID NO: 2226644 - protein, 60 aa, Cryptosporidium parvum
SSVNGQEQDQDQDQDQDQDQDQDQDQNQNQNQNQNQNQDQNHNQDQNQVRAQNPGNNLEE

SEQ ID NO: 2226645 - protein, 21 aa, Cryptosporidium parvum
SSVNQDGKSATLTAPSKNSQV

SEQ ID NO: 2226646 - protein, 10 aa, Cryptosporidium parvum
SSVPSSSSEV

SEQ ID NO: 2226647 - protein, 9 aa, Cryptosporidium parvum
SSVQRSTLY

SEQ ID NO: 2226648 - protein, 7 aa, Cryptosporidium parvum
SSVSKNL

SEQ ID NO: 2226649 - protein, 17 aa, Cryptosporidium parvum
SSVTDNSKSLNNNNHNH

SEQ ID NO: 2226650 - protein, 11 aa, Cryptosporidium parvum
SSYASSSPLQK

SEQ ID NO: 2226651 - protein, 7 aa, Cryptosporidium parvum
SSYEGPD

SEQ ID NO: 2226652 - protein, 16 aa, Cryptosporidium parvum
SSYKEDQNIRSSYSNK

SEQ ID NO: 2226653 - protein, 7 aa, Cryptosporidium parvum
SSYLNTK

SEQ ID NO: 2226654 - protein, 26 aa, Cryptosporidium parvum
SSYNESPSIKGQNSSNFEENQTFSTN

SEQ ID NO: 2226655 - protein, 5 aa, Cryptosporidium parvum
SSYSG

SEQ ID NO: 2226656 - protein, 6 aa, Cryptosporidium parvum
SSYSNI

SEQ ID NO: 2226657 - protein, 6 aa, Cryptosporidium parvum
SSYSPS

SEQ ID NO: 2226658 - protein, 8 aa, Cryptosporidium parvum
SSYYSDSI

SEQ ID NO: 2226659 - protein, 13 aa, Cryptosporidium parvum
STAGSIESNEEEI

SEQ ID NO: 2226660 - protein, 7 aa, Cryptosporidium parvum
STASHVG

SEQ ID NO: 2226661 - protein, 61 aa, Cryptosporidium parvum
STASKKKLKKQKATGTDTTNDNKDSNSSSSPLSTSKQVVEEEKSSNETGNNLKDGADTEMN

SEQ ID NO: 2226662 - protein, 38 aa, Cryptosporidium parvum
STASSDEGFGSGISEEDNTSESESENDSDSNDSTDYDI

SEQ ID NO: 2226663 - protein, 9 aa, Cryptosporidium parvum
STATNTNAS

SEQ ID NO: 2226664 - protein, 9 aa, Cryptosporidium parvum
STATSNGAL

SEQ ID NO: 2226665 - protein, 8 aa, Cryptosporidium parvum
STCGPGNK

SEQ ID NO: 2226666 - protein, 7 aa, Cryptosporidium parvum
STCSGHG

SEQ ID NO: 2226667 - protein, 10 aa, Cryptosporidium parvum
STDDNNRNAS

SEQ ID NO: 2226668 - protein, 16 aa, Cryptosporidium parvum
STDKEVNSAQPSPRKS

SEQ ID NO: 2226669 - protein, 9 aa, Cryptosporidium parvum
STDKRGDVG

SEQ ID NO: 2226670 - protein, 13 aa, Cryptosporidium parvum
STDLKDNNHFRGN

SEQ ID NO: 2226671 - protein, 6 aa, Cryptosporidium parvum
STDNSD

SEQ ID NO: 2226672 - protein, 9 aa, Cryptosporidium parvum
STDNSNSNL

SEQ ID NO: 2226673 - protein, 17 aa, Cryptosporidium parvum
STDPKNLSAMKPTWMPW

SEQ ID NO: 2226674 - protein, 6 aa, Cryptosporidium parvum
STDQNG

SEQ ID NO: 2226675 - protein, 36 aa, Cryptosporidium parvum
STDSCNNSLKQQKTIKSLSDDRKSRKIGRKKNKGYG

SEQ ID NO: 2226676 - protein, 6 aa, Cryptosporidium parvum
STEEDE

SEQ ID NO: 2226677 - protein, 15 aa, Cryptosporidium parvum
STEFNSKSNDIIGNS

SEQ ID NO: 2226678 - protein, 8 aa, Cryptosporidium parvum
STEFQSNN

SEQ ID NO: 2226679 - protein, 16 aa, Cryptosporidium parvum
STEGPNSSVLKTPDSF

SEQ ID NO: 2226680 - protein, 13 aa, Cryptosporidium parvum
STEKFNDKSAKLG

SEQ ID NO: 2226681 - protein, 8 aa, Cryptosporidium parvum
STENMDNS

SEQ ID NO: 2226682 - protein, 9 aa, Cryptosporidium parvum
STETESKPR

SEQ ID NO: 2226683 - protein, 6 aa, Cryptosporidium parvum
STETLE

SEQ ID NO: 2226684 - protein, 22 aa, Cryptosporidium parvum
STETSTENSIKTVNNKKRSIAI

SEQ ID NO: 2226685 - protein, 19 aa, Cryptosporidium parvum
STETSYSTQTKNLKVPSNV

SEQ ID NO: 2226686 - protein, 12 aa, Cryptosporidium parvum
STFKNKDLAKEN

SEQ ID NO: 2226687 - protein, 5 aa, Cryptosporidium parvum
STFQN

SEQ ID NO: 2226688 - protein, 5 aa, Cryptosporidium parvum
STFSS

SEQ ID NO: 2226689 - protein, 6 aa, Cryptosporidium parvum
STGDIT

SEQ ID NO: 2226690 - protein, 4 aa, Cryptosporidium parvum
STGE

SEQ ID NO: 2226691 - protein, 5 aa, Cryptosporidium parvum
STGEF

SEQ ID NO: 2226692 - protein, 4 aa, Cryptosporidium parvum
STGI

SEQ ID NO: 2226693 - protein, 8 aa, Cryptosporidium parvum
STGIPEND

SEQ ID NO: 2226694 - protein, 8 aa, Cryptosporidium parvum
STGIRNNS

SEQ ID NO: 2226695 - protein, 9 aa, Cryptosporidium parvum
STGNPKDTG

SEQ ID NO: 2226696 - protein, 13 aa, Cryptosporidium parvum
STGSNITSSSNSI

SEQ ID NO: 2226697 - protein, 11 aa, Cryptosporidium parvum
STGTGDNRNLG

SEQ ID NO: 2226698 - protein, 6 aa, Cryptosporidium parvum
STHSQK

SEQ ID NO: 2226699 - protein, 4 aa, Cryptosporidium parvum
STIE

SEQ ID NO: 2226700 - protein, 14 aa, Cryptosporidium parvum
STIENSINATSQEE

SEQ ID NO: 2226701 - protein, 4 aa, Cryptosporidium parvum
STIS

SEQ ID NO: 2226702 - protein, 48 aa, Cryptosporidium parvum
STITTSSMSQGEQLDQESSALSRSLGSLPSKSKYSETGTPSATSSKKS

SEQ ID NO: 2226703 - protein, 34 aa, Cryptosporidium parvum
STKFYSKDNYSNEDISGEMHASSNDRPEARAYKS

SEQ ID NO: 2226704 - protein, 13 aa, Cryptosporidium parvum
STKISAENTQSIT

SEQ ID NO: 2226705 - protein, 12 aa, Cryptosporidium parvum
STKKKKFNKENI

SEQ ID NO: 2226706 - protein, 8 aa, Cryptosporidium parvum
STKNETNN

SEQ ID NO: 2226707 - protein, 8 aa, Cryptosporidium parvum
STKNSDSI

SEQ ID NO: 2226708 - protein, 13 aa, Cryptosporidium parvum
STKNTGKQISGGI

SEQ ID NO: 2226709 - protein, 6 aa, Cryptosporidium parvum
STKRIS

SEQ ID NO: 2226710 - protein, 8 aa, Cryptosporidium parvum
STKSLSTY

SEQ ID NO: 2226711 - protein, 13 aa, Cryptosporidium parvum
STKSNSAFAQNKK

SEQ ID NO: 2226712 - protein, 9 aa, Cryptosporidium parvum
STKSRAMNK

SEQ ID NO: 2226713 - protein, 4 aa, Cryptosporidium parvum
STKT

SEQ ID NO: 2226714 - protein, 4 aa, Cryptosporidium parvum
STKW

SEQ ID NO: 2226715 - protein, 10 aa, Cryptosporidium parvum
STLDSKPSLN

SEQ ID NO: 2226716 - protein, 11 aa, Cryptosporidium parvum
STLENDERHSS

SEQ ID NO: 2226717 - protein, 5 aa, Cryptosporidium parvum
STLER

SEQ ID NO: 2226718 - protein, 8 aa, Cryptosporidium parvum
STLPISTK

SEQ ID NO: 2226719 - protein, 8 aa, Cryptosporidium parvum
STLPKSKK

SEQ ID NO: 2226720 - protein, 9 aa, Cryptosporidium parvum
STLRKGTIT

SEQ ID NO: 2226721 - protein, 12 aa, Cryptosporidium parvum
STLSNNSGSSVE

SEQ ID NO: 2226722 - protein, 12 aa, Cryptosporidium parvum
STMNESQKKQLQ

SEQ ID NO: 2226723 - protein, 5 aa, Cryptosporidium parvum
STNDL

SEQ ID NO: 2226724 - protein, 9 aa, Cryptosporidium parvum
STNEADSGY

SEQ ID NO: 2226725 - protein, 9 aa, Cryptosporidium parvum
STNEKDSYK

SEQ ID NO: 2226726 - protein, 5 aa, Cryptosporidium parvum
STNES

SEQ ID NO: 2226727 - protein, 4 aa, Cryptosporidium parvum
STNG

SEQ ID NO: 2226728 - protein, 8 aa, Cryptosporidium parvum
STNGTYPI

SEQ ID NO: 2226729 - protein, 5 aa, Cryptosporidium parvum
STNHS

SEQ ID NO: 2226730 - protein, 4 aa, Cryptosporidium parvum
STNI

SEQ ID NO: 2226731 - protein, 5 aa, Cryptosporidium parvum
STNID

SEQ ID NO: 2226732 - protein, 6 aa, Cryptosporidium parvum
STNIET

SEQ ID NO: 2226733 - protein, 6 aa, Cryptosporidium parvum
STNITR

SEQ ID NO: 2226734 - protein, 5 aa, Cryptosporidium parvum
STNKK

SEQ ID NO: 2226735 - protein, 13 aa, Cryptosporidium parvum
STNLGADYDDDGN

SEQ ID NO: 2226736 - protein, 7 aa, Cryptosporidium parvum
STNNGNV

SEQ ID NO: 2226737 - protein, 7 aa, Cryptosporidium parvum
STNNSIN

SEQ ID NO: 2226738 - protein, 6 aa, Cryptosporidium parvum
STNREA

SEQ ID NO: 2226739 - protein, 26 aa, Cryptosporidium parvum
STNSANIKTSGKNKAFIGRDKEKAKR

SEQ ID NO: 2226740 - protein, 8 aa, Cryptosporidium parvum
STNSTSSI

SEQ ID NO: 2226741 - protein, 10 aa, Cryptosporidium parvum
STNSTTDSEI

SEQ ID NO: 2226742 - protein, 6 aa, Cryptosporidium parvum
STNYKG

SEQ ID NO: 2226743 - protein, 7 aa, Cryptosporidium parvum
STPDGRR

SEQ ID NO: 2226744 - protein, 16 aa, Cryptosporidium parvum
STPFPQNGSSRIQTGN

SEQ ID NO: 2226745 - protein, 5 aa, Cryptosporidium parvum
STPIN

SEQ ID NO: 2226746 - protein, 9 aa, Cryptosporidium parvum
STPISGDSL

SEQ ID NO: 2226747 - protein, 5 aa, Cryptosporidium parvum
STPIY

SEQ ID NO: 2226748 - protein, 6 aa, Cryptosporidium parvum
STPKIS

SEQ ID NO: 2226749 - protein, 4 aa, Cryptosporidium parvum
STPL

SEQ ID NO: 2226750 - protein, 5 aa, Cryptosporidium parvum
STPNK

SEQ ID NO: 2226751 - protein, 14 aa, Cryptosporidium parvum
STPQLKYKPGKTDI

SEQ ID NO: 2226752 - protein, 4 aa, Cryptosporidium parvum
STPR

SEQ ID NO: 2226753 - protein, 14 aa, Cryptosporidium parvum
STPRTKAGSKDAGF

SEQ ID NO: 2226754 - protein, 12 aa, Cryptosporidium parvum
STPSPNCGDEGN

SEQ ID NO: 2226755 - protein, 7 aa, Cryptosporidium parvum
STPSPVW

SEQ ID NO: 2226756 - protein, 5 aa, Cryptosporidium parvum
STPTE

SEQ ID NO: 2226757 - protein, 6 aa, Cryptosporidium parvum
STQADL

SEQ ID NO: 2226758 - protein, 10 aa, Cryptosporidium parvum
STQDESNSQY

SEQ ID NO: 2226759 - protein, 8 aa, Cryptosporidium parvum
STQENQNL

SEQ ID NO: 2226760 - protein, 12 aa, Cryptosporidium parvum
STQETAKRGNSL

SEQ ID NO: 2226761 - protein, 7 aa, Cryptosporidium parvum
STQGRVP

SEQ ID NO: 2226762 - protein, 34 aa, Cryptosporidium parvum
  misc_feature (19)..(19): Xaa can be any naturally occurring amino acid
STQIQSGEIYGENLQVVNXTENNTENQENENPNS

SEQ ID NO: 2226763 - protein, 5 aa, Cryptosporidium parvum
STQLT

SEQ ID NO: 2226764 - protein, 16 aa, Cryptosporidium parvum
STQTRNTLTDSSRKYG

SEQ ID NO: 2226765 - protein, 9 aa, Cryptosporidium parvum
STREAISKN

SEQ ID NO: 2226766 - protein, 5 aa, Cryptosporidium parvum
STRHK

SEQ ID NO: 2226767 - protein, 4 aa, Cryptosporidium parvum
STRL

SEQ ID NO: 2226768 - protein, 9 aa, Cryptosporidium parvum
STRNGLTKQ

SEQ ID NO: 2226769 - protein, 27 aa, Cryptosporidium parvum
STRRSEIENQDNMQEGEYDEGEEEDED

SEQ ID NO: 2226770 - protein, 6 aa, Cryptosporidium parvum
STRSKE

SEQ ID NO: 2226771 - protein, 9 aa, Cryptosporidium parvum
STSADPDYY

SEQ ID NO: 2226772 - protein, 13 aa, Cryptosporidium parvum
STSCGEGNRIRTR

SEQ ID NO: 2226773 - protein, 7 aa, Cryptosporidium parvum
STSCRGG

SEQ ID NO: 2226774 - protein, 8 aa, Cryptosporidium parvum
STSDSSRG

SEQ ID NO: 2226775 - protein, 6 aa, Cryptosporidium parvum
STSDVS

SEQ ID NO: 2226776 - protein, 5 aa, Cryptosporidium parvum
STSEA

SEQ ID NO: 2226777 - protein, 4 aa, Cryptosporidium parvum
STSG

SEQ ID NO: 2226778 - protein, 4 aa, Cryptosporidium parvum
STSI

SEQ ID NO: 2226779 - protein, 7 aa, Cryptosporidium parvum
STSINSK

SEQ ID NO: 2226780 - protein, 16 aa, Cryptosporidium parvum
STSKNLDSSNLTTTGS

SEQ ID NO: 2226781 - protein, 8 aa, Cryptosporidium parvum
STSNIPQS

SEQ ID NO: 2226782 - protein, 6 aa, Cryptosporidium parvum
STSPYS

SEQ ID NO: 2226783 - protein, 8 aa, Cryptosporidium parvum
STSRLAGY

SEQ ID NO: 2226784 - protein, 5 aa, Cryptosporidium parvum
STSRN

SEQ ID NO: 2226785 - protein, 5 aa, Cryptosporidium parvum
STSRS

SEQ ID NO: 2226786 - protein, 9 aa, Cryptosporidium parvum
STSSGTHCQ

SEQ ID NO: 2226787 - protein, 5 aa, Cryptosporidium parvum
STSSS

SEQ ID NO: 2226788 - protein, 23 aa, Cryptosporidium parvum
STSVQNEDERKESRFSQEFPPET

SEQ ID NO: 2226789 - protein, 5 aa, Cryptosporidium parvum
STTCG

SEQ ID NO: 2226790 - protein, 10 aa, Cryptosporidium parvum
STTGFTTDTS

SEQ ID NO: 2226791 - protein, 5 aa, Cryptosporidium parvum
STTHP

SEQ ID NO: 2226792 - protein, 9 aa, Cryptosporidium parvum
STTNIVNEN

SEQ ID NO: 2226793 - protein, 6 aa, Cryptosporidium parvum
STTRFT

SEQ ID NO: 2226794 - protein, 14 aa, Cryptosporidium parvum
STTTPSDKDENDNQ

SEQ ID NO: 2226795 - protein, 4 aa, Cryptosporidium parvum
STVE

SEQ ID NO: 2226796 - protein, 6 aa, Cryptosporidium parvum
STVECT

SEQ ID NO: 2226797 - protein, 10 aa, Cryptosporidium parvum
STVKESEKTK

SEQ ID NO: 2226798 - protein, 14 aa, Cryptosporidium parvum
STVKQENNQIYPPT

SEQ ID NO: 2226799 - protein, 4 aa, Cryptosporidium parvum
STVY

SEQ ID NO: 2226800 - protein, 6 aa, Cryptosporidium parvum
STWRSS

SEQ ID NO: 2226801 - protein, 6 aa, Cryptosporidium parvum
STYDQA

SEQ ID NO: 2226802 - protein, 5 aa, Cryptosporidium parvum
STYFQ

SEQ ID NO: 2226803 - protein, 19 aa, Cryptosporidium parvum
STYNGQPKSKGAALLSDPS

SEQ ID NO: 2226804 - protein, 9 aa, Cryptosporidium parvum
STYRNSNDC

SEQ ID NO: 2226805 - protein, 26 aa, Cryptosporidium parvum
STYSSSSSMLPSSGDISKNTSMSNIK

SEQ ID NO: 2226806 - protein, 11 aa, Cryptosporidium parvum
SVASNDKSYPS

SEQ ID NO: 2226807 - protein, 7 aa, Cryptosporidium parvum
SVDNPDK

SEQ ID NO: 2226808 - protein, 39 aa, Cryptosporidium parvum
SVDNSTNSASIGGGIGRVGGGIGNIRGGGISSTGGMTVN

SEQ ID NO: 2226809 - protein, 9 aa, Cryptosporidium parvum
SVENGISQS

SEQ ID NO: 2226810 - protein, 7 aa, Cryptosporidium parvum
SVENRKN

SEQ ID NO: 2226811 - protein, 5 aa, Cryptosporidium parvum
SVESS

SEQ ID NO: 2226812 - protein, 10 aa, Cryptosporidium parvum
SVFDGNSQSS

SEQ ID NO: 2226813 - protein, 7 aa, Cryptosporidium parvum
SVGDDVP

SEQ ID NO: 2226814 - protein, 8 aa, Cryptosporidium parvum
SVGGAKGV

SEQ ID NO: 2226815 - protein, 28 aa, Cryptosporidium parvum
SVGKGDSSAGLATDKKKNYTKDEGVTTI

SEQ ID NO: 2226816 - protein, 10 aa, Cryptosporidium parvum
SVGKTQPIHS

SEQ ID NO: 2226817 - protein, 7 aa, Cryptosporidium parvum
SVGNAKL

SEQ ID NO: 2226818 - protein, 23 aa, Cryptosporidium parvum
SVGRGASQVRNIPAQNSNPSISS

SEQ ID NO: 2226819 - protein, 7 aa, Cryptosporidium parvum
SVHGNKE

SEQ ID NO: 2226820 - protein, 12 aa, Cryptosporidium parvum
SVHSQKSSTGES

SEQ ID NO: 2226821 - protein, 8 aa, Cryptosporidium parvum
SVKNESST

SEQ ID NO: 2226822 - protein, 24 aa, Cryptosporidium parvum
SVKNKINSKVGSRNTNSSGNSSYR

SEQ ID NO: 2226823 - protein, 6 aa, Cryptosporidium parvum
SVKNQQ

SEQ ID NO: 2226824 - protein, 9 aa, Cryptosporidium parvum
SVKPSSLKK

SEQ ID NO: 2226825 - protein, 12 aa, Cryptosporidium parvum
SVNEKDEKTLNN

SEQ ID NO: 2226826 - protein, 7 aa, Cryptosporidium parvum
SVNKSRK

SEQ ID NO: 2226827 - protein, 19 aa, Cryptosporidium parvum
SVNLSEGQKIDTADSLNNN

SEQ ID NO: 2226828 - protein, 12 aa, Cryptosporidium parvum
SVNNTFSSNYNS

SEQ ID NO: 2226829 - protein, 11 aa, Cryptosporidium parvum
SVNSKNQSNYF

SEQ ID NO: 2226830 - protein, 12 aa, Cryptosporidium parvum
SVNTKKKGWKQY

SEQ ID NO: 2226831 - protein, 82 aa, Cryptosporidium parvum
SVPGPDEREEEKREEKKEGEEKEEEENEEKEEKEEKEEKEEKEEKEEKEEKEEKEENEENETKEENKDKDIEQSEFKGKDKR

SEQ ID NO: 2226832 - protein, 8 aa, Cryptosporidium parvum
SVPHSSTL

SEQ ID NO: 2226833 - protein, 110 aa, Cryptosporidium parvum
SVPKEGGNTQSQTSSAPSMPSSQQSPPKQSSSQPAPPPQQSSSQQSSSQQSSSQQSPPKQSPPQQSPSQPAPPPRNSSSQPSSSTPSSKPSQTQMDSQKSNSQKISPQKI

SEQ ID NO: 2226834 - protein, 9 aa, Cryptosporidium parvum
SVPKSQPKT

SEQ ID NO: 2226835 - protein, 16 aa, Cryptosporidium parvum
SVPSESQYYQQENSNV

SEQ ID NO: 2226836 - protein, 8 aa, Cryptosporidium parvum
SVQTDRKD

SEQ ID NO: 2226837 - protein, 9 aa, Cryptosporidium parvum
SVRPENKNL

SEQ ID NO: 2226838 - protein, 13 aa, Cryptosporidium parvum
SVRSNSEKKEPSK

SEQ ID NO: 2226839 - protein, 8 aa, Cryptosporidium parvum
SVSENNDL

SEQ ID NO: 2226840 - protein, 7 aa, Cryptosporidium parvum
SVSENSL

SEQ ID NO: 2226841 - protein, 10 aa, Cryptosporidium parvum
SVSGGGQCTQ

SEQ ID NO: 2226842 - protein, 7 aa, Cryptosporidium parvum
SVSKETY

SEQ ID NO: 2226843 - protein, 11 aa, Cryptosporidium parvum
SVSPEGKPQGL

SEQ ID NO: 2226844 - protein, 22 aa, Cryptosporidium parvum
SVSPITNNSSNVNSRTQEPSTV

SEQ ID NO: 2226845 - protein, 9 aa, Cryptosporidium parvum
SVSQSNLSQ

SEQ ID NO: 2226846 - protein, 6 aa, Cryptosporidium parvum
SVSRDD

SEQ ID NO: 2226847 - protein, 6 aa, Cryptosporidium parvum
SVSRNS

SEQ ID NO: 2226848 - protein, 6 aa, Cryptosporidium parvum
SVSSGE

SEQ ID NO: 2226849 - protein, 5 aa, Cryptosporidium parvum
SVSTE

SEQ ID NO: 2226850 - protein, 16 aa, Cryptosporidium parvum
SVSTLKNDKNVESSYP

SEQ ID NO: 2226851 - protein, 5 aa, Cryptosporidium parvum
SVTKF

SEQ ID NO: 2226852 - protein, 9 aa, Cryptosporidium parvum
SVTNGKNRC

SEQ ID NO: 2226853 - protein, 18 aa, Cryptosporidium parvum
SVTSQPDSSSNFSSPNTA

SEQ ID NO: 2226854 - protein, 5 aa, Cryptosporidium parvum
SVVSS

SEQ ID NO: 2226855 - protein, 7 aa, Cryptosporidium parvum
SWGSEPR

SEQ ID NO: 2226856 - protein, 10 aa, Cryptosporidium parvum
SWKESDVGKS

SEQ ID NO: 2226857 - protein, 5 aa, Cryptosporidium parvum
SWPTS

SEQ ID NO: 2226858 - protein, 4 aa, Cryptosporidium parvum
SWQD

SEQ ID NO: 2226859 - protein, 13 aa, Cryptosporidium parvum
SWQSNESSRFSKG

SEQ ID NO: 2226860 - protein, 6 aa, Cryptosporidium parvum
SWTPDE

SEQ ID NO: 2226861 - protein, 11 aa, Cryptosporidium parvum
SYARSRAEAVE

SEQ ID NO: 2226862 - protein, 19 aa, Cryptosporidium parvum
SYDDHSSYSNLSKYPDQLE

SEQ ID NO: 2226863 - protein, 4 aa, Cryptosporidium parvum
SYDP

SEQ ID NO: 2226864 - protein, 14 aa, Cryptosporidium parvum
SYDQESPSQSNKQE

SEQ ID NO: 2226865 - protein, 8 aa, Cryptosporidium parvum
SYDSNKNA

SEQ ID NO: 2226866 - protein, 11 aa, Cryptosporidium parvum
SYEHNNGKTLK

SEQ ID NO: 2226867 - protein, 11 aa, Cryptosporidium parvum
SYENDPDSDVR

SEQ ID NO: 2226868 - protein, 6 aa, Cryptosporidium parvum
SYEQTR

SEQ ID NO: 2226869 - protein, 10 aa, Cryptosporidium parvum
SYETDSYKNK

SEQ ID NO: 2226870 - protein, 11 aa, Cryptosporidium parvum
SYGGESSSRDL

SEQ ID NO: 2226871 - protein, 7 aa, Cryptosporidium parvum
SYGGIKS

SEQ ID NO: 2226872 - protein, 4 aa, Cryptosporidium parvum
SYGM

SEQ ID NO: 2226873 - protein, 4 aa, Cryptosporidium parvum
SYGN

SEQ ID NO: 2226874 - protein, 7 aa, Cryptosporidium parvum
SYGSKNL

SEQ ID NO: 2226875 - protein, 6 aa, Cryptosporidium parvum
SYGTNL

SEQ ID NO: 2226876 - protein, 6 aa, Cryptosporidium parvum
SYGTSM

SEQ ID NO: 2226877 - protein, 9 aa, Cryptosporidium parvum
SYIPEKENG

SEQ ID NO: 2226878 - protein, 5 aa, Cryptosporidium parvum
SYKNS

SEQ ID NO: 2226879 - protein, 11 aa, Cryptosporidium parvum
SYKRSAGQGDV

SEQ ID NO: 2226880 - protein, 6 aa, Cryptosporidium parvum
SYKVRK

SEQ ID NO: 2226881 - protein, 4 aa, Cryptosporidium parvum
SYLE

SEQ ID NO: 2226882 - protein, 13 aa, Cryptosporidium parvum
SYMDSSPKCTNSQ

SEQ ID NO: 2226883 - protein, 7 aa, Cryptosporidium parvum
SYNDGTE

SEQ ID NO: 2226884 - protein, 5 aa, Cryptosporidium parvum
SYNDS

SEQ ID NO: 2226885 - protein, 5 aa, Cryptosporidium parvum
SYNSK

SEQ ID NO: 2226886 - protein, 5 aa, Cryptosporidium parvum
SYPGT

SEQ ID NO: 2226887 - protein, 6 aa, Cryptosporidium parvum
SYPKNN

SEQ ID NO: 2226888 - protein, 10 aa, Cryptosporidium parvum
SYPSGEPSNS

SEQ ID NO: 2226889 - protein, 8 aa, Cryptosporidium parvum
SYPSPYIS

SEQ ID NO: 2226890 - protein, 5 aa, Cryptosporidium parvum
SYPSV

SEQ ID NO: 2226891 - protein, 8 aa, Cryptosporidium parvum
SYQQSERK

SEQ ID NO: 2226892 - protein, 9 aa, Cryptosporidium parvum
SYRKDTPYQ

SEQ ID NO: 2226893 - protein, 13 aa, Cryptosporidium parvum
SYRRDENKVYNPK

SEQ ID NO: 2226894 - protein, 81 aa, Cryptosporidium parvum
SYSDGSSSSKNKNSKSSESSSSSDGSSSSDESSSSDEDSDSSDSSGDSDDSNSSGESSSSSDENSSDSSGSSGSEAESENV

SEQ ID NO: 2226895 - protein, 18 aa, Cryptosporidium parvum
SYSFESDKQEESEENSEI

SEQ ID NO: 2226896 - protein, 6 aa, Cryptosporidium parvum
SYSGLR

SEQ ID NO: 2226897 - protein, 5 aa, Cryptosporidium parvum
SYSSA

SEQ ID NO: 2226898 - protein, 16 aa, Cryptosporidium parvum
SYSSKEVSRANSIGTP

SEQ ID NO: 2226899 - protein, 9 aa, Cryptosporidium parvum
SYSSSTTNK

SEQ ID NO: 2226900 - protein, 8 aa, Cryptosporidium parvum
SYSSVSSR

SEQ ID NO: 2226901 - protein, 4 aa, Cryptosporidium parvum
SYTE

SEQ ID NO: 2226902 - protein, 5 aa, Cryptosporidium parvum
SYTNN

SEQ ID NO: 2226903 - protein, 6 aa, Cryptosporidium parvum
SYTTNL

SEQ ID NO: 2226904 - protein, 4 aa, Cryptosporidium parvum
SYYG

SEQ ID NO: 2226905 - protein, 12 aa, Cryptosporidium parvum
TAAPHGNPDDHP

SEQ ID NO: 2226906 - protein, 5 aa, Cryptosporidium parvum
TAAPN

SEQ ID NO: 2226907 - protein, 10 aa, Cryptosporidium parvum
TAASYSPEAA

SEQ ID NO: 2226908 - protein, 20 aa, Cryptosporidium parvum
TADENNTQENYSTSKKSYNN

SEQ ID NO: 2226909 - protein, 9 aa, Cryptosporidium parvum
TADSGNKEK

SEQ ID NO: 2226910 - protein, 6 aa, Cryptosporidium parvum
TAENDQ

SEQ ID NO: 2226911 - protein, 7 aa, Cryptosporidium parvum
TAFDDAT

SEQ ID NO: 2226912 - protein, 12 aa, Cryptosporidium parvum
TAFDQNTDISGV

SEQ ID NO: 2226913 - protein, 4 aa, Cryptosporidium parvum
TAFQ

SEQ ID NO: 2226914 - protein, 9 aa, Cryptosporidium parvum
TAKDYTEKA

SEQ ID NO: 2226915 - protein, 8 aa, Cryptosporidium parvum
TAKSSSEN

SEQ ID NO: 2226916 - protein, 8 aa, Cryptosporidium parvum
TAKTSVSF

SEQ ID NO: 2226917 - protein, 6 aa, Cryptosporidium parvum
TALGGG

SEQ ID NO: 2226918 - protein, 33 aa, Cryptosporidium parvum
TALKKDANSPESMDKAGLEAKPDSSSPSSSFSY

SEQ ID NO: 2226919 - protein, 7 aa, Cryptosporidium parvum
TANASIR

SEQ ID NO: 2226920 - protein, 5 aa, Cryptosporidium parvum
TANFG

SEQ ID NO: 2226921 - protein, 11 aa, Cryptosporidium parvum
TANGSSRIRND

SEQ ID NO: 2226922 - protein, 9 aa, Cryptosporidium parvum
TANNSKANS

SEQ ID NO: 2226923 - protein, 18 aa, Cryptosporidium parvum
TANSDVSEQNNPNSMPSA

SEQ ID NO: 2226924 - protein, 5 aa, Cryptosporidium parvum
TANTV

SEQ ID NO: 2226925 - protein, 16 aa, Cryptosporidium parvum
TANYDSSDSGSLSSYD

SEQ ID NO: 2226926 - protein, 17 aa, Cryptosporidium parvum
  misc_feature (16)..(16): Xaa can be any naturally occurring amino acid
TAQKYNPKIFNLLYPXI

SEQ ID NO: 2226927 - protein, 7 aa, Cryptosporidium parvum
TASITEG

SEQ ID NO: 2226928 - protein, 17 aa, Cryptosporidium parvum
TASPASELEKMSNQESS

SEQ ID NO: 2226929 - protein, 9 aa, Cryptosporidium parvum
TASSLKGGD

SEQ ID NO: 2226930 - protein, 9 aa, Cryptosporidium parvum
TASSQERAP

SEQ ID NO: 2226931 - protein, 23 aa, Cryptosporidium parvum
TAVNQDGRTASLTAPSSKSQSDV

SEQ ID NO: 2226932 - protein, 11 aa, Cryptosporidium parvum
TAYTDTSNEGV

SEQ ID NO: 2226933 - protein, 13 aa, Cryptosporidium parvum
TCAQTNRGLPSLS

SEQ ID NO: 2226934 - protein, 12 aa, Cryptosporidium parvum
TCERGELSSANQ

SEQ ID NO: 2226935 - protein, 11 aa, Cryptosporidium parvum
TCGPGGRVTRT

SEQ ID NO: 2226936 - protein, 7 aa, Cryptosporidium parvum
TCNGGTT

SEQ ID NO: 2226937 - protein, 28 aa, Cryptosporidium parvum
TCQSSKDTRSCSKPEGCTETAPDSGDAT

SEQ ID NO: 2226938 - protein, 8 aa, Cryptosporidium parvum
TCSDGLPR

SEQ ID NO: 2226939 - protein, 21 aa, Cryptosporidium parvum
TDADTKNSKQDNFHEKDSFND

SEQ ID NO: 2226940 - protein, 9 aa, Cryptosporidium parvum
TDAEDEDVF

SEQ ID NO: 2226941 - protein, 44 aa, Cryptosporidium parvum
TDDDEEQDQGTASGKRHKKHKKRKENKPQSEAASSREKKESKRA

SEQ ID NO: 2226942 - protein, 8 aa, Cryptosporidium parvum
TDDELYND

SEQ ID NO: 2226943 - protein, 14 aa, Cryptosporidium parvum
TDDRENTSSPDSTR

SEQ ID NO: 2226944 - protein, 5 aa, Cryptosporidium parvum
TDDRF

SEQ ID NO: 2226945 - protein, 11 aa, Cryptosporidium parvum
TDDSDQTTSEI

SEQ ID NO: 2226946 - protein, 11 aa, Cryptosporidium parvum
TDEAAKKSLEH

SEQ ID NO: 2226947 - protein, 6 aa, Cryptosporidium parvum
TDEDSN

SEQ ID NO: 2226948 - protein, 8 aa, Cryptosporidium parvum
TDENSNMG

SEQ ID NO: 2226949 - protein, 9 aa, Cryptosporidium parvum
TDESQDDDM

SEQ ID NO: 2226950 - protein, 6 aa, Cryptosporidium parvum
TDESSG

SEQ ID NO: 2226951 - protein, 13 aa, Cryptosporidium parvum
TDESTELSHSNEN

SEQ ID NO: 2226952 - protein, 4 aa, Cryptosporidium parvum
TDEV

SEQ ID NO: 2226953 - protein, 21 aa, Cryptosporidium parvum
TDFGVDESSQDFQQKKSESIA

SEQ ID NO: 2226954 - protein, 17 aa, Cryptosporidium parvum
TDFQRDNSHNINSNYPS

SEQ ID NO: 2226955 - protein, 13 aa, Cryptosporidium parvum
TDFRKGNKERSES

SEQ ID NO: 2226956 - protein, 6 aa, Cryptosporidium parvum
TDGNVS

SEQ ID NO: 2226957 - protein, 10 aa, Cryptosporidium parvum
TDGVGKSSKI

SEQ ID NO: 2226958 - protein, 6 aa, Cryptosporidium parvum
TDGVQG

SEQ ID NO: 2226959 - protein, 7 aa, Cryptosporidium parvum
TDHGNRS

SEQ ID NO: 2226960 - protein, 9 aa, Cryptosporidium parvum
TDHGQEKLE

SEQ ID NO: 2226961 - protein, 5 aa, Cryptosporidium parvum
TDHYS

SEQ ID NO: 2226962 - protein, 11 aa, Cryptosporidium parvum
TDIGKNGSKEF

SEQ ID NO: 2226963 - protein, 12 aa, Cryptosporidium parvum
TDISDYDDRKTS

SEQ ID NO: 2226964 - protein, 8 aa, Cryptosporidium parvum
TDITTYSQ

SEQ ID NO: 2226965 - protein, 6 aa, Cryptosporidium parvum
TDKESN

SEQ ID NO: 2226966 - protein, 4 aa, Cryptosporidium parvum
TDKF

SEQ ID NO: 2226967 - protein, 4 aa, Cryptosporidium parvum
TDKK

SEQ ID NO: 2226968 - protein, 4 aa, Cryptosporidium parvum
TDKL

SEQ ID NO: 2226969 - protein, 8 aa, Cryptosporidium parvum
TDKLPNEV

SEQ ID NO: 2226970 - protein, 23 aa, Cryptosporidium parvum
TDKNHMSKSISAKQSCNSLNPNT

SEQ ID NO: 2226971 - protein, 10 aa, Cryptosporidium parvum
TDLKKKTRRS

SEQ ID NO: 2226972 - protein, 5 aa, Cryptosporidium parvum
TDNCR

SEQ ID NO: 2226973 - protein, 6 aa, Cryptosporidium parvum
TDNDGS

SEQ ID NO: 2226974 - protein, 21 aa, Cryptosporidium parvum
TDNDIDTDTENVGNGNSDISP

SEQ ID NO: 2226975 - protein, 7 aa, Cryptosporidium parvum
TDNGITP

SEQ ID NO: 2226976 - protein, 13 aa, Cryptosporidium parvum
TDNISSKSDLDQP

SEQ ID NO: 2226977 - protein, 9 aa, Cryptosporidium parvum
TDNNNSSKI

SEQ ID NO: 2226978 - protein, 8 aa, Cryptosporidium parvum
TDPGIDPS

SEQ ID NO: 2226979 - protein, 9 aa, Cryptosporidium parvum
TDPNTEDSQ

SEQ ID NO: 2226980 - protein, 4 aa, Cryptosporidium parvum
TDQA

SEQ ID NO: 2226981 - protein, 7 aa, Cryptosporidium parvum
TDQEKVN

SEQ ID NO: 2226982 - protein, 8 aa, Cryptosporidium parvum
TDQMDKQQ

SEQ ID NO: 2226983 - protein, 6 aa, Cryptosporidium parvum
TDRKDL

SEQ ID NO: 2226984 - protein, 6 aa, Cryptosporidium parvum
TDRSVR

SEQ ID NO: 2226985 - protein, 7 aa, Cryptosporidium parvum
TDRTNGI

SEQ ID NO: 2226986 - protein, 10 aa, Cryptosporidium parvum
TDRTNTSEDN

SEQ ID NO: 2226987 - protein, 7 aa, Cryptosporidium parvum
TDSGSSV

SEQ ID NO: 2226988 - protein, 4 aa, Cryptosporidium parvum
TDSL

SEQ ID NO: 2226989 - protein, 14 aa, Cryptosporidium parvum
TDSNLSSEANPSNK

SEQ ID NO: 2226990 - protein, 7 aa, Cryptosporidium parvum
TDSQGRP

SEQ ID NO: 2226991 - protein, 8 aa, Cryptosporidium parvum
TDSSLTPE

SEQ ID NO: 2226992 - protein, 9 aa, Cryptosporidium parvum
TDSSNPAPW

SEQ ID NO: 2226993 - protein, 9 aa, Cryptosporidium parvum
TDTFSTKDY

SEQ ID NO: 2226994 - protein, 6 aa, Cryptosporidium parvum
TDTHWD

SEQ ID NO: 2226995 - protein, 11 aa, Cryptosporidium parvum
TDTSNVLSRRD

SEQ ID NO: 2226996 - protein, 6 aa, Cryptosporidium parvum
TDVDGT

SEQ ID NO: 2226997 - protein, 8 aa, Cryptosporidium parvum
TDVGNNNK

SEQ ID NO: 2226998 - protein, 6 aa, Cryptosporidium parvum
TDVSSI

SEQ ID NO: 2226999 - protein, 9 aa, Cryptosporidium parvum
TDYDENGER

SEQ ID NO: 2227000 - protein, 9 aa, Cryptosporidium parvum
TDYDKKNNI

SEQ ID NO: 2227001 - protein, 6 aa, Cryptosporidium parvum
TEAHNC

SEQ ID NO: 2227002 - protein, 6 aa, Cryptosporidium parvum
TECDQE

SEQ ID NO: 2227003 - protein, 19 aa, Cryptosporidium parvum
TEDINQPDISEKNNSTYVS

SEQ ID NO: 2227004 - protein, 4 aa, Cryptosporidium parvum
TEDQ

SEQ ID NO: 2227005 - protein, 11 aa, Cryptosporidium parvum
TEDSARKIKPE

SEQ ID NO: 2227006 - protein, 6 aa, Cryptosporidium parvum
TEDSPW

SEQ ID NO: 2227007 - protein, 4 aa, Cryptosporidium parvum
TEEF

SEQ ID NO: 2227008 - protein, 4 aa, Cryptosporidium parvum
TEEH

SEQ ID NO: 2227009 - protein, 14 aa, Cryptosporidium parvum
TEEIEEVEDTDEVT

SEQ ID NO: 2227010 - protein, 7 aa, Cryptosporidium parvum
TEEIPKL

SEQ ID NO: 2227011 - protein, 11 aa, Cryptosporidium parvum
TEEKHYDNNEV

SEQ ID NO: 2227012 - protein, 10 aa, Cryptosporidium parvum
TEEKQGSFNQ

SEQ ID NO: 2227013 - protein, 11 aa, Cryptosporidium parvum
TEEKSKGNPIK

SEQ ID NO: 2227014 - protein, 5 aa, Cryptosporidium parvum
TEENI

SEQ ID NO: 2227015 - protein, 10 aa, Cryptosporidium parvum
TEENSDLQEG

SEQ ID NO: 2227016 - protein, 23 aa, Cryptosporidium parvum
TEEQKQKQKVAYGGVNSKQTSRL

SEQ ID NO: 2227017 - protein, 10 aa, Cryptosporidium parvum
TEERNEPTQI

SEQ ID NO: 2227018 - protein, 5 aa, Cryptosporidium parvum
TEETI

SEQ ID NO: 2227019 - protein, 6 aa, Cryptosporidium parvum
TEFNNN

SEQ ID NO: 2227020 - protein, 7 aa, Cryptosporidium parvum
TEGTEVS

SEQ ID NO: 2227021 - protein, 6 aa, Cryptosporidium parvum
TEIHNR

SEQ ID NO: 2227022 - protein, 4 aa, Cryptosporidium parvum
TEIN

SEQ ID NO: 2227023 - protein, 11 aa, Cryptosporidium parvum
TEINQNDKISR

SEQ ID NO: 2227024 - protein, 6 aa, Cryptosporidium parvum
TEINSG

SEQ ID NO: 2227025 - protein, 6 aa, Cryptosporidium parvum
TEIQRK

SEQ ID NO: 2227026 - protein, 5 aa, Cryptosporidium parvum
TEIRN

SEQ ID NO: 2227027 - protein, 7 aa, Cryptosporidium parvum
TEKETSL

SEQ ID NO: 2227028 - protein, 8 aa, Cryptosporidium parvum
TEKKDESV

SEQ ID NO: 2227029 - protein, 11 aa, Cryptosporidium parvum
TEKKELSLRGP

SEQ ID NO: 2227030 - protein, 12 aa, Cryptosporidium parvum
TEKKLPVNYFQY

SEQ ID NO: 2227031 - protein, 8 aa, Cryptosporidium parvum
TEKPSTQL

SEQ ID NO: 2227032 - protein, 5 aa, Cryptosporidium parvum
TEKSK

SEQ ID NO: 2227033 - protein, 9 aa, Cryptosporidium parvum
TELDSTENV

SEQ ID NO: 2227034 - protein, 9 aa, Cryptosporidium parvum
TELGPNESG

SEQ ID NO: 2227035 - protein, 4 aa, Cryptosporidium parvum
TELS

SEQ ID NO: 2227036 - protein, 4 aa, Cryptosporidium parvum
TENE

SEQ ID NO: 2227037 - protein, 8 aa, Cryptosporidium parvum
TENEANSL

SEQ ID NO: 2227038 - protein, 14 aa, Cryptosporidium parvum
TENENDNNNNNNKK

SEQ ID NO: 2227039 - protein, 8 aa, Cryptosporidium parvum
TENKDDLR

SEQ ID NO: 2227040 - protein, 9 aa, Cryptosporidium parvum
TENNEDQED

SEQ ID NO: 2227041 - protein, 4 aa, Cryptosporidium parvum
TENQ

SEQ ID NO: 2227042 - protein, 11 aa, Cryptosporidium parvum
TENQKSDKVPI

SEQ ID NO: 2227043 - protein, 9 aa, Cryptosporidium parvum
TENQSLSPF

SEQ ID NO: 2227044 - protein, 6 aa, Cryptosporidium parvum
TENRSV

SEQ ID NO: 2227045 - protein, 5 aa, Cryptosporidium parvum
TENRT

SEQ ID NO: 2227046 - protein, 5 aa, Cryptosporidium parvum
TENSF

SEQ ID NO: 2227047 - protein, 11 aa, Cryptosporidium parvum
TENSPTDEINS

SEQ ID NO: 2227048 - protein, 8 aa, Cryptosporidium parvum
TENTGNFP

SEQ ID NO: 2227049 - protein, 10 aa, Cryptosporidium parvum
TENVNKEVGS

SEQ ID NO: 2227050 - protein, 17 aa, Cryptosporidium parvum
TEPHHSEQVKKDGPEKK

SEQ ID NO: 2227051 - protein, 5 aa, Cryptosporidium parvum
TEPSV

SEQ ID NO: 2227052 - protein, 4 aa, Cryptosporidium parvum
TEQD

SEQ ID NO: 2227053 - protein, 4 aa, Cryptosporidium parvum
TEQR

SEQ ID NO: 2227054 - protein, 7 aa, Cryptosporidium parvum
TERDANK

SEQ ID NO: 2227055 - protein, 5 aa, Cryptosporidium parvum
TERDN

SEQ ID NO: 2227056 - protein, 8 aa, Cryptosporidium parvum
TERQYSDS

SEQ ID NO: 2227057 - protein, 7 aa, Cryptosporidium parvum
TERTSNN

SEQ ID NO: 2227058 - protein, 18 aa, Cryptosporidium parvum
TERVGSLGENGETSSEIK

SEQ ID NO: 2227059 - protein, 27 aa, Cryptosporidium parvum
TESETEDEDVETLKTEHKTKIGKVDQP

SEQ ID NO: 2227060 - protein, 24 aa, Cryptosporidium parvum
TESGAKSGDEIATKPKFSIPSSES

SEQ ID NO: 2227061 - protein, 21 aa, Cryptosporidium parvum
TESGSTDISEKRDINSQGDGF

SEQ ID NO: 2227062 - protein, 5 aa, Cryptosporidium parvum
TESIY

SEQ ID NO: 2227063 - protein, 6 aa, Cryptosporidium parvum
TESSYE

SEQ ID NO: 2227064 - protein, 5 aa, Cryptosporidium parvum
TESVQ

SEQ ID NO: 2227065 - protein, 7 aa, Cryptosporidium parvum
TESYEGV

SEQ ID NO: 2227066 - protein, 6 aa, Cryptosporidium parvum
TETALE

SEQ ID NO: 2227067 - protein, 4 aa, Cryptosporidium parvum
TETE

SEQ ID NO: 2227068 - protein, 11 aa, Cryptosporidium parvum
TETKHKSGLTK

SEQ ID NO: 2227069 - protein, 14 aa, Cryptosporidium parvum
TETSKGASKPSDSI

SEQ ID NO: 2227070 - protein, 16 aa, Cryptosporidium parvum
TETSSQQLSSVASESL

SEQ ID NO: 2227071 - protein, 4 aa, Cryptosporidium parvum
TETV

SEQ ID NO: 2227072 - protein, 4 aa, Cryptosporidium parvum
TETY

SEQ ID NO: 2227073 - protein, 23 aa, Cryptosporidium parvum
TEVGAGSEDGDYNINNNSNEFYS

SEQ ID NO: 2227074 - protein, 5 aa, Cryptosporidium parvum
TEYIE

SEQ ID NO: 2227075 - protein, 12 aa, Cryptosporidium parvum
TEYNENNSTTGG

SEQ ID NO: 2227076 - protein, 5 aa, Cryptosporidium parvum
TEYQK

SEQ ID NO: 2227077 - protein, 9 aa, Cryptosporidium parvum
TEYRTKSSE

SEQ ID NO: 2227078 - protein, 4 aa, Cryptosporidium parvum
TEYS

SEQ ID NO: 2227079 - protein, 4 aa, Cryptosporidium parvum
TFAG

SEQ ID NO: 2227080 - protein, 6 aa, Cryptosporidium parvum
TFGEAS

SEQ ID NO: 2227081 - protein, 8 aa, Cryptosporidium parvum
TFGPPGKQ

SEQ ID NO: 2227082 - protein, 10 aa, Cryptosporidium parvum
TFHNDNSTAA

SEQ ID NO: 2227083 - protein, 9 aa, Cryptosporidium parvum
TFPSNQGRL

SEQ ID NO: 2227084 - protein, 6 aa, Cryptosporidium parvum
TFSPST

SEQ ID NO: 2227085 - protein, 11 aa, Cryptosporidium parvum
TFTNKNNIYDN

SEQ ID NO: 2227086 - protein, 5 aa, Cryptosporidium parvum
TFTNT

SEQ ID NO: 2227087 - protein, 6 aa, Cryptosporidium parvum
TFTREK

SEQ ID NO: 2227088 - protein, 26 aa, Cryptosporidium parvum
TFTSKSNSNSRKNQVSDAKTKTHQVC

SEQ ID NO: 2227089 - protein, 6 aa, Cryptosporidium parvum
TGADTK

SEQ ID NO: 2227090 - protein, 8 aa, Cryptosporidium parvum
TGANRNHG

SEQ ID NO: 2227091 - protein, 7 aa, Cryptosporidium parvum
TGAPPRS

SEQ ID NO: 2227092 - protein, 6 aa, Cryptosporidium parvum
TGCGKS

SEQ ID NO: 2227093 - protein, 6 aa, Cryptosporidium parvum
TGCGKT

SEQ ID NO: 2227094 - protein, 5 aa, Cryptosporidium parvum
TGDES

SEQ ID NO: 2227095 - protein, 13 aa, Cryptosporidium parvum
TGDGVNDAPALKQ

SEQ ID NO: 2227096 - protein, 4 aa, Cryptosporidium parvum
TGDI

SEQ ID NO: 2227097 - protein, 9 aa, Cryptosporidium parvum
TGDLEETEK

SEQ ID NO: 2227098 - protein, 14 aa, Cryptosporidium parvum
TGDPTLSSGEIENA

SEQ ID NO: 2227099 - protein, 5 aa, Cryptosporidium parvum
TGDSE

SEQ ID NO: 2227100 - protein, 12 aa, Cryptosporidium parvum
TGEATPQCKTGG

SEQ ID NO: 2227101 - protein, 7 aa, Cryptosporidium parvum
TGEFDNA

SEQ ID NO: 2227102 - protein, 18 aa, Cryptosporidium parvum
TGEMPNGVEKEVNSRPFE

SEQ ID NO: 2227103 - protein, 6 aa, Cryptosporidium parvum
TGENNP

SEQ ID NO: 2227104 - protein, 5 aa, Cryptosporidium parvum
TGESA

SEQ ID NO: 2227105 - protein, 8 aa, Cryptosporidium parvum
TGESEDVS

SEQ ID NO: 2227106 - protein, 6 aa, Cryptosporidium parvum
TGESNP

SEQ ID NO: 2227107 - protein, 6 aa, Cryptosporidium parvum
TGESQD

SEQ ID NO: 2227108 - protein, 4 aa, Cryptosporidium parvum
TGET

SEQ ID NO: 2227109 - protein, 63 aa, Cryptosporidium parvum
TGFSGSGPRSDSASAGSGSNSSPPPPPPPPPPPSSSSSPSPPPPPPPPPPPPPPPPPPPPPPP

SEQ ID NO: 2227110 - protein, 11 aa, Cryptosporidium parvum
TGGGPTSSQSL

SEQ ID NO: 2227111 - protein, 10 aa, Cryptosporidium parvum
TGGITPEESA

SEQ ID NO: 2227112 - protein, 15 aa, Cryptosporidium parvum
TGGKQNSDLRKGKRY

SEQ ID NO: 2227113 - protein, 6 aa, Cryptosporidium parvum
TGGMDE

SEQ ID NO: 2227114 - protein, 21 aa, Cryptosporidium parvum
TGGNNNEENNSVSDQDNQSIE

SEQ ID NO: 2227115 - protein, 12 aa, Cryptosporidium parvum
TGIATKQGPSIP

SEQ ID NO: 2227116 - protein, 24 aa, Cryptosporidium parvum
TGIDEKSGVPNGDRIPKNYKSWPE

SEQ ID NO: 2227117 - protein, 4 aa, Cryptosporidium parvum
TGIN

SEQ ID NO: 2227118 - protein, 11 aa, Cryptosporidium parvum
TGKANEGQPVN

SEQ ID NO: 2227119 - protein, 9 aa, Cryptosporidium parvum
TGKKEGTIH

SEQ ID NO: 2227120 - protein, 25 aa, Cryptosporidium parvum
TGKKFSPYTGKHADASTTSSAYSAP

SEQ ID NO: 2227121 - protein, 4 aa, Cryptosporidium parvum
TGKS

SEQ ID NO: 2227122 - protein, 20 aa, Cryptosporidium parvum
TGKSSESKTPNNSGLVAENT

SEQ ID NO: 2227123 - protein, 10 aa, Cryptosporidium parvum
TGKYPSTGYL

SEQ ID NO: 2227124 - protein, 7 aa, Cryptosporidium parvum
TGLAESE

SEQ ID NO: 2227125 - protein, 9 aa, Cryptosporidium parvum
TGLNGGGVV

SEQ ID NO: 2227126 - protein, 6 aa, Cryptosporidium parvum
TGLNSE

SEQ ID NO: 2227127 - protein, 10 aa, Cryptosporidium parvum
TGLPKDPVSD

SEQ ID NO: 2227128 - protein, 8 aa, Cryptosporidium parvum
TGLRKPKE

SEQ ID NO: 2227129 - protein, 24 aa, Cryptosporidium parvum
TGMDEDEQDEEDKQDEQEESVEYE

SEQ ID NO: 2227130 - protein, 10 aa, Cryptosporidium parvum
TGNKDLDTIN

SEQ ID NO: 2227131 - protein, 14 aa, Cryptosporidium parvum
TGNKGDLKNYTHKN

SEQ ID NO: 2227132 - protein, 12 aa, Cryptosporidium parvum
TGNNEGVVISSS

SEQ ID NO: 2227133 - protein, 12 aa, Cryptosporidium parvum
TGNNGKQELDGS

SEQ ID NO: 2227134 - protein, 8 aa, Cryptosporidium parvum
TGNPQNFS

SEQ ID NO: 2227135 - protein, 7 aa, Cryptosporidium parvum
TGNPSNI

SEQ ID NO: 2227136 - protein, 13 aa, Cryptosporidium parvum
TGNSKQKSSSNYT

SEQ ID NO: 2227137 - protein, 8 aa, Cryptosporidium parvum
TGNTGILN

SEQ ID NO: 2227138 - protein, 4 aa, Cryptosporidium parvum
TGNY

SEQ ID NO: 2227139 - protein, 19 aa, Cryptosporidium parvum
TGNYMSSSVSKSLRGISGR

SEQ ID NO: 2227140 - protein, 19 aa, Cryptosporidium parvum
TGPANSAENSKTQMKQVSS

SEQ ID NO: 2227141 - protein, 6 aa, Cryptosporidium parvum
TGPEKN

SEQ ID NO: 2227142 - protein, 5 aa, Cryptosporidium parvum
TGPQI

SEQ ID NO: 2227143 - protein, 8 aa, Cryptosporidium parvum
TGQGEVPD

SEQ ID NO: 2227144 - protein, 14 aa, Cryptosporidium parvum
TGQLPRGVTKSKAR

SEQ ID NO: 2227145 - protein, 5 aa, Cryptosporidium parvum
TGQPC

SEQ ID NO: 2227146 - protein, 6 aa, Cryptosporidium parvum
TGRGLS

SEQ ID NO: 2227147 - protein, 4 aa, Cryptosporidium parvum
TGRI

SEQ ID NO: 2227148 - protein, 7 aa, Cryptosporidium parvum
TGRNHGN

SEQ ID NO: 2227149 - protein, 10 aa, Cryptosporidium parvum
TGSDTSSYTI

SEQ ID NO: 2227150 - protein, 4 aa, Cryptosporidium parvum
TGSI

SEQ ID NO: 2227151 - protein, 7 aa, Cryptosporidium parvum
TGSKAQV

SEQ ID NO: 2227152 - protein, 8 aa, Cryptosporidium parvum
TGSNTVNN

SEQ ID NO: 2227153 - protein, 5 aa, Cryptosporidium parvum
TGSSS

SEQ ID NO: 2227154 - protein, 9 aa, Cryptosporidium parvum
TGSSSNYGR

SEQ ID NO: 2227155 - protein, 5 aa, Cryptosporidium parvum
TGSTE

SEQ ID NO: 2227156 - protein, 15 aa, Cryptosporidium parvum
TGTKLPDRIKPGTKL

SEQ ID NO: 2227157 - protein, 6 aa, Cryptosporidium parvum
TGTLTN

SEQ ID NO: 2227158 - protein, 11 aa, Cryptosporidium parvum
TGTLTNGRPTV

SEQ ID NO: 2227159 - protein, 6 aa, Cryptosporidium parvum
TGTLTS

SEQ ID NO: 2227160 - protein, 6 aa, Cryptosporidium parvum
TGTLTT

SEQ ID NO: 2227161 - protein, 8 aa, Cryptosporidium parvum
TGTLTTDG

SEQ ID NO: 2227162 - protein, 4 aa, Cryptosporidium parvum
TGTM

SEQ ID NO: 2227163 - protein, 4 aa, Cryptosporidium parvum
TGTN

SEQ ID NO: 2227164 - protein, 6 aa, Cryptosporidium parvum
TGTNIK

SEQ ID NO: 2227165 - protein, 8 aa, Cryptosporidium parvum
TGTNPTHY

SEQ ID NO: 2227166 - protein, 13 aa, Cryptosporidium parvum
TGTRQDQNQGCSD

SEQ ID NO: 2227167 - protein, 6 aa, Cryptosporidium parvum
TGTTDK

SEQ ID NO: 2227168 - protein, 19 aa, Cryptosporidium parvum
TGTTPTSSGTCTSPSTLNN

SEQ ID NO: 2227169 - protein, 7 aa, Cryptosporidium parvum
TGVNEKE

SEQ ID NO: 2227170 - protein, 5 aa, Cryptosporidium parvum
TGYHI

SEQ ID NO: 2227171 - protein, 10 aa, Cryptosporidium parvum
TGYTIPSTKE

SEQ ID NO: 2227172 - protein, 9 aa, Cryptosporidium parvum
THDEDDQVR

SEQ ID NO: 2227173 - protein, 5 aa, Cryptosporidium parvum
THDQV

SEQ ID NO: 2227174 - protein, 8 aa, Cryptosporidium parvum
THDSDPDV

SEQ ID NO: 2227175 - protein, 6 aa, Cryptosporidium parvum
THENKP

SEQ ID NO: 2227176 - protein, 8 aa, Cryptosporidium parvum
THETTDYI

SEQ ID NO: 2227177 - protein, 8 aa, Cryptosporidium parvum
THFSTEGA

SEQ ID NO: 2227178 - protein, 9 aa, Cryptosporidium parvum
THGNGASER

SEQ ID NO: 2227179 - protein, 17 aa, Cryptosporidium parvum
THNSEDSEIKQEKKEEI

SEQ ID NO: 2227180 - protein, 15 aa, Cryptosporidium parvum
THNTSSVSASQPIAS

SEQ ID NO: 2227181 - protein, 9 aa, Cryptosporidium parvum
THPNPTHPE

SEQ ID NO: 2227182 - protein, 8 aa, Cryptosporidium parvum
THPNQTSY

SEQ ID NO: 2227183 - protein, 22 aa, Cryptosporidium parvum
THQEADDKPELPSKDEDSNSKK

SEQ ID NO: 2227184 - protein, 4 aa, Cryptosporidium parvum
THRS

SEQ ID NO: 2227185 - protein, 7 aa, Cryptosporidium parvum
THSAPGC

SEQ ID NO: 2227186 - protein, 20 aa, Cryptosporidium parvum
THSFGSQYKNENNTAEQSLN

SEQ ID NO: 2227187 - protein, 6 aa, Cryptosporidium parvum
THSKQD

SEQ ID NO: 2227188 - protein, 6 aa, Cryptosporidium parvum
THSNQQ

SEQ ID NO: 2227189 - protein, 15 aa, Cryptosporidium parvum
THSPSPSLTNDDLSG

SEQ ID NO: 2227190 - protein, 5 aa, Cryptosporidium parvum
THSTT

SEQ ID NO: 2227191 - protein, 5 aa, Cryptosporidium parvum
THTSG

SEQ ID NO: 2227192 - protein, 13 aa, Cryptosporidium parvum
THVESQPLKNSGY

SEQ ID NO: 2227193 - protein, 7 aa, Cryptosporidium parvum
TIDDQGE

SEQ ID NO: 2227194 - protein, 6 aa, Cryptosporidium parvum
TIDEQQ

SEQ ID NO: 2227195 - protein, 6 aa, Cryptosporidium parvum
TIEEIS

SEQ ID NO: 2227196 - protein, 10 aa, Cryptosporidium parvum
TIEKKSHPSL

SEQ ID NO: 2227197 - protein, 4 aa, Cryptosporidium parvum
TIEM

SEQ ID NO: 2227198 - protein, 9 aa, Cryptosporidium parvum
TIEQVEEEE

SEQ ID NO: 2227199 - protein, 7 aa, Cryptosporidium parvum
TIGGTSS

SEQ ID NO: 2227200 - protein, 5 aa, Cryptosporidium parvum
TIGKG

SEQ ID NO: 2227201 - protein, 9 aa, Cryptosporidium parvum
TIGNNNEGL

SEQ ID NO: 2227202 - protein, 11 aa, Cryptosporidium parvum
TIGNSTSDYMD

SEQ ID NO: 2227203 - protein, 5 aa, Cryptosporidium parvum
TIGPQ

SEQ ID NO: 2227204 - protein, 8 aa, Cryptosporidium parvum
TIGSDEQS

SEQ ID NO: 2227205 - protein, 22 aa, Cryptosporidium parvum
TIGTSVGSNLSSTLGSSHISPQ

SEQ ID NO: 2227206 - protein, 4 aa, Cryptosporidium parvum
TIIN

SEQ ID NO: 2227207 - protein, 5 aa, Cryptosporidium parvum
TIKPK

SEQ ID NO: 2227208 - protein, 9 aa, Cryptosporidium parvum
TIKSANSVS

SEQ ID NO: 2227209 - protein, 8 aa, Cryptosporidium parvum
TINCGENG

SEQ ID NO: 2227210 - protein, 7 aa, Cryptosporidium parvum
TINDQKP

SEQ ID NO: 2227211 - protein, 4 aa, Cryptosporidium parvum
TINN

SEQ ID NO: 2227212 - protein, 4 aa, Cryptosporidium parvum
TINQ

SEQ ID NO: 2227213 - protein, 9 aa, Cryptosporidium parvum
TINSPSTSE

SEQ ID NO: 2227214 - protein, 4 aa, Cryptosporidium parvum
TINT

SEQ ID NO: 2227215 - protein, 5 aa, Cryptosporidium parvum
TIPDS

SEQ ID NO: 2227216 - protein, 8 aa, Cryptosporidium parvum
TIQTPRQQ

SEQ ID NO: 2227217 - protein, 10 aa, Cryptosporidium parvum
TISASNKENE

SEQ ID NO: 2227218 - protein, 4 aa, Cryptosporidium parvum
TISE

SEQ ID NO: 2227219 - protein, 5 aa, Cryptosporidium parvum
TISED

SEQ ID NO: 2227220 - protein, 8 aa, Cryptosporidium parvum
TISEESDI

SEQ ID NO: 2227221 - protein, 5 aa, Cryptosporidium parvum
TISEL

SEQ ID NO: 2227222 - protein, 6 aa, Cryptosporidium parvum
TISENE

SEQ ID NO: 2227223 - protein, 5 aa, Cryptosporidium parvum
TISGN

SEQ ID NO: 2227224 - protein, 4 aa, Cryptosporidium parvum
TISK

SEQ ID NO: 2227225 - protein, 6 aa, Cryptosporidium parvum
TISKEN

SEQ ID NO: 2227226 - protein, 12 aa, Cryptosporidium parvum
TISNDTSSGDKY

SEQ ID NO: 2227227 - protein, 4 aa, Cryptosporidium parvum
TISR

SEQ ID NO: 2227228 - protein, 26 aa, Cryptosporidium parvum
TISSNSLKNKNFDENNNNNNQDEEAV

SEQ ID NO: 2227229 - protein, 9 aa, Cryptosporidium parvum
TISTNTQNN

SEQ ID NO: 2227230 - protein, 4 aa, Cryptosporidium parvum
TISY

SEQ ID NO: 2227231 - protein, 9 aa, Cryptosporidium parvum
TITEETNST

SEQ ID NO: 2227232 - protein, 13 aa, Cryptosporidium parvum
TITPNKVCPNGTE

SEQ ID NO: 2227233 - protein, 45 aa, Cryptosporidium parvum
TKAEKGEGTFTNESNSEHSTGNKDLSKKVVGSRKKLGKTVVEEDQ

SEQ ID NO: 2227234 - protein, 5 aa, Cryptosporidium parvum
TKAFS

SEQ ID NO: 2227235 - protein, 8 aa, Cryptosporidium parvum
TKAKPNKK

SEQ ID NO: 2227236 - protein, 5 aa, Cryptosporidium parvum
TKAPS

SEQ ID NO: 2227237 - protein, 12 aa, Cryptosporidium parvum
TKDDENKPERMI

SEQ ID NO: 2227238 - protein, 8 aa, Cryptosporidium parvum
TKDDQRKM

SEQ ID NO: 2227239 - protein, 9 aa, Cryptosporidium parvum
TKDKTSSFD

SEQ ID NO: 2227240 - protein, 7 aa, Cryptosporidium parvum
TKDMEKK

SEQ ID NO: 2227241 - protein, 10 aa, Cryptosporidium parvum
TKDPNQRKNA

SEQ ID NO: 2227242 - protein, 11 aa, Cryptosporidium parvum
TKDRINSDNTS

SEQ ID NO: 2227243 - protein, 42 aa, Cryptosporidium parvum
TKDVPSKRFPRTRNTAVSRSHSTKHPRPLQTGDTSDDTKPHV

SEQ ID NO: 2227244 - protein, 7 aa, Cryptosporidium parvum
TKDYPNG

SEQ ID NO: 2227245 - protein, 10 aa, Cryptosporidium parvum
TKEDETPASV

SEQ ID NO: 2227246 - protein, 9 aa, Cryptosporidium parvum
TKEDNKEIK

SEQ ID NO: 2227247 - protein, 7 aa, Cryptosporidium parvum
TKEEHTI

SEQ ID NO: 2227248 - protein, 7 aa, Cryptosporidium parvum
TKEEQDK

SEQ ID NO: 2227249 - protein, 8 aa, Cryptosporidium parvum
TKENEMED

SEQ ID NO: 2227250 - protein, 7 aa, Cryptosporidium parvum
TKENPTV

SEQ ID NO: 2227251 - protein, 6 aa, Cryptosporidium parvum
TKEQEE

SEQ ID NO: 2227252 - protein, 8 aa, Cryptosporidium parvum
TKESQGTI

SEQ ID NO: 2227253 - protein, 25 aa, Cryptosporidium parvum
TKESSKQQKLKDRERKSISKSKQRW

SEQ ID NO: 2227254 - protein, 14 aa, Cryptosporidium parvum
TKESSPINKLRKKT

SEQ ID NO: 2227255 - protein, 20 aa, Cryptosporidium parvum
TKETEYNEDFTTNNHSHAVN

SEQ ID NO: 2227256 - protein, 4 aa, Cryptosporidium parvum
TKFP

SEQ ID NO: 2227257 - protein, 5 aa, Cryptosporidium parvum
TKGAN

SEQ ID NO: 2227258 - protein, 12 aa, Cryptosporidium parvum
TKHSRGDLGSYP

SEQ ID NO: 2227259 - protein, 11 aa, Cryptosporidium parvum
TKINSQDKTPI

SEQ ID NO: 2227260 - protein, 5 aa, Cryptosporidium parvum
TKIPK

SEQ ID NO: 2227261 - protein, 8 aa, Cryptosporidium parvum
TKITTRSP

SEQ ID NO: 2227262 - protein, 7 aa, Cryptosporidium parvum
TKKEEAL

SEQ ID NO: 2227263 - protein, 8 aa, Cryptosporidium parvum
TKKFGDST

SEQ ID NO: 2227264 - protein, 10 aa, Cryptosporidium parvum
TKKGSSKEKI

SEQ ID NO: 2227265 - protein, 5 aa, Cryptosporidium parvum
TKKHH

SEQ ID NO: 2227266 - protein, 9 aa, Cryptosporidium parvum
TKKKSMEDS

SEQ ID NO: 2227267 - protein, 9 aa, Cryptosporidium parvum
TKKSCPSCV

SEQ ID NO: 2227268 - protein, 8 aa, Cryptosporidium parvum
TKKSSNLE

SEQ ID NO: 2227269 - protein, 25 aa, Cryptosporidium parvum
TKKTDSSTGEAEKEHKAGIKSSDIV

SEQ ID NO: 2227270 - protein, 7 aa, Cryptosporidium parvum
TKKYGGA

SEQ ID NO: 2227271 - protein, 11 aa, Cryptosporidium parvum
TKLKEKIQENM

SEQ ID NO: 2227272 - protein, 6 aa, Cryptosporidium parvum
TKLRRN

SEQ ID NO: 2227273 - protein, 9 aa, Cryptosporidium parvum
TKLSPKGSH

SEQ ID NO: 2227274 - protein, 14 aa, Cryptosporidium parvum
TKMDYENKSLQNGF

SEQ ID NO: 2227275 - protein, 5 aa, Cryptosporidium parvum
TKMGE

SEQ ID NO: 2227276 - protein, 9 aa, Cryptosporidium parvum
TKMKSSKAT

SEQ ID NO: 2227277 - protein, 16 aa, Cryptosporidium parvum
TKNAAKKKKMSQVKGD

SEQ ID NO: 2227278 - protein, 10 aa, Cryptosporidium parvum
TKNGKEIKLT

SEQ ID NO: 2227279 - protein, 8 aa, Cryptosporidium parvum
TKNNKNTF

SEQ ID NO: 2227280 - protein, 13 aa, Cryptosporidium parvum
TKNNSNKKQCKAG

SEQ ID NO: 2227281 - protein, 8 aa, Cryptosporidium parvum
TKNPNNQI

SEQ ID NO: 2227282 - protein, 9 aa, Cryptosporidium parvum
TKNQDKTRN

SEQ ID NO: 2227283 - protein, 10 aa, Cryptosporidium parvum
TKNSSNNNKV

SEQ ID NO: 2227284 - protein, 7 aa, Cryptosporidium parvum
TKNTECP

SEQ ID NO: 2227285 - protein, 8 aa, Cryptosporidium parvum
TKNTSGEI

SEQ ID NO: 2227286 - protein, 8 aa, Cryptosporidium parvum
TKPDAKEF

SEQ ID NO: 2227287 - protein, 9 aa, Cryptosporidium parvum
TKPGNSDIE

SEQ ID NO: 2227288 - protein, 24 aa, Cryptosporidium parvum
TKPKPKPKPKQTVTQTAPKQQPKT

SEQ ID NO: 2227289 - protein, 14 aa, Cryptosporidium parvum
TKPPLNGDDSKCPE

SEQ ID NO: 2227290 - protein, 5 aa, Cryptosporidium parvum
TKPTL

SEQ ID NO: 2227291 - protein, 16 aa, Cryptosporidium parvum
TKPVNNSNNSTKAVNL

SEQ ID NO: 2227292 - protein, 10 aa, Cryptosporidium parvum
TKPYRKSNEC

SEQ ID NO: 2227293 - protein, 4 aa, Cryptosporidium parvum
TKQD

SEQ ID NO: 2227294 - protein, 7 aa, Cryptosporidium parvum
TKQIPNK

SEQ ID NO: 2227295 - protein, 10 aa, Cryptosporidium parvum
TKQNRDNTTE

SEQ ID NO: 2227296 - protein, 23 aa, Cryptosporidium parvum
TKQSLERDADAEDQYDSGEERAE

SEQ ID NO: 2227297 - protein, 10 aa, Cryptosporidium parvum
TKQSSYSKRK

SEQ ID NO: 2227298 - protein, 7 aa, Cryptosporidium parvum
TKQTGAR

SEQ ID NO: 2227299 - protein, 7 aa, Cryptosporidium parvum
TKQVENR

SEQ ID NO: 2227300 - protein, 6 aa, Cryptosporidium parvum
TKREHT

SEQ ID NO: 2227301 - protein, 13 aa, Cryptosporidium parvum
TKRKESNFSTGND

SEQ ID NO: 2227302 - protein, 13 aa, Cryptosporidium parvum
TKRTQNELKNTPN

SEQ ID NO: 2227303 - protein, 12 aa, Cryptosporidium parvum
TKRTWNKKNQVN

SEQ ID NO: 2227304 - protein, 10 aa, Cryptosporidium parvum
TKSCSTPKSL

SEQ ID NO: 2227305 - protein, 5 aa, Cryptosporidium parvum
TKSDG

SEQ ID NO: 2227306 - protein, 8 aa, Cryptosporidium parvum
TKSGFSST

SEQ ID NO: 2227307 - protein, 6 aa, Cryptosporidium parvum
TKSGYV

SEQ ID NO: 2227308 - protein, 9 aa, Cryptosporidium parvum
TKSKNNKVP

SEQ ID NO: 2227309 - protein, 11 aa, Cryptosporidium parvum
TKSKSYGSEVS

SEQ ID NO: 2227310 - protein, 8 aa, Cryptosporidium parvum
TKSLTSSK

SEQ ID NO: 2227311 - protein, 7 aa, Cryptosporidium parvum
TKSNEEI

SEQ ID NO: 2227312 - protein, 8 aa, Cryptosporidium parvum
TKSNHNSQ

SEQ ID NO: 2227313 - protein, 7 aa, Cryptosporidium parvum
TKSNNSG

SEQ ID NO: 2227314 - protein, 20 aa, Cryptosporidium parvum
TKSPEDGNGTSENTARSREM

SEQ ID NO: 2227315 - protein, 4 aa, Cryptosporidium parvum
TKSR

SEQ ID NO: 2227316 - protein, 15 aa, Cryptosporidium parvum
TKSRNSSNQENTNDL

SEQ ID NO: 2227317 - protein, 4 aa, Cryptosporidium parvum
TKSS

SEQ ID NO: 2227318 - protein, 9 aa, Cryptosporidium parvum
TKSSASRRE

SEQ ID NO: 2227319 - protein, 5 aa, Cryptosporidium parvum
TKSSF

SEQ ID NO: 2227320 - protein, 4 aa, Cryptosporidium parvum
TKSV

SEQ ID NO: 2227321 - protein, 10 aa, Cryptosporidium parvum
TKSVDPENCR

SEQ ID NO: 2227322 - protein, 8 aa, Cryptosporidium parvum
TKTDPHKS

SEQ ID NO: 2227323 - protein, 7 aa, Cryptosporidium parvum
TKTDPVA

SEQ ID NO: 2227324 - protein, 9 aa, Cryptosporidium parvum
TKTDYDKQR

SEQ ID NO: 2227325 - protein, 10 aa, Cryptosporidium parvum
TKTESNVKNS

SEQ ID NO: 2227326 - protein, 9 aa, Cryptosporidium parvum
TKTGDLTKN

SEQ ID NO: 2227327 - protein, 9 aa, Cryptosporidium parvum
TKTGKDPFA

SEQ ID NO: 2227328 - protein, 15 aa, Cryptosporidium parvum
TKTHSNSSSCENKYK

SEQ ID NO: 2227329 - protein, 6 aa, Cryptosporidium parvum
TKTKEK

SEQ ID NO: 2227330 - protein, 9 aa, Cryptosporidium parvum
TKTKPHNKK

SEQ ID NO: 2227331 - protein, 9 aa, Cryptosporidium parvum
TKTNSLNKE

SEQ ID NO: 2227332 - protein, 6 aa, Cryptosporidium parvum
TKTPIR

SEQ ID NO: 2227333 - protein, 11 aa, Cryptosporidium parvum
TKTSKDELECN

SEQ ID NO: 2227334 - protein, 8 aa, Cryptosporidium parvum
TKTSSLLS

SEQ ID NO: 2227335 - protein, 8 aa, Cryptosporidium parvum
TKWEKAGK

SEQ ID NO: 2227336 - protein, 9 aa, Cryptosporidium parvum
TKYDNSELS

SEQ ID NO: 2227337 - protein, 8 aa, Cryptosporidium parvum
TKYSDSQN

SEQ ID NO: 2227338 - protein, 5 aa, Cryptosporidium parvum
TLASS

SEQ ID NO: 2227339 - protein, 8 aa, Cryptosporidium parvum
TLDDTQDR

SEQ ID NO: 2227340 - protein, 4 aa, Cryptosporidium parvum
TLDE

SEQ ID NO: 2227341 - protein, 17 aa, Cryptosporidium parvum
TLEAGRQSKYNEGEKYP

SEQ ID NO: 2227342 - protein, 5 aa, Cryptosporidium parvum
TLEGS

SEQ ID NO: 2227343 - protein, 6 aa, Cryptosporidium parvum
TLEGSS

SEQ ID NO: 2227344 - protein, 6 aa, Cryptosporidium parvum
TLGSGP

SEQ ID NO: 2227345 - protein, 6 aa, Cryptosporidium parvum
TLKEAV

SEQ ID NO: 2227346 - protein, 16 aa, Cryptosporidium parvum
TLKEKEENVKKGRYAI

SEQ ID NO: 2227347 - protein, 9 aa, Cryptosporidium parvum
TLKNEEKNI

SEQ ID NO: 2227348 - protein, 10 aa, Cryptosporidium parvum
TLKPTSHTSL

SEQ ID NO: 2227349 - protein, 13 aa, Cryptosporidium parvum
TLNDSNPAIGGNS

SEQ ID NO: 2227350 - protein, 18 aa, Cryptosporidium parvum
TLNGNHKDYDQSKNIQRS

SEQ ID NO: 2227351 - protein, 15 aa, Cryptosporidium parvum
TLNKTNKPLRSSSIT

SEQ ID NO: 2227352 - protein, 9 aa, Cryptosporidium parvum
TLNNMEDSE

SEQ ID NO: 2227353 - protein, 14 aa, Cryptosporidium parvum
TLNPDNKPKSRLGS

SEQ ID NO: 2227354 - protein, 5 aa, Cryptosporidium parvum
TLNQD

SEQ ID NO: 2227355 - protein, 9 aa, Cryptosporidium parvum
TLNSKNRGL

SEQ ID NO: 2227356 - protein, 7 aa, Cryptosporidium parvum
TLNSTLP

SEQ ID NO: 2227357 - protein, 5 aa, Cryptosporidium parvum
TLNTS

SEQ ID NO: 2227358 - protein, 23 aa, Cryptosporidium parvum
TLPGMGSSSYGIPPSQGTPFPGS

SEQ ID NO: 2227359 - protein, 5 aa, Cryptosporidium parvum
TLPIN

SEQ ID NO: 2227360 - protein, 4 aa, Cryptosporidium parvum
TLPK

SEQ ID NO: 2227361 - protein, 5 aa, Cryptosporidium parvum
TLPNN

SEQ ID NO: 2227362 - protein, 9 aa, Cryptosporidium parvum
TLPNRSGEL

SEQ ID NO: 2227363 - protein, 11 aa, Cryptosporidium parvum
TLQEEKNNYNK

SEQ ID NO: 2227364 - protein, 10 aa, Cryptosporidium parvum
TLQKEKEKFS

SEQ ID NO: 2227365 - protein, 5 aa, Cryptosporidium parvum
TLSDH

SEQ ID NO: 2227366 - protein, 10 aa, Cryptosporidium parvum
TLSEGPDSVG

SEQ ID NO: 2227367 - protein, 13 aa, Cryptosporidium parvum
TLSETSSSLQTKH

SEQ ID NO: 2227368 - protein, 9 aa, Cryptosporidium parvum
TLSKTNNEL

SEQ ID NO: 2227369 - protein, 11 aa, Cryptosporidium parvum
TLSNGQKPWEE

SEQ ID NO: 2227370 - protein, 23 aa, Cryptosporidium parvum
TLSNNKIENNNIEQNDNNINRKS

SEQ ID NO: 2227371 - protein, 6 aa, Cryptosporidium parvum
TLSNQE

SEQ ID NO: 2227372 - protein, 6 aa, Cryptosporidium parvum
TLSNSR

SEQ ID NO: 2227373 - protein, 6 aa, Cryptosporidium parvum
TLSNSS

SEQ ID NO: 2227374 - protein, 4 aa, Cryptosporidium parvum
TLSS

SEQ ID NO: 2227375 - protein, 7 aa, Cryptosporidium parvum
TLSSDSD

SEQ ID NO: 2227376 - protein, 15 aa, Cryptosporidium parvum
TLSSKEDLKMKTNYK

SEQ ID NO: 2227377 - protein, 8 aa, Cryptosporidium parvum
TLSSSSHK

SEQ ID NO: 2227378 - protein, 13 aa, Cryptosporidium parvum
TLTEKNEKSNIET

SEQ ID NO: 2227379 - protein, 17 aa, Cryptosporidium parvum
TLTPQSIERKEGTIIDQ

SEQ ID NO: 2227380 - protein, 9 aa, Cryptosporidium parvum
TLTPYDDNH

SEQ ID NO: 2227381 - protein, 9 aa, Cryptosporidium parvum
TMAKESDST

SEQ ID NO: 2227382 - protein, 6 aa, Cryptosporidium parvum
TMDSSK

SEQ ID NO: 2227383 - protein, 11 aa, Cryptosporidium parvum
TMGTERDSGPY

SEQ ID NO: 2227384 - protein, 6 aa, Cryptosporidium parvum
TMKDEQ

SEQ ID NO: 2227385 - protein, 9 aa, Cryptosporidium parvum
TNANSANTM

SEQ ID NO: 2227386 - protein, 26 aa, Cryptosporidium parvum
TNANTLSRSNKNNSFASSTSGNGCQT

SEQ ID NO: 2227387 - protein, 10 aa, Cryptosporidium parvum
TNAYTEDTST

SEQ ID NO: 2227388 - protein, 8 aa, Cryptosporidium parvum
TNDANSFT

SEQ ID NO: 2227389 - protein, 7 aa, Cryptosporidium parvum
TNDFKTN

SEQ ID NO: 2227390 - protein, 7 aa, Cryptosporidium parvum
TNDNDIK

SEQ ID NO: 2227391 - protein, 5 aa, Cryptosporidium parvum
TNEAE

SEQ ID NO: 2227392 - protein, 9 aa, Cryptosporidium parvum
TNEENDEEF

SEQ ID NO: 2227393 - protein, 9 aa, Cryptosporidium parvum
TNELKKNNS

SEQ ID NO: 2227394 - protein, 6 aa, Cryptosporidium parvum
TNELSD

SEQ ID NO: 2227395 - protein, 11 aa, Cryptosporidium parvum
TNEMKKSSQAR

SEQ ID NO: 2227396 - protein, 5 aa, Cryptosporidium parvum
TNEQS

SEQ ID NO: 2227397 - protein, 8 aa, Cryptosporidium parvum
TNESSTFG

SEQ ID NO: 2227398 - protein, 4 aa, Cryptosporidium parvum
TNET

SEQ ID NO: 2227399 - protein, 8 aa, Cryptosporidium parvum
TNEVSEQE

SEQ ID NO: 2227400 - protein, 12 aa, Cryptosporidium parvum
TNFGDHNSKRGD

SEQ ID NO: 2227401 - protein, 4 aa, Cryptosporidium parvum
TNGD

SEQ ID NO: 2227402 - protein, 9 aa, Cryptosporidium parvum
TNGNSNPGY

SEQ ID NO: 2227403 - protein, 5 aa, Cryptosporidium parvum
TNHRD

SEQ ID NO: 2227404 - protein, 9 aa, Cryptosporidium parvum
TNHSKPLDL

SEQ ID NO: 2227405 - protein, 17 aa, Cryptosporidium parvum
TNHTAKKNTNTNPTIQQ

SEQ ID NO: 2227406 - protein, 4 aa, Cryptosporidium parvum
TNIE

SEQ ID NO: 2227407 - protein, 6 aa, Cryptosporidium parvum
TNIGDQ

SEQ ID NO: 2227408 - protein, 15 aa, Cryptosporidium parvum
TNINSSAEINDNIPN

SEQ ID NO: 2227409 - protein, 20 aa, Cryptosporidium parvum
TNISGNDGQNYLKPSTKEYN

SEQ ID NO: 2227410 - protein, 17 aa, Cryptosporidium parvum
TNKDQTLRSGSLTNQNS

SEQ ID NO: 2227411 - protein, 5 aa, Cryptosporidium parvum
TNKET

SEQ ID NO: 2227412 - protein, 8 aa, Cryptosporidium parvum
TNKGGNKD

SEQ ID NO: 2227413 - protein, 12 aa, Cryptosporidium parvum
TNKKQRKQGQKR

SEQ ID NO: 2227414 - protein, 7 aa, Cryptosporidium parvum
TNKPTES

SEQ ID NO: 2227415 - protein, 12 aa, Cryptosporidium parvum
TNKQHKNRETFD

SEQ ID NO: 2227416 - protein, 13 aa, Cryptosporidium parvum
TNKQLDKSSSELS

SEQ ID NO: 2227417 - protein, 7 aa, Cryptosporidium parvum
TNKRGKK

SEQ ID NO: 2227418 - protein, 7 aa, Cryptosporidium parvum
TNKSNMH

SEQ ID NO: 2227419 - protein, 9 aa, Cryptosporidium parvum
TNKTEDKDH

SEQ ID NO: 2227420 - protein, 5 aa, Cryptosporidium parvum
TNKVP

SEQ ID NO: 2227421 - protein, 5 aa, Cryptosporidium parvum
TNLDQ

SEQ ID NO: 2227422 - protein, 4 aa, Cryptosporidium parvum
TNLT

SEQ ID NO: 2227423 - protein, 15 aa, Cryptosporidium parvum
TNLTSTSLGSSSTVV

SEQ ID NO: 2227424 - protein, 21 aa, Cryptosporidium parvum
TNMIPPNSQPNSMMGPNGVQG

SEQ ID NO: 2227425 - protein, 9 aa, Cryptosporidium parvum
TNNDLASTI

SEQ ID NO: 2227426 - protein, 6 aa, Cryptosporidium parvum
TNNEIP

SEQ ID NO: 2227427 - protein, 5 aa, Cryptosporidium parvum
TNNEY

SEQ ID NO: 2227428 - protein, 5 aa, Cryptosporidium parvum
TNNFK

SEQ ID NO: 2227429 - protein, 13 aa, Cryptosporidium parvum
TNNGTLQNSSSRI

SEQ ID NO: 2227430 - protein, 6 aa, Cryptosporidium parvum
TNNIRK

SEQ ID NO: 2227431 - protein, 4 aa, Cryptosporidium parvum
TNNL

SEQ ID NO: 2227432 - protein, 9 aa, Cryptosporidium parvum
TNNNNDSIK

SEQ ID NO: 2227433 - protein, 10 aa, Cryptosporidium parvum
TNNNNNHHHD

SEQ ID NO: 2227434 - protein, 7 aa, Cryptosporidium parvum
TNNPTSL

SEQ ID NO: 2227435 - protein, 8 aa, Cryptosporidium parvum
TNNQGKDL

SEQ ID NO: 2227436 - protein, 9 aa, Cryptosporidium parvum
TNNSKNACY

SEQ ID NO: 2227437 - protein, 7 aa, Cryptosporidium parvum
TNNTSTN

SEQ ID NO: 2227438 - protein, 4 aa, Cryptosporidium parvum
TNNY

SEQ ID NO: 2227439 - protein, 4 aa, Cryptosporidium parvum
TNPG

SEQ ID NO: 2227440 - protein, 6 aa, Cryptosporidium parvum
TNPKKL

SEQ ID NO: 2227441 - protein, 7 aa, Cryptosporidium parvum
TNPPIER

SEQ ID NO: 2227442 - protein, 6 aa, Cryptosporidium parvum
TNPPQF

SEQ ID NO: 2227443 - protein, 5 aa, Cryptosporidium parvum
TNPRK

SEQ ID NO: 2227444 - protein, 6 aa, Cryptosporidium parvum
TNPSEY

SEQ ID NO: 2227445 - protein, 8 aa, Cryptosporidium parvum
TNPSTKCE

SEQ ID NO: 2227446 - protein, 8 aa, Cryptosporidium parvum
TNQDNAQK

SEQ ID NO: 2227447 - protein, 7 aa, Cryptosporidium parvum
TNQENNK

SEQ ID NO: 2227448 - protein, 10 aa, Cryptosporidium parvum
TNQQREPNKK

SEQ ID NO: 2227449 - protein, 6 aa, Cryptosporidium parvum
TNQSSE

SEQ ID NO: 2227450 - protein, 8 aa, Cryptosporidium parvum
TNRGNQKK

SEQ ID NO: 2227451 - protein, 8 aa, Cryptosporidium parvum
TNRPDTLD

SEQ ID NO: 2227452 - protein, 5 aa, Cryptosporidium parvum
TNRTY

SEQ ID NO: 2227453 - protein, 4 aa, Cryptosporidium parvum
TNSD

SEQ ID NO: 2227454 - protein, 11 aa, Cryptosporidium parvum
TNSDRNLKDSE

SEQ ID NO: 2227455 - protein, 9 aa, Cryptosporidium parvum
TNSEGKKAL

SEQ ID NO: 2227456 - protein, 6 aa, Cryptosporidium parvum
TNSFPD

SEQ ID NO: 2227457 - protein, 4 aa, Cryptosporidium parvum
TNSG

SEQ ID NO: 2227458 - protein, 12 aa, Cryptosporidium parvum
TNSGKATKGISK

SEQ ID NO: 2227459 - protein, 4 aa, Cryptosporidium parvum
TNSH

SEQ ID NO: 2227460 - protein, 9 aa, Cryptosporidium parvum
TNSKPLLKN

SEQ ID NO: 2227461 - protein, 9 aa, Cryptosporidium parvum
TNSLEESNS

SEQ ID NO: 2227462 - protein, 5 aa, Cryptosporidium parvum
TNSLQ

SEQ ID NO: 2227463 - protein, 4 aa, Cryptosporidium parvum
TNSN

SEQ ID NO: 2227464 - protein, 13 aa, Cryptosporidium parvum
TNSNNVREEHKNE

SEQ ID NO: 2227465 - protein, 14 aa, Cryptosporidium parvum
TNSNVNKVDAQGIL

SEQ ID NO: 2227466 - protein, 24 aa, Cryptosporidium parvum
TNSPKSISATTSSSVSASNVGNNK

SEQ ID NO: 2227467 - protein, 8 aa, Cryptosporidium parvum
TNSPSIGG

SEQ ID NO: 2227468 - protein, 6 aa, Cryptosporidium parvum
TNSPSL

SEQ ID NO: 2227469 - protein, 11 aa, Cryptosporidium parvum
TNSREPNREKH

SEQ ID NO: 2227470 - protein, 5 aa, Cryptosporidium parvum
TNSRG

SEQ ID NO: 2227471 - protein, 4 aa, Cryptosporidium parvum
TNSS

SEQ ID NO: 2227472 - protein, 7 aa, Cryptosporidium parvum
TNSSSDI

SEQ ID NO: 2227473 - protein, 17 aa, Cryptosporidium parvum
TNSSTNSISSSVATSSI

SEQ ID NO: 2227474 - protein, 17 aa, Cryptosporidium parvum
TNSVESVSSKTSNTNSF

SEQ ID NO: 2227475 - protein, 5 aa, Cryptosporidium parvum
TNTGL

SEQ ID NO: 2227476 - protein, 6 aa, Cryptosporidium parvum
TNTKLS

SEQ ID NO: 2227477 - protein, 10 aa, Cryptosporidium parvum
TNTKTESLEI

SEQ ID NO: 2227478 - protein, 7 aa, Cryptosporidium parvum
TNTNAAS

SEQ ID NO: 2227479 - protein, 11 aa, Cryptosporidium parvum
TNTNSNQAVKA

SEQ ID NO: 2227480 - protein, 9 aa, Cryptosporidium parvum
TNTPEDPDH

SEQ ID NO: 2227481 - protein, 12 aa, Cryptosporidium parvum
TNTQGKSSVNIR

SEQ ID NO: 2227482 - protein, 5 aa, Cryptosporidium parvum
TNTQY

SEQ ID NO: 2227483 - protein, 6 aa, Cryptosporidium parvum
TNTTFN

SEQ ID NO: 2227484 - protein, 12 aa, Cryptosporidium parvum
TNTVGKTNSTKK

SEQ ID NO: 2227485 - protein, 15 aa, Cryptosporidium parvum
TNTVTSRSDSRTFKN

SEQ ID NO: 2227486 - protein, 6 aa, Cryptosporidium parvum
TNVENV

SEQ ID NO: 2227487 - protein, 5 aa, Cryptosporidium parvum
TNVNS

SEQ ID NO: 2227488 - protein, 5 aa, Cryptosporidium parvum
TNYPK

SEQ ID NO: 2227489 - protein, 4 aa, Cryptosporidium parvum
TNYS

SEQ ID NO: 2227490 - protein, 5 aa, Cryptosporidium parvum
TNYSA

SEQ ID NO: 2227491 - protein, 5 aa, Cryptosporidium parvum
TPATY

SEQ ID NO: 2227492 - protein, 16 aa, Cryptosporidium parvum
TPDDDYRESKKRRRKL

SEQ ID NO: 2227493 - protein, 6 aa, Cryptosporidium parvum
TPEISR

SEQ ID NO: 2227494 - protein, 7 aa, Cryptosporidium parvum
TPEQGGM

SEQ ID NO: 2227495 - protein, 10 aa, Cryptosporidium parvum
TPESYNNAAK

SEQ ID NO: 2227496 - protein, 5 aa, Cryptosporidium parvum
TPGEK

SEQ ID NO: 2227497 - protein, 8 aa, Cryptosporidium parvum
TPGSETIQ

SEQ ID NO: 2227498 - protein, 6 aa, Cryptosporidium parvum
TPHKGV

SEQ ID NO: 2227499 - protein, 7 aa, Cryptosporidium parvum
TPIDEPK

SEQ ID NO: 2227500 - protein, 4 aa, Cryptosporidium parvum
TPIG

SEQ ID NO: 2227501 - protein, 5 aa, Cryptosporidium parvum
TPIIT

SEQ ID NO: 2227502 - protein, 65 aa, Cryptosporidium parvum
TPINQEQVSTSTSSSGSSSNSSSDSSAAVSSSASTLESAPDSFSSSVQTSTFNHASSSNQADEEI

SEQ ID NO: 2227503 - protein, 8 aa, Cryptosporidium parvum
TPISKNSN

SEQ ID NO: 2227504 - protein, 15 aa, Cryptosporidium parvum
TPISVSSKKSCNTIT

SEQ ID NO: 2227505 - protein, 5 aa, Cryptosporidium parvum
TPKDR

SEQ ID NO: 2227506 - protein, 6 aa, Cryptosporidium parvum
TPKLEN

SEQ ID NO: 2227507 - protein, 7 aa, Cryptosporidium parvum
TPKRIDN

SEQ ID NO: 2227508 - protein, 8 aa, Cryptosporidium parvum
TPKSTAHP

SEQ ID NO: 2227509 - protein, 5 aa, Cryptosporidium parvum
TPKVS

SEQ ID NO: 2227510 - protein, 5 aa, Cryptosporidium parvum
TPKYS

SEQ ID NO: 2227511 - protein, 14 aa, Cryptosporidium parvum
TPLQPPHLTSKEGI

SEQ ID NO: 2227512 - protein, 5 aa, Cryptosporidium parvum
TPNES

SEQ ID NO: 2227513 - protein, 8 aa, Cryptosporidium parvum
TPNINSSP

SEQ ID NO: 2227514 - protein, 8 aa, Cryptosporidium parvum
TPNKSNNN

SEQ ID NO: 2227515 - protein, 21 aa, Cryptosporidium parvum
TPPDSIRDVQKADNGNTPDLE

SEQ ID NO: 2227516 - protein, 11 aa, Cryptosporidium parvum
TPPFTSNKQNI

SEQ ID NO: 2227517 - protein, 5 aa, Cryptosporidium parvum
TPPNK

SEQ ID NO: 2227518 - protein, 7 aa, Cryptosporidium parvum
TPPPDSV

SEQ ID NO: 2227519 - protein, 17 aa, Cryptosporidium parvum
TPPTGRRGRPKKNTNQA

SEQ ID NO: 2227520 - protein, 7 aa, Cryptosporidium parvum
TPQKYTT

SEQ ID NO: 2227521 - protein, 39 aa, Cryptosporidium parvum; identical to SEQ ID NO: 2121094

SEQ ID NO: 2227522 - protein, 7 aa, Cryptosporidium parvum
TPRPYSS

SEQ ID NO: 2227523 - protein, 14 aa, Cryptosporidium parvum
TPRQTHHSNSGQIM

SEQ ID NO: 2227524 - protein, 5 aa, Cryptosporidium parvum
TPRSQ

SEQ ID NO: 2227525 - protein, 9 aa, Cryptosporidium parvum
TPSGIRKSN

SEQ ID NO: 2227526 - protein, 22 aa, Cryptosporidium parvum
TPSKGKVEFTSRKREENEKEVE

SEQ ID NO: 2227527 - protein, 7 aa, Cryptosporidium parvum
TPSNSSF

SEQ ID NO: 2227528 - protein, 5 aa, Cryptosporidium parvum
TPSNY

SEQ ID NO: 2227529 - protein, 11 aa, Cryptosporidium parvum
TPSPRARQTAA

SEQ ID NO: 2227530 - protein, 7 aa, Cryptosporidium parvum
TPSPSKE

SEQ ID NO: 2227531 - protein, 8 aa, Cryptosporidium parvum
TPSSNTMS

SEQ ID NO: 2227532 - protein, 7 aa, Cryptosporidium parvum
TPTPNTV

SEQ ID NO: 2227533 - protein, 5 aa, Cryptosporidium parvum
TPVTP

SEQ ID NO: 2227534 - protein, 4 aa, Cryptosporidium parvum
TPYG

SEQ ID NO: 2227535 - protein, 23 aa, Cryptosporidium parvum
TPYPFEDDESSINQSNSENVKPV

SEQ ID NO: 2227536 - protein, 10 aa, Cryptosporidium parvum
TQDDSLEDND

SEQ ID NO: 2227537 - protein, 12 aa, Cryptosporidium parvum
TQDENDEDYSTI

SEQ ID NO: 2227538 - protein, 6 aa, Cryptosporidium parvum
TQDGRC

SEQ ID NO: 2227539 - protein, 10 aa, Cryptosporidium parvum
TQDPHGDYNN

SEQ ID NO: 2227540 - protein, 8 aa, Cryptosporidium parvum
TQDTNPDI

SEQ ID NO: 2227541 - protein, 10 aa, Cryptosporidium parvum
TQGEERQKDQ

SEQ ID NO: 2227542 - protein, 4 aa, Cryptosporidium parvum
TQGF

SEQ ID NO: 2227543 - protein, 5 aa, Cryptosporidium parvum
TQGNT

SEQ ID NO: 2227544 - protein, 4 aa, Cryptosporidium parvum
TQGR

SEQ ID NO: 2227545 - protein, 8 aa, Cryptosporidium parvum
TQGYSKEE

SEQ ID NO: 2227546 - protein, 4 aa, Cryptosporidium parvum
TQIH

SEQ ID NO: 2227547 - protein, 12 aa, Cryptosporidium parvum
TQITNNTRESYS

SEQ ID NO: 2227548 - protein, 16 aa, Cryptosporidium parvum
TQKGHVYRSTNRGKNW

SEQ ID NO: 2227549 - protein, 13 aa, Cryptosporidium parvum
TQKKSNTESNHGK

SEQ ID NO: 2227550 - protein, 8 aa, Cryptosporidium parvum
TQKSNIPE

SEQ ID NO: 2227551 - protein, 8 aa, Cryptosporidium parvum
TQKYHNNR

SEQ ID NO: 2227552 - protein, 8 aa, Cryptosporidium parvum
TQLPSPSL

SEQ ID NO: 2227553 - protein, 11 aa, Cryptosporidium parvum
TQNGVENDGSI

SEQ ID NO: 2227554 - protein, 4 aa, Cryptosporidium parvum
TQNI

SEQ ID NO: 2227555 - protein, 23 aa, Cryptosporidium parvum
TQNQAIGNISTGDSLEKDDPELN

SEQ ID NO: 2227556 - protein, 6 aa, Cryptosporidium parvum
TQNSAL

SEQ ID NO: 2227557 - protein, 8 aa, Cryptosporidium parvum
TQPASSKL

SEQ ID NO: 2227558 - protein, 8 aa, Cryptosporidium parvum
TQPGNVAK

SEQ ID NO: 2227559 - protein, 13 aa, Cryptosporidium parvum
TQPIHGGDSGNYN

SEQ ID NO: 2227560 - protein, 14 aa, Cryptosporidium parvum
TQPKPKPKLKPKQN

SEQ ID NO: 2227561 - protein, 11 aa, Cryptosporidium parvum
TQPKPKPKPVM

SEQ ID NO: 2227562 - protein, 4 aa, Cryptosporidium parvum
TQPL

SEQ ID NO: 2227563 - protein, 6 aa, Cryptosporidium parvum
TQPQSQ

SEQ ID NO: 2227564 - protein, 15 aa, Cryptosporidium parvum
TQQIYQSDTNISSKT

SEQ ID NO: 2227565 - protein, 8 aa, Cryptosporidium parvum
TQQQTKEA

SEQ ID NO: 2227566 - protein, 11 aa, Cryptosporidium parvum
TQRDWAESHER

SEQ ID NO: 2227567 - protein, 7 aa, Cryptosporidium parvum
TQRITAP

SEQ ID NO: 2227568 - protein, 10 aa, Cryptosporidium parvum
TQRNPPPAQH

SEQ ID NO: 2227569 - protein, 9 aa, Cryptosporidium parvum
TQRRKHRTV

SEQ ID NO: 2227570 - protein, 9 aa, Cryptosporidium parvum
TQRSPTGSI

SEQ ID NO: 2227571 - protein, 6 aa, Cryptosporidium parvum
TQSGNV

SEQ ID NO: 2227572 - protein, 14 aa, Cryptosporidium parvum
TQSLASDPNWKSGD

SEQ ID NO: 2227573 - protein, 6 aa, Cryptosporidium parvum
TQSSSG

SEQ ID NO: 2227574 - protein, 5 aa, Cryptosporidium parvum
TQSSY

SEQ ID NO: 2227575 - protein, 21 aa, Cryptosporidium parvum
TQTDPIKTSRRSGSSKRRARK

SEQ ID NO: 2227576 - protein, 8 aa, Cryptosporidium parvum
TQTPAYQT

SEQ ID NO: 2227577 - protein, 20 aa, Cryptosporidium parvum
TQTSGQKKKKLSYSSPDPKI

SEQ ID NO: 2227578 - protein, 41 aa, Cryptosporidium parvum
TQTSTSNTNEEAPLTRSAAASLSRTRGGRSNEEMENSRMEK

SEQ ID NO: 2227579 - protein, 10 aa, Cryptosporidium parvum
TQVSKSSSYI

SEQ ID NO: 2227580 - protein, 6 aa, Cryptosporidium parvum
TQYTEI

SEQ ID NO: 2227581 - protein, 8 aa, Cryptosporidium parvum
TRAKETAT

SEQ ID NO: 2227582 - protein, 9 aa, Cryptosporidium parvum
TRDSSAKSN

SEQ ID NO: 2227583 - protein, 4 aa, Cryptosporidium parvum
TRES

SEQ ID NO: 2227584 - protein, 8 aa, Cryptosporidium parvum
TRETCKDD

SEQ ID NO: 2227585 - protein, 10 aa, Cryptosporidium parvum
TRETETNIQS

SEQ ID NO: 2227586 - protein, 8 aa, Cryptosporidium parvum
TREYSKQR

SEQ ID NO: 2227587 - protein, 21 aa, Cryptosporidium parvum
TRGGRAGNNGQSSASNIDDDD

SEQ ID NO: 2227588 - protein, 5 aa, Cryptosporidium parvum
TRGNT

SEQ ID NO: 2227589 - protein, 9 aa, Cryptosporidium parvum
TRGSDPNGG

SEQ ID NO: 2227590 - protein, 10 aa, Cryptosporidium parvum
TRGTGASTGH

SEQ ID NO: 2227591 - protein, 5 aa, Cryptosporidium parvum
TRISN

SEQ ID NO: 2227592 - protein, 6 aa, Cryptosporidium parvum
TRKANS

SEQ ID NO: 2227593 - protein, 4 aa, Cryptosporidium parvum
TRNC

SEQ ID NO: 2227594 - protein, 24 aa, Cryptosporidium parvum
TRNQGVNNNTENFEGERFGNNTSI

SEQ ID NO: 2227595 - protein, 8 aa, Cryptosporidium parvum
TRNSITSD

SEQ ID NO: 2227596 - protein, 4 aa, Cryptosporidium parvum
TRNT

SEQ ID NO: 2227597 - protein, 33 aa, Cryptosporidium parvum
TRNYEQESIRNSRRSYNNDDNNTNLKSIQESSQ

SEQ ID NO: 2227598 - protein, 4 aa, Cryptosporidium parvum
TRPD

SEQ ID NO: 2227599 - protein, 24 aa, Cryptosporidium parvum
TRPDSGSESRLETIPEEPSNSYEP

SEQ ID NO: 2227600 - protein, 45 aa, Cryptosporidium parvum
TRPFSDTYQQGDVFSSSSSFGFSQPSNENGNTSGSRINSHPSSQE

SEQ ID NO: 2227601 - protein, 6 aa, Cryptosporidium parvum
TRPGNF

SEQ ID NO: 2227602 - protein, 9 aa, Cryptosporidium parvum
TRPKPEKRK

SEQ ID NO: 2227603 - protein, 11 aa, Cryptosporidium parvum
TRPKSLNGEAG

SEQ ID NO: 2227604 - protein, 17 aa, Cryptosporidium parvum
TRPPGEVSKVGEDGREE

SEQ ID NO: 2227605 - protein, 8 aa, Cryptosporidium parvum
TRPRGTGA

SEQ ID NO: 2227606 - protein, 7 aa, Cryptosporidium parvum
TRRANEN

SEQ ID NO: 2227607 - protein, 6 aa, Cryptosporidium parvum
TRRGPI

SEQ ID NO: 2227608 - protein, 5 aa, Cryptosporidium parvum
TRRNK

SEQ ID NO: 2227609 - protein, 8 aa, Cryptosporidium parvum
TRRPYSGS

SEQ ID NO: 2227610 - protein, 14 aa, Cryptosporidium parvum
TRRRRRDKPTNMKD

SEQ ID NO: 2227611 - protein, 7 aa, Cryptosporidium parvum
TRSEDEL

SEQ ID NO: 2227612 - protein, 10 aa, Cryptosporidium parvum
TRSERYAEPI

SEQ ID NO: 2227613 - protein, 16 aa, Cryptosporidium parvum
TRSFTSEPQTRPLQTQ

SEQ ID NO: 2227614 - protein, 7 aa, Cryptosporidium parvum
TRSGKTT

SEQ ID NO: 2227615 - protein, 5 aa, Cryptosporidium parvum
TRSIV

SEQ ID NO: 2227616 - protein, 9 aa, Cryptosporidium parvum
TRSNTANKR

SEQ ID NO: 2227617 - protein, 7 aa, Cryptosporidium parvum
TRSRNEN

SEQ ID NO: 2227618 - protein, 14 aa, Cryptosporidium parvum
TRSSDAFNSSLTTK

SEQ ID NO: 2227619 - protein, 18 aa, Cryptosporidium parvum
TRSSNKSGIENKENEALS

SEQ ID NO: 2227620 - protein, 11 aa, Cryptosporidium parvum
TRTAGSKETGL

SEQ ID NO: 2227621 - protein, 5 aa, Cryptosporidium parvum
TRTNQ

SEQ ID NO: 2227622 - protein, 4 aa, Cryptosporidium parvum
TRTS

SEQ ID NO: 2227623 - protein, 7 aa, Cryptosporidium parvum
TRTTSGF

SEQ ID NO: 2227624 - protein, 6 aa, Cryptosporidium parvum
TRVEAA

SEQ ID NO: 2227625 - protein, 10 aa, Cryptosporidium parvum
TSAAKDEEKV

SEQ ID NO: 2227626 - protein, 12 aa, Cryptosporidium parvum
TSAISQTKTGIS

SEQ ID NO: 2227627 - protein, 7 aa, Cryptosporidium parvum
TSALANY

SEQ ID NO: 2227628 - protein, 9 aa, Cryptosporidium parvum
TSARKTSDL

SEQ ID NO: 2227629 - protein, 6 aa, Cryptosporidium parvum
TSDDSN

SEQ ID NO: 2227630 - protein, 6 aa, Cryptosporidium parvum
TSDDTI

SEQ ID NO: 2227631 - protein, 6 aa, Cryptosporidium parvum
TSDFSA

SEQ ID NO: 2227632 - protein, 4 aa, Cryptosporidium parvum
TSDG

SEQ ID NO: 2227633 - protein, 23 aa, Cryptosporidium parvum
TSDGRDLKTGTEFYDSNSSSLNT

SEQ ID NO: 2227634 - protein, 4 aa, Cryptosporidium parvum
TSDS

SEQ ID NO: 2227635 - protein, 20 aa, Cryptosporidium parvum
TSDYSEESQNVTISKSRPIS

SEQ ID NO: 2227636 - protein, 15 aa, Cryptosporidium parvum
TSEGMTEKKKEDGGY

SEQ ID NO: 2227637 - protein, 4 aa, Cryptosporidium parvum
TSEI

SEQ ID NO: 2227638 - protein, 17 aa, Cryptosporidium parvum
TSEKYSTNSDNIKKDDD

SEQ ID NO: 2227639 - protein, 4 aa, Cryptosporidium parvum
TSES

SEQ ID NO: 2227640 - protein, 10 aa, Cryptosporidium parvum
TSESDEKNFS

SEQ ID NO: 2227641 - protein, 5 aa, Cryptosporidium parvum
TSESI

SEQ ID NO: 2227642 - protein, 9 aa, Cryptosporidium parvum
TSESLGSES

SEQ ID NO: 2227643 - protein, 12 aa, Cryptosporidium parvum
TSETKEINNGPH

SEQ ID NO: 2227644 - protein, 6 aa, Cryptosporidium parvum
TSETLC

SEQ ID NO: 2227645 - protein, 4 aa, Cryptosporidium parvum
TSFE

SEQ ID NO: 2227646 - protein, 4 aa, Cryptosporidium parvum
TSFN

SEQ ID NO: 2227647 - protein, 6 aa, Cryptosporidium parvum
TSFNNS

SEQ ID NO: 2227648 - protein, 8 aa, Cryptosporidium parvum
TSFSGAQT

SEQ ID NO: 2227649 - protein, 14 aa, Cryptosporidium parvum
TSGHSNANDEHGFT

SEQ ID NO: 2227650 - protein, 6 aa, Cryptosporidium parvum
TSGLDV

SEQ ID NO: 2227651 - protein, 6 aa, Cryptosporidium parvum
TSGPTS

SEQ ID NO: 2227652 - protein, 16 aa, Cryptosporidium parvum
TSGRNDNNNNNGANVV

SEQ ID NO: 2227653 - protein, 7 aa, Cryptosporidium parvum
TSGSQAT

SEQ ID NO: 2227654 - protein, 20 aa, Cryptosporidium parvum
TSGSVNTNQVRAPSEEIDGG

SEQ ID NO: 2227655 - protein, 10 aa, Cryptosporidium parvum
TSHEKEYDIG

SEQ ID NO: 2227656 - protein, 10 aa, Cryptosporidium parvum
TSHENNSLGN

SEQ ID NO: 2227657 - protein, 4 aa, Cryptosporidium parvum
TSHK

SEQ ID NO: 2227658 - protein, 43 aa, Cryptosporidium parvum
TSHPNQQQCNPSSSSSNLQPNSNPSGFNSGSSPSSLPTSSYAH

SEQ ID NO: 2227659 - protein, 5 aa, Cryptosporidium parvum
TSHPY

SEQ ID NO: 2227660 - protein, 13 aa, Cryptosporidium parvum
TSHSSSSSHSNLN

SEQ ID NO: 2227661 - protein, 19 aa, Cryptosporidium parvum
TSINNNSFNNNEGNELGRS

SEQ ID NO: 2227662 - protein, 10 aa, Cryptosporidium parvum
TSIPKNEIEL

SEQ ID NO: 2227663 - protein, 8 aa, Cryptosporidium parvum
TSIRSSSS

SEQ ID NO: 2227664 - protein, 26 aa, Cryptosporidium parvum
TSISAKKLSNNKDDGYRTENKENVEI

SEQ ID NO: 2227665 - protein, 8 aa, Cryptosporidium parvum
TSKDGIKN

SEQ ID NO: 2227666 - protein, 9 aa, Cryptosporidium parvum
TSKDTPPYY

SEQ ID NO: 2227667 - protein, 6 aa, Cryptosporidium parvum
TSKEST

SEQ ID NO: 2227668 - protein, 5 aa, Cryptosporidium parvum
TSKFI

SEQ ID NO: 2227669 - protein, 4 aa, Cryptosporidium parvum
TSKI

SEQ ID NO: 2227670 - protein, 8 aa, Cryptosporidium parvum
TSKIQDGD

SEQ ID NO: 2227671 - protein, 13 aa, Cryptosporidium parvum
TSKNLDSSSKKEK

SEQ ID NO: 2227672 - protein, 9 aa, Cryptosporidium parvum
TSKNPEAIP

SEQ ID NO: 2227673 - protein, 6 aa, Cryptosporidium parvum
TSKWKS

SEQ ID NO: 2227674 - protein, 19 aa, Cryptosporidium parvum
TSKYNKDPKYKEKGSDDFS

SEQ ID NO: 2227675 - protein, 5 aa, Cryptosporidium parvum
TSLEE

SEQ ID NO: 2227676 - protein, 4 aa, Cryptosporidium parvum
TSLN

SEQ ID NO: 2227677 - protein, 6 aa, Cryptosporidium parvum
TSLNET

SEQ ID NO: 2227678 - protein, 6 aa, Cryptosporidium parvum
TSLPQP

SEQ ID NO: 2227679 - protein, 5 aa, Cryptosporidium parvum
TSLPS

SEQ ID NO: 2227680 - protein, 9 aa, Cryptosporidium parvum
TSNEQIKRR

SEQ ID NO: 2227681 - protein, 6 aa, Cryptosporidium parvum
TSNGYD

SEQ ID NO: 2227682 - protein, 6 aa, Cryptosporidium parvum
TSNIKK

SEQ ID NO: 2227683 - protein, 7 aa, Cryptosporidium parvum
TSNKQSI

SEQ ID NO: 2227684 - protein, 11 aa, Cryptosporidium parvum
TSNMKGENGKE

SEQ ID NO: 2227685 - protein, 14 aa, Cryptosporidium parvum
TSNNFPSNANLGNS

SEQ ID NO: 2227686 - protein, 9 aa, Cryptosporidium parvum
TSNNPYSKK

SEQ ID NO: 2227687 - protein, 6 aa, Cryptosporidium parvum
TSNNSI

SEQ ID NO: 2227688 - protein, 11 aa, Cryptosporidium parvum
TSNNVNKRSFK

SEQ ID NO: 2227689 - protein, 4 aa, Cryptosporidium parvum
TSNP

SEQ ID NO: 2227690 - protein, 8 aa, Cryptosporidium parvum
TSNPESGS

SEQ ID NO: 2227691 - protein, 4 aa, Cryptosporidium parvum
TSNQ

SEQ ID NO: 2227692 - protein, 4 aa, Cryptosporidium parvum
TSNS

SEQ ID NO: 2227693 - protein, 9 aa, Cryptosporidium parvum
TSNSEYAKA

SEQ ID NO: 2227694 - protein, 8 aa, Cryptosporidium parvum
TSNSINDN

SEQ ID NO: 2227695 - protein, 16 aa, Cryptosporidium parvum
TSNTLSESKPNNFQNN

SEQ ID NO: 2227696 - protein, 12 aa, Cryptosporidium parvum
TSPGNKCKSGSV

SEQ ID NO: 2227697 - protein, 9 aa, Cryptosporidium parvum
TSPLQTQTA

SEQ ID NO: 2227698 - protein, 4 aa, Cryptosporidium parvum
TSPN

SEQ ID NO: 2227699 - protein, 6 aa, Cryptosporidium parvum
TSPSPM

SEQ ID NO: 2227700 - protein, 4 aa, Cryptosporidium parvum
TSPV

SEQ ID NO: 2227701 - protein, 30 aa, Cryptosporidium parvum
TSPYISTEQEIKSKKDQDLGSEIGVKTSDK

SEQ ID NO: 2227702 - protein, 5 aa, Cryptosporidium parvum
TSQEA

SEQ ID NO: 2227703 - protein, 11 aa, Cryptosporidium parvum
TSQLKQNQTKI

SEQ ID NO: 2227704 - protein, 9 aa, Cryptosporidium parvum
TSQNEEKIP

SEQ ID NO: 2227705 - protein, 11 aa, Cryptosporidium parvum
TSQNSNPKYND

SEQ ID NO: 2227706 - protein, 6 aa, Cryptosporidium parvum
TSQRGF

SEQ ID NO: 2227707 - protein, 23 aa, Cryptosporidium parvum
TSQSSLNSSSGKSNNYGFAGNQA

SEQ ID NO: 2227708 - protein, 8 aa, Cryptosporidium parvum
TSRAPLTD

SEQ ID NO: 2227709 - protein, 7 aa, Cryptosporidium parvum
TSRDGHN

SEQ ID NO: 2227710 - protein, 5 aa, Cryptosporidium parvum
TSREN

SEQ ID NO: 2227711 - protein, 5 aa, Cryptosporidium parvum
TSREY

SEQ ID NO: 2227712 - protein, 8 aa, Cryptosporidium parvum
TSRFGNST

SEQ ID NO: 2227713 - protein, 6 aa, Cryptosporidium parvum
TSRGEL

SEQ ID NO: 2227714 - protein, 5 aa, Cryptosporidium parvum
TSRNV

SEQ ID NO: 2227715 - protein, 14 aa, Cryptosporidium parvum
TSRRGDAHAGSTKL

SEQ ID NO: 2227716 - protein, 9 aa, Cryptosporidium parvum
TSRSGYKIQ

SEQ ID NO: 2227717 - protein, 15 aa, Cryptosporidium parvum
TSRTAGVEKQDVANN

SEQ ID NO: 2227718 - protein, 8 aa, Cryptosporidium parvum
TSSATSNS

SEQ ID NO: 2227719 - protein, 7 aa, Cryptosporidium parvum
TSSCSKV

SEQ ID NO: 2227720 - protein, 30 aa, Cryptosporidium parvum
TSSDEQSDLNKKSDEEMSNSDSSSGSDSDL

SEQ ID NO: 2227721 - protein, 8 aa, Cryptosporidium parvum
TSSDMESS

SEQ ID NO: 2227722 - protein, 7 aa, Cryptosporidium parvum
TSSEAEN

SEQ ID NO: 2227723 - protein, 7 aa, Cryptosporidium parvum
TSSENGD

SEQ ID NO: 2227724 - protein, 16 aa, Cryptosporidium parvum
TSSESTQGFHNTQNTY

SEQ ID NO: 2227725 - protein, 4 aa, Cryptosporidium parvum
TSSK

SEQ ID NO: 2227726 - protein, 9 aa, Cryptosporidium parvum
TSSKYSNSD

SEQ ID NO: 2227727 - protein, 15 aa, Cryptosporidium parvum
TSSLDSKKREKVEGL

SEQ ID NO: 2227728 - protein, 5 aa, Cryptosporidium parvum
TSSMD

SEQ ID NO: 2227729 - protein, 8 aa, Cryptosporidium parvum
TSSNDSIG

SEQ ID NO: 2227730 - protein, 5 aa, Cryptosporidium parvum
TSSNE

SEQ ID NO: 2227731 - protein, 9 aa, Cryptosporidium parvum
TSSNKSSIN

SEQ ID NO: 2227732 - protein, 9 aa, Cryptosporidium parvum
TSSNNANIG

SEQ ID NO: 2227733 - protein, 16 aa, Cryptosporidium parvum
TSSPGEDSKGGQKSIM

SEQ ID NO: 2227734 - protein, 10 aa, Cryptosporidium parvum
TSSPTSHSYN

SEQ ID NO: 2227735 - protein, 18 aa, Cryptosporidium parvum
TSSQKKKKKRLPFKNEKN

SEQ ID NO: 2227736 - protein, 7 aa, Cryptosporidium parvum
TSSRENL

SEQ ID NO: 2227737 - protein, 6 aa, Cryptosporidium parvum
TSSSTI

SEQ ID NO: 2227738 - protein, 9 aa, Cryptosporidium parvum
TSSTLDSGA

SEQ ID NO: 2227739 - protein, 9 aa, Cryptosporidium parvum
TSSYRNKRE

SEQ ID NO: 2227740 - protein, 8 aa, Cryptosporidium parvum
TSTGRFPE

SEQ ID NO: 2227741 - protein, 10 aa, Cryptosporidium parvum
TSTIGSTKKE

SEQ ID NO: 2227742 - protein, 4 aa, Cryptosporidium parvum
TSTN

SEQ ID NO: 2227743 - protein, 14 aa, Cryptosporidium parvum
TSTNNQNLDRTESI

SEQ ID NO: 2227744 - protein, 14 aa, Cryptosporidium parvum
TSTPTNSPKESQKN

SEQ ID NO: 2227745 - protein, 28 aa, Cryptosporidium parvum
TSTQNKNSSKSKNKSNISNSNTEQVPEQ

SEQ ID NO: 2227746 - protein, 10 aa, Cryptosporidium parvum
TSTRETKEYK

SEQ ID NO: 2227747 - protein, 10 aa, Cryptosporidium parvum
TSTSEWNHKP

SEQ ID NO: 2227748 - protein, 21 aa, Cryptosporidium parvum
TSTTTTVTTANTKNESSSNGK

SEQ ID NO: 2227749 - protein, 6 aa, Cryptosporidium parvum
TSTYNE

SEQ ID NO: 2227750 - protein, 5 aa, Cryptosporidium parvum
TSVAN

SEQ ID NO: 2227751 - protein, 39 aa, Cryptosporidium parvum
TSVDSKINSNISSSTQQPSGISNTFPNSLGTSGQTKNLS

SEQ ID NO: 2227752 - protein, 8 aa, Cryptosporidium parvum
TSVEKKEI

SEQ ID NO: 2227753 - protein, 11 aa, Cryptosporidium parvum
TSVENSHKDSE

SEQ ID NO: 2227754 - protein, 21 aa, Cryptosporidium parvum
TSVNQDGKSATITAPNGPSQQ

SEQ ID NO: 2227755 - protein, 10 aa, Cryptosporidium parvum
TSVPGKTTSE

SEQ ID NO: 2227756 - protein, 5 aa, Cryptosporidium parvum
TSVRG

SEQ ID NO: 2227757 - protein, 11 aa, Cryptosporidium parvum
TSVSTSSNSKL

SEQ ID NO: 2227758 - protein, 6 aa, Cryptosporidium parvum
TSWNSD

SEQ ID NO: 2227759 - protein, 22 aa, Cryptosporidium parvum
TSYNSQIKHSTSNYHKDTSKSL

SEQ ID NO: 2227760 - protein, 11 aa, Cryptosporidium parvum
TSYSSSSSKYF

SEQ ID NO: 2227761 - protein, 13 aa, Cryptosporidium parvum
TSYTKNDSKTEFE

SEQ ID NO: 2227762 - protein, 8 aa, Cryptosporidium parvum
TSYTVSGD

SEQ ID NO: 2227763 - protein, 8 aa, Cryptosporidium parvum
TTAGSTKH

SEQ ID NO: 2227764 - protein, 6 aa, Cryptosporidium parvum
TTAPRG

SEQ ID NO: 2227765 - protein, 6 aa, Cryptosporidium parvum
TTCPRL

SEQ ID NO: 2227766 - protein, 9 aa, Cryptosporidium parvum
TTCTNSNEK

SEQ ID NO: 2227767 - protein, 7 aa, Cryptosporidium parvum
TTEDGGY

SEQ ID NO: 2227768 - protein, 10 aa, Cryptosporidium parvum
TTEEGYGSNI

SEQ ID NO: 2227769 - protein, 9 aa, Cryptosporidium parvum
TTEEKNHET

SEQ ID NO: 2227770 - protein, 11 aa, Cryptosporidium parvum
TTENKRSISEL

SEQ ID NO: 2227771 - protein, 6 aa, Cryptosporidium parvum
TTESAK

SEQ ID NO: 2227772 - protein, 5 aa, Cryptosporidium parvum
TTFGD

SEQ ID NO: 2227773 - protein, 15 aa, Cryptosporidium parvum
TTFPEDSQTPSTITE

SEQ ID NO: 2227774 - protein, 24 aa, Cryptosporidium parvum
TTFSNTTKQTNKPVPKLESSNINP

SEQ ID NO: 2227775 - protein, 6 aa, Cryptosporidium parvum
TTFSPE

SEQ ID NO: 2227776 - protein, 17 aa, Cryptosporidium parvum
TTGFQEGRFSNQQKQQV

SEQ ID NO: 2227777 - protein, 7 aa, Cryptosporidium parvum
TTGLRGS

SEQ ID NO: 2227778 - protein, 6 aa, Cryptosporidium parvum
TTGNIA

SEQ ID NO: 2227779 - protein, 15 aa, Cryptosporidium parvum
TTGPKRASYVHTGAA

SEQ ID NO: 2227780 - protein, 10 aa, Cryptosporidium parvum
TTGTKYSHPK

SEQ ID NO: 2227781 - protein, 10 aa, Cryptosporidium parvum
TTHSLSGQNH

SEQ ID NO: 2227782 - protein, 11 aa, Cryptosporidium parvum
TTHTKKLGSET

SEQ ID NO: 2227783 - protein, 20 aa, Cryptosporidium parvum
TTINHPSHDITSSHYPETCN

SEQ ID NO: 2227784 - protein, 9 aa, Cryptosporidium parvum
TTIPKGSSI

SEQ ID NO: 2227785 - protein, 6 aa, Cryptosporidium parvum
TTIRES

SEQ ID NO: 2227786 - protein, 12 aa, Cryptosporidium parvum
TTIRNSNQLNEV

SEQ ID NO: 2227787 - protein, 8 aa, Cryptosporidium parvum
TTISENLQ

SEQ ID NO: 2227788 - protein, 4 aa, Cryptosporidium parvum
TTKG

SEQ ID NO: 2227789 - protein, 12 aa, Cryptosporidium parvum
TTKPTGQLCASY

SEQ ID NO: 2227790 - protein, 7 aa, Cryptosporidium parvum
TTKQNGV

SEQ ID NO: 2227791 - protein, 8 aa, Cryptosporidium parvum
TTKTSTVA

SEQ ID NO: 2227792 - protein, 4 aa, Cryptosporidium parvum
TTLN

SEQ ID NO: 2227793 - protein, 4 aa, Cryptosporidium parvum
TTLP

SEQ ID NO: 2227794 - protein, 13 aa, Cryptosporidium parvum
TTMPSKDNQINQV

SEQ ID NO: 2227795 - protein, 23 aa, Cryptosporidium parvum
TTMTKSPQTSQTNKTQTTQDSQD

SEQ ID NO: 2227796 - protein, 5 aa, Cryptosporidium parvum
TTNGK

SEQ ID NO: 2227797 - protein, 8 aa, Cryptosporidium parvum
TTNKESHK

SEQ ID NO: 2227798 - protein, 5 aa, Cryptosporidium parvum
TTNLT

SEQ ID NO: 2227799 - protein, 5 aa, Cryptosporidium parvum
TTNPN

SEQ ID NO: 2227800 - protein, 6 aa, Cryptosporidium parvum
TTNSQG

SEQ ID NO: 2227801 - protein, 9 aa, Cryptosporidium parvum
TTNSRSPQL

SEQ ID NO: 2227802 - protein, 13 aa, Cryptosporidium parvum
TTNTSGKKKSYYG

SEQ ID NO: 2227803 - protein, 17 aa, Cryptosporidium parvum
TTPDPSTIQNKDSPDLK

SEQ ID NO: 2227804 - protein, 16 aa, Cryptosporidium parvum
TTPEKGKGLKSNGNLN

SEQ ID NO: 2227805 - protein, 5 aa, Cryptosporidium parvum
TTPET

SEQ ID NO: 2227806 - protein, 9 aa, Cryptosporidium parvum
TTPGKGTLK

SEQ ID NO: 2227807 - protein, 20 aa, Cryptosporidium parvum
TTPKSTQGEYLSENPSSERI

SEQ ID NO: 2227808 - protein, 6 aa, Cryptosporidium parvum
TTPNNG

SEQ ID NO: 2227809 - protein, 11 aa, Cryptosporidium parvum
TTQKEPPLNTE

SEQ ID NO: 2227810 - protein, 5 aa, Cryptosporidium parvum
TTQLR

SEQ ID NO: 2227811 - protein, 11 aa, Cryptosporidium parvum
TTQNDYNTTSR

SEQ ID NO: 2227812 - protein, 8 aa, Cryptosporidium parvum
TTQNNTIT

SEQ ID NO: 2227813 - protein, 4 aa, Cryptosporidium parvum
TTQP

SEQ ID NO: 2227814 - protein, 5 aa, Cryptosporidium parvum
TTSAV

SEQ ID NO: 2227815 - protein, 6 aa, Cryptosporidium parvum
TTSDGV

SEQ ID NO: 2227816 - protein, 11 aa, Cryptosporidium parvum
TTSDSKTNGNS

SEQ ID NO: 2227817 - protein, 49 aa, Cryptosporidium parvum
TTSEKVSKHTRGKHTKRKQNKRNREREEEYSDASSTQSWSPSSRISKSR

SEQ ID NO: 2227818 - protein, 5 aa, Cryptosporidium parvum
TTSGI

SEQ ID NO: 2227819 - protein, 16 aa, Cryptosporidium parvum
TTSKTGISADLNSETF

SEQ ID NO: 2227820 - protein, 6 aa, Cryptosporidium parvum
TTSPFS

SEQ ID NO: 2227821 - protein, 7 aa, Cryptosporidium parvum
TTSSTSD

SEQ ID NO: 2227822 - protein, 9 aa, Cryptosporidium parvum
TTSTSSGKS

SEQ ID NO: 2227823 - protein, 9 aa, Cryptosporidium parvum
TTTASNSEF

SEQ ID NO: 2227824 - protein, 16 aa, Cryptosporidium parvum
TTTDPGVMPNNGDKGE

SEQ ID NO: 2227825 - protein, 14 aa, Cryptosporidium parvum
TTTFESTGESKVGG

SEQ ID NO: 2227826 - protein, 26 aa, Cryptosporidium parvum
TTTQKPTTTTTTKVPGKPPIATTTTT

SEQ ID NO: 2227827 - protein, 6 aa, Cryptosporidium parvum
TTTSKQ

SEQ ID NO: 2227828 - protein, 8 aa, Cryptosporidium parvum
TTTSTISG

SEQ ID NO: 2227829 - protein, 49 aa, Cryptosporidium parvum
TTTSTTTTSTRKSFTSKTSTSIPINNNNTKLPTTKGREKEENTDSDIGK

SEQ ID NO: 2227830 - protein, 43 aa, Cryptosporidium parvum
TTTTAKPTTTTTGAPGQPTTTTTGSPSKPTTTTTTKATTTTTT

SEQ ID NO: 2227831 - protein, 14 aa, Cryptosporidium parvum
TTTTKAPQSVTGSR

SEQ ID NO: 2227832 - protein, 24 aa, Cryptosporidium parvum
TTTTPSSRRFNEYDKENATHSTSP

SEQ ID NO: 2227833 - protein, 36 aa, Cryptosporidium parvum
TTTTTKATTTTTTTVPTTTTTTKRDEMTTTTTPLPD

SEQ ID NO: 2227834 - protein, 13 aa, Cryptosporidium parvum
TTTTTSTSQPTKV

SEQ ID NO: 2227835 - protein, 16 aa, Cryptosporidium parvum
TTTTTTTRKTETTSND

SEQ ID NO: 2227836 - protein, 37 aa, Cryptosporidium parvum
TTTTTTTTTTTTTTTTTTTRKTTQSTSTSTETTTSTA

SEQ ID NO: 2227837 - protein, 7 aa, Cryptosporidium parvum
TTVSNTT

SEQ ID NO: 2227838 - protein, 7 aa, Cryptosporidium parvum
TTYEEEE

SEQ ID NO: 2227839 - protein, 10 aa, Cryptosporidium parvum
TVCPSGSELS

SEQ ID NO: 2227840 - protein, 12 aa, Cryptosporidium parvum
TVDGKERSSSFG

SEQ ID NO: 2227841 - protein, 4 aa, Cryptosporidium parvum
TVDN

SEQ ID NO: 2227842 - protein, 8 aa, Cryptosporidium parvum
TVDSKKDY

SEQ ID NO: 2227843 - protein, 4 aa, Cryptosporidium parvum
TVKG

SEQ ID NO: 2227844 - protein, 5 aa, Cryptosporidium parvum
TVNIK

SEQ ID NO: 2227845 - protein, 9 aa, Cryptosporidium parvum
TVNPPSDVS

SEQ ID NO: 2227846 - protein, 7 aa, Cryptosporidium parvum
TVNSCPR

SEQ ID NO: 2227847 - protein, 12 aa, Cryptosporidium parvum
TVNSPTSTNSLS

SEQ ID NO: 2227848 - protein, 9 aa, Cryptosporidium parvum
TVNTRNQSE

SEQ ID NO: 2227849 - protein, 5 aa, Cryptosporidium parvum
TVPDY

SEQ ID NO: 2227850 - protein, 4 aa, Cryptosporidium parvum
TVPE

SEQ ID NO: 2227851 - protein, 8 aa, Cryptosporidium parvum
TVSAKDAS

SEQ ID NO: 2227852 - protein, 24 aa, Cryptosporidium parvum
TVSGSGSGSLSGAGSGSVSGSGSG

SEQ ID NO: 2227853 - protein, 23 aa, Cryptosporidium parvum
TVSGTHSNTIHQTQTNNNLPNNS

SEQ ID NO: 2227854 - protein, 9 aa, Cryptosporidium parvum
TVTISKSND

SEQ ID NO: 2227855 - protein, 32 aa, Cryptosporidium parvum
  misc_feature (17)..(17): Xaa can be any naturally occurring amino acid
TVVQGTENSNVTGSANXNSNSDNNINNNNNNN

SEQ ID NO: 2227856 - protein, 5 aa, Cryptosporidium parvum
TWDTS

SEQ ID NO: 2227857 - protein, 5 aa, Cryptosporidium parvum
TWGAS

SEQ ID NO: 2227858 - protein, 9 aa, Cryptosporidium parvum
TWKNPDDDD

SEQ ID NO: 2227859 - protein, 4 aa, Cryptosporidium parvum
TYAS

SEQ ID NO: 2227860 - protein, 14 aa, Cryptosporidium parvum
TYDPYKDKELKPLP

SEQ ID NO: 2227861 - protein, 10 aa, Cryptosporidium parvum
TYDSNADSFP

SEQ ID NO: 2227862 - protein, 4 aa, Cryptosporidium parvum
TYEQ

SEQ ID NO: 2227863 - protein, 4 aa, Cryptosporidium parvum
TYES

SEQ ID NO: 2227864 - protein, 6 aa, Cryptosporidium parvum
TYESKS

SEQ ID NO: 2227865 - protein, 11 aa, Cryptosporidium parvum
TYGLAEKTTSL

SEQ ID NO: 2227866 - protein, 15 aa, Cryptosporidium parvum
TYGNGGTINNKQKDR

SEQ ID NO: 2227867 - protein, 5 aa, Cryptosporidium parvum
TYHEE

SEQ ID NO: 2227868 - protein, 7 aa, Cryptosporidium parvum
TYKEKGI

SEQ ID NO: 2227869 - protein, 8 aa, Cryptosporidium parvum
TYKGESPN

SEQ ID NO: 2227870 - protein, 6 aa, Cryptosporidium parvum
TYNLPT

SEQ ID NO: 2227871 - protein, 11 aa, Cryptosporidium parvum
TYNTKRNFNED

SEQ ID NO: 2227872 - protein, 4 aa, Cryptosporidium parvum
TYSE

SEQ ID NO: 2227873 - protein, 12 aa, Cryptosporidium parvum
TYSEKEKSNSCE

SEQ ID NO: 2227874 - protein, 8 aa, Cryptosporidium parvum
TYSEKSTI

SEQ ID NO: 2227875 - protein, 13 aa, Cryptosporidium parvum
TYSINDNDSNFEE

SEQ ID NO: 2227876 - protein, 12 aa, Cryptosporidium parvum
TYSTKTNTPLPE

SEQ ID NO: 2227877 - protein, 5 aa, Cryptosporidium parvum
TYSVA

SEQ ID NO: 2227878 - protein, 8 aa, Cryptosporidium parvum
TYSYSSSG

SEQ ID NO: 2227879 - protein, 22 aa, Cryptosporidium parvum
TYTDKLGDDSLNKMNTQKEQLD

SEQ ID NO: 2227880 - protein, 7 aa, Cryptosporidium parvum
VAAEAAK

SEQ ID NO: 2227881 - protein, 15 aa, Cryptosporidium parvum
VAEKTKTYQKLPDDI

SEQ ID NO: 2227882 - protein, 9 aa, Cryptosporidium parvum
VAENSNSPF

SEQ ID NO: 2227883 - protein, 8 aa, Cryptosporidium parvum
VAGSYDNE

SEQ ID NO: 2227884 - protein, 10 aa, Cryptosporidium parvum
VANQISQSIE

SEQ ID NO: 2227885 - protein, 14 aa, Cryptosporidium parvum
VAPEDSFGYNDDGV

SEQ ID NO: 2227886 - protein, 6 aa, Cryptosporidium parvum
VAPQNV

SEQ ID NO: 2227887 - protein, 5 aa, Cryptosporidium parvum
VAPTI

SEQ ID NO: 2227888 - protein, 7 aa, Cryptosporidium parvum
VAQKDES

SEQ ID NO: 2227889 - protein, 16 aa, Cryptosporidium parvum
VAQNPNSARNLNSTVR

SEQ ID NO: 2227890 - protein, 11 aa, Cryptosporidium parvum
VAQNPSNIDYT

SEQ ID NO: 2227891 - protein, 17 aa, Cryptosporidium parvum
VAQNQSSSGSKHESDIH

SEQ ID NO: 2227892 - protein, 18 aa, Cryptosporidium parvum
VARSNYEKYGNPDGPTSM

SEQ ID NO: 2227893 - protein, 6 aa, Cryptosporidium parvum
VASRSA

SEQ ID NO: 2227894 - protein, 5 aa, Cryptosporidium parvum
VASST

SEQ ID NO: 2227895 - protein, 15 aa, Cryptosporidium parvum
VASTSTSSDVSSVGT

SEQ ID NO: 2227896 - protein, 10 aa, Cryptosporidium parvum
VCSNNKSKTW

SEQ ID NO: 2227897 - protein, 8 aa, Cryptosporidium parvum
VDAEEECP

SEQ ID NO: 2227898 - protein, 13 aa, Cryptosporidium parvum
VDDGSVGEDFTSS

SEQ ID NO: 2227899 - protein, 16 aa, Cryptosporidium parvum
VDEAGESLEKEAKGTI

SEQ ID NO: 2227900 - protein, 4 aa, Cryptosporidium parvum
VDEE

SEQ ID NO: 2227901 - protein, 12 aa, Cryptosporidium parvum
VDEEEEEEEEEG

SEQ ID NO: 2227902 - protein, 4 aa, Cryptosporidium parvum
VDEI

SEQ ID NO: 2227903 - protein, 10 aa, Cryptosporidium parvum
VDEKLEEGGC

SEQ ID NO: 2227904 - protein, 7 aa, Cryptosporidium parvum
VDENEDL

SEQ ID NO: 2227905 - protein, 12 aa, Cryptosporidium parvum
VDESDNDNSNLK

SEQ ID NO: 2227906 - protein, 6 aa, Cryptosporidium parvum
VDESKT

SEQ ID NO: 2227907 - protein, 15 aa, Cryptosporidium parvum
VDESVTDNDGITEEV

SEQ ID NO: 2227908 - protein, 4 aa, Cryptosporidium parvum
VDET

SEQ ID NO: 2227909 - protein, 6 aa, Cryptosporidium parvum
VDKDNV

SEQ ID NO: 2227910 - protein, 7 aa, Cryptosporidium parvum
VDNNSND

SEQ ID NO: 2227911 - protein, 27 aa, Cryptosporidium parvum
VDNNVEDSSIENETEISDQQSNSENPS

SEQ ID NO: 2227912 - protein, 11 aa, Cryptosporidium parvum
VDPATQRDSGF

SEQ ID NO: 2227913 - protein, 4 aa, Cryptosporidium parvum
VDPE

SEQ ID NO: 2227914 - protein, 14 aa, Cryptosporidium parvum
VDPKGEKLSNQEEE

SEQ ID NO: 2227915 - protein, 7 aa, Cryptosporidium parvum
VDPPDPN

SEQ ID NO: 2227916 - protein, 6 aa, Cryptosporidium parvum
VDPPYI

SEQ ID NO: 2227917 - protein, 6 aa, Cryptosporidium parvum
VDPQSY

SEQ ID NO: 2227918 - protein, 8 aa, Cryptosporidium parvum
VDPSEVPP

SEQ ID NO: 2227919 - protein, 16 aa, Cryptosporidium parvum
VDQDTDHDHDDDDVDG

SEQ ID NO: 2227920 - protein, 69 aa, Cryptosporidium parvum
VDSASEEEKNTTDTEAKTNTNSESSYSSQTNDETELKPQNSSQSEEEDGESKKLKSEMQAEESEFSSDF

SEQ ID NO: 2227921 - protein, 11 aa, Cryptosporidium parvum
VDSDNEQEDPQ

SEQ ID NO: 2227922 - protein, 9 aa, Cryptosporidium parvum
VDSKNVHNS

SEQ ID NO: 2227923 - protein, 9 aa, Cryptosporidium parvum
VDSKRLDEK

SEQ ID NO: 2227924 - protein, 13 aa, Cryptosporidium parvum
VDSNNKSSCNSDN

SEQ ID NO: 2227925 - protein, 10 aa, Cryptosporidium parvum
VDSNTRELDT

SEQ ID NO: 2227926 - protein, 9 aa, Cryptosporidium parvum
VDSSSKKPL

SEQ ID NO: 2227927 - protein, 11 aa, Cryptosporidium parvum
VDTNPSSSKVS

SEQ ID NO: 2227928 - protein, 17 aa, Cryptosporidium parvum
VDTSSASIGRRYARTDE

SEQ ID NO: 2227929 - protein, 6 aa, Cryptosporidium parvum
VDTSSM

SEQ ID NO: 2227930 - protein, 10 aa, Cryptosporidium parvum
VEARKKNAGF

SEQ ID NO: 2227931 - protein, 9 aa, Cryptosporidium parvum
VEASQTSTI

SEQ ID NO: 2227932 - protein, 7 aa, Cryptosporidium parvum
VEDGETT

SEQ ID NO: 2227933 - protein, 35 aa, Cryptosporidium parvum
VEDGSSNSNGRTFKKSSSSSSTSSSSSSIHQSEKR

SEQ ID NO: 2227934 - protein, 12 aa, Cryptosporidium parvum
VEDNADEIRVTN

SEQ ID NO: 2227935 - protein, 11 aa, Cryptosporidium parvum
VEDNKTNCKTS

SEQ ID NO: 2227936 - protein, 10 aa, Cryptosporidium parvum
VEDPNTASDY

SEQ ID NO: 2227937 - protein, 4 aa, Cryptosporidium parvum
VEDR

SEQ ID NO: 2227938 - protein, 5 aa, Cryptosporidium parvum
VEEAC

SEQ ID NO: 2227939 - protein, 43 aa, Cryptosporidium parvum
VEEKEEEEDEDEEEEEEGKENDRRKNNNKHHEKEQNEDGIENL

SEQ ID NO: 2227940 - protein, 5 aa, Cryptosporidium parvum
VEEMK

SEQ ID NO: 2227941 - protein, 7 aa, Cryptosporidium parvum
VEEPSSA

SEQ ID NO: 2227942 - protein, 41 aa, Cryptosporidium parvum
VEEQQTDNNYSNTNNNNSSNERSQTQADNKNKNQSLPTTLP

SEQ ID NO: 2227943 - protein, 11 aa, Cryptosporidium parvum
VEESSGHSDPT

SEQ ID NO: 2227944 - protein, 6 aa, Cryptosporidium parvum
VEETDD

SEQ ID NO: 2227945 - protein, 14 aa, Cryptosporidium parvum
VEGASQRVQEDTAR

SEQ ID NO: 2227946 - protein, 4 aa, Cryptosporidium parvum
VEGD

SEQ ID NO: 2227947 - protein, 20 aa, Cryptosporidium parvum
VEGEGEGEEVPPPPESSSNI

SEQ ID NO: 2227948 - protein, 12 aa, Cryptosporidium parvum
VEGESSNNDTNL

SEQ ID NO: 2227949 - protein, 8 aa, Cryptosporidium parvum
VEGNNSSK

SEQ ID NO: 2227950 - protein, 8 aa, Cryptosporidium parvum
VEGQNYDN

SEQ ID NO: 2227951 - protein, 8 aa, Cryptosporidium parvum
VEIPPPKI

SEQ ID NO: 2227952 - protein, 6 aa, Cryptosporidium parvum
VEISHG

SEQ ID NO: 2227953 - protein, 28 aa, Cryptosporidium parvum
VEKEPGEDEDEDGDGNEDGENEKDEITR

SEQ ID NO: 2227954 - protein, 25 aa, Cryptosporidium parvum
VEKNTNTNLKDINTEKKIKYGNSGG

SEQ ID NO: 2227955 - protein, 9 aa, Cryptosporidium parvum
VEKPSSNLE

SEQ ID NO: 2227956 - protein, 7 aa, Cryptosporidium parvum
VEKQNIS

SEQ ID NO: 2227957 - protein, 7 aa, Cryptosporidium parvum
VENERNN

SEQ ID NO: 2227958 - protein, 8 aa, Cryptosporidium parvum
VENGEDEF

SEQ ID NO: 2227959 - protein, 15 aa, Cryptosporidium parvum
VENGYIDKDTTLSLS

SEQ ID NO: 2227960 - protein, 14 aa, Cryptosporidium parvum
VENLTKPQETNTSY

SEQ ID NO: 2227961 - protein, 11 aa, Cryptosporidium parvum
VENNMDQETQH

SEQ ID NO: 2227962 - protein, 8 aa, Cryptosporidium parvum
VENQRNVK

SEQ ID NO: 2227963 - protein, 11 aa, Cryptosporidium parvum
VENRESSLQEA

SEQ ID NO: 2227964 - protein, 6 aa, Cryptosporidium parvum
VENTTD

SEQ ID NO: 2227965 - protein, 9 aa, Cryptosporidium parvum
VEPNSKFTE

SEQ ID NO: 2227966 - protein, 7 aa, Cryptosporidium parvum
VEQASPS

SEQ ID NO: 2227967 - protein, 17 aa, Cryptosporidium parvum
VEQKNERRSNLEESESL

SEQ ID NO: 2227968 - protein, 16 aa, Cryptosporidium parvum
VERKKSSLKEGSNNSA

SEQ ID NO: 2227969 - protein, 17 aa, Cryptosporidium parvum
VERSNYKETQTSNSIGG

SEQ ID NO: 2227970 - protein, 6 aa, Cryptosporidium parvum
VESGDE

SEQ ID NO: 2227971 - protein, 33 aa, Cryptosporidium parvum
VESKKDDYETIGEDGKGVEKAENTLEEEEKGVG

SEQ ID NO: 2227972 - protein, 19 aa, Cryptosporidium parvum
VESKRKSRRRAASNTKKIS

SEQ ID NO: 2227973 - protein, 4 aa, Cryptosporidium parvum
VESL

SEQ ID NO: 2227974 - protein, 4 aa, Cryptosporidium parvum
VESR

SEQ ID NO: 2227975 - protein, 8 aa, Cryptosporidium parvum
VESRSSRG

SEQ ID NO: 2227976 - protein, 8 aa, Cryptosporidium parvum
VESSADSA

SEQ ID NO: 2227977 - protein, 7 aa, Cryptosporidium parvum
VESSDNR

SEQ ID NO: 2227978 - protein, 110 aa, Cryptosporidium parvum
VESSGKVADVPSEATALGEGYVGSGKNITTEATRQGPSTNIKQKSLKKAASSSRDKSKRKSSRTDDSALKKVSRESNKGEGLESPKSARLGSSRGDNPKTTKHKKHKQYK

SEQ ID NO: 2227979 - protein, 11 aa, Cryptosporidium parvum
VESTKKKSIEI

SEQ ID NO: 2227980 - protein, 9 aa, Cryptosporidium parvum
VETFSGQSR

SEQ ID NO: 2227981 - protein, 13 aa, Cryptosporidium parvum
VETGGSKIDGQEG

SEQ ID NO: 2227982 - protein, 7 aa, Cryptosporidium parvum
VEWSGSY

SEQ ID NO: 2227983 - protein, 12 aa, Cryptosporidium parvum
VEYDSPQNLLSN

SEQ ID NO: 2227984 - protein, 17 aa, Cryptosporidium parvum
VFEEKKEEEEEEDESET

SEQ ID NO: 2227985 - protein, 10 aa, Cryptosporidium parvum
VFGSTQSEPC

SEQ ID NO: 2227986 - protein, 8 aa, Cryptosporidium parvum
VFTGDSGG

SEQ ID NO: 2227987 - protein, 14 aa, Cryptosporidium parvum
VGAPQNINKANPNV

SEQ ID NO: 2227988 - protein, 14 aa, Cryptosporidium parvum
VGDPMEKSIKKKSS

SEQ ID NO: 2227989 - protein, 8 aa, Cryptosporidium parvum
VGEDEPRT

SEQ ID NO: 2227990 - protein, 13 aa, Cryptosporidium parvum
VGEELEDDIENET

SEQ ID NO: 2227991 - protein, 26 aa, Cryptosporidium parvum
VGETEHLGSTQLDDEGNLRQKSGTEI

SEQ ID NO: 2227992 - protein, 10 aa, Cryptosporidium parvum
VGGGGGVSEE

SEQ ID NO: 2227993 - protein, 4 aa, Cryptosporidium parvum
VGGI

SEQ ID NO: 2227994 - protein, 10 aa, Cryptosporidium parvum
VGGSERNNPY

SEQ ID NO: 2227995 - protein, 10 aa, Cryptosporidium parvum
VGGSGPSAGI

SEQ ID NO: 2227996 - protein, 10 aa, Cryptosporidium parvum
VGKEEKKTRM

SEQ ID NO: 2227997 - protein, 8 aa, Cryptosporidium parvum
VGKGSTLS

SEQ ID NO: 2227998 - protein, 10 aa, Cryptosporidium parvum
VGKPAEVSNQ

SEQ ID NO: 2227999 - protein, 8 aa, Cryptosporidium parvum
VGKPQDYD

SEQ ID NO: 2228000 - protein, 11 aa, Cryptosporidium parvum
VGKTNEKIYTR

SEQ ID NO: 2228001 - protein, 7 aa, Cryptosporidium parvum
VGNGSGD

SEQ ID NO: 2228002 - protein, 7 aa, Cryptosporidium parvum
VGNPTAL

SEQ ID NO: 2228003 - protein, 8 aa, Cryptosporidium parvum
VGNSKKEK

SEQ ID NO: 2228004 - protein, 4 aa, Cryptosporidium parvum
VGNT

SEQ ID NO: 2228005 - protein, 9 aa, Cryptosporidium parvum
VGPAARGLT

SEQ ID NO: 2228006 - protein, 29 aa, Cryptosporidium parvum
VGPGPSGDKNLDGEHTENETLKSSKREEY

SEQ ID NO: 2228007 - protein, 5 aa, Cryptosporidium parvum
VGPGV

SEQ ID NO: 2228008 - protein, 9 aa, Cryptosporidium parvum
VGPNKQRTE

SEQ ID NO: 2228009 - protein, 5 aa, Cryptosporidium parvum
VGPWS

SEQ ID NO: 2228010 - protein, 9 aa, Cryptosporidium parvum
VGPYDQEKT

SEQ ID NO: 2228011 - protein, 11 aa, Cryptosporidium parvum
VGQAGNPRKIT

SEQ ID NO: 2228012 - protein, 6 aa, Cryptosporidium parvum
VGQNKR

SEQ ID NO: 2228013 - protein, 24 aa, Cryptosporidium parvum
VGQNSSQSTSSSYAGSNSGMTNNF

SEQ ID NO: 2228014 - protein, 7 aa, Cryptosporidium parvum
VGQVSSQ

SEQ ID NO: 2228015 - protein, 27 aa, Cryptosporidium parvum
VGSADNSAEKFEEVASNKTSTIAPAEV

SEQ ID NO: 2228016 - protein, 17 aa, Cryptosporidium parvum
VGSCTGEEAQGTKHTTI

SEQ ID NO: 2228017 - protein, 5 aa, Cryptosporidium parvum
VGSGQ

SEQ ID NO: 2228018 - protein, 7 aa, Cryptosporidium parvum
VGSGSRS

SEQ ID NO: 2228019 - protein, 21 aa, Cryptosporidium parvum
VGSKEFSQSELPKHTQNGNSK

SEQ ID NO: 2228020 - protein, 7 aa, Cryptosporidium parvum
VGSKNEK

SEQ ID NO: 2228021 - protein, 6 aa, Cryptosporidium parvum
VGSSGG

SEQ ID NO: 2228022 - protein, 8 aa, Cryptosporidium parvum
VGSSSPLM

SEQ ID NO: 2228023 - protein, 4 aa, Cryptosporidium parvum
VGST

SEQ ID NO: 2228024 - protein, 10 aa, Cryptosporidium parvum
VGSTSNSKIP

SEQ ID NO: 2228025 - protein, 24 aa, Cryptosporidium parvum
VGTNTGNIESEGVTGSSPNSSTYS

SEQ ID NO: 2228026 - protein, 6 aa, Cryptosporidium parvum
VGTPPR

SEQ ID NO: 2228027 - protein, 4 aa, Cryptosporidium parvum
VGTY

SEQ ID NO: 2228028 - protein, 8 aa, Cryptosporidium parvum
VGVPGKAA

SEQ ID NO: 2228029 - protein, 7 aa, Cryptosporidium parvum
VGVSPSP

SEQ ID NO: 2228030 - protein, 9 aa, Cryptosporidium parvum
VGYSSPPES

SEQ ID NO: 2228031 - protein, 5 aa, Cryptosporidium parvum
VHGEE

SEQ ID NO: 2228032 - protein, 8 aa, Cryptosporidium parvum
VHNNQDEC

SEQ ID NO: 2228033 - protein, 17 aa, Cryptosporidium parvum
VHRGPVTTNVNNTNPSQ

SEQ ID NO: 2228034 - protein, 9 aa, Cryptosporidium parvum
VHSKNESIT

SEQ ID NO: 2228035 - protein, 4 aa, Cryptosporidium parvum
VHSS

SEQ ID NO: 2228036 - protein, 8 aa, Cryptosporidium parvum
VIDPSGGN

SEQ ID NO: 2228037 - protein, 28 aa, Cryptosporidium parvum
VIEGNEKGNDHSSLPINKPNDPNKKSKI

SEQ ID NO: 2228038 - protein, 19 aa, Cryptosporidium parvum
VISKKNNKYDSKGYEKNNN

SEQ ID NO: 2228039 - protein, 18 aa, Cryptosporidium parvum
VISRENNSSPFRKLNTQK

SEQ ID NO: 2228040 - protein, 14 aa, Cryptosporidium parvum
VITGGTGAGVGVGT

SEQ ID NO: 2228041 - protein, 11 aa, Cryptosporidium parvum
VITNDDEGTHH

SEQ ID NO: 2228042 - protein, 5 aa, Cryptosporidium parvum
VKARG

SEQ ID NO: 2228043 - protein, 106 aa, Cryptosporidium parvum
VKDSKSEEGGDEGKEEKKEKEEKKEKDEKKEKDEKKEKDEKDKKSEDKESEDKKEEVKNEDKEKKNENKEEKSESNEENKETGENTDEKHIKEEEDSTSTSNKRSI

SEQ ID NO: 2228044 - protein, 6 aa, Cryptosporidium parvum
VKEEKE

SEQ ID NO: 2228045 - protein, 5 aa, Cryptosporidium parvum
VKEFD

SEQ ID NO: 2228046 - protein, 12 aa, Cryptosporidium parvum
VKEQLSKTAFGD

SEQ ID NO: 2228047 - protein, 12 aa, Cryptosporidium parvum
VKETTGLNSEKI

SEQ ID NO: 2228048 - protein, 14 aa, Cryptosporidium parvum
VKGGLKKDYLDSND

SEQ ID NO: 2228049 - protein, 11 aa, Cryptosporidium parvum
VKGNDGKIIEN

SEQ ID NO: 2228050 - protein, 9 aa, Cryptosporidium parvum
VKGPSQDSC

SEQ ID NO: 2228051 - protein, 12 aa, Cryptosporidium parvum
VKKNSNSLTGNN

SEQ ID NO: 2228052 - protein, 9 aa, Cryptosporidium parvum
VKLNNNNEQ

SEQ ID NO: 2228053 - protein, 12 aa, Cryptosporidium parvum
VKNDNSGNSFNK

SEQ ID NO: 2228054 - protein, 8 aa, Cryptosporidium parvum
VKPEQKAN

SEQ ID NO: 2228055 - protein, 33 aa, Cryptosporidium parvum
VKPQKNATKTNKKPNKSKNSYINKKKQTKKHKK

SEQ ID NO: 2228056 - protein, 9 aa, Cryptosporidium parvum
VKPRGEKGF

SEQ ID NO: 2228057 - protein, 7 aa, Cryptosporidium parvum
VKQSYPE

SEQ ID NO: 2228058 - protein, 9 aa, Cryptosporidium parvum
VKRRETREA

SEQ ID NO: 2228059 - protein, 5 aa, Cryptosporidium parvum
VKRRK

SEQ ID NO: 2228060 - protein, 6 aa, Cryptosporidium parvum
VKSDGT

SEQ ID NO: 2228061 - protein, 7 aa, Cryptosporidium parvum
VKSDPEM

SEQ ID NO: 2228062 - protein, 9 aa, Cryptosporidium parvum
VKTINGPFK

SEQ ID NO: 2228063 - protein, 8 aa, Cryptosporidium parvum
VKTPKEFE

SEQ ID NO: 2228064 - protein, 10 aa, Cryptosporidium parvum
VKTSQNKSNF

SEQ ID NO: 2228065 - protein, 8 aa, Cryptosporidium parvum
VKVNTNNP

SEQ ID NO: 2228066 - protein, 8 aa, Cryptosporidium parvum
VLEDETES

SEQ ID NO: 2228067 - protein, 12 aa, Cryptosporidium parvum
VLENTKDHKFSN

SEQ ID NO: 2228068 - protein, 10 aa, Cryptosporidium parvum
VLGGSSENSY

SEQ ID NO: 2228069 - protein, 22 aa, Cryptosporidium parvum
VLNPKSNKFCEANKDNNNNSNS

SEQ ID NO: 2228070 - protein, 7 aa, Cryptosporidium parvum
VLPNSSK

SEQ ID NO: 2228071 - protein, 11 aa, Cryptosporidium parvum
VLQGKSPYTRH

SEQ ID NO: 2228072 - protein, 30 aa, Cryptosporidium parvum
VMDGREEKEEEEKKKEEKEAEGEGEEGRGS

SEQ ID NO: 2228073 - protein, 14 aa, Cryptosporidium parvum
VMSPKNKKSKQIKT

SEQ ID NO: 2228074 - protein, 8 aa, Cryptosporidium parvum
VNAKDVPR

SEQ ID NO: 2228075 - protein, 6 aa, Cryptosporidium parvum
VNATDD

SEQ ID NO: 2228076 - protein, 10 aa, Cryptosporidium parvum
VNDHGTSSRV

SEQ ID NO: 2228077 - protein, 7 aa, Cryptosporidium parvum
VNDNTKL

SEQ ID NO: 2228078 - protein, 4 aa, Cryptosporidium parvum
VNDP

SEQ ID NO: 2228079 - protein, 8 aa, Cryptosporidium parvum
VNDSEDHA

SEQ ID NO: 2228080 - protein, 13 aa, Cryptosporidium parvum
VNDSGKNQHNDIK

SEQ ID NO: 2228081 - protein, 23 aa, Cryptosporidium parvum
VNEEDGNIVGGTTGNGTEVESKR

SEQ ID NO: 2228082 - protein, 5 aa, Cryptosporidium parvum
VNEGF

SEQ ID NO: 2228083 - protein, 18 aa, Cryptosporidium parvum
VNEKGNTQFSKKSGYVTQ

SEQ ID NO: 2228084 - protein, 23 aa, Cryptosporidium parvum
VNEPLSSSAVGTSSNASQGVPTS

SEQ ID NO: 2228085 - protein, 14 aa, Cryptosporidium parvum
VNETPTNQIRNSDS

SEQ ID NO: 2228086 - protein, 9 aa, Cryptosporidium parvum
VNEVSNSSV

SEQ ID NO: 2228087 - protein, 9 aa, Cryptosporidium parvum
VNGEKGNEF

SEQ ID NO: 2228088 - protein, 8 aa, Cryptosporidium parvum
VNGNESIK

SEQ ID NO: 2228089 - protein, 7 aa, Cryptosporidium parvum
VNGNGID

SEQ ID NO: 2228090 - protein, 18 aa, Cryptosporidium parvum
VNGNRENENSDEESDPMN

SEQ ID NO: 2228091 - protein, 6 aa, Cryptosporidium parvum
VNGNYS

SEQ ID NO: 2228092 - protein, 70 aa, Cryptosporidium parvum
VNGPGQAPGVASHQVSTSGRLIPPSSSMDGQRYSNASSNASSMNGVGVGGGGVSGSSSGLPSNENSISGT

SEQ ID NO: 2228093 - protein, 20 aa, Cryptosporidium parvum
VNGSNNGNGLSSSVQTSRIK

SEQ ID NO: 2228094 - protein, 4 aa, Cryptosporidium parvum
VNIE

SEQ ID NO: 2228095 - protein, 29 aa, Cryptosporidium parvum
VNKETNDTKNGNSSNNNNKSNSDIGPGTT

SEQ ID NO: 2228096 - protein, 10 aa, Cryptosporidium parvum
VNKLDKKQFE

SEQ ID NO: 2228097 - protein, 5 aa, Cryptosporidium parvum
VNKNI

SEQ ID NO: 2228098 - protein, 6 aa, Cryptosporidium parvum
VNKQEA

SEQ ID NO: 2228099 - protein, 10 aa, Cryptosporidium parvum
VNKSKKQQSM

SEQ ID NO: 2228100 - protein, 18 aa, Cryptosporidium parvum
VNKSSGGQKGSNKGEIEQ

SEQ ID NO: 2228101 - protein, 11 aa, Cryptosporidium parvum
VNKTNKMDEKG

SEQ ID NO: 2228102 - protein, 8 aa, Cryptosporidium parvum
VNLEEGSK

SEQ ID NO: 2228103 - protein, 6 aa, Cryptosporidium parvum
VNLSEN

SEQ ID NO: 2228104 - protein, 8 aa, Cryptosporidium parvum
VNNDNSTY

SEQ ID NO: 2228105 - protein, 6 aa, Cryptosporidium parvum
VNNDQL

SEQ ID NO: 2228106 - protein, 8 aa, Cryptosporidium parvum
VNNEKLDR

SEQ ID NO: 2228107 - protein, 10 aa, Cryptosporidium parvum
VNNKPKFSEK

SEQ ID NO: 2228108 - protein, 9 aa, Cryptosporidium parvum
VNNNESSID

SEQ ID NO: 2228109 - protein, 8 aa, Cryptosporidium parvum
VNNNNNLD

SEQ ID NO: 2228110 - protein, 6 aa, Cryptosporidium parvum
VNNNQS

SEQ ID NO: 2228111 - protein, 4 aa, Cryptosporidium parvum
VNNQ

SEQ ID NO: 2228112 - protein, 7 aa, Cryptosporidium parvum
VNNQFTK

SEQ ID NO: 2228113 - protein, 5 aa, Cryptosporidium parvum
VNNSN

SEQ ID NO: 2228114 - protein, 7 aa, Cryptosporidium parvum
VNNTSEH

SEQ ID NO: 2228115 - protein, 5 aa, Cryptosporidium parvum
VNPNL

SEQ ID NO: 2228116 - protein, 7 aa, Cryptosporidium parvum
VNQEERI

SEQ ID NO: 2228117 - protein, 12 aa, Cryptosporidium parvum
VNQEHEKNIPNK

SEQ ID NO: 2228118 - protein, 6 aa, Cryptosporidium parvum
VNQENY

SEQ ID NO: 2228119 - protein, 17 aa, Cryptosporidium parvum
VNQKNYKNDKSVFSSFL

SEQ ID NO: 2228120 - protein, 10 aa, Cryptosporidium parvum
VNRNERKKSE

SEQ ID NO: 2228121 - protein, 7 aa, Cryptosporidium parvum
VNRNGNT

SEQ ID NO: 2228122 - protein, 7 aa, Cryptosporidium parvum
VNRNKKE

SEQ ID NO: 2228123 - protein, 18 aa, Cryptosporidium parvum
VNSDRRTRSKNVNNDLPN

SEQ ID NO: 2228124 - protein, 10 aa, Cryptosporidium parvum
VNSDSTENNV

SEQ ID NO: 2228125 - protein, 6 aa, Cryptosporidium parvum
VNSEEA

SEQ ID NO: 2228126 - protein, 7 aa, Cryptosporidium parvum
VNSEENS

SEQ ID NO: 2228127 - protein, 13 aa, Cryptosporidium parvum
VNSGSAQHTPKQI

SEQ ID NO: 2228128 - protein, 6 aa, Cryptosporidium parvum
VNSHVN

SEQ ID NO: 2228129 - protein, 10 aa, Cryptosporidium parvum
VNSLNTSNGM

SEQ ID NO: 2228130 - protein, 9 aa, Cryptosporidium parvum
VNSNNGNSL

SEQ ID NO: 2228131 - protein, 9 aa, Cryptosporidium parvum
VNSNQKNYE

SEQ ID NO: 2228132 - protein, 14 aa, Cryptosporidium parvum
VNSPISSQVSGTQC

SEQ ID NO: 2228133 - protein, 14 aa, Cryptosporidium parvum
VNSPNSKSNNRENC

SEQ ID NO: 2228134 - protein, 15 aa, Cryptosporidium parvum
VNSPRNELKEESESI

SEQ ID NO: 2228135 - protein, 8 aa, Cryptosporidium parvum
VNSRPRGS

SEQ ID NO: 2228136 - protein, 10 aa, Cryptosporidium parvum
VNSSPEGRSC

SEQ ID NO: 2228137 - protein, 14 aa, Cryptosporidium parvum
VNSTKSISSNSGAF

SEQ ID NO: 2228138 - protein, 14 aa, Cryptosporidium parvum
VNSTNPHKDSSSEH

SEQ ID NO: 2228139 - protein, 16 aa, Cryptosporidium parvum
VNTASRMKSSCETGKI

SEQ ID NO: 2228140 - protein, 4 aa, Cryptosporidium parvum
VNTD

SEQ ID NO: 2228141 - protein, 10 aa, Cryptosporidium parvum
VNTEQKNQEI

SEQ ID NO: 2228142 - protein, 11 aa, Cryptosporidium parvum
VNTGKSSNFKN

SEQ ID NO: 2228143 - protein, 46 aa, Cryptosporidium parvum
VNTGNDSVATTKDYQKSVTRDTTDSTKKPTDNQGDHDNDDEDDQES

SEQ ID NO: 2228144 - protein, 6 aa, Cryptosporidium parvum
VNTINT

SEQ ID NO: 2228145 - protein, 5 aa, Cryptosporidium parvum
VNTNN

SEQ ID NO: 2228146 - protein, 8 aa, Cryptosporidium parvum
VNTPGPSN

SEQ ID NO: 2228147 - protein, 10 aa, Cryptosporidium parvum
VNTQEYGRRP

SEQ ID NO: 2228148 - protein, 7 aa, Cryptosporidium parvum
VNTYGPN

SEQ ID NO: 2228149 - protein, 5 aa, Cryptosporidium parvum
VNVNT

SEQ ID NO: 2228150 - protein, 19 aa, Cryptosporidium parvum
VNVTNQSSNFTSYSSSVSK

SEQ ID NO: 2228151 - protein, 5 aa, Cryptosporidium parvum
VNYAG

SEQ ID NO: 2228152 - protein, 8 aa, Cryptosporidium parvum
VNYSRPNK

SEQ ID NO: 2228153 - protein, 43 aa, Cryptosporidium parvum
VPASAQTPVPTPAPAPAPAPAPNSIQTRLSSNGNISKSSGMNN

SEQ ID NO: 2228154 - protein, 10 aa, Cryptosporidium parvum
VPDSNRQTGV

SEQ ID NO: 2228155 - protein, 5 aa, Cryptosporidium parvum
VPENE

SEQ ID NO: 2228156 - protein, 5 aa, Cryptosporidium parvum
VPENS

SEQ ID NO: 2228157 - protein, 7 aa, Cryptosporidium parvum
VPEYNDA

SEQ ID NO: 2228158 - protein, 6 aa, Cryptosporidium parvum
VPGDAS

SEQ ID NO: 2228159 - protein, 4 aa, Cryptosporidium parvum
VPGK

SEQ ID NO: 2228160 - protein, 5 aa, Cryptosporidium parvum
VPGPG

SEQ ID NO: 2228161 - protein, 6 aa, Cryptosporidium parvum
VPGPKN

SEQ ID NO: 2228162 - protein, 8 aa, Cryptosporidium parvum
VPGVKNPI

SEQ ID NO: 2228163 - protein, 7 aa, Cryptosporidium parvum
VPIEPNT

SEQ ID NO: 2228164 - protein, 12 aa, Cryptosporidium parvum
VPKDADDAAIKK

SEQ ID NO: 2228165 - protein, 7 aa, Cryptosporidium parvum
VPKDAKV

SEQ ID NO: 2228166 - protein, 12 aa, Cryptosporidium parvum
VPKNKGDDYENG

SEQ ID NO: 2228167 - protein, 11 aa, Cryptosporidium parvum
VPKPQKNNVPK

SEQ ID NO: 2228168 - protein, 8 aa, Cryptosporidium parvum
VPKSETNS

SEQ ID NO: 2228169 - protein, 9 aa, Cryptosporidium parvum
VPKSPESKL

SEQ ID NO: 2228170 - protein, 18 aa, Cryptosporidium parvum
VPLSGQSLDSFPKPKGRY

SEQ ID NO: 2228171 - protein, 5 aa, Cryptosporidium parvum
VPNIS

SEQ ID NO: 2228172 - protein, 14 aa, Cryptosporidium parvum
VPNISSNIKSPNNN

SEQ ID NO: 2228173 - protein, 10 aa, Cryptosporidium parvum
VPNVSASRKA

SEQ ID NO: 2228174 - protein, 8 aa, Cryptosporidium parvum
VPPDDEPL

SEQ ID NO: 2228175 - protein, 4 aa, Cryptosporidium parvum
VPPQ

SEQ ID NO: 2228176 - protein, 11 aa, Cryptosporidium parvum
VPPRPKKSPIM

SEQ ID NO: 2228177 - protein, 10 aa, Cryptosporidium parvum
VPPSEKCRKY

SEQ ID NO: 2228178 - protein, 6 aa, Cryptosporidium parvum
VPPTSA

SEQ ID NO: 2228179 - protein, 10 aa, Cryptosporidium parvum
VPRGSPPELR

SEQ ID NO: 2228180 - protein, 9 aa, Cryptosporidium parvum
VPRTSRAQT

SEQ ID NO: 2228181 - protein, 8 aa, Cryptosporidium parvum
VPRTTRAQ

SEQ ID NO: 2228182 - protein, 5 aa, Cryptosporidium parvum
VPSEH

SEQ ID NO: 2228183 - protein, 15 aa, Cryptosporidium parvum
VPSEIQKSQENEELE

SEQ ID NO: 2228184 - protein, 5 aa, Cryptosporidium parvum
VPSGD

SEQ ID NO: 2228185 - protein, 7 aa, Cryptosporidium parvum
VPSGQNC

SEQ ID NO: 2228186 - protein, 5 aa, Cryptosporidium parvum
VPSTR

SEQ ID NO: 2228187 - protein, 7 aa, Cryptosporidium parvum
VPSTSLN

SEQ ID NO: 2228188 - protein, 9 aa, Cryptosporidium parvum
VPTLEDSNK

SEQ ID NO: 2228189 - protein, 4 aa, Cryptosporidium parvum
VPTT

SEQ ID NO: 2228190 - protein, 95 aa, Cryptosporidium parvum
VPVEGSSSSSSSSSSSSSSSSSTSTVAPANKARTGEDAEGSQDSSGTEASGSQGSEEEGSEDDGQTSAASQPTTPAQSEGATTETIEATPKEECG

SEQ ID NO: 2228191 - protein, 9 aa, Cryptosporidium parvum
VQDDGPDSS

SEQ ID NO: 2228192 - protein, 8 aa, Cryptosporidium parvum
VQDVSPEI

SEQ ID NO: 2228193 - protein, 12 aa, Cryptosporidium parvum
VQEIGPESQNWA

SEQ ID NO: 2228194 - protein, 12 aa, Cryptosporidium parvum
VQGAPDAVTLIK

SEQ ID NO: 2228195 - protein, 4 aa, Cryptosporidium parvum
VQHN

SEQ ID NO: 2228196 - protein, 16 aa, Cryptosporidium parvum
VQKASESTEDTPLGKK

SEQ ID NO: 2228197 - protein, 10 aa, Cryptosporidium parvum
VQNEKDGARL

SEQ ID NO: 2228198 - protein, 14 aa, Cryptosporidium parvum
VQNKKKEADEEPKM

SEQ ID NO: 2228199 - protein, 37 aa, Cryptosporidium parvum
VQNKNEQGLSKSINNDTNSNQINQESVTNDMAQNKED

SEQ ID NO: 2228200 - protein, 31 aa, Cryptosporidium parvum
VQPKKNQTQENAEYYKKQKKKSEKKRGKKKL

SEQ ID NO: 2228201 - protein, 4 aa, Cryptosporidium parvum
VQQI

SEQ ID NO: 2228202 - protein, 9 aa, Cryptosporidium parvum
VQQQGKGCP

SEQ ID NO: 2228203 - protein, 4 aa, Cryptosporidium parvum
VQRR

SEQ ID NO: 2228204 - protein, 5 aa, Cryptosporidium parvum
VQSPE

SEQ ID NO: 2228205 - protein, 5 aa, Cryptosporidium parvum
VQSPT

SEQ ID NO: 2228206 - protein, 11 aa, Cryptosporidium parvum
VQSSEINERYK

SEQ ID NO: 2228207 - protein, 19 aa, Cryptosporidium parvum
VQTDGKYGRIAKRSSDSTP

SEQ ID NO: 2228208 - protein, 5 aa, Cryptosporidium parvum
VRAAS

SEQ ID NO: 2228209 - protein, 8 aa, Cryptosporidium parvum
VRAPNSNV

SEQ ID NO: 2228210 - protein, 10 aa, Cryptosporidium parvum
VRDDSQAKEE

SEQ ID NO: 2228211 - protein, 7 aa, Cryptosporidium parvum
VRDEDLT

SEQ ID NO: 2228212 - protein, 21 aa, Cryptosporidium parvum
VRDFGTPGKYTNEKKYESNEL

SEQ ID NO: 2228213 - protein, 6 aa, Cryptosporidium parvum
VRDSRS

SEQ ID NO: 2228214 - protein, 10 aa, Cryptosporidium parvum
VREMETSRQP

SEQ ID NO: 2228215 - protein, 5 aa, Cryptosporidium parvum
VRERQ

SEQ ID NO: 2228216 - protein, 46 aa, Cryptosporidium parvum
VREVSTEEVSKVNEENRKGRKRQQKEKGSSELWGPKTVPKSKNRYI

SEQ ID NO: 2228217 - protein, 4 aa, Cryptosporidium parvum
VRIP

SEQ ID NO: 2228218 - protein, 9 aa, Cryptosporidium parvum
VRKTGPLRD

SEQ ID NO: 2228219 - protein, 4 aa, Cryptosporidium parvum
VRNM

SEQ ID NO: 2228220 - protein, 6 aa, Cryptosporidium parvum
VRNNKD

SEQ ID NO: 2228221 - protein, 7 aa, Cryptosporidium parvum
VRNSLPG

SEQ ID NO: 2228222 - protein, 4 aa, Cryptosporidium parvum
VRPE

SEQ ID NO: 2228223 - protein, 32 aa, Cryptosporidium parvum
VRSDNTSSQMPSSNHSQMNTSPSTIVQPPEPV

SEQ ID NO: 2228224 - protein, 13 aa, Cryptosporidium parvum
VRTPNNDSFSNNV

SEQ ID NO: 2228225 - protein, 7 aa, Cryptosporidium parvum
VSAPESS

SEQ ID NO: 2228226 - protein, 19 aa, Cryptosporidium parvum
VSASSETEIPPAASVPRES

SEQ ID NO: 2228227 - protein, 8 aa, Cryptosporidium parvum
VSDENGLE

SEQ ID NO: 2228228 - protein, 9 aa, Cryptosporidium parvum
VSDEPSTTT

SEQ ID NO: 2228229 - protein, 22 aa, Cryptosporidium parvum
VSDNCSDFTNEKSLSGSPNSND

SEQ ID NO: 2228230 - protein, 7 aa, Cryptosporidium parvum
VSDNEES

SEQ ID NO: 2228231 - protein, 10 aa, Cryptosporidium parvum
VSDNPEIDSE

SEQ ID NO: 2228232 - protein, 6 aa, Cryptosporidium parvum
VSDPPV

SEQ ID NO: 2228233 - protein, 10 aa, Cryptosporidium parvum
VSDQNEVNGS

SEQ ID NO: 2228234 - protein, 4 aa, Cryptosporidium parvum
VSDS

SEQ ID NO: 2228235 - protein, 5 aa, Cryptosporidium parvum
VSEDS

SEQ ID NO: 2228236 - protein, 6 aa, Cryptosporidium parvum
VSESTD

SEQ ID NO: 2228237 - protein, 15 aa, Cryptosporidium parvum
VSETEFDEENYNSKY

SEQ ID NO: 2228238 - protein, 6 aa, Cryptosporidium parvum
VSETEL

SEQ ID NO: 2228239 - protein, 5 aa, Cryptosporidium parvum
VSFGE

SEQ ID NO: 2228240 - protein, 7 aa, Cryptosporidium parvum
VSGEDAT

SEQ ID NO: 2228241 - protein, 27 aa, Cryptosporidium parvum
VSGFPENNYYSNNPSMSYSQNGHLSGQ

SEQ ID NO: 2228242 - protein, 15 aa, Cryptosporidium parvum
VSGPQIDLPMMNQQG

SEQ ID NO: 2228243 - protein, 4 aa, Cryptosporidium parvum
VSGQ

SEQ ID NO: 2228244 - protein, 9 aa, Cryptosporidium parvum
VSGSAYPNY

SEQ ID NO: 2228245 - protein, 10 aa, Cryptosporidium parvum
VSGSQLGMSP

SEQ ID NO: 2228246 - protein, 5 aa, Cryptosporidium parvum
VSIPS

SEQ ID NO: 2228247 - protein, 19 aa, Cryptosporidium parvum
VSISNQVGGSFSSKSEESI

SEQ ID NO: 2228248 - protein, 20 aa, Cryptosporidium parvum
VSITGTGHSTTNSTNTGVIS

SEQ ID NO: 2228249 - protein, 6 aa, Cryptosporidium parvum
VSKDEI

SEQ ID NO: 2228250 - protein, 11 aa, Cryptosporidium parvum
VSKDVEEDLKE

SEQ ID NO: 2228251 - protein, 25 aa, Cryptosporidium parvum
VSKNAQSSNKEDEDKDEAEKNYKYT

SEQ ID NO: 2228252 - protein, 5 aa, Cryptosporidium parvum
VSKNQ

SEQ ID NO: 2228253 - protein, 24 aa, Cryptosporidium parvum
VSLGSDSKDSLSISDSSDQTDSSS

SEQ ID NO: 2228254 - protein, 14 aa, Cryptosporidium parvum
VSNETKRKTSNSSH

SEQ ID NO: 2228255 - protein, 9 aa, Cryptosporidium parvum
VSNKSPLKP

SEQ ID NO: 2228256 - protein, 18 aa, Cryptosporidium parvum
VSNNFGSDKFPAISNRAK

SEQ ID NO: 2228257 - protein, 8 aa, Cryptosporidium parvum
VSNNKSIR

SEQ ID NO: 2228258 - protein, 11 aa, Cryptosporidium parvum
VSNNSNGNPNW

SEQ ID NO: 2228259 - protein, 6 aa, Cryptosporidium parvum
VSNPDH

SEQ ID NO: 2228260 - protein, 7 aa, Cryptosporidium parvum
VSNPDTD

SEQ ID NO: 2228261 - protein, 20 aa, Cryptosporidium parvum
VSNPGYIGGGSTGTIGGNNS

SEQ ID NO: 2228262 - protein, 7 aa, Cryptosporidium parvum
VSNPSVT

SEQ ID NO: 2228263 - protein, 5 aa, Cryptosporidium parvum
VSNQG

SEQ ID NO: 2228264 - protein, 7 aa, Cryptosporidium parvum
VSNQNNK

SEQ ID NO: 2228265 - protein, 18 aa, Cryptosporidium parvum
VSNQNNRPKFTRSDVYNG

SEQ ID NO: 2228266 - protein, 4 aa, Cryptosporidium parvum
VSNR

SEQ ID NO: 2228267 - protein, 9 aa, Cryptosporidium parvum
VSNSELRSS

SEQ ID NO: 2228268 - protein, 7 aa, Cryptosporidium parvum
VSNSENM

SEQ ID NO: 2228269 - protein, 21 aa, Cryptosporidium parvum
VSNSESGVKKNAISKHRKSSI

SEQ ID NO: 2228270 - protein, 12 aa, Cryptosporidium parvum
VSNTNTNNNTNI

SEQ ID NO: 2228271 - protein, 10 aa, Cryptosporidium parvum
VSNTTDKTAL

SEQ ID NO: 2228272 - protein, 16 aa, Cryptosporidium parvum
VSNYKSNNDNSSISTL

SEQ ID NO: 2228273 - protein, 7 aa, Cryptosporidium parvum
VSNYNNS

SEQ ID NO: 2228274 - protein, 10 aa, Cryptosporidium parvum
VSPDPNNPFP

SEQ ID NO: 2228275 - protein, 6 aa, Cryptosporidium parvum
VSPKTA

SEQ ID NO: 2228276 - protein, 24 aa, Cryptosporidium parvum
VSPKTKRKYGYKISESSKITESEY

SEQ ID NO: 2228277 - protein, 7 aa, Cryptosporidium parvum
VSPPKKY

SEQ ID NO: 2228278 - protein, 15 aa, Cryptosporidium parvum
VSPPTPKTKSSSWIP

SEQ ID NO: 2228279 - protein, 6 aa, Cryptosporidium parvum
VSPSIK

SEQ ID NO: 2228280 - protein, 9 aa, Cryptosporidium parvum
VSPSPASQP

SEQ ID NO: 2228281 - protein, 10 aa, Cryptosporidium parvum
VSQASSEPVT

SEQ ID NO: 2228282 - protein, 7 aa, Cryptosporidium parvum
VSQDSSK

SEQ ID NO: 2228283 - protein, 4 aa, Cryptosporidium parvum
VSQE

SEQ ID NO: 2228284 - protein, 12 aa, Cryptosporidium parvum
VSQGNNEKDQLE

SEQ ID NO: 2228285 - protein, 10 aa, Cryptosporidium parvum
VSQSAQDDSL

SEQ ID NO: 2228286 - protein, 13 aa, Cryptosporidium parvum
VSQSETHSSEMKD

SEQ ID NO: 2228287 - protein, 9 aa, Cryptosporidium parvum
VSQTNKTKF

SEQ ID NO: 2228288 - protein, 12 aa, Cryptosporidium parvum
VSRSTGKTIPNT

SEQ ID NO: 2228289 - protein, 4 aa, Cryptosporidium parvum
VSSA

SEQ ID NO: 2228290 - protein, 13 aa, Cryptosporidium parvum
VSSALSSRNSLEK

SEQ ID NO: 2228291 - protein, 10 aa, Cryptosporidium parvum
VSSDLANKIS

SEQ ID NO: 2228292 - protein, 10 aa, Cryptosporidium parvum
VSSDSQINKA

SEQ ID NO: 2228293 - protein, 5 aa, Cryptosporidium parvum
VSSET

SEQ ID NO: 2228294 - protein, 8 aa, Cryptosporidium parvum
VSSKAEKE

SEQ ID NO: 2228295 - protein, 8 aa, Cryptosporidium parvum
VSSPDRRV

SEQ ID NO: 2228296 - protein, 7 aa, Cryptosporidium parvum
VSSPTMA

SEQ ID NO: 2228297 - protein, 6 aa, Cryptosporidium parvum
VSSQSD

SEQ ID NO: 2228298 - protein, 11 aa, Cryptosporidium parvum
VSSQSYSNSPW

SEQ ID NO: 2228299 - protein, 8 aa, Cryptosporidium parvum
VSSSPQSQ

SEQ ID NO: 2228300 - protein, 5 aa, Cryptosporidium parvum
VSSSS

SEQ ID NO: 2228301 - protein, 7 aa, Cryptosporidium parvum
VSSTNYG

SEQ ID NO: 2228302 - protein, 28 aa, Cryptosporidium parvum
VSSWEPKKSKENSNAEENRNKSNRQSDE

SEQ ID NO: 2228303 - protein, 50 aa, Cryptosporidium parvum
VSTASELSGDEVQTAAELSGDEAPTVAELSGDEAPTVTELSGDEASATIE

SEQ ID NO: 2228304 - protein, 37 aa, Cryptosporidium parvum
VSTGHDTDGTTSQSGLGSRRRRANEVPDSGPRRPTSD

SEQ ID NO: 2228305 - protein, 16 aa, Cryptosporidium parvum
VSTGTGSKIDKERISG

SEQ ID NO: 2228306 - protein, 12 aa, Cryptosporidium parvum
VSTKEPANIQGI

SEQ ID NO: 2228307 - protein, 18 aa, Cryptosporidium parvum
VSTNNSNKDSDPSKDFHS

SEQ ID NO: 2228308 - protein, 20 aa, Cryptosporidium parvum
VSTPNNTKFNHNNETQDAKV

SEQ ID NO: 2228309 - protein, 7 aa, Cryptosporidium parvum
VSVEEKK

SEQ ID NO: 2228310 - protein, 4 aa, Cryptosporidium parvum
VSVS

SEQ ID NO: 2228311 - protein, 10 aa, Cryptosporidium parvum
VSYEEEDPLI

SEQ ID NO: 2228312 - protein, 7 aa, Cryptosporidium parvum
VTAQREA

SEQ ID NO: 2228313 - protein, 14 aa, Cryptosporidium parvum
VTDEDSDEEAEPVT

SEQ ID NO: 2228314 - protein, 4 aa, Cryptosporidium parvum
VTDG

SEQ ID NO: 2228315 - protein, 12 aa, Cryptosporidium parvum
VTDPESEGCPCS

SEQ ID NO: 2228316 - protein, 13 aa, Cryptosporidium parvum
VTDSDEVRGGSKL

SEQ ID NO: 2228317 - protein, 18 aa, Cryptosporidium parvum
VTEEEERIGGVGGTGREI

SEQ ID NO: 2228318 - protein, 8 aa, Cryptosporidium parvum
VTEGTGIT

SEQ ID NO: 2228319 - protein, 5 aa, Cryptosporidium parvum
VTENK

SEQ ID NO: 2228320 - protein, 6 aa, Cryptosporidium parvum
VTEQPG

SEQ ID NO: 2228321 - protein, 16 aa, Cryptosporidium parvum
VTERNENKTMISEEAG

SEQ ID NO: 2228322 - protein, 4 aa, Cryptosporidium parvum
VTGG

SEQ ID NO: 2228323 - protein, 6 aa, Cryptosporidium parvum
VTGNNN

SEQ ID NO: 2228324 - protein, 9 aa, Cryptosporidium parvum
VTKPKSKIG

SEQ ID NO: 2228325 - protein, 8 aa, Cryptosporidium parvum
VTKSREEE

SEQ ID NO: 2228326 - protein, 24 aa, Cryptosporidium parvum
VTKTSKTSKRNTVKQTTTKTQAPT

SEQ ID NO: 2228327 - protein, 6 aa, Cryptosporidium parvum
VTMGPG

SEQ ID NO: 2228328 - protein, 6 aa, Cryptosporidium parvum
VTNDLQ

SEQ ID NO: 2228329 - protein, 7 aa, Cryptosporidium parvum
VTNKNTE

SEQ ID NO: 2228330 - protein, 10 aa, Cryptosporidium parvum
VTNQNKQHFD

SEQ ID NO: 2228331 - protein, 7 aa, Cryptosporidium parvum
VTPQQKA

SEQ ID NO: 2228332 - protein, 6 aa, Cryptosporidium parvum
VTPSDY

SEQ ID NO: 2228333 - protein, 7 aa, Cryptosporidium parvum
VTPTEMS

SEQ ID NO: 2228334 - protein, 4 aa, Cryptosporidium parvum
VTQP

SEQ ID NO: 2228335 - protein, 9 aa, Cryptosporidium parvum
VTSASVDNS

SEQ ID NO: 2228336 - protein, 24 aa, Cryptosporidium parvum
VTSEYDNGSEKSNKIAHTYDSGHY

SEQ ID NO: 2228337 - protein, 5 aa, Cryptosporidium parvum
VTSNG

SEQ ID NO: 2228338 - protein, 14 aa, Cryptosporidium parvum
VTSNNQTTTNDNSN

SEQ ID NO: 2228339 - protein, 5 aa, Cryptosporidium parvum
VTSSS

SEQ ID NO: 2228340 - protein, 8 aa, Cryptosporidium parvum
VTSSSTDV

SEQ ID NO: 2228341 - protein, 4 aa, Cryptosporidium parvum
VTTS

SEQ ID NO: 2228342 - protein, 7 aa, Cryptosporidium parvum
VTTSNLP

SEQ ID NO: 2228343 - protein, 38 aa, Cryptosporidium parvum
VTTTTNNNNNVQSQSISNASTPNTAKSNSSYSIGGNSY

SEQ ID NO: 2228344 - protein, 7 aa, Cryptosporidium parvum
VTYDDKN

SEQ ID NO: 2228345 - protein, 16 aa, Cryptosporidium parvum
VVSNESKFGCKTSSIS

SEQ ID NO: 2228346 - protein, 8 aa, Cryptosporidium parvum
VYNSNNKD

SEQ ID NO: 2228347 - protein, 6 aa, Cryptosporidium parvum
VYSTDV

SEQ ID NO: 2228348 - protein, 6 aa, Cryptosporidium parvum
WAPNSS

SEQ ID NO: 2228349 - protein, 4 aa, Cryptosporidium parvum
WECP

SEQ ID NO: 2228350 - protein, 5 aa, Cryptosporidium parvum
WEENR

SEQ ID NO: 2228351 - protein, 9 aa, Cryptosporidium parvum
WEGKPRAKA

SEQ ID NO: 2228352 - protein, 9 aa, Cryptosporidium parvum
WEKSNNMND

SEQ ID NO: 2228353 - protein, 26 aa, Cryptosporidium parvum
WERAQEHKEDLKTEKSMEDKNDEARF

SEQ ID NO: 2228354 - protein, 8 aa, Cryptosporidium parvum
WERGGTRF

SEQ ID NO: 2228355 - protein, 8 aa, Cryptosporidium parvum
WESNSEER

SEQ ID NO: 2228356 - protein, 15 aa, Cryptosporidium parvum
WGDPSRGKLGQQDIR

SEQ ID NO: 2228357 - protein, 24 aa, Cryptosporidium parvum
WGKQSSAYQSTSSSASPPSYYATN

SEQ ID NO: 2228358 - protein, 13 aa, Cryptosporidium parvum
WGTTTQRVYSKSG

SEQ ID NO: 2228359 - protein, 4 aa, Cryptosporidium parvum
WGVS

SEQ ID NO: 2228360 - protein, 4 aa, Cryptosporidium parvum
WKES

SEQ ID NO: 2228361 - protein, 8 aa, Cryptosporidium parvum
WKKEAQDV

SEQ ID NO: 2228362 - protein, 8 aa, Cryptosporidium parvum
WKPDEQKN

SEQ ID NO: 2228363 - protein, 4 aa, Cryptosporidium parvum
WKPP

SEQ ID NO: 2228364 - protein, 6 aa, Cryptosporidium parvum
WKPYGD

SEQ ID NO: 2228365 - protein, 12 aa, Cryptosporidium parvum
WNEEGQKTLESL

SEQ ID NO: 2228366 - protein, 4 aa, Cryptosporidium parvum
WNPS

SEQ ID NO: 2228367 - protein, 5 aa, Cryptosporidium parvum
WPNPS

SEQ ID NO: 2228368 - protein, 13 aa, Cryptosporidium parvum
WPSEEESYQKKVP

SEQ ID NO: 2228369 - protein, 13 aa, Cryptosporidium parvum
WPTRIDGSTYSIP

SEQ ID NO: 2228370 - protein, 17 aa, Cryptosporidium parvum
WRGSTTAQIDRTNYANN

SEQ ID NO: 2228371 - protein, 11 aa, Cryptosporidium parvum
WRNPIKKKPKE

SEQ ID NO: 2228372 - protein, 7 aa, Cryptosporidium parvum
WRNTPDP

SEQ ID NO: 2228373 - protein, 7 aa, Cryptosporidium parvum
WSDISSK

SEQ ID NO: 2228374 - protein, 15 aa, Cryptosporidium parvum
WSGFGDDHDNADGNG

SEQ ID NO: 2228375 - protein, 17 aa, Cryptosporidium parvum
WSGSAINRSPDGNQPVI

SEQ ID NO: 2228376 - protein, 8 aa, Cryptosporidium parvum
WSKDGSSL

SEQ ID NO: 2228377 - protein, 9 aa, Cryptosporidium parvum
WSLPGPDER

SEQ ID NO: 2228378 - protein, 10 aa, Cryptosporidium parvum
WSPSKSNGYL

SEQ ID NO: 2228379 - protein, 4 aa, Cryptosporidium parvum
WSSI

SEQ ID NO: 2228380 - protein, 6 aa, Cryptosporidium parvum
WSSSQQ

SEQ ID NO: 2228381 - protein, 6 aa, Cryptosporidium parvum
WTGNGK

SEQ ID NO: 2228382 - protein, 4 aa, Cryptosporidium parvum
WTNK

SEQ ID NO: 2228383 - protein, 10 aa, Cryptosporidium parvum
WTQSYSKEEL

SEQ ID NO: 2228384 - protein, 13 aa, Cryptosporidium parvum
WTSKSDSKEQKEV

SEQ ID NO: 2228385 - protein, 9 aa, Cryptosporidium parvum
WTTDYGGDL

SEQ ID NO: 2228386 - protein, 7 aa, Cryptosporidium parvum
WTVSETA

SEQ ID NO: 2228387 - protein, 12 aa, Cryptosporidium parvum
YAASKSRKNNRL

SEQ ID NO: 2228388 - protein, 7 aa, Cryptosporidium parvum
YADESAR

SEQ ID NO: 2228389 - protein, 4 aa, Cryptosporidium parvum
YAEA

SEQ ID NO: 2228390 - protein, 6 aa, Cryptosporidium parvum
YAGTTT

SEQ ID NO: 2228391 - protein, 7 aa, Cryptosporidium parvum
YANPSHD

SEQ ID NO: 2228392 - protein, 10 aa, Cryptosporidium parvum
YAPRSGDNSC

SEQ ID NO: 2228393 - protein, 5 aa, Cryptosporidium parvum
YAPSI

SEQ ID NO: 2228394 - protein, 10 aa, Cryptosporidium parvum
YASKSGDLPE

SEQ ID NO: 2228395 - protein, 7 aa, Cryptosporidium parvum
YASTSRY

SEQ ID NO: 2228396 - protein, 5 aa, Cryptosporidium parvum
YATTR

SEQ ID NO: 2228397 - protein, 5 aa, Cryptosporidium parvum
YAWSD

SEQ ID NO: 2228398 - protein, 10 aa, Cryptosporidium parvum
YCDSSPRPWN

SEQ ID NO: 2228399 - protein, 4 aa, Cryptosporidium parvum
YCEE

SEQ ID NO: 2228400 - protein, 9 aa, Cryptosporidium parvum
YCKETNQDI

SEQ ID NO: 2228401 - protein, 11 aa, Cryptosporidium parvum
YDDCSDGTSFR

SEQ ID NO: 2228402 - protein, 15 aa, Cryptosporidium parvum
YDEERDTAGIASQAA

SEQ ID NO: 2228403 - protein, 50 aa, Cryptosporidium parvum
YDESKSSNSDMSKQTGTSKDTNTSSQTYNSSSESDIYENESTASTQDFET

SEQ ID NO: 2228404 - protein, 9 aa, Cryptosporidium parvum
YDESTGEYE

SEQ ID NO: 2228405 - protein, 4 aa, Cryptosporidium parvum
YDFD

SEQ ID NO: 2228406 - protein, 6 aa, Cryptosporidium parvum
YDGNAR

SEQ ID NO: 2228407 - protein, 6 aa, Cryptosporidium parvum
YDGNTP

SEQ ID NO: 2228408 - protein, 6 aa, Cryptosporidium parvum
YDGSNT

SEQ ID NO: 2228409 - protein, 8 aa, Cryptosporidium parvum
YDGTGIPP

SEQ ID NO: 2228410 - protein, 34 aa, Cryptosporidium parvum
YDKDNSGINCQNNQSGTGYSTTDNTNVVNSTKTN

SEQ ID NO: 2228411 - protein, 10 aa, Cryptosporidium parvum
YDKESNEESH

SEQ ID NO: 2228412 - protein, 7 aa, Cryptosporidium parvum
YDKRVSE

SEQ ID NO: 2228413 - protein, 6 aa, Cryptosporidium parvum
YDLGSK

SEQ ID NO: 2228414 - protein, 11 aa, Cryptosporidium parvum
YDNNSKKKLKH

SEQ ID NO: 2228415 - protein, 14 aa, Cryptosporidium parvum
YDNQDISSSGYNSL

SEQ ID NO: 2228416 - protein, 9 aa, Cryptosporidium parvum
YDNQDYKSL

SEQ ID NO: 2228417 - protein, 7 aa, Cryptosporidium parvum
YDNSDVN

SEQ ID NO: 2228418 - protein, 18 aa, Cryptosporidium parvum
YDNSNEGYLVNNDEGNWM

SEQ ID NO: 2228419 - protein, 8 aa, Cryptosporidium parvum
YDPHTDQQ

SEQ ID NO: 2228420 - protein, 7 aa, Cryptosporidium parvum
YDPTTAG

SEQ ID NO: 2228421 - protein, 8 aa, Cryptosporidium parvum
YDQTTENS

SEQ ID NO: 2228422 - protein, 4 aa, Cryptosporidium parvum
YDRS

SEQ ID NO: 2228423 - protein, 10 aa, Cryptosporidium parvum
YDSDKDNHNT

SEQ ID NO: 2228424 - protein, 7 aa, Cryptosporidium parvum
YDSGTSF

SEQ ID NO: 2228425 - protein, 8 aa, Cryptosporidium parvum
YDSNGKNN

SEQ ID NO: 2228426 - protein, 11 aa, Cryptosporidium parvum
YDSQQSGFSSP

SEQ ID NO: 2228427 - protein, 12 aa, Cryptosporidium parvum
YDSSSASADANY

SEQ ID NO: 2228428 - protein, 8 aa, Cryptosporidium parvum
YDSTSLSA

SEQ ID NO: 2228429 - protein, 24 aa, Cryptosporidium parvum
YDSYGSSFSTNHSGDSGYSEDGLS

SEQ ID NO: 2228430 - protein, 5 aa, Cryptosporidium parvum
YDTPS

SEQ ID NO: 2228431 - protein, 8 aa, Cryptosporidium parvum
YDTSNDGK

SEQ ID NO: 2228432 - protein, 4 aa, Cryptosporidium parvum
YDYS

SEQ ID NO: 2228433 - protein, 8 aa, Cryptosporidium parvum
YEANPNEE

SEQ ID NO: 2228434 - protein, 12 aa, Cryptosporidium parvum
YEAPSKTVQERI

SEQ ID NO: 2228435 - protein, 14 aa, Cryptosporidium parvum
YEDDDDDNDNISGL

SEQ ID NO: 2228436 - protein, 36 aa, Cryptosporidium parvum; identical to SEQ ID NO: 2121699

SEQ ID NO: 2228437 - protein, 5 aa, Cryptosporidium parvum
YEDHH

SEQ ID NO: 2228438 - protein, 20 aa, Cryptosporidium parvum
YEDKNEKSSFNPTNTYGEYG

SEQ ID NO: 2228439 - protein, 5 aa, Cryptosporidium parvum
YEDYN

SEQ ID NO: 2228440 - protein, 14 aa, Cryptosporidium parvum
YEEGYKRKSPTRSY

SEQ ID NO: 2228441 - protein, 5 aa, Cryptosporidium parvum
YEEKQ

SEQ ID NO: 2228442 - protein, 5 aa, Cryptosporidium parvum
YEENP

SEQ ID NO: 2228443 - protein, 15 aa, Cryptosporidium parvum
YEEQSISPARGSFRT

SEQ ID NO: 2228444 - protein, 10 aa, Cryptosporidium parvum
YEESDSKNLG

SEQ ID NO: 2228445 - protein, 11 aa, Cryptosporidium parvum
YEESENNESLE

SEQ ID NO: 2228446 - protein, 4 aa, Cryptosporidium parvum
YEGL

SEQ ID NO: 2228447 - protein, 4 aa, Cryptosporidium parvum
YEIN

SEQ ID NO: 2228448 - protein, 9 aa, Cryptosporidium parvum
YEKENQQSI

SEQ ID NO: 2228449 - protein, 8 aa, Cryptosporidium parvum
YEKYPDEY

SEQ ID NO: 2228450 - protein, 8 aa, Cryptosporidium parvum
YENHTTNY

SEQ ID NO: 2228451 - protein, 8 aa, Cryptosporidium parvum
YENPSPNS

SEQ ID NO: 2228452 - protein, 14 aa, Cryptosporidium parvum
YENSNQPNNPIASE

SEQ ID NO: 2228453 - protein, 5 aa, Cryptosporidium parvum
YEPDW

SEQ ID NO: 2228454 - protein, 6 aa, Cryptosporidium parvum
YEPQGQ

SEQ ID NO: 2228455 - protein, 29 aa, Cryptosporidium parvum
YERENNQENENNKANHSEKSRNIDKGSKI

SEQ ID NO: 2228456 - protein, 5 aa, Cryptosporidium parvum
YERKK

SEQ ID NO: 2228457 - protein, 10 aa, Cryptosporidium parvum
YERSSRSASH

SEQ ID NO: 2228458 - protein, 6 aa, Cryptosporidium parvum
YESDTK

SEQ ID NO: 2228459 - protein, 4 aa, Cryptosporidium parvum
YESE

SEQ ID NO: 2228460 - protein, 24 aa, Cryptosporidium parvum
YESKKDKVKDEANDSNISSSSNTF

SEQ ID NO: 2228461 - protein, 4 aa, Cryptosporidium parvum
YESN

SEQ ID NO: 2228462 - protein, 9 aa, Cryptosporidium parvum
YESNDSDGY

SEQ ID NO: 2228463 - protein, 8 aa, Cryptosporidium parvum
YESNRDTF

SEQ ID NO: 2228464 - protein, 19 aa, Cryptosporidium parvum
YESQNKAFSYPGEKKYSIN

SEQ ID NO: 2228465 - protein, 8 aa, Cryptosporidium parvum
YESSSLDN

SEQ ID NO: 2228466 - protein, 6 aa, Cryptosporidium parvum
YESTEY

SEQ ID NO: 2228467 - protein, 5 aa, Cryptosporidium parvum
YESYK

SEQ ID NO: 2228468 - protein, 11 aa, Cryptosporidium parvum
YETDNRNNNYG

SEQ ID NO: 2228469 - protein, 8 aa, Cryptosporidium parvum
YETNNFGS

SEQ ID NO: 2228470 - protein, 5 aa, Cryptosporidium parvum
YEYSS

SEQ ID NO: 2228471 - protein, 12 aa, Cryptosporidium parvum
YEYTNYSNSGYQ

SEQ ID NO: 2228472 - protein, 8 aa, Cryptosporidium parvum
YFPNRSQN

SEQ ID NO: 2228473 - protein, 6 aa, Cryptosporidium parvum
YGAHSN

SEQ ID NO: 2228474 - protein, 5 aa, Cryptosporidium parvum
YGALE

SEQ ID NO: 2228475 - protein, 5 aa, Cryptosporidium parvum
YGASK

SEQ ID NO: 2228476 - protein, 11 aa, Cryptosporidium parvum
YGCSGNQKKVA

SEQ ID NO: 2228477 - protein, 13 aa, Cryptosporidium parvum
YGDSTEKDRSERI

SEQ ID NO: 2228478 - protein, 4 aa, Cryptosporidium parvum
YGDY

SEQ ID NO: 2228479 - protein, 8 aa, Cryptosporidium parvum
YGDYTPSN

SEQ ID NO: 2228480 - protein, 10 aa, Cryptosporidium parvum
YGENVKKGID

SEQ ID NO: 2228481 - protein, 11 aa, Cryptosporidium parvum
YGESSRELSES

SEQ ID NO: 2228482 - protein, 13 aa, Cryptosporidium parvum
YGGDKPLNNPFGA

SEQ ID NO: 2228483 - protein, 7 aa, Cryptosporidium parvum
YGGESNR

SEQ ID NO: 2228484 - protein, 9 aa, Cryptosporidium parvum
YGGGDGPRL

SEQ ID NO: 2228485 - protein, 10 aa, Cryptosporidium parvum
YGGPNTQNSA

SEQ ID NO: 2228486 - protein, 5 aa, Cryptosporidium parvum
YGGVS

SEQ ID NO: 2228487 - protein, 5 aa, Cryptosporidium parvum
YGKTN

SEQ ID NO: 2228488 - protein, 4 aa, Cryptosporidium parvum
YGLG

SEQ ID NO: 2228489 - protein, 7 aa, Cryptosporidium parvum
YGLGQSQ

SEQ ID NO: 2228490 - protein, 12 aa, Cryptosporidium parvum
YGLQPGSARGPT

SEQ ID NO: 2228491 - protein, 5 aa, Cryptosporidium parvum
YGNEY

SEQ ID NO: 2228492 - protein, 18 aa, Cryptosporidium parvum
YGNHDTVDHEYENDDGYR

SEQ ID NO: 2228493 - protein, 4 aa, Cryptosporidium parvum
YGNN

SEQ ID NO: 2228494 - protein, 6 aa, Cryptosporidium parvum
YGNQEN

SEQ ID NO: 2228495 - protein, 12 aa, Cryptosporidium parvum
YGPLTTGSIESD

SEQ ID NO: 2228496 - protein, 5 aa, Cryptosporidium parvum
YGPPE

SEQ ID NO: 2228497 - protein, 6 aa, Cryptosporidium parvum
YGPSRN

SEQ ID NO: 2228498 - protein, 4 aa, Cryptosporidium parvum
YGRG

SEQ ID NO: 2228499 - protein, 15 aa, Cryptosporidium parvum
YGRSSSSTFEGVGDS

SEQ ID NO: 2228500 - protein, 10 aa, Cryptosporidium parvum
YGSDDSTDKV

SEQ ID NO: 2228501 - protein, 10 aa, Cryptosporidium parvum
YGSEKTKEIP

SEQ ID NO: 2228502 - protein, 17 aa, Cryptosporidium parvum
YGSGASSGSGNSGVGSF

SEQ ID NO: 2228503 - protein, 6 aa, Cryptosporidium parvum
YGSGNY

SEQ ID NO: 2228504 - protein, 6 aa, Cryptosporidium parvum
YGSGVG

SEQ ID NO: 2228505 - protein, 14 aa, Cryptosporidium parvum
YGSPGEGTSSGSRH

SEQ ID NO: 2228506 - protein, 6 aa, Cryptosporidium parvum
YGSPRS

SEQ ID NO: 2228507 - protein, 4 aa, Cryptosporidium parvum
YGSS

SEQ ID NO: 2228508 - protein, 14 aa, Cryptosporidium parvum
YGSTETSSSKEDNL

SEQ ID NO: 2228509 - protein, 8 aa, Cryptosporidium parvum
YGVNDGGK

SEQ ID NO: 2228510 - protein, 8 aa, Cryptosporidium parvum
YGVSGKLK

SEQ ID NO: 2228511 - protein, 5 aa, Cryptosporidium parvum
YGYGE

SEQ ID NO: 2228512 - protein, 9 aa, Cryptosporidium parvum
YHPDGPEGK

SEQ ID NO: 2228513 - protein, 5 aa, Cryptosporidium parvum
YHTQE

SEQ ID NO: 2228514 - protein, 9 aa, Cryptosporidium parvum
YIDDKDNTA

SEQ ID NO: 2228515 - protein, 10 aa, Cryptosporidium parvum
YIEAKPGSKI

SEQ ID NO: 2228516 - protein, 13 aa, Cryptosporidium parvum
YIGTGTASSIASN

SEQ ID NO: 2228517 - protein, 9 aa, Cryptosporidium parvum
YINNNTSNY

SEQ ID NO: 2228518 - protein, 9 aa, Cryptosporidium parvum
YISETSNSL

SEQ ID NO: 2228519 - protein, 24 aa, Cryptosporidium parvum
YKDKDKEENKDEEEKEKEEEEEEE

SEQ ID NO: 2228520 - protein, 14 aa, Cryptosporidium parvum
YKDLDNDENDEFKT

SEQ ID NO: 2228521 - protein, 8 aa, Cryptosporidium parvum
YKDTEPNY

SEQ ID NO: 2228522 - protein, 4 aa, Cryptosporidium parvum
YKED

SEQ ID NO: 2228523 - protein, 48 aa, Cryptosporidium parvum
YKEDETDGDKIENQRNDDKKRRKVKKKLDHDNIQDENNKDEKTGIRKD

SEQ ID NO: 2228524 - protein, 7 aa, Cryptosporidium parvum
YKEDPTA

SEQ ID NO: 2228525 - protein, 22 aa, Cryptosporidium parvum
YKELNNSVNTISSVSSSSTGSI

SEQ ID NO: 2228526 - protein, 4 aa, Cryptosporidium parvum
YKEN

SEQ ID NO: 2228527 - protein, 10 aa, Cryptosporidium parvum
YKENDTKTEL

SEQ ID NO: 2228528 - protein, 4 aa, Cryptosporidium parvum
YKFP

SEQ ID NO: 2228529 - protein, 5 aa, Cryptosporidium parvum
YKGIT

SEQ ID NO: 2228530 - protein, 7 aa, Cryptosporidium parvum
YKGNGET

SEQ ID NO: 2228531 - protein, 16 aa, Cryptosporidium parvum
YKGNPTELRYTNPNET

SEQ ID NO: 2228532 - protein, 6 aa, Cryptosporidium parvum
YKGQIS

SEQ ID NO: 2228533 - protein, 8 aa, Cryptosporidium parvum
YKGSSNVD

SEQ ID NO: 2228534 - protein, 9 aa, Cryptosporidium parvum
YKKDENHRT

SEQ ID NO: 2228535 - protein, 7 aa, Cryptosporidium parvum
YKKGSMT

SEQ ID NO: 2228536 - protein, 26 aa, Cryptosporidium parvum
YKKTRRKATHGQDIGPFGKNNNRTLR

SEQ ID NO: 2228537 - protein, 14 aa, Cryptosporidium parvum
YKNGEDGTKNTGII

SEQ ID NO: 2228538 - protein, 4 aa, Cryptosporidium parvum
YKNK

SEQ ID NO: 2228539 - protein, 10 aa, Cryptosporidium parvum
YKNKTDETSI

SEQ ID NO: 2228540 - protein, 17 aa, Cryptosporidium parvum
YKNSNNSRNLEDETTDL

SEQ ID NO: 2228541 - protein, 6 aa, Cryptosporidium parvum
YKPDRT

SEQ ID NO: 2228542 - protein, 7 aa, Cryptosporidium parvum
YKPDRTH

SEQ ID NO: 2228543 - protein, 5 aa, Cryptosporidium parvum
YKPEF

SEQ ID NO: 2228544 - protein, 5 aa, Cryptosporidium parvum
YKPES

SEQ ID NO: 2228545 - protein, 4 aa, Cryptosporidium parvum
YKPG

SEQ ID NO: 2228546 - protein, 89 aa, Cryptosporidium parvum
YKPHKTTTTTTTTTTTTTTTTTTTTTSTTTTTTTTTTTTTTTTTTTTTTTTTTTTTTTTTTTTTTTTTTTTTTTTTTTTTTTEAPGSRI

SEQ ID NO: 2228547 - protein, 4 aa, Cryptosporidium parvum
YKPL

SEQ ID NO: 2228548 - protein, 7 aa, Cryptosporidium parvum
YKPSSYT

SEQ ID NO: 2228549 - protein, 15 aa, Cryptosporidium parvum
YKPSVSKRYPCKKCC

SEQ ID NO: 2228550 - protein, 10 aa, Cryptosporidium parvum
YKSDEDSAYG

SEQ ID NO: 2228551 - protein, 5 aa, Cryptosporidium parvum
YKSER

SEQ ID NO: 2228552 - protein, 6 aa, Cryptosporidium parvum
YKSGNI

SEQ ID NO: 2228553 - protein, 5 aa, Cryptosporidium parvum
YKSGS

SEQ ID NO: 2228554 - protein, 7 aa, Cryptosporidium parvum
YKSNEIE

SEQ ID NO: 2228555 - protein, 7 aa, Cryptosporidium parvum
YKSPSDA

SEQ ID NO: 2228556 - protein, 15 aa, Cryptosporidium parvum
YKSRNGTDDEDNADF

SEQ ID NO: 2228557 - protein, 12 aa, Cryptosporidium parvum
YKSRNNSINDDN

SEQ ID NO: 2228558 - protein, 4 aa, Cryptosporidium parvum
YKST

SEQ ID NO: 2228559 - protein, 6 aa, Cryptosporidium parvum
YKSTSC

SEQ ID NO: 2228560 - protein, 5 aa, Cryptosporidium parvum
YKTDG

SEQ ID NO: 2228561 - protein, 6 aa, Cryptosporidium parvum
YKTIGT

SEQ ID NO: 2228562 - protein, 4 aa, Cryptosporidium parvum
YKYP

SEQ ID NO: 2228563 - protein, 20 aa, Cryptosporidium parvum
YLDENMSRNEKGCNGREEQY

SEQ ID NO: 2228564 - protein, 9 aa, Cryptosporidium parvum
YLEGSGNRR

SEQ ID NO: 2228565 - protein, 9 aa, Cryptosporidium parvum
YLETDNSNY

SEQ ID NO: 2228566 - protein, 4 aa, Cryptosporidium parvum
YLNK

SEQ ID NO: 2228567 - protein, 6 aa, Cryptosporidium parvum
YLPGTD

SEQ ID NO: 2228568 - protein, 17 aa, Cryptosporidium parvum
YLSDSGHYTVGKDASNA

SEQ ID NO: 2228569 - protein, 14 aa, Cryptosporidium parvum
YMSGQTQKGLEGED

SEQ ID NO: 2228570 - protein, 9 aa, Cryptosporidium parvum
YNANKKTKY

SEQ ID NO: 2228571 - protein, 4 aa, Cryptosporidium parvum
YNDK

SEQ ID NO: 2228572 - protein, 7 aa, Cryptosporidium parvum
YNDQNLS

SEQ ID NO: 2228573 - protein, 22 aa, Cryptosporidium parvum
YNDSNTSDKKLQGKFRKDSSQI

SEQ ID NO: 2228574 - protein, 18 aa, Cryptosporidium parvum
YNEEDITSEFQNNQNSLY

SEQ ID NO: 2228575 - protein, 16 aa, Cryptosporidium parvum
YNEFSSTNKASDLNGR

SEQ ID NO: 2228576 - protein, 34 aa, Cryptosporidium parvum
YNEGEGGGGGGEEEEEEEEGIKGEGRRKRGGRRN

SEQ ID NO: 2228577 - protein, 6 aa, Cryptosporidium parvum
YNEKGK

SEQ ID NO: 2228578 - protein, 11 aa, Cryptosporidium parvum
YNEKSKIENEI

SEQ ID NO: 2228579 - protein, 5 aa, Cryptosporidium parvum
YNENG

SEQ ID NO: 2228580 - protein, 7 aa, Cryptosporidium parvum
YNESEES

SEQ ID NO: 2228581 - protein, 4 aa, Cryptosporidium parvum
YNET

SEQ ID NO: 2228582 - protein, 6 aa, Cryptosporidium parvum
YNGDRS

SEQ ID NO: 2228583 - protein, 11 aa, Cryptosporidium parvum
YNGEESGGTLN

SEQ ID NO: 2228584 - protein, 8 aa, Cryptosporidium parvum
YNGPRTAN

SEQ ID NO: 2228585 - protein, 8 aa, Cryptosporidium parvum
YNGSKQNL

SEQ ID NO: 2228586 - protein, 4 aa, Cryptosporidium parvum
YNKD

SEQ ID NO: 2228587 - protein, 4 aa, Cryptosporidium parvum
YNKE

SEQ ID NO: 2228588 - protein, 9 aa, Cryptosporidium parvum
YNKGSPSTF

SEQ ID NO: 2228589 - protein, 4 aa, Cryptosporidium parvum
YNKN

SEQ ID NO: 2228590 - protein, 5 aa, Cryptosporidium parvum
YNKPS

SEQ ID NO: 2228591 - protein, 23 aa, Cryptosporidium parvum
YNKYQEESKFSSFNSQAKSNESK

SEQ ID NO: 2228592 - protein, 11 aa, Cryptosporidium parvum
YNNDKNDSNNY

SEQ ID NO: 2228593 - protein, 7 aa, Cryptosporidium parvum
YNNGFGG

SEQ ID NO: 2228594 - protein, 23 aa, Cryptosporidium parvum
YNNISAGSEITEGESSIKNNKYN

SEQ ID NO: 2228595 - protein, 20 aa, Cryptosporidium parvum
YNNNDNHTYNSSNSNSGVEN

SEQ ID NO: 2228596 - protein, 22 aa, Cryptosporidium parvum
YNNNNNSNNNNNNNYNNYNNNY

SEQ ID NO: 2228597 - protein, 7 aa, Cryptosporidium parvum
YNNNVTS

SEQ ID NO: 2228598 - protein, 4 aa, Cryptosporidium parvum
YNNS

SEQ ID NO: 2228599 - protein, 10 aa, Cryptosporidium parvum
YNNSYKETNF

SEQ ID NO: 2228600 - protein, 5 aa, Cryptosporidium parvum
YNPDE

SEQ ID NO: 2228601 - protein, 7 aa, Cryptosporidium parvum
YNPENQS

SEQ ID NO: 2228602 - protein, 8 aa, Cryptosporidium parvum
YNPETQKC

SEQ ID NO: 2228603 - protein, 7 aa, Cryptosporidium parvum
YNPNSND

SEQ ID NO: 2228604 - protein, 13 aa, Cryptosporidium parvum
YNPPGTSEEQNKV

SEQ ID NO: 2228605 - protein, 7 aa, Cryptosporidium parvum
YNQKETV

SEQ ID NO: 2228606 - protein, 6 aa, Cryptosporidium parvum
YNQQND

SEQ ID NO: 2228607 - protein, 7 aa, Cryptosporidium parvum
YNRDPRG

SEQ ID NO: 2228608 - protein, 6 aa, Cryptosporidium parvum
YNRRSN

SEQ ID NO: 2228609 - protein, 8 aa, Cryptosporidium parvum
YNRSEINS

SEQ ID NO: 2228610 - protein, 4 aa, Cryptosporidium parvum
YNSG

SEQ ID NO: 2228611 - protein, 5 aa, Cryptosporidium parvum
YNSNL

SEQ ID NO: 2228612 - protein, 7 aa, Cryptosporidium parvum
YNSQPPP

SEQ ID NO: 2228613 - protein, 14 aa, Cryptosporidium parvum
YNSSSKATNSNADC

SEQ ID NO: 2228614 - protein, 13 aa, Cryptosporidium parvum
YNSYNDGSNGALS

SEQ ID NO: 2228615 - protein, 33 aa, Cryptosporidium parvum
YNSYSESAYTDIKSSEAKDSDSDYSDVKDSSEI

SEQ ID NO: 2228616 - protein, 4 aa, Cryptosporidium parvum
YNTP

SEQ ID NO: 2228617 - protein, 5 aa, Cryptosporidium parvum
YNTSL

SEQ ID NO: 2228618 - protein, 6 aa, Cryptosporidium parvum
YNVPTS

SEQ ID NO: 2228619 - protein, 8 aa, Cryptosporidium parvum
YNYETRST

SEQ ID NO: 2228620 - protein, 8 aa, Cryptosporidium parvum
YNYNDTSD

SEQ ID NO: 2228621 - protein, 5 aa, Cryptosporidium parvum
YNYYS

SEQ ID NO: 2228622 - protein, 10 aa, Cryptosporidium parvum
YPASDGKQYL

SEQ ID NO: 2228623 - protein, 6 aa, Cryptosporidium parvum
YPDGKK

SEQ ID NO: 2228624 - protein, 11 aa, Cryptosporidium parvum
YPEKSGKAKVS

SEQ ID NO: 2228625 - protein, 4 aa, Cryptosporidium parvum
YPEN

SEQ ID NO: 2228626 - protein, 6 aa, Cryptosporidium parvum
YPEQTY

SEQ ID NO: 2228627 - protein, 8 aa, Cryptosporidium parvum
YPGNRGSS

SEQ ID NO: 2228628 - protein, 17 aa, Cryptosporidium parvum
YPGNTVQQEEYEDEEDF

SEQ ID NO: 2228629 - protein, 4 aa, Cryptosporidium parvum
YPGT

SEQ ID NO: 2228630 - protein, 12 aa, Cryptosporidium parvum
YPHKEEHLGTQS

SEQ ID NO: 2228631 - protein, 4 aa, Cryptosporidium parvum
YPIP

SEQ ID NO: 2228632 - protein, 4 aa, Cryptosporidium parvum
YPKN

SEQ ID NO: 2228633 - protein, 9 aa, Cryptosporidium parvum
YPKNTPYHE

SEQ ID NO: 2228634 - protein, 8 aa, Cryptosporidium parvum
YPKYPNQE

SEQ ID NO: 2228635 - protein, 12 aa, Cryptosporidium parvum
YPLGKKVKTQKA

SEQ ID NO: 2228636 - protein, 11 aa, Cryptosporidium parvum
YPLNRPQDNRY

SEQ ID NO: 2228637 - protein, 8 aa, Cryptosporidium parvum
YPNAISPP

SEQ ID NO: 2228638 - protein, 6 aa, Cryptosporidium parvum
YPNGNR

SEQ ID NO: 2228639 - protein, 5 aa, Cryptosporidium parvum
YPNIP

SEQ ID NO: 2228640 - protein, 6 aa, Cryptosporidium parvum
YPNPNN

SEQ ID NO: 2228641 - protein, 4 aa, Cryptosporidium parvum
YPNY

SEQ ID NO: 2228642 - protein, 6 aa, Cryptosporidium parvum
YPPPGY

SEQ ID NO: 2228643 - protein, 28 aa, Cryptosporidium parvum
YPRPGTPAAKMKPVPNGVSKSRSSEITN

SEQ ID NO: 2228644 - protein, 6 aa, Cryptosporidium parvum
YPRSDV

SEQ ID NO: 2228645 - protein, 10 aa, Cryptosporidium parvum
YPSGPNIDTS

SEQ ID NO: 2228646 - protein, 4 aa, Cryptosporidium parvum
YPSL

SEQ ID NO: 2228647 - protein, 31 aa, Cryptosporidium parvum
YPSPIEETAKSKVDSDSIKDPYTDSPTGNED

SEQ ID NO: 2228648 - protein, 14 aa, Cryptosporidium parvum
YPSREKGVNRKMSK

SEQ ID NO: 2228649 - protein, 9 aa, Cryptosporidium parvum
YPTAKTPSV

SEQ ID NO: 2228650 - protein, 10 aa, Cryptosporidium parvum
YPTGRKIGGS

SEQ ID NO: 2228651 - protein, 11 aa, Cryptosporidium parvum
YPTHDTTQYGE

SEQ ID NO: 2228652 - protein, 11 aa, Cryptosporidium parvum
YPTKNSLVPRS

SEQ ID NO: 2228653 - protein, 4 aa, Cryptosporidium parvum
YPTN

SEQ ID NO: 2228654 - protein, 10 aa, Cryptosporidium parvum
YPTPSASQLT

SEQ ID NO: 2228655 - protein, 4 aa, Cryptosporidium parvum
YPTS

SEQ ID NO: 2228656 - protein, 23 aa, Cryptosporidium parvum
YPYPSKTILPGNKLSSKSDCISE

SEQ ID NO: 2228657 - protein, 22 aa, Cryptosporidium parvum
YQDDQEEIKQVNKEPQSKWNAT

SEQ ID NO: 2228658 - protein, 10 aa, Cryptosporidium parvum
YQDKENSQDQ

SEQ ID NO: 2228659 - protein, 8 aa, Cryptosporidium parvum
YQDSSEQF

SEQ ID NO: 2228660 - protein, 7 aa, Cryptosporidium parvum
YQDSSLY

SEQ ID NO: 2228661 - protein, 9 aa, Cryptosporidium parvum
YQEKEQSNF

SEQ ID NO: 2228662 - protein, 33 aa, Cryptosporidium parvum
YQENNRKESKEDNKISQNQYKKTEIRQRRANKI

SEQ ID NO: 2228663 - protein, 5 aa, Cryptosporidium parvum
YQEQP

SEQ ID NO: 2228664 - protein, 20 aa, Cryptosporidium parvum
YQESKENSPSKDRESYHSVG

SEQ ID NO: 2228665 - protein, 4 aa, Cryptosporidium parvum
YQFG

SEQ ID NO: 2228666 - protein, 9 aa, Cryptosporidium parvum
YQGPSKSSV

SEQ ID NO: 2228667 - protein, 35 aa, Cryptosporidium parvum
YQKPNNPSVESDFDNSSQTVINSPNTANDHSQNTI

SEQ ID NO: 2228668 - protein, 4 aa, Cryptosporidium parvum
YQNQ

SEQ ID NO: 2228669 - protein, 8 aa, Cryptosporidium parvum
YQNQGKKM

SEQ ID NO: 2228670 - protein, 6 aa, Cryptosporidium parvum
YQNTNF

SEQ ID NO: 2228671 - protein, 6 aa, Cryptosporidium parvum
YQQNLE

SEQ ID NO: 2228672 - protein, 19 aa, Cryptosporidium parvum
YQSKSKLKEIQNRSKPNCD

SEQ ID NO: 2228673 - protein, 7 aa, Cryptosporidium parvum
YQSSSGS

SEQ ID NO: 2228674 - protein, 8 aa, Cryptosporidium parvum
YQSYGKNE

SEQ ID NO: 2228675 - protein, 5 aa, Cryptosporidium parvum
YQTET

SEQ ID NO: 2228676 - protein, 5 aa, Cryptosporidium parvum
YQTRN

SEQ ID NO: 2228677 - protein, 14 aa, Cryptosporidium parvum
YQTSSEKNLESQPT

SEQ ID NO: 2228678 - protein, 7 aa, Cryptosporidium parvum
YRATGQA

SEQ ID NO: 2228679 - protein, 21 aa, Cryptosporidium parvum
YRDSLSTLKSSEMSPEQGSGV

SEQ ID NO: 2228680 - protein, 14 aa, Cryptosporidium parvum
YREESMASSYYSNK

SEQ ID NO: 2228681 - protein, 4 aa, Cryptosporidium parvum
YREK

SEQ ID NO: 2228682 - protein, 6 aa, Cryptosporidium parvum
YRGDSD

SEQ ID NO: 2228683 - protein, 11 aa, Cryptosporidium parvum
YRGKGGDLTRK

SEQ ID NO: 2228684 - protein, 6 aa, Cryptosporidium parvum
YRHNDQ

SEQ ID NO: 2228685 - protein, 4 aa, Cryptosporidium parvum
YRIK

SEQ ID NO: 2228686 - protein, 10 aa, Cryptosporidium parvum
YRNDSQLSYE

SEQ ID NO: 2228687 - protein, 10 aa, Cryptosporidium parvum
YRNRKEGGLG

SEQ ID NO: 2228688 - protein, 13 aa, Cryptosporidium parvum
YRNSEATQEEQNK

SEQ ID NO: 2228689 - protein, 5 aa, Cryptosporidium parvum
YRPAE

SEQ ID NO: 2228690 - protein, 10 aa, Cryptosporidium parvum
YRPKSPRPKF

SEQ ID NO: 2228691 - protein, 5 aa, Cryptosporidium parvum
YRQNG

SEQ ID NO: 2228692 - protein, 13 aa, Cryptosporidium parvum
YRRKSRQRKLHLV

SEQ ID NO: 2228693 - protein, 8 aa, Cryptosporidium parvum
YRRSPDSY

SEQ ID NO: 2228694 - protein, 8 aa, Cryptosporidium parvum
YRSKTQKD

SEQ ID NO: 2228695 - protein, 5 aa, Cryptosporidium parvum
YSADP

SEQ ID NO: 2228696 - protein, 11 aa, Cryptosporidium parvum
YSATSSNGGIG

SEQ ID NO: 2228697 - protein, 10 aa, Cryptosporidium parvum
YSDESSQFEV

SEQ ID NO: 2228698 - protein, 4 aa, Cryptosporidium parvum
YSDN

SEQ ID NO: 2228699 - protein, 7 aa, Cryptosporidium parvum
YSDPDEE

SEQ ID NO: 2228700 - protein, 10 aa, Cryptosporidium parvum
YSDTNKQAGE

SEQ ID NO: 2228701 - protein, 7 aa, Cryptosporidium parvum
YSEAQKP

SEQ ID NO: 2228702 - protein, 11 aa, Cryptosporidium parvum
YSEDSKSFKND

SEQ ID NO: 2228703 - protein, 8 aa, Cryptosporidium parvum
YSEDSSNK

SEQ ID NO: 2228704 - protein, 5 aa, Cryptosporidium parvum
YSEEK

SEQ ID NO: 2228705 - protein, 6 aa, Cryptosporidium parvum
YSEEKT

SEQ ID NO: 2228706 - protein, 7 aa, Cryptosporidium parvum
YSEERKY

SEQ ID NO: 2228707 - protein, 10 aa, Cryptosporidium parvum
YSEKTNGISE

SEQ ID NO: 2228708 - protein, 24 aa, Cryptosporidium parvum
YSENESDSDLQIKQGDGNSNRDEE

SEQ ID NO: 2228709 - protein, 18 aa, Cryptosporidium parvum
YSENESTEISEEKNQQKC

SEQ ID NO: 2228710 - protein, 5 aa, Cryptosporidium parvum
YSENG

SEQ ID NO: 2228711 - protein, 9 aa, Cryptosporidium parvum
YSESENRDL

SEQ ID NO: 2228712 - protein, 9 aa, Cryptosporidium parvum
YSETSNPWY

SEQ ID NO: 2228713 - protein, 11 aa, Cryptosporidium parvum
YSGDKKENISP

SEQ ID NO: 2228714 - protein, 5 aa, Cryptosporidium parvum
YSGNN

SEQ ID NO: 2228715 - protein, 9 aa, Cryptosporidium parvum
YSGREETRT

SEQ ID NO: 2228716 - protein, 12 aa, Cryptosporidium parvum
YSGSESTKNNSF

SEQ ID NO: 2228717 - protein, 5 aa, Cryptosporidium parvum
YSGSF

SEQ ID NO: 2228718 - protein, 14 aa, Cryptosporidium parvum
YSGSQYSSKNTSQL

SEQ ID NO: 2228719 - protein, 23 aa, Cryptosporidium parvum
YSGTPAQKTDFTRYGKRTKKGVI

SEQ ID NO: 2228720 - protein, 6 aa, Cryptosporidium parvum
YSIDSS

SEQ ID NO: 2228721 - protein, 9 aa, Cryptosporidium parvum
YSIDSSTGF

SEQ ID NO: 2228722 - protein, 9 aa, Cryptosporidium parvum
YSKDDAPKF

SEQ ID NO: 2228723 - protein, 18 aa, Cryptosporidium parvum
YSKETIDKIKSNTSSTTC

SEQ ID NO: 2228724 - protein, 6 aa, Cryptosporidium parvum
YSKGEG

SEQ ID NO: 2228725 - protein, 7 aa, Cryptosporidium parvum
YSKHSKN

SEQ ID NO: 2228726 - protein, 6 aa, Cryptosporidium parvum
YSKISK

SEQ ID NO: 2228727 - protein, 9 aa, Cryptosporidium parvum
YSKKDREEK

SEQ ID NO: 2228728 - protein, 10 aa, Cryptosporidium parvum
YSKNNNSKYV

SEQ ID NO: 2228729 - protein, 9 aa, Cryptosporidium parvum
YSKNPRPSN

SEQ ID NO: 2228730 - protein, 7 aa, Cryptosporidium parvum
YSKNSGS

SEQ ID NO: 2228731 - protein, 6 aa, Cryptosporidium parvum
YSKPES

SEQ ID NO: 2228732 - protein, 10 aa, Cryptosporidium parvum
YSKSDPSETN

SEQ ID NO: 2228733 - protein, 9 aa, Cryptosporidium parvum
YSKSSEETL

SEQ ID NO: 2228734 - protein, 13 aa, Cryptosporidium parvum
YSKTKDPPAFPSG

SEQ ID NO: 2228735 - protein, 5 aa, Cryptosporidium parvum
YSKTP

SEQ ID NO: 2228736 - protein, 27 aa, Cryptosporidium parvum
YSKTPPFPEGDLKQSSTSNSAAFPEVS

SEQ ID NO: 2228737 - protein, 4 aa, Cryptosporidium parvum
YSND

SEQ ID NO: 2228738 - protein, 6 aa, Cryptosporidium parvum
YSNDEN

SEQ ID NO: 2228739 - protein, 6 aa, Cryptosporidium parvum
YSNEEK

SEQ ID NO: 2228740 - protein, 7 aa, Cryptosporidium parvum
YSNEKEI

SEQ ID NO: 2228741 - protein, 47 aa, Cryptosporidium parvum
YSNKNKNNNNNYNNYNNNNNNNNNNNTNNNTNNNNNINNNNSNNNNN

SEQ ID NO: 2228742 - protein, 9 aa, Cryptosporidium parvum
YSNKRKKSL

SEQ ID NO: 2228743 - protein, 10 aa, Cryptosporidium parvum
YSNKRRQEKN

SEQ ID NO: 2228744 - protein, 4 aa, Cryptosporidium parvum
YSNN

SEQ ID NO: 2228745 - protein, 5 aa, Cryptosporidium parvum
YSNNM

SEQ ID NO: 2228746 - protein, 13 aa, Cryptosporidium parvum
YSNNNNNNNNNNN

SEQ ID NO: 2228747 - protein, 9 aa, Cryptosporidium parvum
YSNNSSKSI

SEQ ID NO: 2228748 - protein, 8 aa, Cryptosporidium parvum
YSNNVPNL

SEQ ID NO: 2228749 - protein, 6 aa, Cryptosporidium parvum
YSNPVK

SEQ ID NO: 2228750 - protein, 11 aa, Cryptosporidium parvum
YSNRDDTKFDK

SEQ ID NO: 2228751 - protein, 10 aa, Cryptosporidium parvum
YSNRSTETEN

SEQ ID NO: 2228752 - protein, 20 aa, Cryptosporidium parvum
YSNSKKSTGPQDRRGNRSDA

SEQ ID NO: 2228753 - protein, 15 aa, Cryptosporidium parvum
YSNSSDGNESSEDYR

SEQ ID NO: 2228754 - protein, 9 aa, Cryptosporidium parvum
YSNSTENSS

SEQ ID NO: 2228755 - protein, 5 aa, Cryptosporidium parvum
YSNTD

SEQ ID NO: 2228756 - protein, 5 aa, Cryptosporidium parvum
YSPAR

SEQ ID NO: 2228757 - protein, 7 aa, Cryptosporidium parvum
YSPNETE

SEQ ID NO: 2228758 - protein, 6 aa, Cryptosporidium parvum
YSPNIK

SEQ ID NO: 2228759 - protein, 9 aa, Cryptosporidium parvum
YSPNKATCE

SEQ ID NO: 2228760 - protein, 7 aa, Cryptosporidium parvum
YSPPDSF

SEQ ID NO: 2228761 - protein, 7 aa, Cryptosporidium parvum
YSQKQRK

SEQ ID NO: 2228762 - protein, 5 aa, Cryptosporidium parvum
YSQSL

SEQ ID NO: 2228763 - protein, 12 aa, Cryptosporidium parvum
YSQSSNASPKNS

SEQ ID NO: 2228764 - protein, 7 aa, Cryptosporidium parvum
YSRESNF

SEQ ID NO: 2228765 - protein, 10 aa, Cryptosporidium parvum
YSRETNSSLG

SEQ ID NO: 2228766 - protein, 19 aa, Cryptosporidium parvum
YSRPETEYSEAMSSNQGNN

SEQ ID NO: 2228767 - protein, 4 aa, Cryptosporidium parvum
YSRS

SEQ ID NO: 2228768 - protein, 14 aa, Cryptosporidium parvum
YSRSPLDYPSSGIN

SEQ ID NO: 2228769 - protein, 10 aa, Cryptosporidium parvum
YSRTESQLTS

SEQ ID NO: 2228770 - protein, 15 aa, Cryptosporidium parvum
YSSASCSSLNPTNET

SEQ ID NO: 2228771 - protein, 4 aa, Cryptosporidium parvum
YSSE

SEQ ID NO: 2228772 - protein, 7 aa, Cryptosporidium parvum
YSSGLSQ

SEQ ID NO: 2228773 - protein, 10 aa, Cryptosporidium parvum
YSSITARKSW

SEQ ID NO: 2228774 - protein, 8 aa, Cryptosporidium parvum
YSSKNFSK

SEQ ID NO: 2228775 - protein, 7 aa, Cryptosporidium parvum
YSSNLSN

SEQ ID NO: 2228776 - protein, 30 aa, Cryptosporidium parvum
YSSNSNNLSGFGSSIGDSKTSFSSGTKYSK

SEQ ID NO: 2228777 - protein, 7 aa, Cryptosporidium parvum
YSSQKLD

SEQ ID NO: 2228778 - protein, 19 aa, Cryptosporidium parvum
YSSRESEEEEDDDDDDDFD

SEQ ID NO: 2228779 - protein, 5 aa, Cryptosporidium parvum
YSSSE

SEQ ID NO: 2228780 - protein, 10 aa, Cryptosporidium parvum
YSSSGFFSSP

SEQ ID NO: 2228781 - protein, 5 aa, Cryptosporidium parvum
YSSSI

SEQ ID NO: 2228782 - protein, 10 aa, Cryptosporidium parvum
YSSSITAPSK

SEQ ID NO: 2228783 - protein, 5 aa, Cryptosporidium parvum
YSSSN

SEQ ID NO: 2228784 - protein, 20 aa, Cryptosporidium parvum
YSSSNANRSVESKQNTDGYY

SEQ ID NO: 2228785 - protein, 7 aa, Cryptosporidium parvum
YSSSNNF

SEQ ID NO: 2228786 - protein, 8 aa, Cryptosporidium parvum
YSSTPSCG

SEQ ID NO: 2228787 - protein, 25 aa, Cryptosporidium parvum
YSSYSKLDSPIKDIDPTKNRKYQKS

SEQ ID NO: 2228788 - protein, 5 aa, Cryptosporidium parvum
YSTDR

SEQ ID NO: 2228789 - protein, 9 aa, Cryptosporidium parvum
YSTEEQNNP

SEQ ID NO: 2228790 - protein, 10 aa, Cryptosporidium parvum
YSTSEPDRQA

SEQ ID NO: 2228791 - protein, 22 aa, Cryptosporidium parvum
YSTSSPSSSSSSSFSSPSSLNE

SEQ ID NO: 2228792 - protein, 27 aa, Cryptosporidium parvum
YSWPPGGRTNPIIGQDGASSVGSQHLD

SEQ ID NO: 2228793 - protein, 39 aa, Cryptosporidium parvum
YSYEEEEEEEEEEEEEEEEEEIEEYDEDHERESLRHGRK

SEQ ID NO: 2228794 - protein, 9 aa, Cryptosporidium parvum
YSYNHDSGF

SEQ ID NO: 2228795 - protein, 10 aa, Cryptosporidium parvum
YSYQEQEPMD

SEQ ID NO: 2228796 - protein, 4 aa, Cryptosporidium parvum
YSYS

SEQ ID NO: 2228797 - protein, 9 aa, Cryptosporidium parvum
YSYSSANSY

SEQ ID NO: 2228798 - protein, 4 aa, Cryptosporidium parvum
YTDH

SEQ ID NO: 2228799 - protein, 5 aa, Cryptosporidium parvum
YTDNP

SEQ ID NO: 2228800 - protein, 4 aa, Cryptosporidium parvum
YTDS

SEQ ID NO: 2228801 - protein, 5 aa, Cryptosporidium parvum
YTEMN

SEQ ID NO: 2228802 - protein, 19 aa, Cryptosporidium parvum
YTESSSSPSSSKSNQKESV

SEQ ID NO: 2228803 - protein, 8 aa, Cryptosporidium parvum
YTESTKAI

SEQ ID NO: 2228804 - protein, 7 aa, Cryptosporidium parvum
YTETSEL

SEQ ID NO: 2228805 - protein, 5 aa, Cryptosporidium parvum
YTGAG

SEQ ID NO: 2228806 - protein, 7 aa, Cryptosporidium parvum
YTGDRDL

SEQ ID NO: 2228807 - protein, 5 aa, Cryptosporidium parvum
YTGEN

SEQ ID NO: 2228808 - protein, 8 aa, Cryptosporidium parvum
YTGGGNDH

SEQ ID NO: 2228809 - protein, 13 aa, Cryptosporidium parvum
YTGPEVPNQPKVA

SEQ ID NO: 2228810 - protein, 6 aa, Cryptosporidium parvum
YTGSGD

SEQ ID NO: 2228811 - protein, 12 aa, Cryptosporidium parvum
YTIHEQKSSYTP

SEQ ID NO: 2228812 - protein, 7 aa, Cryptosporidium parvum
YTKKHNQ

SEQ ID NO: 2228813 - protein, 9 aa, Cryptosporidium parvum
YTKNTNETL

SEQ ID NO: 2228814 - protein, 16 aa, Cryptosporidium parvum
YTKSIKPPKEITKFSF

SEQ ID NO: 2228815 - protein, 10 aa, Cryptosporidium parvum
YTKSQKSNKI

SEQ ID NO: 2228816 - protein, 5 aa, Cryptosporidium parvum
YTLDP

SEQ ID NO: 2228817 - protein, 5 aa, Cryptosporidium parvum
YTNFG

SEQ ID NO: 2228818 - protein, 9 aa, Cryptosporidium parvum
YTNPLTTDQ

SEQ ID NO: 2228819 - protein, 8 aa, Cryptosporidium parvum
YTPEEPEV

SEQ ID NO: 2228820 - protein, 6 aa, Cryptosporidium parvum
YTPLNP

SEQ ID NO: 2228821 - protein, 4 aa, Cryptosporidium parvum
YTPN

SEQ ID NO: 2228822 - protein, 13 aa, Cryptosporidium parvum
YTPNEYRYREWNR

SEQ ID NO: 2228823 - protein, 4 aa, Cryptosporidium parvum
YTPQ

SEQ ID NO: 2228824 - protein, 5 aa, Cryptosporidium parvum
YTSDN

SEQ ID NO: 2228825 - protein, 5 aa, Cryptosporidium parvum
YTSEN

SEQ ID NO: 2228826 - protein, 9 aa, Cryptosporidium parvum
YTSRATSGV

SEQ ID NO: 2228827 - protein, 11 aa, Cryptosporidium parvum
YTSSKVNNGIG

SEQ ID NO: 2228828 - protein, 5 aa, Cryptosporidium parvum
YTTCG

SEQ ID NO: 2228829 - protein, 5 aa, Cryptosporidium parvum
YTTSS

SEQ ID NO: 2228830 - protein, 4 aa, Cryptosporidium parvum
YTTY

SEQ ID NO: 2228831 - protein, 21 aa, Cryptosporidium parvum
YTWNKETRKRNKYNNDTANEH

SEQ ID NO: 2228832 - protein, 5 aa, Cryptosporidium parvum
YVDGQ

SEQ ID NO: 2228833 - protein, 14 aa, Cryptosporidium parvum
YVNSESDDPQETQE

SEQ ID NO: 2228834 - protein, 12 aa, Cryptosporidium parvum
YVQGDSALRPSS

SEQ ID NO: 2228835 - protein, 8 aa, Cryptosporidium parvum
YVSEDEQQ

SEQ ID NO: 2228836 - protein, 12 aa, Cryptosporidium parvum
YYEKGLSQDYSE

SEQ ID NO: 2228837 - protein, 4 aa, Cryptosporidium parvum
YYET

SEQ ID NO: 2228838 - protein, 5 aa, Cryptosporidium parvum
YYGKD

SEQ ID NO: 2228839 - protein, 23 aa, Cryptosporidium parvum
YYGNNGNSLINSQQNNAIKQPAL

SEQ ID NO: 2228840 - protein, 16 aa, Cryptosporidium parvum
YYKVDNKSGNIILKQQ

SEQ ID NO: 2228841 - protein, 11 aa, Cryptosporidium parvum
YYNNNSSINNT

SEQ ID NO: 2228842 - protein, 6 aa, Cryptosporidium parvum
YYNSDE

SEQ ID NO: 2228843 - protein, 20 aa, Cryptosporidium parvum
YYPNNTNNNGNDSKSAPYEI

SEQ ID NO: 2228844 - protein, 5 aa, Cryptosporidium parvum
YYPQD

SEQ ID NO: 2228845 - protein, 34 aa, Cryptosporidium parvum
YYPQQHPQQHPQQQQQHPQQQHHQQQIQQNQHSI

SEQ ID NO: 2228846 - protein, 6 aa, Cryptosporidium parvum
YYRKKD

SEQ ID NO: 2228847 - protein, 44 aa, Cryptosporidium parvum
YYSSSNSQNLNSLQPSALSGKSNISNANKNTNISTSRSNTQNLN

SEQ ID NO: 2228848 - protein, 5 aa, Cryptosporidium parvum
YYTDT

SEQ ID NO: 2228849 - protein, 8 aa, Cryptosporidium parvum
YYTEDEKR

SEQ ID NO: 2228850 - protein, 8 aa, Cryptosporidium parvum
YYYPPNPW

SEQ ID NO: 2228851 - protein, 23 aa, Cryptosporidium parvum
KSIIQFRFIFPLDKITDNFSEFS

SEQ ID NO: 2228852 - protein, 19 aa, Cryptosporidium parvum
AAAIEIFFGVFVDLLSLPI

SEQ ID NO: 2228853 - protein, 18 aa, Cryptosporidium parvum
AAFPGNIMNDYDLCLPIC

SEQ ID NO: 2228854 - protein, 21 aa, Cryptosporidium parvum
AAGNARLVFNLMLVIMSPVSR

SEQ ID NO: 2228855 - protein, 24 aa, Cryptosporidium parvum
AAGVGIYFGWKLFKKGKVCSMIKE

SEQ ID NO: 2228856 - protein, 20 aa, Cryptosporidium parvum
AAKLPPPFGNPAVKNEQKFP

SEQ ID NO: 2228857 - protein, 20 aa, Cryptosporidium parvum
AAKSTLLRLYKGYTQFEKDL

SEQ ID NO: 2228858 - protein, 18 aa, Cryptosporidium parvum
AAPPEYLYPVTITIYSSA

SEQ ID NO: 2228859 - protein, 17 aa, Cryptosporidium parvum
AAPRILRHIMRRTSREN

SEQ ID NO: 2228860 - protein, 19 aa, Cryptosporidium parvum
AARIALKFHNLREAYPQHF

SEQ ID NO: 2228861 - protein, 18 aa, Cryptosporidium parvum
AASSLNHYFIVAKLKNKG

SEQ ID NO: 2228862 - protein, 24 aa, Cryptosporidium parvum
AASVPRESCSLGFSCQSTSCRGGS

SEQ ID NO: 2228863 - protein, 19 aa, Cryptosporidium parvum
AATLYEIFYFRVFVLLTRF

SEQ ID NO: 2228864 - protein, 20 aa, Cryptosporidium parvum
AAVLKYADNILKCFGNSFSI

SEQ ID NO: 2228865 - protein, 22 aa, Cryptosporidium parvum
AAYFGLECEIHMGEVDVKKEYP

SEQ ID NO: 2228866 - protein, 24 aa, Cryptosporidium parvum
AAYMVMAFLAIYWQSALFSLGLKS

SEQ ID NO: 2228867 - protein, 22 aa, Cryptosporidium parvum
ACFILIRYFWLAKLIKINKRKY

SEQ ID NO: 2228868 - protein, 24 aa, Cryptosporidium parvum
ACKDLSLKAFHHFHNVSNLSFIQS

SEQ ID NO: 2228869 - protein, 25 aa, Cryptosporidium parvum
ACKIEIEAFYKWIQVLYYKVLNNNI

SEQ ID NO: 2228870 - protein, 22 aa, Cryptosporidium parvum
ACNGFEREQFGILMDPNIMRNE

SEQ ID NO: 2228871 - protein, 21 aa, Cryptosporidium parvum
ACSRTLVGLIDFPPFKSNDLD

SEQ ID NO: 2228872 - protein, 25 aa, Cryptosporidium parvum
ACTCPPFYGGETCDQFEFPWWFYNI

SEQ ID NO: 2228873 - protein, 19 aa, Cryptosporidium parvum
ACTVGFFLMGFIGYSVKLV

SEQ ID NO: 2228874 - protein, 24 aa, Cryptosporidium parvum
ADAMYFSFVYEVNWEYDSLKNLLI

SEQ ID NO: 2228875 - protein, 21 aa, Cryptosporidium parvum
ADCSYELAICIIKSIYSSSYF

SEQ ID NO: 2228876 - protein, 17 aa, Cryptosporidium parvum
ADFACLIYKALKFKLPA

SEQ ID NO: 2228877 - protein, 22 aa, Cryptosporidium parvum
ADFRNRIKLGVSEHEKENSDES

SEQ ID NO: 2228878 - protein, 19 aa, Cryptosporidium parvum
ADGIIRVYLFLSNLIDSEF

SEQ ID NO: 2228879 - protein, 23 aa, Cryptosporidium parvum
ADGILKCFCNALSIVLITLISWL

SEQ ID NO: 2228880 - protein, 17 aa, Cryptosporidium parvum
ADHFLDIVYPKLIRRKA

SEQ ID NO: 2228881 - protein, 26 aa, Cryptosporidium parvum
ADIRLVGSVWLHFSVQLLDGYDAPIY

SEQ ID NO: 2228882 - protein, 21 aa, Cryptosporidium parvum
ADLSLLRFSLVTNNFYESVIN

SEQ ID NO: 2228883 - protein, 35 aa, Cryptosporidium parvum; identical to SEQ ID NO: 2121962

SEQ ID NO: 2228884 - protein, 20 aa, Cryptosporidium parvum
ADSAIPWWAVILGIVPERFS

SEQ ID NO: 2228885 - protein, 24 aa, Cryptosporidium parvum
ADSCDMFWYPGIIRQVSSESLPDK

SEQ ID NO: 2228886 - protein, 26 aa, Cryptosporidium parvum
ADSRYKLVPIKWSWSVQEISEIFILQ

SEQ ID NO: 2228887 - protein, 19 aa, Cryptosporidium parvum
ADVGECGWHVLKYKSQIKY

SEQ ID NO: 2228888 - protein, 24 aa, Cryptosporidium parvum
ADYKEFKFLVDIVIDTGSTELIDM

SEQ ID NO: 2228889 - protein, 20 aa, Cryptosporidium parvum
AEAKLGAWLPPGKNEFLMLI

SEQ ID NO: 2228890 - protein, 19 aa, Cryptosporidium parvum
AEALKAFSQILYKHITEAT

SEQ ID NO: 2228891 - protein, 22 aa, Cryptosporidium parvum
AECTLKIVKMLWGFLNSDLFRF

SEQ ID NO: 2228892 - protein, 25 aa, Cryptosporidium parvum
AEECIRYIYRYGLYIYNGLILDFKI

SEQ ID NO: 2228893 - protein, 21 aa, Cryptosporidium parvum
AEERLNFIGLMVFANKLRPST

SEQ ID NO: 2228894 - protein, 19 aa, Cryptosporidium parvum
AEFLVKKCLSNQWKTGIDF

SEQ ID NO: 2228895 - protein, 17 aa, Cryptosporidium parvum
AEFRKQLILGEEGIPRL

SEQ ID NO: 2228896 - protein, 23 aa, Cryptosporidium parvum
AEGELNCPVGYEINELDMSCHKT

SEQ ID NO: 2228897 - protein, 22 aa, Cryptosporidium parvum
AEGLVFWLFRVHNLVTLRVATE

SEQ ID NO: 2228898 - protein, 19 aa, Cryptosporidium parvum
AEIIDVFYRVCIDDKQNNT

SEQ ID NO: 2228899 - protein, 17 aa, Cryptosporidium parvum
AEILKMSLFAYFALKKA

SEQ ID NO: 2228900 - protein, 21 aa, Cryptosporidium parvum
AEILSAFLVVVLFSFFFFHLW

SEQ ID NO: 2228901 - protein, 26 aa, Cryptosporidium parvum
AEIRSRLLAKTALCPGFSTLLTNLFN

SEQ ID NO: 2228902 - protein, 17 aa, Cryptosporidium parvum
AELIKSLIFSWKIFSER

SEQ ID NO: 2228903 - protein, 22 aa, Cryptosporidium parvum
AELSFTITVCRMISNISYDFNN

SEQ ID NO: 2228904 - protein, 34 aa, Cryptosporidium parvum
AEMKKLLKILPMSICFVGLVAFGNICLKYVQVST

SEQ ID NO: 2228905 - protein, 18 aa, Cryptosporidium parvum
AEMMLLRSIGIFPDIIFG

SEQ ID NO: 2228906 - protein, 17 aa, Cryptosporidium parvum
AENATCLMADYVQLEKE

SEQ ID NO: 2228907 - protein, 23 aa, Cryptosporidium parvum
AEQLRSTLILSLGHSIGEVPILL

SEQ ID NO: 2228908 - protein, 20 aa, Cryptosporidium parvum
AEWQMLKLIQYFFEDQSQNS

SEQ ID NO: 2228909 - protein, 23 aa, Cryptosporidium parvum
AEYRSMLIRDLINIARNDSDFLN

SEQ ID NO: 2228910 - protein, 20 aa, Cryptosporidium parvum
AEYYGQVLFSLWIKTKLHAI

SEQ ID NO: 2228911 - protein, 19 aa, Cryptosporidium parvum
AFALFSFFDEYELVLDDFS

SEQ ID NO: 2228912 - protein, 29 aa, Cryptosporidium parvum
AFDIIPFWVLICLLFCNYGKITLSAYWLP

SEQ ID NO: 2228913 - protein, 20 aa, Cryptosporidium parvum
AFFIHLKRFHRDISNVFPEL

SEQ ID NO: 2228914 - protein, 25 aa, Cryptosporidium parvum
AFGNEFLLSMGYKFDNTKLILDQVY

SEQ ID NO: 2228915 - protein, 23 aa, Cryptosporidium parvum
AFHIICFLLSFSPLLAVTEGCPF

SEQ ID NO: 2228916 - protein, 19 aa, Cryptosporidium parvum
AFHIMGWIFCFFLDKTWFY

SEQ ID NO: 2228917 - protein, 20 aa, Cryptosporidium parvum
AFHVYSCLFGLFLSFPSIFR

SEQ ID NO: 2228918 - protein, 17 aa, Cryptosporidium parvum
AFILDIFLIISGIITSI

SEQ ID NO: 2228919 - protein, 18 aa, Cryptosporidium parvum
AFKDPRPLIPNNLANTKK

SEQ ID NO: 2228920 - protein, 33 aa, Cryptosporidium parvum
AFKSSYTILFILKISLMLTMFFLAYSLKKFKES

SEQ ID NO: 2228921 - protein, 19 aa, Cryptosporidium parvum
AFLLRLSYSRLFYSYNSEK

SEQ ID NO: 2228922 - protein, 19 aa, Cryptosporidium parvum
AFLSFIFGPFFFRFFSNNS

SEQ ID NO: 2228923 - protein, 17 aa, Cryptosporidium parvum
AFLYNIILIISLTISIY

SEQ ID NO: 2228924 - protein, 17 aa, Cryptosporidium parvum
AFMAFQILQLLIKLAKT

SEQ ID NO: 2228925 - protein, 26 aa, Cryptosporidium parvum
AFNFPFKSLYLMNAIIILKFGLVCIF

SEQ ID NO: 2228926 - protein, 20 aa, Cryptosporidium parvum
AFNIEWWELYSFIYEAIISL

SEQ ID NO: 2228927 - protein, 22 aa, Cryptosporidium parvum
AFPDSVWSYAYSCVYILDENDE

SEQ ID NO: 2228928 - protein, 20 aa, Cryptosporidium parvum
AFQIFKNCFDHFGREKKPTL

SEQ ID NO: 2228929 - protein, 17 aa, Cryptosporidium parvum
AFSIEAFLLRLSYSRLF

SEQ ID NO: 2228930 - protein, 28 aa, Cryptosporidium parvum
AFTMAEWKFYKLVSVLRFISFLYCIVIF

SEQ ID NO: 2228931 - protein, 20 aa, Cryptosporidium parvum
AFVKGCIKMGTLPRTKMAIH

SEQ ID NO: 2228932 - protein, 23 aa, Cryptosporidium parvum
AFVRETYEIFLFLSAISLLYFIL

SEQ ID NO: 2228933 - protein, 19 aa, Cryptosporidium parvum
AGFVSKWATTFIGKYLENV

SEQ ID NO: 2228934 - protein, 26 aa, Cryptosporidium parvum
AGGNTLWSKLFFTWLSPWMSKFLGPG

SEQ ID NO: 2228935 - protein, 18 aa, Cryptosporidium parvum
AGICFGISLSCTFASRSR

SEQ ID NO: 2228936 - protein, 24 aa, Cryptosporidium parvum
AGIEPACISSLLSLYFENNDQLIL

SEQ ID NO: 2228937 - protein, 17 aa, Cryptosporidium parvum
AGIFDCLRRVSKEQGIL

SEQ ID NO: 2228938 - protein, 31 aa, Cryptosporidium parvum
AGKYEPRSKFGYRFFLVCNRVQNIGFGFEYR

SEQ ID NO: 2228939 - protein, 20 aa, Cryptosporidium parvum
AGLESVYCLSIFSRIILDFF

SEQ ID NO: 2228940 - protein, 17 aa, Cryptosporidium parvum
AGLIALGSVFIIITDYA

SEQ ID NO: 2228941 - protein, 20 aa, Cryptosporidium parvum
AGLLFKYIVLFDLLIMFLIL

SEQ ID NO: 2228942 - protein, 19 aa, Cryptosporidium parvum
AGLQTAGGWFIYKDPASIK

SEQ ID NO: 2228943 - protein, 20 aa, Cryptosporidium parvum
AGMCNDEWAILSSKRNYCNA

SEQ ID NO: 2228944 - protein, 26 aa, Cryptosporidium parvum
AGQKQLLCLARALLRQSKVVLLDEAT

SEQ ID NO: 2228945 - protein, 18 aa, Cryptosporidium parvum
AGRHQWKDPHLLAFSKSR

SEQ ID NO: 2228946 - protein, 18 aa, Cryptosporidium parvum
AGRMPGHMNVLLAESGVP

SEQ ID NO: 2228947 - protein, 31 aa, Cryptosporidium parvum; identical to SEQ ID NO: 2122005

SEQ ID NO: 2228948 - protein, 33 aa, Cryptosporidium parvum; identical to SEQ ID NO: 2122006

SEQ ID NO: 2228949 - protein, 22 aa, Cryptosporidium parvum
AHARLYLARVTMRLESGLTGII

SEQ ID NO: 2228950 - protein, 21 aa, Cryptosporidium parvum
AHGSKRVAYCRLKIIDIPHYI

SEQ ID NO: 2228951 - protein, 20 aa, Cryptosporidium parvum
AHHCTTCNICIFKMDHHCML

SEQ ID NO: 2228952 - protein, 21 aa, Cryptosporidium parvum
AHSYIQFTWVTKWIYLGSRRP

SEQ ID NO: 2228953 - protein, 25 aa, Cryptosporidium parvum
AHTLKRFLLLYSLSTGLSLTFGGLV

SEQ ID NO: 2228954 - protein, 25 aa, Cryptosporidium parvum
AIAACREPLRVAFTAQLRQVLHPTP

SEQ ID NO: 2228955 - protein, 27 aa, Cryptosporidium parvum
AIALIPRYAKRFGFKSRRDEVPIEQEC

SEQ ID NO: 2228956 - protein, 18 aa, Cryptosporidium parvum
AIEYMKINLYFFGVILHA

SEQ ID NO: 2228957 - protein, 25 aa, Cryptosporidium parvum
AIFEAICVLSVLIISMYTSLGVFQR

SEQ ID NO: 2228958 - protein, 22 aa, Cryptosporidium parvum
AIFKKLADDISFFKKSKIVNYV

SEQ ID NO: 2228959 - protein, 23 aa, Cryptosporidium parvum
AIFLLTFWFCYRTRRVRQSIFML

SEQ ID NO: 2228960 - protein, 20 aa, Cryptosporidium parvum
AIFQVCNYSGFNIFSNSEAI

SEQ ID NO: 2228961 - protein, 35 aa, Cryptosporidium parvum
AIGAATSAALWKAYFYRPEEMDDFTTYSMYIVTVL

SEQ ID NO: 2228962 - protein, 20 aa, Cryptosporidium parvum
AIGKSARKSIILRHAESRGI

SEQ ID NO: 2228963 - protein, 21 aa, Cryptosporidium parvum
AIHKYWGFLYLYKSVITNEVD

SEQ ID NO: 2228964 - protein, 26 aa, Cryptosporidium parvum
AIIEDFSKLLLCFEINVEDLFYNISD

SEQ ID NO: 2228965 - protein, 19 aa, Cryptosporidium parvum
AIIIDVYRQHVWNDAQAVN

SEQ ID NO: 2228966 - protein, 24 aa, Cryptosporidium parvum
AIKIFPITFLPSIKILEIGLSDKS

SEQ ID NO: 2228967 - protein, 19 aa, Cryptosporidium parvum
AILHILNKIVLIFPQSIYF

SEQ ID NO: 2228968 - protein, 20 aa, Cryptosporidium parvum
AILKSFFISLKFNDRRLPRL

SEQ ID NO: 2228969 - protein, 17 aa, Cryptosporidium parvum
AILLSFLKQKKIFHEER

SEQ ID NO: 2228970 - protein, 26 aa, Cryptosporidium parvum
AILSYFICFFLFIYNWIYLEKQNSNR

SEQ ID NO: 2228971 - protein, 28 aa, Cryptosporidium parvum
AIMAPNCFDNKFILAARRYQCCFDQIKG

SEQ ID NO: 2228972 - protein, 26 aa, Cryptosporidium parvum
AIMLFEGGICTYLMIILLNQELRNCN

SEQ ID NO: 2228973 - protein, 17 aa, Cryptosporidium parvum
AINCARTDMSIRIQIDL

SEQ ID NO: 2228974 - protein, 18 aa, Cryptosporidium parvum
AINGYPFFYTKNIVPSEH

SEQ ID NO: 2228975 - protein, 25 aa, Cryptosporidium parvum
AINQRLIFRGRCMLDDDTVGTYIKE

SEQ ID NO: 2228976 - protein, 20 aa, Cryptosporidium parvum
AIPIAFLIIISMFRIIRHSS

SEQ ID NO: 2228977 - protein, 21 aa, Cryptosporidium parvum
AIQLRNPRVSHIVYPYWSHSL

SEQ ID NO: 2228978 - protein, 33 aa, Cryptosporidium parvum
AISAWKLWKTKIFILSGRFPFFSIKDDSDAHLD

SEQ ID NO: 2228979 - protein, 22 aa, Cryptosporidium parvum
AISIVIGIIWLISLRYESRIAD

SEQ ID NO: 2228980 - protein, 26 aa, Cryptosporidium parvum
AISKIFPELVCRKGHDIIVELLSLLH

SEQ ID NO: 2228981 - protein, 26 aa, Cryptosporidium parvum
AISNLGFKYMMVFVGITIIACIIKIT

SEQ ID NO: 2228982 - protein, 24 aa, Cryptosporidium parvum
AISSACLCTSIISKHIFVIFNYWI

SEQ ID NO: 2228983 - protein, 18 aa, Cryptosporidium parvum
AISTACSNLFYSRPKCKF

SEQ ID NO: 2228984 - protein, 23 aa, Cryptosporidium parvum
AITELKNSYYLSIESLIICYLIL

SEQ ID NO: 2228985 - protein, 25 aa, Cryptosporidium parvum
AIWYCSINNTLLFFGISFLITMFPL

SEQ ID NO: 2228986 - protein, 23 aa, Cryptosporidium parvum
AIYSAQEFILFPISKIVATSHEK

SEQ ID NO: 2228987 - protein, 20 aa, Cryptosporidium parvum
AIYSLFGLRITNFVNSCLQL

SEQ ID NO: 2228988 - protein, 23 aa, Cryptosporidium parvum
AIYYLKIAVALAVAAIPEGLPAV

SEQ ID NO: 2228989 - protein, 18 aa, Cryptosporidium parvum
AKAHWIICLVDGMDSYLY

SEQ ID NO: 2228990 - protein, 19 aa, Cryptosporidium parvum
AKALKGIVPVVAIDDQSDM

SEQ ID NO: 2228991 - protein, 19 aa, Cryptosporidium parvum
AKDSKCLLFRSEINKHLNS

SEQ ID NO: 2228992 - protein, 23 aa, Cryptosporidium parvum
AKEFGDRIGYFHGVFSNSNSKSC

SEQ ID NO: 2228993 - protein, 24 aa, Cryptosporidium parvum
AKELLHPINILRLGSLWQGIFLRF

SEQ ID NO: 2228994 - protein, 19 aa, Cryptosporidium parvum
AKERFSLPQKYVFGYLKGK

SEQ ID NO: 2228995 - protein, 20 aa, Cryptosporidium parvum
AKLKGFPKYTNYNLNKEKSD

SEQ ID NO: 2228996 - protein, 17 aa, Cryptosporidium parvum
AKLPTAIEKFKNKSKSE

SEQ ID NO: 2228997 - protein, 24 aa, Cryptosporidium parvum
AKMEVLFFSWVICLDNWLEYLRTR

SEQ ID NO: 2228998 - protein, 23 aa, Cryptosporidium parvum
AKMIKHALCTLNISAKILEEEYI

SEQ ID NO: 2228999 - protein, 34 aa, Cryptosporidium parvum
AKMKKLMILICGGDGTVRWVIDRCREIYGVNSNS

SEQ ID NO: 2229000 - protein, 18 aa, Cryptosporidium parvum
AKMLPEPEIQHLISVLSS

SEQ ID NO: 2229001 - protein, 17 aa, Cryptosporidium parvum
AKMVRDAFEIAREKAPS

SEQ ID NO: 2229002 - protein, 19 aa, Cryptosporidium parvum
AKQTLNYIRLCLQGKTKLI

SEQ ID NO: 2229003 - protein, 32 aa, Cryptosporidium parvum
AKSGLDGGTVFKGEFPVGGPFSSPSDSSTFSS

SEQ ID NO: 2229004 - protein, 20 aa, Cryptosporidium parvum
AKSKRSSSIINMERNKNEKF

SEQ ID NO: 2229005 - protein, 22 aa, Cryptosporidium parvum
AKSLITISLWAYITLVLQFLTI

SEQ ID NO: 2229006 - protein, 30 aa, Cryptosporidium parvum
AKSLWPSYLQDMPWTMIKFASIARKSHRLP

SEQ ID NO: 2229007 - protein, 25 aa, Cryptosporidium parvum
AKSSSENWLALQFIKQYNVSIYIDH

SEQ ID NO: 2229008 - protein, 19 aa, Cryptosporidium parvum
AKVGELIFYNDFKGEPDVV

SEQ ID NO: 2229009 - protein, 26 aa, Cryptosporidium parvum
ALAKETIEKFLLGYLVRKNADSRYKL

SEQ ID NO: 2229010 - protein, 24 aa, Cryptosporidium parvum
ALAYHFKSALSYYFNEEAPRSIIP

SEQ ID NO: 2229011 - protein, 20 aa, Cryptosporidium parvum
ALDAFRVALGPGVILNYLLQ

SEQ ID NO: 2229012 - protein, 19 aa, Cryptosporidium parvum
ALEHGLPPTGGWGLGIDRL

SEQ ID NO: 2229013 - protein, 28 aa, Cryptosporidium parvum
ALENLLKRRFFIAPSFEIYGGVAGLFDY

SEQ ID NO: 2229014 - protein, 26 aa, Cryptosporidium parvum
ALFFTYCVVFILHLISGIILLISSAS

SEQ ID NO: 2229015 - protein, 25 aa, Cryptosporidium parvum
ALFPIFCVVASIILIFSLTGYSILG

SEQ ID NO: 2229016 - protein, 32 aa, Cryptosporidium parvum; identical to SEQ ID NO: 2122061

SEQ ID NO: 2229017 - protein, 28 aa, Cryptosporidium parvum
ALGRQRLRMILTLQQGILLLCFNEEKIF

SEQ ID NO: 2229018 - protein, 17 aa, Cryptosporidium parvum
ALHPERLVGTVGVQANY

SEQ ID NO: 2229019 - protein, 18 aa, Cryptosporidium parvum
ALHSGKKGTCGILVEPVY

SEQ ID NO: 2229020 - protein, 18 aa, Cryptosporidium parvum
ALIFGLKCTLVGYDAFED

SEQ ID NO: 2229021 - protein, 23 aa, Cryptosporidium parvum
ALIFRFYEVPVITLISPSHAGMS

SEQ ID NO: 2229022 - protein, 29 aa, Cryptosporidium parvum
ALIHLFVIYFGWKISYSLMPLNYSTNIDG

SEQ ID NO: 2229023 - protein, 26 aa, Cryptosporidium parvum
ALILTWLIVLIVMKFSKKLQHYVNQQ

SEQ ID NO: 2229024 - protein, 22 aa, Cryptosporidium parvum
ALIPKLLPSLLISESTYATYIR

SEQ ID NO: 2229025 - protein, 18 aa, Cryptosporidium parvum
ALISYFGFVNDYLFMFSS

SEQ ID NO: 2229026 - protein, 17 aa, Cryptosporidium parvum
ALKCLSNTFSVPWIATN

SEQ ID NO: 2229027 - protein, 21 aa, Cryptosporidium parvum
ALKLRDLRQVVSMGSSQRPSI

SEQ ID NO: 2229028 - protein, 23 aa, Cryptosporidium parvum
ALLCCGEVVHLFLSIIGFEGVSG

SEQ ID NO: 2229029 - protein, 19 aa, Cryptosporidium parvum
ALLEGIAGFLFNSTACQNG

SEQ ID NO: 2229030 - protein, 28 aa, Cryptosporidium parvum
ALLFKLPRGRYLLESGVEMVADHLLKDI

SEQ ID NO: 2229031 - protein, 19 aa, Cryptosporidium parvum
ALLKDLVFLLGNREFDVFR

SEQ ID NO: 2229032 - protein, 22 aa, Cryptosporidium parvum
ALLKLFLLIFLNITNIFMFLIT

SEQ ID NO: 2229033 - protein, 17 aa, Cryptosporidium parvum
ALLKYKSCENGKEYQWE

SEQ ID NO: 2229034 - protein, 17 aa, Cryptosporidium parvum
ALLSFLYSLGVSIVCRV

SEQ ID NO: 2229035 - protein, 21 aa, Cryptosporidium parvum
ALMDFRFSVKMNEETLGIGED

SEQ ID NO: 2229036 - protein, 17 aa, Cryptosporidium parvum
ALNAIFISRSYRKNLLE

SEQ ID NO: 2229037 - protein, 20 aa, Cryptosporidium parvum
ALNFKHEVDQSFHISVYIPQ

SEQ ID NO: 2229038 - protein, 22 aa, Cryptosporidium parvum
ALNICGVTNYLLERETMNNFNH

SEQ ID NO: 2229039 - protein, 21 aa, Cryptosporidium parvum
ALNLSRRSICMAKEQKSKITL

SEQ ID NO: 2229040 - protein, 20 aa, Cryptosporidium parvum
ALPLISGYFILLPITHYVAN

SEQ ID NO: 2229041 - protein, 21 aa, Cryptosporidium parvum
ALPSDWFLAALQQLSQMNAEL

SEQ ID NO: 2229042 - protein, 26 aa, Cryptosporidium parvum
ALQICTTCTLLGFLPACLNLLNNPSR

SEQ ID NO: 2229043 - protein, 26 aa, Cryptosporidium parvum
ALQKTFAYMTLWPIAYSVKRSIRHSW

SEQ ID NO: 2229044 - protein, 22 aa, Cryptosporidium parvum
ALRAFRFTSRLHFRVDEELLSA

SEQ ID NO: 2229045 - protein, 19 aa, Cryptosporidium parvum
ALRAVLCVISGIFLTLGPF

SEQ ID NO: 2229046 - protein, 24 aa, Cryptosporidium parvum
ALRIWQCTQSGLLGGLLGISGNCI

SEQ ID NO: 2229047 - protein, 22 aa, Cryptosporidium parvum
ALRLRDIYVEFAIHPVAGRMPG

SEQ ID NO: 2229048 - protein, 27 aa, Cryptosporidium parvum
ALRPIWLKIRIVYVIFAILLFFIIGAV

SEQ ID NO: 2229049 - protein, 27 aa, Cryptosporidium parvum
ALSENMIALLIGFRGIYIYQIVEDYDG

SEQ ID NO: 2229050 - protein, 27 aa, Cryptosporidium parvum
ALSHIKHYGMLLGSFILRKNDPEKQFE

SEQ ID NO: 2229051 - protein, 24 aa, Cryptosporidium parvum
ALSIAKYILFFSFIYKSYTQFSNS

SEQ ID NO: 2229052 - protein, 29 aa, Cryptosporidium parvum
ALVGKGSKFDCFIPLIIKKIHEVERSNYK

SEQ ID NO: 2229053 - protein, 17 aa, Cryptosporidium parvum
ALYAVRIAQGFLYMGKG

SEQ ID NO: 2229054 - protein, 22 aa, Cryptosporidium parvum
ALYGSGLFPFFVHSSTQVKPIF

SEQ ID NO: 2229055 - protein, 19 aa, Cryptosporidium parvum
ALYHFDWNIFVRKKALLSI

SEQ ID NO: 2229056 - protein, 18 aa, Cryptosporidium parvum
ALYSLPIRYSAFSKNKFY

SEQ ID NO: 2229057 - protein, 21 aa, Cryptosporidium parvum
AMIPAMAWLFIDIFCTLLPLL

SEQ ID NO: 2229058 - protein, 25 aa, Cryptosporidium parvum
AMLLRRLAKRIDLFRSAEESLSAIM

SEQ ID NO: 2229059 - protein, 21 aa, Cryptosporidium parvum
AMNPFIPIYIFQVHKSNCFWS

SEQ ID NO: 2229060 - protein, 24 aa, Cryptosporidium parvum
ANADKFKLSIPPSVPESIPEKDQK

SEQ ID NO: 2229061 - protein, 26 aa, Cryptosporidium parvum
ANFIPYCFLSHLFGIVICVFCYSYFI

SEQ ID NO: 2229062 - protein, 23 aa, Cryptosporidium parvum
ANGKLKLFLTKTINIENFDTSCN

SEQ ID NO: 2229063 - protein, 22 aa, Cryptosporidium parvum
ANIKRFDFYSNIVYFYYKNSVK

SEQ ID NO: 2229064 - protein, 17 aa, Cryptosporidium parvum
ANIRASKYFPYKNIESS

SEQ ID NO: 2229065 - protein, 27 aa, Cryptosporidium parvum
ANKNEKEWFLYWSSIFGKLCGKEPILR

SEQ ID NO: 2229066 - protein, 23 aa, Cryptosporidium parvum
ANKRSELYIKLFDQEVNEYQNSE

SEQ ID NO: 2229067 - protein, 17 aa, Cryptosporidium parvum
ANLHLSLDFTRESSKLF

SEQ ID NO: 2229068 - protein, 23 aa, Cryptosporidium parvum
ANNVLEFWDDWFYPDSNKITETL

SEQ ID NO: 2229069 - protein, 24 aa, Cryptosporidium parvum
ANQFQLFLNWSILRLMEEDFSYCI

SEQ ID NO: 2229070 - protein, 17 aa, Cryptosporidium parvum
ANRFKYPKNWSITEKIQ

SEQ ID NO: 2229071 - protein, 20 aa, Cryptosporidium parvum
ANRLTWIVIILLAIDCFFSF

SEQ ID NO: 2229072 - protein, 18 aa, Cryptosporidium parvum
ANSAVFFLACVMISSMVV

SEQ ID NO: 2229073 - protein, 45 aa, Cryptosporidium parvum; identical to SEQ ID NO: 2122096

SEQ ID NO: 2229074 - protein, 26 aa, Cryptosporidium parvum
ANSNLCIICLQGILSLLKNYELQALK

SEQ ID NO: 2229075 - protein, 23 aa, Cryptosporidium parvum
ANSRSLYLFMIMYGFTIVICKNI

SEQ ID NO: 2229076 - protein, 18 aa, Cryptosporidium parvum
APFDPEWYAQVVDACCLV

SEQ ID NO: 2229077 - protein, 19 aa, Cryptosporidium parvum
APFFTGMLMSYSLQDIIGA

SEQ ID NO: 2229078 - protein, 17 aa, Cryptosporidium parvum
APGLMIFILTQRIQVLR

SEQ ID NO: 2229079 - protein, 24 aa, Cryptosporidium parvum
APTFQPRSGFVVGMGSGAGTGTGT

SEQ ID NO: 2229080 - protein, 19 aa, Cryptosporidium parvum
APTWLLVLYFRGSKKKIRP

SEQ ID NO: 2229081 - protein, 25 aa, Cryptosporidium parvum
APVEYKEEISLLWRLLTLLVGNSSK

SEQ ID NO: 2229082 - protein, 25 aa, Cryptosporidium parvum
AQALLHYMIVWRGDYSGCRRLSQML

SEQ ID NO: 2229083 - protein, 24 aa, Cryptosporidium parvum
AQFGCISGVFGFTMGMMIFGGLIS

SEQ ID NO: 2229084 - protein, 17 aa, Cryptosporidium parvum
AQFITSVCSLVLRKLVY

SEQ ID NO: 2229085 - protein, 23 aa, Cryptosporidium parvum
AQGTCWGFAAACHAVVFHALLFT

SEQ ID NO: 2229086 - protein, 35 aa, Cryptosporidium parvum; identical to SEQ ID NO: 2122112

SEQ ID NO: 2229087 - protein, 17 aa, Cryptosporidium parvum
AQISEFIYRSEHIPISF

SEQ ID NO: 2229088 - protein, 20 aa, Cryptosporidium parvum
AQKLLRFPIKSCERQLNKNE

SEQ ID NO: 2229089 - protein, 25 aa, Cryptosporidium parvum
AQLIISFVFILLCRFNYKVEISLLF

SEQ ID NO: 2229090 - protein, 18 aa, Cryptosporidium parvum
AQNFKYWICGVEENDCFA

SEQ ID NO: 2229091 - protein, 18 aa, Cryptosporidium parvum
AQSFGLWYGSKMTVEKKI

SEQ ID NO: 2229092 - protein, 21 aa, Cryptosporidium parvum
AQSSYLFSRIVEYFESESFSP

SEQ ID NO: 2229093 - protein, 19 aa, Cryptosporidium parvum
AQVALLIPIFGRRNVLTFG

SEQ ID NO: 2229094 - protein, 26 aa, Cryptosporidium parvum
AQVPSIFHQRCCTLLLNSVRSIIDTF

SEQ ID NO: 2229095 - protein, 24 aa, Cryptosporidium parvum
AQVSKQLIDWVWIISSLPELIFGL

SEQ ID NO: 2229096 - protein, 18 aa, Cryptosporidium parvum
ARAILRKSKIILLDEATS

SEQ ID NO: 2229097 - protein, 17 aa, Cryptosporidium parvum
AREIQYCFLQYGPEVLE

SEQ ID NO: 2229098 - protein, 20 aa, Cryptosporidium parvum
ARFLLGRNCSMEELENDIED

SEQ ID NO: 2229099 - protein, 17 aa, Cryptosporidium parvum
ARFQILINLIILIDSTR

SEQ ID NO: 2229100 - protein, 21 aa, Cryptosporidium parvum
ARIIEKLLRLHINTKTKEKIR

SEQ ID NO: 2229101 - protein, 23 aa, Cryptosporidium parvum
ARLFWSFWLHTGFIHLFINLSCQ

SEQ ID NO: 2229102 - protein, 25 aa, Cryptosporidium parvum
ARLWCTSRTYPIRIFTGHFGDVRSV

SEQ ID NO: 2229103 - protein, 17 aa, Cryptosporidium parvum
ARMYYAFQMSIEQIHSE

SEQ ID NO: 2229104 - protein, 24 aa, Cryptosporidium parvum
ARRNTRVLTKFAIPVINREFNKRW

SEQ ID NO: 2229105 - protein, 17 aa, Cryptosporidium parvum
ARSGNKLIWPNTSASLV

SEQ ID NO: 2229106 - protein, 25 aa, Cryptosporidium parvum
ARSKIKYKFFRNFQLSPFLPENSNK

SEQ ID NO: 2229107 - protein, 19 aa, Cryptosporidium parvum
ARSLLLTPLSIKWNDSHTR

SEQ ID NO: 2229108 - protein, 17 aa, Cryptosporidium parvum
ARSTIFSQVQFSRGQKV

SEQ ID NO: 2229109 - protein, 24 aa, Cryptosporidium parvum
ARVMFRSVLESVFFSNSFSELEDV

SEQ ID NO: 2229110 - protein, 18 aa, Cryptosporidium parvum
ARVSLARSIYQNYINING

SEQ ID NO: 2229111 - protein, 20 aa, Cryptosporidium parvum
ARYFFQFDECHIILCNCCYK

SEQ ID NO: 2229112 - protein, 19 aa, Cryptosporidium parvum
ASADFVIKGLIQFDPNRLI

SEQ ID NO: 2229113 - protein, 18 aa, Cryptosporidium parvum
ASCPYMYLTGFSTNNGNV

SEQ ID NO: 2229114 - protein, 17 aa, Cryptosporidium parvum
ASDKIWLERFLSQRNIS

SEQ ID NO: 2229115 - protein, 19 aa, Cryptosporidium parvum
ASDKLEFSFEIVISKLIDS

SEQ ID NO: 2229116 - protein, 24 aa, Cryptosporidium parvum
ASENRAIIRWGISVEPAINIVMYP

SEQ ID NO: 2229117 - protein, 24 aa, Cryptosporidium parvum
ASFIFLLFICLSFGIIVACIDYFG

SEQ ID NO: 2229118 - protein, 18 aa, Cryptosporidium parvum
ASFNLAFMAQFGIGIVQD

SEQ ID NO: 2229119 - protein, 19 aa, Cryptosporidium parvum
ASFSIGSDVYTIWIPLYNN

SEQ ID NO: 2229120 - protein, 18 aa, Cryptosporidium parvum
ASIALDLIKRHHLLLVTL

SEQ ID NO: 2229121 - protein, 19 aa, Cryptosporidium parvum
ASIFPSLILLPQIEFQGIF

SEQ ID NO: 2229122 - protein, 18 aa, Cryptosporidium parvum
ASILPRLNVNIENKIENL

SEQ ID NO: 2229123 - protein, 17 aa, Cryptosporidium parvum
ASIPTIFSTVKVSLNQY

SEQ ID NO: 2229124 - protein, 19 aa, Cryptosporidium parvum
ASIWTKIIVQFFLAFTNGL

SEQ ID NO: 2229125 - protein, 22 aa, Cryptosporidium parvum
ASKELKNIFLLLLNSEQLASLN

SEQ ID NO: 2229126 - protein, 19 aa, Cryptosporidium parvum
ASLKYCRTSFLSNVLGTEK

SEQ ID NO: 2229127 - protein, 17 aa, Cryptosporidium parvum
ASLLGGLSLNIALGMVY

SEQ ID NO: 2229128 - protein, 23 aa, Cryptosporidium parvum
ASLPIVAAAGFLITKIHRSWGTT

SEQ ID NO: 2229129 - protein, 23 aa, Cryptosporidium parvum
ASLQNCKKVWVLGKGRILFETDL

SEQ ID NO: 2229130 - protein, 18 aa, Cryptosporidium parvum
ASLSCSKMLILISLIVKF

SEQ ID NO: 2229131 - protein, 18 aa, Cryptosporidium parvum
ASNFLKQIGHFFISKIQF

SEQ ID NO: 2229132 - protein, 23 aa, Cryptosporidium parvum
ASNIKRRKTNMIPPNSQPNSMMG

SEQ ID NO: 2229133 - protein, 36 aa, Cryptosporidium parvum
ASNIWKASISIRLYYFILRIVIIIGTISVLIPLNIA

SEQ ID NO: 2229134 - protein, 21 aa, Cryptosporidium parvum
ASNSFFYPAIDLMKTEKKDES

SEQ ID NO: 2229135 - protein, 17 aa, Cryptosporidium parvum
ASQIGVLLINLINSDSI

SEQ ID NO: 2229136 - protein, 25 aa, Cryptosporidium parvum
ASQSIFKFYLLESIGHQMAPSVKIV

SEQ ID NO: 2229137 - protein, 19 aa, Cryptosporidium parvum
ASSIVFIFMMYSRNYQITG

SEQ ID NO: 2229138 - protein, 24 aa, Cryptosporidium parvum
ASSPLRLALEMFLKEGLTHIPIVF

SEQ ID NO: 2229139 - protein, 19 aa, Cryptosporidium parvum
ASTAARFLLGRNCSMEELE

SEQ ID NO: 2229140 - protein, 20 aa, Cryptosporidium parvum
ASTCFNLLKLPSYNSKEILK

SEQ ID NO: 2229141 - protein, 24 aa, Cryptosporidium parvum
ASYLNIRLSCSFGNKKNIELELTQ

SEQ ID NO: 2229142 - protein, 25 aa, Cryptosporidium parvum
ASYLNWTCWYAWMIQSFLLPTGLIV

SEQ ID NO: 2229143 - protein, 19 aa, Cryptosporidium parvum
ATDCHCLSELLSLPCLKSR

SEQ ID NO: 2229144 - protein, 17 aa, Cryptosporidium parvum
ATFGFYFLSVVICTLST

SEQ ID NO: 2229145 - protein, 25 aa, Cryptosporidium parvum
ATFSILFEWSTSMSPQISLIFHYWG

SEQ ID NO: 2229146 - protein, 25 aa, Cryptosporidium parvum
ATGECEFDRVMSLEGVYIANVKDDE

SEQ ID NO: 2229147 - protein, 20 aa, Cryptosporidium parvum
ATHWSRFSTAASLGVIHMGH

SEQ ID NO: 2229148 - protein, 23 aa, Cryptosporidium parvum
ATIQVPLLLSRLIDNVGAISSSN

SEQ ID NO: 2229149 - protein, 18 aa, Cryptosporidium parvum
ATLDNTWAVSRQKTEQAA

SEQ ID NO: 2229150 - protein, 29 aa, Cryptosporidium parvum
ATSASLLLFCIFVGIAIKTFEGMRNELST

SEQ ID NO: 2229151 - protein, 33 aa, Cryptosporidium parvum
ATVGLKICFSSKVFKDLILFFGTKVPTCSDIFE

SEQ ID NO: 2229152 - protein, 19 aa, Cryptosporidium parvum
ATWSISFLNIRAYLRKPFS

SEQ ID NO: 2229153 - protein, 19 aa, Cryptosporidium parvum
ATYFDIVQIIFLRQIFILL

SEQ ID NO: 2229154 - protein, 25 aa, Cryptosporidium parvum
AVCVVLCTRLSFRFPAKDGRNYIPS

SEQ ID NO: 2229155 - protein, 21 aa, Cryptosporidium parvum
AVEGILRWINIESEIGANDFV

SEQ ID NO: 2229156 - protein, 35 aa, Cryptosporidium parvum
AVFCEMLRAYTVRTWDWFTKPLFNNPWLHFACSLS

SEQ ID NO: 2229157 - protein, 17 aa, Cryptosporidium parvum
AVGGRRVGVKVGPGPSG

SEQ ID NO: 2229158 - protein, 24 aa, Cryptosporidium parvum
AVGLVAAGVGAWYASRNRQEGEDD

SEQ ID NO: 2229159 - protein, 25 aa, Cryptosporidium parvum
AVGNPRGSIDYIWYGAILQNLCGCI

SEQ ID NO: 2229160 - protein, 27 aa, Cryptosporidium parvum
AVGNVIFKQSFDIYKEVGFGVPMEEYI

SEQ ID NO: 2229161 - protein, 17 aa, Cryptosporidium parvum
AVGRYKCRVGETSCYGS

SEQ ID NO: 2229162 - protein, 20 aa, Cryptosporidium parvum
AVIYRHFYPINLFNTISQQN

SEQ ID NO: 2229163 - protein, 17 aa, Cryptosporidium parvum
AVKGTESYADGFSFFED

SEQ ID NO: 2229164 - protein, 22 aa, Cryptosporidium parvum
AVLRYIEIFLFSGMNGSSPLIT

SEQ ID NO: 2229165 - protein, 25 aa, Cryptosporidium parvum
AVMNEFCGNFALAVKQYIAAWDNIM

SEQ ID NO: 2229166 - protein, 25 aa, Cryptosporidium parvum
AVPGIPSRCILLIYIGLSSPVYFGS

SEQ ID NO: 2229167 - protein, 24 aa, Cryptosporidium parvum
AVSIPCSIGIFFLLFLTSNIIWFF

SEQ ID NO: 2229168 - protein, 22 aa, Cryptosporidium parvum
AVSLGFVLCRVMNDRVVSFEET

SEQ ID NO: 2229169 - protein, 17 aa, Cryptosporidium parvum
AVYPCILALAVVLHHIF

SEQ ID NO: 2229170 - protein, 19 aa, Cryptosporidium parvum
AYEQGHLPSAYALSQLNLN

SEQ ID NO: 2229171 - protein, 33 aa, Cryptosporidium parvum
AYGLPVDPKTGFPIDPISYLPFAKNGELIDPIS

SEQ ID NO: 2229172 - protein, 29 aa, Cryptosporidium parvum
AYGSCLIVRLSAYIAFKKKFRSMLASDLI

SEQ ID NO: 2229173 - protein, 18 aa, Cryptosporidium parvum
AYGYACIENELFTCERTR

SEQ ID NO: 2229174 - protein, 26 aa, Cryptosporidium parvum
AYISLAIFCVIVFFFLSDGDFSFLLT

SEQ ID NO: 2229175 - protein, 25 aa, Cryptosporidium parvum
AYKCNELGIRECISITWREMMKSSF

SEQ ID NO: 2229176 - protein, 23 aa, Cryptosporidium parvum
AYLHLNHHLPWIEEYHQRSLKTE

SEQ ID NO: 2229177 - protein, 26 aa, Cryptosporidium parvum
AYLNDRLKVILIYKHANKNYFSFHPK

SEQ ID NO: 2229178 - protein, 34 aa, Cryptosporidium parvum; identical to SEQ ID NO: 2122174

SEQ ID NO: 2229179 - protein, 19 aa, Cryptosporidium parvum
AYRSKGWSYLDIVSKAPQC

SEQ ID NO: 2229180 - protein, 25 aa, Cryptosporidium parvum
AYSNTRFGDILTFPTKDYPNGLTLE

SEQ ID NO: 2229181 - protein, 33 aa, Cryptosporidium parvum; identical to SEQ ID NO: 2122176

SEQ ID NO: 2229182 - protein, 19 aa, Cryptosporidium parvum
AYTDLGIIYYELGKEEKAI

SEQ ID NO: 2229183 - protein, 23 aa, Cryptosporidium parvum
AYVILRMIYEWVAPDDYSSMIGA

SEQ ID NO: 2229184 - protein, 25 aa, Cryptosporidium parvum
CAAIKEPWSILSLDISFKEKKKNSK

SEQ ID NO: 2229185 - protein, 20 aa, Cryptosporidium parvum
CADGLELSPFMDIQPGDTLN

SEQ ID NO: 2229186 - protein, 19 aa, Cryptosporidium parvum
CADSCGLCEAFSNDKKSIG

SEQ ID NO: 2229187 - protein, 19 aa, Cryptosporidium parvum
CAFSALRSFIFGSLNCFIG

SEQ ID NO: 2229188 - protein, 29 aa, Cryptosporidium parvum
CALGGPLLGFLFGWGVHLFLKVAQATNDV

SEQ ID NO: 2229189 - protein, 22 aa, Cryptosporidium parvum
CANQCYWSKYTVFGNCQRSVYN

SEQ ID NO: 2229190 - protein, 23 aa, Cryptosporidium parvum
CAPFNIRGSDCFIQGAEGNTIIP

SEQ ID NO: 2229191 - protein, 20 aa, Cryptosporidium parvum
CAVSSILVFVCLCSAYSIWI

SEQ ID NO: 2229192 - protein, 33 aa, Cryptosporidium parvum
CCCLCTRFDGILLPLRKGYQIDFSGTKTRKTLL

SEQ ID NO: 2229193 - protein, 17 aa, Cryptosporidium parvum
CCFAAQLEIQRGILGIE

SEQ ID NO: 2229194 - protein, 21 aa, Cryptosporidium parvum
CCGILSIICFFFMKETKGCSV

SEQ ID NO: 2229195 - protein, 24 aa, Cryptosporidium parvum
CCTTFQWQMVFQFIKILKEYFNQL

SEQ ID NO: 2229196 - protein, 19 aa, Cryptosporidium parvum
CCVVLKEKILELLTEMIQS

SEQ ID NO: 2229197 - protein, 21 aa, Cryptosporidium parvum
CDFLYKIYNGILYNMESIHFS

SEQ ID NO: 2229198 - protein, 18 aa, Cryptosporidium parvum
CDHFSKRGGLPCLSVLRL

SEQ ID NO: 2229199 - protein, 21 aa, Cryptosporidium parvum
CDIQSLFGIYDWYSDYSRAFC

SEQ ID NO: 2229200 - protein, 19 aa, Cryptosporidium parvum
CDKIGGFWITIRLNKNPFR

SEQ ID NO: 2229201 - protein, 28 aa, Cryptosporidium parvum
CDLCNNWYHWYCLGLHKDNIPSENEPFH

SEQ ID NO: 2229202 - protein, 20 aa, Cryptosporidium parvum
CDLSPFSTCCNSESPDGSST

SEQ ID NO: 2229203 - protein, 24 aa, Cryptosporidium parvum
CDMFFGIIMSIYWNGVLVNELVEC

SEQ ID NO: 2229204 - protein, 19 aa, Cryptosporidium parvum
CDSESFSILSDILILIRQL

SEQ ID NO: 2229205 - protein, 19 aa, Cryptosporidium parvum
CDSIWVANLMNAFRIYFME

SEQ ID NO: 2229206 - protein, 26 aa, Cryptosporidium parvum
CDSLLLNITCVLGYVSMEEHSLWVSI

SEQ ID NO: 2229207 - protein, 18 aa, Cryptosporidium parvum
CDYIHNIISSNWVDPNSL

SEQ ID NO: 2229208 - protein, 17 aa, Cryptosporidium parvum
CEEKKKIGFCDCNSVWT

SEQ ID NO: 2229209 - protein, 18 aa, Cryptosporidium parvum
CEFECKYSKEEILKSIRK

SEQ ID NO: 2229210 - protein, 27 aa, Cryptosporidium parvum
CEFINMFSLCIVCKLYTEISICQASTP

SEQ ID NO: 2229211 - protein, 23 aa, Cryptosporidium parvum
CEGFERNFRLAFHHFNESAFHLF

SEQ ID NO: 2229212 - protein, 28 aa, Cryptosporidium parvum
CEIFSTRFRAFLSYFLPMVYGISLFSVA

SEQ ID NO: 2229213 - protein, 18 aa, Cryptosporidium parvum
CEILKIFDFNGVSRSMSV

SEQ ID NO: 2229214 - protein, 17 aa, Cryptosporidium parvum
CELEAIDLLCEVEQMET

SEQ ID NO: 2229215 - protein, 25 aa, Cryptosporidium parvum
CELIIIIDFMLEYLLLLLENGLDIN

SEQ ID NO: 2229216 - protein, 24 aa, Cryptosporidium parvum
CESKSRLVFIPNIHEYKDCTSTNQ

SEQ ID NO: 2229217 - protein, 23 aa, Cryptosporidium parvum
CESSDFCQKCGGVENHLMEEPKN

SEQ ID NO: 2229218 - protein, 20 aa, Cryptosporidium parvum
CEYGFNILTTRSFKTELSNL

SEQ ID NO: 2229219 - protein, 18 aa, Cryptosporidium parvum
CFAFKLFSKEIEKADTYF

SEQ ID NO: 2229220 - protein, 17 aa, Cryptosporidium parvum
CFDIFFYIFNWKSIPKM

SEQ ID NO: 2229221 - protein, 28 aa, Cryptosporidium parvum
CFDLSSSKFLSCWAIFFLTTAFAAGLNK

SEQ ID NO: 2229222 - protein, 22 aa, Cryptosporidium parvum
CFEKIPNIFFISSLELFNQIIV

SEQ ID NO: 2229223 - protein, 20 aa, Cryptosporidium parvum
CFENEILDYMVVKCMDSFSR

SEQ ID NO: 2229224 - protein, 31 aa, Cryptosporidium parvum
CFFLIVCGWVINVFWPFVEGIGIRDLEIHGT

SEQ ID NO: 2229225 - protein, 18 aa, Cryptosporidium parvum
CFFNKCAHNINLKFDDAE

SEQ ID NO: 2229226 - protein, 21 aa, Cryptosporidium parvum
CFFSILWMIGFYFIIPKHPFV

SEQ ID NO: 2229227 - protein, 26 aa, Cryptosporidium parvum
CFGWIRKKLFAFSVIVKRSFMNNARN

SEQ ID NO: 2229228 - protein, 29 aa, Cryptosporidium parvum
CFHPKEMLLIMGFPNNWFEGVNIDLKKQY

SEQ ID NO: 2229229 - protein, 26 aa, Cryptosporidium parvum
CFIESFGPKERYEWRTDFDYESDTKF

SEQ ID NO: 2229230 - protein, 18 aa, Cryptosporidium parvum
CFIPMRYSISDYKLMENK

SEQ ID NO: 2229231 - protein, 20 aa, Cryptosporidium parvum
CFLASLRPSPIGIPSTIIRR

SEQ ID NO: 2229232 - protein, 24 aa, Cryptosporidium parvum
CFQYLSLLLNMWFGKVTIVITPLI

SEQ ID NO: 2229233 - protein, 23 aa, Cryptosporidium parvum
CFSNCIRKEAPFIIKEIKDLGIK

SEQ ID NO: 2229234 - protein, 19 aa, Cryptosporidium parvum
CFSNFKFKQRPSYFSTVPE

SEQ ID NO: 2229235 - protein, 17 aa, Cryptosporidium parvum
CFTLFTFAKSHRIKTSN

SEQ ID NO: 2229236 - protein, 18 aa, Cryptosporidium parvum
CFYSLRELMNIEIFNHLI

SEQ ID NO: 2229237 - protein, 19 aa, Cryptosporidium parvum
CGAFKYKKRHPGTKWPLAI

SEQ ID NO: 2229238 - protein, 18 aa, Cryptosporidium parvum
CGCMTLHVLQFILVLLTW

SEQ ID NO: 2229239 - protein, 20 aa, Cryptosporidium parvum
CGFKTYRDETTISFHPGCNC

SEQ ID NO: 2229240 - protein, 18 aa, Cryptosporidium parvum
CGHCKAFAPEYEKAAKAL

SEQ ID NO: 2229241 - protein, 25 aa, Cryptosporidium parvum
CGIKDARFGLISNIYYIKENMDKID

SEQ ID NO: 2229242 - protein, 18 aa, Cryptosporidium parvum
CGNSDWALMQGNQISESE

SEQ ID NO: 2229243 - protein, 22 aa, Cryptosporidium parvum
CGTESFNSPILIWDVEGTDSLE

SEQ ID NO: 2229244 - protein, 25 aa, Cryptosporidium parvum
CGTFITRFSIYYIPDITKEKSIRMI

SEQ ID NO: 2229245 - protein, 17 aa, Cryptosporidium parvum
CHFPILRLQVWNRGLLV

SEQ ID NO: 2229246 - protein, 27 aa, Cryptosporidium parvum
CHLAICLSRATGLWSHLDTVERLASVI

SEQ ID NO: 2229247 - protein, 17 aa, Cryptosporidium parvum
CHNWKFEDEFLRVNHSV

SEQ ID NO: 2229248 - protein, 20 aa, Cryptosporidium parvum
CIAIIIYTFHGFRIDENMYD

SEQ ID NO: 2229249 - protein, 23 aa, Cryptosporidium parvum
CIASEFRLYFQIILGSCLIIYAF

SEQ ID NO: 2229250 - protein, 17 aa, Cryptosporidium parvum
CIDYELRCYLYACRNLN

SEQ ID NO: 2229251 - protein, 18 aa, Cryptosporidium parvum
CIESGLIISRTFSSVICD

SEQ ID NO: 2229252 - protein, 26 aa, Cryptosporidium parvum
CIGSIKLNPLIALRMRLILHGFHSNR

SEQ ID NO: 2229253 - protein, 19 aa, Cryptosporidium parvum
CIHSIFWVPFDIYDDDNLW

SEQ ID NO: 2229254 - protein, 19 aa, Cryptosporidium parvum
CIIDFKIAIESSNTAYNSI

SEQ ID NO: 2229255 - protein, 19 aa, Cryptosporidium parvum
CIIDLIFFKENCGIISLNS

SEQ ID NO: 2229256 - protein, 17 aa, Cryptosporidium parvum
CIIGICFQNKPSSLVIM

SEQ ID NO: 2229257 - protein, 20 aa, Cryptosporidium parvum
CIIGPIPPKLLFITKSLSLQ

SEQ ID NO: 2229258 - protein, 20 aa, Cryptosporidium parvum
CIIPLIQLEIGFKHEELKLI

SEQ ID NO: 2229259 - protein, 21 aa, Cryptosporidium parvum
CILALAVVLHHIFRYLFCDQR

SEQ ID NO: 2229260 - protein, 26 aa, Cryptosporidium parvum
CILIYPILIWYYFKYIFKPTRIQTRE

SEQ ID NO: 2229261 - protein, 19 aa, Cryptosporidium parvum
CILNSVTVGIFFTKFSEST

SEQ ID NO: 2229262 - protein, 23 aa, Cryptosporidium parvum
CILSFFLTFAIHLNFLEANPGGE

SEQ ID NO: 2229263 - protein, 17 aa, Cryptosporidium parvum
CINEAWVQILNCDDTLA

SEQ ID NO: 2229264 - protein, 19 aa, Cryptosporidium parvum
CINYRGSCININIFNIISV

SEQ ID NO: 2229265 - protein, 19 aa, Cryptosporidium parvum
CIPCKNSSLNYIKVMCEKA

SEQ ID NO: 2229266 - protein, 22 aa, Cryptosporidium parvum
CIQSPVCLDISLNMSRYQIFLD

SEQ ID NO: 2229267 - protein, 19 aa, Cryptosporidium parvum
CIQSSWKMVESNWKNQNVQ

SEQ ID NO: 2229268 - protein, 23 aa, Cryptosporidium parvum
CIRNILRKYPLVLQPLIQFLNIF

SEQ ID NO: 2229269 - protein, 21 aa, Cryptosporidium parvum
CIRSFRSFFFYNRPKKDVYTA

SEQ ID NO: 2229270 - protein, 20 aa, Cryptosporidium parvum
CIRSQIIQFLSIINLKIHFK

SEQ ID NO: 2229271 - protein, 19 aa, Cryptosporidium parvum
CITTKLLLLFYKYIILLLR

SEQ ID NO: 2229272 - protein, 35 aa, Cryptosporidium parvum
CIVSELNFTSTTGFTTDTSMNWPVSITSGELKDPN

SEQ ID NO: 2229273 - protein, 25 aa, Cryptosporidium parvum
CKAYFELFCVRYWYSENLKKFTCVE

SEQ ID NO: 2229274 - protein, 19 aa, Cryptosporidium parvum
CKENAFCLRYRKFVEYIRK

SEQ ID NO: 2229275 - protein, 19 aa, Cryptosporidium parvum
CKENFFLIVCMMSLLISSV

SEQ ID NO: 2229276 - protein, 18 aa, Cryptosporidium parvum
CKEQERKKELSLLLDNII

SEQ ID NO: 2229277 - protein, 20 aa, Cryptosporidium parvum
CKGIQFHISYFFLNKEDPEI

SEQ ID NO: 2229278 - protein, 20 aa, Cryptosporidium parvum
CKICVLDFVREKALYISDVP

SEQ ID NO: 2229279 - protein, 17 aa, Cryptosporidium parvum
CKINRLKLEDVVIPNII

SEQ ID NO: 2229280 - protein, 17 aa, Cryptosporidium parvum
CKINSLFTVSFKYNSTN

SEQ ID NO: 2229281 - protein, 19 aa, Cryptosporidium parvum
CKIQAIPFVEHIRNLNNSA

SEQ ID NO: 2229282 - protein, 19 aa, Cryptosporidium parvum
CKKSLFCGIWLLFHSWSIS

SEQ ID NO: 2229283 - protein, 19 aa, Cryptosporidium parvum
CKLPFEPIKIFRLVTQAGL

SEQ ID NO: 2229284 - protein, 21 aa, Cryptosporidium parvum
CKNKIPEIFVDFITNSDMDMN

SEQ ID NO: 2229285 - protein, 17 aa, Cryptosporidium parvum
CKPRQDLLTGILLQPLL

SEQ ID NO: 2229286 - protein, 21 aa, Cryptosporidium parvum
CKQDPFCVAWSYNATLSEGPD

SEQ ID NO: 2229287 - protein, 19 aa, Cryptosporidium parvum
CKQIWKKPVYLSWVNACCN

SEQ ID NO: 2229288 - protein, 17 aa, Cryptosporidium parvum
CKQLEAILSDLKSSCNA

SEQ ID NO: 2229289 - protein, 24 aa, Cryptosporidium parvum
CKSSLKKELKSICQNAQIDSQIFH

SEQ ID NO: 2229290 - protein, 20 aa, Cryptosporidium parvum
CKTCKEAFGRKEKCKTISNT

SEQ ID NO: 2229291 - protein, 18 aa, Cryptosporidium parvum
CKTINFLGKTAIDVRLSL

SEQ ID NO: 2229292 - protein, 24 aa, Cryptosporidium parvum
CKVGLHPWIRVNRVIRDIPNQSII

SEQ ID NO: 2229293 - protein, 19 aa, Cryptosporidium parvum
CKVQISWLDIGFNLSNNSH

SEQ ID NO: 2229294 - protein, 22 aa, Cryptosporidium parvum
CKYAFFHYMCAYLFILTVISFL

SEQ ID NO: 2229295 - protein, 23 aa, Cryptosporidium parvum
CKYILQCITQHFVKLCNSERDKH

SEQ ID NO: 2229296 - protein, 18 aa, Cryptosporidium parvum
CKYIPGVGMTCIINSMKV

SEQ ID NO: 2229297 - protein, 19 aa, Cryptosporidium parvum
CLDDRIVLELWDAYGGGDG

SEQ ID NO: 2229298 - protein, 19 aa, Cryptosporidium parvum
CLIILSKGLGIFNIIYNYL

SEQ ID NO: 2229299 - protein, 17 aa, Cryptosporidium parvum
CLILASRLTNTFKKKNN

SEQ ID NO: 2229300 - protein, 17 aa, Cryptosporidium parvum
CLIQDTFEDILYDYIQY

SEQ ID NO: 2229301 - protein, 21 aa, Cryptosporidium parvum
CLKQIPKNDKFLFNANNNNNN

SEQ ID NO: 2229302 - protein, 35 aa, Cryptosporidium parvum
CLLIYVYVCTYWGLFYFKIPKKYGIYLNKHTDGPC

SEQ ID NO: 2229303 - protein, 24 aa, Cryptosporidium parvum
CLNLISLLSLCSFLVITGLQGTIE

SEQ ID NO: 2229304 - protein, 25 aa, Cryptosporidium parvum
CLQFQKSYFSWVFSLFIVSFFCYFS

SEQ ID NO: 2229305 - protein, 23 aa, Cryptosporidium parvum
CLQILKYRSNMKVFKEKKLMNEI

SEQ ID NO: 2229306 - protein, 18 aa, Cryptosporidium parvum
CLREGIDRKYCKAISNSI

SEQ ID NO: 2229307 - protein, 32 aa, Cryptosporidium parvum
CLRIVEFIYKLFFRSIEDWHYPITKKLPSATK

SEQ ID NO: 2229308 - protein, 30 aa, Cryptosporidium parvum
CLSFMKIIKSYAWEECFTKKITDCRNNEIK

SEQ ID NO: 2229309 - protein, 19 aa, Cryptosporidium parvum
CLSGGAIIRAFDAERVYLD

SEQ ID NO: 2229310 - protein, 25 aa, Cryptosporidium parvum
CLSPCLKGGLFSKISTWGASDKLEF

SEQ ID NO: 2229311 - protein, 18 aa, Cryptosporidium parvum
CLSVLRLLPPNLLGARTL

SEQ ID NO: 2229312 - protein, 22 aa, Cryptosporidium parvum
CLTFCGSASYTAFNHFGSKPSM

SEQ ID NO: 2229313 - protein, 26 aa, Cryptosporidium parvum
CLVFPAVVYLKLFKYIFICDKYLSRP

SEQ ID NO: 2229314 - protein, 20 aa, Cryptosporidium parvum
CLVLYSPLCGVFSEAMSGGP

SEQ ID NO: 2229315 - protein, 19 aa, Cryptosporidium parvum
CLVSLIFIIAFANLFNTIF

SEQ ID NO: 2229316 - protein, 29 aa, Cryptosporidium parvum
CMDNLNCWRKLLPCTTLDFSSKIGSYGIL

SEQ ID NO: 2229317 - protein, 25 aa, Cryptosporidium parvum
CMEALPLFLDRIIPSWVAVICSVTA

SEQ ID NO: 2229318 - protein, 26 aa, Cryptosporidium parvum
CMFKAVLPLMKIRWKTLNLINTSKMD

SEQ ID NO: 2229319 - protein, 22 aa, Cryptosporidium parvum
CMLKHRLQRSSTFDELLFMLKP

SEQ ID NO: 2229320 - protein, 18 aa, Cryptosporidium parvum
CMVSPWKNLEFICVMDTV

SEQ ID NO: 2229321 - protein, 18 aa, Cryptosporidium parvum
CNAKWKIYSLLFEQFTST

SEQ ID NO: 2229322 - protein, 17 aa, Cryptosporidium parvum
CNCIVGLNGSGKSNILA

SEQ ID NO: 2229323 - protein, 22 aa, Cryptosporidium parvum
CNFQEIRFLQIFTDIPLSFSKI

SEQ ID NO: 2229324 - protein, 22 aa, Cryptosporidium parvum
CNICFLDFDSIIIFSPCGHGGV

SEQ ID NO: 2229325 - protein, 18 aa, Cryptosporidium parvum
CNIINILVSIIIKDFKLH

SEQ ID NO: 2229326 - protein, 31 aa, Cryptosporidium parvum
CNKCRECSPGCALWFIGNGVCDPECDNLSCQ

SEQ ID NO: 2229327 - protein, 22 aa, Cryptosporidium parvum
CNKMGNLLFRRKSWLTEQGVYG

SEQ ID NO: 2229328 - protein, 24 aa, Cryptosporidium parvum
CNKNSNIKFCWFDFHSECSKMRWS

SEQ ID NO: 2229329 - protein, 25 aa, Cryptosporidium parvum
CNLPRPAFSRPVLRRNQQDWMKFAI

SEQ ID NO: 2229330 - protein, 31 aa, Cryptosporidium parvum; identical to SEQ ID NO: 2122272

SEQ ID NO: 2229331 - protein, 20 aa, Cryptosporidium parvum
CNNIFHSECIYKWFRTSNKT

SEQ ID NO: 2229332 - protein, 25 aa, Cryptosporidium parvum
CNPNSDLVCISRFIDFNYIDRFKMN

SEQ ID NO: 2229333 - protein, 28 aa, Cryptosporidium parvum
CNSFVDLLLLKRIYRFSQITLDENINTE

SEQ ID NO: 2229334 - protein, 18 aa, Cryptosporidium parvum
CNSISFTEFETVNYNHSK

SEQ ID NO: 2229335 - protein, 19 aa, Cryptosporidium parvum
CNSSNMLLRGCKLRNTSWA

SEQ ID NO: 2229336 - protein, 18 aa, Cryptosporidium parvum
CNTIEIYRSYALSDPLFG

SEQ ID NO: 2229337 - protein, 20 aa, Cryptosporidium parvum
CNYALVFSYFIVKVLEKPQN

SEQ ID NO: 2229338 - protein, 26 aa, Cryptosporidium parvum
CNYICLFPDIISGPSVEWRNSLNELD

SEQ ID NO: 2229339 - protein, 18 aa, Cryptosporidium parvum
CNYLKPQIVLSISFMVCG

SEQ ID NO: 2229340 - protein, 19 aa, Cryptosporidium parvum
CPATCGMCVECAPGCQLRD

SEQ ID NO: 2229341 - protein, 22 aa, Cryptosporidium parvum
CPEHSCNIAPTILLRKYQLSHF

SEQ ID NO: 2229342 - protein, 18 aa, Cryptosporidium parvum
CPFMYMNVICKPRQDLLT

SEQ ID NO: 2229343 - protein, 17 aa, Cryptosporidium parvum
CPIKLSLIEKLREISNL

SEQ ID NO: 2229344 - protein, 23 aa, Cryptosporidium parvum
CPKRITFSKSLPWVIFQNNKQFS

SEQ ID NO: 2229345 - protein, 21 aa, Cryptosporidium parvum
CPRIERCPSDCKVGEWSSWSE

SEQ ID NO: 2229346 - protein, 19 aa, Cryptosporidium parvum
CPSKHYIKMLEHFFNTIYL

SEQ ID NO: 2229347 - protein, 25 aa, Cryptosporidium parvum
CPTFELLLRKCIIEWEKQIDYIINN

SEQ ID NO: 2229348 - protein, 19 aa, Cryptosporidium parvum
CPWFGNCIGYFNYKFFFLA

SEQ ID NO: 2229349 - protein, 19 aa, Cryptosporidium parvum
CQERSYLPIIVFSFSKKDC

SEQ ID NO: 2229350 - protein, 17 aa, Cryptosporidium parvum
CQIEISKSFGINTSESE

SEQ ID NO: 2229351 - protein, 27 aa, Cryptosporidium parvum
CQILCLALSCPIWGLLADRYSRKYILA

SEQ ID NO: 2229352 - protein, 22 aa, Cryptosporidium parvum
CQILKLIYNNVINKKWFEKEYQ

SEQ ID NO: 2229353 - protein, 20 aa, Cryptosporidium parvum
CQISNKFGSHILLKAYKPRA

SEQ ID NO: 2229354 - protein, 32 aa, Cryptosporidium parvum; identical to SEQ ID NO: 2122283

SEQ ID NO: 2229355 - protein, 22 aa, Cryptosporidium parvum
CREQFAKLAFITVRMKSNLILV

SEQ ID NO: 2229356 - protein, 18 aa, Cryptosporidium parvum
CRFISNKDAIKWVDFDFC

SEQ ID NO: 2229357 - protein, 20 aa, Cryptosporidium parvum
CRPESLDIVFDDVKFGQCTS

SEQ ID NO: 2229358 - protein, 17 aa, Cryptosporidium parvum
CRTKHQPCHVVYTDYRP

SEQ ID NO: 2229359 - protein, 18 aa, Cryptosporidium parvum
CRTLREFGTNHPKFKFLS

SEQ ID NO: 2229360 - protein, 20 aa, Cryptosporidium parvum
CRYPSAPGFQILSVVDMGPT

SEQ ID NO: 2229361 - protein, 20 aa, Cryptosporidium parvum
CSCKHKKISFESCSEIYNLI

SEQ ID NO: 2229362 - protein, 21 aa, Cryptosporidium parvum
CSECGKCVLNMDHHCPWINNC

SEQ ID NO: 2229363 - protein, 18 aa, Cryptosporidium parvum
CSGKEAWKNISKCNKLRR

SEQ ID NO: 2229364 - protein, 19 aa, Cryptosporidium parvum
CSHFNCWDNSLIIGNGIDG

SEQ ID NO: 2229365 - protein, 23 aa, Cryptosporidium parvum
CSHGTFFWILKRYILPWDTYSDY

SEQ ID NO: 2229366 - protein, 26 aa, Cryptosporidium parvum
CSIIIKELPFMLAIEPPSTNCVPIKA

SEQ ID NO: 2229367 - protein, 19 aa, Cryptosporidium parvum
CSILHFMLPISFMSILIYS

SEQ ID NO: 2229368 - protein, 18 aa, Cryptosporidium parvum
CSILSLKIFLLLINNIDW

SEQ ID NO: 2229369 - protein, 25 aa, Cryptosporidium parvum
CSKLYPALCFDLYGSPGFHNIYVGL

SEQ ID NO: 2229370 - protein, 20 aa, Cryptosporidium parvum
CSKMLILISLIVKFYSTFVF

SEQ ID NO: 2229371 - protein, 21 aa, Cryptosporidium parvum
CSKRMKYGIMGDGVNLASRIE

SEQ ID NO: 2229372 - protein, 24 aa, Cryptosporidium parvum
CSLHSHMALIFGMGGYHREPFYKN

SEQ ID NO: 2229373 - protein, 19 aa, Cryptosporidium parvum
CSPFIKDIHKCIGELLKDY

SEQ ID NO: 2229374 - protein, 26 aa, Cryptosporidium parvum
CSQILRYVDSIAFIIAWNASDAFVFS

SEQ ID NO: 2229375 - protein, 22 aa, Cryptosporidium parvum
CSSFLKNLFCTLACNEESSDIG

SEQ ID NO: 2229376 - protein, 20 aa, Cryptosporidium parvum
CSSLKVTIFGAGSFGSAISC

SEQ ID NO: 2229377 - protein, 19 aa, Cryptosporidium parvum
CSSNLTISVLLPLLIAIYY

SEQ ID NO: 2229378 - protein, 19 aa, Cryptosporidium parvum
CSSPLCIWYSHKCDAYRIV

SEQ ID NO: 2229379 - protein, 24 aa, Cryptosporidium parvum
CSSRSKRFLGFCVNGIKEIHGSFA

SEQ ID NO: 2229380 - protein, 24 aa, Cryptosporidium parvum
CSTHIKNLLLLYLSIFWTDIGTTE

SEQ ID NO: 2229381 - protein, 19 aa, Cryptosporidium parvum
CSTSYPVLSVWPQLSVNDF

SEQ ID NO: 2229382 - protein, 20 aa, Cryptosporidium parvum
CSVQCIFGKIILLIVSIILL

SEQ ID NO: 2229383 - protein, 21 aa, Cryptosporidium parvum
CSWETVGPAARGLTCSGSVHM

SEQ ID NO: 2229384 - protein, 19 aa, Cryptosporidium parvum
CSYFSNDICIITIIMRLVS

SEQ ID NO: 2229385 - protein, 21 aa, Cryptosporidium parvum
CTACGEGKYSFPGSYSQSLCF

SEQ ID NO: 2229386 - protein, 19 aa, Cryptosporidium parvum
CTEPFRIPFAGKLRICAFD

SEQ ID NO: 2229387 - protein, 17 aa, Cryptosporidium parvum
CTESLMKIINFKIANVL

SEQ ID NO: 2229388 - protein, 21 aa, Cryptosporidium parvum
CTIKVLLLLGQVLAFDAEGHS

SEQ ID NO: 2229389 - protein, 20 aa, Cryptosporidium parvum
CVAYLGRLLVSASLSRIPNP

SEQ ID NO: 2229390 - protein, 18 aa, Cryptosporidium parvum
CVFGHPLMDAGLSIDPYS

SEQ ID NO: 2229391 - protein, 17 aa, Cryptosporidium parvum
CVGEKNFMCTLWLVILR

SEQ ID NO: 2229392 - protein, 19 aa, Cryptosporidium parvum
CVGVYFLGVGVVGSVLYIP

SEQ ID NO: 2229393 - protein, 22 aa, Cryptosporidium parvum
CVHPAPILRKHASKVFNAILEQ

SEQ ID NO: 2229394 - protein, 18 aa, Cryptosporidium parvum
CVIQLTFLIINIMVVSKQ

SEQ ID NO: 2229395 - protein, 27 aa, Cryptosporidium parvum
CVLIPNSLCPIKLIGMVFVLSPSPLLQ

SEQ ID NO: 2229396 - protein, 24 aa, Cryptosporidium parvum
CVNNLKIKCIFRLNSDREGISIIQ

SEQ ID NO: 2229397 - protein, 26 aa, Cryptosporidium parvum
CVQMLCGILSICLLIIIVLLVVLGIR

SEQ ID NO: 2229398 - protein, 18 aa, Cryptosporidium parvum
CVVFSISVAYLLYFLHVS

SEQ ID NO: 2229399 - protein, 19 aa, Cryptosporidium parvum
CVYELLLRAFEIVRKEQSG

SEQ ID NO: 2229400 - protein, 18 aa, Cryptosporidium parvum
CWASLLSKHVINSHLERV

SEQ ID NO: 2229401 - protein, 19 aa, Cryptosporidium parvum
CWRYESKKRIHGRMFVNDR

SEQ ID NO: 2229402 - protein, 18 aa, Cryptosporidium parvum
CYFLPAVLHLKLFSDSPW

SEQ ID NO: 2229403 - protein, 25 aa, Cryptosporidium parvum
CYHICRELNNEFGMIYINQIFSVNP

SEQ ID NO: 2229404 - protein, 25 aa, Cryptosporidium parvum
CYKATARAGVKIIYTPTILLSSSES

SEQ ID NO: 2229405 - protein, 30 aa, Cryptosporidium parvum
CYKMISGYDSEVHWQYVFDLDEAISVYSTP

SEQ ID NO: 2229406 - protein, 22 aa, Cryptosporidium parvum
CYLYIYCYHRFAAKNLIINGLK

SEQ ID NO: 2229407 - protein, 19 aa, Cryptosporidium parvum
CYNGWTITVWFHYPLLTNY

SEQ ID NO: 2229408 - protein, 39 aa, Cryptosporidium parvum
CYNNVEKTFKCYRLLFIVQVICLIFSFLITMKLPFNCYS

SEQ ID NO: 2229409 - protein, 21 aa, Cryptosporidium parvum
CYTNPMGIDCFCYNDQSIYNH

SEQ ID NO: 2229410 - protein, 20 aa, Cryptosporidium parvum
CYVFILTIFFGFFFLYLERI

SEQ ID NO: 2229411 - protein, 18 aa, Cryptosporidium parvum
CYYGDHFLDTCTENVEYE

SEQ ID NO: 2229412 - protein, 17 aa, Cryptosporidium parvum
DAACASSLIAIDQAIKS

SEQ ID NO: 2229413 - protein, 21 aa, Cryptosporidium parvum
DAALDDQYRWSVANLIKKQSI

SEQ ID NO: 2229414 - protein, 22 aa, Cryptosporidium parvum
DAAMLIAIFPRQIRFLIAEASF

SEQ ID NO: 2229415 - protein, 24 aa, Cryptosporidium parvum
DADCELKWALSDSELALITKELIY

SEQ ID NO: 2229416 - protein, 21 aa, Cryptosporidium parvum
DAEIYGEIWIIVLSLVLVSII

SEQ ID NO: 2229417 - protein, 21 aa, Cryptosporidium parvum
DAFVKYKGILFIGALIGTRTA

SEQ ID NO: 2229418 - protein, 36 aa, Cryptosporidium parvum
DAGLSIDPYSLWMLVDYRWGWPLVNSYFQLQEPLVQ

SEQ ID NO: 2229419 - protein, 21 aa, Cryptosporidium parvum
DAGNIWNIISSPLIYPLFMET

SEQ ID NO: 2229420 - protein, 17 aa, Cryptosporidium parvum
DAIPFFFVSVLKLNLLL

SEQ ID NO: 2229421 - protein, 24 aa, Cryptosporidium parvum
DANAYRPPILQMYIFISALGTLFC

SEQ ID NO: 2229422 - protein, 20 aa, Cryptosporidium parvum
DARIRLGAIILLSKNWGLLE

SEQ ID NO: 2229423 - protein, 19 aa, Cryptosporidium parvum
DASRLRLLKEIAGTRTYDE

SEQ ID NO: 2229424 - protein, 24 aa, Cryptosporidium parvum
DAVNHLKLGSAMPTVCESLSKSCQ

SEQ ID NO: 2229425 - protein, 18 aa, Cryptosporidium parvum
DCCSGISIAKFAAGNLLK

SEQ ID NO: 2229426 - protein, 28 aa, Cryptosporidium parvum
DCFETFTMGIVINGVYLRICPNTYPVYL

SEQ ID NO: 2229427 - protein, 21 aa, Cryptosporidium parvum
DCILGSWSHWSSCSVECGKGN

SEQ ID NO: 2229428 - protein, 26 aa, Cryptosporidium parvum
DCILLPVNIWITWKLLSKQVGLIAAL

SEQ ID NO: 2229429 - protein, 20 aa, Cryptosporidium parvum
DCISWWFLGSSPEYILLIQV

SEQ ID NO: 2229430 - protein, 23 aa, Cryptosporidium parvum
DCLFIIPCLLIFLSDFLIPINIL

SEQ ID NO: 2229431 - protein, 21 aa, Cryptosporidium parvum
DCLYFIKKHHKLLLKSNLSRE

SEQ ID NO: 2229432 - protein, 23 aa, Cryptosporidium parvum
DCMEFTLRIDRMLNAVANVDIGA

SEQ ID NO: 2229433 - protein, 25 aa, Cryptosporidium parvum
DCRLDELRYILSNIRTIKLLNWESF

SEQ ID NO: 2229434 - protein, 25 aa, Cryptosporidium parvum
DCRSGIWPLYLIIMLICTFRIIFMV

SEQ ID NO: 2229435 - protein, 17 aa, Cryptosporidium parvum
DCVLGEWTEWGVCSKSC

SEQ ID NO: 2229436 - protein, 17 aa, Cryptosporidium parvum
DCVLSFWSPWTGCSKFL

SEQ ID NO: 2229437 - protein, 24 aa, Cryptosporidium parvum
DDDCIYDLGFVIPIINSRFKLAYS

SEQ ID NO: 2229438 - protein, 18 aa, Cryptosporidium parvum
DDDMLGAFEVKRSESRSL

SEQ ID NO: 2229439 - protein, 17 aa, Cryptosporidium parvum
DDDPFPLSSKFRYISDE

SEQ ID NO: 2229440 - protein, 24 aa, Cryptosporidium parvum
DDEIKLNLLSLMNFEGCILIDEMY

SEQ ID NO: 2229441 - protein, 20 aa, Cryptosporidium parvum
DDFNKIFVLYGLILDGCSSL

SEQ ID NO: 2229442 - protein, 24 aa, Cryptosporidium parvum
DDIFKSKLPKIGIFHTKGSCGLLI

SEQ ID NO: 2229443 - protein, 47 aa, Cryptosporidium parvum
DDIFSFIIDMPWMHRMACFRDDIIFIIYIYQRWIYRSKKEYQSSIER

SEQ ID NO: 2229444 - protein, 24 aa, Cryptosporidium parvum
DDIIFEILYGWRALLGYEKGRAVF

SEQ ID NO: 2229445 - protein, 19 aa, Cryptosporidium parvum
DDIIGCLHISKPVFSNLIL

SEQ ID NO: 2229446 - protein, 26 aa, Cryptosporidium parvum
DDILRYRPDFRIHLAEFFRVPINFNF

SEQ ID NO: 2229447 - protein, 33 aa, Cryptosporidium parvum
DDIMEVYKFYWRRLKSGIFSNIGSLFSILVSIV

SEQ ID NO: 2229448 - protein, 24 aa, Cryptosporidium parvum
DDINRYHAIKGYLSNQVPIFSKKF

SEQ ID NO: 2229449 - protein, 23 aa, Cryptosporidium parvum
DDIPETIPSIWPSIGTVVELEKG

SEQ ID NO: 2229450 - protein, 27 aa, Cryptosporidium parvum
DDIRLTSNLRFRRIIHGFTLGNVLCNE

SEQ ID NO: 2229451 - protein, 25 aa, Cryptosporidium parvum
DDITMIKLRFKYIFDSINRKILEFE

SEQ ID NO: 2229452 - protein, 21 aa, Cryptosporidium parvum
DDKFKHLPSLIISISKRRGHK

SEQ ID NO: 2229453 - protein, 23 aa, Cryptosporidium parvum
DDKLSIGYSERFGNLSLASNSSL

SEQ ID NO: 2229454 - protein, 23 aa, Cryptosporidium parvum
DDKSKELLTKFVSGFPGIQSNEQ

SEQ ID NO: 2229455 - protein, 17 aa, Cryptosporidium parvum
DDLPILFNKVLKDVLSI

SEQ ID NO: 2229456 - protein, 17 aa, Cryptosporidium parvum
DDLRDGSNFLAFTNELD

SEQ ID NO: 2229457 - protein, 20 aa, Cryptosporidium parvum
DDLYRKLPFNLKPIKLNSGS

SEQ ID NO: 2229458 - protein, 18 aa, Cryptosporidium parvum
DDNFPFKTLEELSKCSIK

SEQ ID NO: 2229459 - protein, 24 aa, Cryptosporidium parvum
DDNKRAAVFALGLVMCRNTQQIPQ

SEQ ID NO: 2229460 - protein, 24 aa, Cryptosporidium parvum
DDQWLCDVCLNIKNQLLDHQYLFF

SEQ ID NO: 2229461 - protein, 23 aa, Cryptosporidium parvum
DDRQVHSLYSFYHVKYAFNGLIR

SEQ ID NO: 2229462 - protein, 22 aa, Cryptosporidium parvum
DDRRMMLAIIFYISFFAVGFID

SEQ ID NO: 2229463 - protein, 19 aa, Cryptosporidium parvum
DDSVAPLLIFKWFDQTTLD

SEQ ID NO: 2229464 - protein, 24 aa, Cryptosporidium parvum
DDTLYRRAYRLGILGFLLVLEPES

SEQ ID NO: 2229465 - protein, 26 aa, Cryptosporidium parvum
DDVSKRWCIKPALPKYTGLTFSTETG

SEQ ID NO: 2229466 - protein, 19 aa, Cryptosporidium parvum
DDWEYPRKILIGSNKSEKL

SEQ ID NO: 2229467 - protein, 17 aa, Cryptosporidium parvum
DDYKGFTSLLAHIILYW

SEQ ID NO: 2229468 - protein, 24 aa, Cryptosporidium parvum
DDYYGEILVGFWKNGHPVGPFKTR

SEQ ID NO: 2229469 - protein, 19 aa, Cryptosporidium parvum
DEAMFFTPIIKQVCGEGNK

SEQ ID NO: 2229470 - protein, 22 aa, Cryptosporidium parvum
DEARSGSIIKRTILPYNCQQPQ

SEQ ID NO: 2229471 - protein, 19 aa, Cryptosporidium parvum
DECLHFYSPLTWISKVITL

SEQ ID NO: 2229472 - protein, 17 aa, Cryptosporidium parvum
DEDKGTIPYSYRNKYEF

SEQ ID NO: 2229473 - protein, 20 aa, Cryptosporidium parvum
DEEKRLAIMLFEGGICTYLM

SEQ ID NO: 2229474 - protein, 17 aa, Cryptosporidium parvum
DEEVLMLKLGIDRMYED

SEQ ID NO: 2229475 - protein, 23 aa, Cryptosporidium parvum
DEFKTRKALLLPYLALLNTLLSS

SEQ ID NO: 2229476 - protein, 24 aa, Cryptosporidium parvum
DEFPRLSQGYLQIPTIRIIPPELN

SEQ ID NO: 2229477 - protein, 21 aa, Cryptosporidium parvum
DEFRHFFPKISLIDGKDISKL

SEQ ID NO: 2229478 - protein, 22 aa, Cryptosporidium parvum
DEFSIVGSFNWEEYIGIRLQCY

SEQ ID NO: 2229479 - protein, 23 aa, Cryptosporidium parvum
DEFTSIFQKCWDDAGNELRNRNE

SEQ ID NO: 2229480 - protein, 21 aa, Cryptosporidium parvum
DEICQIYNLLLVTYMLFCGLE

SEQ ID NO: 2229481 - protein, 34 aa, Cryptosporidium parvum
DEIDLYLQFFIFKRPYLSAFSLVFSKSQMDMMNK

SEQ ID NO: 2229482 - protein, 24 aa, Cryptosporidium parvum
DEIKACGSMEIVVLPIIGVSNKIN

SEQ ID NO: 2229483 - protein, 27 aa, Cryptosporidium parvum
DEIKEIAEFLIYYRFREVIRDKDDYDD

SEQ ID NO: 2229484 - protein, 17 aa, Cryptosporidium parvum
DEIKPKLCVSAPVKAIS

SEQ ID NO: 2229485 - protein, 17 aa, Cryptosporidium parvum
DEIKSACKLAGVHENIL

SEQ ID NO: 2229486 - protein, 23 aa, Cryptosporidium parvum
DEINSSICKWEICQFNNIDNKNF

SEQ ID NO: 2229487 - protein, 23 aa, Cryptosporidium parvum
DEIRMKFLNGFEIINEKSIIKNE

SEQ ID NO: 2229488 - protein, 25 aa, Cryptosporidium parvum
DEKCDVWSIGVILFILLAGYPPFGG

SEQ ID NO: 2229489 - protein, 17 aa, Cryptosporidium parvum
DELRNVLYMDNAVAGEA

SEQ ID NO: 2229490 - protein, 20 aa, Cryptosporidium parvum
DENKVIFVVNLREKFILVEI

SEQ ID NO: 2229491 - protein, 23 aa, Cryptosporidium parvum
DESFPPSLAPLYMWVLKPYHIRK

SEQ ID NO: 2229492 - protein, 21 aa, Cryptosporidium parvum
DETWMKYIKLFGVLTQLDPFS

SEQ ID NO: 2229493 - protein, 19 aa, Cryptosporidium parvum
DEVMSMVYIMLNFIEEERS

SEQ ID NO: 2229494 - protein, 26 aa, Cryptosporidium parvum
DEVRYLNEIVHAFVLIQKGFYRSAKE

SEQ ID NO: 2229495 - protein, 19 aa, Cryptosporidium parvum
DEYDFLISPHHLLKNSELT

SEQ ID NO: 2229496 - protein, 23 aa, Cryptosporidium parvum
DEYKCKRILIIGSNDLEDNLETK

SEQ ID NO: 2229497 - protein, 38 aa, Cryptosporidium parvum; identical to SEQ ID NO: 2122370

SEQ ID NO: 2229498 - protein, 22 aa, Cryptosporidium parvum
DEYSFKGLESFDLDSNNYKYEE

SEQ ID NO: 2229499 - protein, 23 aa, Cryptosporidium parvum
DFARGASLKFSRVIEADDNIKLE

SEQ ID NO: 2229500 - protein, 18 aa, Cryptosporidium parvum
DFCIIPSSYENWNIELDD

SEQ ID NO: 2229501 - protein, 20 aa, Cryptosporidium parvum
DFDLRLKRIKIYSELTYESN

SEQ ID NO: 2229502 - protein, 19 aa, Cryptosporidium parvum
DFFTYDMMNRVCLFKAAKS

SEQ ID NO: 2229503 - protein, 23 aa, Cryptosporidium parvum
DFICSSLEFSIRIIIGNPLKNES

SEQ ID NO: 2229504 - protein, 21 aa, Cryptosporidium parvum
DFIQFRKLGPFSHLWFHRTTF

SEQ ID NO: 2229505 - protein, 23 aa, Cryptosporidium parvum
DFKDFFLELYFKRLNINKKGDCE

SEQ ID NO: 2229506 - protein, 23 aa, Cryptosporidium parvum
DFLNDFKSIIGIFEGAEIRQGAS

SEQ ID NO: 2229507 - protein, 31 aa, Cryptosporidium parvum
DFLQFSFRWMNCLLTREFPTKCVVRLWDTYI

SEQ ID NO: 2229508 - protein, 26 aa, Cryptosporidium parvum
DFPEFLCDYSCSFCDVLPVNCIQIRN

SEQ ID NO: 2229509 - protein, 23 aa, Cryptosporidium parvum
DFPNCPKPSLGILGIEDQEEGYE

SEQ ID NO: 2229510 - protein, 25 aa, Cryptosporidium parvum
DFQYLLVRLCHLFSFRIECLATNVY

SEQ ID NO: 2229511 - protein, 18 aa, Cryptosporidium parvum
DFRLISATLDPLIINEYI

SEQ ID NO: 2229512 - protein, 23 aa, Cryptosporidium parvum
DFSHIDGIILFNAESLNVRNWND

SEQ ID NO: 2229513 - protein, 23 aa, Cryptosporidium parvum
DFTFRLYALYAQHSYIFFLSIPL

SEQ ID NO: 2229514 - protein, 20 aa, Cryptosporidium parvum
DFTIKLSEFCGPPYSIDFSV

SEQ ID NO: 2229515 - protein, 26 aa, Cryptosporidium parvum
DFVDPWKSLISMILYEPVRRSSLKFD

SEQ ID NO: 2229516 - protein, 17 aa, Cryptosporidium parvum
DFVKRVYSLLSISIAIT

SEQ ID NO: 2229517 - protein, 21 aa, Cryptosporidium parvum
DGDFTFDRMFVIEHYKSIVEI

SEQ ID NO: 2229518 - protein, 18 aa, Cryptosporidium parvum
DGFVYKLYLSFASNTEVN

SEQ ID NO: 2229519 - protein, 21 aa, Cryptosporidium parvum
DGGGLLKDFITSISKELCSES

SEQ ID NO: 2229520 - protein, 24 aa, Cryptosporidium parvum
DGHFNIKVADVFSSSSSSSSSSSS

SEQ ID NO: 2229521 - protein, 37 aa, Cryptosporidium parvum; identical to SEQ ID NO: 2122386

SEQ ID NO: 2229522 - protein, 22 aa, Cryptosporidium parvum
DGLTCWRMLNGISTDKFPNIKV

SEQ ID NO: 2229523 - protein, 27 aa, Cryptosporidium parvum
DGNLCLWRLNIANLKEFLMNDCNSSNH

SEQ ID NO: 2229524 - protein, 19 aa, Cryptosporidium parvum
DGQNCKEKVFSVIDDIMSY

SEQ ID NO: 2229525 - protein, 24 aa, Cryptosporidium parvum
DGRGKCECNPGFKLHEDRKTCVDI

SEQ ID NO: 2229526 - protein, 23 aa, Cryptosporidium parvum
DGSDRWNSDWGYYYENKVRKNYM

SEQ ID NO: 2229527 - protein, 18 aa, Cryptosporidium parvum
DGSSWTWDAILPVYDSIT

SEQ ID NO: 2229528 - protein, 29 aa, Cryptosporidium parvum
DGSYISGLTCMGFLFANFRLRLLSRISSL

SEQ ID NO: 2229529 - protein, 28 aa, Cryptosporidium parvum
DGTGIFNWRFVFDIKIPTQYPILKLQLW

SEQ ID NO: 2229530 - protein, 22 aa, Cryptosporidium parvum
DHFDLYLGLRYSFGSIIDNWSI

SEQ ID NO: 2229531 - protein, 25 aa, Cryptosporidium parvum
DHGCDRDRVIVIVIMIIFVIIIIVM

SEQ ID NO: 2229532 - protein, 23 aa, Cryptosporidium parvum
DHGKGFKWKCIKGTNEVYSVNSF

SEQ ID NO: 2229533 - protein, 17 aa, Cryptosporidium parvum
DHHCKWLNTCIGEKNYR

SEQ ID NO: 2229534 - protein, 18 aa, Cryptosporidium parvum
DHHCPWINNCVGINNQKH

SEQ ID NO: 2229535 - protein, 18 aa, Cryptosporidium parvum
DHHCPWVGTCIGAGNYKL

SEQ ID NO: 2229536 - protein, 23 aa, Cryptosporidium parvum
DHICNALLRISRQTFIGRGLSND

SEQ ID NO: 2229537 - protein, 24 aa, Cryptosporidium parvum
DHNSKRGDLTWLRLQRQRREMINN

SEQ ID NO: 2229538 - protein, 27 aa, Cryptosporidium parvum
DHQIFRPLLWKVQTAYVSYLYYLGFSY

SEQ ID NO: 2229539 - protein, 17 aa, Cryptosporidium parvum
DICCGVGAIGLTLLDIF

SEQ ID NO: 2229540 - protein, 22 aa, Cryptosporidium parvum
DICNTCIFDSRIISNVKSLFSE

SEQ ID NO: 2229541 - protein, 24 aa, Cryptosporidium parvum
DIDWRVEASCFLWESLIKSRVHSR

SEQ ID NO: 2229542 - protein, 33 aa, Cryptosporidium parvum; identical to SEQ ID NO: 2122403

SEQ ID NO: 2229543 - protein, 23 aa, Cryptosporidium parvum
DIFGLVLKRNFSGILSATYSIEL

SEQ ID NO: 2229544 - protein, 25 aa, Cryptosporidium parvum
DIFKYLSIWHYLRISDVSQIVNSQH

SEQ ID NO: 2229545 - protein, 24 aa, Cryptosporidium parvum
DIFLEYIALFSLEYFSSSFREIEI

SEQ ID NO: 2229546 - protein, 18 aa, Cryptosporidium parvum
DIFMGFSRILSCISLCVI

SEQ ID NO: 2229547 - protein, 22 aa, Cryptosporidium parvum
DIFWMNIFFPAWSVSSEEGDLR

SEQ ID NO: 2229548 - protein, 18 aa, Cryptosporidium parvum
DIFYKSWIHAIAVTVIAF

SEQ ID NO: 2229549 - protein, 19 aa, Cryptosporidium parvum
DIGLLLFQYSDDWPTRIDG

SEQ ID NO: 2229550 - protein, 25 aa, Cryptosporidium parvum
DIISFLTIIFLIFIYKVFGYVERPE

SEQ ID NO: 2229551 - protein, 18 aa, Cryptosporidium parvum
DILIRNGMQIKQKPFLIW

SEQ ID NO: 2229552 - protein, 19 aa, Cryptosporidium parvum
DILKEISRLIELFNKEEIL

SEQ ID NO: 2229553 - protein, 25 aa, Cryptosporidium parvum
DILLKGGEFLFVYPAPNFLNLLIKR

SEQ ID NO: 2229554 - protein, 18 aa, Cryptosporidium parvum
DILLQIIFVLTRTSDDSN

SEQ ID NO: 2229555 - protein, 20 aa, Cryptosporidium parvum
DILNCLICNNGNYIKVTEQI

SEQ ID NO: 2229556 - protein, 24 aa, Cryptosporidium parvum
DILYFTYFVCIFLAILSVIASGIL

SEQ ID NO: 2229557 - protein, 18 aa, Cryptosporidium parvum
DINFQFGLIKAFCFSYIN

SEQ ID NO: 2229558 - protein, 24 aa, Cryptosporidium parvum
DINNDCLILIFALILYLIISIIDI

SEQ ID NO: 2229559 - protein, 22 aa, Cryptosporidium parvum
DIPDLLKTLNWVENVNLFEKEI

SEQ ID NO: 2229560 - protein, 23 aa, Cryptosporidium parvum
DIPEKHYSSSHFIQFNGKQILRT

SEQ ID NO: 2229561 - protein, 27 aa, Cryptosporidium parvum
DIPLLILRTYIWLHFPVFPGFNPWIMK

SEQ ID NO: 2229562 - protein, 21 aa, Cryptosporidium parvum
DIPLYGGYIIKSWGIPFNYCC

SEQ ID NO: 2229563 - protein, 24 aa, Cryptosporidium parvum
DISEVKYAIGPLFDFSKTFQFIRN

SEQ ID NO: 2229564 - protein, 18 aa, Cryptosporidium parvum
DISLNMSRYQIFLDLFEL

SEQ ID NO: 2229565 - protein, 19 aa, Cryptosporidium parvum
DISPIIMREYLLKVLINDS

SEQ ID NO: 2229566 - protein, 20 aa, Cryptosporidium parvum
DITTSILLLDFLSFIENSEF

SEQ ID NO: 2229567 - protein, 25 aa, Cryptosporidium parvum
DIVYWKFIPNTPIQWIIGLSECLKG

SEQ ID NO: 2229568 - protein, 23 aa, Cryptosporidium parvum
DIYSKITASYGFELFERYFDSFK

SEQ ID NO: 2229569 - protein, 18 aa, Cryptosporidium parvum
DKAWIRNYLHPFQNVEKN

SEQ ID NO: 2229570 - protein, 28 aa, Cryptosporidium parvum
DKEFIIKLIGLRSANKIFNRIIFVENKL

SEQ ID NO: 2229571 - protein, 23 aa, Cryptosporidium parvum
DKFEFPDLPFVIMEEIYTYINQN

SEQ ID NO: 2229572 - protein, 23 aa, Cryptosporidium parvum
DKFIDKIGIRYGILKEITSNKIN

SEQ ID NO: 2229573 - protein, 38 aa, Cryptosporidium parvum; identical to SEQ ID NO: 2130144

SEQ ID NO: 2229574 - protein, 17 aa, Cryptosporidium parvum
DKHKAFPILALTPNEII

SEQ ID NO: 2229575 - protein, 17 aa, Cryptosporidium parvum
DKIDFKWSIGRISYSLK

SEQ ID NO: 2229576 - protein, 21 aa, Cryptosporidium parvum
DKIMPRYKISSAKIISNSEYS

SEQ ID NO: 2229577 - protein, 24 aa, Cryptosporidium parvum
DKIPKLSMMLSRWWSQSISPNFIK

SEQ ID NO: 2229578 - protein, 23 aa, Cryptosporidium parvum
DKIQRRRLVYGWWISGYENTNMN

SEQ ID NO: 2229579 - protein, 23 aa, Cryptosporidium parvum
DKISLNIAHGFQRPSTTNFFRFN

SEQ ID NO: 2229580 - protein, 27 aa, Cryptosporidium parvum
DKIYKRDWQQVCLDWIYCDLCNNWYHW

SEQ ID NO: 2229581 - protein, 27 aa, Cryptosporidium parvum
DKKHFGNICKYCGFSNGATIGCALSTC

SEQ ID NO: 2229582 - protein, 19 aa, Cryptosporidium parvum
DKLIDRIGSLIIINNQELI

SEQ ID NO: 2229583 - protein, 26 aa, Cryptosporidium parvum
DKLILPLDFSKLILNKRATYFDIVQI

SEQ ID NO: 2229584 - protein, 20 aa, Cryptosporidium parvum
DKLNFCVVVNKLLEDIESLL

SEQ ID NO: 2229585 - protein, 25 aa, Cryptosporidium parvum
DKLRLFKENFGFEIYIKEKEYKLKN

SEQ ID NO: 2229586 - protein, 27 aa, Cryptosporidium parvum
DKLRVKAILLLWKILYLHFTNSDSIQG

SEQ ID NO: 2229587 - protein, 22 aa, Cryptosporidium parvum
DKNEGGYVWIQRNLIATRTTSG

SEQ ID NO: 2229588 - protein, 27 aa, Cryptosporidium parvum
DKNGKLVVVRKMFKFNIASSIQNSNKS

SEQ ID NO: 2229589 - protein, 20 aa, Cryptosporidium parvum
DKNHLVKLCESIIISPWDYK

SEQ ID NO: 2229590 - protein, 19 aa, Cryptosporidium parvum
DKNMDLIILLLMINSSNNN

SEQ ID NO: 2229591 - protein, 29 aa, Cryptosporidium parvum
DKPKINCIFSLKLSEMISNMSLFSKVPYM

SEQ ID NO: 2229592 - protein, 24 aa, Cryptosporidium parvum
DKPKSYRLLWHLITRGPFNIEDIL

SEQ ID NO: 2229593 - protein, 23 aa, Cryptosporidium parvum
DKPSEIMGFALITVGIFAPGDSI

SEQ ID NO: 2229594 - protein, 19 aa, Cryptosporidium parvum
DKPTILYLIDCIKSYQTEV

SEQ ID NO: 2229595 - protein, 22 aa, Cryptosporidium parvum
DKRKVMVLIIVYRYLVIIQNDI

SEQ ID NO: 2229596 - protein, 24 aa, Cryptosporidium parvum
DKSMIKECIKNIVTNPFALKDKVI

SEQ ID NO: 2229597 - protein, 19 aa, Cryptosporidium parvum
DKSNLFWFLVIPYWIIYFI

SEQ ID NO: 2229598 - protein, 20 aa, Cryptosporidium parvum
DKSTKECIYEILSMINQDSS

SEQ ID NO: 2229599 - protein, 23 aa, Cryptosporidium parvum
DKVDLYLPIFLLFLETFSFEDLN

SEQ ID NO: 2229600 - protein, 22 aa, Cryptosporidium parvum
DKWGFRIYFQCHYWDQVIENKI

SEQ ID NO: 2229601 - protein, 18 aa, Cryptosporidium parvum
DKYECVFPSINSEVINRI

SEQ ID NO: 2229602 - protein, 18 aa, Cryptosporidium parvum
DLDFPILLHRKLINISLR

SEQ ID NO: 2229603 - protein, 19 aa, Cryptosporidium parvum
DLEILKGRIFSKSDEYSRE

SEQ ID NO: 2229604 - protein, 25 aa, Cryptosporidium parvum
DLEKFRLACIESKYLPNEWQETALC

SEQ ID NO: 2229605 - protein, 24 aa, Cryptosporidium parvum
DLEYNQRMDLILSKEYIIDYLKIT

SEQ ID NO: 2229606 - protein, 21 aa, Cryptosporidium parvum
DLFGRLRYLFTTSNFDVLAER

SEQ ID NO: 2229607 - protein, 20 aa, Cryptosporidium parvum
DLFPHLRPSVPLSGQSLDSF

SEQ ID NO: 2229608 - protein, 37 aa, Cryptosporidium parvum
DLFSRSCLIFKYYCLRYPCLINYLFKLYSRIVDEINK

SEQ ID NO: 2229609 - protein, 25 aa, Cryptosporidium parvum
DLGPLISRSKLYGMMNKHPICDKSS

SEQ ID NO: 2229610 - protein, 21 aa, Cryptosporidium parvum
DLGSKCNCCFNGENEGFGSNG

SEQ ID NO: 2229611 - protein, 20 aa, Cryptosporidium parvum
DLHLKILLVCLIQKSITVEI

SEQ ID NO: 2229612 - protein, 21 aa, Cryptosporidium parvum
DLIDGSIVWTGRNIKVLSSGP

SEQ ID NO: 2229613 - protein, 24 aa, Cryptosporidium parvum
DLIITFPRYVLWELIFTSRWIWLS

SEQ ID NO: 2229614 - protein, 21 aa, Cryptosporidium parvum
DLIKMSPCSVIRVKLYQLRTQ

SEQ ID NO: 2229615 - protein, 18 aa, Cryptosporidium parvum
DLILKNNIKIVVGDTSIP

SEQ ID NO: 2229616 - protein, 19 aa, Cryptosporidium parvum
DLIPALISYFGFVNDYLFM

SEQ ID NO: 2229617 - protein, 18 aa, Cryptosporidium parvum
DLKKCILNLVGIENEEDN

SEQ ID NO: 2229618 - protein, 23 aa, Cryptosporidium parvum
DLKKSSTRLLALMYKNDQINTYF

SEQ ID NO: 2229619 - protein, 19 aa, Cryptosporidium parvum
DLKNWCHGFWFKANKIDIS

SEQ ID NO: 2229620 - protein, 24 aa, Cryptosporidium parvum
DLLARPIVNIEIHFKQIFDYTRNG

SEQ ID NO: 2229621 - protein, 19 aa, Cryptosporidium parvum
DLLIRIEISKFWNNPENWD

SEQ ID NO: 2229622 - protein, 24 aa, Cryptosporidium parvum
DLLSKLCTLSCSRIHETILGDKNN

SEQ ID NO: 2229623 - protein, 26 aa, Cryptosporidium parvum
DLLSLPIKLIMSWYVLSKVLGSSSAL

SEQ ID NO: 2229624 - protein, 22 aa, Cryptosporidium parvum
DLMAKAKLGVKILETTALLANR

SEQ ID NO: 2229625 - protein, 17 aa, Cryptosporidium parvum
DLMPIIMELCRISCCNI

SEQ ID NO: 2229626 - protein, 33 aa, Cryptosporidium parvum
DLNEKYGLLSLRKGDLFDFLGCIRSFRSFFFYN

SEQ ID NO: 2229627 - protein, 17 aa, Cryptosporidium parvum
DLNGLRESINFLFSAMQ

SEQ ID NO: 2229628 - protein, 26 aa, Cryptosporidium parvum
DLNIRKELFDDLSFPISLSDGIVGKV

SEQ ID NO: 2229629 - protein, 20 aa, Cryptosporidium parvum
DLNNSPKCRIIYFLRKLSKF

SEQ ID NO: 2229630 - protein, 21 aa, Cryptosporidium parvum
DLNTILPFFILLEFNSNGQKH

SEQ ID NO: 2229631 - protein, 23 aa, Cryptosporidium parvum
DLPSEKLVAIAPNFVKKLRKLGF

SEQ ID NO: 2229632 - protein, 17 aa, Cryptosporidium parvum
DLQIRLASLDEWDSKKW

SEQ ID NO: 2229633 - protein, 26 aa, Cryptosporidium parvum
DLQRGFRSGYYWNICNSELRRVNQKC

SEQ ID NO: 2229634 - protein, 19 aa, Cryptosporidium parvum
DLRGTVCIVTGGATGIGKK

SEQ ID NO: 2229635 - protein, 18 aa, Cryptosporidium parvum
DLSDISFIFSEPHFLFIC

SEQ ID NO: 2229636 - protein, 18 aa, Cryptosporidium parvum
DLSMTLGFHPYNFNIYQL

SEQ ID NO: 2229637 - protein, 21 aa, Cryptosporidium parvum
DLSNLIRIWWHFIPIPHCEIP

SEQ ID NO: 2229638 - protein, 24 aa, Cryptosporidium parvum
DLSTMINHSWIYQGLIHDVYNLKL

SEQ ID NO: 2229639 - protein, 24 aa, Cryptosporidium parvum
DLTDEFLSLILIEIEDLRNFHISN

SEQ ID NO: 2229640 - protein, 22 aa, Cryptosporidium parvum
DLTRTPSWCDRVLVLSNNSKLP

SEQ ID NO: 2229641 - protein, 26 aa, Cryptosporidium parvum
DLVKTWHLFLGISIKVNEEFQPFIFN

SEQ ID NO: 2229642 - protein, 26 aa, Cryptosporidium parvum
DLYGIILNWIITFYFKSIAVHLERKI

SEQ ID NO: 2229643 - protein, 27 aa, Cryptosporidium parvum
DMAKQSFKLFMTFLRTPIRNISFPPYL

SEQ ID NO: 2229644 - protein, 19 aa, Cryptosporidium parvum
DMFRPEANYCYYLESKQSG

SEQ ID NO: 2229645 - protein, 17 aa, Cryptosporidium parvum
DMHDIWIGRLMVESSKA

SEQ ID NO: 2229646 - protein, 23 aa, Cryptosporidium parvum
DMIDLILFHIKKIRSFSLDCLNL

SEQ ID NO: 2229647 - protein, 24 aa, Cryptosporidium parvum
DMLFKELMPSLAYHFDLLSITSDT

SEQ ID NO: 2229648 - protein, 22 aa, Cryptosporidium parvum
DMLKSAIFGQEFANFDTMIYKM

SEQ ID NO: 2229649 - protein, 18 aa, Cryptosporidium parvum
DMLRECDYIHNIISSNWV

SEQ ID NO: 2229650 - protein, 20 aa, Cryptosporidium parvum
DMLYAMAICNSTVPHLRLIK

SEQ ID NO: 2229651 - protein, 29 aa, Cryptosporidium parvum
DMNSLKSKCIWKSVRMINIPKEANFQDYS

SEQ ID NO: 2229652 - protein, 18 aa, Cryptosporidium parvum
DMVNSYRLFSIDYIDIKL

SEQ ID NO: 2229653 - protein, 21 aa, Cryptosporidium parvum
DMVRLGKRFVYYNSFKQFPKN

SEQ ID NO: 2229654 - protein, 17 aa, Cryptosporidium parvum
DNARFTLRYATDLCQKK

SEQ ID NO: 2229655 - protein, 18 aa, Cryptosporidium parvum
DNAYRERQGMAIKDLPVV

SEQ ID NO: 2229656 - protein, 23 aa, Cryptosporidium parvum
DNFIPLRLNLEIPKFEGEEAKNL

SEQ ID NO: 2229657 - protein, 25 aa, Cryptosporidium parvum
DNFWRVRYCSIILLILSLYKLLSSY

SEQ ID NO: 2229658 - protein, 27 aa, Cryptosporidium parvum
DNGCKGEELPLLWGQRATILHENMIKG

SEQ ID NO: 2229659 - protein, 31 aa, Cryptosporidium parvum
DNGLILFTACWNEFLVIYAFEISENPKESCR

SEQ ID NO: 2229660 - protein, 18 aa, Cryptosporidium parvum
DNGRLFRLLTKINTIADR

SEQ ID NO: 2229661 - protein, 18 aa, Cryptosporidium parvum
DNHVFMVIPMFRKISDLL

SEQ ID NO: 2229662 - protein, 17 aa, Cryptosporidium parvum
DNIARSFAFDFKSPLSI

SEQ ID NO: 2229663 - protein, 23 aa, Cryptosporidium parvum
DNKIFRYNLKIEYFNKNNKMVHG

SEQ ID NO: 2229664 - protein, 21 aa, Cryptosporidium parvum
DNLWIRNAINLIEMGIETLST

SEQ ID NO: 2229665 - protein, 19 aa, Cryptosporidium parvum
DNMEIPKIYPFNRFIVDVR

SEQ ID NO: 2229666 - protein, 21 aa, Cryptosporidium parvum
DNMPIILSILFSLMLACQYLV

SEQ ID NO: 2229667 - protein, 23 aa, Cryptosporidium parvum
DNNDYFKLFLYYIVISNLVHSIN

SEQ ID NO: 2229668 - protein, 25 aa, Cryptosporidium parvum
DNNVCLLRYSPLYLGAIKANIGHLE

SEQ ID NO: 2229669 - protein, 19 aa, Cryptosporidium parvum
DNRAEIIWILVHSFFSTLT

SEQ ID NO: 2229670 - protein, 25 aa, Cryptosporidium parvum
DNREVLEVVPLLLIKDISVMIDKNI

SEQ ID NO: 2229671 - protein, 20 aa, Cryptosporidium parvum
DNRIMLAIAVNILIMVTIFG

SEQ ID NO: 2229672 - protein, 25 aa, Cryptosporidium parvum
DNRSLYSLEWEFEWLNNNSEGGLSL

SEQ ID NO: 2229673 - protein, 36 aa, Cryptosporidium parvum; identical to SEQ ID NO: 2122467

SEQ ID NO: 2229674 - protein, 24 aa, Cryptosporidium parvum
DNSWAVSVTDAFKVPSIMEKPNEG

SEQ ID NO: 2229675 - protein, 20 aa, Cryptosporidium parvum
DNVYGLPVDEITGLPKDPVS

SEQ ID NO: 2229676 - protein, 24 aa, Cryptosporidium parvum
DNYFEISKYFLIFGSFGENPLHRI

SEQ ID NO: 2229677 - protein, 19 aa, Cryptosporidium parvum
DNYLKRRWELQTMLDTCFR

SEQ ID NO: 2229678 - protein, 18 aa, Cryptosporidium parvum
DNYVGIVIKCPHEEACLP

SEQ ID NO: 2229679 - protein, 17 aa, Cryptosporidium parvum
DNYWKFNMLLDMNNEES

SEQ ID NO: 2229680 - protein, 19 aa, Cryptosporidium parvum
DPDSIFSFLSSFLTTKELD

SEQ ID NO: 2229681 - protein, 19 aa, Cryptosporidium parvum
DPIAWPCIHIVGNILRDGF

SEQ ID NO: 2229682 - protein, 25 aa, Cryptosporidium parvum
DPIKCLEFLPKIFLSSKDEKLVIPK

SEQ ID NO: 2229683 - protein, 26 aa, Cryptosporidium parvum
DPIQLPGIRYFALFIFSKQVNVCMSK

SEQ ID NO: 2229684 - protein, 23 aa, Cryptosporidium parvum
DPKDKVVTYGFGGGPVAPPASTT

SEQ ID NO: 2229685 - protein, 22 aa, Cryptosporidium parvum
DPKFPWPNCSQVPINSPEYDVL

SEQ ID NO: 2229686 - protein, 21 aa, Cryptosporidium parvum
DPKLKLDDFWELTGSSIVNIH

SEQ ID NO: 2229687 - protein, 25 aa, Cryptosporidium parvum
DPKSPKKPLSIFIENFFLNFLSQDE

SEQ ID NO: 2229688 - protein, 25 aa, Cryptosporidium parvum
DPLKIEILKLLILLVKNKYSLETIS

SEQ ID NO: 2229689 - protein, 22 aa, Cryptosporidium parvum
DPLRISPISGLDVMDLAIREND

SEQ ID NO: 2229690 - protein, 25 aa, Cryptosporidium parvum
DPMTCIPIGFLFLLFIYWNYLSYFI

SEQ ID NO: 2229691 - protein, 20 aa, Cryptosporidium parvum
DPPVCCSILEKLFNHENGLL

SEQ ID NO: 2229692 - protein, 19 aa, Cryptosporidium parvum
DPPVISWPNNHIVFVHSQV

SEQ ID NO: 2229693 - protein, 31 aa, Cryptosporidium parvum; identical to SEQ ID NO: 2122480

SEQ ID NO: 2229694 - protein, 23 aa, Cryptosporidium parvum
DPSFEKYRLWSLVDISQQKIIQE

SEQ ID NO: 2229695 - protein, 33 aa, Cryptosporidium parvum
DPSMIYLYIFRMMNVRMRQIWGLYLEEENYGIT

SEQ ID NO: 2229696 - protein, 17 aa, Cryptosporidium parvum
DQALFEWQDGPIIKAMK

SEQ ID NO: 2229697 - protein, 24 aa, Cryptosporidium parvum
DQCPEILNFYSVIQCNLDTILNPR

SEQ ID NO: 2229698 - protein, 33 aa, Cryptosporidium parvum
DQCVTSWPEKCQIWKSKCEDNLIYGYKNPQCVP

SEQ ID NO: 2229699 - protein, 17 aa, Cryptosporidium parvum
DQFNAVCNVVFDTYGKS

SEQ ID NO: 2229700 - protein, 17 aa, Cryptosporidium parvum
DQFRVPKSFSMKCNSSK

SEQ ID NO: 2229701 - protein, 24 aa, Cryptosporidium parvum
DQGKCGGCYAFVVSASISISNCIQ

SEQ ID NO: 2229702 - protein, 22 aa, Cryptosporidium parvum
DQIKSGLLVTVFGTILLSVMIY

SEQ ID NO: 2229703 - protein, 24 aa, Cryptosporidium parvum
DQINIFIFDSFFRMVKHDIIHCTK

SEQ ID NO: 2229704 - protein, 25 aa, Cryptosporidium parvum
DQISFKSALFIFGFIIALIIGNYFV

SEQ ID NO: 2229705 - protein, 22 aa, Cryptosporidium parvum
DQIWLCSGDSFYTSNSIASMVS

SEQ ID NO: 2229706 - protein, 31 aa, Cryptosporidium parvum
DQLKYKILCHLWIFRFIMSIAAISFPGVPSN

SEQ ID NO: 2229707 - protein, 19 aa, Cryptosporidium parvum
DQLPIVWLFLSIIVALIIF

SEQ ID NO: 2229708 - protein, 24 aa, Cryptosporidium parvum
DQLRHCLRPVLVHLASATKLTVHV

SEQ ID NO: 2229709 - protein, 27 aa, Cryptosporidium parvum
DQLRRSAWLLGCIFEFSSPNMALAIVD

SEQ ID NO: 2229710 - protein, 23 aa, Cryptosporidium parvum
DQNSCLFSIIILDVISESLRSME

SEQ ID NO: 2229711 - protein, 30 aa, Cryptosporidium parvum; identical to SEQ ID NO: 2206384

SEQ ID NO: 2229712 - protein, 17 aa, Cryptosporidium parvum
DRDPESCVIEWNSSYHL

SEQ ID NO: 2229713 - protein, 20 aa, Cryptosporidium parvum
DRIIEEFSLRYFLDNPEIFP

SEQ ID NO: 2229714 - protein, 22 aa, Cryptosporidium parvum
DRIRKAPKYMKFHFPEFSDRYE

SEQ ID NO: 2229715 - protein, 23 aa, Cryptosporidium parvum
DRLKLSLKMVEDFSKLDKNQDEY

SEQ ID NO: 2229716 - protein, 23 aa, Cryptosporidium parvum
DRLLNEILTLCFFSEGELLHSLY

SEQ ID NO: 2229717 - protein, 26 aa, Cryptosporidium parvum
DRNKFLLRLTCEFYMKAMREIQGYLR

SEQ ID NO: 2229718 - protein, 19 aa, Cryptosporidium parvum
DRNTRVIETLGLMGIPIFH

SEQ ID NO: 2229719 - protein, 32 aa, Cryptosporidium parvum
DRTNGIKGFHWFKVNEYWDWSRNYLSCRNDSV

SEQ ID NO: 2229720 - protein, 26 aa, Cryptosporidium parvum
DRTSFSIPINFLWVIPLGTLPSPHIL

SEQ ID NO: 2229721 - protein, 18 aa, Cryptosporidium parvum
DRVAREIQYCFLQYGPEV

SEQ ID NO: 2229722 - protein, 22 aa, Cryptosporidium parvum
DRVFYILCAFLALYVAMESICI

SEQ ID NO: 2229723 - protein, 21 aa, Cryptosporidium parvum
DRYIIMVLFIFIEYLIILKED

SEQ ID NO: 2229724 - protein, 18 aa, Cryptosporidium parvum
DSADAFYLVPCESHCLHN

SEQ ID NO: 2229725 - protein, 25 aa, Cryptosporidium parvum
DSANKELNCGLVLDSLEVRSIPNLS

SEQ ID NO: 2229726 - protein, 18 aa, Cryptosporidium parvum
DSDGRTPLFYAISQLDIG

SEQ ID NO: 2229727 - protein, 22 aa, Cryptosporidium parvum
DSDISVGFVAYIDRFEPITIGV

SEQ ID NO: 2229728 - protein, 21 aa, Cryptosporidium parvum
DSEFPLIIYLNYTFQKEETFS

SEQ ID NO: 2229729 - protein, 23 aa, Cryptosporidium parvum
DSEHFIRYGAMHVLGLAYCGTGN

SEQ ID NO: 2229730 - protein, 17 aa, Cryptosporidium parvum
DSEPVVLCVLQRSTNDL

SEQ ID NO: 2229731 - protein, 25 aa, Cryptosporidium parvum
DSERYAVTMLCEWNVVNTKLIPLWN

SEQ ID NO: 2229732 - protein, 20 aa, Cryptosporidium parvum
DSFGKFNLRGIRHFYKGYIP

SEQ ID NO: 2229733 - protein, 19 aa, Cryptosporidium parvum
DSFIRLRLSIEELIFKDIK

SEQ ID NO: 2229734 - protein, 25 aa, Cryptosporidium parvum
DSFPKPKGRYAFGAWEVGLSMKFGQ

SEQ ID NO: 2229735 - protein, 21 aa, Cryptosporidium parvum
DSFPSIYSALTLWNHGSAWSG

SEQ ID NO: 2229736 - protein, 24 aa, Cryptosporidium parvum
DSFVPHSIQLFWGVDYFAAKELLI

SEQ ID NO: 2229737 - protein, 24 aa, Cryptosporidium parvum
DSFYIEFIELLFLSQGESYDGQVQ

SEQ ID NO: 2229738 - protein, 22 aa, Cryptosporidium parvum
DSIAKYNVCEHIKFKNYNKGSP

SEQ ID NO: 2229739 - protein, 25 aa, Cryptosporidium parvum
DSIIKDVYIKWIWNNDDSANNNCSS

SEQ ID NO: 2229740 - protein, 19 aa, Cryptosporidium parvum
DSIIVLYSFYSILEQYCIA

SEQ ID NO: 2229741 - protein, 20 aa, Cryptosporidium parvum
DSIMKCFFNALTIVIITILS

SEQ ID NO: 2229742 - protein, 23 aa, Cryptosporidium parvum
DSIYRSCLMLILMYPETYSLLNY

SEQ ID NO: 2229743 - protein, 19 aa, Cryptosporidium parvum
DSKKWCKRLLKSKRKKILR

SEQ ID NO: 2229744 - protein, 27 aa, Cryptosporidium parvum
DSKYLLQCIDLIYFIFLNKCTEMIQEE

SEQ ID NO: 2229745 - protein, 18 aa, Cryptosporidium parvum
DSLEFALTAENVINQSIA

SEQ ID NO: 2229746 - protein, 17 aa, Cryptosporidium parvum
DSLELNKEFTILHPIPV

SEQ ID NO: 2229747 - protein, 26 aa, Cryptosporidium parvum
DSLISRERFVKWAAILGIKIWHKEQR

SEQ ID NO: 2229748 - protein, 23 aa, Cryptosporidium parvum
DSLKRANKLPVIYQNSGGRDLFV

SEQ ID NO: 2229749 - protein, 23 aa, Cryptosporidium parvum
DSLPFWCIYLYFCAFSALRSFIF

SEQ ID NO: 2229750 - protein, 21 aa, Cryptosporidium parvum
DSLPSLLKILLLIWESIGLSL

SEQ ID NO: 2229751 - protein, 23 aa, Cryptosporidium parvum
DSLTDLYFLFSILKSKIKNMDQD

SEQ ID NO: 2229752 - protein, 22 aa, Cryptosporidium parvum
DSMLRISLKLSESKDMFDTIGA

SEQ ID NO: 2229753 - protein, 25 aa, Cryptosporidium parvum
DSNLMIFKIWFSRNLKINNNQLISI

SEQ ID NO: 2229754 - protein, 24 aa, Cryptosporidium parvum
DSPDLKSKFLRFFSSDGENNSVDG

SEQ ID NO: 2229755 - protein, 19 aa, Cryptosporidium parvum
DSPGFILNVLIRYFNNYYE

SEQ ID NO: 2229756 - protein, 23 aa, Cryptosporidium parvum
DSPHSKSGIILGYIDLDQLSKQN

SEQ ID NO: 2229757 - protein, 38 aa, Cryptosporidium parvum
DSPKLASLIRRISFALNLIWRFGSIGFIIVRIQDNPNW

SEQ ID NO: 2229758 - protein, 19 aa, Cryptosporidium parvum
DSQKCPLETVGNIINEYMS

SEQ ID NO: 2229759 - protein, 18 aa, Cryptosporidium parvum
DSQTQFGILSNMDGVGPT

SEQ ID NO: 2229760 - protein, 21 aa, Cryptosporidium parvum
DSRILKLIFPMKEYMVQHKNK

SEQ ID NO: 2229761 - protein, 20 aa, Cryptosporidium parvum
DSRILKLIFPMKEYMVQHNN

SEQ ID NO: 2229762 - protein, 24 aa, Cryptosporidium parvum
DSRVSEHAIFCFGNNIEVIVEYLT

SEQ ID NO: 2229763 - protein, 20 aa, Cryptosporidium parvum
DSSRTRLLFYANKENKNNQS

SEQ ID NO: 2229764 - protein, 22 aa, Cryptosporidium parvum
DSTLLGIGIRVTFHVGSNSQIN

SEQ ID NO: 2229765 - protein, 23 aa, Cryptosporidium parvum
DSTLRLWVFFESVSLLVSCSTSI

SEQ ID NO: 2229766 - protein, 33 aa, Cryptosporidium parvum
DSTMPLFYILSCWKLLWCLSINELIGEGLRNMI

SEQ ID NO: 2229767 - protein, 20 aa, Cryptosporidium parvum
DTDPTRRGRLKYTYMQPNDF

SEQ ID NO: 2229768 - protein, 25 aa, Cryptosporidium parvum
DTGVFVGLCNIDWSLYLLNERSCNS

SEQ ID NO: 2229769 - protein, 19 aa, Cryptosporidium parvum
DTHILKLRFLGGKLGKCLI

SEQ ID NO: 2229770 - protein, 19 aa, Cryptosporidium parvum
DTHLKYYIMRVRARVIGAI

SEQ ID NO: 2229771 - protein, 17 aa, Cryptosporidium parvum
DTIILIFNICKNIIISN

SEQ ID NO: 2229772 - protein, 19 aa, Cryptosporidium parvum
DTISICSILSELDVLEKCF

SEQ ID NO: 2229773 - protein, 26 aa, Cryptosporidium parvum
DTKRICEIILRLASQYGPNKKAVSTY

SEQ ID NO: 2229774 - protein, 23 aa, Cryptosporidium parvum
DTNEFDMVYGLSIQLSYINIAII

SEQ ID NO: 2229775 - protein, 17 aa, Cryptosporidium parvum
DTPEMNFENAIPLREDP

SEQ ID NO: 2229776 - protein, 24 aa, Cryptosporidium parvum
DTQCGFKLFSRRLARVIFPSLHIK

SEQ ID NO: 2229777 - protein, 43 aa, Cryptosporidium parvum
DTSNLFPVQTHKSTGLPIDPMVGLPFDPKSGNLVHPYTNQTMS

SEQ ID NO: 2229778 - protein, 24 aa, Cryptosporidium parvum
DTVFKAAVCLLLISLSAAFCSSIA

SEQ ID NO: 2229779 - protein, 18 aa, Cryptosporidium parvum
DTVLCIRRFRAISRFEAF

SEQ ID NO: 2229780 - protein, 19 aa, Cryptosporidium parvum
DTVLSRLATPWSGDIIFWQ

SEQ ID NO: 2229781 - protein, 25 aa, Cryptosporidium parvum
DTWDTSEDIILVYFVSQYSSTPSCG

SEQ ID NO: 2229782 - protein, 18 aa, Cryptosporidium parvum
DTYLCIIGPIPPKLLFIT

SEQ ID NO: 2229783 - protein, 25 aa, Cryptosporidium parvum
DTYLESVIKFFTYIGFVDGSFKQEK

SEQ ID NO: 2229784 - protein, 17 aa, Cryptosporidium parvum
DVACSRTLVGLIDFPPF

SEQ ID NO: 2229785 - protein, 24 aa, Cryptosporidium parvum
DVADPLMRFHCFIFGAIYLESAHA

SEQ ID NO: 2229786 - protein, 18 aa, Cryptosporidium parvum
DVCARSCNYCSPSQGGLG

SEQ ID NO: 2229787 - protein, 22 aa, Cryptosporidium parvum
DVECLPCGFTDWGSWSPCSASC

SEQ ID NO: 2229788 - protein, 18 aa, Cryptosporidium parvum
DVFDQCLESLISWKKSSL

SEQ ID NO: 2229789 - protein, 22 aa, Cryptosporidium parvum
DVFSSSSSFGFSQPSNENGNTS

SEQ ID NO: 2229790 - protein, 23 aa, Cryptosporidium parvum
DVFTLLFIFKFDVCYLENSYMNS

SEQ ID NO: 2229791 - protein, 32 aa, Cryptosporidium parvum
DVIIPELLLMLSNVQLELCSAIFNSFNSNLDN

SEQ ID NO: 2229792 - protein, 17 aa, Cryptosporidium parvum
DVIKRLNSNISKLAFIV

SEQ ID NO: 2229793 - protein, 19 aa, Cryptosporidium parvum
DVILIDWNTMRSFGRVTWG

SEQ ID NO: 2229794 - protein, 19 aa, Cryptosporidium parvum
DVLKALIRIHGRKDGNHSN

SEQ ID NO: 2229795 - protein, 17 aa, Cryptosporidium parvum
DVLNVMGLYPGDPGPPC

SEQ ID NO: 2229796 - protein, 20 aa, Cryptosporidium parvum
DVLRSMAIIIDVYRQHVWND

SEQ ID NO: 2229797 - protein, 17 aa, Cryptosporidium parvum
DVNFPLKNLYQMDASLR

SEQ ID NO: 2229798 - protein, 28 aa, Cryptosporidium parvum
DVPRIPLDIACTAMWFISQRWDFCPLVF

SEQ ID NO: 2229799 - protein, 25 aa, Cryptosporidium parvum
DVSTPRFVDLLLFSTWDSMDLLSNG

SEQ ID NO: 2229800 - protein, 24 aa, Cryptosporidium parvum
DVSVIPLFFEWCYILYRQKLNFSK

SEQ ID NO: 2229801 - protein, 18 aa, Cryptosporidium parvum
DVTLEFAWLEIFRSRILI

SEQ ID NO: 2229802 - protein, 18 aa, Cryptosporidium parvum
DVVISGKFFVDGSVRIVA

SEQ ID NO: 2229803 - protein, 17 aa, Cryptosporidium parvum
DVYKCLNYSIYHSVKSI

SEQ ID NO: 2229804 - protein, 17 aa, Cryptosporidium parvum
DVYLPRIRFGYKTLPTV

SEQ ID NO: 2229805 - protein, 18 aa, Cryptosporidium parvum
DWEGGWWSKEFLSRRDVR

SEQ ID NO: 2229806 - protein, 23 aa, Cryptosporidium parvum
DWGRARISFSAFRSRDDELKAST

SEQ ID NO: 2229807 - protein, 24 aa, Cryptosporidium parvum
DWIFPNVRFQLSVVNFLDPKANIT

SEQ ID NO: 2229808 - protein, 18 aa, Cryptosporidium parvum
DWIREIFLNYNWEKRPDA

SEQ ID NO: 2229809 - protein, 22 aa, Cryptosporidium parvum
DWIVKTEFLGVITISDTTVKLP

SEQ ID NO: 2229810 - protein, 25 aa, Cryptosporidium parvum
DWKKVCRKYSYNFAKSIAIRKNISI

SEQ ID NO: 2229811 - protein, 20 aa, Cryptosporidium parvum
DWVSSLRITDKLAISEEVLK

SEQ ID NO: 2229812 - protein, 18 aa, Cryptosporidium parvum
DWWNAGNFGEYWRKWNLP

SEQ ID NO: 2229813 - protein, 18 aa, Cryptosporidium parvum
DWYQWLIMHQEISKNNNT

SEQ ID NO: 2229814 - protein, 24 aa, Cryptosporidium parvum
DYENGRLSFIFPIHSLKETDLTIE

SEQ ID NO: 2229815 - protein, 26 aa, Cryptosporidium parvum
DYFNYKLFWKYYINIEYLEITRPKWI

SEQ ID NO: 2229816 - protein, 23 aa, Cryptosporidium parvum
DYFQCSINFFLANNFQFDELSVK

SEQ ID NO: 2229817 - protein, 18 aa, Cryptosporidium parvum
DYHVQAISQLVLFVSYIS

SEQ ID NO: 2229818 - protein, 20 aa, Cryptosporidium parvum
DYIISKEITFFWTTLLLLGE

SEQ ID NO: 2229819 - protein, 17 aa, Cryptosporidium parvum
DYLELGIPDMDYGVENQ

SEQ ID NO: 2229820 - protein, 34 aa, Cryptosporidium parvum
DYLKECLVCLRYLVCLISKISIGFSLQFIPDHPT

SEQ ID NO: 2229821 - protein, 17 aa, Cryptosporidium parvum
DYMPFFVRQCISVTTAF

SEQ ID NO: 2229822 - protein, 27 aa, Cryptosporidium parvum
DYNARRRFTWVYVVAITFVFMLATSFA

SEQ ID NO: 2229823 - protein, 19 aa, Cryptosporidium parvum
DYNSGIIKSDFQHILDPSK

SEQ ID NO: 2229824 - protein, 25 aa, Cryptosporidium parvum
DYPKLLACSDLGISMHYSSSGLDLP

SEQ ID NO: 2229825 - protein, 19 aa, Cryptosporidium parvum
DYTRRIPLEGLEMYCKTVW

SEQ ID NO: 2229826 - protein, 34 aa, Cryptosporidium parvum
DYVRCSLNLSTYHLDEWYAIYLCYKVTESMENLV

SEQ ID NO: 2229827 - protein, 17 aa, Cryptosporidium parvum
DYYKNNILFYLNRGNHT

SEQ ID NO: 2229828 - protein, 23 aa, Cryptosporidium parvum
DYYRKLCSQVIFPTPLVSTDKVV

SEQ ID NO: 2229829 - protein, 28 aa, Cryptosporidium parvum
EAASSWCYISFQLVNQVWPIWLRSSSLI

SEQ ID NO: 2229830 - protein, 18 aa, Cryptosporidium parvum
EAELDLAKSASRTSKLAM

SEQ ID NO: 2229831 - protein, 21 aa, Cryptosporidium parvum
EAFIHDPLIEWMRPGKTTQIS

SEQ ID NO: 2229832 - protein, 21 aa, Cryptosporidium parvum
EAFLRFYSKGAFIVRSIYKFL

SEQ ID NO: 2229833 - protein, 19 aa, Cryptosporidium parvum
EAHIIFMFRQYYKLYNTLL

SEQ ID NO: 2229834 - protein, 24 aa, Cryptosporidium parvum
EAKPGSKIKLEFRVVPLTNGLLKL

SEQ ID NO: 2229835 - protein, 18 aa, Cryptosporidium parvum
EAKQNIGRKSRRFVIKYY

SEQ ID NO: 2229836 - protein, 35 aa, Cryptosporidium parvum
EALECIYRNGLSIQILESFLGYSLDYIISKEITFF

SEQ ID NO: 2229837 - protein, 19 aa, Cryptosporidium parvum
EALIQSICMIFFQSSPESK

SEQ ID NO: 2229838 - protein, 19 aa, Cryptosporidium parvum
EALISFNRFQSFLRSRPLD

SEQ ID NO: 2229839 - protein, 24 aa, Cryptosporidium parvum
EALSIKGLLNDGGQFTITSLDQNI

SEQ ID NO: 2229840 - protein, 22 aa, Cryptosporidium parvum
EALYSLHLRKLLARLSLNALIL

SEQ ID NO: 2229841 - protein, 20 aa, Cryptosporidium parvum
EAPDRLTGLASYYEILELFE

SEQ ID NO: 2229842 - protein, 28 aa, Cryptosporidium parvum
EAPGSRINSLRRLRGLSEDNSQDVEEVN

SEQ ID NO: 2229843 - protein, 19 aa, Cryptosporidium parvum
EARNWKGKIDILYNNAGIG

SEQ ID NO: 2229844 - protein, 19 aa, Cryptosporidium parvum
EATMCRLLLPEMIDKRIDK

SEQ ID NO: 2229845 - protein, 30 aa, Cryptosporidium parvum; identical to SEQ ID NO: 2169705

SEQ ID NO: 2229846 - protein, 24 aa, Cryptosporidium parvum
EATSSCAFNQTFYFQNMMLDSLEF

SEQ ID NO: 2229847 - protein, 26 aa, Cryptosporidium parvum
EAVSALLSFGAFPWIRNYAGFDPVTL

SEQ ID NO: 2229848 - protein, 21 aa, Cryptosporidium parvum
EAYCFKFYSYILFIYTPIGRG

SEQ ID NO: 2229849 - protein, 17 aa, Cryptosporidium parvum
EAYEAKQRLKAVKCELH

SEQ ID NO: 2229850 - protein, 23 aa, Cryptosporidium parvum
EAYYWKEGWILPKTTLDLQKSEL

SEQ ID NO: 2229851 - protein, 24 aa, Cryptosporidium parvum
ECDVWSAGVVMYFLLAGTLPFTGR

SEQ ID NO: 2229852 - protein, 17 aa, Cryptosporidium parvum
ECHIILCNCCYKESYNL

SEQ ID NO: 2229853 - protein, 17 aa, Cryptosporidium parvum
ECICPFCKEDIVTQVEL

SEQ ID NO: 2229854 - protein, 23 aa, Cryptosporidium parvum
ECICRLGRCPGVHGIKNIGDFKD

SEQ ID NO: 2229855 - protein, 24 aa, Cryptosporidium parvum
ECIEKRTKILLGLGEEENNRIEAR

SEQ ID NO: 2229856 - protein, 33 aa, Cryptosporidium parvum
ECISPNLLTIFGFLCSLIAMLLTMMTCPMLDNA

SEQ ID NO: 2229857 - protein, 31 aa, Cryptosporidium parvum; identical to SEQ ID NO: 2122565

SEQ ID NO: 2229858 - protein, 22 aa, Cryptosporidium parvum
ECLIPFKDLLLKSFIALQDQAF

SEQ ID NO: 2229859 - protein, 21 aa, Cryptosporidium parvum
ECLIVKSIIVSSTFGVIKMIT

SEQ ID NO: 2229860 - protein, 21 aa, Cryptosporidium parvum
ECLLPFIPLSWTKFFPETNND

SEQ ID NO: 2229861 - protein, 18 aa, Cryptosporidium parvum
ECQSGIMAANTNFCREGK

SEQ ID NO: 2229862 - protein, 17 aa, Cryptosporidium parvum
ECRRHLEVLNSHEPFLS

SEQ ID NO: 2229863 - protein, 18 aa, Cryptosporidium parvum
ECSNAHYELLASLKPFVN

SEQ ID NO: 2229864 - protein, 19 aa, Cryptosporidium parvum
ECVRYKERLKEGGLGNFLL

SEQ ID NO: 2229865 - protein, 24 aa, Cryptosporidium parvum
EDAWEIYYLITFIQLSFREIFIIF

SEQ ID NO: 2229866 - protein, 25 aa, Cryptosporidium parvum
EDCFCMPGFKPASLRDETCVQCAST

SEQ ID NO: 2229867 - protein, 20 aa, Cryptosporidium parvum
EDEICLPPEMIHGIIDEFLY

SEQ ID NO: 2229868 - protein, 21 aa, Cryptosporidium parvum
EDEILKIILNYEGNLKAKIEG

SEQ ID NO: 2229869 - protein, 31 aa, Cryptosporidium parvum
EDFLQLETWYKCAIVKVPIFPPSESLSDEAK

SEQ ID NO: 2229870 - protein, 19 aa, Cryptosporidium parvum
EDGFFVSIVKICLIAISIL

SEQ ID NO: 2229871 - protein, 18 aa, Cryptosporidium parvum
EDGFKYIIFEITKINTES

SEQ ID NO: 2229872 - protein, 18 aa, Cryptosporidium parvum
EDGISELIDKVMYMNDPN

SEQ ID NO: 2229873 - protein, 22 aa, Cryptosporidium parvum
EDHPRIFPEISNYYCCRSEESF

SEQ ID NO: 2229874 - protein, 33 aa, Cryptosporidium parvum; identical to SEQ ID NO: 2122574

SEQ ID NO: 2229875 - protein, 24 aa, Cryptosporidium parvum
EDIKRWIYHSIEFTCNSIPKIEDD

SEQ ID NO: 2229876 - protein, 27 aa, Cryptosporidium parvum
EDINFLRIWPAYFMMVTTIGWGMVMIS

SEQ ID NO: 2229877 - protein, 19 aa, Cryptosporidium parvum
EDIVRFSAEFYKFSNDKWE

SEQ ID NO: 2229878 - protein, 24 aa, Cryptosporidium parvum
EDLIRSGLFYAHSIVVCSSNSINS

SEQ ID NO: 2229879 - protein, 30 aa, Cryptosporidium parvum
EDLNISLHCNFTWSCIRNIFESNIRRLQTP

SEQ ID NO: 2229880 - protein, 23 aa, Cryptosporidium parvum
EDLSNLFLEFSWLEEKGELIKES

SEQ ID NO: 2229881 - protein, 18 aa, Cryptosporidium parvum
EDNLRISANLAQETQHIG

SEQ ID NO: 2229882 - protein, 17 aa, Cryptosporidium parvum
EDNRYPTAHFYTVAAML

SEQ ID NO: 2229883 - protein, 24 aa, Cryptosporidium parvum
EDQWKYKMLHSFRQFISGAINSKF

SEQ ID NO: 2229884 - protein, 17 aa, Cryptosporidium parvum
EDSPCLRTYCECLCEIK

SEQ ID NO: 2229885 - protein, 26 aa, Cryptosporidium parvum
EECAPGCPKWFIKNGYCDVNCQNPEC

SEQ ID NO: 2229886 - protein, 28 aa, Cryptosporidium parvum
EEDKRLPFFYTLRWYWLGVTLFSTGKLW

SEQ ID NO: 2229887 - protein, 25 aa, Cryptosporidium parvum
EEEERLRYLIFLAEVQMRRLINMIQ

SEQ ID NO: 2229888 - protein, 23 aa, Cryptosporidium parvum
EEELKKLLGYSGLFGQNYGNEQS

SEQ ID NO: 2229889 - protein, 18 aa, Cryptosporidium parvum
EEELYWNKRRFIYSRIAA

SEQ ID NO: 2229890 - protein, 26 aa, Cryptosporidium parvum
EEFGDSPLHWAVRLELPKVVHRLVKS

SEQ ID NO: 2229891 - protein, 21 aa, Cryptosporidium parvum
EEFLELLLDYGASMTDLTLEG

SEQ ID NO: 2229892 - protein, 24 aa, Cryptosporidium parvum
EEGGCPTFRLHLSIISIEDLPIFP

SEQ ID NO: 2229893 - protein, 21 aa, Cryptosporidium parvum
EEGRPHGFGRWREDDYYGEIL

SEQ ID NO: 2229894 - protein, 24 aa, Cryptosporidium parvum
EEGSKYRIGIGFKDSAINLLIENP

SEQ ID NO: 2229895 - protein, 25 aa, Cryptosporidium parvum
EEHVLSFPMSYIFFSTYGRKFADKI

SEQ ID NO: 2229896 - protein, 24 aa, Cryptosporidium parvum
EEIELRKGEIVFKNVFFSYSDNID

SEQ ID NO: 2229897 - protein, 18 aa, Cryptosporidium parvum
EEIFKYSRLATELLCTNV

SEQ ID NO: 2229898 - protein, 31 aa, Cryptosporidium parvum
EEIRDFCEYQNKWICTKYEMLVLKLLQEYYK

SEQ ID NO: 2229899 - protein, 29 aa, Cryptosporidium parvum
EELCNSKVIFPWSMGNRVPINSVSCSDPI

SEQ ID NO: 2229900 - protein, 19 aa, Cryptosporidium parvum
EELEILKVYEFCSKLRRMT

SEQ ID NO: 2229901 - protein, 19 aa, Cryptosporidium parvum
EELFWRSFVYKELIISLGV

SEQ ID NO: 2229902 - protein, 30 aa, Cryptosporidium parvum; identical to SEQ ID NO: 2122597

SEQ ID NO: 2229903 - protein, 23 aa, Cryptosporidium parvum
EELLRLANSYAFNVYIGNECIES

SEQ ID NO: 2229904 - protein, 18 aa, Cryptosporidium parvum
EELMKSKTPLTVEEIEAA

SEQ ID NO: 2229905 - protein, 17 aa, Cryptosporidium parvum
EELPMDCFIIKSKPELK

SEQ ID NO: 2229906 - protein, 27 aa, Cryptosporidium parvum
EEMNISKFWLLIAIILIYITSLEKDVE

SEQ ID NO: 2229907 - protein, 27 aa, Cryptosporidium parvum
EENVSFTGIQIWISTLSFQIWTSTKNL

SEQ ID NO: 2229908 - protein, 22 aa, Cryptosporidium parvum
EENWIKQCVQFDFNRDLYSSRE

SEQ ID NO: 2229909 - protein, 24 aa, Cryptosporidium parvum
EERIKKFLFTYGYPVELLKPLSNI

SEQ ID NO: 2229910 - protein, 19 aa, Cryptosporidium parvum
EERISCLTKSISQNDDFIL

SEQ ID NO: 2229911 - protein, 20 aa, Cryptosporidium parvum
EERKNRVSIKIPTDDENKNK

SEQ ID NO: 2229912 - protein, 17 aa, Cryptosporidium parvum
EERLKQFMKLFSCNYSS

SEQ ID NO: 2229913 - protein, 26 aa, Cryptosporidium parvum
EERRGECLIIGKGVSCGDFDCKKYMN

SEQ ID NO: 2229914 - protein, 19 aa, Cryptosporidium parvum
EERRIPTFMVIVREKLIIL

SEQ ID NO: 2229915 - protein, 24 aa, Cryptosporidium parvum
EESCFKLIFYEIPLISWISETELF

SEQ ID NO: 2229916 - protein, 25 aa, Cryptosporidium parvum
EESDDFFGSGLFNLDEIINWDDLNF

SEQ ID NO: 2229917 - protein, 18 aa, Cryptosporidium parvum
EESFQWDDHNCQAHPHSQ

SEQ ID NO: 2229918 - protein, 27 aa, Cryptosporidium parvum
EESKSDILECFIKWKNDHYYTKWEEFN

SEQ ID NO: 2229919 - protein, 24 aa, Cryptosporidium parvum
EESPWIHGGRLIWYKTGKNSSNNY

SEQ ID NO: 2229920 - protein, 26 aa, Cryptosporidium parvum
EEVCSSIQLMSFWKLYNDVFDLVESE

SEQ ID NO: 2229921 - protein, 25 aa, Cryptosporidium parvum
EEVGPALFWFITWGLILLCAAGAIV

SEQ ID NO: 2229922 - protein, 18 aa, Cryptosporidium parvum
EEWGEPTNSYFGTRINGE

SEQ ID NO: 2229923 - protein, 22 aa, Cryptosporidium parvum
EEWRFLCYDFEKFDLEKDHLKI

SEQ ID NO: 2229924 - protein, 22 aa, Cryptosporidium parvum
EFADLRPLFLWHGRHAYQNSAK

SEQ ID NO: 2229925 - protein, 17 aa, Cryptosporidium parvum
EFCGPPYSIDFSVSYLD

SEQ ID NO: 2229926 - protein, 20 aa, Cryptosporidium parvum
EFDISEIISHFIRISLLYSI

SEQ ID NO: 2229927 - protein, 27 aa, Cryptosporidium parvum
EFDVFRRLYSLLIKFAPLDLKDLISIE

SEQ ID NO: 2229928 - protein, 23 aa, Cryptosporidium parvum
EFEDKIRWFGLSKYSSQKLDSFT

SEQ ID NO: 2229929 - protein, 18 aa, Cryptosporidium parvum
EFEFPVRVFRNITPDFDS

SEQ ID NO: 2229930 - protein, 24 aa, Cryptosporidium parvum
EFEIKLPISVLFDYPTLNELIGYI

SEQ ID NO: 2229931 - protein, 19 aa, Cryptosporidium parvum
EFFENDLIFCGFLALYCPI

SEQ ID NO: 2229932 - protein, 29 aa, Cryptosporidium parvum
EFGESIKLFNCLPNKVSINNCFNKIISEY

SEQ ID NO: 2229933 - protein, 24 aa, Cryptosporidium parvum
EFGLICGLFKKCEATGIEKNNLFN

SEQ ID NO: 2229934 - protein, 19 aa, Cryptosporidium parvum
EFHLYQWIFVIDFFNTKDT

SEQ ID NO: 2229935 - protein, 19 aa, Cryptosporidium parvum
EFHVRNLLCSLLRDDLHAF

SEQ ID NO: 2229936 - protein, 20 aa, Cryptosporidium parvum
EFLEYDWSKSTLWQQYYNNL

SEQ ID NO: 2229937 - protein, 27 aa, Cryptosporidium parvum
EFLKEGFLSKGGGFWGALNRNSKVDPD

SEQ ID NO: 2229938 - protein, 27 aa, Cryptosporidium parvum
EFLNALVCAWTLFSLLIICTLKGISSG

SEQ ID NO: 2229939 - protein, 26 aa, Cryptosporidium parvum
EFLTRNLFFSQFVKIACIIRGLHISA

SEQ ID NO: 2229940 - protein, 26 aa, Cryptosporidium parvum
EFLVDWRFWFCPDSNMLETGEDLYFR

SEQ ID NO: 2229941 - protein, 24 aa, Cryptosporidium parvum
EFNFIMYVATAWRTYLESKVYKGP

SEQ ID NO: 2229942 - protein, 19 aa, Cryptosporidium parvum
EFNFPMKVNFFSALEVFQV

SEQ ID NO: 2229943 - protein, 29 aa, Cryptosporidium parvum
EFNSELPFWFERWLEAFNEKFNFLNHESI

SEQ ID NO: 2229944 - protein, 24 aa, Cryptosporidium parvum
EFPLEAETSWSRNSIFFNRTNSNN

SEQ ID NO: 2229945 - protein, 20 aa, Cryptosporidium parvum
EFPTWQWGEEVSIKEIGDNI

SEQ ID NO: 2229946 - protein, 20 aa, Cryptosporidium parvum
EFSTCFKYLISPISPLLLSS

SEQ ID NO: 2229947 - protein, 21 aa, Cryptosporidium parvum
EFVCSRFNYFNGKTFGEASAA

SEQ ID NO: 2229948 - protein, 23 aa, Cryptosporidium parvum
EFVLVSLIFICRLIYNCINGQFP

SEQ ID NO: 2229949 - protein, 19 aa, Cryptosporidium parvum
EFYRIFRFNLYNLFTILYK

SEQ ID NO: 2229950 - protein, 17 aa, Cryptosporidium parvum
EGAAGLAGLLKVLLVMS

SEQ ID NO: 2229951 - protein, 33 aa, Cryptosporidium parvum
EGARLKFIDFIAPIIIQTSLKWVSASQEISLRR

SEQ ID NO: 2229952 - protein, 22 aa, Cryptosporidium parvum
EGCCSMVLCRFDERENVDFDKK

SEQ ID NO: 2229953 - protein, 19 aa, Cryptosporidium parvum
EGEGFAFWFVSEAYGSIYP

SEQ ID NO: 2229954 - protein, 18 aa, Cryptosporidium parvum
EGFISFRRFQEFLKNTEI

SEQ ID NO: 2229955 - protein, 18 aa, Cryptosporidium parvum
EGFTIESWHSLALHLYNV

SEQ ID NO: 2229956 - protein, 20 aa, Cryptosporidium parvum
EGGLKIRGKPVVTHHGVIDV

SEQ ID NO: 2229957 - protein, 28 aa, Cryptosporidium parvum
EGGLSLFFHVLRTSFFILYESYGGAISD

SEQ ID NO: 2229958 - protein, 24 aa, Cryptosporidium parvum
EGGYFRIYDTFTWENIQICHKFGL

SEQ ID NO: 2229959 - protein, 19 aa, Cryptosporidium parvum
EGIISFKRIIDFFERNSYS

SEQ ID NO: 2229960 - protein, 17 aa, Cryptosporidium parvum
EGINFCINKNGKISKSK

SEQ ID NO: 2229961 - protein, 21 aa, Cryptosporidium parvum
EGIQSFRIMTMIKHSPLNSQY

SEQ ID NO: 2229962 - protein, 24 aa, Cryptosporidium parvum
EGIYVLRRMELFVGGVMGMITFVG

SEQ ID NO: 2229963 - protein, 21 aa, Cryptosporidium parvum
EGLEIPKIVDFDRVCTEIQSF

SEQ ID NO: 2229964 - protein, 19 aa, Cryptosporidium parvum
EGLIICNIPSFSGGVNLWK

SEQ ID NO: 2229965 - protein, 31 aa, Cryptosporidium parvum
EGLILTYGGPRKWSLGFQILECKKLYYHQNN

SEQ ID NO: 2229966 - protein, 24 aa, Cryptosporidium parvum
EGLMLTECRVLYSSNLEDLNKKEN

SEQ ID NO: 2229967 - protein, 21 aa, Cryptosporidium parvum
EGNIIRDCCEYANFSNLQDIS

SEQ ID NO: 2229968 - protein, 25 aa, Cryptosporidium parvum
EGNTIIPIRTMVAINCRRWVTKDNP

SEQ ID NO: 2229969 - protein, 19 aa, Cryptosporidium parvum
EGRNLLWWMAHLGDEDLIR

SEQ ID NO: 2229970 - protein, 18 aa, Cryptosporidium parvum
EGSISLLLTYLSKAKENN

SEQ ID NO: 2229971 - protein, 24 aa, Cryptosporidium parvum
EGSPDQWLNLDWIHPMEPSCSNTE

SEQ ID NO: 2229972 - protein, 22 aa, Cryptosporidium parvum
EGSVIRCLRRLEELLRQVASAT

SEQ ID NO: 2229973 - protein, 21 aa, Cryptosporidium parvum
EGTCNQLVYLRVYQLIHELIV

SEQ ID NO: 2229974 - protein, 24 aa, Cryptosporidium parvum
EGTDFPFQWIEKVIHTLENFSYDR

SEQ ID NO: 2229975 - protein, 22 aa, Cryptosporidium parvum
EGTHFMLPWIERPVIFDIRARP

SEQ ID NO: 2229976 - protein, 20 aa, Cryptosporidium parvum
EGTILFLLCFNHNYWYNLMV

SEQ ID NO: 2229977 - protein, 22 aa, Cryptosporidium parvum
EGTLLKEFVKLAVDFSFLSGSS

SEQ ID NO: 2229978 - protein, 20 aa, Cryptosporidium parvum
EGVGCPNLTITSTFQFSNKN

SEQ ID NO: 2229979 - protein, 24 aa, Cryptosporidium parvum
EGVGDSFGGFSIRGKSSNNISNNI

SEQ ID NO: 2229980 - protein, 20 aa, Cryptosporidium parvum
EGVMGVGINVNGPGQAPGVA

SEQ ID NO: 2229981 - protein, 24 aa, Cryptosporidium parvum
EHDLVCPIGYILEGNHCKLCESGT

SEQ ID NO: 2229982 - protein, 27 aa, Cryptosporidium parvum
EHDLYLKLCFELLLSFEKHSWAVSIAL

SEQ ID NO: 2229983 - protein, 18 aa, Cryptosporidium parvum
EHERRTCCKKSHSEAISR

SEQ ID NO: 2229984 - protein, 24 aa, Cryptosporidium parvum
EHILGNKCLFRLDSSNALLKKASN

SEQ ID NO: 2229985 - protein, 19 aa, Cryptosporidium parvum
EHISNILGIHIQDIVIDEI

SEQ ID NO: 2229986 - protein, 25 aa, Cryptosporidium parvum
EHKKYSWWVYFVFCIATQIIIGAIV

SEQ ID NO: 2229987 - protein, 23 aa, Cryptosporidium parvum
EHKNRYNSLFALLFGKTRFNLIE

SEQ ID NO: 2229988 - protein, 29 aa, Cryptosporidium parvum
EHPVEILLINICIEFCIFLILQKDWKLYK

SEQ ID NO: 2229989 - protein, 19 aa, Cryptosporidium parvum
EIAIICFDFFNLLEFYTDQ

SEQ ID NO: 2229990 - protein, 20 aa, Cryptosporidium parvum
EIALKISFHSSYTRELYYTS

SEQ ID NO: 2229991 - protein, 23 aa, Cryptosporidium parvum
EIAPRNGLLRVREFQMAEIEHFI

SEQ ID NO: 2229992 - protein, 31 aa, Cryptosporidium parvum
EIDLAVKFKKIIRYLSIFKFNFENINCILLR

SEQ ID NO: 2229993 - protein, 20 aa, Cryptosporidium parvum
EIDMSSDLLIRVYTKDESHS

SEQ ID NO: 2229994 - protein, 19 aa, Cryptosporidium parvum
EIEFNPVFLNSVFEQNNDF

SEQ ID NO: 2229995 - protein, 22 aa, Cryptosporidium parvum
EIELKSSILIESLFMDSYNYFI

SEQ ID NO: 2229996 - protein, 25 aa, Cryptosporidium parvum
EIENALRLSQAWDFVNSFRDGLETL

SEQ ID NO: 2229997 - protein, 24 aa, Cryptosporidium parvum
EIFDLSLLCGSLFSAFNNIKIYDL

SEQ ID NO: 2229998 - protein, 26 aa, Cryptosporidium parvum
EIFFKNRYFWIISCLFTILFKTNNII

SEQ ID NO: 2229999 - protein, 21 aa, Cryptosporidium parvum
EIFIGIAISAWKLWKTKIFIL

SEQ ID NO: 2230000 - protein, 19 aa, Cryptosporidium parvum
EIFRECLLNGMGVVTLKDS

SEQ ID NO: 2230001 - protein, 19 aa, Cryptosporidium parvum
EIFSNILGILLPKIQINSN

SEQ ID NO: 2230002 - protein, 17 aa, Cryptosporidium parvum
EIIEYLRFKADMKDPLI

SEQ ID NO: 2230003 - protein, 22 aa, Cryptosporidium parvum
EIILQLISLRGLSYSRMGNIIL

SEQ ID NO: 2230004 - protein, 26 aa, Cryptosporidium parvum
EIISHFIRISLLYSIDNQNNSYMDEI

SEQ ID NO: 2230005 - protein, 24 aa, Cryptosporidium parvum
EIISKEILESVILEEVELVNPNGL

SEQ ID NO: 2230006 - protein, 25 aa, Cryptosporidium parvum
EIITFKELILLKILAFVEINKRSSQ

SEQ ID NO: 2230007 - protein, 23 aa, Cryptosporidium parvum
EIKEKMRDYCRVFMTDTDDIYSI

SEQ ID NO: 2230008 - protein, 25 aa, Cryptosporidium parvum
EIKVELKLSAVWTIFDSIHGIFALS

SEQ ID NO: 2230009 - protein, 20 aa, Cryptosporidium parvum
EILCFMAISFYCYCNQHTGS

SEQ ID NO: 2230010 - protein, 20 aa, Cryptosporidium parvum
EILDSLLFAGGLDINYEKEF

SEQ ID NO: 2230011 - protein, 24 aa, Cryptosporidium parvum
EILKHARPGLISMLDSLSHGISLK

SEQ ID NO: 2230012 - protein, 18 aa, Cryptosporidium parvum
EILLELPSEYSWLLSNDI

SEQ ID NO: 2230013 - protein, 18 aa, Cryptosporidium parvum
EILQLLINILLVITNNMF

SEQ ID NO: 2230014 - protein, 17 aa, Cryptosporidium parvum
EILSSFIEMCFRQTQTP

SEQ ID NO: 2230015 - protein, 24 aa, Cryptosporidium parvum
EILVCLRSILNTEFRQGFYDRIEI

SEQ ID NO: 2230016 - protein, 18 aa, Cryptosporidium parvum
EILYKLIKKKGLNLITSL

SEQ ID NO: 2230017 - protein, 19 aa, Cryptosporidium parvum
EIMIYRYSNQYGELELVSK

SEQ ID NO: 2230018 - protein, 32 aa, Cryptosporidium parvum
EINKKSFFKFEFKLEIENGIFGFTSHPQKRIL

SEQ ID NO: 2230019 - protein, 20 aa, Cryptosporidium parvum
EINKLISALCDDFYGESEER

SEQ ID NO: 2230020 - protein, 21 aa, Cryptosporidium parvum
EIPEISLCILRNSGFQLLQSI

SEQ ID NO: 2230021 - protein, 19 aa, Cryptosporidium parvum
EIPKLKMRAFINFGNQTTD

SEQ ID NO: 2230022 - protein, 28 aa, Cryptosporidium parvum
EIPVSSLCLWWKHPVNYPLSVVLADKLP

SEQ ID NO: 2230023 - protein, 21 aa, Cryptosporidium parvum
EIPYVKGLYEKAERLGISCVA

SEQ ID NO: 2230024 - protein, 31 aa, Cryptosporidium parvum
EIRFYSWDIVERWKYQWIFQDAIPFFFVSVL

SEQ ID NO: 2230025 - protein, 24 aa, Cryptosporidium parvum
EIRGLRNFFLRSGDYCTVSIKLPV

SEQ ID NO: 2230026 - protein, 18 aa, Cryptosporidium parvum
EIRICIKSLLGIIKEQFF

SEQ ID NO: 2230027 - protein, 18 aa, Cryptosporidium parvum
EIRKKLAKDSVNWHCNTC

SEQ ID NO: 2230028 - protein, 21 aa, Cryptosporidium parvum
EIRLQCLNMLLIKAQLESKYL

SEQ ID NO: 2230029 - protein, 17 aa, Cryptosporidium parvum
EISEYYLNVLKFLNEYN

SEQ ID NO: 2230030 - protein, 28 aa, Cryptosporidium parvum
EISFLKNHMVSWFKWNFLQVKSQSLILG

SEQ ID NO: 2230031 - protein, 27 aa, Cryptosporidium parvum
EISFYWNRPEAWEYPKNTPYHEEVENV

SEQ ID NO: 2230032 - protein, 20 aa, Cryptosporidium parvum
EISHLRIPLTENVNTKFKNT

SEQ ID NO: 2230033 - protein, 25 aa, Cryptosporidium parvum
EISNFRLPIVFNEASGIIVFGDKGC

SEQ ID NO: 2230034 - protein, 21 aa, Cryptosporidium parvum
EISNHKYLWAKAILNNVGKQQ

SEQ ID NO: 2230035 - protein, 19 aa, Cryptosporidium parvum
EISSLILQFSQYLVSEQIH

SEQ ID NO: 2230036 - protein, 27 aa, Cryptosporidium parvum
EITQDFGIRCPYFLTSILRSGKVGHSL

SEQ ID NO: 2230037 - protein, 23 aa, Cryptosporidium parvum
EITTLYKYCFNWVSQMLIYSKEE

SEQ ID NO: 2230038 - protein, 25 aa, Cryptosporidium parvum
EIVELLFGESFIKVLFSTETFSMGI

SEQ ID NO: 2230039 - protein, 19 aa, Cryptosporidium parvum
EIVVELLVYFYSSRSNKSS

SEQ ID NO: 2230040 - protein, 22 aa, Cryptosporidium parvum
EIWKGDIPFWKHSLAGSIAGVM

SEQ ID NO: 2230041 - protein, 19 aa, Cryptosporidium parvum
EIYESVYTLAIRNFTRDTV

SEQ ID NO: 2230042 - protein, 27 aa, Cryptosporidium parvum
EIYKRGYCILFMRLLEIPGESVPISAI

SEQ ID NO: 2230043 - protein, 19 aa, Cryptosporidium parvum
EIYLPDGGIEFVKIGSNES

SEQ ID NO: 2230044 - protein, 23 aa, Cryptosporidium parvum
EIYSDWSPLLVIDRNKIVNFRKI

SEQ ID NO: 2230045 - protein, 23 aa, Cryptosporidium parvum
EIYWMELIAFWVLLIMVIVLLRG

SEQ ID NO: 2230046 - protein, 35 aa, Cryptosporidium parvum
EKAICRKGSLILWDSLFCYLKLKKVPIPSLKKYLL

SEQ ID NO: 2230047 - protein, 18 aa, Cryptosporidium parvum
EKAQMFVDIVLKEEEEAK

SEQ ID NO: 2230048 - protein, 33 aa, Cryptosporidium parvum
EKATLRWPSDLTFKIGLTYCLERLVYSEMGDME

SEQ ID NO: 2230049 - protein, 31 aa, Cryptosporidium parvum
EKECKMCFDYHKSHILMIQFKDLISVNSKPE

SEQ ID NO: 2230050 - protein, 23 aa, Cryptosporidium parvum
EKEKKMTVCFELTQKEFIEKRDV

SEQ ID NO: 2230051 - protein, 20 aa, Cryptosporidium parvum
EKELSRQSGLFSESSRNEET

SEQ ID NO: 2230052 - protein, 28 aa, Cryptosporidium parvum
EKEYDIGPRFGVIMQIIFASSEKHRNDN

SEQ ID NO: 2230053 - protein, 17 aa, Cryptosporidium parvum
EKFKGLYSRPLSGEWDD

SEQ ID NO: 2230054 - protein, 21 aa, Cryptosporidium parvum
EKFNISYSFINIWSNRSSMTD

SEQ ID NO: 2230055 - protein, 26 aa, Cryptosporidium parvum
EKFRKVGSCILGIFLFMIHNFVPDSC

SEQ ID NO: 2230056 - protein, 19 aa, Cryptosporidium parvum
EKHSWAVSIALKLDGQNCK

SEQ ID NO: 2230057 - protein, 37 aa, Cryptosporidium parvum
EKHTLWDISRLISLMTWVLAYKRTVFFEVTKSEKDKQ

SEQ ID NO: 2230058 - protein, 20 aa, Cryptosporidium parvum
EKIHFGIPWEFRTYKTQDDR

SEQ ID NO: 2230059 - protein, 23 aa, Cryptosporidium parvum
EKIIEILDIMGLRHVQDTYVGGI

SEQ ID NO: 2230060 - protein, 27 aa, Cryptosporidium parvum
EKIIFIKPIFYSRLTKTLIIYQYPSQL

SEQ ID NO: 2230061 - protein, 24 aa, Cryptosporidium parvum
EKINLWLKDRKSLLESLKSKVTTL

SEQ ID NO: 2230062 - protein, 22 aa, Cryptosporidium parvum
EKIVNIKGLFSYFSREITTKTY

SEQ ID NO: 2230063 - protein, 25 aa, Cryptosporidium parvum
EKIVSQICIFMFLIVSCLGINIFTN

SEQ ID NO: 2230064 - protein, 25 aa, Cryptosporidium parvum
EKKEFYNEIKLCIDYYIQIITMDIF

SEQ ID NO: 2230065 - protein, 18 aa, Cryptosporidium parvum
EKKKIGFCDCNSVWTGGD

SEQ ID NO: 2230066 - protein, 26 aa, Cryptosporidium parvum
EKKLYRISVEIERDWFQIYNVDMEVT

SEQ ID NO: 2230067 - protein, 21 aa, Cryptosporidium parvum
EKKWYCIYTNSFSQIQNCVWL

SEQ ID NO: 2230068 - protein, 20 aa, Cryptosporidium parvum
EKLFEVITHLIIRYKEDYKE

SEQ ID NO: 2230069 - protein, 19 aa, Cryptosporidium parvum
EKLFKESYGWEIVDIGRKF

SEQ ID NO: 2230070 - protein, 25 aa, Cryptosporidium parvum
EKLLEIRTPFYLFILHTLRQHGVEY

SEQ ID NO: 2230071 - protein, 18 aa, Cryptosporidium parvum
EKLLKTFSCLKLHSLLVK

SEQ ID NO: 2230072 - protein, 20 aa, Cryptosporidium parvum
EKLLRCESCGRNFHLDCIRN

SEQ ID NO: 2230073 - protein, 27 aa, Cryptosporidium parvum
EKLLYLPNCFLCYTLPKIQHPPISEPP

SEQ ID NO: 2230074 - protein, 20 aa, Cryptosporidium parvum
EKLPNLEIFPLETVNSPNSK

SEQ ID NO: 2230075 - protein, 28 aa, Cryptosporidium parvum
EKLQLAEILFKICKPFEIKNIEEIINYS

SEQ ID NO: 2230076 - protein, 23 aa, Cryptosporidium parvum
EKLRWPGGFYFYISGSGPYYPCH

SEQ ID NO: 2230077 - protein, 26 aa, Cryptosporidium parvum
EKLTYQYFLDWFKQIYDNSVLFMFAI

SEQ ID NO: 2230078 - protein, 21 aa, Cryptosporidium parvum
EKMEMIFILPYGKFCIEKCLG

SEQ ID NO: 2230079 - protein, 18 aa, Cryptosporidium parvum
EKMNGILLKDEYTVASYG

SEQ ID NO: 2230080 - protein, 20 aa, Cryptosporidium parvum
EKNFMCTLWLVILRTTQVRY

SEQ ID NO: 2230081 - protein, 27 aa, Cryptosporidium parvum
EKNIPNKVRAMIELAMYLAPEECPARK

SEQ ID NO: 2230082 - protein, 25 aa, Cryptosporidium parvum
EKNKSREGLKWVCMDIEKDFGDYVE

SEQ ID NO: 2230083 - protein, 19 aa, Cryptosporidium parvum
EKPFFMLKKIFEMFVELQI

SEQ ID NO: 2230084 - protein, 20 aa, Cryptosporidium parvum
  misc_feature (18)..(19): Xaa can be any naturally occurring amino acid
EKPLKGKYIKYYTIFNNXXN

SEQ ID NO: 2230085 - protein, 21 aa, Cryptosporidium parvum
EKRALNLITVFILVLTTSCAI

SEQ ID NO: 2230086 - protein, 28 aa, Cryptosporidium parvum
EKRIYRRKYDVFPFLKFKLNNKRSKYLF

SEQ ID NO: 2230087 - protein, 32 aa, Cryptosporidium parvum
EKSDIWMLSYMKFYCLFGKEKLSCVNNLKIKC

SEQ ID NO: 2230088 - protein, 23 aa, Cryptosporidium parvum
EKSFMIFCIPISWLDSTDDYIKL

SEQ ID NO: 2230089 - protein, 24 aa, Cryptosporidium parvum
EKSLEFKLNFPAGIASKSLKNCVK

SEQ ID NO: 2230090 - protein, 21 aa, Cryptosporidium parvum
EKTFLLCLSDSITSNHSIYIT

SEQ ID NO: 2230091 - protein, 19 aa, Cryptosporidium parvum
EKVKLCLSDTTQLRTGLNI

SEQ ID NO: 2230092 - protein, 22 aa, Cryptosporidium parvum
EKVPFRLTRNMEHLMGPFGKNG

SEQ ID NO: 2230093 - protein, 26 aa, Cryptosporidium parvum
EKWYFEDLVKLCFTGFVISMVHLTYL

SEQ ID NO: 2230094 - protein, 18 aa, Cryptosporidium parvum
EKYIPCIISISIPAASII

SEQ ID NO: 2230095 - protein, 21 aa, Cryptosporidium parvum
EKYIYIFGLLFSWVLFVLSIP

SEQ ID NO: 2230096 - protein, 24 aa, Cryptosporidium parvum
EKYLIKFGFLSDFLFNSKLNKLFS

SEQ ID NO: 2230097 - protein, 19 aa, Cryptosporidium parvum
EKYLNLHFISGREGISAFS

SEQ ID NO: 2230098 - protein, 17 aa, Cryptosporidium parvum
EKYSTLYPSEFDMRMSG

SEQ ID NO: 2230099 - protein, 18 aa, Cryptosporidium parvum
ELADPWAIKSMLTGQPLR

SEQ ID NO: 2230100 - protein, 33 aa, Cryptosporidium parvum
ELCILLEIYWRRMQIRFPIFFGGSMTEKANSYY

SEQ ID NO: 2230101 - protein, 24 aa, Cryptosporidium parvum
ELCLIRYFAYIGFFMINSIENIHH

SEQ ID NO: 2230102 - protein, 25 aa, Cryptosporidium parvum
ELCSESFGLFKSCKDNTIIPREYDS

SEQ ID NO: 2230103 - protein, 25 aa, Cryptosporidium parvum
ELDLCLRILHIFKYESVVIVDEIDM

SEQ ID NO: 2230104 - protein, 17 aa, Cryptosporidium parvum
ELDNCIFLKSQRKSIDI

SEQ ID NO: 2230105 - protein, 25 aa, Cryptosporidium parvum
ELEAWRSVLIPIYLPDTSVRGKYMT

SEQ ID NO: 2230106 - protein, 18 aa, Cryptosporidium parvum
ELECIKFDSKISLVQLLN

SEQ ID NO: 2230107 - protein, 23 aa, Cryptosporidium parvum
ELEIFPMEFFKIILNVKQMEEIE

SEQ ID NO: 2230108 - protein, 47 aa, Cryptosporidium parvum
ELELPVFHPLFLGNLVRILKCCCWHCCCIRLSKKVCNGYVKRFESIG

SEQ ID NO: 2230109 - protein, 22 aa, Cryptosporidium parvum
ELEPPFPCSWERVKMIDSTIVP

SEQ ID NO: 2230110 - protein, 24 aa, Cryptosporidium parvum
ELEQRDLFGFFGRISNFSIHTVLS

SEQ ID NO: 2230111 - protein, 23 aa, Cryptosporidium parvum
ELERARLMLILSNIKQEDNDLKE

SEQ ID NO: 2230112 - protein, 20 aa, Cryptosporidium parvum
ELFIRILSFEEMIFIQPENN

SEQ ID NO: 2230113 - protein, 17 aa, Cryptosporidium parvum
ELFKLLIEYTKSSNLKT

SEQ ID NO: 2230114 - protein, 19 aa, Cryptosporidium parvum
ELFLYSIEVSNRLIKLFSK

SEQ ID NO: 2230115 - protein, 21 aa, Cryptosporidium parvum
ELFNIMNIYWLYKVVKNVFNP

SEQ ID NO: 2230116 - protein, 19 aa, Cryptosporidium parvum
ELFSRGLLFESLRMSSNMR

SEQ ID NO: 2230117 - protein, 18 aa, Cryptosporidium parvum
ELIHCRSLRDILYNLVKI

SEQ ID NO: 2230118 - protein, 25 aa, Cryptosporidium parvum
ELIKESRISFDFKVFDQERKCYEIY

SEQ ID NO: 2230119 - protein, 19 aa, Cryptosporidium parvum
ELILCWKSLIKQDNTRETV

SEQ ID NO: 2230120 - protein, 23 aa, Cryptosporidium parvum
ELIRKIKAIICRENRKDTTTGLF

SEQ ID NO: 2230121 - protein, 24 aa, Cryptosporidium parvum
ELKCYWIILESELIHLLKAAKSGS

SEQ ID NO: 2230122 - protein, 24 aa, Cryptosporidium parvum
ELLCTDIRVARCIYLHQIHKKDEG

SEQ ID NO: 2230123 - protein, 31 aa, Cryptosporidium parvum
ELLLCKPNLPFGWINEWVFFLSVDSSLLLNT

SEQ ID NO: 2230124 - protein, 18 aa, Cryptosporidium parvum
ELLLSFFSSFLWLQYFRQ

SEQ ID NO: 2230125 - protein, 29 aa, Cryptosporidium parvum
ELLPVAITIRLKRLLFKSSDDLLFDPRLT

SEQ ID NO: 2230126 - protein, 24 aa, Cryptosporidium parvum
ELLSEIYPSINWTLNLPDRLAERP

SEQ ID NO: 2230127 - protein, 24 aa, Cryptosporidium parvum
ELLYNRRFRLMFIPPNEVQHNSDF

SEQ ID NO: 2230128 - protein, 17 aa, Cryptosporidium parvum
ELNKEFTILHPIPVLLN

SEQ ID NO: 2230129 - protein, 17 aa, Cryptosporidium parvum
ELNLRFLHLNNQPDLGI

SEQ ID NO: 2230130 - protein, 19 aa, Cryptosporidium parvum
ELNLRNELFFSVNNSDIYY

SEQ ID NO: 2230131 - protein, 22 aa, Cryptosporidium parvum
ELNRIVKQKGLFRDRTNQIHQL

SEQ ID NO: 2230132 - protein, 20 aa, Cryptosporidium parvum
ELNSLICLSPAFDKIIHPKI

SEQ ID NO: 2230133 - protein, 23 aa, Cryptosporidium parvum
ELPGIIDIFSRYFVPSIILLSLL

SEQ ID NO: 2230134 - protein, 18 aa, Cryptosporidium parvum
ELPILVDYYADWCNPCKK

SEQ ID NO: 2230135 - protein, 20 aa, Cryptosporidium parvum
ELPPHPKKVLLPIIENQFVF

SEQ ID NO: 2230136 - protein, 19 aa, Cryptosporidium parvum
ELQAIFVTCGLKHQKQLNI

SEQ ID NO: 2230137 - protein, 19 aa, Cryptosporidium parvum
ELQLKISVFSMIRPYNLKK

SEQ ID NO: 2230138 - protein, 20 aa, Cryptosporidium parvum
ELRDLLLKLIDLEIVELKRF

SEQ ID NO: 2230139 - protein, 38 aa, Cryptosporidium parvum
ELSEVSISLIRRLRYISSLKLDIFREILSRVENERQPN

SEQ ID NO: 2230140 - protein, 17 aa, Cryptosporidium parvum
ELSGFYERIMPMGYDNF

SEQ ID NO: 2230141 - protein, 23 aa, Cryptosporidium parvum
ELSKKCHSPFVHIERANIVGTIT

SEQ ID NO: 2230142 - protein, 18 aa, Cryptosporidium parvum
ELSKRILDEFNIEMKNLS

SEQ ID NO: 2230143 - protein, 19 aa, Cryptosporidium parvum
ELSNLVWIQRLRKGEKKVD

SEQ ID NO: 2230144 - protein, 21 aa, Cryptosporidium parvum
ELTHMGIGFITVFKAAIGTGI

SEQ ID NO: 2230145 - protein, 19 aa, Cryptosporidium parvum
ELTIINWIAVFSSLYVAAV

SEQ ID NO: 2230146 - protein, 29 aa, Cryptosporidium parvum
ELTPSGILIACWNAPVLIISRLQKMIKGF

SEQ ID NO: 2230147 - protein, 17 aa, Cryptosporidium parvum
ELVPLHFALEDQPSPIS

SEQ ID NO: 2230148 - protein, 25 aa, Cryptosporidium parvum
ELVSLGNLCGWEFEKKNFYSQNDID

SEQ ID NO: 2230149 - protein, 25 aa, Cryptosporidium parvum
ELVYCIWSTLCLVLTMGEMNATIDP

SEQ ID NO: 2230150 - protein, 18 aa, Cryptosporidium parvum
ELVYKYHALIFNRLQEKA

SEQ ID NO: 2230151 - protein, 17 aa, Cryptosporidium parvum
ELYMISPGYHFWVAELV

SEQ ID NO: 2230152 - protein, 22 aa, Cryptosporidium parvum
EMARCLPCNHVFHDDCIDMWLL

SEQ ID NO: 2230153 - protein, 17 aa, Cryptosporidium parvum
EMCRRKANIRKLPAVET

SEQ ID NO: 2230154 - protein, 19 aa, Cryptosporidium parvum
EMDYVIAAVYYYFIRWQGI

SEQ ID NO: 2230155 - protein, 31 aa, Cryptosporidium parvum; identical to SEQ ID NO: 2122752

SEQ ID NO: 2230156 - protein, 23 aa, Cryptosporidium parvum
EMIQKFWINLSIIIDNEKWEKRD

SEQ ID NO: 2230157 - protein, 24 aa, Cryptosporidium parvum
EMKEYQGKFPIGFIESSKTFINNS

SEQ ID NO: 2230158 - protein, 17 aa, Cryptosporidium parvum
EMMIHRFLISQSTWSSI

SEQ ID NO: 2230159 - protein, 18 aa, Cryptosporidium parvum
EMNNALCECKLNKRDKSI

SEQ ID NO: 2230160 - protein, 24 aa, Cryptosporidium parvum
EMRSRTRSVLSFPRYDHEYCPHLI

SEQ ID NO: 2230161 - protein, 20 aa, Cryptosporidium parvum
EMSGCLDLRYNGVKHSMDLV

SEQ ID NO: 2230162 - protein, 20 aa, Cryptosporidium parvum
EMSRFPTITLGFPGLKVEWE

SEQ ID NO: 2230163 - protein, 20 aa, Cryptosporidium parvum
EMTFAALTLDGWELLIDPTI

SEQ ID NO: 2230164 - protein, 30 aa, Cryptosporidium parvum
EMYYISSIFTRVIFIWLFQSFGKSQLNDLI

SEQ ID NO: 2230165 - protein, 30 aa, Cryptosporidium parvum
ENAFLSQMCCLFQFIKVIGLFLAEFEGPHN

SEQ ID NO: 2230166 - protein, 18 aa, Cryptosporidium parvum
ENALKPSNFIIFITSKAF

SEQ ID NO: 2230167 - protein, 20 aa, Cryptosporidium parvum
ENCISIARFLAQNRAINKKA

SEQ ID NO: 2230168 - protein, 17 aa, Cryptosporidium parvum
ENCWKDHTERVGSLGEN

SEQ ID NO: 2230169 - protein, 23 aa, Cryptosporidium parvum
ENDKLRVVLSLLLHERHGQNLNQ

SEQ ID NO: 2230170 - protein, 20 aa, Cryptosporidium parvum
ENDSRFIVIISYNDLTNILS

SEQ ID NO: 2230171 - protein, 18 aa, Cryptosporidium parvum
ENDYLFYVNVLIKTLLKS

SEQ ID NO: 2230172 - protein, 24 aa, Cryptosporidium parvum
ENEILARILLCLTTIPRLSFILDD

SEQ ID NO: 2230173 - protein, 19 aa, Cryptosporidium parvum
ENEIYPFVHFFFQNLDISN

SEQ ID NO: 2230174 - protein, 22 aa, Cryptosporidium parvum
ENELKPGDLVGVNKDSYLILDK

SEQ ID NO: 2230175 - protein, 22 aa, Cryptosporidium parvum
ENERESISILKLFKAISKSPMR

SEQ ID NO: 2230176 - protein, 26 aa, Cryptosporidium parvum
ENGKEAFFKYIMRFYIFEKLSQFLVN

SEQ ID NO: 2230177 - protein, 25 aa, Cryptosporidium parvum
ENHRRRLNILWSQRYKNIKLRLFIK

SEQ ID NO: 2230178 - protein, 17 aa, Cryptosporidium parvum
ENIAGFDSLLFKRMDVN

SEQ ID NO: 2230179 - protein, 28 aa, Cryptosporidium parvum
ENIARYLKCVIMFKSIKEYSGNNNICTK

SEQ ID NO: 2230180 - protein, 26 aa, Cryptosporidium parvum
ENICKRFKQLVLLLSTMHFDWDTHYY

SEQ ID NO: 2230181 - protein, 22 aa, Cryptosporidium parvum
ENIKPRINLINELKEEIENTNK

SEQ ID NO: 2230182 - protein, 30 aa, Cryptosporidium parvum
ENILKRFFECIKLILRKEATRIVKIKFKIR

SEQ ID NO: 2230183 - protein, 25 aa, Cryptosporidium parvum
ENILLRIECCKKYEKKCLEIERYIT

SEQ ID NO: 2230184 - protein, 20 aa, Cryptosporidium parvum
ENIMIWQILFPKLIYEFFFC

SEQ ID NO: 2230185 - protein, 28 aa, Cryptosporidium parvum
ENINKWYLPQMFLEFSIYNENVDSIIRY

SEQ ID NO: 2230186 - protein, 17 aa, Cryptosporidium parvum
ENIPSPESILFSPFCNI

SEQ ID NO: 2230187 - protein, 33 aa, Cryptosporidium parvum
ENIRRIILCFIVWTLSCGILLRFDRNENDFLTF

SEQ ID NO: 2230188 - protein, 23 aa, Cryptosporidium parvum
ENISFLTYLFIEFDLDINSENLV

SEQ ID NO: 2230189 - protein, 19 aa, Cryptosporidium parvum
ENKCFYSSSSILSFYYDEY

SEQ ID NO: 2230190 - protein, 27 aa, Cryptosporidium parvum
ENKEMPRIPLLILIRANIGVIEDESIL

SEQ ID NO: 2230191 - protein, 23 aa, Cryptosporidium parvum
ENKISVKLVENFPLQRKHPFNFN

SEQ ID NO: 2230192 - protein, 22 aa, Cryptosporidium parvum
ENKYDYGFSFEVFKKDDNMKIT

SEQ ID NO: 2230193 - protein, 21 aa, Cryptosporidium parvum
ENLFSVIEIRSWREMTRPKSL

SEQ ID NO: 2230194 - protein, 21 aa, Cryptosporidium parvum
ENLIECYRLSYSMENRPISSS

SEQ ID NO: 2230195 - protein, 21 aa, Cryptosporidium parvum
ENLKRKSIQTIDKFLPIHISM

SEQ ID NO: 2230196 - protein, 28 aa, Cryptosporidium parvum
ENLLFHYMKRFVIGLSIDKISSRNCNEY

SEQ ID NO: 2230197 - protein, 20 aa, Cryptosporidium parvum
ENLNKVLICNQFDLERNRQI

SEQ ID NO: 2230198 - protein, 19 aa, Cryptosporidium parvum
ENMLYKWIIAQTVTTSAGI

SEQ ID NO: 2230199 - protein, 17 aa, Cryptosporidium parvum
ENMRAAVFLSVNSVSLV

SEQ ID NO: 2230200 - protein, 24 aa, Cryptosporidium parvum
ENNIFKDKDCCYTKLMISNEGYSV

SEQ ID NO: 2230201 - protein, 17 aa, Cryptosporidium parvum
ENPESKPIVGIIHAAGV

SEQ ID NO: 2230202 - protein, 17 aa, Cryptosporidium parvum
ENPEYLFPWGNDYLNSC

SEQ ID NO: 2230203 - protein, 19 aa, Cryptosporidium parvum
ENQISVWLFLTASLLTSLL

SEQ ID NO: 2230204 - protein, 25 aa, Cryptosporidium parvum
ENQRFIPKNVNVEFYWDKFQVNDIY

SEQ ID NO: 2230205 - protein, 24 aa, Cryptosporidium parvum
ENSGTKFLLLIPVLMNLINVLIKH

SEQ ID NO: 2230206 - protein, 19 aa, Cryptosporidium parvum
ENSLLGFGAGEYVNSESDD

SEQ ID NO: 2230207 - protein, 25 aa, Cryptosporidium parvum
ENSPLWRIRMMRLGKCGNTYRTCFI

SEQ ID NO: 2230208 - protein, 17 aa, Cryptosporidium parvum
ENSWIVVNIENWIPDSH

SEQ ID NO: 2230209 - protein, 25 aa, Cryptosporidium parvum
ENTCTKGLCVIAFLPHIADSSDSER

SEQ ID NO: 2230210 - protein, 23 aa, Cryptosporidium parvum
ENTKRLSEEWVELFKNMKYFSNF

SEQ ID NO: 2230211 - protein, 22 aa, Cryptosporidium parvum
ENTVIPGFCPNFNYHIIHDEYL

SEQ ID NO: 2230212 - protein, 25 aa, Cryptosporidium parvum
ENVRYELVNRITLFIDFDSDKYQFM

SEQ ID NO: 2230213 - protein, 25 aa, Cryptosporidium parvum
ENYEKKARISFTFNTLDKLIISQGN

SEQ ID NO: 2230214 - protein, 17 aa, Cryptosporidium parvum
EPCFKSIIYNIPQVGSG

SEQ ID NO: 2230215 - protein, 20 aa, Cryptosporidium parvum
EPDSFPGLAHYLEHLLFINT

SEQ ID NO: 2230216 - protein, 21 aa, Cryptosporidium parvum
EPDSFPGLAHYLEHLLFINTE

SEQ ID NO: 2230217 - protein, 25 aa, Cryptosporidium parvum
EPGLRIMTEGGISRESYYYKDQSII

SEQ ID NO: 2230218 - protein, 23 aa, Cryptosporidium parvum
EPIPPVYIPIFWTSIHRNKVELD

SEQ ID NO: 2230219 - protein, 23 aa, Cryptosporidium parvum
EPIRAATLVRFVKKFSSVGFCSS

SEQ ID NO: 2230220 - protein, 17 aa, Cryptosporidium parvum
EPITWTFFKDHRLAISI

SEQ ID NO: 2230221 - protein, 26 aa, Cryptosporidium parvum
EPPFTLEIFQNIILITSFHSNYKVPV

SEQ ID NO: 2230222 - protein, 34 aa, Cryptosporidium parvum
EPPPSNRASMYWYRVFRSLSLLLYFSRKYIKEYA

SEQ ID NO: 2230223 - protein, 18 aa, Cryptosporidium parvum
EPRVAQLNLLFTNLTNFP

SEQ ID NO: 2230224 - protein, 26 aa, Cryptosporidium parvum
EPYLSIRNFCLFSAASIIFTYLYVFL

SEQ ID NO: 2230225 - protein, 17 aa, Cryptosporidium parvum
EQDRLIEGLQWNRSSNE

SEQ ID NO: 2230226 - protein, 29 aa, Cryptosporidium parvum
EQECVRLIAIENIEAFFLQVFELANSNKE

SEQ ID NO: 2230227 - protein, 17 aa, Cryptosporidium parvum
EQFCKKGLHSKRSSKLF

SEQ ID NO: 2230228 - protein, 23 aa, Cryptosporidium parvum
EQGKPWLWGLSFSGIDHHNVNSI

SEQ ID NO: 2230229 - protein, 24 aa, Cryptosporidium parvum
EQHRLDEILSFVFSNGNLNLLNEF

SEQ ID NO: 2230230 - protein, 24 aa, Cryptosporidium parvum
EQIPEIIRSSSFKSLVQDYMIACS

SEQ ID NO: 2230231 - protein, 19 aa, Cryptosporidium parvum
EQLELLSSIVSKFGANMRK

SEQ ID NO: 2230232 - protein, 20 aa, Cryptosporidium parvum
EQLFEHRLSVIFKQENMGVN

SEQ ID NO: 2230233 - protein, 18 aa, Cryptosporidium parvum
EQMCGMSLDRTCSDGLPR

SEQ ID NO: 2230234 - protein, 25 aa, Cryptosporidium parvum
EQNHKFCLVLIYGHLVIMRIENICV

SEQ ID NO: 2230235 - protein, 27 aa, Cryptosporidium parvum
EQRIKFFISSKCMEMFILNLQFQDNKM

SEQ ID NO: 2230236 - protein, 24 aa, Cryptosporidium parvum
EQSEKSLFCPKGLQCIIQNTNIEN

SEQ ID NO: 2230237 - protein, 24 aa, Cryptosporidium parvum
EQSSNWIAFDFINFINGLMGLKIL

SEQ ID NO: 2230238 - protein, 20 aa, Cryptosporidium parvum
EQVILCLRVLLLKVHYQSLM

SEQ ID NO: 2230239 - protein, 23 aa, Cryptosporidium parvum
EQWKCDSCTINLIFDEINMNFGI

SEQ ID NO: 2230240 - protein, 24 aa, Cryptosporidium parvum
EQYIFDIFCSQVLVSVIWENPSRN

SEQ ID NO: 2230241 - protein, 19 aa, Cryptosporidium parvum
EQYLAAVICLFIAIVYALI

SEQ ID NO: 2230242 - protein, 26 aa, Cryptosporidium parvum
EQYLKYGLKSNCFYCKQSISNFEEED

SEQ ID NO: 2230243 - protein, 24 aa, Cryptosporidium parvum
EQYPNCIIILTFLVIRNTMISSNI

SEQ ID NO: 2230244 - protein, 29 aa, Cryptosporidium parvum
ERAFPCSEYLLKLKLILKRNSRNKIIAKY

SEQ ID NO: 2230245 - protein, 18 aa, Cryptosporidium parvum
ERAIKIIRKTSVSTSSNS

SEQ ID NO: 2230246 - protein, 20 aa, Cryptosporidium parvum
ERALRLCISLLFYNFYYLSG

SEQ ID NO: 2230247 - protein, 25 aa, Cryptosporidium parvum
ERCLPLKQFFVSFLLNSTFERRNNM

SEQ ID NO: 2230248 - protein, 30 aa, Cryptosporidium parvum; identical to SEQ ID NO: 2122802

SEQ ID NO: 2230249 - protein, 21 aa, Cryptosporidium parvum
EREIKVWQGSISKLMNRIMSD

SEQ ID NO: 2230250 - protein, 21 aa, Cryptosporidium parvum
ERGRNMFSFGFTGKNLNEQNN

SEQ ID NO: 2230251 - protein, 24 aa, Cryptosporidium parvum
ERIHEILSTLSLRCIEDKHSITAR

SEQ ID NO: 2230252 - protein, 21 aa, Cryptosporidium parvum
ERILRIKNLFIQELNNHRIQY

SEQ ID NO: 2230253 - protein, 24 aa, Cryptosporidium parvum
ERKCYEIYKFFGGLDKFLKIDNGK

SEQ ID NO: 2230254 - protein, 17 aa, Cryptosporidium parvum
ERKMIIDNFCKLCETHK

SEQ ID NO: 2230255 - protein, 24 aa, Cryptosporidium parvum
ERLLNCLHYLFFILNKMDDINSKQ

SEQ ID NO: 2230256 - protein, 19 aa, Cryptosporidium parvum
ERLVALISMENINIIQVFF

SEQ ID NO: 2230257 - protein, 19 aa, Cryptosporidium parvum
ERNLRYFLLNYIVIILGMT

SEQ ID NO: 2230258 - protein, 22 aa, Cryptosporidium parvum
ERNQARIPLLIKTDIMNNHSYL

SEQ ID NO: 2230259 - protein, 33 aa, Cryptosporidium parvum
ERNQILLLLGILSRYSIRISMNLNENELLLKFK

SEQ ID NO: 2230260 - protein, 19 aa, Cryptosporidium parvum
ERRKELWIISKSLGAITLV

SEQ ID NO: 2230261 - protein, 43 aa, Cryptosporidium parvum
ERTVNKKLIIGVVIGILLILLILMFCCVFFLRRRSDDTESAQN

SEQ ID NO: 2230262 - protein, 17 aa, Cryptosporidium parvum
ESAMITGFIGNKLDGNT

SEQ ID NO: 2230263 - protein, 19 aa, Cryptosporidium parvum
ESCKSLAFNFMDSGDFYKS

SEQ ID NO: 2230264 - protein, 27 aa, Cryptosporidium parvum
ESDSDCACLYTCPSHIAHSPVCQSSRM

SEQ ID NO: 2230265 - protein, 21 aa, Cryptosporidium parvum
ESFISHYLKSNFGYVIAGISS

SEQ ID NO: 2230266 - protein, 24 aa, Cryptosporidium parvum
ESFKKIRSGGTFIELGKRETLDYS

SEQ ID NO: 2230267 - protein, 19 aa, Cryptosporidium parvum
ESFLEFLSNSFPMTLGLLN

SEQ ID NO: 2230268 - protein, 18 aa, Cryptosporidium parvum
ESFPIRYQLGYFSILGLL

SEQ ID NO: 2230269 - protein, 18 aa, Cryptosporidium parvum
ESHFHFVKIFAHLANHLI

SEQ ID NO: 2230270 - protein, 25 aa, Cryptosporidium parvum
ESHKTCKSCFSFNNAQTFVDNSMES

SEQ ID NO: 2230271 - protein, 20 aa, Cryptosporidium parvum
ESHLFLRILENVIPKILENK

SEQ ID NO: 2230272 - protein, 26 aa, Cryptosporidium parvum
ESHYPWSVVSGKFWSSYLIMEQFVGP

SEQ ID NO: 2230273 - protein, 23 aa, Cryptosporidium parvum
ESIAITCKWIKSTANASIRPLRH

SEQ ID NO: 2230274 - protein, 27 aa, Cryptosporidium parvum
ESICIALRLLFRCCGIKCGSSCTNKKN

SEQ ID NO: 2230275 - protein, 22 aa, Cryptosporidium parvum
ESICIPAKHILLSLQVHSSGTS

SEQ ID NO: 2230276 - protein, 28 aa, Cryptosporidium parvum
ESIDYYHWWFLCIDIVFSGISISQNSEL

SEQ ID NO: 2230277 - protein, 25 aa, Cryptosporidium parvum
ESIFQRKYWPVFIGTIPICDLEPSN

SEQ ID NO: 2230278 - protein, 23 aa, Cryptosporidium parvum
ESIHFSVIFSIELVSRKLFNVTL

SEQ ID NO: 2230279 - protein, 23 aa, Cryptosporidium parvum
ESIHSCIQWLSIIIGSWTIFCNI

SEQ ID NO: 2230280 - protein, 17 aa, Cryptosporidium parvum
ESILDMYSKKHFINNNI

SEQ ID NO: 2230281 - protein, 26 aa, Cryptosporidium parvum
ESILSVLRLIVYLIKSVFNIFSNISS

SEQ ID NO: 2230282 - protein, 25 aa, Cryptosporidium parvum
ESILTRFRAFVAISVILEYMEPLIL

SEQ ID NO: 2230283 - protein, 17 aa, Cryptosporidium parvum
ESINFLFSAMQSRFISI

SEQ ID NO: 2230284 - protein, 19 aa, Cryptosporidium parvum
ESISSLIYKFVQLEKEMCS

SEQ ID NO: 2230285 - protein, 17 aa, Cryptosporidium parvum
ESKCTEWERCMSQNPTI

SEQ ID NO: 2230286 - protein, 25 aa, Cryptosporidium parvum
ESKLSDLKKIFGIKNGPRLLSNNLH

SEQ ID NO: 2230287 - protein, 19 aa, Cryptosporidium parvum
ESKNGFVLDSVLFPCKYSF

SEQ ID NO: 2230288 - protein, 18 aa, Cryptosporidium parvum
ESKQRLGPLKKMETEKKN

SEQ ID NO: 2230289 - protein, 27 aa, Cryptosporidium parvum
ESKRINFTILICFLILSFLEALKSIQF

SEQ ID NO: 2230290 - protein, 20 aa, Cryptosporidium parvum
ESKYKLKPGYQIEGELGSSS

SEQ ID NO: 2230291 - protein, 18 aa, Cryptosporidium parvum
ESLILPEFSNFSELLTAY

SEQ ID NO: 2230292 - protein, 47 aa, Cryptosporidium parvum
ESLKMLLEHYPRWIPKFFFLLNFRIPRSRFDRVMISLFWAIITFGAF

SEQ ID NO: 2230293 - protein, 19 aa, Cryptosporidium parvum
ESLLCWRFSGNLRVDSFIP

SEQ ID NO: 2230294 - protein, 29 aa, Cryptosporidium parvum
ESLLIFPDEPEMALSAFVKPVSMNKDSEL

SEQ ID NO: 2230295 - protein, 24 aa, Cryptosporidium parvum
ESLLLRWVDDFLFLTSDLESAKKF

SEQ ID NO: 2230296 - protein, 45 aa, Cryptosporidium parvum
ESLRPQSAAGFSLFFQFWFWFPLVHCISLSYVPTCIVGLDDQFRV

SEQ ID NO: 2230297 - protein, 19 aa, Cryptosporidium parvum
ESLSYYQLYILLVFLIESS

SEQ ID NO: 2230298 - protein, 22 aa, Cryptosporidium parvum
ESMISSCINMFFLMDIDSGEGL

SEQ ID NO: 2230299 - protein, 26 aa, Cryptosporidium parvum
ESMLIERWKWVLAIFAIHNIIGGLLF

SEQ ID NO: 2230300 - protein, 20 aa, Cryptosporidium parvum
ESMRRLKRKKSAEVEQIQIR

SEQ ID NO: 2230301 - protein, 19 aa, Cryptosporidium parvum
ESNALHWSVYYRWDDVSIH

SEQ ID NO: 2230302 - protein, 24 aa, Cryptosporidium parvum
ESNEFKDALVQYSHLQLRGRKCPS

SEQ ID NO: 2230303 - protein, 19 aa, Cryptosporidium parvum
ESNGMKSLFSLDWKIPNVV

SEQ ID NO: 2230304 - protein, 28 aa, Cryptosporidium parvum
ESNIRFPTIGSFFSWLGSFNSLYVKYER

SEQ ID NO: 2230305 - protein, 22 aa, Cryptosporidium parvum
ESNLRLLASFCNIYYCINPTGD

SEQ ID NO: 2230306 - protein, 22 aa, Cryptosporidium parvum
ESNYSPEIIGVVLDPKEVTEVS

SEQ ID NO: 2230307 - protein, 26 aa, Cryptosporidium parvum
ESPQIGYCRGFYYRLLVHPRGGSCND

SEQ ID NO: 2230308 - protein, 25 aa, Cryptosporidium parvum
ESQMVYRILERFSVSYIRDNPTTLY

SEQ ID NO: 2230309 - protein, 24 aa, Cryptosporidium parvum
ESQNCWIHCMILMPPKFTFIHIQR

SEQ ID NO: 2230310 - protein, 22 aa, Cryptosporidium parvum
ESRPKSSLLRIILDYIGLLLYY

SEQ ID NO: 2230311 - protein, 23 aa, Cryptosporidium parvum
ESRVDVFVTLSFGKDLSKLFLVF

SEQ ID NO: 2230312 - protein, 22 aa, Cryptosporidium parvum
ESSELKKFVSIVFPHPKKFKPI

SEQ ID NO: 2230313 - protein, 19 aa, Cryptosporidium parvum
ESSISTLISVFVLKLNAKR

SEQ ID NO: 2230314 - protein, 24 aa, Cryptosporidium parvum
ESSIYIKLKLPFFNLSVESIFCIH

SEQ ID NO: 2230315 - protein, 18 aa, Cryptosporidium parvum
ESSLSYLLVQLLPGSFVN

SEQ ID NO: 2230316 - protein, 24 aa, Cryptosporidium parvum
ESTGEYGIYCLIDDVALDVKSICD

SEQ ID NO: 2230317 - protein, 21 aa, Cryptosporidium parvum
ESTILRASHQVFLKDHIKNIS

SEQ ID NO: 2230318 - protein, 30 aa, Cryptosporidium parvum
ESTSGISRRNWLGQRFPEFKTIKSEKDITK

SEQ ID NO: 2230319 - protein, 17 aa, Cryptosporidium parvum
ESTSQIVEWCNKIQSEF

SEQ ID NO: 2230320 - protein, 19 aa, Cryptosporidium parvum
ESVGNLKISFGHIRMNIWQ

SEQ ID NO: 2230321 - protein, 20 aa, Cryptosporidium parvum
ESVNIVWRSFMLAFSEAEEL

SEQ ID NO: 2230322 - protein, 19 aa, Cryptosporidium parvum
ESVNRLAIFISDLQGNLYV

SEQ ID NO: 2230323 - protein, 26 aa, Cryptosporidium parvum
ESVVPARLKYIWNCIKEFEPIDLSQI

SEQ ID NO: 2230324 - protein, 21 aa, Cryptosporidium parvum
ESYFRYCTMIILQILNINFYE

SEQ ID NO: 2230325 - protein, 24 aa, Cryptosporidium parvum
ESYLEAFQSFLIIKESILSRNGFC

SEQ ID NO: 2230326 - protein, 26 aa, Cryptosporidium parvum
ESYLYRFCFNATLAVLIESIISLIIY

SEQ ID NO: 2230327 - protein, 18 aa, Cryptosporidium parvum
ESYPEVVKNISFESINDL

SEQ ID NO: 2230328 - protein, 18 aa, Cryptosporidium parvum
ETDVKWELLGFQRCDQPY

SEQ ID NO: 2230329 - protein, 23 aa, Cryptosporidium parvum
ETDWKVKRALGITQHLETLDDIF

SEQ ID NO: 2230330 - protein, 21 aa, Cryptosporidium parvum
ETFGLAGLMSVQGFQTLLSTS

SEQ ID NO: 2230331 - protein, 21 aa, Cryptosporidium parvum
ETFQFKKALSLILYGLVSVAL

SEQ ID NO: 2230332 - protein, 18 aa, Cryptosporidium parvum
ETFTLAAIMPESFCSDVS

SEQ ID NO: 2230333 - protein, 25 aa, Cryptosporidium parvum
ETGDRYICKLFREYLFQQTDSQGRP

SEQ ID NO: 2230334 - protein, 17 aa, Cryptosporidium parvum
ETGFCRNRCRIISSKSC

SEQ ID NO: 2230335 - protein, 25 aa, Cryptosporidium parvum
ETGFSLELRGCRELLMQLFHDTMDL

SEQ ID NO: 2230336 - protein, 31 aa, Cryptosporidium parvum
ETGIFKKEETALISFEFLGLAAMNLSLLDKI

SEQ ID NO: 2230337 - protein, 20 aa, Cryptosporidium parvum
ETHFRIIMYFVRKTINSKEI

SEQ ID NO: 2230338 - protein, 26 aa, Cryptosporidium parvum
ETIFLTMGIVMFIFSSYVIRLLYQIN

SEQ ID NO: 2230339 - protein, 20 aa, Cryptosporidium parvum
ETIINLSILLLILCILISTI

SEQ ID NO: 2230340 - protein, 23 aa, Cryptosporidium parvum
ETIIRLLFFFNYFVRMSTEMNNQ

SEQ ID NO: 2230341 - protein, 19 aa, Cryptosporidium parvum
ETIQGWEIIRDFKNDVLYR

SEQ ID NO: 2230342 - protein, 20 aa, Cryptosporidium parvum
ETISFPRLVIIRPKGLNNLK

SEQ ID NO: 2230343 - protein, 21 aa, Cryptosporidium parvum
ETISRICLGIYNFRRNTKDLK

SEQ ID NO: 2230344 - protein, 23 aa, Cryptosporidium parvum
ETKQELKGIVSHNLEYLLKMMEL

SEQ ID NO: 2230345 - protein, 27 aa, Cryptosporidium parvum
ETLEYIQVFKLFCLVFSRLDMNQITLI

SEQ ID NO: 2230346 - protein, 20 aa, Cryptosporidium parvum
ETLKFLLALFTISSYISGFV

SEQ ID NO: 2230347 - protein, 26 aa, Cryptosporidium parvum
ETLKRMLKEDVQLELDEGFAAKDFEN

SEQ ID NO: 2230348 - protein, 32 aa, Cryptosporidium parvum
ETLLLFEEAFLWIADISFLYKILGEISLLSRG

SEQ ID NO: 2230349 - protein, 22 aa, Cryptosporidium parvum
ETLRKTASDWNVFFSDKNTLII

SEQ ID NO: 2230350 - protein, 22 aa, Cryptosporidium parvum
ETLYKVSRSRIFRINNEANNNS

SEQ ID NO: 2230351 - protein, 23 aa, Cryptosporidium parvum
ETLYVSRYLYLVVSLLDLPYFVD

SEQ ID NO: 2230352 - protein, 19 aa, Cryptosporidium parvum
ETMDIVAGLRLPHYSKKDR

SEQ ID NO: 2230353 - protein, 17 aa, Cryptosporidium parvum
ETMGVCNIGVYDESIFE

SEQ ID NO: 2230354 - protein, 20 aa, Cryptosporidium parvum
ETMKSLKSLINIITFLIEEN

SEQ ID NO: 2230355 - protein, 21 aa, Cryptosporidium parvum
ETNRPFLAICDILQIENYISN

SEQ ID NO: 2230356 - protein, 24 aa, Cryptosporidium parvum
ETPSFKFSCWRISSSSILAIQEAI

SEQ ID NO: 2230357 - protein, 22 aa, Cryptosporidium parvum
ETPTKFSITFGLAYFGITIFDD

SEQ ID NO: 2230358 - protein, 24 aa, Cryptosporidium parvum
ETQMFCFLPLFILSHNIIKQYYQS

SEQ ID NO: 2230359 - protein, 26 aa, Cryptosporidium parvum
ETRIIVLRIFERLALVLFNTGLLPYF

SEQ ID NO: 2230360 - protein, 17 aa, Cryptosporidium parvum
ETRSVAVNQTTTTIENN

SEQ ID NO: 2230361 - protein, 17 aa, Cryptosporidium parvum
ETSHPIAFEKATRNSIT

SEQ ID NO: 2230362 - protein, 29 aa, Cryptosporidium parvum
ETTEIAVMFLRYFSPLIIYVLDKALAYYS

SEQ ID NO: 2230363 - protein, 34 aa, Cryptosporidium parvum
ETYGLPIDTLTGYPLDPVSLIPFNPETGELFDPI

SEQ ID NO: 2230364 - protein, 19 aa, Cryptosporidium parvum
EVALIKSYFLHNSRVSINF

SEQ ID NO: 2230365 - protein, 22 aa, Cryptosporidium parvum
EVANFMIFICDKLFILNIQEFC

SEQ ID NO: 2230366 - protein, 21 aa, Cryptosporidium parvum
EVDFPIHILLFLIAIDQIISS

SEQ ID NO: 2230367 - protein, 26 aa, Cryptosporidium parvum
EVGRLNSQLSLHCRIRRVNYIPQNYE

SEQ ID NO: 2230368 - protein, 26 aa, Cryptosporidium parvum
EVGSCKKCSLLNFTPFILSNLFIFGL

SEQ ID NO: 2230369 - protein, 23 aa, Cryptosporidium parvum
EVIASHWRRLIGPSLAQQLLETY

SEQ ID NO: 2230370 - protein, 29 aa, Cryptosporidium parvum
EVIFKNVHWARTYIVGVNWIRNQLPFPNV

SEQ ID NO: 2230371 - protein, 22 aa, Cryptosporidium parvum
EVIKAHEDFMLFATQNPAGSIY

SEQ ID NO: 2230372 - protein, 20 aa, Cryptosporidium parvum
EVILSIPYIFERTGEEYPPI

SEQ ID NO: 2230373 - protein, 19 aa, Cryptosporidium parvum
EVIPICKTINFLGKTAIDV

SEQ ID NO: 2230374 - protein, 23 aa, Cryptosporidium parvum
EVISFKELGDFEILIFSELNQLI

SEQ ID NO: 2230375 - protein, 29 aa, Cryptosporidium parvum
EVLDLTTLPIRLWKSYRFEYSSIDEEKSI

SEQ ID NO: 2230376 - protein, 19 aa, Cryptosporidium parvum
EVLEIPALENYVERLKSWG

SEQ ID NO: 2230377 - protein, 24 aa, Cryptosporidium parvum
EVLETCTAEHKFDFDNKGFEGAIG

SEQ ID NO: 2230378 - protein, 20 aa, Cryptosporidium parvum
EVLYECIHFGKVTIPISSVF

SEQ ID NO: 2230379 - protein, 17 aa, Cryptosporidium parvum
EVMKLQIACFSFADLLS

SEQ ID NO: 2230380 - protein, 20 aa, Cryptosporidium parvum
EVMLYWKFNISKILNSSIGA

SEQ ID NO: 2230381 - protein, 19 aa, Cryptosporidium parvum
EVMQNKSCFGRLSKYLRLK

SEQ ID NO: 2230382 - protein, 18 aa, Cryptosporidium parvum
EVNCCNSPDLIKEEIYCY

SEQ ID NO: 2230383 - protein, 19 aa, Cryptosporidium parvum
EVNCKTLLVLKNGKCTIFS

SEQ ID NO: 2230384 - protein, 25 aa, Cryptosporidium parvum
EVNCVCHLILLGFLFSIIFESIADE

SEQ ID NO: 2230385 - protein, 19 aa, Cryptosporidium parvum
EVQEKRKYLSIFRGGSISG

SEQ ID NO: 2230386 - protein, 25 aa, Cryptosporidium parvum
EVQVPATGGGRCEFELNQKVGCNGF

SEQ ID NO: 2230387 - protein, 27 aa, Cryptosporidium parvum
EVRIPRVVIITFVFIIWIRRTNQQVIN

SEQ ID NO: 2230388 - protein, 25 aa, Cryptosporidium parvum
EVRKNSCLLPCLIYNKEGIQLISDI

SEQ ID NO: 2230389 - protein, 17 aa, Cryptosporidium parvum
EVSNRLIKLFSKLGGET

SEQ ID NO: 2230390 - protein, 17 aa, Cryptosporidium parvum
EVTCRKSTIAWMDNPKL

SEQ ID NO: 2230391 - protein, 34 aa, Cryptosporidium parvum
EVTGLPIDLETGLPRDPVSGLPQLPNGTLVDPSN

SEQ ID NO: 2230392 - protein, 20 aa, Cryptosporidium parvum
EVVRKLSGSGFHWNLETELI

SEQ ID NO: 2230393 - protein, 19 aa, Cryptosporidium parvum
EVVSRFVYGIGIPKQKIIN

SEQ ID NO: 2230394 - protein, 18 aa, Cryptosporidium parvum
EWDRICFDLLDSLKANKK

SEQ ID NO: 2230395 - protein, 17 aa, Cryptosporidium parvum
EWEGINFCINKNGKISK

SEQ ID NO: 2230396 - protein, 19 aa, Cryptosporidium parvum
EWVRFCVGIYDSRKKILRA

SEQ ID NO: 2230397 - protein, 19 aa, Cryptosporidium parvum
EYFKAIKVIEELVNCRFDQ

SEQ ID NO: 2230398 - protein, 20 aa, Cryptosporidium parvum
EYFLENWENIYLIEGVSQRI

SEQ ID NO: 2230399 - protein, 23 aa, Cryptosporidium parvum
EYGFYGYRRKLIYLITLFSLGNY

SEQ ID NO: 2230400 - protein, 20 aa, Cryptosporidium parvum
EYIDLVAFGTIRGRTASFIA

SEQ ID NO: 2230401 - protein, 20 aa, Cryptosporidium parvum
EYIFNFKLIYMMEDVYSAID

SEQ ID NO: 2230402 - protein, 18 aa, Cryptosporidium parvum
EYIIPRKTRNIFVRYYNH

SEQ ID NO: 2230403 - protein, 21 aa, Cryptosporidium parvum
EYIVHITHLFLLTKRNSGVER

SEQ ID NO: 2230404 - protein, 23 aa, Cryptosporidium parvum
EYKRCKINLCNKKDRFTLFMQRI

SEQ ID NO: 2230405 - protein, 18 aa, Cryptosporidium parvum
EYKRICLYTESNISIPLE

SEQ ID NO: 2230406 - protein, 20 aa, Cryptosporidium parvum
EYLDGIYLGYFYTWMILFAA

SEQ ID NO: 2230407 - protein, 25 aa, Cryptosporidium parvum
EYLLYQFCLFNLCFKYTNNLNNNHR

SEQ ID NO: 2230408 - protein, 19 aa, Cryptosporidium parvum
EYLPHVFQLVHRVSYGLLD

SEQ ID NO: 2230409 - protein, 21 aa, Cryptosporidium parvum
EYLRTRIFIIDNFQRNFSEDI

SEQ ID NO: 2230410 - protein, 18 aa, Cryptosporidium parvum
EYLTRISPLSILIMELSS

SEQ ID NO: 2230411 - protein, 25 aa, Cryptosporidium parvum
EYLYDIRNGLLFYKGVELLTRNIGG

SEQ ID NO: 2230412 - protein, 18 aa, Cryptosporidium parvum
EYMIKGALLVAKKPLYFD

SEQ ID NO: 2230413 - protein, 21 aa, Cryptosporidium parvum
EYNAKFSYNIIYNIILIVINI

SEQ ID NO: 2230414 - protein, 22 aa, Cryptosporidium parvum
EYNEIHDWLTLIVKPINSLLLF

SEQ ID NO: 2230415 - protein, 25 aa, Cryptosporidium parvum
EYNFQEFFELILWDKYFIPIYYSEI

SEQ ID NO: 2230416 - protein, 20 aa, Cryptosporidium parvum
EYNIKGSVAINGFTDIDLGY

SEQ ID NO: 2230417 - protein, 19 aa, Cryptosporidium parvum
EYNSFLLDYALFLADNRVG

SEQ ID NO: 2230418 - protein, 24 aa, Cryptosporidium parvum
EYPETAEAISFLIGALAKDTRLEL

SEQ ID NO: 2230419 - protein, 23 aa, Cryptosporidium parvum
EYPGNSLYLWSFVNESNAISWII

SEQ ID NO: 2230420 - protein, 25 aa, Cryptosporidium parvum
EYQIWRLATCFFFFGTFSLHFFWNA

SEQ ID NO: 2230421 - protein, 23 aa, Cryptosporidium parvum
EYSFKLDTFQAVSIGCLEIGESV

SEQ ID NO: 2230422 - protein, 23 aa, Cryptosporidium parvum
EYSKQRWTGIHNVGFYTNPKANF

SEQ ID NO: 2230423 - protein, 18 aa, Cryptosporidium parvum
FAASLGLRLVSRSNENMD

SEQ ID NO: 2230424 - protein, 20 aa, Cryptosporidium parvum
FAASLRFFASIFGYGHSYQG

SEQ ID NO: 2230425 - protein, 19 aa, Cryptosporidium parvum
FACKMCYRDYIDSLTRYDI

SEQ ID NO: 2230426 - protein, 19 aa, Cryptosporidium parvum
FAFAATIVVCAVTIYSLDK

SEQ ID NO: 2230427 - protein, 23 aa, Cryptosporidium parvum
FAGGTLLSLSLCHLIPEAEEIVR

SEQ ID NO: 2230428 - protein, 27 aa, Cryptosporidium parvum
FAIFLVVFLNFLGLQTFFNTRNVESNL

SEQ ID NO: 2230429 - protein, 34 aa, Cryptosporidium parvum
FAIIAAPILRYFREKEVRGFLLGRQEMEGECLQF

SEQ ID NO: 2230430 - protein, 22 aa, Cryptosporidium parvum
FAIVASCLKYNPGYDLPKFSSC

SEQ ID NO: 2230431 - protein, 17 aa, Cryptosporidium parvum
FAIYSMISLPLCFIGGL

SEQ ID NO: 2230432 - protein, 24 aa, Cryptosporidium parvum
FAKTIEIFKKIIIFLKDLIINIFN

SEQ ID NO: 2230433 - protein, 17 aa, Cryptosporidium parvum
FALGYKKIALVKMDNNA

SEQ ID NO: 2230434 - protein, 24 aa, Cryptosporidium parvum
FALISYKLAVVFLKSVSSFLSKKS

SEQ ID NO: 2230435 - protein, 27 aa, Cryptosporidium parvum
FALMFSRLRFANWVLGIVVYAGTDTKI

SEQ ID NO: 2230436 - protein, 25 aa, Cryptosporidium parvum
FARVRSTTIPVRWYNFYGNSALNIE

SEQ ID NO: 2230437 - protein, 18 aa, Cryptosporidium parvum
FASLDFSQGSLIAVYDYI

SEQ ID NO: 2230438 - protein, 18 aa, Cryptosporidium parvum
FATALSWFCAYLALFLKL

SEQ ID NO: 2230439 - protein, 19 aa, Cryptosporidium parvum
FAVNLLFYLEIKDITIQTN

SEQ ID NO: 2230440 - protein, 24 aa, Cryptosporidium parvum
FAYGYLKFIILYFLSLVLWGLYRH

SEQ ID NO: 2230441 - protein, 26 aa, Cryptosporidium parvum
FCGYKVFTFSSERLFIIPLCNRKTFL

SEQ ID NO: 2230442 - protein, 17 aa, Cryptosporidium parvum
FCIPYIFCHSDVEKNIF

SEQ ID NO: 2230443 - protein, 20 aa, Cryptosporidium parvum
FCKVVLELINLFSASHPSML

SEQ ID NO: 2230444 - protein, 17 aa, Cryptosporidium parvum
FCKYKLNKEIFLKFLAD

SEQ ID NO: 2230445 - protein, 33 aa, Cryptosporidium parvum
FCLHDRFHVMLSMSWGSLILFIFLVYILLAIIL

SEQ ID NO: 2230446 - protein, 17 aa, Cryptosporidium parvum
FCLISMVLSVVYRNKSS

SEQ ID NO: 2230447 - protein, 17 aa, Cryptosporidium parvum
FCLLAIIISRLRVLALP

SEQ ID NO: 2230448 - protein, 18 aa, Cryptosporidium parvum
FCLRYRKFVEYIRKKSNS

SEQ ID NO: 2230449 - protein, 17 aa, Cryptosporidium parvum
FCMVSAIFATLFGALAL

SEQ ID NO: 2230450 - protein, 17 aa, Cryptosporidium parvum
FCNYGKITLSAYWLPQM

SEQ ID NO: 2230451 - protein, 18 aa, Cryptosporidium parvum
FCRFFQHYLQIMINPYLQ

SEQ ID NO: 2230452 - protein, 20 aa, Cryptosporidium parvum
FCRNRCRIISSKSCKTCKEA

SEQ ID NO: 2230453 - protein, 21 aa, Cryptosporidium parvum
FCSTGLRYSLKQNLDNPLNLS

SEQ ID NO: 2230454 - protein, 19 aa, Cryptosporidium parvum
FCVVLSCYISAIGPILSSI

SEQ ID NO: 2230455 - protein, 20 aa, Cryptosporidium parvum
FCYPFSWIDIEGIKEIPNFG

SEQ ID NO: 2230456 - protein, 19 aa, Cryptosporidium parvum
FDCHSRIIVSRLCVRIEGS

SEQ ID NO: 2230457 - protein, 17 aa, Cryptosporidium parvum
FDCNEMEQLNSFIIDSI

SEQ ID NO: 2230458 - protein, 23 aa, Cryptosporidium parvum
FDDAKSYYSAMIYLLISILPNRP

SEQ ID NO: 2230459 - protein, 23 aa, Cryptosporidium parvum
FDDLCLSGFLAVREHADLLLSLT

SEQ ID NO: 2230460 - protein, 19 aa, Cryptosporidium parvum
FDEKPFFWCEYLRYLNLSR

SEQ ID NO: 2230461 - protein, 17 aa, Cryptosporidium parvum
FDFDKLKSEICINSINT

SEQ ID NO: 2230462 - protein, 17 aa, Cryptosporidium parvum
FDFFSSWNLFNIRNSIS

SEQ ID NO: 2230463 - protein, 17 aa, Cryptosporidium parvum
FDFRIKNGLLYDCKINS

SEQ ID NO: 2230464 - protein, 25 aa, Cryptosporidium parvum
FDGEGFLKAVSKLVNIRKRVNTGND

SEQ ID NO: 2230465 - protein, 19 aa, Cryptosporidium parvum
FDGLRIPPPKSILIHPHQF

SEQ ID NO: 2230466 - protein, 17 aa, Cryptosporidium parvum
FDGLVAFFKTFSDIHVN

SEQ ID NO: 2230467 - protein, 32 aa, Cryptosporidium parvum
FDHFEWETGRHMIPLALCFIGMVSLSNICLKH

SEQ ID NO: 2230468 - protein, 20 aa, Cryptosporidium parvum
FDIDGFKNHVIFAGTNIILT

SEQ ID NO: 2230469 - protein, 17 aa, Cryptosporidium parvum
FDIDRFLLKNALDNSNI

SEQ ID NO: 2230470 - protein, 25 aa, Cryptosporidium parvum
FDILPINIQWSFIILQVPKLIDPIN

SEQ ID NO: 2230471 - protein, 19 aa, Cryptosporidium parvum
FDINRLWIRNLGRDCRLAL

SEQ ID NO: 2230472 - protein, 18 aa, Cryptosporidium parvum
FDIVFWLDIILDISNLFK

SEQ ID NO: 2230473 - protein, 18 aa, Cryptosporidium parvum
FDIYKGFNSNNEFEKTKK

SEQ ID NO: 2230474 - protein, 17 aa, Cryptosporidium parvum
FDLKASNIIPLIHVINY

SEQ ID NO: 2230475 - protein, 20 aa, Cryptosporidium parvum
FDLRSRISIIPQDPIIFSGT

SEQ ID NO: 2230476 - protein, 21 aa, Cryptosporidium parvum
FDLSTGFAFAAFGMIWIVLLP

SEQ ID NO: 2230477 - protein, 18 aa, Cryptosporidium parvum
FDMILRIQLQQMAERPEI

SEQ ID NO: 2230478 - protein, 18 aa, Cryptosporidium parvum
FDMPIPFTATSVLINNVL

SEQ ID NO: 2230479 - protein, 19 aa, Cryptosporidium parvum
FDNIQEIDDLLGLLKLLTT

SEQ ID NO: 2230480 - protein, 19 aa, Cryptosporidium parvum
FDNKWRTNINFLLQNEESQ

SEQ ID NO: 2230481 - protein, 18 aa, Cryptosporidium parvum
FDNSLNHKIKFGINNIFN

SEQ ID NO: 2230482 - protein, 24 aa, Cryptosporidium parvum
FDNVKPCIRISCLKQKKKGSNNKI

SEQ ID NO: 2230483 - protein, 20 aa, Cryptosporidium parvum
FDPNRLIGLVPMLLSVVKYK

SEQ ID NO: 2230484 - protein, 19 aa, Cryptosporidium parvum
FDPVWKGAVNEMSFLNSFK

SEQ ID NO: 2230485 - protein, 19 aa, Cryptosporidium parvum
FDQVILISISIHFILETLE

SEQ ID NO: 2230486 - protein, 21 aa, Cryptosporidium parvum
FDREYNLKMLYNWDLWGPCII

SEQ ID NO: 2230487 - protein, 21 aa, Cryptosporidium parvum
FDRKSLAIWFFEWYDSKGRRL

SEQ ID NO: 2230488 - protein, 22 aa, Cryptosporidium parvum
FDSKRFNLRTAILTAESIGLRL

SEQ ID NO: 2230489 - protein, 21 aa, Cryptosporidium parvum
FDSLLFKRMDVNLVNKQNDIN

SEQ ID NO: 2230490 - protein, 19 aa, Cryptosporidium parvum
FDSYFKISLEVAIILLTIA

SEQ ID NO: 2230491 - protein, 31 aa, Cryptosporidium parvum
FDTGGNLSFCFPEIDLSIAILTNDYVKGSYI

SEQ ID NO: 2230492 - protein, 19 aa, Cryptosporidium parvum
FDTHFIYILTMFIDQIKEI

SEQ ID NO: 2230493 - protein, 19 aa, Cryptosporidium parvum
FDVIFPADIARILVGVTSF

SEQ ID NO: 2230494 - protein, 17 aa, Cryptosporidium parvum
FDVKYLVNWIIPPFIRK

SEQ ID NO: 2230495 - protein, 21 aa, Cryptosporidium parvum
FDVVSCYQLIPVIGIEDNELV

SEQ ID NO: 2230496 - protein, 24 aa, Cryptosporidium parvum
FDWDNIRIIKLFIIKIFQENLKIK

SEQ ID NO: 2230497 - protein, 17 aa, Cryptosporidium parvum
FDYLINIVFLASYSIVI

SEQ ID NO: 2230498 - protein, 27 aa, Cryptosporidium parvum
FDYLKIFKIPLILFILSFISVLFVDLF

SEQ ID NO: 2230499 - protein, 18 aa, Cryptosporidium parvum
FDYNRRLMSIIVHCKYND

SEQ ID NO: 2230500 - protein, 19 aa, Cryptosporidium parvum
FEAALSMFSEFFKSPLFDE

SEQ ID NO: 2230501 - protein, 17 aa, Cryptosporidium parvum
FEAHLIIQYFIEYLQST

SEQ ID NO: 2230502 - protein, 17 aa, Cryptosporidium parvum
FEDFEFMALFEDNLATE

SEQ ID NO: 2230503 - protein, 18 aa, Cryptosporidium parvum
FEDGDYEKTSGFETSSDE

SEQ ID NO: 2230504 - protein, 27 aa, Cryptosporidium parvum
FEDIITFLSLYSFGGFVGKYSKNCQYY

SEQ ID NO: 2230505 - protein, 18 aa, Cryptosporidium parvum
FEDLCFLIDSLLNMNRGF

SEQ ID NO: 2230506 - protein, 20 aa, Cryptosporidium parvum
FEDRIIKKWKAQNIDGVMKS

SEQ ID NO: 2230507 - protein, 19 aa, Cryptosporidium parvum
FEEEIYWSRLPQICSNYNN

SEQ ID NO: 2230508 - protein, 22 aa, Cryptosporidium parvum
FEEIINFLLCRVIGECKSNTVV

SEQ ID NO: 2230509 - protein, 19 aa, Cryptosporidium parvum
FEEKLNLAFGYPAVVAINN

SEQ ID NO: 2230510 - protein, 26 aa, Cryptosporidium parvum
FEEWLAYEYRLFFVLDKLQKQLDNIF

SEQ ID NO: 2230511 - protein, 17 aa, Cryptosporidium parvum
FEFFSRINNEIILTFES

SEQ ID NO: 2230512 - protein, 18 aa, Cryptosporidium parvum
FEFVKRNECCSLYERKFS

SEQ ID NO: 2230513 - protein, 18 aa, Cryptosporidium parvum
FEIDFIKKYLSKFSNKNC

SEQ ID NO: 2230514 - protein, 25 aa, Cryptosporidium parvum
FEIFFRSKFFNKRYFGLIENKKNHK

SEQ ID NO: 2230515 - protein, 24 aa, Cryptosporidium parvum
FEIHYLKRRINMLSTTKRYLRDFG

SEQ ID NO: 2230516 - protein, 25 aa, Cryptosporidium parvum
FEILGKLPGTLIFKSLDKFPQAVQL

SEQ ID NO: 2230517 - protein, 31 aa, Cryptosporidium parvum; identical to SEQ ID NO: 2122970

SEQ ID NO: 2230518 - protein, 25 aa, Cryptosporidium parvum
FEKFPIPSWLYKLFSRLVEVDFTEY

SEQ ID NO: 2230519 - protein, 19 aa, Cryptosporidium parvum
FEKIRVLRSLFTCVLIISF

SEQ ID NO: 2230520 - protein, 25 aa, Cryptosporidium parvum
FEKMFTCSLFGFGMGSCTLSPNIAS

SEQ ID NO: 2230521 - protein, 21 aa, Cryptosporidium parvum
FEKSEGLSILLLTLKNIEVAI

SEQ ID NO: 2230522 - protein, 22 aa, Cryptosporidium parvum
FEKWPFFDKWVISFQRQEYGIS

SEQ ID NO: 2230523 - protein, 18 aa, Cryptosporidium parvum
FELFPLPLKRIFSKFNSS

SEQ ID NO: 2230524 - protein, 21 aa, Cryptosporidium parvum
FELIKNIKLKNWEKIIFVIDN

SEQ ID NO: 2230525 - protein, 19 aa, Cryptosporidium parvum
FELIREFLRSAKIDSRGNA

SEQ ID NO: 2230526 - protein, 24 aa, Cryptosporidium parvum
FELLMVPLILRFDNNLTYEQPFCL

SEQ ID NO: 2230527 - protein, 26 aa, Cryptosporidium parvum
FELSLAYQGTVAWQHPWSFFHSNECF

SEQ ID NO: 2230528 - protein, 18 aa, Cryptosporidium parvum
FELTEEIGIEFELCNDYI

SEQ ID NO: 2230529 - protein, 17 aa, Cryptosporidium parvum
FEMYYDFEVSKKLRQNE

SEQ ID NO: 2230530 - protein, 17 aa, Cryptosporidium parvum
FENAFFYNTISNINNNN

SEQ ID NO: 2230531 - protein, 17 aa, Cryptosporidium parvum
FENKNFLKWILKELNCE

SEQ ID NO: 2230532 - protein, 21 aa, Cryptosporidium parvum
FENLIPITLGYLFDLLCQESY

SEQ ID NO: 2230533 - protein, 18 aa, Cryptosporidium parvum
FENLKYVCDGIVIEYGKD

SEQ ID NO: 2230534 - protein, 18 aa, Cryptosporidium parvum
FENLSGNPLRIFIEEISM

SEQ ID NO: 2230535 - protein, 25 aa, Cryptosporidium parvum
FENNCFPCPIFKTGWMETNSKGDLN

SEQ ID NO: 2230536 - protein, 18 aa, Cryptosporidium parvum
FEPALYYDLVRFMDCALK

SEQ ID NO: 2230537 - protein, 26 aa, Cryptosporidium parvum
FEQYGSPLLHFLKTVAYYPFKLVVAF

SEQ ID NO: 2230538 - protein, 21 aa, Cryptosporidium parvum
FERINSFIFGPSFIITLIQSW

SEQ ID NO: 2230539 - protein, 22 aa, Cryptosporidium parvum
FERRLPEFKFWISATKATIASI

SEQ ID NO: 2230540 - protein, 23 aa, Cryptosporidium parvum
FESKSGFLASFSFVTWMICIPSA

SEQ ID NO: 2230541 - protein, 17 aa, Cryptosporidium parvum
FESNIAFSEHDLREIDN

SEQ ID NO: 2230542 - protein, 19 aa, Cryptosporidium parvum
FESPISLPYLINLNLSSNN

SEQ ID NO: 2230543 - protein, 25 aa, Cryptosporidium parvum
FESYFKFKVEFLNYYLWFIKVKFII

SEQ ID NO: 2230544 - protein, 17 aa, Cryptosporidium parvum
FETRKVILENLILMTKT

SEQ ID NO: 2230545 - protein, 17 aa, Cryptosporidium parvum
FEVFCGAIYQLVIFSSY

SEQ ID NO: 2230546 - protein, 25 aa, Cryptosporidium parvum
FEVFDLPVFWPILLIYFIFLFILTM

SEQ ID NO: 2230547 - protein, 17 aa, Cryptosporidium parvum
FEVIDYFIFNGFSGNIK

SEQ ID NO: 2230548 - protein, 18 aa, Cryptosporidium parvum
FEVILIIFILRYIGDRLL

SEQ ID NO: 2230549 - protein, 17 aa, Cryptosporidium parvum
FEVTFIVNVEWFATIPK

SEQ ID NO: 2230550 - protein, 18 aa, Cryptosporidium parvum
FEYILSYTGSLIWNIWNQ

SEQ ID NO: 2230551 - protein, 27 aa, Cryptosporidium parvum
FFAILSIVGYCIFPFTVISLISLIIPY

SEQ ID NO: 2230552 - protein, 26 aa, Cryptosporidium parvum
FFCIDRRTFRCWTNIISKLVSYDSTS

SEQ ID NO: 2230553 - protein, 23 aa, Cryptosporidium parvum
FFDIACMLITISLFGRILDVHSN

SEQ ID NO: 2230554 - protein, 33 aa, Cryptosporidium parvum
FFDKYGIPEYVFWIIVYTVPVLFVLLLCLTSYC

SEQ ID NO: 2230555 - protein, 18 aa, Cryptosporidium parvum
FFFFLKFLTISFFLYYYL

SEQ ID NO: 2230556 - protein, 19 aa, Cryptosporidium parvum
FFFKNYKFFFLRKFFFFFQ

SEQ ID NO: 2230557 - protein, 26 aa, Cryptosporidium parvum
FFFVSVLKLNLLLLWAPKENSKKYLS

SEQ ID NO: 2230558 - protein, 23 aa, Cryptosporidium parvum
FFGGKSRMQSPCPSSNSTNTGLK

SEQ ID NO: 2230559 - protein, 23 aa, Cryptosporidium parvum
FFGKRKARIWEIVNPQMTNTCFQ

SEQ ID NO: 2230560 - protein, 26 aa, Cryptosporidium parvum
FFHSNECFMLYKMLIGFYTATNNLEN

SEQ ID NO: 2230561 - protein, 18 aa, Cryptosporidium parvum
FFIDRYPISLVYSLSDEF

SEQ ID NO: 2230562 - protein, 17 aa, Cryptosporidium parvum
FFINPTLPSFFRDENPK

SEQ ID NO: 2230563 - protein, 19 aa, Cryptosporidium parvum
FFISNGWLAMYSMHFICMF

SEQ ID NO: 2230564 - protein, 19 aa, Cryptosporidium parvum
FFKFIQRLKFDSVSKISRV

SEQ ID NO: 2230565 - protein, 28 aa, Cryptosporidium parvum
FFKRGFLNTILFKWLSPIINSAEKGIIV

SEQ ID NO: 2230566 - protein, 20 aa, Cryptosporidium parvum
FFKTLFCVPNLNNRAQDNVS

SEQ ID NO: 2230567 - protein, 25 aa, Cryptosporidium parvum
FFLILKLGHLLLFLLILKLLVYIYT

SEQ ID NO: 2230568 - protein, 25 aa, Cryptosporidium parvum
FFLQIFRYLLFYSLTLLSFSSSVIW

SEQ ID NO: 2230569 - protein, 25 aa, Cryptosporidium parvum
FFLSIPLFISYVVLYNLIFKIIIHH

SEQ ID NO: 2230570 - protein, 19 aa, Cryptosporidium parvum
FFLTCFFISLLIGFSSIYM

SEQ ID NO: 2230571 - protein, 19 aa, Cryptosporidium parvum
FFNNGGAFSSFSYMPCPNY

SEQ ID NO: 2230572 - protein, 23 aa, Cryptosporidium parvum
FFNPESFIKMMIDSAYEIGYLLI

SEQ ID NO: 2230573 - protein, 18 aa, Cryptosporidium parvum
FFNVFLYYFNFVIRRLNK

SEQ ID NO: 2230574 - protein, 17 aa, Cryptosporidium parvum
FFPECAVPVDMFPFTKH

SEQ ID NO: 2230575 - protein, 21 aa, Cryptosporidium parvum
FFPKVMLKLSKDLTHLIIEEI

SEQ ID NO: 2230576 - protein, 17 aa, Cryptosporidium parvum
FFPLEFINLVKNVNLLP

SEQ ID NO: 2230577 - protein, 17 aa, Cryptosporidium parvum
FFPNIEKLFSLNIGNLI

SEQ ID NO: 2230578 - protein, 24 aa, Cryptosporidium parvum
FFQELKIEYIVAILSSLLYDEKCP

SEQ ID NO: 2230579 - protein, 23 aa, Cryptosporidium parvum
FFRGFPLCHIYPAPSIGMNRSGS

SEQ ID NO: 2230580 - protein, 17 aa, Cryptosporidium parvum
FFRKKVVPILKSVNFMA

SEQ ID NO: 2230581 - protein, 17 aa, Cryptosporidium parvum
FFSAIKFASNNEFSKEI

SEQ ID NO: 2230582 - protein, 25 aa, Cryptosporidium parvum
FFSAMASQGYIIWSSPICILIYPIL

SEQ ID NO: 2230583 - protein, 25 aa, Cryptosporidium parvum
FFSIKEIMVGLHILVGTGIAVASQV

SEQ ID NO: 2230584 - protein, 36 aa, Cryptosporidium parvum
FFSKEFYSRIRIILRLSCAISPNWLQVLYHPYTCII

SEQ ID NO: 2230585 - protein, 20 aa, Cryptosporidium parvum
FFSSFLWLQYFRQWNLTGSS

SEQ ID NO: 2230586 - protein, 19 aa, Cryptosporidium parvum
FFVGNIFLWPSFFHGSMTV

SEQ ID NO: 2230587 - protein, 18 aa, Cryptosporidium parvum
FFVIIVHFISFSIGEQQP

SEQ ID NO: 2230588 - protein, 25 aa, Cryptosporidium parvum
FFVNLPIFFAMAITLPCFLIIWCSC

SEQ ID NO: 2230589 - protein, 19 aa, Cryptosporidium parvum
FFYKVKRDCINKFKNLPNK

SEQ ID NO: 2230590 - protein, 20 aa, Cryptosporidium parvum
FGAIRLDGETGLPLEAEDLM

SEQ ID NO: 2230591 - protein, 30 aa, Cryptosporidium parvum
FGATFLGVDFFKLLFENILKLFEDYTKKCA

SEQ ID NO: 2230592 - protein, 21 aa, Cryptosporidium parvum
FGATVKIRMTGLVGDDILMTA

SEQ ID NO: 2230593 - protein, 21 aa, Cryptosporidium parvum
FGDHILELVVGVSLGNFDLAK

SEQ ID NO: 2230594 - protein, 19 aa, Cryptosporidium parvum
FGDPLPAVFNDSYKSFKYS

SEQ ID NO: 2230595 - protein, 22 aa, Cryptosporidium parvum
FGEIRKIFLMEFIRRIKQDDAR

SEQ ID NO: 2230596 - protein, 17 aa, Cryptosporidium parvum
FGGFPNKNKPVLVNESD

SEQ ID NO: 2230597 - protein, 17 aa, Cryptosporidium parvum
FGGSLLHLNPIKWKALN

SEQ ID NO: 2230598 - protein, 18 aa, Cryptosporidium parvum
FGGTNAHVIIECNSDNIT

SEQ ID NO: 2230599 - protein, 17 aa, Cryptosporidium parvum
FGIIAWIPFKIHIYYLI

SEQ ID NO: 2230600 - protein, 28 aa, Cryptosporidium parvum
FGILFGMVNIPIVFAIDGAGIPVMDDTF

SEQ ID NO: 2230601 - protein, 17 aa, Cryptosporidium parvum
FGILGGIIYERPWYFIF

SEQ ID NO: 2230602 - protein, 25 aa, Cryptosporidium parvum
FGIPFYFRDIEIIIFDVLGGKRKKR

SEQ ID NO: 2230603 - protein, 17 aa, Cryptosporidium parvum
FGIPLALYIKHTKTNSL

SEQ ID NO: 2230604 - protein, 18 aa, Cryptosporidium parvum
FGKFGEDFDNIFKSEKII

SEQ ID NO: 2230605 - protein, 17 aa, Cryptosporidium parvum
FGKGRRAYLTGIVATIY

SEQ ID NO: 2230606 - protein, 18 aa, Cryptosporidium parvum
FGKILFKTSYSLVYLNSK

SEQ ID NO: 2230607 - protein, 17 aa, Cryptosporidium parvum
FGKKGIMVAVRRSEEQI

SEQ ID NO: 2230608 - protein, 19 aa, Cryptosporidium parvum
FGKLSSLIVTWKYQKEYIQ

SEQ ID NO: 2230609 - protein, 24 aa, Cryptosporidium parvum
FGKSGLKISIFAFITFKAKFINLF

SEQ ID NO: 2230610 - protein, 17 aa, Cryptosporidium parvum
FGLIKAFCFSYINYYLK

SEQ ID NO: 2230611 - protein, 17 aa, Cryptosporidium parvum
FGLKINNLPTIWRDSIS

SEQ ID NO: 2230612 - protein, 20 aa, Cryptosporidium parvum
FGLLPIKTIQMLKGICYLIN

SEQ ID NO: 2230613 - protein, 19 aa, Cryptosporidium parvum
FGLNFCLILLELHILNENK

SEQ ID NO: 2230614 - protein, 20 aa, Cryptosporidium parvum
FGLRKWSPLLEKFNGEVSSF

SEQ ID NO: 2230615 - protein, 25 aa, Cryptosporidium parvum
FGNHCIFESEFFRDWKKPLLQQCSE

SEQ ID NO: 2230616 - protein, 21 aa, Cryptosporidium parvum
FGNVCELDLIFNFHKAYFILD

SEQ ID NO: 2230617 - protein, 17 aa, Cryptosporidium parvum
FGPTFKSKARVCIFFPI

SEQ ID NO: 2230618 - protein, 25 aa, Cryptosporidium parvum
FGSIASFRFALAFLTPITTYIIGYF

SEQ ID NO: 2230619 - protein, 23 aa, Cryptosporidium parvum
FGTIVICILIFWTYNVLSKVLCP

SEQ ID NO: 2230620 - protein, 28 aa, Cryptosporidium parvum
FGTNHPKFKFLSSLWLSQTLQKLASVLF

SEQ ID NO: 2230621 - protein, 18 aa, Cryptosporidium parvum
FGWLSKGMMNIKCQEDLK

SEQ ID NO: 2230622 - protein, 20 aa, Cryptosporidium parvum
FGYESGIWSKFVGLMKNSLN

SEQ ID NO: 2230623 - protein, 25 aa, Cryptosporidium parvum
FGYITCLTILLGVLCIDARLEEKKM

SEQ ID NO: 2230624 - protein, 28 aa, Cryptosporidium parvum
FGYNRAEILGALLSILLIWFMTIMLVYE

SEQ ID NO: 2230625 - protein, 17 aa, Cryptosporidium parvum
FGYYSKRKFTFISNEWW

SEQ ID NO: 2230626 - protein, 24 aa, Cryptosporidium parvum
FHAEKSSKCGLNSRFSSDEYDNSL

SEQ ID NO: 2230627 - protein, 21 aa, Cryptosporidium parvum
FHDLCELTRQLIETGSFRRKV

SEQ ID NO: 2230628 - protein, 18 aa, Cryptosporidium parvum
FHDVLPKFLRIFAKHLSH

SEQ ID NO: 2230629 - protein, 25 aa, Cryptosporidium parvum
FHFDSLKYKLECISFSKTCKNYTKI

SEQ ID NO: 2230630 - protein, 20 aa, Cryptosporidium parvum
FHFLSKLIQIEWLYIIIMCK

SEQ ID NO: 2230631 - protein, 24 aa, Cryptosporidium parvum
FHFPLETLAGFIIAFFGLFGIFWM

SEQ ID NO: 2230632 - protein, 18 aa, Cryptosporidium parvum
FHGANGYNKIVSMIERGA

SEQ ID NO: 2230633 - protein, 23 aa, Cryptosporidium parvum
FHHAVAFFILAPIKFLIKNFSKN

SEQ ID NO: 2230634 - protein, 24 aa, Cryptosporidium parvum
FHIILPGAFKLFPDYEVKSSRIWR

SEQ ID NO: 2230635 - protein, 24 aa, Cryptosporidium parvum
FHIPQIKLVLSWISRIYGSNLTLL

SEQ ID NO: 2230636 - protein, 25 aa, Cryptosporidium parvum
FHLECIDGWFKQNCVCPICRSDIVQ

SEQ ID NO: 2230637 - protein, 24 aa, Cryptosporidium parvum
FHLLNERIDFSLKFFSTHAPYITY

SEQ ID NO: 2230638 - protein, 18 aa, Cryptosporidium parvum
FHLNPSLCKLFFEMKQYI

SEQ ID NO: 2230639 - protein, 17 aa, Cryptosporidium parvum
FHPGCNCIVGLNGSGKS

SEQ ID NO: 2230640 - protein, 19 aa, Cryptosporidium parvum
FHPLRMPKSKLEWKINPNF

SEQ ID NO: 2230641 - protein, 26 aa, Cryptosporidium parvum
FHPWNPEFLLSAGIDSIIKLSIITKD

SEQ ID NO: 2230642 - protein, 20 aa, Cryptosporidium parvum
FHPYCLISNSDGIGFIVIGL

SEQ ID NO: 2230643 - protein, 30 aa, Cryptosporidium parvum
FHRSTALRICYNIGLTFGRSPVFLSHIFDL

SEQ ID NO: 2230644 - protein, 22 aa, Cryptosporidium parvum
FHYLALISMKCQRCIDFEQKNF

SEQ ID NO: 2230645 - protein, 19 aa, Cryptosporidium parvum
FIACPIRVIQFILLCINGR

SEQ ID NO: 2230646 - protein, 26 aa, Cryptosporidium parvum
FICRKESISFIDWINRLVSSKFSLDL

SEQ ID NO: 2230647 - protein, 24 aa, Cryptosporidium parvum
FIDIFCTLLPLLLFSFSRPKEYKI

SEQ ID NO: 2230648 - protein, 18 aa, Cryptosporidium parvum
FIDLKVIYYQYLIILWHY

SEQ ID NO: 2230649 - protein, 19 aa, Cryptosporidium parvum
FIDLPFMYNNAWWDSYSSI

SEQ ID NO: 2230650 - protein, 20 aa, Cryptosporidium parvum
FIDNVCTLVLCGKRSQLEDN

SEQ ID NO: 2230651 - protein, 17 aa, Cryptosporidium parvum
FIDQCWTQISAFPDSVW

SEQ ID NO: 2230652 - protein, 23 aa, Cryptosporidium parvum
FIDSIKMSGIRPVILTGDSAFTA

SEQ ID NO: 2230653 - protein, 31 aa, Cryptosporidium parvum
FIFGTICKFIGLPLLLGYIIGGYVVGPSGFG

SEQ ID NO: 2230654 - protein, 18 aa, Cryptosporidium parvum
FIFGYVIYRGYEVCPTYS

SEQ ID NO: 2230655 - protein, 31 aa, Cryptosporidium parvum
FIFHMYRNLGGFILRFFNKFKENIKIECEIY

SEQ ID NO: 2230656 - protein, 17 aa, Cryptosporidium parvum
FIFIPILICTEVFTGYI

SEQ ID NO: 2230657 - protein, 25 aa, Cryptosporidium parvum
FIFKILSLILGCFETYIANLMYIES

SEQ ID NO: 2230658 - protein, 17 aa, Cryptosporidium parvum
FIGIFIWILIKSKFHRD

SEQ ID NO: 2230659 - protein, 20 aa, Cryptosporidium parvum
FIGSDIWGLVRSARYELDKY

SEQ ID NO: 2230660 - protein, 23 aa, Cryptosporidium parvum
FIGYNYKLSFVFLENEQSDSIIE

SEQ ID NO: 2230661 - protein, 27 aa, Cryptosporidium parvum
FIHPNIKFRLLSAIALSKLVPYCHHFC

SEQ ID NO: 2230662 - protein, 17 aa, Cryptosporidium parvum
FIHQLIETVEFLIGSIS

SEQ ID NO: 2230663 - protein, 29 aa, Cryptosporidium parvum
FIIAWNASDAFVFSGITCWSHVNNQIIKT

SEQ ID NO: 2230664 - protein, 27 aa, Cryptosporidium parvum
FIIEYSIKIAHLDFNIFWEYWEHKNTN

SEQ ID NO: 2230665 - protein, 26 aa, Cryptosporidium parvum
FIIISNCIINFILINCINSFEIKKSL

SEQ ID NO: 2230666 - protein, 21 aa, Cryptosporidium parvum
FIITLIQSWLISNCSKKQINT

SEQ ID NO: 2230667 - protein, 22 aa, Cryptosporidium parvum
FIIWILQWYFFVLLVILMAGRI

SEQ ID NO: 2230668 - protein, 27 aa, Cryptosporidium parvum
FIKPFLKRVNSIYSMSALILLAPTPLG

SEQ ID NO: 2230669 - protein, 19 aa, Cryptosporidium parvum
FILDISVKVGKLITQDPYF

SEQ ID NO: 2230670 - protein, 17 aa, Cryptosporidium parvum
FILFCIWMEPSRLGCIL

SEQ ID NO: 2230671 - protein, 21 aa, Cryptosporidium parvum
FILQLIAACVCNRQLVYSDGL

SEQ ID NO: 2230672 - protein, 24 aa, Cryptosporidium parvum
FILSIYIILAFNCGGLFLNNCIHK

SEQ ID NO: 2230673 - protein, 18 aa, Cryptosporidium parvum
FILTIIFSLISEKERNNH

SEQ ID NO: 2230674 - protein, 18 aa, Cryptosporidium parvum
FILVEIGGLFSVYIEILD

SEQ ID NO: 2230675 - protein, 17 aa, Cryptosporidium parvum
FILYIAIIGCYSFSNLR

SEQ ID NO: 2230676 - protein, 18 aa, Cryptosporidium parvum
FIMAKYFSSILIFSTIPL

SEQ ID NO: 2230677 - protein, 26 aa, Cryptosporidium parvum
FIMFLFRPFKSLKLFSNVLAKHNNES

SEQ ID NO: 2230678 - protein, 25 aa, Cryptosporidium parvum
FIMNNRFTLILAEIEVQLFGSINLA

SEQ ID NO: 2230679 - protein, 27 aa, Cryptosporidium parvum
FINKFKPFCFIEIPLINAGNLFTSQLN

SEQ ID NO: 2230680 - protein, 23 aa, Cryptosporidium parvum
FINLMIKYEFLWQSWKNNNCVDI

SEQ ID NO: 2230681 - protein, 30 aa, Cryptosporidium parvum; identical to SEQ ID NO: 2123066

SEQ ID NO: 2230682 - protein, 27 aa, Cryptosporidium parvum
FINSQLSSIILLWIINFLKLQKQLPCL

SEQ ID NO: 2230683 - protein, 21 aa, Cryptosporidium parvum
FINTCRTLRLLFLNSQTAISD

SEQ ID NO: 2230684 - protein, 25 aa, Cryptosporidium parvum
FINYAEKVLDCFKSIPLSDIIENVG

SEQ ID NO: 2230685 - protein, 18 aa, Cryptosporidium parvum
FINYNSICKDFGDPLNSH

SEQ ID NO: 2230686 - protein, 22 aa, Cryptosporidium parvum
FIPLKAGPLLPNKAKENIVFKL

SEQ ID NO: 2230687 - protein, 17 aa, Cryptosporidium parvum
FIQAFFVLFSLLLPNRI

SEQ ID NO: 2230688 - protein, 25 aa, Cryptosporidium parvum
FIQPSDEMLFFFKDYIENDVPLNDK

SEQ ID NO: 2230689 - protein, 17 aa, Cryptosporidium parvum
FIRCALGGPLLGFLFGW

SEQ ID NO: 2230690 - protein, 17 aa, Cryptosporidium parvum
FIRDEIDYQISTRMYTN

SEQ ID NO: 2230691 - protein, 34 aa, Cryptosporidium parvum
FIRPNDCRIWYIIQWLICMLITLSFYTLSYIDKK

SEQ ID NO: 2230692 - protein, 17 aa, Cryptosporidium parvum
FIRYFINGCRSLRSCYI

SEQ ID NO: 2230693 - protein, 25 aa, Cryptosporidium parvum
FISIIKFFVNFLIFFAFGHMIKLSA

SEQ ID NO: 2230694 - protein, 18 aa, Cryptosporidium parvum
FISISFPGSCRFSKNNIW

SEQ ID NO: 2230695 - protein, 24 aa, Cryptosporidium parvum
FISIWKEATCDFLLQNVTISKMVS

SEQ ID NO: 2230696 - protein, 18 aa, Cryptosporidium parvum
FISLRYDFMDEVAAYDSY

SEQ ID NO: 2230697 - protein, 22 aa, Cryptosporidium parvum
FISSICIPYFQALLKFDPEIVQ

SEQ ID NO: 2230698 - protein, 19 aa, Cryptosporidium parvum
FITPAIYILLSFRAAPQLY

SEQ ID NO: 2230699 - protein, 18 aa, Cryptosporidium parvum
FIVNVEWFATIPKIIKNN

SEQ ID NO: 2230700 - protein, 19 aa, Cryptosporidium parvum
FIVSISWVAAMFVSPIVGF

SEQ ID NO: 2230701 - protein, 19 aa, Cryptosporidium parvum
FIVWPLCWSIITFYTISWS

SEQ ID NO: 2230702 - protein, 24 aa, Cryptosporidium parvum
FIWNMPSSYWIRYLPILLGINTFC

SEQ ID NO: 2230703 - protein, 22 aa, Cryptosporidium parvum
FIWYICTWFVGAHLLRIETKEG

SEQ ID NO: 2230704 - protein, 17 aa, Cryptosporidium parvum
FIYHFLVAMVMYPIICL

SEQ ID NO: 2230705 - protein, 25 aa, Cryptosporidium parvum
FIYLDYRFIIVFLPISYFFNKFRIR

SEQ ID NO: 2230706 - protein, 18 aa, Cryptosporidium parvum
FIYYCNFFTFTIITLIMM

SEQ ID NO: 2230707 - protein, 25 aa, Cryptosporidium parvum
FKCHGFEWLWFLALLIVISVVMFPF

SEQ ID NO: 2230708 - protein, 21 aa, Cryptosporidium parvum
FKCNNSLLLPEIMILYEQTNA

SEQ ID NO: 2230709 - protein, 17 aa, Cryptosporidium parvum
FKDDFQQCLTYTKKNDI

SEQ ID NO: 2230710 - protein, 37 aa, Cryptosporidium parvum
FKDLKVLLLVHGRLAYRRICKLALYMFYKNLTVGIPV

SEQ ID NO: 2230711 - protein, 17 aa, Cryptosporidium parvum
FKEEYPLINVIKPITKQ

SEQ ID NO: 2230712 - protein, 17 aa, Cryptosporidium parvum
FKEILQLLINILLVITN

SEQ ID NO: 2230713 - protein, 21 aa, Cryptosporidium parvum
FKEPFPISWVNLYWTQPPYGG

SEQ ID NO: 2230714 - protein, 29 aa, Cryptosporidium parvum
FKERRIRGKFFLILMVQLFCFFFLCMWFS

SEQ ID NO: 2230715 - protein, 21 aa, Cryptosporidium parvum
FKERVLWTLISLFVFLVCCQI

SEQ ID NO: 2230716 - protein, 22 aa, Cryptosporidium parvum
FKESISLLKSGKLVWMVPLINI

SEQ ID NO: 2230717 - protein, 25 aa, Cryptosporidium parvum
FKESSILDLSIQWGPWAEQGMAADL

SEQ ID NO: 2230718 - protein, 19 aa, Cryptosporidium parvum
FKFCILRFKSYLSKIRGLL

SEQ ID NO: 2230719 - protein, 22 aa, Cryptosporidium parvum
FKFFNEPLWNAISWYSTDKILR

SEQ ID NO: 2230720 - protein, 18 aa, Cryptosporidium parvum
FKFFSRIPRSYFFSPSKR

SEQ ID NO: 2230721 - protein, 19 aa, Cryptosporidium parvum
FKFQAAISEIFRKCIQPQK

SEQ ID NO: 2230722 - protein, 20 aa, Cryptosporidium parvum
FKGLYSRPLSGEWDDHVYNF

SEQ ID NO: 2230723 - protein, 19 aa, Cryptosporidium parvum
FKGQDIAPIVGMYNTLEPY

SEQ ID NO: 2230724 - protein, 25 aa, Cryptosporidium parvum
FKGRKRKNGMIGIDIDKEYIDDKDN

SEQ ID NO: 2230725 - protein, 23 aa, Cryptosporidium parvum
FKGVYPLLPYFGLKADFSKKYPN

SEQ ID NO: 2230726 - protein, 17 aa, Cryptosporidium parvum
FKHCPSLIITHDIGIFD

SEQ ID NO: 2230727 - protein, 20 aa, Cryptosporidium parvum
FKHIYLCLIFIATFIGYIFC

SEQ ID NO: 2230728 - protein, 23 aa, Cryptosporidium parvum
FKIANVLCKVSFSPIPLKFDPNE

SEQ ID NO: 2230729 - protein, 17 aa, Cryptosporidium parvum
FKIENEIPGNSPINKTK

SEQ ID NO: 2230730 - protein, 21 aa, Cryptosporidium parvum
FKIFCIGRFISGASLGLSAAS

SEQ ID NO: 2230731 - protein, 20 aa, Cryptosporidium parvum
FKIFILQLLWIGFFIILILG

SEQ ID NO: 2230732 - protein, 27 aa, Cryptosporidium parvum
FKIGDHVWGFARGCFKSQLVTTSTLIS

SEQ ID NO: 2230733 - protein, 17 aa, Cryptosporidium parvum
FKILNDFNIPILQENEK

SEQ ID NO: 2230734 - protein, 21 aa, Cryptosporidium parvum
FKILNELGLMYQVKFVSIYLM

SEQ ID NO: 2230735 - protein, 19 aa, Cryptosporidium parvum
FKINLYVRYLLLIKLIEHF

SEQ ID NO: 2230736 - protein, 17 aa, Cryptosporidium parvum
FKIQVLTLVCPISLLIS

SEQ ID NO: 2230737 - protein, 19 aa, Cryptosporidium parvum
FKISMSLPAYALKYGNVEN

SEQ ID NO: 2230738 - protein, 18 aa, Cryptosporidium parvum
FKIVRLYLDNTIDSKSLL

SEQ ID NO: 2230739 - protein, 20 aa, Cryptosporidium parvum
FKKGDTNGGYGLNFTPSNYQ

SEQ ID NO: 2230740 - protein, 21 aa, Cryptosporidium parvum
FKKILELSILFEYIHTENDKT

SEQ ID NO: 2230741 - protein, 17 aa, Cryptosporidium parvum
FKKIVKFFCKNNYQCLY

SEQ ID NO: 2230742 - protein, 20 aa, Cryptosporidium parvum
FKKKELNSAFLVASEHETVA

SEQ ID NO: 2230743 - protein, 19 aa, Cryptosporidium parvum
FKKKFRSMLASDLIENIPY

SEQ ID NO: 2230744 - protein, 17 aa, Cryptosporidium parvum
FKKLCKEYNGIFIKIDY

SEQ ID NO: 2230745 - protein, 21 aa, Cryptosporidium parvum
FKKSFTYLLLLALVGIIIIDF

SEQ ID NO: 2230746 - protein, 24 aa, Cryptosporidium parvum
FKKYDVWTSYILLYLFSRKDPVDL

SEQ ID NO: 2230747 - protein, 17 aa, Cryptosporidium parvum
FKLEGLKIHYIPTNLTS

SEQ ID NO: 2230748 - protein, 20 aa, Cryptosporidium parvum
FKLGSESLVTISPIIISEPK

SEQ ID NO: 2230749 - protein, 19 aa, Cryptosporidium parvum
FKLKISLNYINLRYEIFSL

SEQ ID NO: 2230750 - protein, 17 aa, Cryptosporidium parvum
FKLLIEYTKSSNLKTIV

SEQ ID NO: 2230751 - protein, 19 aa, Cryptosporidium parvum
FKLPAPRVQQIISEAVEVE

SEQ ID NO: 2230752 - protein, 17 aa, Cryptosporidium parvum
FKLPITRIHILINNEAA

SEQ ID NO: 2230753 - protein, 20 aa, Cryptosporidium parvum
FKLRIYELILGKLQESILRD

SEQ ID NO: 2230754 - protein, 18 aa, Cryptosporidium parvum
FKLYPVIYGFPFIFFINP

SEQ ID NO: 2230755 - protein, 19 aa, Cryptosporidium parvum
FKMESCTLEALRFMQKASH

SEQ ID NO: 2230756 - protein, 29 aa, Cryptosporidium parvum
FKMFKLGLNIQLFWFLRLNSLKFDFVSDN

SEQ ID NO: 2230757 - protein, 38 aa, Cryptosporidium parvum
FKNQHGRLGYFKSIFRITKELKLFYIALQETFYNNKST

SEQ ID NO: 2230758 - protein, 17 aa, Cryptosporidium parvum
FKNQSCWNSFKSIDNSI

SEQ ID NO: 2230759 - protein, 19 aa, Cryptosporidium parvum
FKNSFKYRSKTQKDLHVLD

SEQ ID NO: 2230760 - protein, 23 aa, Cryptosporidium parvum
FKPIFKGSLLIPNTNMETGIFTI

SEQ ID NO: 2230761 - protein, 17 aa, Cryptosporidium parvum
FKPKYDYIFNGNKDYSF

SEQ ID NO: 2230762 - protein, 21 aa, Cryptosporidium parvum
FKPNRVEYWFKLLSAKVIPKI

SEQ ID NO: 2230763 - protein, 18 aa, Cryptosporidium parvum
FKPTEFALVNSFCYSMVI

SEQ ID NO: 2230764 - protein, 27 aa, Cryptosporidium parvum
FKQGRQSWRLKEWHHLQSILYLIYGAG

SEQ ID NO: 2230765 - protein, 17 aa, Cryptosporidium parvum
FKQILFKSSVNCLEISL

SEQ ID NO: 2230766 - protein, 20 aa, Cryptosporidium parvum
FKQKYVLFSLVHKRYPHKEE

SEQ ID NO: 2230767 - protein, 19 aa, Cryptosporidium parvum
FKQVWDFAQTTMIQDCLLR

SEQ ID NO: 2230768 - protein, 21 aa, Cryptosporidium parvum
FKREKLNFIPEDEILNHFMNF

SEQ ID NO: 2230769 - protein, 23 aa, Cryptosporidium parvum
FKRKLLDWNESWRPWIMNHCIIN

SEQ ID NO: 2230770 - protein, 17 aa, Cryptosporidium parvum
FKRSILRKFNSHDQSFL

SEQ ID NO: 2230771 - protein, 25 aa, Cryptosporidium parvum
FKSEKIIRLEVLLNSFLLKRLLIFG

SEQ ID NO: 2230772 - protein, 18 aa, Cryptosporidium parvum
FKSMNYCLIQQGGGPCGV

SEQ ID NO: 2230773 - protein, 18 aa, Cryptosporidium parvum
FKSPLSIHLTGRHQGPKN

SEQ ID NO: 2230774 - protein, 22 aa, Cryptosporidium parvum
FKSQLRSSLELNKEELKEGIGE

SEQ ID NO: 2230775 - protein, 17 aa, Cryptosporidium parvum
FKSWMEKVGTFFDNSYE

SEQ ID NO: 2230776 - protein, 25 aa, Cryptosporidium parvum
FKTFYLRIINILLFKLIYDIIQMCR

SEQ ID NO: 2230777 - protein, 18 aa, Cryptosporidium parvum
FKTLEELSKCSIKHWLKK

SEQ ID NO: 2230778 - protein, 20 aa, Cryptosporidium parvum
FKTVKIGFPSIVIYEKESVD

SEQ ID NO: 2230779 - protein, 21 aa, Cryptosporidium parvum
FKVTGEFEGLMDIYLRNCHQR

SEQ ID NO: 2230780 - protein, 21 aa, Cryptosporidium parvum
FKVYIYSAYYDWRIDRIRINS

SEQ ID NO: 2230781 - protein, 34 aa, Cryptosporidium parvum
FKVYTCKNVDFIRNLKLCRLNLELEELVNFSEDN

SEQ ID NO: 2230782 - protein, 17 aa, Cryptosporidium parvum
FKWIMSGTPLPISIIKS

SEQ ID NO: 2230783 - protein, 20 aa, Cryptosporidium parvum
FLAFCSSFIFGYVIYRGYEV

SEQ ID NO: 2230784 - protein, 19 aa, Cryptosporidium parvum
FLAHSIMGHSHFKADVAEK

SEQ ID NO: 2230785 - protein, 21 aa, Cryptosporidium parvum
FLATFFLFGILNALQIHESVT

SEQ ID NO: 2230786 - protein, 21 aa, Cryptosporidium parvum
FLCGPDMLDSPVITKFIENIN

SEQ ID NO: 2230787 - protein, 21 aa, Cryptosporidium parvum
FLCIVLLKLAQNGMLATDVVN

SEQ ID NO: 2230788 - protein, 18 aa, Cryptosporidium parvum
FLDGISILGFNTFTDETF

SEQ ID NO: 2230789 - protein, 20 aa, Cryptosporidium parvum
FLDGKWLFNKDMRKNRNDYI

SEQ ID NO: 2230790 - protein, 17 aa, Cryptosporidium parvum
FLDIFSRGISIISECIV

SEQ ID NO: 2230791 - protein, 20 aa, Cryptosporidium parvum
FLDILISLIDNCRRLQSEYK

SEQ ID NO: 2230792 - protein, 18 aa, Cryptosporidium parvum
FLDIPLKEAMFIEGAKEK

SEQ ID NO: 2230793 - protein, 17 aa, Cryptosporidium parvum
FLDVISLPNEISLLSLY

SEQ ID NO: 2230794 - protein, 19 aa, Cryptosporidium parvum
FLEAVCKVFPQVNANILDR

SEQ ID NO: 2230795 - protein, 17 aa, Cryptosporidium parvum
FLECKKLKNKQGLCILD

SEQ ID NO: 2230796 - protein, 19 aa, Cryptosporidium parvum
FLEEVKLYKSRLINSNNSS

SEQ ID NO: 2230797 - protein, 21 aa, Cryptosporidium parvum
FLEFIHEFGRDLVVLTHRCVN

SEQ ID NO: 2230798 - protein, 22 aa, Cryptosporidium parvum
FLEILIRGGFIIFVFPWLLLMI

SEQ ID NO: 2230799 - protein, 25 aa, Cryptosporidium parvum
FLEKIKKKRNLGLTNEEMDKFSERE

SEQ ID NO: 2230800 - protein, 26 aa, Cryptosporidium parvum
FLEMEDISLILSLFVLAVDHLPAFLN

SEQ ID NO: 2230801 - protein, 27 aa, Cryptosporidium parvum
FLEQLRLPIKVKYGCIETINISIPYSN

SEQ ID NO: 2230802 - protein, 18 aa, Cryptosporidium parvum
FLETCGINSLNLQRTVLS

SEQ ID NO: 2230803 - protein, 25 aa, Cryptosporidium parvum
FLFCAYSLILICLRFYKCISYPLPN

SEQ ID NO: 2230804 - protein, 18 aa, Cryptosporidium parvum
FLFGLVYLLSLNFNYYNS

SEQ ID NO: 2230805 - protein, 28 aa, Cryptosporidium parvum
FLFHIFSFLIKFLFGYRYRDLKQQINYQ

SEQ ID NO: 2230806 - protein, 26 aa, Cryptosporidium parvum
FLFKRNGPAILLRWFQASYFLQLILI

SEQ ID NO: 2230807 - protein, 22 aa, Cryptosporidium parvum
FLFLKSIVDFCIIEEDLKNKGF

SEQ ID NO: 2230808 - protein, 17 aa, Cryptosporidium parvum
FLFPITSYIKFYPLENI

SEQ ID NO: 2230809 - protein, 23 aa, Cryptosporidium parvum
FLFSDICGFTQWAMTVEAESVVY

SEQ ID NO: 2230810 - protein, 18 aa, Cryptosporidium parvum
FLFVLLFILCHLFILHLL

SEQ ID NO: 2230811 - protein, 18 aa, Cryptosporidium parvum
FLGLAAMNLSLLDKIKFL

SEQ ID NO: 2230812 - protein, 18 aa, Cryptosporidium parvum
FLGTRLFSNLIFPILMNT

SEQ ID NO: 2230813 - protein, 17 aa, Cryptosporidium parvum
FLGVGVVGSVLYIPISL

SEQ ID NO: 2230814 - protein, 24 aa, Cryptosporidium parvum
FLGYFMVMIPWFFSILSPQPMLLV

SEQ ID NO: 2230815 - protein, 19 aa, Cryptosporidium parvum
FLHAGIPFGAIGAFMGLFI

SEQ ID NO: 2230816 - protein, 32 aa, Cryptosporidium parvum
FLHYLCNNGLFANRHLCAFILKQSLKITKFNE

SEQ ID NO: 2230817 - protein, 18 aa, Cryptosporidium parvum
FLIECVPSLLYINHIEIQ

SEQ ID NO: 2230818 - protein, 25 aa, Cryptosporidium parvum
FLIFVSRLSKIYIILTLTISSLSIS

SEQ ID NO: 2230819 - protein, 20 aa, Cryptosporidium parvum
FLIGCAEIYFNINSKRRVGI

SEQ ID NO: 2230820 - protein, 25 aa, Cryptosporidium parvum
FLIGFKMAFIITMIWIVTLIVNIIS

SEQ ID NO: 2230821 - protein, 24 aa, Cryptosporidium parvum
FLIHLENFLKFIISSVLSINKSYF

SEQ ID NO: 2230822 - protein, 19 aa, Cryptosporidium parvum
FLINAIECFIFPLRLIIAY

SEQ ID NO: 2230823 - protein, 25 aa, Cryptosporidium parvum
FLISEYDYIWFLIGVIITATLCSSV

SEQ ID NO: 2230824 - protein, 18 aa, Cryptosporidium parvum
FLISIGINPDGIRFRQHL

SEQ ID NO: 2230825 - protein, 24 aa, Cryptosporidium parvum
FLITFFWNCITLQYQNFISHGDKL

SEQ ID NO: 2230826 - protein, 23 aa, Cryptosporidium parvum
FLKKIKFKNCVNISNNSKNNLKQ

SEQ ID NO: 2230827 - protein, 17 aa, Cryptosporidium parvum
FLKMKSIFQEMVNNHQE

SEQ ID NO: 2230828 - protein, 20 aa, Cryptosporidium parvum
FLKSALKAMKPWKINSILIK

SEQ ID NO: 2230829 - protein, 18 aa, Cryptosporidium parvum
FLKSLLLASIPIPSQSTM

SEQ ID NO: 2230830 - protein, 17 aa, Cryptosporidium parvum
FLLFIYWNYLSYFINTC

SEQ ID NO: 2230831 - protein, 24 aa, Cryptosporidium parvum
FLLIIEFMTLIILFVLVPTGGTVW

SEQ ID NO: 2230832 - protein, 18 aa, Cryptosporidium parvum
FLLNRILWIPEYENFNTI

SEQ ID NO: 2230833 - protein, 19 aa, Cryptosporidium parvum
FLLSIAIPSKNEFNYSKET

SEQ ID NO: 2230834 - protein, 17 aa, Cryptosporidium parvum
FLLSWIIEHVEQKKLLI

SEQ ID NO: 2230835 - protein, 34 aa, Cryptosporidium parvum
FLLTELKGRIILLELFVELLYCIKLNSNETSNYE

SEQ ID NO: 2230836 - protein, 25 aa, Cryptosporidium parvum
FLLTFKILFCIGTKQIFPIGCPLNS

SEQ ID NO: 2230837 - protein, 17 aa, Cryptosporidium parvum
FLLVLVIYSKLWLNGSI

SEQ ID NO: 2230838 - protein, 24 aa, Cryptosporidium parvum
FLMFRTRRRLGLITSLLAYDDAVR

SEQ ID NO: 2230839 - protein, 18 aa, Cryptosporidium parvum
FLMIDLFFIRYFELKILN

SEQ ID NO: 2230840 - protein, 29 aa, Cryptosporidium parvum
FLNFPIERWCIGDTWPINNPKISVGQIYA

SEQ ID NO: 2230841 - protein, 19 aa, Cryptosporidium parvum
FLNGIVLNRSIPVGWDSFR

SEQ ID NO: 2230842 - protein, 20 aa, Cryptosporidium parvum
FLNKKRHSSLMITDSEDVYS

SEQ ID NO: 2230843 - protein, 26 aa, Cryptosporidium parvum
FLNLIFRKYLSLSFGDIQTVALIGSC

SEQ ID NO: 2230844 - protein, 30 aa, Cryptosporidium parvum
FLNREEFLYWVINLHYDRFLFNGLNTKYQD

SEQ ID NO: 2230845 - protein, 19 aa, Cryptosporidium parvum
FLNTLRLYQTMKRYPILTH

SEQ ID NO: 2230846 - protein, 18 aa, Cryptosporidium parvum
FLPKLEKFFKTFISTLGC

SEQ ID NO: 2230847 - protein, 19 aa, Cryptosporidium parvum
FLPNTKWIIPTSKYRKITA

SEQ ID NO: 2230848 - protein, 18 aa, Cryptosporidium parvum
FLPSIIRHKIDLVLESDQ

SEQ ID NO: 2230849 - protein, 25 aa, Cryptosporidium parvum
FLQHCACQWAGLRMQLLTAPLTLIV

SEQ ID NO: 2230850 - protein, 17 aa, Cryptosporidium parvum
FLQILALITKSIINFGV

SEQ ID NO: 2230851 - protein, 27 aa, Cryptosporidium parvum
FLRFFTWSFCWSALILYTNLFSFFKDI

SEQ ID NO: 2230852 - protein, 18 aa, Cryptosporidium parvum
FLRIKEAEREGGYLNSKD

SEQ ID NO: 2230853 - protein, 21 aa, Cryptosporidium parvum
FLRKPLFFAKDCRLDELRYIL

SEQ ID NO: 2230854 - protein, 20 aa, Cryptosporidium parvum
FLSDRRKFLLTKLLKLSNPL

SEQ ID NO: 2230855 - protein, 17 aa, Cryptosporidium parvum
FLSFEFLALLDLSLLSI

SEQ ID NO: 2230856 - protein, 24 aa, Cryptosporidium parvum
FLSFLFSIFLYKSCIEHALQQKGG

SEQ ID NO: 2230857 - protein, 23 aa, Cryptosporidium parvum
FLSLLGTCFSFYYIVMTRLLNSP

SEQ ID NO: 2230858 - protein, 18 aa, Cryptosporidium parvum
FLSNEVNCCNSPDLIKEE

SEQ ID NO: 2230859 - protein, 22 aa, Cryptosporidium parvum
FLSNSFPLPALAIAYACNDVYS

SEQ ID NO: 2230860 - protein, 17 aa, Cryptosporidium parvum
FLSNSFPMTLGLLNSEK

SEQ ID NO: 2230861 - protein, 20 aa, Cryptosporidium parvum
FLSPEILEFNEAMITLIVSI

SEQ ID NO: 2230862 - protein, 26 aa, Cryptosporidium parvum
FLSTLGLIGVVIGGVWYITKNNKKEI

SEQ ID NO: 2230863 - protein, 21 aa, Cryptosporidium parvum
FLSVKWRIVVSKTIFHIYFKF

SEQ ID NO: 2230864 - protein, 25 aa, Cryptosporidium parvum
FLTIFCPVLLFIRGIISGVQCIYSI

SEQ ID NO: 2230865 - protein, 18 aa, Cryptosporidium parvum
FLTNLSIFQYKRFFDHYI

SEQ ID NO: 2230866 - protein, 17 aa, Cryptosporidium parvum
FLVDEFFRSELFERKPG

SEQ ID NO: 2230867 - protein, 25 aa, Cryptosporidium parvum
FLVFIPFLIVILIKRLNNHSVKIKK

SEQ ID NO: 2230868 - protein, 25 aa, Cryptosporidium parvum
FLVFPSIWLMILCKPKKYINSYRPT

SEQ ID NO: 2230869 - protein, 20 aa, Cryptosporidium parvum
FLVILPWFLDTTIKMQKETK

SEQ ID NO: 2230870 - protein, 17 aa, Cryptosporidium parvum
FLYETYLYHAIRKDHRH

SEQ ID NO: 2230871 - protein, 18 aa, Cryptosporidium parvum
FLYFDPKQPCMHDQDSSK

SEQ ID NO: 2230872 - protein, 24 aa, Cryptosporidium parvum
FMEFIPQFIFMVGFIGYLNFLIFF

SEQ ID NO: 2230873 - protein, 18 aa, Cryptosporidium parvum
FMFLPYKFLTKMKKSIDL

SEQ ID NO: 2230874 - protein, 17 aa, Cryptosporidium parvum
FMIIYLIIIAIEVSKRI

SEQ ID NO: 2230875 - protein, 23 aa, Cryptosporidium parvum
FMLVIKLDIPLIIENNLLIPVQL

SEQ ID NO: 2230876 - protein, 21 aa, Cryptosporidium parvum
FMNGTAFSILLSLEINTEMMN

SEQ ID NO: 2230877 - protein, 17 aa, Cryptosporidium parvum
FMNKNIRSFNSMENDII

SEQ ID NO: 2230878 - protein, 25 aa, Cryptosporidium parvum
FMQRIRFLQHTSLIWCNTRIQFFIL

SEQ ID NO: 2230879 - protein, 17 aa, Cryptosporidium parvum
FMRSLRMELSSKVKILL

SEQ ID NO: 2230880 - protein, 20 aa, Cryptosporidium parvum
FMTSDPWFALIMFNSIMNIP

SEQ ID NO: 2230881 - protein, 18 aa, Cryptosporidium parvum
FNALKYCNRIINLSYKCR

SEQ ID NO: 2230882 - protein, 18 aa, Cryptosporidium parvum
FNASEKYLQDSLLSNNNM

SEQ ID NO: 2230883 - protein, 17 aa, Cryptosporidium parvum
FNCETHLIISCPPPKFK

SEQ ID NO: 2230884 - protein, 31 aa, Cryptosporidium parvum; identical to SEQ ID NO: 2123185

SEQ ID NO: 2230885 - protein, 18 aa, Cryptosporidium parvum
FNDLNRMIYLWGLITTSA

SEQ ID NO: 2230886 - protein, 25 aa, Cryptosporidium parvum
FNDPELRIYWKLILNSIPETLHIDQ

SEQ ID NO: 2230887 - protein, 17 aa, Cryptosporidium parvum
FNELGGVNKLIQRPAPS

SEQ ID NO: 2230888 - protein, 25 aa, Cryptosporidium parvum
FNEMIKGKSFFLGRSLTIVDLVIYI

SEQ ID NO: 2230889 - protein, 21 aa, Cryptosporidium parvum
FNFEILCSIFEAIERIVLPPS

SEQ ID NO: 2230890 - protein, 25 aa, Cryptosporidium parvum
FNFKADFPTLTTFRIKSLMSGENPG

SEQ ID NO: 2230891 - protein, 24 aa, Cryptosporidium parvum
FNFLNCVDEFLLLNWNNSRYSLLK

SEQ ID NO: 2230892 - protein, 23 aa, Cryptosporidium parvum
FNFLRYPEKWIRFSESTIITVFF

SEQ ID NO: 2230893 - protein, 26 aa, Cryptosporidium parvum
FNFVWKIILFFIIWKSRNDFIKFQQY

SEQ ID NO: 2230894 - protein, 30 aa, Cryptosporidium parvum
FNGIKFPYTNLYFIPPIKMKVGYVRILTIT

SEQ ID NO: 2230895 - protein, 19 aa, Cryptosporidium parvum
FNGIVLMRILHHDRYYYSD

SEQ ID NO: 2230896 - protein, 27 aa, Cryptosporidium parvum
FNIDFPATLIFDFPTLRLLIEHIDLLK

SEQ ID NO: 2230897 - protein, 19 aa, Cryptosporidium parvum
FNIEYYPLWVYPALLMAIE

SEQ ID NO: 2230898 - protein, 17 aa, Cryptosporidium parvum
FNIPTLRDSQSYRRSVY

SEQ ID NO: 2230899 - protein, 24 aa, Cryptosporidium parvum
FNKDSWWDSEICRKLHLATDESLN

SEQ ID NO: 2230900 - protein, 22 aa, Cryptosporidium parvum
FNKLRTSLMTQFGLASKYSGNA

SEQ ID NO: 2230901 - protein, 25 aa, Cryptosporidium parvum
FNKRSFEFHLFIKPWSYLDDIIENN

SEQ ID NO: 2230902 - protein, 21 aa, Cryptosporidium parvum
FNKYFLLVVTIIVYFNNLMFN

SEQ ID NO: 2230903 - protein, 24 aa, Cryptosporidium parvum
FNKYRKLWFCVGEIGSHWMEILCF

SEQ ID NO: 2230904 - protein, 17 aa, Cryptosporidium parvum
FNLKSVPIMLGISLIPI

SEQ ID NO: 2230905 - protein, 18 aa, Cryptosporidium parvum
FNLLVLLIMIPFGYYLVE

SEQ ID NO: 2230906 - protein, 21 aa, Cryptosporidium parvum
FNLYNLFTILYKCGGENISDL

SEQ ID NO: 2230907 - protein, 17 aa, Cryptosporidium parvum
FNNIKLVKSYCLESIMF

SEQ ID NO: 2230908 - protein, 20 aa, Cryptosporidium parvum
FNNIKSLKFISITNYPLSVF

SEQ ID NO: 2230909 - protein, 18 aa, Cryptosporidium parvum
FNNLIKCAIKGDKSLANL

SEQ ID NO: 2230910 - protein, 20 aa, Cryptosporidium parvum
FNNLYFKNYVDFFMEFIPQF

SEQ ID NO: 2230911 - protein, 26 aa, Cryptosporidium parvum
FNNVKAIICGEAIQLRNPRVSHIVYP

SEQ ID NO: 2230912 - protein, 25 aa, Cryptosporidium parvum
FNPDFKMSFLMGICVVLLVNLFVIC

SEQ ID NO: 2230913 - protein, 17 aa, Cryptosporidium parvum
FNPKFESNIAFSEHDLR

SEQ ID NO: 2230914 - protein, 17 aa, Cryptosporidium parvum
FNPNCNCSLFFDRCTSI

SEQ ID NO: 2230915 - protein, 23 aa, Cryptosporidium parvum
FNPYLRLSAKYCLQLAIRSLPSE

SEQ ID NO: 2230916 - protein, 30 aa, Cryptosporidium parvum
FNSDFSLKRWKMFLDILPFSDILPLLHMIE

SEQ ID NO: 2230917 - protein, 23 aa, Cryptosporidium parvum
FNSILEFAPWLAPKVLACIQHLI

SEQ ID NO: 2230918 - protein, 32 aa, Cryptosporidium parvum
FNSLLIRYFPDWEVALALSICLAIGRIGSVLS

SEQ ID NO: 2230919 - protein, 18 aa, Cryptosporidium parvum
FNSLQIIGLILLLIKPIC

SEQ ID NO: 2230920 - protein, 19 aa, Cryptosporidium parvum
FNSPCRRLAAARPFGSIAS

SEQ ID NO: 2230921 - protein, 19 aa, Cryptosporidium parvum
FNSPLIVGVCISLLKSKNA

SEQ ID NO: 2230922 - protein, 17 aa, Cryptosporidium parvum
FNTRRASDNTIRYNIPH

SEQ ID NO: 2230923 - protein, 17 aa, Cryptosporidium parvum
FNVHPIIQFLSYYSVSV

SEQ ID NO: 2230924 - protein, 19 aa, Cryptosporidium parvum
FNWFIPSIINKIRILNSDN

SEQ ID NO: 2230925 - protein, 27 aa, Cryptosporidium parvum
FNYTIFSISISFAFLAKYYFQNTRKQL

SEQ ID NO: 2230926 - protein, 25 aa, Cryptosporidium parvum
FPCDDLTGMYAFCVGSINNKNGMPS

SEQ ID NO: 2230927 - protein, 21 aa, Cryptosporidium parvum
FPDEAALCYGAQYLGVSLICL

SEQ ID NO: 2230928 - protein, 19 aa, Cryptosporidium parvum
FPFLNAPSRMEFIEYLNSG

SEQ ID NO: 2230929 - protein, 19 aa, Cryptosporidium parvum
FPGAMMFGAIRLDGETGLP

SEQ ID NO: 2230930 - protein, 17 aa, Cryptosporidium parvum
FPGLIVAIARFGVGVIG

SEQ ID NO: 2230931 - protein, 30 aa, Cryptosporidium parvum
FPHALARTFRSIFCLCREGSANHGINNIQK

SEQ ID NO: 2230932 - protein, 17 aa, Cryptosporidium parvum
FPICIPSGCFNWIGLTF

SEQ ID NO: 2230933 - protein, 20 aa, Cryptosporidium parvum
FPILLHRKLINISLRKLNNI

SEQ ID NO: 2230934 - protein, 30 aa, Cryptosporidium parvum
FPIQIRLKMASGLKLPALVGNTLDDIEFDI

SEQ ID NO: 2230935 - protein, 19 aa, Cryptosporidium parvum
FPISSRVMFALHFSLSILA

SEQ ID NO: 2230936 - protein, 20 aa, Cryptosporidium parvum
FPKKDLKHYFQLRDEVAPQN

SEQ ID NO: 2230937 - protein, 26 aa, Cryptosporidium parvum
FPLDESIPIVLALPVTACLDDIVRPW

SEQ ID NO: 2230938 - protein, 22 aa, Cryptosporidium parvum
FPLFRLVLMGIFVLWGSGISIC

SEQ ID NO: 2230939 - protein, 19 aa, Cryptosporidium parvum
FPLIHWSQRECQTLFRLKS

SEQ ID NO: 2230940 - protein, 19 aa, Cryptosporidium parvum
FPLKINKLFGSFKNQNLIE

SEQ ID NO: 2230941 - protein, 18 aa, Cryptosporidium parvum
FPLMGYLIGKFVTSGVLP

SEQ ID NO: 2230942 - protein, 17 aa, Cryptosporidium parvum
FPLPLKRIFSKFNSSIL

SEQ ID NO: 2230943 - protein, 20 aa, Cryptosporidium parvum
FPLTNGIKMNDYFLRRDFEK

SEQ ID NO: 2230944 - protein, 24 aa, Cryptosporidium parvum
FPMIRYSALWSKWLFPNVNISHSR

SEQ ID NO: 2230945 - protein, 24 aa, Cryptosporidium parvum
FPMYRIPSSSLFYVTGSWIIVFVL

SEQ ID NO: 2230946 - protein, 17 aa, Cryptosporidium parvum
FPNMLPSTFALKSTKER

SEQ ID NO: 2230947 - protein, 20 aa, Cryptosporidium parvum
FPNPNYCLGINLYLIPVQNI

SEQ ID NO: 2230948 - protein, 22 aa, Cryptosporidium parvum
FPQDEIVAIIGHEIGHWKNWDN

SEQ ID NO: 2230949 - protein, 19 aa, Cryptosporidium parvum
FPSIARFLLKKINKSLNKQ

SEQ ID NO: 2230950 - protein, 26 aa, Cryptosporidium parvum
FPTFSSRFGWRRVEEIIKSNTSDLSR

SEQ ID NO: 2230951 - protein, 18 aa, Cryptosporidium parvum
FPTKCVVRLWDTYIAENT

SEQ ID NO: 2230952 - protein, 17 aa, Cryptosporidium parvum
FPTSLVSIWGFTLQAYQ

SEQ ID NO: 2230953 - protein, 25 aa, Cryptosporidium parvum
FPTTKYEEWWIFAVTKGSNPQIIGY

SEQ ID NO: 2230954 - protein, 26 aa, Cryptosporidium parvum
FPVFVSCAQQLVGMIIMSIFGLIRMA

SEQ ID NO: 2230955 - protein, 20 aa, Cryptosporidium parvum
FPVNLLPRFNPYNSGMPNFM

SEQ ID NO: 2230956 - protein, 20 aa, Cryptosporidium parvum
FPVPLFIRDEIDYQISTRMY

SEQ ID NO: 2230957 - protein, 17 aa, Cryptosporidium parvum
FPVSKEFYAPRSGDNSC

SEQ ID NO: 2230958 - protein, 18 aa, Cryptosporidium parvum
FPVTKLCRIIKRSEPINF

SEQ ID NO: 2230959 - protein, 19 aa, Cryptosporidium parvum
FPYNVYRLISKSGRFRDII

SEQ ID NO: 2230960 - protein, 27 aa, Cryptosporidium parvum
FQAVSLLWKLTDLIGASLSKNSQEDIG

SEQ ID NO: 2230961 - protein, 18 aa, Cryptosporidium parvum
FQDLKLTLFEALDSLFES

SEQ ID NO: 2230962 - protein, 26 aa, Cryptosporidium parvum
FQDQGVVYMCGFKSYTVEKDLIELKN

SEQ ID NO: 2230963 - protein, 21 aa, Cryptosporidium parvum
FQDQLFKFLIQKNHRTTTLKV

SEQ ID NO: 2230964 - protein, 25 aa, Cryptosporidium parvum
FQEFLSKFFAHFSINAELTKVWEII

SEQ ID NO: 2230965 - protein, 25 aa, Cryptosporidium parvum
FQFNRNSICTPELYRRLVHAKEQKA

SEQ ID NO: 2230966 - protein, 17 aa, Cryptosporidium parvum
FQFVQIFVPILLPIILC

SEQ ID NO: 2230967 - protein, 18 aa, Cryptosporidium parvum
FQGMKFGKFGEDFDNIFK

SEQ ID NO: 2230968 - protein, 17 aa, Cryptosporidium parvum
FQIFPLFSLVFALLAGY

SEQ ID NO: 2230969 - protein, 21 aa, Cryptosporidium parvum
FQIKLPFIGRKSMENLEKIET

SEQ ID NO: 2230970 - protein, 24 aa, Cryptosporidium parvum
FQIYYSEVFDLFFTEWNERKSKIL

SEQ ID NO: 2230971 - protein, 18 aa, Cryptosporidium parvum
FQKILFYYFLMLIINGAI

SEQ ID NO: 2230972 - protein, 21 aa, Cryptosporidium parvum
FQLGNFFTFSGFLVGGNFLSS

SEQ ID NO: 2230973 - protein, 17 aa, Cryptosporidium parvum
FQLILISPYFTMKSLNS

SEQ ID NO: 2230974 - protein, 26 aa, Cryptosporidium parvum
FQLLPARLLITYILFWYSIPFLVFAN

SEQ ID NO: 2230975 - protein, 25 aa, Cryptosporidium parvum
FQNGIKILFCVIRYKPDIVDEVIIE

SEQ ID NO: 2230976 - protein, 24 aa, Cryptosporidium parvum
FQNNLKIGNFISYLRYLEGIANLY

SEQ ID NO: 2230977 - protein, 19 aa, Cryptosporidium parvum
FQNTFMLPDIIYLEVAMLL

SEQ ID NO: 2230978 - protein, 25 aa, Cryptosporidium parvum
FQQELPRLIKIIIEVILFGMKPNNQ

SEQ ID NO: 2230979 - protein, 21 aa, Cryptosporidium parvum
FQQGRCHVAILTNYVDEYTYS

SEQ ID NO: 2230980 - protein, 24 aa, Cryptosporidium parvum
FQRLKNCISNYIFIQKSILKHVEQ

SEQ ID NO: 2230981 - protein, 22 aa, Cryptosporidium parvum
FQTCVELAQKFCDILDNEININ

SEQ ID NO: 2230982 - protein, 25 aa, Cryptosporidium parvum
FQWFALEWFLCFFVTSLPLKSIMEI

SEQ ID NO: 2230983 - protein, 18 aa, Cryptosporidium parvum
FQYEISFIDIIPSSDTVL

SEQ ID NO: 2230984 - protein, 26 aa, Cryptosporidium parvum
FQYPHLFQFTRFYPLTVSFLHFTAFI

SEQ ID NO: 2230985 - protein, 18 aa, Cryptosporidium parvum
FRDDRIILMLAENIPCNT

SEQ ID NO: 2230986 - protein, 18 aa, Cryptosporidium parvum
FRDLKQKIFRFLDFGKQT

SEQ ID NO: 2230987 - protein, 32 aa, Cryptosporidium parvum
FRFFFPDSAPLSWLFFLACSSIAAYVNYLIDN

SEQ ID NO: 2230988 - protein, 18 aa, Cryptosporidium parvum
FRFLYSAIKSINKFEKSE

SEQ ID NO: 2230989 - protein, 18 aa, Cryptosporidium parvum
FRGSEKFANLESSEGKDE

SEQ ID NO: 2230990 - protein, 20 aa, Cryptosporidium parvum
FRIKNGLLYDCKINSLFTVS

SEQ ID NO: 2230991 - protein, 21 aa, Cryptosporidium parvum
FRILDKYIPLELHDSNYYENI

SEQ ID NO: 2230992 - protein, 26 aa, Cryptosporidium parvum
FRILSGILLLFYFVIGWLGTFYPPLY

SEQ ID NO: 2230993 - protein, 17 aa, Cryptosporidium parvum
FRIPFAGKLRICAFDKT

SEQ ID NO: 2230994 - protein, 18 aa, Cryptosporidium parvum
FRKMRKSLIWRLIPMGSM

SEQ ID NO: 2230995 - protein, 22 aa, Cryptosporidium parvum
FRKRTEIGIFWIGLLTLFLIIL

SEQ ID NO: 2230996 - protein, 18 aa, Cryptosporidium parvum
FRKYCTWNEKKIVQTDGK

SEQ ID NO: 2230997 - protein, 19 aa, Cryptosporidium parvum
FRLIACKVSAASIFTTGVS

SEQ ID NO: 2230998 - protein, 20 aa, Cryptosporidium parvum
FRLLSLLVILSLVFLLGLTE

SEQ ID NO: 2230999 - protein, 21 aa, Cryptosporidium parvum
FRLTFGEVVCKVSEIFMKLAN

SEQ ID NO: 2231000 - protein, 27 aa, Cryptosporidium parvum
FRNGELLFPRLSKISIPINGPLNIRLA

SEQ ID NO: 2231001 - protein, 21 aa, Cryptosporidium parvum
FRNILKIILFFTSFTITFLSL

SEQ ID NO: 2231002 - protein, 19 aa, Cryptosporidium parvum
FRNKIPINLLINGNLTIDT

SEQ ID NO: 2231003 - protein, 20 aa, Cryptosporidium parvum
FRNSIKYIIRAERLLRNLSK

SEQ ID NO: 2231004 - protein, 23 aa, Cryptosporidium parvum
FRQAACIFVSLAISYCMLTSRLI

SEQ ID NO: 2231005 - protein, 32 aa, Cryptosporidium parvum
FRRKSTWRSSKFRSWKAILSLIYTTKESSKQQ

SEQ ID NO: 2231006 - protein, 18 aa, Cryptosporidium parvum
FRRVVHWKTSAISFEESA

SEQ ID NO: 2231007 - protein, 20 aa, Cryptosporidium parvum
FRSLPPPPLRKNLPQENTQV

SEQ ID NO: 2231008 - protein, 19 aa, Cryptosporidium parvum
FRTSSGIIFSYERKFHNEV

SEQ ID NO: 2231009 - protein, 20 aa, Cryptosporidium parvum
FRVPKSFSMKCNSSKEKFDY

SEQ ID NO: 2231010 - protein, 19 aa, Cryptosporidium parvum
FRVQFLVLLLFLNNLACEN

SEQ ID NO: 2231011 - protein, 20 aa, Cryptosporidium parvum
FRVWMCGGFIECAPCSRVFH

SEQ ID NO: 2231012 - protein, 17 aa, Cryptosporidium parvum
FRWSSCICDRNIMIGVR

SEQ ID NO: 2231013 - protein, 20 aa, Cryptosporidium parvum
FRYEHGLGVPRSCEAAISNY

SEQ ID NO: 2231014 - protein, 21 aa, Cryptosporidium parvum
FRYLFCDQRNLLSFKTVLITA

SEQ ID NO: 2231015 - protein, 19 aa, Cryptosporidium parvum
FSDEDLDSFSYLKSTNFVN

SEQ ID NO: 2231016 - protein, 27 aa, Cryptosporidium parvum
FSDNSPFRIACQFSLIKCTLANIKSKC

SEQ ID NO: 2231017 - protein, 23 aa, Cryptosporidium parvum
FSDYSTCCLRAKHIHSIPKAIEH

SEQ ID NO: 2231018 - protein, 22 aa, Cryptosporidium parvum
FSEFGMPIFFYVSGRASFLSST

SEQ ID NO: 2231019 - protein, 17 aa, Cryptosporidium parvum
FSEKIIFTVEDKDDAIK

SEQ ID NO: 2231020 - protein, 22 aa, Cryptosporidium parvum
FSELFESCFEFKLFKKFNIDSL

SEQ ID NO: 2231021 - protein, 26 aa, Cryptosporidium parvum
FSESTSRKWSICFSKELCGIGFKSIT

SEQ ID NO: 2231022 - protein, 17 aa, Cryptosporidium parvum
FSFLGDRTEEFLLNSLT

SEQ ID NO: 2231023 - protein, 19 aa, Cryptosporidium parvum
FSFNLSIFGTFIVDVLSQS

SEQ ID NO: 2231024 - protein, 24 aa, Cryptosporidium parvum
FSFVTVRDLLRWGNRLITSKDNVL

SEQ ID NO: 2231025 - protein, 17 aa, Cryptosporidium parvum
FSGFIIDFIGGYKSERG

SEQ ID NO: 2231026 - protein, 18 aa, Cryptosporidium parvum
FSGFSIASIKAFAIFGIL

SEQ ID NO: 2231027 - protein, 20 aa, Cryptosporidium parvum
FSGIHFLHAALLCRKTREWR

SEQ ID NO: 2231028 - protein, 17 aa, Cryptosporidium parvum
FSGLYLPGLPLLNTHLE

SEQ ID NO: 2231029 - protein, 17 aa, Cryptosporidium parvum
FSGNLLSLISELGPTSD

SEQ ID NO: 2231030 - protein, 17 aa, Cryptosporidium parvum
FSGTGIALAQSIGALNI

SEQ ID NO: 2231031 - protein, 27 aa, Cryptosporidium parvum
FSIASIKAFAIFGILFVFEEPYLLVST

SEQ ID NO: 2231032 - protein, 19 aa, Cryptosporidium parvum
FSIFLCYADRIIMPSCIKS

SEQ ID NO: 2231033 - protein, 17 aa, Cryptosporidium parvum
FSIFQIFTAMSFPGLIV

SEQ ID NO: 2231034 - protein, 18 aa, Cryptosporidium parvum
FSIFSFFNSLLFKPSLSY

SEQ ID NO: 2231035 - protein, 19 aa, Cryptosporidium parvum
FSIFYKRNIDTFNLPTPSL

SEQ ID NO: 2231036 - protein, 25 aa, Cryptosporidium parvum
FSIIICAFLFFLSILCFPYIFHIPE

SEQ ID NO: 2231037 - protein, 17 aa, Cryptosporidium parvum
FSIIIFIGEWIKSLFNN

SEQ ID NO: 2231038 - protein, 17 aa, Cryptosporidium parvum
FSIIQFSLWEKLNRTGD

SEQ ID NO: 2231039 - protein, 20 aa, Cryptosporidium parvum
FSILHIKLFLSGRSHIGFFQ

SEQ ID NO: 2231040 - protein, 17 aa, Cryptosporidium parvum
FSIPLSLGSVIDYSVDN

SEQ ID NO: 2231041 - protein, 22 aa, Cryptosporidium parvum
FSISKINLVLSWILNENDQSLD

SEQ ID NO: 2231042 - protein, 17 aa, Cryptosporidium parvum
FSIYIIFYIIFFYIQVV

SEQ ID NO: 2231043 - protein, 31 aa, Cryptosporidium parvum; identical to SEQ ID NO: 2123295

SEQ ID NO: 2231044 - protein, 18 aa, Cryptosporidium parvum
FSKGCIFNAAKQIIYNAY

SEQ ID NO: 2231045 - protein, 18 aa, Cryptosporidium parvum
FSKGSIKVIRPGRRISMT

SEQ ID NO: 2231046 - protein, 23 aa, Cryptosporidium parvum
FSKHHKHSLGLRGNQNTEKQLDL

SEQ ID NO: 2231047 - protein, 18 aa, Cryptosporidium parvum
FSKILNIPLTLIIIIRGE

SEQ ID NO: 2231048 - protein, 20 aa, Cryptosporidium parvum
FSKTQLQTRCRLFKTIRSAV

SEQ ID NO: 2231049 - protein, 17 aa, Cryptosporidium parvum
FSKYIVILIVLFSLNNQ

SEQ ID NO: 2231050 - protein, 22 aa, Cryptosporidium parvum
FSLDDILFHWTLNDPITSKTKY

SEQ ID NO: 2231051 - protein, 24 aa, Cryptosporidium parvum
FSLFIVSFFCYFSMSIKNIYSIIS

SEQ ID NO: 2231052 - protein, 18 aa, Cryptosporidium parvum
FSLFRRRFSNEVGNTHNH

SEQ ID NO: 2231053 - protein, 18 aa, Cryptosporidium parvum
FSLKSIKRISGIFEPCII

SEQ ID NO: 2231054 - protein, 26 aa, Cryptosporidium parvum
FSLLESCLQALIARSVGKGSTLSKLL

SEQ ID NO: 2231055 - protein, 20 aa, Cryptosporidium parvum
FSLLNICIFAFFAQFNIIQA

SEQ ID NO: 2231056 - protein, 21 aa, Cryptosporidium parvum
FSLLPRKSYQSTFISQLEKYS

SEQ ID NO: 2231057 - protein, 25 aa, Cryptosporidium parvum
FSLNEFPILILITISNSSFKIRRNI

SEQ ID NO: 2231058 - protein, 21 aa, Cryptosporidium parvum
FSLNFIKGFVLIKHSNSNDYN

SEQ ID NO: 2231059 - protein, 20 aa, Cryptosporidium parvum
FSLRIFSYFRSIGVYNTIPD

SEQ ID NO: 2231060 - protein, 31 aa, Cryptosporidium parvum
FSLRSKVGIIMAIFFNMWSTITASRFFEYTV

SEQ ID NO: 2231061 - protein, 20 aa, Cryptosporidium parvum
FSLSQLRLISLLRVYLNSSK

SEQ ID NO: 2231062 - protein, 24 aa, Cryptosporidium parvum
FSLYEFPEIFLFELDSQVNFDTWR

SEQ ID NO: 2231063 - protein, 20 aa, Cryptosporidium parvum
FSLYPKYHRVREYKKTELLE

SEQ ID NO: 2231064 - protein, 25 aa, Cryptosporidium parvum
FSLYYRRFLDPCVGSLSILSAGFNT

SEQ ID NO: 2231065 - protein, 21 aa, Cryptosporidium parvum
FSMDDSLRFYSLINLNLMGNK

SEQ ID NO: 2231066 - protein, 24 aa, Cryptosporidium parvum
FSNFSELLTAYAYFLHFSGYKVIC

SEQ ID NO: 2231067 - protein, 20 aa, Cryptosporidium parvum
FSNLETCTALLFSNNLLQVP

SEQ ID NO: 2231068 - protein, 27 aa, Cryptosporidium parvum
FSNLLFLFRNCLILIFLNDQNKIHNIN

SEQ ID NO: 2231069 - protein, 17 aa, Cryptosporidium parvum
FSNPITVSERIHQNEIQ

SEQ ID NO: 2231070 - protein, 30 aa, Cryptosporidium parvum
FSPEKIEAIKIFGELEVINFFINEVNCKTL

SEQ ID NO: 2231071 - protein, 18 aa, Cryptosporidium parvum
FSRIIGFTLIIILIIFTG

SEQ ID NO: 2231072 - protein, 23 aa, Cryptosporidium parvum
FSSCEYILFITLVFLISISIMYR

SEQ ID NO: 2231073 - protein, 17 aa, Cryptosporidium parvum
FSSEGKLQVTIPKARIS

SEQ ID NO: 2231074 - protein, 19 aa, Cryptosporidium parvum
FSSILGTRFVPLVFQSKKK

SEQ ID NO: 2231075 - protein, 24 aa, Cryptosporidium parvum
FSSILRFLVILAAFISLLVLIKLP

SEQ ID NO: 2231076 - protein, 30 aa, Cryptosporidium parvum
FSSISIPHIVFFQYRYIFRIYSSLATNILW

SEQ ID NO: 2231077 - protein, 25 aa, Cryptosporidium parvum
FSSNGFPWWRGIISFFKEYLTSNKQ

SEQ ID NO: 2231078 - protein, 27 aa, Cryptosporidium parvum
FSSTFKIPEVWGVYKFVINHKRIGYNT

SEQ ID NO: 2231079 - protein, 24 aa, Cryptosporidium parvum
FSSVGFCSSAFLPAYGMAENTLII

SEQ ID NO: 2231080 - protein, 21 aa, Cryptosporidium parvum
FSSVVSLGFCTLIYILMGSSG

SEQ ID NO: 2231081 - protein, 22 aa, Cryptosporidium parvum
FSSYVIRLLYQINRTSVRTHSW

SEQ ID NO: 2231082 - protein, 24 aa, Cryptosporidium parvum
FSTACICCAVTLYVLGYVKGKFCN

SEQ ID NO: 2231083 - protein, 17 aa, Cryptosporidium parvum
FSTCPTVISGRVLTTDM

SEQ ID NO: 2231084 - protein, 20 aa, Cryptosporidium parvum
FSTEGASIWNNFTHKNVHDC

SEQ ID NO: 2231085 - protein, 22 aa, Cryptosporidium parvum
FSTGKLWWVPLIEKYRRNYYLL

SEQ ID NO: 2231086 - protein, 18 aa, Cryptosporidium parvum
FSTLKYIISQAMESNSKI

SEQ ID NO: 2231087 - protein, 25 aa, Cryptosporidium parvum
FSTLQCFSFIFSLMNGFIMDKIGVS

SEQ ID NO: 2231088 - protein, 20 aa, Cryptosporidium parvum
FSTNFLFEYGNSYAKTLFEN

SEQ ID NO: 2231089 - protein, 18 aa, Cryptosporidium parvum
FSTPVCILENDFVTICNA

SEQ ID NO: 2231090 - protein, 25 aa, Cryptosporidium parvum
FSTSESFKVFLWITTIVLCVSATAG

SEQ ID NO: 2231091 - protein, 27 aa, Cryptosporidium parvum
FSTVFKEMLRISGIITVGVVRTIGNNV

SEQ ID NO: 2231092 - protein, 19 aa, Cryptosporidium parvum
FSTVLFKSFFDCHSRIIVS

SEQ ID NO: 2231093 - protein, 22 aa, Cryptosporidium parvum
FSVIVGWLLGKPMTLSFTPVSA

SEQ ID NO: 2231094 - protein, 24 aa, Cryptosporidium parvum
FSVLCIYFGYKMKVSWYAPTFYPP

SEQ ID NO: 2231095 - protein, 18 aa, Cryptosporidium parvum
FSVYKYRSNSIINKNSSI

SEQ ID NO: 2231096 - protein, 24 aa, Cryptosporidium parvum
FSWNTLQMGTLWKFITGNYSSIIR

SEQ ID NO: 2231097 - protein, 18 aa, Cryptosporidium parvum
FSYFEFNSPLIVGVCISL

SEQ ID NO: 2231098 - protein, 18 aa, Cryptosporidium parvum
FSYFSMINYILLGENSTN

SEQ ID NO: 2231099 - protein, 19 aa, Cryptosporidium parvum
FTAAFSMIVAGIWWILALF

SEQ ID NO: 2231100 - protein, 18 aa, Cryptosporidium parvum
FTACIERAIYLSLNHNSS

SEQ ID NO: 2231101 - protein, 20 aa, Cryptosporidium parvum
FTAMSFPGLIVAIARFGVGV

SEQ ID NO: 2231102 - protein, 21 aa, Cryptosporidium parvum
FTDDLKNIWLFINNSEESLSK

SEQ ID NO: 2231103 - protein, 20 aa, Cryptosporidium parvum
FTDFVICCIVFFIGCASVLV

SEQ ID NO: 2231104 - protein, 17 aa, Cryptosporidium parvum
FTDIILREYISTIKAGI

SEQ ID NO: 2231105 - protein, 27 aa, Cryptosporidium parvum
FTDLKFDISKLFAKFIFDLKGNSSNKN

SEQ ID NO: 2231106 - protein, 21 aa, Cryptosporidium parvum
FTEIKLDGMVAFYDSLLIKGL

SEQ ID NO: 2231107 - protein, 25 aa, Cryptosporidium parvum
FTEYLSKLWPPFNMESFKADVKTLC

SEQ ID NO: 2231108 - protein, 24 aa, Cryptosporidium parvum
FTFFPRYLSISIFSVVINNIDIFK

SEQ ID NO: 2231109 - protein, 19 aa, Cryptosporidium parvum
FTFIFDYEIQQILNFGFFN

SEQ ID NO: 2231110 - protein, 19 aa, Cryptosporidium parvum
FTFQTIFRHFPLRRSFVFE

SEQ ID NO: 2231111 - protein, 23 aa, Cryptosporidium parvum
FTGESFPEFKMEKVVIPNEKSTE

SEQ ID NO: 2231112 - protein, 17 aa, Cryptosporidium parvum
FTGFVISMVHLTYLSIF

SEQ ID NO: 2231113 - protein, 33 aa, Cryptosporidium parvum
FTGTVIACIASLLMLFRIFQIFSSLFSQVNVPL

SEQ ID NO: 2231114 - protein, 22 aa, Cryptosporidium parvum
FTIDGKLLRRSIVSEVKTSFET

SEQ ID NO: 2231115 - protein, 26 aa, Cryptosporidium parvum
FTIEPFKGSLGWGFYLLLLANSLLIV

SEQ ID NO: 2231116 - protein, 18 aa, Cryptosporidium parvum
FTIHSSYGDKYFCLYKLR

SEQ ID NO: 2231117 - protein, 28 aa, Cryptosporidium parvum
FTIWYLNGFLRACLFRKLNYNIQNSNTY

SEQ ID NO: 2231118 - protein, 24 aa, Cryptosporidium parvum
FTKEITCSVIVKFFRIIKEQKEKF

SEQ ID NO: 2231119 - protein, 17 aa, Cryptosporidium parvum
FTKFVGMIYLFFLDIFR

SEQ ID NO: 2231120 - protein, 26 aa, Cryptosporidium parvum
FTKYIEHFGKLVVSHELCFEKNKLIE

SEQ ID NO: 2231121 - protein, 19 aa, Cryptosporidium parvum
FTLASLPSMDYFDTLEPSQ

SEQ ID NO: 2231122 - protein, 23 aa, Cryptosporidium parvum
FTLTCNYLSLGQFELARSSILQL

SEQ ID NO: 2231123 - protein, 23 aa, Cryptosporidium parvum
FTLVSFPFLFGIMYGDVGHGFIV

SEQ ID NO: 2231124 - protein, 27 aa, Cryptosporidium parvum
FTNPNFWASVVHELWLFIIVSQHNNLK

SEQ ID NO: 2231125 - protein, 24 aa, Cryptosporidium parvum
FTPGSSWRLGGMFLSSLHVPVNPS

SEQ ID NO: 2231126 - protein, 20 aa, Cryptosporidium parvum
FTQIFNVIQDPEWITSNGDY

SEQ ID NO: 2231127 - protein, 19 aa, Cryptosporidium parvum
FTQPIDCKYIPGVGMTCII

SEQ ID NO: 2231128 - protein, 18 aa, Cryptosporidium parvum
FTRHVYKVRSEVVKNYQR

SEQ ID NO: 2231129 - protein, 23 aa, Cryptosporidium parvum
FTRSRPPLPTRKPYSGSLLTSSR

SEQ ID NO: 2231130 - protein, 21 aa, Cryptosporidium parvum
FTRSSPYLNHYIPEIEITTGL

SEQ ID NO: 2231131 - protein, 23 aa, Cryptosporidium parvum
FTSELINGLSIRNVMNYLSKELL

SEQ ID NO: 2231132 - protein, 19 aa, Cryptosporidium parvum
FTSLLAHIILYWTGLSVDF

SEQ ID NO: 2231133 - protein, 22 aa, Cryptosporidium parvum
FTSNPYLDLGFRDLDYEKCTKF

SEQ ID NO: 2231134 - protein, 21 aa, Cryptosporidium parvum
FTSRIQIITIFNQFIPLLLIG

SEQ ID NO: 2231135 - protein, 26 aa, Cryptosporidium parvum
FTTIFECLRIKLLIIPEQKSLIMNIS

SEQ ID NO: 2231136 - protein, 18 aa, Cryptosporidium parvum
FTTIPFFISQAFYSFLYC

SEQ ID NO: 2231137 - protein, 17 aa, Cryptosporidium parvum
FTVANVFSIFFVITNAS

SEQ ID NO: 2231138 - protein, 22 aa, Cryptosporidium parvum
FTVASCIIVMIGFTISAFDSNT

SEQ ID NO: 2231139 - protein, 26 aa, Cryptosporidium parvum
FTYCFTRVTIYIGYFIYLDYRFIIVF

SEQ ID NO: 2231140 - protein, 24 aa, Cryptosporidium parvum
FTYEYRKAIFYSILEVFSHGIIPK

SEQ ID NO: 2231141 - protein, 21 aa, Cryptosporidium parvum
FVACDLYYNWNRIKNQSEAGI

SEQ ID NO: 2231142 - protein, 19 aa, Cryptosporidium parvum
FVCESLRSYGFSDFGMEKL

SEQ ID NO: 2231143 - protein, 20 aa, Cryptosporidium parvum
FVDSFSLFWCKEQERKKELS

SEQ ID NO: 2231144 - protein, 23 aa, Cryptosporidium parvum
FVFDYKSKIPIFYHILEEINIIK

SEQ ID NO: 2231145 - protein, 23 aa, Cryptosporidium parvum
FVFNRLVGIFEMCFQVIFFNGNN

SEQ ID NO: 2231146 - protein, 18 aa, Cryptosporidium parvum
FVFSYVVKSQTCFYPLQI

SEQ ID NO: 2231147 - protein, 18 aa, Cryptosporidium parvum
FVGDLAVSIFGYNSSKQL

SEQ ID NO: 2231148 - protein, 19 aa, Cryptosporidium parvum
FVGRIALYIWCRKYTTDYN

SEQ ID NO: 2231149 - protein, 25 aa, Cryptosporidium parvum
FVGTAAYLWVCAPVTLSYYSSINNQ

SEQ ID NO: 2231150 - protein, 24 aa, Cryptosporidium parvum
FVGTIKGFCLIFLETSSKKCIVID

SEQ ID NO: 2231151 - protein, 17 aa, Cryptosporidium parvum
FVIFLFYIINAYKSAVE

SEQ ID NO: 2231152 - protein, 17 aa, Cryptosporidium parvum
FVIGLLAVLVSGGSLGS

SEQ ID NO: 2231153 - protein, 20 aa, Cryptosporidium parvum
FVILEIKYPIAVNYLYPKKI

SEQ ID NO: 2231154 - protein, 26 aa, Cryptosporidium parvum
FVISEIYLRYLYACRIILYSKNYNLI

SEQ ID NO: 2231155 - protein, 24 aa, Cryptosporidium parvum
FVKDQILILWGREIIGPVFELLKS

SEQ ID NO: 2231156 - protein, 19 aa, Cryptosporidium parvum
FVKIACIIRGLHISAGTPQ

SEQ ID NO: 2231157 - protein, 19 aa, Cryptosporidium parvum
FVLPFKFSIIDNRYPAILD

SEQ ID NO: 2231158 - protein, 18 aa, Cryptosporidium parvum
FVLRLKYLNNLFSDLVLN

SEQ ID NO: 2231159 - protein, 18 aa, Cryptosporidium parvum
FVLWGSGISICIMEYYGV

SEQ ID NO: 2231160 - protein, 22 aa, Cryptosporidium parvum
FVLYRKTCRMLSSGTKKSDKTR

SEQ ID NO: 2231161 - protein, 17 aa, Cryptosporidium parvum
FVMELIGIYILVMQLYP

SEQ ID NO: 2231162 - protein, 20 aa, Cryptosporidium parvum
FVNFKRLYEYNGKKLPFSVA

SEQ ID NO: 2231163 - protein, 18 aa, Cryptosporidium parvum
FVNMLLFGYIWRKSAGYL

SEQ ID NO: 2231164 - protein, 27 aa, Cryptosporidium parvum
FVPIICIFGIILPSYVYALFCHIYNST

SEQ ID NO: 2231165 - protein, 25 aa, Cryptosporidium parvum
FVPKLSSSLLICYGNILFILWLDYS

SEQ ID NO: 2231166 - protein, 34 aa, Cryptosporidium parvum
FVQGFRVGLIHFFRYFLGGAFQTASVIFNFGHKL

SEQ ID NO: 2231167 - protein, 29 aa, Cryptosporidium parvum
FVRLISIMSICIWLSLLVFEGSYLFTEVI

SEQ ID NO: 2231168 - protein, 17 aa, Cryptosporidium parvum
FVRQCISVTTAFVRFQI

SEQ ID NO: 2231169 - protein, 18 aa, Cryptosporidium parvum
FVSALTMLVVIPMHVIPF

SEQ ID NO: 2231170 - protein, 18 aa, Cryptosporidium parvum
FVSCFNILCRSVTKEELI

SEQ ID NO: 2231171 - protein, 17 aa, Cryptosporidium parvum
FVSEAYGSIYPKSNEDL

SEQ ID NO: 2231172 - protein, 33 aa, Cryptosporidium parvum
FVSKEVLKIIPMESSLFLEWGLSIANQTSPDIE

SEQ ID NO: 2231173 - protein, 30 aa, Cryptosporidium parvum; identical to SEQ ID NO: 2123379

SEQ ID NO: 2231174 - protein, 17 aa, Cryptosporidium parvum
FVTRYFLIYYISPDSSY

SEQ ID NO: 2231175 - protein, 24 aa, Cryptosporidium parvum
FVTSSRKAPLLGFQHLNPKFGIQI

SEQ ID NO: 2231176 - protein, 27 aa, Cryptosporidium parvum
FVYFLDLNYIWVLRLGFDPFRSKCKLG

SEQ ID NO: 2231177 - protein, 17 aa, Cryptosporidium parvum
FVYKELIISLGVRNETN

SEQ ID NO: 2231178 - protein, 17 aa, Cryptosporidium parvum
FWERTLLSMQTWSSEVP

SEQ ID NO: 2231179 - protein, 20 aa, Cryptosporidium parvum
FWGKICVLTSISWGPILLYK

SEQ ID NO: 2231180 - protein, 17 aa, Cryptosporidium parvum
FWLDSWSQFDIFATGRK

SEQ ID NO: 2231181 - protein, 20 aa, Cryptosporidium parvum
FWMFTYCFFLSYNTIYFNSL

SEQ ID NO: 2231182 - protein, 22 aa, Cryptosporidium parvum
FWMMISCIFITFLGYILHDSLS

SEQ ID NO: 2231183 - protein, 17 aa, Cryptosporidium parvum
FWNECIKSNPLFSNSIS

SEQ ID NO: 2231184 - protein, 24 aa, Cryptosporidium parvum
FWNVSSDTYIYWGYQNKTGTVYIL

SEQ ID NO: 2231185 - protein, 33 aa, Cryptosporidium parvum
FWQVPKKMYRQMGNWGIFLGMFLAIVRIIPAGF

SEQ ID NO: 2231186 - protein, 23 aa, Cryptosporidium parvum
FWYFKLIGPKWMIVFTLGCVIKV

SEQ ID NO: 2231187 - protein, 19 aa, Cryptosporidium parvum
FYAFWNWFDSRSWYPLGRI

SEQ ID NO: 2231188 - protein, 18 aa, Cryptosporidium parvum
FYCNQRFNYFEKFNEIKN

SEQ ID NO: 2231189 - protein, 23 aa, Cryptosporidium parvum
FYDLLFKKNRLFFKFNNISDILL

SEQ ID NO: 2231190 - protein, 18 aa, Cryptosporidium parvum
FYFKTFNELMAFLYESIQ

SEQ ID NO: 2231191 - protein, 19 aa, Cryptosporidium parvum
FYFNPCIISIFGESNNNSE

SEQ ID NO: 2231192 - protein, 18 aa, Cryptosporidium parvum
FYFPVAQVRVVECTDNTH

SEQ ID NO: 2231193 - protein, 19 aa, Cryptosporidium parvum
FYFSMVVTISLRSPSNSGK

SEQ ID NO: 2231194 - protein, 17 aa, Cryptosporidium parvum
FYGCLASGIVAIPVYPA

SEQ ID NO: 2231195 - protein, 18 aa, Cryptosporidium parvum
FYIFNWKSIPKMGMAIEM

SEQ ID NO: 2231196 - protein, 17 aa, Cryptosporidium parvum
FYIGYNMLLNLLRLEGA

SEQ ID NO: 2231197 - protein, 17 aa, Cryptosporidium parvum
FYISRVSFEMIMPLTRN

SEQ ID NO: 2231198 - protein, 18 aa, Cryptosporidium parvum
FYKNASIYRYEGYTSCNP

SEQ ID NO: 2231199 - protein, 25 aa, Cryptosporidium parvum
FYKNIIFLLRLIALYSEKNEQKYNE

SEQ ID NO: 2231200 - protein, 32 aa, Cryptosporidium parvum
FYKSLSIEEFEIFKSSFLGLGKKFLNINESGQ

SEQ ID NO: 2231201 - protein, 18 aa, Cryptosporidium parvum
FYLGIGSTFEDLVRDLIN

SEQ ID NO: 2231202 - protein, 25 aa, Cryptosporidium parvum
FYLPNCQQSQMSLVELDKLSVIARE

SEQ ID NO: 2231203 - protein, 17 aa, Cryptosporidium parvum
FYLSLEIDEINYEIISL

SEQ ID NO: 2231204 - protein, 25 aa, Cryptosporidium parvum
FYMIPEFPKPSFLDSIIPSSPAQGI

SEQ ID NO: 2231205 - protein, 17 aa, Cryptosporidium parvum
FYMKAMREIQGYLRDEY

SEQ ID NO: 2231206 - protein, 29 aa, Cryptosporidium parvum
FYNKYEFVSQLPFPIVIHRFTNSKEMHQT

SEQ ID NO: 2231207 - protein, 26 aa, Cryptosporidium parvum
FYNTLRFEVFNSFKTNILVGVPGLLY

SEQ ID NO: 2231208 - protein, 17 aa, Cryptosporidium parvum
FYPCGVATLTIFNDTFT

SEQ ID NO: 2231209 - protein, 19 aa, Cryptosporidium parvum
FYPFIPQLFLMMGREQVIS

SEQ ID NO: 2231210 - protein, 18 aa, Cryptosporidium parvum
FYPHKFKISMSLPAYALK

SEQ ID NO: 2231211 - protein, 17 aa, Cryptosporidium parvum
FYPRPGTPAAKMKPVPN

SEQ ID NO: 2231212 - protein, 25 aa, Cryptosporidium parvum
FYQFLRKFFPSLVKVFREAFLKEKV

SEQ ID NO: 2231213 - protein, 19 aa, Cryptosporidium parvum
FYRDVLFIFVTRGILLTLC

SEQ ID NO: 2231214 - protein, 29 aa, Cryptosporidium parvum
FYSKDRFYRFNIFHIYSLISHYKSYETDS

SEQ ID NO: 2231215 - protein, 17 aa, Cryptosporidium parvum
FYSLFLFAFGSPFSETE

SEQ ID NO: 2231216 - protein, 22 aa, Cryptosporidium parvum
FYSPNNMKLAIVGREPLDKLEK

SEQ ID NO: 2231217 - protein, 22 aa, Cryptosporidium parvum
FYSSFCAYCHMASNPLKKVAES

SEQ ID NO: 2231218 - protein, 26 aa, Cryptosporidium parvum
FYVFHEILRPSGRLFLKSPNVLSPLQ

SEQ ID NO: 2231219 - protein, 23 aa, Cryptosporidium parvum
FYVKSIIFLLMLDFPNDRMDKTL

SEQ ID NO: 2231220 - protein, 17 aa, Cryptosporidium parvum
GACFLLFIMTMIALLYA

SEQ ID NO: 2231221 - protein, 24 aa, Cryptosporidium parvum
GADRCILDSSFIDGKFTKINIRFI

SEQ ID NO: 2231222 - protein, 31 aa, Cryptosporidium parvum
GAIAIAFQCSVSFTQLVLWMIRNISETENNF

SEQ ID NO: 2231223 - protein, 24 aa, Cryptosporidium parvum
GAIHSGYQTSADFVTTTTAKPTTT

SEQ ID NO: 2231224 - protein, 25 aa, Cryptosporidium parvum
GAILSHIMCLGMNRSLLNVMLGGWE

SEQ ID NO: 2231225 - protein, 17 aa, Cryptosporidium parvum
GAIYQLVIFSSYFFVVH

SEQ ID NO: 2231226 - protein, 30 aa, Cryptosporidium parvum; identical to SEQ ID NO: 2123412

SEQ ID NO: 2231227 - protein, 19 aa, Cryptosporidium parvum
GALFGFIAFILSLRNYTLR

SEQ ID NO: 2231228 - protein, 19 aa, Cryptosporidium parvum
GALGLFGMIVGFYQLSLAD

SEQ ID NO: 2231229 - protein, 29 aa, Cryptosporidium parvum
GALVKHIPFLIALCTICNGIICITGVIYI

SEQ ID NO: 2231230 - protein, 17 aa, Cryptosporidium parvum
GAMAPAVLFARVRAAIA

SEQ ID NO: 2231231 - protein, 22 aa, Cryptosporidium parvum
GANKLLLGGILYDLSRLDQNQR

SEQ ID NO: 2231232 - protein, 24 aa, Cryptosporidium parvum
GAPDRIVKHIGFMLNTDWKNEEPM

SEQ ID NO: 2231233 - protein, 18 aa, Cryptosporidium parvum
GAPSRRRGSSPSRQDRSR

SEQ ID NO: 2231234 - protein, 22 aa, Cryptosporidium parvum
GAQCVLEIKEMVAWGEFALQHT

SEQ ID NO: 2231235 - protein, 17 aa, Cryptosporidium parvum
GAVGPGFNLNQSGSGVG

SEQ ID NO: 2231236 - protein, 18 aa, Cryptosporidium parvum
GAVNEMSFLNSFKMKFSV

SEQ ID NO: 2231237 - protein, 29 aa, Cryptosporidium parvum
GCALKSEVESFWRRHFVLAEDMLEISATC

SEQ ID NO: 2231238 - protein, 17 aa, Cryptosporidium parvum
GCCKQLELLLSIDETEI

SEQ ID NO: 2231239 - protein, 21 aa, Cryptosporidium parvum
GCIFKLPNIEFQKDHEFYLTL

SEQ ID NO: 2231240 - protein, 20 aa, Cryptosporidium parvum
GCMSTCKQDPFCVAWSYNAT

SEQ ID NO: 2231241 - protein, 25 aa, Cryptosporidium parvum
GCYGACVFLLLFGFGSSVFVRAIQL

SEQ ID NO: 2231242 - protein, 22 aa, Cryptosporidium parvum
GDEDLIRILVSFYKFQTNTGVL

SEQ ID NO: 2231243 - protein, 25 aa, Cryptosporidium parvum
GDFMLPLRIKHWFIEIMKKNANIPL

SEQ ID NO: 2231244 - protein, 18 aa, Cryptosporidium parvum
GDFYLLGLCEGNFCMGEM

SEQ ID NO: 2231245 - protein, 23 aa, Cryptosporidium parvum
GDIECLNLLLKRSPNLDLCDEEF

SEQ ID NO: 2231246 - protein, 21 aa, Cryptosporidium parvum
GDIPLLMNFLLRRHESNSAIS

SEQ ID NO: 2231247 - protein, 20 aa, Cryptosporidium parvum
GDISTCIKVTTIFWKNQGIK

SEQ ID NO: 2231248 - protein, 34 aa, Cryptosporidium parvum
GDKPGEFKWEYGILSLCLINGDWLLIENIQDSPK

SEQ ID NO: 2231249 - protein, 17 aa, Cryptosporidium parvum
GDLFCNYKMNQIIITTI

SEQ ID NO: 2231250 - protein, 17 aa, Cryptosporidium parvum
GDLFSWGQGRDGSLGTG

SEQ ID NO: 2231251 - protein, 34 aa, Cryptosporidium parvum
GDLVERCPFHSSLFPGLYLTGSRTSDVLAIDLFT

SEQ ID NO: 2231252 - protein, 24 aa, Cryptosporidium parvum
GDPFIVKWLTTRVDPNYKLETMPR

SEQ ID NO: 2231253 - protein, 20 aa, Cryptosporidium parvum
GDPQGALARAFLNLDGTMGT

SEQ ID NO: 2231254 - protein, 28 aa, Cryptosporidium parvum
GDRNTLAMYMEWIWLNNHIQSVIEQGYD

SEQ ID NO: 2231255 - protein, 17 aa, Cryptosporidium parvum
GDVPRGYLMNAVSFSIV

SEQ ID NO: 2231256 - protein, 24 aa, Cryptosporidium parvum
GDYFKYAYVLFSWLTRVLYKQNRR

SEQ ID NO: 2231257 - protein, 25 aa, Cryptosporidium parvum
GDYSARILIDLGYFYYLYMLCLTVF

SEQ ID NO: 2231258 - protein, 28 aa, Cryptosporidium parvum
GDYSGCRRLSQMLYHYVRVTLKEPRVAQ

SEQ ID NO: 2231259 - protein, 30 aa, Cryptosporidium parvum
GEAEVVGFIKVYCKILSKFSLKNKNSKKSN

SEQ ID NO: 2231260 - protein, 25 aa, Cryptosporidium parvum
GECNEMRILPGFPIRIKEETLIQFG

SEQ ID NO: 2231261 - protein, 24 aa, Cryptosporidium parvum
GECSKEFYYRIHTFVGGLEISVED

SEQ ID NO: 2231262 - protein, 23 aa, Cryptosporidium parvum
GEDATEFLIKFLGRSTISKMISN

SEQ ID NO: 2231263 - protein, 19 aa, Cryptosporidium parvum
GEECIRWTMMNCNYKNIKV

SEQ ID NO: 2231264 - protein, 19 aa, Cryptosporidium parvum
GEELFDLNAVKNCRLAWKE

SEQ ID NO: 2231265 - protein, 25 aa, Cryptosporidium parvum
GEFLRNHLMCYSRNNLLTSELIFPT

SEQ ID NO: 2231266 - protein, 17 aa, Cryptosporidium parvum
GEFSLRIFSYFRSIGVY

SEQ ID NO: 2231267 - protein, 19 aa, Cryptosporidium parvum
GEGESAGFFSMARNKVSSA

SEQ ID NO: 2231268 - protein, 21 aa, Cryptosporidium parvum
GEGRSAARFGSLHASSITEEE

SEQ ID NO: 2231269 - protein, 17 aa, Cryptosporidium parvum
GEGVAAIVILPKKECER

SEQ ID NO: 2231270 - protein, 22 aa, Cryptosporidium parvum
GEGVNMAWNLLVERITTAFEIL

SEQ ID NO: 2231271 - protein, 18 aa, Cryptosporidium parvum
GEGVSFPALNSIVGHHIP

SEQ ID NO: 2231272 - protein, 21 aa, Cryptosporidium parvum
GEIEIQWIIPAFYSSLSSSNS

SEQ ID NO: 2231273 - protein, 17 aa, Cryptosporidium parvum
GEIKNLSLYPGNRGSSL

SEQ ID NO: 2231274 - protein, 22 aa, Cryptosporidium parvum
GEKNIGYILLSFFSAIKFASNN

SEQ ID NO: 2231275 - protein, 21 aa, Cryptosporidium parvum
GEKNIGYILLSFFSVIKFASN

SEQ ID NO: 2231276 - protein, 19 aa, Cryptosporidium parvum
GELLTCVPGDLSIISFSED

SEQ ID NO: 2231277 - protein, 18 aa, Cryptosporidium parvum
GELLYGLYQSYRLTNITS

SEQ ID NO: 2231278 - protein, 18 aa, Cryptosporidium parvum
GELRKAYNSSSYKFSLIA

SEQ ID NO: 2231279 - protein, 18 aa, Cryptosporidium parvum
GELVRLLYHLGVLEKYEE

SEQ ID NO: 2231280 - protein, 20 aa, Cryptosporidium parvum
GENLLLLPLEFKRSPNWTSD

SEQ ID NO: 2231281 - protein, 21 aa, Cryptosporidium parvum
GENVFTWEFLEIVSQVNKLIR

SEQ ID NO: 2231282 - protein, 24 aa, Cryptosporidium parvum
GEQIKGSVPYVSLYVKEKNIVTEA

SEQ ID NO: 2231283 - protein, 19 aa, Cryptosporidium parvum
GERCKLLTISVGFLALAHA

SEQ ID NO: 2231284 - protein, 25 aa, Cryptosporidium parvum
GERIIEIYESLSFSFFGKSGNGRFN

SEQ ID NO: 2231285 - protein, 25 aa, Cryptosporidium parvum
GERILPPYWYMNWVEQTSTRSKERF

SEQ ID NO: 2231286 - protein, 23 aa, Cryptosporidium parvum
GERQCGFCGEIFQDEKTYDQHMG

SEQ ID NO: 2231287 - protein, 22 aa, Cryptosporidium parvum
GESFPACRIHKMKTADFSKIPS

SEQ ID NO: 2231288 - protein, 27 aa, Cryptosporidium parvum
GESKVGGLHDLRMGPLSNRDFCGTCGS

SEQ ID NO: 2231289 - protein, 21 aa, Cryptosporidium parvum
GESKYLWFLPLRNIIRPNFNE

SEQ ID NO: 2231290 - protein, 29 aa, Cryptosporidium parvum
GESNRAFEWYGDFEVLRDLLIQSLRNSGR

SEQ ID NO: 2231291 - protein, 19 aa, Cryptosporidium parvum
GEVGFYFEVTGNSYKTGCG

SEQ ID NO: 2231292 - protein, 22 aa, Cryptosporidium parvum
GEVILWDGRIVKVPNYIFWLKK

SEQ ID NO: 2231293 - protein, 17 aa, Cryptosporidium parvum
GEVVFLAARDSEWRNRN

SEQ ID NO: 2231294 - protein, 22 aa, Cryptosporidium parvum
GEWKPSIPSIDCFSNCNLEDLE

SEQ ID NO: 2231295 - protein, 26 aa, Cryptosporidium parvum
GEYALKLAISEVFGFLVSSSTIQGMF

SEQ ID NO: 2231296 - protein, 23 aa, Cryptosporidium parvum
GEYICLPDLLSITSTISNDTSSG

SEQ ID NO: 2231297 - protein, 25 aa, Cryptosporidium parvum
GEYNRCKFWWLSLVQFPECIWILYC

SEQ ID NO: 2231298 - protein, 18 aa, Cryptosporidium parvum
GFCCKILPIIIRILNLFF

SEQ ID NO: 2231299 - protein, 30 aa, Cryptosporidium parvum
GFFLLLAGKIHFGYIYGIGILSCIGTYILL

SEQ ID NO: 2231300 - protein, 19 aa, Cryptosporidium parvum
GFFSAIYSLFGLRITNFVN

SEQ ID NO: 2231301 - protein, 20 aa, Cryptosporidium parvum
GFFTGIGVTNIFSRNSNRSK

SEQ ID NO: 2231302 - protein, 21 aa, Cryptosporidium parvum
GFGFEYRGVYYFSNAHFNANT

SEQ ID NO: 2231303 - protein, 20 aa, Cryptosporidium parvum
GFIAICFGPPISKSLISILF

SEQ ID NO: 2231304 - protein, 25 aa, Cryptosporidium parvum
GFIECAPCSRVFHVFRKGGVGYSSP

SEQ ID NO: 2231305 - protein, 21 aa, Cryptosporidium parvum
GFIKYCLKYNYLIRPVYVFGE

SEQ ID NO: 2231306 - protein, 18 aa, Cryptosporidium parvum
GFITVFKAAIGTGILFSP

SEQ ID NO: 2231307 - protein, 20 aa, Cryptosporidium parvum
GFLFWSLVCNYLKPQIVLSI

SEQ ID NO: 2231308 - protein, 20 aa, Cryptosporidium parvum
GFLIGCLLTGLFLPVLKSKV

SEQ ID NO: 2231309 - protein, 23 aa, Cryptosporidium parvum
GFLKRAANAAGRLIFGVDTTQKE

SEQ ID NO: 2231310 - protein, 26 aa, Cryptosporidium parvum
GFLLEIPEIVPFRLTPNIVIAMGSCG

SEQ ID NO: 2231311 - protein, 18 aa, Cryptosporidium parvum
GFLLGIKLIFIIFILLSF

SEQ ID NO: 2231312 - protein, 24 aa, Cryptosporidium parvum
GFMKKSRPEWFVLQTPRTPECKAR

SEQ ID NO: 2231313 - protein, 19 aa, Cryptosporidium parvum
GFNNTKCGISIYSRPSEST

SEQ ID NO: 2231314 - protein, 20 aa, Cryptosporidium parvum
GFPEIVYNGLPFLVKDMQRY

SEQ ID NO: 2231315 - protein, 21 aa, Cryptosporidium parvum
GFSRIVVISGVGVREYYANNG

SEQ ID NO: 2231316 - protein, 19 aa, Cryptosporidium parvum
GFTLILSIWILKSQDWYNL

SEQ ID NO: 2231317 - protein, 27 aa, Cryptosporidium parvum
GFWILSSMFFICFSLVYGTKTESNVKN

SEQ ID NO: 2231318 - protein, 22 aa, Cryptosporidium parvum
GGALLMRISNIFGYQFQNLTLF

SEQ ID NO: 2231319 - protein, 22 aa, Cryptosporidium parvum
GGEAEKTIPYYVAQSQANTLQL

SEQ ID NO: 2231320 - protein, 25 aa, Cryptosporidium parvum
GGECSEGFKFKFLDYLDGMSNDELM

SEQ ID NO: 2231321 - protein, 18 aa, Cryptosporidium parvum
GGEMKRLSIALELIQNPP

SEQ ID NO: 2231322 - protein, 17 aa, Cryptosporidium parvum
GGEVWRHIYYEIEKVDF

SEQ ID NO: 2231323 - protein, 24 aa, Cryptosporidium parvum
GGFILKSEDICWISLCEKDHIVDK

SEQ ID NO: 2231324 - protein, 17 aa, Cryptosporidium parvum
GGFVVGILYTFATMKAC

SEQ ID NO: 2231325 - protein, 27 aa, Cryptosporidium parvum
GGGKLYRVASFLSFLSLMTLFLTASIQ

SEQ ID NO: 2231326 - protein, 17 aa, Cryptosporidium parvum
GGGPCGVLASLNGFIIS

SEQ ID NO: 2231327 - protein, 30 aa, Cryptosporidium parvum; identical to SEQ ID NO: 2123476

SEQ ID NO: 2231328 - protein, 21 aa, Cryptosporidium parvum
GGGSLPPMIAFSETYLEKYCY

SEQ ID NO: 2231329 - protein, 23 aa, Cryptosporidium parvum
GGGVYRRAWCISHNQCNNNNNSI

SEQ ID NO: 2231330 - protein, 25 aa, Cryptosporidium parvum
GGIIKDSRLSKIYKIDIPYRSTFLY

SEQ ID NO: 2231331 - protein, 25 aa, Cryptosporidium parvum
GGIKEVNSFISFLSNYRIEYNINTV

SEQ ID NO: 2231332 - protein, 24 aa, Cryptosporidium parvum
GGKASGIYKEFLVILPWFLDTTIK

SEQ ID NO: 2231333 - protein, 29 aa, Cryptosporidium parvum
GGKNAKFDLVLNCLSGEFIHESFKKIRSG

SEQ ID NO: 2231334 - protein, 27 aa, Cryptosporidium parvum
GGKRLEKFCKLFFPALWLSCNDLKPDV

SEQ ID NO: 2231335 - protein, 22 aa, Cryptosporidium parvum
GGLGDNLIRLSFTLEEELNHKE

SEQ ID NO: 2231336 - protein, 18 aa, Cryptosporidium parvum
GGLLPFEKIRVLRSLFTC

SEQ ID NO: 2231337 - protein, 18 aa, Cryptosporidium parvum
GGLSSEWTTVEIPLENGK

SEQ ID NO: 2231338 - protein, 24 aa, Cryptosporidium parvum
GGNKVLRGSVTFEIHNNSEIPLEL

SEQ ID NO: 2231339 - protein, 20 aa, Cryptosporidium parvum
GGNNSEMWVGAGNVDLVTGG

SEQ ID NO: 2231340 - protein, 23 aa, Cryptosporidium parvum
GGQRSRLTLARALYGFLSDQEEY

SEQ ID NO: 2231341 - protein, 24 aa, Cryptosporidium parvum
GGSCGTKNCPKCNDGIKNGDETGI

SEQ ID NO: 2231342 - protein, 27 aa, Cryptosporidium parvum
GGSQCPTCEPCHGFPLSKLPEGTMLSV

SEQ ID NO: 2231343 - protein, 20 aa, Cryptosporidium parvum
GGSSCRKCNSCDPEFIFRLE

SEQ ID NO: 2231344 - protein, 21 aa, Cryptosporidium parvum
GGTGKFWPGHTLIYIVQNEEN

SEQ ID NO: 2231345 - protein, 27 aa, Cryptosporidium parvum
GGTRWPHQLPIRSWRVWGPSDENIKIN

SEQ ID NO: 2231346 - protein, 25 aa, Cryptosporidium parvum
GGVNLKSLLNFKIMNNFGNPYLNFN

SEQ ID NO: 2231347 - protein, 18 aa, Cryptosporidium parvum
GGVSLALAMSLESEDYID

SEQ ID NO: 2231348 - protein, 26 aa, Cryptosporidium parvum
GHEGCARCVCVLKDNRIVTGGLDNQI

SEQ ID NO: 2231349 - protein, 17 aa, Cryptosporidium parvum
GHLEGAAGIAGLIKLIL

SEQ ID NO: 2231350 - protein, 21 aa, Cryptosporidium parvum
GHLEGAAGIVGFIRLLVVLSF

SEQ ID NO: 2231351 - protein, 25 aa, Cryptosporidium parvum
GHLFFEIFPFLSGIENMILKQIIMQ

SEQ ID NO: 2231352 - protein, 26 aa, Cryptosporidium parvum
GHLFVLHCYLVFRGVTTYEYLTKIVI

SEQ ID NO: 2231353 - protein, 17 aa, Cryptosporidium parvum
GHLLICIGDTCFASTEI

SEQ ID NO: 2231354 - protein, 33 aa, Cryptosporidium parvum; identical to SEQ ID NO: 2123488

SEQ ID NO: 2231355 - protein, 27 aa, Cryptosporidium parvum
GHNGMPDYIVLLFAHWEIMIYRYSNQY

SEQ ID NO: 2231356 - protein, 23 aa, Cryptosporidium parvum
GHRAIKFSRIHGVQRRIYGEGTH

SEQ ID NO: 2231357 - protein, 31 aa, Cryptosporidium parvum
GHSKIPYLLKCQICNVIICSICNNMYQYGLV

SEQ ID NO: 2231358 - protein, 24 aa, Cryptosporidium parvum
GHWYEMAEYLGSIESCFEDEMFPN

SEQ ID NO: 2231359 - protein, 24 aa, Cryptosporidium parvum
GIAERIDPLLLFYLLTNYFDEMVK

SEQ ID NO: 2231360 - protein, 17 aa, Cryptosporidium parvum
GIAGFIICRIFLGVGEG

SEQ ID NO: 2231361 - protein, 18 aa, Cryptosporidium parvum
GIAGFLFNSTACQNGQMN

SEQ ID NO: 2231362 - protein, 18 aa, Cryptosporidium parvum
GIANLYLLNVERPNFLTP

SEQ ID NO: 2231363 - protein, 18 aa, Cryptosporidium parvum
GIARDVNRAAQLWEESAR

SEQ ID NO: 2231364 - protein, 17 aa, Cryptosporidium parvum
GICKWIIIIAHFFCLNR

SEQ ID NO: 2231365 - protein, 17 aa, Cryptosporidium parvum
GICLCAIASVIPTEAPT

SEQ ID NO: 2231366 - protein, 19 aa, Cryptosporidium parvum
GICQCGFIKFPDNNSNSNT

SEQ ID NO: 2231367 - protein, 18 aa, Cryptosporidium parvum
GIDCSREAINSAKKNAEN

SEQ ID NO: 2231368 - protein, 19 aa, Cryptosporidium parvum
GIDGMSFNDGIDLENEDKV

SEQ ID NO: 2231369 - protein, 17 aa, Cryptosporidium parvum
GIELKFFYLDDLKNSIS

SEQ ID NO: 2231370 - protein, 19 aa, Cryptosporidium parvum
GIENCLFVYDFITIYDSLM

SEQ ID NO: 2231371 - protein, 24 aa, Cryptosporidium parvum
GIERCFRYNLTIPVYLWHIRQDNI

SEQ ID NO: 2231372 - protein, 20 aa, Cryptosporidium parvum
GIFAFSGMIDIFFFKFLSSV

SEQ ID NO: 2231373 - protein, 26 aa, Cryptosporidium parvum
GIFIIFRLSSAMYRYSVLSCIISHLI

SEQ ID NO: 2231374 - protein, 22 aa, Cryptosporidium parvum
GIFRFYYKIILERERINSNSTR

SEQ ID NO: 2231375 - protein, 17 aa, Cryptosporidium parvum
GIFVYRAAYFGLYDTTK

SEQ ID NO: 2231376 - protein, 23 aa, Cryptosporidium parvum
GIGCTLGFLWKLIEHAFPQQISP

SEQ ID NO: 2231377 - protein, 17 aa, Cryptosporidium parvum
GIGDLFYEPIYAVTSGR

SEQ ID NO: 2231378 - protein, 24 aa, Cryptosporidium parvum
GIGILSCIGTYILLNIMSSSQSID

SEQ ID NO: 2231379 - protein, 18 aa, Cryptosporidium parvum
GIICLPLNHLECKEISNI

SEQ ID NO: 2231380 - protein, 19 aa, Cryptosporidium parvum
GIIIFKESISLLKSGKLVW

SEQ ID NO: 2231381 - protein, 19 aa, Cryptosporidium parvum
GIIISLIISVATLRIGVIL

SEQ ID NO: 2231382 - protein, 19 aa, Cryptosporidium parvum
GIIKEFLRISAPRTNGENK

SEQ ID NO: 2231383 - protein, 23 aa, Cryptosporidium parvum
GIIPFCSSNPLLVVNSISKPEDD

SEQ ID NO: 2231384 - protein, 18 aa, Cryptosporidium parvum
GIIPKVGMITIWLNDYPW

SEQ ID NO: 2231385 - protein, 18 aa, Cryptosporidium parvum
GIISFYLSVIMCSTSPYK

SEQ ID NO: 2231386 - protein, 17 aa, Cryptosporidium parvum
GIISIPFHIFASGYTSI

SEQ ID NO: 2231387 - protein, 19 aa, Cryptosporidium parvum
GIKLDWRPVAASELFENND

SEQ ID NO: 2231388 - protein, 20 aa, Cryptosporidium parvum
GIKLIFIIFILLSFSNYLIF

SEQ ID NO: 2231389 - protein, 25 aa, Cryptosporidium parvum
GIKSELKFTWLGWLSFGRDQETGDE

SEQ ID NO: 2231390 - protein, 17 aa, Cryptosporidium parvum
GILFIGALIGTRTAGSK

SEQ ID NO: 2231391 - protein, 18 aa, Cryptosporidium parvum
GILIEPYDTYGLEDDELD

SEQ ID NO: 2231392 - protein, 18 aa, Cryptosporidium parvum
GILLEFKGRYIYFCKGAE

SEQ ID NO: 2231393 - protein, 18 aa, Cryptosporidium parvum
GILLLCFNEEKIFVELRR

SEQ ID NO: 2231394 - protein, 34 aa, Cryptosporidium parvum
GILTTHIFKLFDIIWIKLSYLWCGERHLLLEPLN

SEQ ID NO: 2231395 - protein, 22 aa, Cryptosporidium parvum
GILYRIFACIAFALFFRNLGLE

SEQ ID NO: 2231396 - protein, 17 aa, Cryptosporidium parvum
GINICFDTHFIYILTMF

SEQ ID NO: 2231397 - protein, 19 aa, Cryptosporidium parvum
GIPAQFRGFIWMKLAEVEN

SEQ ID NO: 2231398 - protein, 19 aa, Cryptosporidium parvum
GIPEILPQEFLRLSNPSIS

SEQ ID NO: 2231399 - protein, 20 aa, Cryptosporidium parvum
GIPPYRYLVSENWSENIMRH

SEQ ID NO: 2231400 - protein, 24 aa, Cryptosporidium parvum
GIQNTFFAAFPIFFLSKIIYDVRK

SEQ ID NO: 2231401 - protein, 18 aa, Cryptosporidium parvum
GISAILASTFIKYISTEL

SEQ ID NO: 2231402 - protein, 17 aa, Cryptosporidium parvum
GISDPYFILSIIEVTSK

SEQ ID NO: 2231403 - protein, 25 aa, Cryptosporidium parvum
GISGRGMKVFRCLIKGNCINTTNED

SEQ ID NO: 2231404 - protein, 19 aa, Cryptosporidium parvum
GISLSCTFASRSRFMQMFP

SEQ ID NO: 2231405 - protein, 22 aa, Cryptosporidium parvum
GISRNNPYFIVRQGKVAELATM

SEQ ID NO: 2231406 - protein, 19 aa, Cryptosporidium parvum
GISSFGFGGTNSHVIIEEG

SEQ ID NO: 2231407 - protein, 22 aa, Cryptosporidium parvum
GISSFIPLVSIFKVKRNIAPRC

SEQ ID NO: 2231408 - protein, 20 aa, Cryptosporidium parvum
GISVVFSLRSKVGIIMAIFF

SEQ ID NO: 2231409 - protein, 25 aa, Cryptosporidium parvum
GITEGRSSIPFGIIPDLNFHLRRYT

SEQ ID NO: 2231410 - protein, 17 aa, Cryptosporidium parvum
GITKCLFVTEAEFITEI

SEQ ID NO: 2231411 - protein, 27 aa, Cryptosporidium parvum
GIVICVFCYSYFIGCSFSLFTSAFGYT

SEQ ID NO: 2231412 - protein, 20 aa, Cryptosporidium parvum
GIYLCMVVGIGLPLMQEGLL

SEQ ID NO: 2231413 - protein, 25 aa, Cryptosporidium parvum
GIYPSIKMILGRSGRRRTIEDNPKN

SEQ ID NO: 2231414 - protein, 19 aa, Cryptosporidium parvum
GKALALRLAKLSKESNITL

SEQ ID NO: 2231415 - protein, 23 aa, Cryptosporidium parvum
GKDEFKFVRGFVFNDSVESRSSR

SEQ ID NO: 2231416 - protein, 23 aa, Cryptosporidium parvum
GKDIRKIPLMFPFLEGEDTKNII

SEQ ID NO: 2231417 - protein, 19 aa, Cryptosporidium parvum
GKDLSKLFLVFDGLNENAS

SEQ ID NO: 2231418 - protein, 19 aa, Cryptosporidium parvum
GKDYCGWIVSDLFSPIGMN

SEQ ID NO: 2231419 - protein, 19 aa, Cryptosporidium parvum
GKEVSRIMDNYALEELNKE

SEQ ID NO: 2231420 - protein, 19 aa, Cryptosporidium parvum
GKFAMLRRNLVSVISAWGE

SEQ ID NO: 2231421 - protein, 23 aa, Cryptosporidium parvum
GKFSCYFYYWSFCQCSKPWKLKF

SEQ ID NO: 2231422 - protein, 25 aa, Cryptosporidium parvum
GKGRRGTRFSIIWRKPEEDKERTNE

SEQ ID NO: 2231423 - protein, 22 aa, Cryptosporidium parvum
GKGVLFFGVMFWSLCMIFTSFL

SEQ ID NO: 2231424 - protein, 28 aa, Cryptosporidium parvum
GKHKLRAGMICWIECFFVLFQGGANYLY

SEQ ID NO: 2231425 - protein, 20 aa, Cryptosporidium parvum
GKIELFNYNSIREFWKITSV

SEQ ID NO: 2231426 - protein, 31 aa, Cryptosporidium parvum; identical to SEQ ID NO: 2123536

SEQ ID NO: 2231427 - protein, 20 aa, Cryptosporidium parvum
GKKALKRYFVDLCDSAEVVI

SEQ ID NO: 2231428 - protein, 26 aa, Cryptosporidium parvum
GKKLPPRIKSCIIRYYTLNLLAYLLS

SEQ ID NO: 2231429 - protein, 32 aa, Cryptosporidium parvum; identical to SEQ ID NO: 2172009

SEQ ID NO: 2231430 - protein, 21 aa, Cryptosporidium parvum
GKKVMGIYGFCDIRNFTDATE

SEQ ID NO: 2231431 - protein, 25 aa, Cryptosporidium parvum
GKKYPKLHHGRAIYKKEGKTNGNAT

SEQ ID NO: 2231432 - protein, 20 aa, Cryptosporidium parvum
GKLARPVIECLKSLKNYIRD

SEQ ID NO: 2231433 - protein, 17 aa, Cryptosporidium parvum
GKLASLIATDWTGNGKV

SEQ ID NO: 2231434 - protein, 17 aa, Cryptosporidium parvum
GKLEFPYGWPRNIDIAL

SEQ ID NO: 2231435 - protein, 18 aa, Cryptosporidium parvum
GKLINFYSLFLIIIFILI

SEQ ID NO: 2231436 - protein, 23 aa, Cryptosporidium parvum
GKLKMEISVAFGTCYFIYRGVNK

SEQ ID NO: 2231437 - protein, 18 aa, Cryptosporidium parvum
GKLRICAFDKTGTLTSDK

SEQ ID NO: 2231438 - protein, 20 aa, Cryptosporidium parvum
GKLVWMVPLININRINLYLV

SEQ ID NO: 2231439 - protein, 17 aa, Cryptosporidium parvum
GKMIIKKSLSFNYNLHW

SEQ ID NO: 2231440 - protein, 23 aa, Cryptosporidium parvum
GKMPQKLIISFAMLENHKLLNKY

SEQ ID NO: 2231441 - protein, 20 aa, Cryptosporidium parvum
GKNFDILKCICVCIFTSFFG

SEQ ID NO: 2231442 - protein, 26 aa, Cryptosporidium parvum
GKNSSRRTLMWFSISIIIVLLNIFIG

SEQ ID NO: 2231443 - protein, 20 aa, Cryptosporidium parvum
GKRQELSVHRFLKPSFSSYY

SEQ ID NO: 2231444 - protein, 30 aa, Cryptosporidium parvum; identical to SEQ ID NO: 2123541

SEQ ID NO: 2231445 - protein, 25 aa, Cryptosporidium parvum
GKSFTRLSLEPEIIYIFDSIRQIRI

SEQ ID NO: 2231446 - protein, 23 aa, Cryptosporidium parvum
GKSIFPRMNLGLDLDLDLEIDEE

SEQ ID NO: 2231447 - protein, 22 aa, Cryptosporidium parvum
GKSIRMYLQFQTVWDGNKKGKQ

SEQ ID NO: 2231448 - protein, 19 aa, Cryptosporidium parvum
GKSSILKLILRLYDPDKGK

SEQ ID NO: 2231449 - protein, 28 aa, Cryptosporidium parvum
GKVIPGSLPGSLNYPSFNTPQQTDEITG

SEQ ID NO: 2231450 - protein, 20 aa, Cryptosporidium parvum
GKVRLPLSVVLFGYGIMMDY

SEQ ID NO: 2231451 - protein, 19 aa, Cryptosporidium parvum
GKYKFSGLYLPGLPLLNTH

SEQ ID NO: 2231452 - protein, 18 aa, Cryptosporidium parvum
GKYLKALSTLKHRIEDIP

SEQ ID NO: 2231453 - protein, 19 aa, Cryptosporidium parvum
GKYSFPGSYSQSLCFQCSI

SEQ ID NO: 2231454 - protein, 18 aa, Cryptosporidium parvum
GKYYKLRKSVGIFAAESL

SEQ ID NO: 2231455 - protein, 24 aa, Cryptosporidium parvum
GLAAMLISFANLWTPFQSSEEEFS

SEQ ID NO: 2231456 - protein, 18 aa, Cryptosporidium parvum
GLASFLLLETYPNKKRIN

SEQ ID NO: 2231457 - protein, 24 aa, Cryptosporidium parvum
GLCRGDVGIKEILGNVNWGIYFGQ

SEQ ID NO: 2231458 - protein, 18 aa, Cryptosporidium parvum
GLEPRSFFMGTLSSFFQS

SEQ ID NO: 2231459 - protein, 22 aa, Cryptosporidium parvum
GLESGHLWVKSSLYRLVTNLLK

SEQ ID NO: 2231460 - protein, 18 aa, Cryptosporidium parvum
GLFAGWPGIGACRPILCE

SEQ ID NO: 2231461 - protein, 21 aa, Cryptosporidium parvum
GLFCVPISIILPALFHLTLFK

SEQ ID NO: 2231462 - protein, 23 aa, Cryptosporidium parvum
GLFCVPLNILLPALFHFIIFRKE

SEQ ID NO: 2231463 - protein, 22 aa, Cryptosporidium parvum
GLFPNIPSEFYLKYGSASVVIS

SEQ ID NO: 2231464 - protein, 24 aa, Cryptosporidium parvum
GLGDRGRLGYTRGYTEFGNEHDKN

SEQ ID NO: 2231465 - protein, 19 aa, Cryptosporidium parvum
GLGERLAFEGIKIGIELSM

SEQ ID NO: 2231466 - protein, 25 aa, Cryptosporidium parvum
GLGIGWKLLAAVGFTAIVLQIISII

SEQ ID NO: 2231467 - protein, 17 aa, Cryptosporidium parvum
GLGKLYWYLTILGLLSY

SEQ ID NO: 2231468 - protein, 18 aa, Cryptosporidium parvum
GLGNEFLFNLLFLNDYNI

SEQ ID NO: 2231469 - protein, 17 aa, Cryptosporidium parvum
GLGPNINVFHIHKSTNF

SEQ ID NO: 2231470 - protein, 17 aa, Cryptosporidium parvum
GLIFICIDYLIRTSNFS

SEQ ID NO: 2231471 - protein, 17 aa, Cryptosporidium parvum
GLILEEFDSLQLNWSCL

SEQ ID NO: 2231472 - protein, 23 aa, Cryptosporidium parvum
GLIPSLLTILSCEYSIHSQSFRR

SEQ ID NO: 2231473 - protein, 18 aa, Cryptosporidium parvum
GLIQRCLIHQIRAYSELK

SEQ ID NO: 2231474 - protein, 18 aa, Cryptosporidium parvum
GLISLLRIRTFISSHPDN

SEQ ID NO: 2231475 - protein, 24 aa, Cryptosporidium parvum
GLKDPKYIFDMNVLNGFSQNQYLD

SEQ ID NO: 2231476 - protein, 23 aa, Cryptosporidium parvum
GLKICSVLCSLVARIEQVSSNEQ

SEQ ID NO: 2231477 - protein, 20 aa, Cryptosporidium parvum
GLKKNIRGGISFITSSNKLK

SEQ ID NO: 2231478 - protein, 17 aa, Cryptosporidium parvum
GLKNCIIDLIFFKENCG

SEQ ID NO: 2231479 - protein, 25 aa, Cryptosporidium parvum
GLKNHLRILWRRPRNDTSSNSDGLL

SEQ ID NO: 2231480 - protein, 17 aa, Cryptosporidium parvum
GLKVEWEPAQYLYKKYR

SEQ ID NO: 2231481 - protein, 17 aa, Cryptosporidium parvum
GLLADRYSRKYILATGV

SEQ ID NO: 2231482 - protein, 27 aa, Cryptosporidium parvum
GLLDGFFEFCDFFRQLLMTPIMFILYL

SEQ ID NO: 2231483 - protein, 31 aa, Cryptosporidium parvum
GLLEELKFEFPLDGLCSWWLNVKKINASPNY

SEQ ID NO: 2231484 - protein, 18 aa, Cryptosporidium parvum
GLLKSDLPTKVLDLNNER

SEQ ID NO: 2231485 - protein, 23 aa, Cryptosporidium parvum
GLLKSIICNTSLILNLVPFSGSK

SEQ ID NO: 2231486 - protein, 18 aa, Cryptosporidium parvum
GLLLGLFVHLLSVYDFYF

SEQ ID NO: 2231487 - protein, 18 aa, Cryptosporidium parvum
GLLLNPRKPHFETIQEQG

SEQ ID NO: 2231488 - protein, 19 aa, Cryptosporidium parvum
GLLMLPIITARTMFELLET

SEQ ID NO: 2231489 - protein, 31 aa, Cryptosporidium parvum; identical to SEQ ID NO: 2123564

SEQ ID NO: 2231490 - protein, 23 aa, Cryptosporidium parvum
GLLPCALVGHILSIFGYTLMFLL

SEQ ID NO: 2231491 - protein, 19 aa, Cryptosporidium parvum
GLLRAMEIEISKLLSKSEN

SEQ ID NO: 2231492 - protein, 19 aa, Cryptosporidium parvum
GLMDIYLRNCHQRLADQRI

SEQ ID NO: 2231493 - protein, 19 aa, Cryptosporidium parvum
GLMGLKILHYSNREVLKGF

SEQ ID NO: 2231494 - protein, 24 aa, Cryptosporidium parvum
GLMLEFINSYLFLGANKFYLYQNY

SEQ ID NO: 2231495 - protein, 19 aa, Cryptosporidium parvum
GLMLTAALMRYIAHQLGLL

SEQ ID NO: 2231496 - protein, 18 aa, Cryptosporidium parvum
GLMTLCYAGAHPEKVLKV

SEQ ID NO: 2231497 - protein, 17 aa, Cryptosporidium parvum
GLPCPKLLDSSPCNADI

SEQ ID NO: 2231498 - protein, 29 aa, Cryptosporidium parvum
GLPSDPSTGLPFIPGFNVLVDPQTGEQIK

SEQ ID NO: 2231499 - protein, 20 aa, Cryptosporidium parvum
GLRLNFCIHTSISTQCIDHN

SEQ ID NO: 2231500 - protein, 19 aa, Cryptosporidium parvum
GLSEFFLYIPANEASLTTH

SEQ ID NO: 2231501 - protein, 21 aa, Cryptosporidium parvum
GLSGISWKYLINLILVTVVVY

SEQ ID NO: 2231502 - protein, 18 aa, Cryptosporidium parvum
GLSKCGYTIVFALDNCEP

SEQ ID NO: 2231503 - protein, 24 aa, Cryptosporidium parvum
GLSKFLSYFQWRDFIFGQEHILGN

SEQ ID NO: 2231504 - protein, 17 aa, Cryptosporidium parvum
GLSMNFPVHITNIGDFV

SEQ ID NO: 2231505 - protein, 17 aa, Cryptosporidium parvum
GLSTIFGGITHETNLFF

SEQ ID NO: 2231506 - protein, 22 aa, Cryptosporidium parvum
GLTICSIFSGFGLHITKFLSPF

SEQ ID NO: 2231507 - protein, 36 aa, Cryptosporidium parvum; identical to SEQ ID NO: 2123577

SEQ ID NO: 2231508 - protein, 25 aa, Cryptosporidium parvum
GLVGIQRYFVWSIVQLGEFPDELYN

SEQ ID NO: 2231509 - protein, 21 aa, Cryptosporidium parvum
GLVSSCFAGALSLGGSLTNLF

SEQ ID NO: 2231510 - protein, 28 aa, Cryptosporidium parvum
GLYHIFRISINIILFIWSSLLLRLSLWI

SEQ ID NO: 2231511 - protein, 22 aa, Cryptosporidium parvum
GLYWAFIFFFIFLKTGQLTNIS

SEQ ID NO: 2231512 - protein, 20 aa, Cryptosporidium parvum
GMIDIFFFKFLSSVNKYRQK

SEQ ID NO: 2231513 - protein, 18 aa, Cryptosporidium parvum
GMLQRGIESNPNISASFL

SEQ ID NO: 2231514 - protein, 23 aa, Cryptosporidium parvum
GMNRSGSIFARIGAKGKAALDDT

SEQ ID NO: 2231515 - protein, 18 aa, Cryptosporidium parvum
GMQNRGGNGPGDMNSGMG

SEQ ID NO: 2231516 - protein, 21 aa, Cryptosporidium parvum
GMRHFPIKKLIALIQSHSDSR

SEQ ID NO: 2231517 - protein, 26 aa, Cryptosporidium parvum
GMRNAEVIKAFIWNKDYKKLTPQPVP

SEQ ID NO: 2231518 - protein, 18 aa, Cryptosporidium parvum
GMSDLLICNDNFPKNSQC

SEQ ID NO: 2231519 - protein, 32 aa, Cryptosporidium parvum; identical to SEQ ID NO: 2123585

SEQ ID NO: 2231520 - protein, 20 aa, Cryptosporidium parvum
GMVGAMLRHFSSLRKMKRDN

SEQ ID NO: 2231521 - protein, 26 aa, Cryptosporidium parvum
GNDVFKLSRLISAHLFYSATFLLVAL

SEQ ID NO: 2231522 - protein, 28 aa, Cryptosporidium parvum
GNESIKIHPRFRLFSCMNPVIVPIEQKE

SEQ ID NO: 2231523 - protein, 25 aa, Cryptosporidium parvum
GNFKYICSWAKLLGLTISSFLFIWV

SEQ ID NO: 2231524 - protein, 25 aa, Cryptosporidium parvum
GNGHGIPNFSLRTFSSCLSYIRTIL

SEQ ID NO: 2231525 - protein, 24 aa, Cryptosporidium parvum
GNIIRYKYTFYKYVKYSLIIDLIL

SEQ ID NO: 2231526 - protein, 17 aa, Cryptosporidium parvum
GNINLILKLFSDLDQNN

SEQ ID NO: 2231527 - protein, 23 aa, Cryptosporidium parvum
GNINRPLLFHFLRQLISENRNQN

SEQ ID NO: 2231528 - protein, 17 aa, Cryptosporidium parvum
GNKFLASNGYIFVARIL

SEQ ID NO: 2231529 - protein, 20 aa, Cryptosporidium parvum
GNLELKCTSSNEVWSMTILD

SEQ ID NO: 2231530 - protein, 26 aa, Cryptosporidium parvum
GNLFKEFFELPNGCVCCTVKDELLKA

SEQ ID NO: 2231531 - protein, 19 aa, Cryptosporidium parvum
GNLHFTYILSSISIYSINS

SEQ ID NO: 2231532 - protein, 25 aa, Cryptosporidium parvum
GNLHTCYIPIYLYILGCFSIDCLAL

SEQ ID NO: 2231533 - protein, 18 aa, Cryptosporidium parvum
GNNFKLRIYELILGKLQE

SEQ ID NO: 2231534 - protein, 21 aa, Cryptosporidium parvum
GNNSIFMWVILGFIVLLLTLI

SEQ ID NO: 2231535 - protein, 19 aa, Cryptosporidium parvum
GNNTRLFLRTKLIPSQYLI

SEQ ID NO: 2231536 - protein, 19 aa, Cryptosporidium parvum
GNNWIKVGGGKVLGKEFNE

SEQ ID NO: 2231537 - protein, 22 aa, Cryptosporidium parvum
GNPGRRWCWKFVKHAQVSYFPF

SEQ ID NO: 2231538 - protein, 21 aa, Cryptosporidium parvum
GNRGSSLLLKAIKKVSSALSS

SEQ ID NO: 2231539 - protein, 18 aa, Cryptosporidium parvum
GNSGKLWVRGDISAGEVV

SEQ ID NO: 2231540 - protein, 22 aa, Cryptosporidium parvum
GNSIKFGKRFLSLFKQDFGIPQ

SEQ ID NO: 2231541 - protein, 20 aa, Cryptosporidium parvum
GNSLLSMLLGIHLVASIGGA

SEQ ID NO: 2231542 - protein, 31 aa, Cryptosporidium parvum; identical to SEQ ID NO: 2123604

SEQ ID NO: 2231543 - protein, 28 aa, Cryptosporidium parvum
GNTGRIPIPIKFGFGPLFDSVFQDELQE

SEQ ID NO: 2231544 - protein, 37 aa, Cryptosporidium parvum
GNTISVRCRKGAGKLEFPDRSLDFTIPPVAGHNSCSI

SEQ ID NO: 2231545 - protein, 24 aa, Cryptosporidium parvum
GNTLKSSDILSMFGTQSLTVVIAK

SEQ ID NO: 2231546 - protein, 24 aa, Cryptosporidium parvum
GNVEEAKRLISAVLGSRNLGDPDD

SEQ ID NO: 2231547 - protein, 29 aa, Cryptosporidium parvum
GNVIRYMFCKGLQYPTSGWLRLNHLNCGV

SEQ ID NO: 2231548 - protein, 18 aa, Cryptosporidium parvum
GNVNYKLPYILKSSFTSD

SEQ ID NO: 2231549 - protein, 20 aa, Cryptosporidium parvum
GPAARGLTCSGSVHMTTRMG

SEQ ID NO: 2231550 - protein, 17 aa, Cryptosporidium parvum
GPCGVLASLNGFIISQL

SEQ ID NO: 2231551 - protein, 20 aa, Cryptosporidium parvum
GPDGLSYLKIRSILDENLGF

SEQ ID NO: 2231552 - protein, 22 aa, Cryptosporidium parvum
GPDLKPFCVFCRNQSNHGPYTY

SEQ ID NO: 2231553 - protein, 17 aa, Cryptosporidium parvum
GPDSVGFSREYRPCYTH

SEQ ID NO: 2231554 - protein, 18 aa, Cryptosporidium parvum
GPFFFRFFSNNSFILTFF

SEQ ID NO: 2231555 - protein, 19 aa, Cryptosporidium parvum
GPFSPPAILVCFRSANPNK

SEQ ID NO: 2231556 - protein, 17 aa, Cryptosporidium parvum
GPHYTGMMVGGRHVGIE

SEQ ID NO: 2231557 - protein, 24 aa, Cryptosporidium parvum
GPIIRAFRAQDHYMLQGTEIIDMV

SEQ ID NO: 2231558 - protein, 19 aa, Cryptosporidium parvum
GPLFDFSKTFQFIRNYLEV

SEQ ID NO: 2231559 - protein, 19 aa, Cryptosporidium parvum
GPLPLRRVVTILSSVTLAF

SEQ ID NO: 2231560 - protein, 23 aa, Cryptosporidium parvum
GPNGRINYALSFPNIEKAAYKGP

SEQ ID NO: 2231561 - protein, 18 aa, Cryptosporidium parvum
GPPPDWQLSVTISTSAHF

SEQ ID NO: 2231562 - protein, 19 aa, Cryptosporidium parvum
GPRITRIVLKIKQILRDNI

SEQ ID NO: 2231563 - protein, 25 aa, Cryptosporidium parvum
GPSTREWIQLPSISGGGRFVPLSEI

SEQ ID NO: 2231564 - protein, 23 aa, Cryptosporidium parvum
GPTSMKVGIGLPSFLVSKKYQLF

SEQ ID NO: 2231565 - protein, 21 aa, Cryptosporidium parvum
GPTYFPHFHPLRMPKSKLEWK

SEQ ID NO: 2231566 - protein, 17 aa, Cryptosporidium parvum
GPYYPCHSIVYSNVNKL

SEQ ID NO: 2231567 - protein, 24 aa, Cryptosporidium parvum
GQFCDQCLNLIRYLDSNDFRMKSY

SEQ ID NO: 2231568 - protein, 26 aa, Cryptosporidium parvum
GQGYIKLRGSYLLRLLHSLVDRDHNI

SEQ ID NO: 2231569 - protein, 17 aa, Cryptosporidium parvum
GQHYVPPIVQRVFYGLC

SEQ ID NO: 2231570 - protein, 19 aa, Cryptosporidium parvum
GQILWDMASKFSHIPQHFS

SEQ ID NO: 2231571 - protein, 23 aa, Cryptosporidium parvum
GQKTLVALAFLFALHRADPAPMY

SEQ ID NO: 2231572 - protein, 26 aa, Cryptosporidium parvum
GQKTRICIARTLYFFFSNMDSNSKSE

SEQ ID NO: 2231573 - protein, 20 aa, Cryptosporidium parvum
GQKYMTEFFNNGGAFSSFSY

SEQ ID NO: 2231574 - protein, 22 aa, Cryptosporidium parvum
GQLCNLELKYKGNHHFEEINSN

SEQ ID NO: 2231575 - protein, 19 aa, Cryptosporidium parvum
GQLLYKTVHSFSNISQYSV

SEQ ID NO: 2231576 - protein, 17 aa, Cryptosporidium parvum
GQLSFISFFLLTGGSWS

SEQ ID NO: 2231577 - protein, 17 aa, Cryptosporidium parvum
GQTGVWIEYISKIRRDI

SEQ ID NO: 2231578 - protein, 19 aa, Cryptosporidium parvum
GQTPLHLAVLIGNEEVIME

SEQ ID NO: 2231579 - protein, 17 aa, Cryptosporidium parvum
GQVKFDLLDDVIGNLKR

SEQ ID NO: 2231580 - protein, 23 aa, Cryptosporidium parvum
GQWLCVSAIFVALGIQTVFSRKN

SEQ ID NO: 2231581 - protein, 21 aa, Cryptosporidium parvum
GRAEPPFPRIWSRSPKCRPWS

SEQ ID NO: 2231582 - protein, 23 aa, Cryptosporidium parvum
GRCARQLDKLGICLMLLSDEDYR

SEQ ID NO: 2231583 - protein, 22 aa, Cryptosporidium parvum
GREFKLIDSLGLFVNLSDVKRP

SEQ ID NO: 2231584 - protein, 26 aa, Cryptosporidium parvum
GRFINISSFLSRIGYKFGKSKHSETA

SEQ ID NO: 2231585 - protein, 22 aa, Cryptosporidium parvum
GRFKFLDDYKHEFGALNEEILL

SEQ ID NO: 2231586 - protein, 18 aa, Cryptosporidium parvum
GRGEGVATIILKKFNFKN

SEQ ID NO: 2231587 - protein, 24 aa, Cryptosporidium parvum
GRGPDIWNILTIYILFEDNTIFSI

SEQ ID NO: 2231588 - protein, 22 aa, Cryptosporidium parvum
GRGSYWTIIPLKIEGTVYPNWF

SEQ ID NO: 2231589 - protein, 20 aa, Cryptosporidium parvum
GRHFFTPSVIFSKFSGHLIP

SEQ ID NO: 2231590 - protein, 19 aa, Cryptosporidium parvum
GRIVKVPNYIFWLKKHEEV

SEQ ID NO: 2231591 - protein, 19 aa, Cryptosporidium parvum
GRKALGCNVFGLHYGTIGS

SEQ ID NO: 2231592 - protein, 27 aa, Cryptosporidium parvum
GRKCGKKFSVGFSVSINFNLRVTWKKN

SEQ ID NO: 2231593 - protein, 24 aa, Cryptosporidium parvum
GRKKIEDFAPFAFFTTSKGSGGGI

SEQ ID NO: 2231594 - protein, 20 aa, Cryptosporidium parvum
GRKLPLCNFPLLDNNAYNID

SEQ ID NO: 2231595 - protein, 29 aa, Cryptosporidium parvum
GRKRSTNLLKSWFSKAFKQGLSLSPKLNN

SEQ ID NO: 2231596 - protein, 18 aa, Cryptosporidium parvum
GRLKYTYMQPNDFLENHY

SEQ ID NO: 2231597 - protein, 21 aa, Cryptosporidium parvum
GRLNFDFCRWVISNIDGNSIG

SEQ ID NO: 2231598 - protein, 17 aa, Cryptosporidium parvum
GRMPGHMNVLLAEADVP

SEQ ID NO: 2231599 - protein, 24 aa, Cryptosporidium parvum
GRPEISRLGSIYGAGLVLGTSAFN

SEQ ID NO: 2231600 - protein, 24 aa, Cryptosporidium parvum
GRPYSPAYTRGWYVQPRKFSAHDI

SEQ ID NO: 2231601 - protein, 24 aa, Cryptosporidium parvum
GRRKRGGRRNCHDFYYNREELGYL

SEQ ID NO: 2231602 - protein, 24 aa, Cryptosporidium parvum
GRSCKSVIYRRADFFRRKNHKTEH

SEQ ID NO: 2231603 - protein, 17 aa, Cryptosporidium parvum
GRSGLILVDTSIFFSQL

SEQ ID NO: 2231604 - protein, 17 aa, Cryptosporidium parvum
GRSLYKYECIVTSENTC

SEQ ID NO: 2231605 - protein, 25 aa, Cryptosporidium parvum
GRSPVFLSHIFDLLAFDQSIQEQLG

SEQ ID NO: 2231606 - protein, 22 aa, Cryptosporidium parvum
GRSSIDFENKFAIKLLELSEKG

SEQ ID NO: 2231607 - protein, 37 aa, Cryptosporidium parvum; identical to SEQ ID NO: 2123634

SEQ ID NO: 2231608 - protein, 19 aa, Cryptosporidium parvum
GRTCLRSSIINKKVISMSN

SEQ ID NO: 2231609 - protein, 20 aa, Cryptosporidium parvum
GRTPLFYAISQLDIGLVNYL

SEQ ID NO: 2231610 - protein, 27 aa, Cryptosporidium parvum
GRTTNVLKLCRFCIEFLICQRENKLEK

SEQ ID NO: 2231611 - protein, 26 aa, Cryptosporidium parvum
GRVKYWMMLCEAVGNFYHWLSIIKET

SEQ ID NO: 2231612 - protein, 23 aa, Cryptosporidium parvum
GRVLCGAGVGFSCNLVPSYIFEL

SEQ ID NO: 2231613 - protein, 17 aa, Cryptosporidium parvum
GRVMLGLYHIFRISINI

SEQ ID NO: 2231614 - protein, 18 aa, Cryptosporidium parvum
GSAAYFIDKIQKILRLIS

SEQ ID NO: 2231615 - protein, 20 aa, Cryptosporidium parvum
GSDTQLTWIWRELKKDSSSY

SEQ ID NO: 2231616 - protein, 18 aa, Cryptosporidium parvum
GSEKANNFMAIWLDAQRI

SEQ ID NO: 2231617 - protein, 18 aa, Cryptosporidium parvum
GSFFALGLINAGYMDQKS

SEQ ID NO: 2231618 - protein, 20 aa, Cryptosporidium parvum
GSFGKVFLVRERCSGLTRVC

SEQ ID NO: 2231619 - protein, 24 aa, Cryptosporidium parvum
GSFSFKRGYLYITVLNSISVSLSV

SEQ ID NO: 2231620 - protein, 18 aa, Cryptosporidium parvum
GSFVKPWVPFVMGLGSEK

SEQ ID NO: 2231621 - protein, 20 aa, Cryptosporidium parvum
GSGATFWSSPSFTRASFTRV

SEQ ID NO: 2231622 - protein, 26 aa, Cryptosporidium parvum
GSGKSNILAAIQFLLSDSFGNTLVER

SEQ ID NO: 2231623 - protein, 17 aa, Cryptosporidium parvum
GSHILLKAYKPRAYFGF

SEQ ID NO: 2231624 - protein, 20 aa, Cryptosporidium parvum
GSHSGTFMPVPGKPQGENGG

SEQ ID NO: 2231625 - protein, 27 aa, Cryptosporidium parvum
GSIEFYLCILFSIALIFFGGILSGLTT

SEQ ID NO: 2231626 - protein, 27 aa, Cryptosporidium parvum
GSIFYLLFKDCRGIVLSSFDHYKINKY

SEQ ID NO: 2231627 - protein, 25 aa, Cryptosporidium parvum
GSIIRAFRCGHVFLNRNINYIDNLQ

SEQ ID NO: 2231628 - protein, 25 aa, Cryptosporidium parvum
GSIKVIRPGRRISMTNFGLIPPNKL

SEQ ID NO: 2231629 - protein, 20 aa, Cryptosporidium parvum
GSINRLTQQFGRCGRDHKTK

SEQ ID NO: 2231630 - protein, 25 aa, Cryptosporidium parvum
GSIQILLCTISLYLTQSTYFSLMSL

SEQ ID NO: 2231631 - protein, 24 aa, Cryptosporidium parvum
GSKDKLIPFHIFLQTSIFMSTELE

SEQ ID NO: 2231632 - protein, 20 aa, Cryptosporidium parvum
GSKEKIIMGRNIGKNKMSYK

SEQ ID NO: 2231633 - protein, 21 aa, Cryptosporidium parvum
GSKYKDIFSLIPYVKDKKEIQ

SEQ ID NO: 2231634 - protein, 30 aa, Cryptosporidium parvum
GSLFKAPFMRYRDIRISKTHEMLRQITQIW

SEQ ID NO: 2231635 - protein, 24 aa, Cryptosporidium parvum
GSLHPLNVGLVFKVYKELNYNDIQ

SEQ ID NO: 2231636 - protein, 27 aa, Cryptosporidium parvum
GSLIYPTKQWIPIGILRRNQILPKEMF

SEQ ID NO: 2231637 - protein, 24 aa, Cryptosporidium parvum
GSLNSYPWIWLKSILEICKDTKQV

SEQ ID NO: 2231638 - protein, 32 aa, Cryptosporidium parvum
GSLYKIKFMKFRDVRILKCHEYLSSLPIIRNL

SEQ ID NO: 2231639 - protein, 20 aa, Cryptosporidium parvum
GSNFKHLNWYHLYPRTSEMV

SEQ ID NO: 2231640 - protein, 18 aa, Cryptosporidium parvum
GSNPEFIKWCESKGSSAQ

SEQ ID NO: 2231641 - protein, 24 aa, Cryptosporidium parvum
GSPRIQLFSDLECNLYRGLSKINE

SEQ ID NO: 2231642 - protein, 17 aa, Cryptosporidium parvum
GSQIASRIHQDFLTRIN

SEQ ID NO: 2231643 - protein, 25 aa, Cryptosporidium parvum
GSRFREFTLDYALREINKLISALCD

SEQ ID NO: 2231644 - protein, 22 aa, Cryptosporidium parvum
GSRGKSGVLYHLDFNTLGQVQC

SEQ ID NO: 2231645 - protein, 28 aa, Cryptosporidium parvum
GSSDFYFKLSLIELKAVGGFGAGQAESS

SEQ ID NO: 2231646 - protein, 17 aa, Cryptosporidium parvum
GSSGFLCDDCEDGYAKI

SEQ ID NO: 2231647 - protein, 24 aa, Cryptosporidium parvum
GSSISYILCCLYYNFLDLNPEIQN

SEQ ID NO: 2231648 - protein, 32 aa, Cryptosporidium parvum
GSSKRRARKIMTKKGLSLLIKEFNTSKTKKKI

SEQ ID NO: 2231649 - protein, 17 aa, Cryptosporidium parvum
GSSLIHNVFNWKLKILI

SEQ ID NO: 2231650 - protein, 19 aa, Cryptosporidium parvum
GSSLLRFLECKKLKNKQGL

SEQ ID NO: 2231651 - protein, 18 aa, Cryptosporidium parvum
GSVLSNKQIYCFICTSNI

SEQ ID NO: 2231652 - protein, 26 aa, Cryptosporidium parvum
GSYICSCPIGWYGNGYICIPKGEKRD

SEQ ID NO: 2231653 - protein, 21 aa, Cryptosporidium parvum
GSYILHMMFILIGSLDYYNLD

SEQ ID NO: 2231654 - protein, 18 aa, Cryptosporidium parvum
GTCILEWTKMEKIPDTSE

SEQ ID NO: 2231655 - protein, 26 aa, Cryptosporidium parvum
GTDLDMRREMMLKRQFDYEAISNLGF

SEQ ID NO: 2231656 - protein, 22 aa, Cryptosporidium parvum
GTESEFSRYIGTGVVILAIQCI

SEQ ID NO: 2231657 - protein, 17 aa, Cryptosporidium parvum
GTFLILFSIIIDTANIR

SEQ ID NO: 2231658 - protein, 25 aa, Cryptosporidium parvum
GTFLTVWKLQFEIFNIDIYKEIIYR

SEQ ID NO: 2231659 - protein, 25 aa, Cryptosporidium parvum
GTGALGLIIAEWLIKCKNIRNIILL

SEQ ID NO: 2231660 - protein, 21 aa, Cryptosporidium parvum
GTHTIYWWLYILAIGAGFLNM

SEQ ID NO: 2231661 - protein, 18 aa, Cryptosporidium parvum
GTLYFKTKYPWYDYLAVI

SEQ ID NO: 2231662 - protein, 25 aa, Cryptosporidium parvum
GTLYIPNTCKIFFYQDGFLSSLWKF

SEQ ID NO: 2231663 - protein, 17 aa, Cryptosporidium parvum
GTNYRVATLEGNEKNVN

SEQ ID NO: 2231664 - protein, 21 aa, Cryptosporidium parvum
GTPAATLKCGAYTIVYAPIKD

SEQ ID NO: 2231665 - protein, 19 aa, Cryptosporidium parvum
GTPVYLSDWIFIYELLTGY

SEQ ID NO: 2231666 - protein, 25 aa, Cryptosporidium parvum
GTSSGRTSCFLRFQEVINRYKNRKG

SEQ ID NO: 2231667 - protein, 25 aa, Cryptosporidium parvum
GTTISIFPARLFKKITRGLFNNVSK

SEQ ID NO: 2231668 - protein, 18 aa, Cryptosporidium parvum
GTVPQVLSSLFYPLNPED

SEQ ID NO: 2231669 - protein, 19 aa, Cryptosporidium parvum
GTVYVCLREIMFRNYQQNS

SEQ ID NO: 2231670 - protein, 23 aa, Cryptosporidium parvum
GTYKRIPAQLVDRILAEEANWSL

SEQ ID NO: 2231671 - protein, 18 aa, Cryptosporidium parvum
GVAAIVILPKKECERKNK

SEQ ID NO: 2231672 - protein, 23 aa, Cryptosporidium parvum
GVDCGGVCEKKCPDTCFDGVLNG

SEQ ID NO: 2231673 - protein, 19 aa, Cryptosporidium parvum
GVFQGFSWLTILVIFLNAY

SEQ ID NO: 2231674 - protein, 21 aa, Cryptosporidium parvum
GVFSLPTFHFWILDNNSYILV

SEQ ID NO: 2231675 - protein, 24 aa, Cryptosporidium parvum
GVFVSIRISPRWIINNDVRQSRIS

SEQ ID NO: 2231676 - protein, 18 aa, Cryptosporidium parvum
GVICIMVQFGCRNQLQAA

SEQ ID NO: 2231677 - protein, 26 aa, Cryptosporidium parvum
GVKFYAFECGKGYSECSIWGIDGLPN

SEQ ID NO: 2231678 - protein, 24 aa, Cryptosporidium parvum
GVKHLKCGDEVYAMVPGCLNTFIV

SEQ ID NO: 2231679 - protein, 26 aa, Cryptosporidium parvum
GVKLHPGQIIMIWGFLLFILATILYC

SEQ ID NO: 2231680 - protein, 17 aa, Cryptosporidium parvum
GVLDCFFSDVDLISKIY

SEQ ID NO: 2231681 - protein, 20 aa, Cryptosporidium parvum
GVLPIGRPGLAVATIPISNF

SEQ ID NO: 2231682 - protein, 24 aa, Cryptosporidium parvum
GVLSRIISIFGQFFILSNKILLNK

SEQ ID NO: 2231683 - protein, 24 aa, Cryptosporidium parvum
GVLSRLDILLLFILPFNNITLFNS

SEQ ID NO: 2231684 - protein, 26 aa, Cryptosporidium parvum
GVNGRDGIRIELERRDILGVNDQTIE

SEQ ID NO: 2231685 - protein, 21 aa, Cryptosporidium parvum
GVPPKGTWVSWMHCIALVLGR

SEQ ID NO: 2231686 - protein, 23 aa, Cryptosporidium parvum
GVRILLEFDDSFNLERTMQSITV

SEQ ID NO: 2231687 - protein, 24 aa, Cryptosporidium parvum
GVRIQYLRFVFSFFDISFIESSKF

SEQ ID NO: 2231688 - protein, 20 aa, Cryptosporidium parvum
GVSFCSVLVIYLSQSLQDIL

SEQ ID NO: 2231689 - protein, 23 aa, Cryptosporidium parvum
GVTPSIFEKVWFHRNITENNEDQ

SEQ ID NO: 2231690 - protein, 19 aa, Cryptosporidium parvum
GVTTYEYLTKIVIEDETSK

SEQ ID NO: 2231691 - protein, 17 aa, Cryptosporidium parvum
GVVYSFRLSVLYTAITF

SEQ ID NO: 2231692 - protein, 17 aa, Cryptosporidium parvum
GWGGFYCSYPYLSSQSI

SEQ ID NO: 2231693 - protein, 25 aa, Cryptosporidium parvum
GWHKMVSHVRLTRAAGFVDDEGTVL

SEQ ID NO: 2231694 - protein, 20 aa, Cryptosporidium parvum
GWISLKRFSHHLGYSHLPSD

SEQ ID NO: 2231695 - protein, 26 aa, Cryptosporidium parvum
GWIVSDLFSPIGMNWISTVSPELGMI

SEQ ID NO: 2231696 - protein, 24 aa, Cryptosporidium parvum
GWLPESWRAYCLFIGENMMNKSSK

SEQ ID NO: 2231697 - protein, 22 aa, Cryptosporidium parvum
GWSEICFYNIGSYLSLLISRLT

SEQ ID NO: 2231698 - protein, 19 aa, Cryptosporidium parvum
GYFSIFFIYLFSRIIEADK

SEQ ID NO: 2231699 - protein, 24 aa, Cryptosporidium parvum
GYGSPRSPCCLITNYFTSITVISG

SEQ ID NO: 2231700 - protein, 18 aa, Cryptosporidium parvum
GYGYKCTHILSIDDILRY

SEQ ID NO: 2231701 - protein, 18 aa, Cryptosporidium parvum
GYIKLALHSGKKGTCGIL

SEQ ID NO: 2231702 - protein, 26 aa, Cryptosporidium parvum
GYKNPQCVPLTILENGCPMKQVGFKV

SEQ ID NO: 2231703 - protein, 22 aa, Cryptosporidium parvum
GYKSIKSFVLLAYFLNVFGVKD

SEQ ID NO: 2231704 - protein, 23 aa, Cryptosporidium parvum
GYLIFRISVIVGLLIVAIILYIY

SEQ ID NO: 2231705 - protein, 34 aa, Cryptosporidium parvum; identical to SEQ ID NO: 2123703

SEQ ID NO: 2231706 - protein, 19 aa, Cryptosporidium parvum
GYMGSSCCVVLKEKILELL

SEQ ID NO: 2231707 - protein, 18 aa, Cryptosporidium parvum
GYNEYFLYDMNKLASTQH

SEQ ID NO: 2231708 - protein, 18 aa, Cryptosporidium parvum
GYNFSRCYVFILTIFFGF

SEQ ID NO: 2231709 - protein, 19 aa, Cryptosporidium parvum
GYSLLPIVILAGISVVFSL

SEQ ID NO: 2231710 - protein, 18 aa, Cryptosporidium parvum
GYTIVFALDNCEPIIIGA

SEQ ID NO: 2231711 - protein, 21 aa, Cryptosporidium parvum
GYTSSILNWIDSIGIWNRIVF

SEQ ID NO: 2231712 - protein, 22 aa, Cryptosporidium parvum
GYYSEKFIKFIIESKNITCPNM

SEQ ID NO: 2231713 - protein, 18 aa, Cryptosporidium parvum
HAHFKIKIDATRSTLIFT

SEQ ID NO: 2231714 - protein, 20 aa, Cryptosporidium parvum
HAIGTWIVVCYLFSKYKKKD

SEQ ID NO: 2231715 - protein, 29 aa, Cryptosporidium parvum
HALKEGFNWSVCGFRHFFYNLKYTNSLIQ

SEQ ID NO: 2231716 - protein, 17 aa, Cryptosporidium parvum
HALLRSEVQFNEVSMIE

SEQ ID NO: 2231717 - protein, 26 aa, Cryptosporidium parvum
HANEVCGLIKLIRIIFSIFTYSVFIL

SEQ ID NO: 2231718 - protein, 20 aa, Cryptosporidium parvum
HASLTFRIIYYYGGGAADFL

SEQ ID NO: 2231719 - protein, 17 aa, Cryptosporidium parvum
HAVFAAFFFFNYRSNSY

SEQ ID NO: 2231720 - protein, 24 aa, Cryptosporidium parvum
HAYKNNLLMVSCIFISSNYEELDP

SEQ ID NO: 2231721 - protein, 25 aa, Cryptosporidium parvum
HCECKLEPLVSLSFVVQESISTYSE

SEQ ID NO: 2231722 - protein, 21 aa, Cryptosporidium parvum
HCFGEKTFGLFWGKNHNQGSF

SEQ ID NO: 2231723 - protein, 19 aa, Cryptosporidium parvum
HCILILTLFINFKVSGDLI

SEQ ID NO: 2231724 - protein, 21 aa, Cryptosporidium parvum
HCLSELLSLPCLKSRSICPSE

SEQ ID NO: 2231725 - protein, 25 aa, Cryptosporidium parvum
HDHHCPWLGVCIGEYNRCKFWWLSL

SEQ ID NO: 2231726 - protein, 23 aa, Cryptosporidium parvum
HDLDLAYYLAHCFEGQATMLYYF

SEQ ID NO: 2231727 - protein, 19 aa, Cryptosporidium parvum
HDLHVWSVSVGVPALSCHI

SEQ ID NO: 2231728 - protein, 17 aa, Cryptosporidium parvum
HDNEFLQFIIFPFQTFF

SEQ ID NO: 2231729 - protein, 18 aa, Cryptosporidium parvum
HDPHIYNGVLAYWSLQCL

SEQ ID NO: 2231730 - protein, 22 aa, Cryptosporidium parvum
HDSEFIDHVLLWLEETSHETFL

SEQ ID NO: 2231731 - protein, 18 aa, Cryptosporidium parvum
HDSIPYFIVYELEKIVFD

SEQ ID NO: 2231732 - protein, 17 aa, Cryptosporidium parvum
HDTERFFMTLSIAEAEL

SEQ ID NO: 2231733 - protein, 23 aa, Cryptosporidium parvum
HEFNISTYFLWKVLSNDLIINIY

SEQ ID NO: 2231734 - protein, 19 aa, Cryptosporidium parvum
HEKYLKFQIELACTNFDFC

SEQ ID NO: 2231735 - protein, 17 aa, Cryptosporidium parvum
HEMCKKYNLSNRVELLG

SEQ ID NO: 2231736 - protein, 18 aa, Cryptosporidium parvum
HESIPIYIQEFFRNEGIW

SEQ ID NO: 2231737 - protein, 20 aa, Cryptosporidium parvum
HEVDQSFHISVYIPQYIGYI

SEQ ID NO: 2231738 - protein, 19 aa, Cryptosporidium parvum
HEVLEKWNLPIIGILNKNH

SEQ ID NO: 2231739 - protein, 29 aa, Cryptosporidium parvum
HFESSLQLSIRFIVAFSKFINIHDQNKQF

SEQ ID NO: 2231740 - protein, 22 aa, Cryptosporidium parvum
HFFLQVVILLSINGISLGKESD

SEQ ID NO: 2231741 - protein, 20 aa, Cryptosporidium parvum
HFHPALPIHLFPKRIIQLLN

SEQ ID NO: 2231742 - protein, 20 aa, Cryptosporidium parvum
HFIEVCYRWTGPEKNQVFVK

SEQ ID NO: 2231743 - protein, 23 aa, Cryptosporidium parvum
HFKSRLGNQLVYGEVGFRDFFNK

SEQ ID NO: 2231744 - protein, 20 aa, Cryptosporidium parvum
HFPHITLSFNPPICILYAKL

SEQ ID NO: 2231745 - protein, 25 aa, Cryptosporidium parvum
HFPLFMAAITFIWAVSDSLCLYFTH

SEQ ID NO: 2231746 - protein, 20 aa, Cryptosporidium parvum
HFPVFPGFNPWIMKNILFIP

SEQ ID NO: 2231747 - protein, 23 aa, Cryptosporidium parvum
HFSSCTILSIAHRIHTIIDYDLI

SEQ ID NO: 2231748 - protein, 20 aa, Cryptosporidium parvum
HFVYLLIRNVVSFKFQAAIS

SEQ ID NO: 2231749 - protein, 23 aa, Cryptosporidium parvum
HGDFPKTATWHIMKLGDITLFLL

SEQ ID NO: 2231750 - protein, 19 aa, Cryptosporidium parvum
HGHSIAYEVCCRLRSTISA

SEQ ID NO: 2231751 - protein, 25 aa, Cryptosporidium parvum
HGISCCLLRIFGLAHFVDFLSDSVL

SEQ ID NO: 2231752 - protein, 23 aa, Cryptosporidium parvum
HGISLKSPFSISIFNFLTYNLIG

SEQ ID NO: 2231753 - protein, 22 aa, Cryptosporidium parvum
HGMGACIMTAIWLVQDLKSNLG

SEQ ID NO: 2231754 - protein, 28 aa, Cryptosporidium parvum
HGNRSFNIFDMFFFYKVLNFYYNDLNGA

SEQ ID NO: 2231755 - protein, 34 aa, Cryptosporidium parvum
HGPHTRLASILLPLIKKYRVDFIISGHDHHSEIL

SEQ ID NO: 2231756 - protein, 18 aa, Cryptosporidium parvum
HGSDTFGILFGMVNIPIV

SEQ ID NO: 2231757 - protein, 23 aa, Cryptosporidium parvum
HGSNPCWVRYIRVRAISYYEEGH

SEQ ID NO: 2231758 - protein, 17 aa, Cryptosporidium parvum
HGSRFFSFIGDYSSFGE

SEQ ID NO: 2231759 - protein, 25 aa, Cryptosporidium parvum
HGSTFRYKKLVGMLLESRGEIEKAL

SEQ ID NO: 2231760 - protein, 24 aa, Cryptosporidium parvum
HGTYMAHIPLMFTRKYIQEKKEEM

SEQ ID NO: 2231761 - protein, 19 aa, Cryptosporidium parvum
HGYFRIYWLEIPKLAFKLT

SEQ ID NO: 2231762 - protein, 17 aa, Cryptosporidium parvum
HHCPWIGQCVGLYNRKY

SEQ ID NO: 2231763 - protein, 17 aa, Cryptosporidium parvum
HHFRFSTQIKYFLISIF

SEQ ID NO: 2231764 - protein, 19 aa, Cryptosporidium parvum
HHLEIFEVMQFIYKIPIMV

SEQ ID NO: 2231765 - protein, 24 aa, Cryptosporidium parvum
HHPNELSFDWSFSKSFDYKYNKHS

SEQ ID NO: 2231766 - protein, 25 aa, Cryptosporidium parvum
HHRVSSAMPSEWTIPHVILDSLLSC

SEQ ID NO: 2231767 - protein, 22 aa, Cryptosporidium parvum
HHYITILLAWKVKEETKTMDYY

SEQ ID NO: 2231768 - protein, 24 aa, Cryptosporidium parvum
HIATRFGAILGLGLMDSGGRNVKA

SEQ ID NO: 2231769 - protein, 17 aa, Cryptosporidium parvum
HICHCFAHCSGKDRNTR

SEQ ID NO: 2231770 - protein, 17 aa, Cryptosporidium parvum
HIFKETFAKDIGLIIFL

SEQ ID NO: 2231771 - protein, 18 aa, Cryptosporidium parvum
HIFPFCLDSKQLLRGENE

SEQ ID NO: 2231772 - protein, 17 aa, Cryptosporidium parvum
HIGAIFLSYGYFNIQPS

SEQ ID NO: 2231773 - protein, 19 aa, Cryptosporidium parvum
HIILYWTGLSVDFFGFITA

SEQ ID NO: 2231774 - protein, 24 aa, Cryptosporidium parvum
HIIPWKGILRWIDSWEGVFLQSVL

SEQ ID NO: 2231775 - protein, 18 aa, Cryptosporidium parvum
HIIRTCLRIKYMNNYIKF

SEQ ID NO: 2231776 - protein, 18 aa, Cryptosporidium parvum
HILIGWNKFVLKKFMVYT

SEQ ID NO: 2231777 - protein, 17 aa, Cryptosporidium parvum
HILIRYRYEIHSFYCNI

SEQ ID NO: 2231778 - protein, 45 aa, Cryptosporidium parvum
HILLKAYKPRAYFGFNCIIDFYYYLSHSWRSSAFSKLVVSEDHSI

SEQ ID NO: 2231779 - protein, 18 aa, Cryptosporidium parvum
HINFGCSPHCKKKLLDQL

SEQ ID NO: 2231780 - protein, 20 aa, Cryptosporidium parvum
HINYIWKYSNGNIFNKFDNN

SEQ ID NO: 2231781 - protein, 23 aa, Cryptosporidium parvum
HIPIRMSMEGAKLVRVHPEKALE

SEQ ID NO: 2231782 - protein, 19 aa, Cryptosporidium parvum
HIQHYWVSKSFNYSFKPQI

SEQ ID NO: 2231783 - protein, 23 aa, Cryptosporidium parvum
HIRQMAFYRYLRCLEAGGKEAQT

SEQ ID NO: 2231784 - protein, 17 aa, Cryptosporidium parvum
HIYCFNLLVLLIMIPFG

SEQ ID NO: 2231785 - protein, 27 aa, Cryptosporidium parvum
HIYNDFLFEFIIKFILKQESCQPLLNV

SEQ ID NO: 2231786 - protein, 26 aa, Cryptosporidium parvum
HKDDSVYEIFKWIDSLALDKNNLISD

SEQ ID NO: 2231787 - protein, 25 aa, Cryptosporidium parvum
HKDPFIVSGSYSFKGVESGLIYRSP

SEQ ID NO: 2231788 - protein, 25 aa, Cryptosporidium parvum
HKEELRKLFGPESVTVPILYSNKGP

SEQ ID NO: 2231789 - protein, 17 aa, Cryptosporidium parvum
HKFNDWLPKDIFPGRIE

SEQ ID NO: 2231790 - protein, 18 aa, Cryptosporidium parvum
HKIKFGINNIFNLPIFEL

SEQ ID NO: 2231791 - protein, 19 aa, Cryptosporidium parvum
HKKVISWIIQQISRLENNP

SEQ ID NO: 2231792 - protein, 21 aa, Cryptosporidium parvum
HKKYPILRPKYNIREKNKVKN

SEQ ID NO: 2231793 - protein, 23 aa, Cryptosporidium parvum
HKPLYRLVDEVSYNTPYEYFNVV

SEQ ID NO: 2231794 - protein, 19 aa, Cryptosporidium parvum
HKSNHCSPVKLNLLEIPPS

SEQ ID NO: 2231795 - protein, 20 aa, Cryptosporidium parvum
HKTGNSWIWNTIKGNQIQEI

SEQ ID NO: 2231796 - protein, 17 aa, Cryptosporidium parvum
HKVDPRLEGAIYNVISF

SEQ ID NO: 2231797 - protein, 20 aa, Cryptosporidium parvum
HLCNRGQYQFLYDTFKKNYF

SEQ ID NO: 2231798 - protein, 18 aa, Cryptosporidium parvum
HLDHCGALPFFTEKIGYK

SEQ ID NO: 2231799 - protein, 23 aa, Cryptosporidium parvum
HLDPINLSHCWSIHTAQAAQVFQ

SEQ ID NO: 2231800 - protein, 19 aa, Cryptosporidium parvum
HLEAFVAPLRNGAVRFSLK

SEQ ID NO: 2231801 - protein, 23 aa, Cryptosporidium parvum
HLGLVKEIFCSRSECSDEKLFEP

SEQ ID NO: 2231802 - protein, 24 aa, Cryptosporidium parvum
HLIFYEIPRYSPIGLLSSLGAIYD

SEQ ID NO: 2231803 - protein, 17 aa, Cryptosporidium parvum
HLIIYSIAPFIVYIYNR

SEQ ID NO: 2231804 - protein, 25 aa, Cryptosporidium parvum
HLILYPVRFGFFGYIFFNSNWNTFL

SEQ ID NO: 2231805 - protein, 22 aa, Cryptosporidium parvum
HLIRFDLPDGRSLELLRDTMQE

SEQ ID NO: 2231806 - protein, 20 aa, Cryptosporidium parvum
HLIYKYLIKNIFNYILNFIS

SEQ ID NO: 2231807 - protein, 26 aa, Cryptosporidium parvum
HLKIECLDIRKALIHFFDRIKQYGQT

SEQ ID NO: 2231808 - protein, 20 aa, Cryptosporidium parvum
HLKIHCRTLREFGTNHPKFK

SEQ ID NO: 2231809 - protein, 21 aa, Cryptosporidium parvum
HLKLIMIAQSLLFVINNAIDT

SEQ ID NO: 2231810 - protein, 17 aa, Cryptosporidium parvum
HLKREFFENDLIFCGFL

SEQ ID NO: 2231811 - protein, 19 aa, Cryptosporidium parvum
HLKVHSCLGDHDWRGSTTA

SEQ ID NO: 2231812 - protein, 25 aa, Cryptosporidium parvum
HLLGIRCSINLLPEDFLVQIITKLL

SEQ ID NO: 2231813 - protein, 18 aa, Cryptosporidium parvum
HLLKQIDSLFSLKHSFLW

SEQ ID NO: 2231814 - protein, 17 aa, Cryptosporidium parvum
HLNTSFFRLRTCSKSLR

SEQ ID NO: 2231815 - protein, 36 aa, Cryptosporidium parvum
HLQLRGRKCPSCFSGLGARIRRFFGRGERGIRRRQE

SEQ ID NO: 2231816 - protein, 19 aa, Cryptosporidium parvum
HLQPLVLIHGRLCYRRTSI

SEQ ID NO: 2231817 - protein, 17 aa, Cryptosporidium parvum
HLRECIMDINAWKMKAY

SEQ ID NO: 2231818 - protein, 18 aa, Cryptosporidium parvum
HLWDLRKSAILDSLELST

SEQ ID NO: 2231819 - protein, 18 aa, Cryptosporidium parvum
HLYFLSLQGHENQYIKLV

SEQ ID NO: 2231820 - protein, 17 aa, Cryptosporidium parvum
HLYYRLIGDNSKFKINY

SEQ ID NO: 2231821 - protein, 17 aa, Cryptosporidium parvum
HMECYDILSYINLNGVL

SEQ ID NO: 2231822 - protein, 20 aa, Cryptosporidium parvum
HMNYMYGLIIIFIFGILTHL

SEQ ID NO: 2231823 - protein, 17 aa, Cryptosporidium parvum
HNFHHAVSISITLNNWL

SEQ ID NO: 2231824 - protein, 27 aa, Cryptosporidium parvum
HNFNECFRFPVVVPIVEDIIILKLWDN

SEQ ID NO: 2231825 - protein, 20 aa, Cryptosporidium parvum
HNHHHHGYKPHKTTTTTTTT

SEQ ID NO: 2231826 - protein, 18 aa, Cryptosporidium parvum
HNIFKSKLLIYKMKKNIS

SEQ ID NO: 2231827 - protein, 17 aa, Cryptosporidium parvum
HNQLYRYLIREMNKTSR

SEQ ID NO: 2231828 - protein, 24 aa, Cryptosporidium parvum
HPEKALEFPLVLYSSVTTPLILEN

SEQ ID NO: 2231829 - protein, 22 aa, Cryptosporidium parvum
HPFSPGCILSIISISSQYKTTL

SEQ ID NO: 2231830 - protein, 20 aa, Cryptosporidium parvum
HPHQDYKKRISIVHNGTIDN

SEQ ID NO: 2231831 - protein, 23 aa, Cryptosporidium parvum
HPKLCFFPRTKTFGISHGFEPLI

SEQ ID NO: 2231832 - protein, 19 aa, Cryptosporidium parvum
HPLFRSELYLVKSSNGIEK

SEQ ID NO: 2231833 - protein, 21 aa, Cryptosporidium parvum
HPLRSYCFVHQAFNLNDGSWL

SEQ ID NO: 2231834 - protein, 20 aa, Cryptosporidium parvum
HPMYCYKALLYIYTQSLEQE

SEQ ID NO: 2231835 - protein, 22 aa, Cryptosporidium parvum
HPNFYLVLLYFHFVLESKFSLL

SEQ ID NO: 2231836 - protein, 25 aa, Cryptosporidium parvum
HPNKAKLALFSSWTEGCNKSFLQTL

SEQ ID NO: 2231837 - protein, 24 aa, Cryptosporidium parvum
HPNSSFLLRSGFYDIIPLVHCFVD

SEQ ID NO: 2231838 - protein, 23 aa, Cryptosporidium parvum
HPNSYFKNSCHTFNDQVLENEYA

SEQ ID NO: 2231839 - protein, 34 aa, Cryptosporidium parvum; identical to SEQ ID NO: 2123791

SEQ ID NO: 2231840 - protein, 27 aa, Cryptosporidium parvum
HPPLIIRTGKLLSFSRNHPIIFSCNNI

SEQ ID NO: 2231841 - protein, 29 aa, Cryptosporidium parvum
HPQKKENCFWSFCQSQLFRSQQVRILELL

SEQ ID NO: 2231842 - protein, 18 aa, Cryptosporidium parvum
HPSFPMSYVPKILNFIDR

SEQ ID NO: 2231843 - protein, 18 aa, Cryptosporidium parvum
HQPHRFQTRPSILVTLCK

SEQ ID NO: 2231844 - protein, 27 aa, Cryptosporidium parvum
HQSEKRFSSLYIRNPWGYTLNNILGVP

SEQ ID NO: 2231845 - protein, 17 aa, Cryptosporidium parvum
HQVFLKDHIKNISENTM

SEQ ID NO: 2231846 - protein, 25 aa, Cryptosporidium parvum
HQYSNRFLLEISHKILFKLSMENLK

SEQ ID NO: 2231847 - protein, 28 aa, Cryptosporidium parvum
HRAIPLSLYRWYLSKVGIVFFISVCLLI

SEQ ID NO: 2231848 - protein, 18 aa, Cryptosporidium parvum
HRATLFAMFSLFETIGSA

SEQ ID NO: 2231849 - protein, 24 aa, Cryptosporidium parvum
HRFKRFPETLFIYFTPPKNAKKGE

SEQ ID NO: 2231850 - protein, 17 aa, Cryptosporidium parvum
HRHNFSVFFYLFYLTMY

SEQ ID NO: 2231851 - protein, 27 aa, Cryptosporidium parvum
HRLYISNEVVHRFLPWDSLNELMDILE

SEQ ID NO: 2231852 - protein, 21 aa, Cryptosporidium parvum
HRNNFRFLLEKSCETLHNTNF

SEQ ID NO: 2231853 - protein, 21 aa, Cryptosporidium parvum
HRTPPGAGIYIVIEKVLLVIN

SEQ ID NO: 2231854 - protein, 18 aa, Cryptosporidium parvum
HSAHFIISVANSFPQLNK

SEQ ID NO: 2231855 - protein, 18 aa, Cryptosporidium parvum
HSALRALISYSLVLLCGI

SEQ ID NO: 2231856 - protein, 18 aa, Cryptosporidium parvum
HSDFCVFCHEPIHIEQDR

SEQ ID NO: 2231857 - protein, 17 aa, Cryptosporidium parvum
HSECIYKWFRTSNKTTC

SEQ ID NO: 2231858 - protein, 24 aa, Cryptosporidium parvum
HSELPRLITQLIMALKSKDREIRR

SEQ ID NO: 2231859 - protein, 19 aa, Cryptosporidium parvum
HSELVKFLLFESSQRDLGL

SEQ ID NO: 2231860 - protein, 20 aa, Cryptosporidium parvum
HSGEGHWLFENPIRYLTSSE

SEQ ID NO: 2231861 - protein, 18 aa, Cryptosporidium parvum
HSGLEFITSIDLTNNHLF

SEQ ID NO: 2231862 - protein, 29 aa, Cryptosporidium parvum
HSIKIKVVKLMPIWSIRNKSNFNIRITYG

SEQ ID NO: 2231863 - protein, 30 aa, Cryptosporidium parvum; identical to SEQ ID NO: 2123803

SEQ ID NO: 2231864 - protein, 23 aa, Cryptosporidium parvum
HSKRRCIIRKGLTVRGSMILPFS

SEQ ID NO: 2231865 - protein, 18 aa, Cryptosporidium parvum
HSLIIGYIKLNWDEFREL

SEQ ID NO: 2231866 - protein, 18 aa, Cryptosporidium parvum
HSLTPVIRQNLSYYYYFD

SEQ ID NO: 2231867 - protein, 19 aa, Cryptosporidium parvum
HSLVPLLIIFDLMDLPLNS

SEQ ID NO: 2231868 - protein, 19 aa, Cryptosporidium parvum
HSNDFSIEHPNRFFYSKKL

SEQ ID NO: 2231869 - protein, 26 aa, Cryptosporidium parvum
HSSKERMKGILFKILISEQIKEIVET

SEQ ID NO: 2231870 - protein, 18 aa, Cryptosporidium parvum
HSVGRGASQVRNIPAQNS

SEQ ID NO: 2231871 - protein, 22 aa, Cryptosporidium parvum
HSVGSKVTRYICILLSENTFTR

SEQ ID NO: 2231872 - protein, 21 aa, Cryptosporidium parvum
HSWSIRINKILTKFILQNISY

SEQ ID NO: 2231873 - protein, 28 aa, Cryptosporidium parvum
HSYRGYFTHEMLRRFLALAKITIPNSGV

SEQ ID NO: 2231874 - protein, 22 aa, Cryptosporidium parvum
HTFGDLWTIPWNCCKDKDLNEN

SEQ ID NO: 2231875 - protein, 18 aa, Cryptosporidium parvum
HTGIRIVQQIAILHGSSV

SEQ ID NO: 2231876 - protein, 23 aa, Cryptosporidium parvum
HTIPQCIWGCIVGIFIGIFAFIM

SEQ ID NO: 2231877 - protein, 25 aa, Cryptosporidium parvum
HTLDPYRMFLMIVARGGYSRVNKNS

SEQ ID NO: 2231878 - protein, 18 aa, Cryptosporidium parvum
HTNMSRRGIFNIGPRITR

SEQ ID NO: 2231879 - protein, 22 aa, Cryptosporidium parvum
HTQVKWLMSFPAGFKLNQNLTT

SEQ ID NO: 2231880 - protein, 19 aa, Cryptosporidium parvum
HVASKFLIILSDIFELETN

SEQ ID NO: 2231881 - protein, 17 aa, Cryptosporidium parvum
HVDVGWYHMVVTFNTTQ

SEQ ID NO: 2231882 - protein, 22 aa, Cryptosporidium parvum
HVKNRYPVHFFNGSKHIVISQS

SEQ ID NO: 2231883 - protein, 27 aa, Cryptosporidium parvum
HVNACKAGKFLSSFLIWCSKYEENYIL

SEQ ID NO: 2231884 - protein, 18 aa, Cryptosporidium parvum
HVQCELGEWSSWSPCSVT

SEQ ID NO: 2231885 - protein, 20 aa, Cryptosporidium parvum
HVRIKIRHCDNADLNGEIEY

SEQ ID NO: 2231886 - protein, 25 aa, Cryptosporidium parvum
HVSEYRKNMSLDYFIEIYKDLYSEP

SEQ ID NO: 2231887 - protein, 18 aa, Cryptosporidium parvum
HVSGLLFSSNREVSFKSY

SEQ ID NO: 2231888 - protein, 26 aa, Cryptosporidium parvum
HVVCTLQGMQCCVPQKSAKGWRKKPP

SEQ ID NO: 2231889 - protein, 19 aa, Cryptosporidium parvum
HWLEINGKVIISSKLFDLF

SEQ ID NO: 2231890 - protein, 19 aa, Cryptosporidium parvum
HWRLFWDAFSFMPPCSAQQ

SEQ ID NO: 2231891 - protein, 28 aa, Cryptosporidium parvum
HYASDCWDAEVLTSYGWIECAGHADRSC

SEQ ID NO: 2231892 - protein, 24 aa, Cryptosporidium parvum
HYSLFKFAYCIILDIKSIILKFNY

SEQ ID NO: 2231893 - protein, 25 aa, Cryptosporidium parvum
HYSNREVLKGFILNYPQILHCILLI

SEQ ID NO: 2231894 - protein, 17 aa, Cryptosporidium parvum
IAAVFCEMLRAYTVRTW

SEQ ID NO: 2231895 - protein, 17 aa, Cryptosporidium parvum
IACIFVYILNILGLVII

SEQ ID NO: 2231896 - protein, 36 aa, Cryptosporidium parvum; identical to SEQ ID NO: 2123824

SEQ ID NO: 2231897 - protein, 21 aa, Cryptosporidium parvum
IACSEFCLYFNLKTIEELHEL

SEQ ID NO: 2231898 - protein, 22 aa, Cryptosporidium parvum
IADPLCTILFSFFVLATTIKIL

SEQ ID NO: 2231899 - protein, 24 aa, Cryptosporidium parvum
IADVCLSGGILNRNSRLLVPLFCP

SEQ ID NO: 2231900 - protein, 18 aa, Cryptosporidium parvum
IAELQGKLIRSHLNSQDN

SEQ ID NO: 2231901 - protein, 17 aa, Cryptosporidium parvum
IAGLVGTAAFLWVSGPV

SEQ ID NO: 2231902 - protein, 23 aa, Cryptosporidium parvum
IAILICVEKGYISLDDPICHYWD

SEQ ID NO: 2231903 - protein, 17 aa, Cryptosporidium parvum
IAILKCRATFHRSYLKH

SEQ ID NO: 2231904 - protein, 19 aa, Cryptosporidium parvum
IAILKDFFKFIRNIKLICC

SEQ ID NO: 2231905 - protein, 26 aa, Cryptosporidium parvum
IAILMSLRISCYKCDNQAVKNVKPII

SEQ ID NO: 2231906 - protein, 22 aa, Cryptosporidium parvum
IAIRTLGKIFIKIREYHTFDHQ

SEQ ID NO: 2231907 - protein, 24 aa, Cryptosporidium parvum
IAISTCIFIFFILYIVLNALSRNK

SEQ ID NO: 2231908 - protein, 21 aa, Cryptosporidium parvum
IAKERGFLLLALIRLSLFLPF

SEQ ID NO: 2231909 - protein, 26 aa, Cryptosporidium parvum
IAKFFIAVSMVFSFPIQCHPCRRSLS

SEQ ID NO: 2231910 - protein, 21 aa, Cryptosporidium parvum
IAKKRLMFFSPFISAVPSIMG

SEQ ID NO: 2231911 - protein, 21 aa, Cryptosporidium parvum
IAKLGFLSLFSFIIFLLSVLY

SEQ ID NO: 2231912 - protein, 25 aa, Cryptosporidium parvum
IAKVFKRMVSIVLWFFSSLFILIII

SEQ ID NO: 2231913 - protein, 23 aa, Cryptosporidium parvum
IALEIIYRRGIVISKFGKKGIMV

SEQ ID NO: 2231914 - protein, 19 aa, Cryptosporidium parvum
IALFLFWFQFVQIFVPILL

SEQ ID NO: 2231915 - protein, 18 aa, Cryptosporidium parvum
IALKDSIMKQWFSINKAC

SEQ ID NO: 2231916 - protein, 17 aa, Cryptosporidium parvum
IALLKLRGSVEMGDQLK

SEQ ID NO: 2231917 - protein, 19 aa, Cryptosporidium parvum
IALQLVLKFIQLIQQQSKY

SEQ ID NO: 2231918 - protein, 20 aa, Cryptosporidium parvum
IALRYFLSRFFLPGESQMVY

SEQ ID NO: 2231919 - protein, 26 aa, Cryptosporidium parvum
IALSHNYFFGALYGRMKTAKQCQERW

SEQ ID NO: 2231920 - protein, 17 aa, Cryptosporidium parvum
IALTYPVNINRISKVPI

SEQ ID NO: 2231921 - protein, 27 aa, Cryptosporidium parvum
IANTNCYRRWKWKKRVKRRKMKKIKDE

SEQ ID NO: 2231922 - protein, 26 aa, Cryptosporidium parvum
IAQGFEFWHIIAMIIVAIVALKLINY

SEQ ID NO: 2231923 - protein, 22 aa, Cryptosporidium parvum
IARICLTSVLLFFSIPTNSQYV

SEQ ID NO: 2231924 - protein, 20 aa, Cryptosporidium parvum
IASAKLVIWTKEIETGRLTD

SEQ ID NO: 2231925 - protein, 20 aa, Cryptosporidium parvum
IASEVLASCEIVRRNIKSLI

SEQ ID NO: 2231926 - protein, 17 aa, Cryptosporidium parvum
IASLEYKLSCDVSSFKH

SEQ ID NO: 2231927 - protein, 18 aa, Cryptosporidium parvum
IASVLPFICKILENVKGG

SEQ ID NO: 2231928 - protein, 19 aa, Cryptosporidium parvum
IATELEWGKAAIQVLKDNN

SEQ ID NO: 2231929 - protein, 23 aa, Cryptosporidium parvum
IATLFPVYWTFLLGLVLLVFGGI

SEQ ID NO: 2231930 - protein, 17 aa, Cryptosporidium parvum
IATMIIDSLKLVNDVKE

SEQ ID NO: 2231931 - protein, 19 aa, Cryptosporidium parvum
IATVIGVFIILPPIFYISR

SEQ ID NO: 2231932 - protein, 18 aa, Cryptosporidium parvum
IAVSGIFSLIGTIWEGGY

SEQ ID NO: 2231933 - protein, 19 aa, Cryptosporidium parvum
IAYEVCCRLRSTISADSEL

SEQ ID NO: 2231934 - protein, 25 aa, Cryptosporidium parvum
IAYSFPFSFCLSNFDFRDITSNIYY

SEQ ID NO: 2231935 - protein, 19 aa, Cryptosporidium parvum
IAYSKWKCLLANSIYMLSI

SEQ ID NO: 2231936 - protein, 21 aa, Cryptosporidium parvum
ICAIAATFLAPTFTMNWIMFI

SEQ ID NO: 2231937 - protein, 20 aa, Cryptosporidium parvum
ICDLLRRGNVETVFELLMVP

SEQ ID NO: 2231938 - protein, 25 aa, Cryptosporidium parvum
ICFLWLTILVELFWFNKESRKNVDL

SEQ ID NO: 2231939 - protein, 19 aa, Cryptosporidium parvum
ICFPSSCYCNICNPFENMK

SEQ ID NO: 2231940 - protein, 23 aa, Cryptosporidium parvum
ICFQMVIYLPFIFLRDIENLGFL

SEQ ID NO: 2231941 - protein, 20 aa, Cryptosporidium parvum
ICGLIMAPVAIFFIAYSYYI

SEQ ID NO: 2231942 - protein, 19 aa, Cryptosporidium parvum
ICHYWDGFIRYGKRNITLR

SEQ ID NO: 2231943 - protein, 17 aa, Cryptosporidium parvum
ICIFFVLLKLSLRNFNY

SEQ ID NO: 2231944 - protein, 24 aa, Cryptosporidium parvum
ICIFGCGIVILGFIIGSLDSSTLG

SEQ ID NO: 2231945 - protein, 21 aa, Cryptosporidium parvum
ICIIPIFSIDIFYFRMLDILS

SEQ ID NO: 2231946 - protein, 20 aa, Cryptosporidium parvum
ICIPSGCFNWIGLTFLSVIS

SEQ ID NO: 2231947 - protein, 19 aa, Cryptosporidium parvum
ICISLPFTECERIHELTKL

SEQ ID NO: 2231948 - protein, 21 aa, Cryptosporidium parvum
ICKMSQFIYFWGVVILLVTII

SEQ ID NO: 2231949 - protein, 19 aa, Cryptosporidium parvum
ICLFGTKVHYLRSLAELLI

SEQ ID NO: 2231950 - protein, 20 aa, Cryptosporidium parvum
ICLGLAFRILGYFLTAFTLR

SEQ ID NO: 2231951 - protein, 18 aa, Cryptosporidium parvum
ICLLVWSCILFIACGTVA

SEQ ID NO: 2231952 - protein, 17 aa, Cryptosporidium parvum
ICLRKIYNIKKGDRVLI

SEQ ID NO: 2231953 - protein, 17 aa, Cryptosporidium parvum
ICLYTESNISIPLEYGQ

SEQ ID NO: 2231954 - protein, 25 aa, Cryptosporidium parvum
ICMDECIKHRGLFRIIKNKSFIQAF

SEQ ID NO: 2231955 - protein, 34 aa, Cryptosporidium parvum; identical to SEQ ID NO: 2123862

SEQ ID NO: 2231956 - protein, 30 aa, Cryptosporidium parvum
ICSIGRLKPELIKDLLLIQINSFWSSSSRY

SEQ ID NO: 2231957 - protein, 18 aa, Cryptosporidium parvum
ICSQIPSYLWYLPSDKIF

SEQ ID NO: 2231958 - protein, 21 aa, Cryptosporidium parvum
ICSRLLCIFISFLTNDLFSTI

SEQ ID NO: 2231959 - protein, 18 aa, Cryptosporidium parvum
ICSVCREAIIASTKNSDS

SEQ ID NO: 2231960 - protein, 19 aa, Cryptosporidium parvum
ICSWNEYPYIDSISSCKAS

SEQ ID NO: 2231961 - protein, 18 aa, Cryptosporidium parvum
ICYPLSNCIAEFLENNSL

SEQ ID NO: 2231962 - protein, 19 aa, Cryptosporidium parvum
IDAPHHWTLVLSVSPQKTI

SEQ ID NO: 2231963 - protein, 18 aa, Cryptosporidium parvum
IDCWFPLVDECISYIFSG

SEQ ID NO: 2231964 - protein, 18 aa, Cryptosporidium parvum
IDDLLGLLKLLTTIRNSL

SEQ ID NO: 2231965 - protein, 18 aa, Cryptosporidium parvum
IDELKEFLEKNEIIVILK

SEQ ID NO: 2231966 - protein, 17 aa, Cryptosporidium parvum
IDFELLDEFNLIYEESF

SEQ ID NO: 2231967 - protein, 19 aa, Cryptosporidium parvum
IDFIILRSIFGNGLLIFLL

SEQ ID NO: 2231968 - protein, 17 aa, Cryptosporidium parvum
IDFLVPYFLLESAKICI

SEQ ID NO: 2231969 - protein, 25 aa, Cryptosporidium parvum
IDGELNLGIILKFFSAMASQGYIIW

SEQ ID NO: 2231970 - protein, 17 aa, Cryptosporidium parvum
IDGFPLSEFEAVRPLLE

SEQ ID NO: 2231971 - protein, 20 aa, Cryptosporidium parvum
IDGGLAFIPSLIFIRKTDKE

SEQ ID NO: 2231972 - protein, 21 aa, Cryptosporidium parvum
IDHHIIIGLSFLKQGIDNLVD

SEQ ID NO: 2231973 - protein, 19 aa, Cryptosporidium parvum
IDIGLFGFMYYWNVKLNMV

SEQ ID NO: 2231974 - protein, 21 aa, Cryptosporidium parvum
IDIRVSYGCHNWKFEDEFLRV

SEQ ID NO: 2231975 - protein, 18 aa, Cryptosporidium parvum
IDISLVFKYYGLLSKDST

SEQ ID NO: 2231976 - protein, 19 aa, Cryptosporidium parvum
IDLFCKISKILVKNSKLTN

SEQ ID NO: 2231977 - protein, 19 aa, Cryptosporidium parvum
IDLLTKCSETLRKTASDWN

SEQ ID NO: 2231978 - protein, 20 aa, Cryptosporidium parvum
IDLPLLCKIIINYSNSEKVH

SEQ ID NO: 2231979 - protein, 23 aa, Cryptosporidium parvum
IDLRGAVHRCLQSGKAKTDKDIV

SEQ ID NO: 2231980 - protein, 19 aa, Cryptosporidium parvum
IDLVKEIFPLYDVIVDATD

SEQ ID NO: 2231981 - protein, 18 aa, Cryptosporidium parvum
IDLYICFGNKNSSNLFED

SEQ ID NO: 2231982 - protein, 20 aa, Cryptosporidium parvum
IDLYTTMSILGYSLLPIVIL

SEQ ID NO: 2231983 - protein, 17 aa, Cryptosporidium parvum
IDMMNGPAICVGIRNRK

SEQ ID NO: 2231984 - protein, 17 aa, Cryptosporidium parvum
IDMNHHWDLLLKCDPEW

SEQ ID NO: 2231985 - protein, 23 aa, Cryptosporidium parvum
IDMPGHGLSSWNYFGKLTTDDFI

SEQ ID NO: 2231986 - protein, 18 aa, Cryptosporidium parvum
IDNGRFSKNFEIVKLIGS

SEQ ID NO: 2231987 - protein, 18 aa, Cryptosporidium parvum
IDNIKFFLEISGYSVIYL

SEQ ID NO: 2231988 - protein, 27 aa, Cryptosporidium parvum
IDNNFIWLRNFCKNGSLQLLVNSLSCT

SEQ ID NO: 2231989 - protein, 19 aa, Cryptosporidium parvum
IDNRIPRKLYYIAKANIYS

SEQ ID NO: 2231990 - protein, 21 aa, Cryptosporidium parvum
IDPATKLPIPGSVAGDEILTE

SEQ ID NO: 2231991 - protein, 24 aa, Cryptosporidium parvum
IDPQQRLSLMLAVQSIEDAKLNLS

SEQ ID NO: 2231992 - protein, 25 aa, Cryptosporidium parvum
IDPVIVPCIIFPIIGRNPNNLFQEC

SEQ ID NO: 2231993 - protein, 22 aa, Cryptosporidium parvum
IDQICLLWPLDVINLQDHEQLE

SEQ ID NO: 2231994 - protein, 22 aa, Cryptosporidium parvum
IDRFKNCIGNWIAMNTINDKDL

SEQ ID NO: 2231995 - protein, 21 aa, Cryptosporidium parvum
IDRRTDIEIGINIDTHPVISL

SEQ ID NO: 2231996 - protein, 19 aa, Cryptosporidium parvum
IDRVSSWKNYIALFNHLLF

SEQ ID NO: 2231997 - protein, 31 aa, Cryptosporidium parvum; identical to SEQ ID NO: 2123892

SEQ ID NO: 2231998 - protein, 19 aa, Cryptosporidium parvum
IDSIIRLAKYENREYNSIV

SEQ ID NO: 2231999 - protein, 18 aa, Cryptosporidium parvum
IDSKSLLGNWIVGDKPGE

SEQ ID NO: 2232000 - protein, 23 aa, Cryptosporidium parvum
IDTCIVCRDTLYIGSKKIPCGHV

SEQ ID NO: 2232001 - protein, 25 aa, Cryptosporidium parvum
IDTFQLKSCHGVSCASDCIVTEWSD

SEQ ID NO: 2232002 - protein, 26 aa, Cryptosporidium parvum
IDTLFPKFWVENTFGALLPDISEVKY

SEQ ID NO: 2232003 - protein, 25 aa, Cryptosporidium parvum
IDVIWRKIFTQEFVKITLDDVYVIF

SEQ ID NO: 2232004 - protein, 24 aa, Cryptosporidium parvum
IDYDKCIGILLALHSNILIIDFDL

SEQ ID NO: 2232005 - protein, 35 aa, Cryptosporidium parvum
IDYECAPWRCYCLIQRWLGIHIDILGACVISSLGI

SEQ ID NO: 2232006 - protein, 23 aa, Cryptosporidium parvum
IDYNSTCFWDFDMPIPFTATSVL

SEQ ID NO: 2232007 - protein, 18 aa, Cryptosporidium parvum
IEADNGWQKLILGVNSAH

SEQ ID NO: 2232008 - protein, 21 aa, Cryptosporidium parvum
IEAVSALGLMGLIYELRENRM

SEQ ID NO: 2232009 - protein, 26 aa, Cryptosporidium parvum
IECFIFPLRLIIAYFVLKDSLGSSTT

SEQ ID NO: 2232010 - protein, 26 aa, Cryptosporidium parvum
IEDFFKCLKIIIDLLFNSNLFSKEEF

SEQ ID NO: 2232011 - protein, 21 aa, Cryptosporidium parvum
IEDFSGIPLFMIFVQSNNLIL

SEQ ID NO: 2232012 - protein, 25 aa, Cryptosporidium parvum
IEDLQLRISVCKMVDEDGLSNVILL

SEQ ID NO: 2232013 - protein, 19 aa, Cryptosporidium parvum
IEDSEKFYVRVLLNKKRFP

SEQ ID NO: 2232014 - protein, 37 aa, Cryptosporidium parvum
IEEIWLKIIPILSIPSGNLFKTRFYQFINYKKATEFE

SEQ ID NO: 2232015 - protein, 19 aa, Cryptosporidium parvum
IEENKCFVFSYVVKSQTCF

SEQ ID NO: 2232016 - protein, 18 aa, Cryptosporidium parvum
IEEYNCIELLRRLENINS

SEQ ID NO: 2232017 - protein, 21 aa, Cryptosporidium parvum
IEFLSEFYLGIGSTFEDLVRD

SEQ ID NO: 2232018 - protein, 17 aa, Cryptosporidium parvum
IEFWQWVPDVYDILPIC

SEQ ID NO: 2232019 - protein, 26 aa, Cryptosporidium parvum
IEFYIFRTSIKYYRFLLKDWLILTNQ

SEQ ID NO: 2232020 - protein, 17 aa, Cryptosporidium parvum
IEFYWDKPTILYLIDCI

SEQ ID NO: 2232021 - protein, 22 aa, Cryptosporidium parvum
IEGTVYPNWFLMKEILKNKKNN

SEQ ID NO: 2232022 - protein, 19 aa, Cryptosporidium parvum
IEHPNRFFYSKKLLIGLVN

SEQ ID NO: 2232023 - protein, 25 aa, Cryptosporidium parvum
IEIDFTTPWKRFSFVEEIESGLGEK

SEQ ID NO: 2232024 - protein, 17 aa, Cryptosporidium parvum
IEIDGGLAFIPSLIFIR

SEQ ID NO: 2232025 - protein, 19 aa, Cryptosporidium parvum
IEIDILCSWVINNFPKDSI

SEQ ID NO: 2232026 - protein, 21 aa, Cryptosporidium parvum
IEIEYSFDFVKHEWIKQTLDQ

SEQ ID NO: 2232027 - protein, 22 aa, Cryptosporidium parvum
IEILKMRKRCFGNYIENVLPEL

SEQ ID NO: 2232028 - protein, 24 aa, Cryptosporidium parvum
IEILLFPIIRNFCCDEQECVRLIA

SEQ ID NO: 2232029 - protein, 17 aa, Cryptosporidium parvum
IEIPALMIISIFQTLST

SEQ ID NO: 2232030 - protein, 18 aa, Cryptosporidium parvum
IEIRSWREMTRPKSLNGE

SEQ ID NO: 2232031 - protein, 19 aa, Cryptosporidium parvum
IEIYYCFIIGIQKGIEKTE

SEQ ID NO: 2232032 - protein, 22 aa, Cryptosporidium parvum
IEKLIKINFNFSKGTEMSEFNE

SEQ ID NO: 2232033 - protein, 26 aa, Cryptosporidium parvum
IEKLLLLRIYFLPQFIQRDNSKNDMN

SEQ ID NO: 2232034 - protein, 24 aa, Cryptosporidium parvum
IEKRKTMLLPEHYLYGVKDLSRHL

SEQ ID NO: 2232035 - protein, 20 aa, Cryptosporidium parvum
IEKYALFELIITKLLPLCSS

SEQ ID NO: 2232036 - protein, 18 aa, Cryptosporidium parvum
IELIDTFFIIARKKSLSF

SEQ ID NO: 2232037 - protein, 23 aa, Cryptosporidium parvum
IELLNHIPPIWAQTYFQKLSDAL

SEQ ID NO: 2232038 - protein, 24 aa, Cryptosporidium parvum
IELLNRKLLSLGILKVQLDDHFIT

SEQ ID NO: 2232039 - protein, 23 aa, Cryptosporidium parvum
IELQEGFRLSSDIERKLYPDGPN

SEQ ID NO: 2232040 - protein, 31 aa, Cryptosporidium parvum
IELQSNPLLLNWKAFFPNIIFDKNKSEFIIA

SEQ ID NO: 2232041 - protein, 24 aa, Cryptosporidium parvum
IELRKEMLENALLLKKKHEGRAYN

SEQ ID NO: 2232042 - protein, 25 aa, Cryptosporidium parvum
IELRVRLVPCIIRYDENIYASALND

SEQ ID NO: 2232043 - protein, 19 aa, Cryptosporidium parvum
IELSEKFCLREGIDRKYCK

SEQ ID NO: 2232044 - protein, 22 aa, Cryptosporidium parvum
IENEIRGNVLINTRKDTESRKK

SEQ ID NO: 2232045 - protein, 24 aa, Cryptosporidium parvum
IENLCSTSLHPNHFSLVFKSRYPN

SEQ ID NO: 2232046 - protein, 20 aa, Cryptosporidium parvum
IENLLSFSFIDEALRFITAI

SEQ ID NO: 2232047 - protein, 19 aa, Cryptosporidium parvum
IERKKCCNRKDLKKFDQDE

SEQ ID NO: 2232048 - protein, 19 aa, Cryptosporidium parvum
IERRIRFELLEDIQNNIGQ

SEQ ID NO: 2232049 - protein, 18 aa, Cryptosporidium parvum
IERYKNYLERSGIYFKTI

SEQ ID NO: 2232050 - protein, 21 aa, Cryptosporidium parvum
IESCGVKSYLGNPIRAVREFE

SEQ ID NO: 2232051 - protein, 17 aa, Cryptosporidium parvum
IESCILNRILSILKSII

SEQ ID NO: 2232052 - protein, 17 aa, Cryptosporidium parvum
IESELMLLGSEFQSQSR

SEQ ID NO: 2232053 - protein, 17 aa, Cryptosporidium parvum
IESFCYSTCKVLNCVEH

SEQ ID NO: 2232054 - protein, 22 aa, Cryptosporidium parvum
IESFPLGYKLILILDNLELIKF

SEQ ID NO: 2232055 - protein, 18 aa, Cryptosporidium parvum
IESIKAVEICNALSKEFN

SEQ ID NO: 2232056 - protein, 26 aa, Cryptosporidium parvum
IESIKKLCKVWLLSPFNALDVLLTDS

SEQ ID NO: 2232057 - protein, 21 aa, Cryptosporidium parvum
IESISQWSIERCFHIVKNTLN

SEQ ID NO: 2232058 - protein, 22 aa, Cryptosporidium parvum
IESIYPWIGRQALAQTAILLRI

SEQ ID NO: 2232059 - protein, 29 aa, Cryptosporidium parvum
IESSSLFLKEGILIWILSKEIFAPVSNKK

SEQ ID NO: 2232060 - protein, 19 aa, Cryptosporidium parvum
IESTLRMEFVLDYFTNIKL

SEQ ID NO: 2232061 - protein, 17 aa, Cryptosporidium parvum
IESWHSLALHLYNVEEL

SEQ ID NO: 2232062 - protein, 22 aa, Cryptosporidium parvum
IETKGRGGPLFDFSENHEKIEK

SEQ ID NO: 2232063 - protein, 22 aa, Cryptosporidium parvum
IETLKSAFLMKEESLKCDKTSE

SEQ ID NO: 2232064 - protein, 17 aa, Cryptosporidium parvum
IETPILVFCHKVDPRLE

SEQ ID NO: 2232065 - protein, 17 aa, Cryptosporidium parvum
IETSFLPLITFDFEFPY

SEQ ID NO: 2232066 - protein, 27 aa, Cryptosporidium parvum
IEVAIRGCPAHRIVPNMVKALIEHSTW

SEQ ID NO: 2232067 - protein, 26 aa, Cryptosporidium parvum
IEVSKRIPSGVTIFFIFVVFSFAISS

SEQ ID NO: 2232068 - protein, 21 aa, Cryptosporidium parvum
IEVWVKLPPLFDKLEEIKEEK

SEQ ID NO: 2232069 - protein, 30 aa, Cryptosporidium parvum
IEWDMAGPILLIACLGFFLLLAGKIHFGYI

SEQ ID NO: 2232070 - protein, 19 aa, Cryptosporidium parvum
IEYILEFFISKGEVISFKE

SEQ ID NO: 2232071 - protein, 19 aa, Cryptosporidium parvum
IEYLLNMDINISFEDLVAK

SEQ ID NO: 2232072 - protein, 18 aa, Cryptosporidium parvum
IFAFTYISGKSFTTSILT

SEQ ID NO: 2232073 - protein, 29 aa, Cryptosporidium parvum
IFAHCYWYLLWLRKHWRSLFHSEEIPYSK

SEQ ID NO: 2232074 - protein, 18 aa, Cryptosporidium parvum
IFCFFLDKTWFYFPYIGI

SEQ ID NO: 2232075 - protein, 22 aa, Cryptosporidium parvum
IFCGETWWNPLLPLRNVPYLIV

SEQ ID NO: 2232076 - protein, 19 aa, Cryptosporidium parvum
IFCIINLFCKYKLNKEIFL

SEQ ID NO: 2232077 - protein, 18 aa, Cryptosporidium parvum
IFCKLCGIIHNKVIDNKY

SEQ ID NO: 2232078 - protein, 26 aa, Cryptosporidium parvum
IFEAGLKKHRLVFCEKPESIPNMARQ

SEQ ID NO: 2232079 - protein, 18 aa, Cryptosporidium parvum
IFEALSVRLETPFNEVSI

SEQ ID NO: 2232080 - protein, 19 aa, Cryptosporidium parvum
IFEEILITLLFLAILHPKT

SEQ ID NO: 2232081 - protein, 24 aa, Cryptosporidium parvum
IFEELRILIISPIFPEILLDKILS

SEQ ID NO: 2232082 - protein, 31 aa, Cryptosporidium parvum
IFEFIFPICKSLGWEAFFMFTVPVSANKFRP

SEQ ID NO: 2232083 - protein, 17 aa, Cryptosporidium parvum
IFFCLLAIIISRLRVLA

SEQ ID NO: 2232084 - protein, 24 aa, Cryptosporidium parvum
IFFDYNKLFIFCFNNFTKCISDYN

SEQ ID NO: 2232085 - protein, 18 aa, Cryptosporidium parvum
IFFGFFFLYLERIKTERV

SEQ ID NO: 2232086 - protein, 23 aa, Cryptosporidium parvum
IFFIYWKIIKQISIYFSTHSIDY

SEQ ID NO: 2232087 - protein, 19 aa, Cryptosporidium parvum
IFFLFINFLFLFENVTDNF

SEQ ID NO: 2232088 - protein, 25 aa, Cryptosporidium parvum
IFFNKIFFLNSMICFYRCSGSFLTT

SEQ ID NO: 2232089 - protein, 17 aa, Cryptosporidium parvum
IFFSCIFAFTYISGKSF

SEQ ID NO: 2232090 - protein, 17 aa, Cryptosporidium parvum
IFFSNIFCRNTNIAQQI

SEQ ID NO: 2232091 - protein, 18 aa, Cryptosporidium parvum
IFFYCTHLEIPLMQNNNV

SEQ ID NO: 2232092 - protein, 26 aa, Cryptosporidium parvum
IFGGAGELWEYIKGLLSRIIDFIKTL

SEQ ID NO: 2232093 - protein, 22 aa, Cryptosporidium parvum
IFGLTCCGNILVWKVDLMENFV

SEQ ID NO: 2232094 - protein, 17 aa, Cryptosporidium parvum
IFGNGLLIFLLFEIHYL

SEQ ID NO: 2232095 - protein, 17 aa, Cryptosporidium parvum
IFGTLLINQLFNQLHIY

SEQ ID NO: 2232096 - protein, 17 aa, Cryptosporidium parvum
IFHIICTDFEDQANSLS

SEQ ID NO: 2232097 - protein, 24 aa, Cryptosporidium parvum
IFHIYFKFPCIINSKLIVQSKNYN

SEQ ID NO: 2232098 - protein, 18 aa, Cryptosporidium parvum
IFILISFIVKIIIFPVIL

SEQ ID NO: 2232099 - protein, 19 aa, Cryptosporidium parvum
IFIPGTFLILFSIIIDTAN

SEQ ID NO: 2232100 - protein, 24 aa, Cryptosporidium parvum
IFIRRISVRFNEYFDDISTYDIID

SEQ ID NO: 2232101 - protein, 17 aa, Cryptosporidium parvum
IFIRYIQYTLCLSPYAL

SEQ ID NO: 2232102 - protein, 17 aa, Cryptosporidium parvum
IFISFLVLYISYFYSFE

SEQ ID NO: 2232103 - protein, 25 aa, Cryptosporidium parvum
IFISKKLRGIYAFPYIVSRRIGFIS

SEQ ID NO: 2232104 - protein, 17 aa, Cryptosporidium parvum
IFIYNSWSFYLLVYTIG

SEQ ID NO: 2232105 - protein, 21 aa, Cryptosporidium parvum
IFKAIKYIIKFFIINNYDGSA

SEQ ID NO: 2232106 - protein, 35 aa, Cryptosporidium parvum
IFKEKECLRCKLPPVPDCSWIMKALYMNDLQRIDV

SEQ ID NO: 2232107 - protein, 25 aa, Cryptosporidium parvum
IFKFQLSLNNLEIWFHRDNKKENMS

SEQ ID NO: 2232108 - protein, 21 aa, Cryptosporidium parvum
IFKVYCSSISTPVIGDLPLAP

SEQ ID NO: 2232109 - protein, 27 aa, Cryptosporidium parvum
IFLFLFALRFYFWVRGRFSFNVGSNEK

SEQ ID NO: 2232110 - protein, 17 aa, Cryptosporidium parvum
IFLFYIINAYKSAVEKL

SEQ ID NO: 2232111 - protein, 20 aa, Cryptosporidium parvum
IFLICKIIFYLTVIKINKNK

SEQ ID NO: 2232112 - protein, 26 aa, Cryptosporidium parvum
IFLIFFFKRRLVIDLLLIVELILIDI

SEQ ID NO: 2232113 - protein, 22 aa, Cryptosporidium parvum
IFLIILCLSNVYSTWNLEWLHS

SEQ ID NO: 2232114 - protein, 18 aa, Cryptosporidium parvum
IFLKINWKNNIQKFIPFR

SEQ ID NO: 2232115 - protein, 19 aa, Cryptosporidium parvum
IFLKSFLIENFSVYIDEIS

SEQ ID NO: 2232116 - protein, 20 aa, Cryptosporidium parvum
IFLLFCILFALLAKNAAQYV

SEQ ID NO: 2232117 - protein, 17 aa, Cryptosporidium parvum
IFLPLSPLFDPRLTIRI

SEQ ID NO: 2232118 - protein, 21 aa, Cryptosporidium parvum
IFLQSHFRFLYSAIKSINKFE

SEQ ID NO: 2232119 - protein, 31 aa, Cryptosporidium parvum; identical to SEQ ID NO: 2123949

SEQ ID NO: 2232120 - protein, 18 aa, Cryptosporidium parvum
IFLSIPPLHFAYLGVVLC

SEQ ID NO: 2232121 - protein, 18 aa, Cryptosporidium parvum
IFLTCFIYILPVYLMVIS

SEQ ID NO: 2232122 - protein, 23 aa, Cryptosporidium parvum
IFNFKDCKNIISIPLEYKIKLIQ

SEQ ID NO: 2232123 - protein, 26 aa, Cryptosporidium parvum
IFNFVTGFIIKFRLPIDPHILSYYLK

SEQ ID NO: 2232124 - protein, 18 aa, Cryptosporidium parvum
IFNHLRDTIALTIGLIQL

SEQ ID NO: 2232125 - protein, 18 aa, Cryptosporidium parvum
IFNKFWSSWNQFELEYGN

SEQ ID NO: 2232126 - protein, 29 aa, Cryptosporidium parvum
IFNNFNSRFSWIVGMSIFTSSIFGLSYLR

SEQ ID NO: 2232127 - protein, 18 aa, Cryptosporidium parvum
IFNSISFSGENNVLKRNS

SEQ ID NO: 2232128 - protein, 19 aa, Cryptosporidium parvum
IFNVLLCTFNYNSIDLNDT

SEQ ID NO: 2232129 - protein, 25 aa, Cryptosporidium parvum
IFPEILLDKILSFKSGKVVFLTIYD

SEQ ID NO: 2232130 - protein, 21 aa, Cryptosporidium parvum
IFPIGCPLNSISDSLVNVIQK

SEQ ID NO: 2232131 - protein, 19 aa, Cryptosporidium parvum
IFPILILKVNCQIQLIIKQ

SEQ ID NO: 2232132 - protein, 20 aa, Cryptosporidium parvum
IFPKAYFGGIMVNFLINNPV

SEQ ID NO: 2232133 - protein, 18 aa, Cryptosporidium parvum
IFPLFSLVFALLAGYFVT

SEQ ID NO: 2232134 - protein, 28 aa, Cryptosporidium parvum
IFPSGALKLPGRHFLNALMVAGLIALGS

SEQ ID NO: 2232135 - protein, 22 aa, Cryptosporidium parvum
IFQIKSGFLRKPLFFAKDCRLD

SEQ ID NO: 2232136 - protein, 24 aa, Cryptosporidium parvum
IFQKMCYFLGCSMSKKVFSSHESS

SEQ ID NO: 2232137 - protein, 24 aa, Cryptosporidium parvum
IFQPLRYLFISAMNYGRRVVIPKL

SEQ ID NO: 2232138 - protein, 19 aa, Cryptosporidium parvum
IFQRTCWRIQLDSQSRYFD

SEQ ID NO: 2232139 - protein, 21 aa, Cryptosporidium parvum
IFQYKRFFDHYIYQIILYSLN

SEQ ID NO: 2232140 - protein, 20 aa, Cryptosporidium parvum
IFRAVCLEKALHVTERDANK

SEQ ID NO: 2232141 - protein, 24 aa, Cryptosporidium parvum
IFRNYLRCLLKAGFPHIVLTTLLN

SEQ ID NO: 2232142 - protein, 19 aa, Cryptosporidium parvum
IFRQIKIVYPDATQSAIES

SEQ ID NO: 2232143 - protein, 17 aa, Cryptosporidium parvum
IFSEFNISFIITTNSDL

SEQ ID NO: 2232144 - protein, 25 aa, Cryptosporidium parvum
IFSLIRISFWYEWIMIKIHLQLGID

SEQ ID NO: 2232145 - protein, 26 aa, Cryptosporidium parvum
IFSLTWILYLGFYWYWIPPKSISFPI

SEQ ID NO: 2232146 - protein, 25 aa, Cryptosporidium parvum
IFSNLKIEYTHGWDLNKLKSTFQNK

SEQ ID NO: 2232147 - protein, 24 aa, Cryptosporidium parvum
IFSQSCFKSSIKLDVELPKYSRQI

SEQ ID NO: 2232148 - protein, 17 aa, Cryptosporidium parvum
IFSRKMLSMILLLNHIL

SEQ ID NO: 2232149 - protein, 22 aa, Cryptosporidium parvum
IFSWNEGLSWYDFELGSKTLQV

SEQ ID NO: 2232150 - protein, 20 aa, Cryptosporidium parvum
IFVCGTLAMVALLLIPKNSF

SEQ ID NO: 2232151 - protein, 26 aa, Cryptosporidium parvum
IFVCILRLYAYYPVWLLLNNTSNDWY

SEQ ID NO: 2232152 - protein, 24 aa, Cryptosporidium parvum
IFVRLKISLWAPLFEDVTDQKLFR

SEQ ID NO: 2232153 - protein, 20 aa, Cryptosporidium parvum
IFVSLCKAKMLSDTGKCSPF

SEQ ID NO: 2232154 - protein, 17 aa, Cryptosporidium parvum
IFVSLIWALFVHGMKLW

SEQ ID NO: 2232155 - protein, 21 aa, Cryptosporidium parvum
IFWFMAYTMITLCVFAGIVVI

SEQ ID NO: 2232156 - protein, 17 aa, Cryptosporidium parvum
IFWGRFFEFGMNDSDNA

SEQ ID NO: 2232157 - protein, 19 aa, Cryptosporidium parvum
IFYFICLFISTILQDFYYT

SEQ ID NO: 2232158 - protein, 24 aa, Cryptosporidium parvum
IFYFRMLDILSYFFLFWFTGFHPI

SEQ ID NO: 2232159 - protein, 17 aa, Cryptosporidium parvum
IFYLICIGFIFFNMGAG

SEQ ID NO: 2232160 - protein, 18 aa, Cryptosporidium parvum
IFYQAFKGQWGVSGRDFV

SEQ ID NO: 2232161 - protein, 20 aa, Cryptosporidium parvum
IFYTTRFGSLLAKYKMNFLI

SEQ ID NO: 2232162 - protein, 23 aa, Cryptosporidium parvum
IFYYLEFIESFNLPHIMNGAAIL

SEQ ID NO: 2232163 - protein, 23 aa, Cryptosporidium parvum
IGAPKCRCPNGFQGDGLIGGTGC

SEQ ID NO: 2232164 - protein, 21 aa, Cryptosporidium parvum
IGDIESFLSFDSEFEKNEMEE

SEQ ID NO: 2232165 - protein, 24 aa, Cryptosporidium parvum
IGDNISMVYFRLSTFFASSTYRNS

SEQ ID NO: 2232166 - protein, 18 aa, Cryptosporidium parvum
IGDSSKWMKLVAIQSPYT

SEQ ID NO: 2232167 - protein, 18 aa, Cryptosporidium parvum
IGEISMLIFFLTERHRYY

SEQ ID NO: 2232168 - protein, 23 aa, Cryptosporidium parvum
IGFCSEDPWIPIGTIRSVILFER

SEQ ID NO: 2232169 - protein, 25 aa, Cryptosporidium parvum
IGFEKRANVTINHFFSIVTQKSNSS

SEQ ID NO: 2232170 - protein, 27 aa, Cryptosporidium parvum
IGFKKPRIGEITLRKHVSRIYKSVYNQ

SEQ ID NO: 2232171 - protein, 17 aa, Cryptosporidium parvum
IGFPSIVIYEKESVDKH

SEQ ID NO: 2232172 - protein, 25 aa, Cryptosporidium parvum
IGFQPCLINYLSVFLMYMDPPSAFK

SEQ ID NO: 2232173 - protein, 22 aa, Cryptosporidium parvum
IGGDLPWIIGCHKYLRTDSLNN

SEQ ID NO: 2232174 - protein, 26 aa, Cryptosporidium parvum
IGGEILPPLSLGCFEELSSPETFLEY

SEQ ID NO: 2232175 - protein, 26 aa, Cryptosporidium parvum
IGGGLESGSGWGYFSQFRVYGVHTSN

SEQ ID NO: 2232176 - protein, 22 aa, Cryptosporidium parvum
IGGLIFWKVYVTIIPDEENALN

SEQ ID NO: 2232177 - protein, 28 aa, Cryptosporidium parvum
IGGLKSFLLNLFKSIFGGAGELWEYIKG

SEQ ID NO: 2232178 - protein, 26 aa, Cryptosporidium parvum
IGGTSSWKHIWIMSFFIFLVFLLMYI

SEQ ID NO: 2232179 - protein, 19 aa, Cryptosporidium parvum
IGIAFRTGIYSSYGQLLYK

SEQ ID NO: 2232180 - protein, 18 aa, Cryptosporidium parvum
IGIELSMASNITFFQLYT

SEQ ID NO: 2232181 - protein, 18 aa, Cryptosporidium parvum
IGIFPDIIFGHSLGEYLV

SEQ ID NO: 2232182 - protein, 19 aa, Cryptosporidium parvum
IGIIFRLLYIIVYLAINIL

SEQ ID NO: 2232183 - protein, 17 aa, Cryptosporidium parvum
IGIKGEFISHVRTATSA

SEQ ID NO: 2232184 - protein, 18 aa, Cryptosporidium parvum
IGIKLVKCDSEFEKNKSE

SEQ ID NO: 2232185 - protein, 21 aa, Cryptosporidium parvum
IGILCPSGLAIRSTIPLLAME

SEQ ID NO: 2232186 - protein, 25 aa, Cryptosporidium parvum
IGILQEPHCSFVIQVFSEIKWSRLS

SEQ ID NO: 2232187 - protein, 20 aa, Cryptosporidium parvum
IGILVCHIISGFIFSRNMFW

SEQ ID NO: 2232188 - protein, 31 aa, Cryptosporidium parvum
IGIPSCLAIGFFFCNFGLLISYLFLENYFLY

SEQ ID NO: 2232189 - protein, 20 aa, Cryptosporidium parvum
IGKDRPEKMVKIINFCLISM

SEQ ID NO: 2232190 - protein, 25 aa, Cryptosporidium parvum
IGKKSIFNFCKWYNIISTSNISIQA

SEQ ID NO: 2232191 - protein, 17 aa, Cryptosporidium parvum
IGLGIYYAVARYFSRSS

SEQ ID NO: 2232192 - protein, 21 aa, Cryptosporidium parvum
IGLRYSNVMYPYIDQINEFSR

SEQ ID NO: 2232193 - protein, 19 aa, Cryptosporidium parvum
IGLSIMIFINFSSCNDNYS

SEQ ID NO: 2232194 - protein, 17 aa, Cryptosporidium parvum
IGMCKAIDDCIYHSNSI

SEQ ID NO: 2232195 - protein, 18 aa, Cryptosporidium parvum
IGPSWLKKAVSKVMSPKN

SEQ ID NO: 2232196 - protein, 17 aa, Cryptosporidium parvum
IGQKIHKDFKWLERNLI

SEQ ID NO: 2232197 - protein, 17 aa, Cryptosporidium parvum
IGQVSKRPIPGSIAGDL

SEQ ID NO: 2232198 - protein, 18 aa, Cryptosporidium parvum
IGRRSRPSTLCSIYPISA

SEQ ID NO: 2232199 - protein, 25 aa, Cryptosporidium parvum
IGSFELSYKWCFQVFSYDNRYCDAL

SEQ ID NO: 2232200 - protein, 22 aa, Cryptosporidium parvum
IGSKRLYILGLILVIFSYIPIC

SEQ ID NO: 2232201 - protein, 26 aa, Cryptosporidium parvum
IGSLSMKSSSTGLRYSVSNSIQSSLS

SEQ ID NO: 2232202 - protein, 38 aa, Cryptosporidium parvum; identical to SEQ ID NO: 2123996

SEQ ID NO: 2232203 - protein, 19 aa, Cryptosporidium parvum
IGSNLKYAACSNSEMTNVW

SEQ ID NO: 2232204 - protein, 27 aa, Cryptosporidium parvum
IGSSGRKGLPQSFLNRFVRINVGKLTY

SEQ ID NO: 2232205 - protein, 17 aa, Cryptosporidium parvum
IGSSVIMTMFILSIILL

SEQ ID NO: 2232206 - protein, 17 aa, Cryptosporidium parvum
IGSTAMDLTDRWHSKEW

SEQ ID NO: 2232207 - protein, 18 aa, Cryptosporidium parvum
IGSYECECLSGFRKHEQR

SEQ ID NO: 2232208 - protein, 25 aa, Cryptosporidium parvum
IGTAGAKMMIEWNFAFHWYDDGLPE

SEQ ID NO: 2232209 - protein, 25 aa, Cryptosporidium parvum
IGTLKIFYLYARWTLYFNTQVIAGK

SEQ ID NO: 2232210 - protein, 17 aa, Cryptosporidium parvum
IGVSFYFALDRLNKSIK

SEQ ID NO: 2232211 - protein, 17 aa, Cryptosporidium parvum
IGWTGWVVLAFVFQVPL

SEQ ID NO: 2232212 - protein, 22 aa, Cryptosporidium parvum
IGYLLITLIRLIAFMTDKLLLL

SEQ ID NO: 2232213 - protein, 21 aa, Cryptosporidium parvum
IGYSLSRLCFEIDGNIDKSIG

SEQ ID NO: 2232214 - protein, 25 aa, Cryptosporidium parvum
IHAASLSPAVVWCRCSPSQKKDLVL

SEQ ID NO: 2232215 - protein, 19 aa, Cryptosporidium parvum
IHAYTIWRNIVQKGIKNMS

SEQ ID NO: 2232216 - protein, 20 aa, Cryptosporidium parvum
IHFADLTLAYLTRLFQTQPQ

SEQ ID NO: 2232217 - protein, 22 aa, Cryptosporidium parvum
IHFLNLLLFFGISNNLHYTVGI

SEQ ID NO: 2232218 - protein, 17 aa, Cryptosporidium parvum
IHGCVPPKIHLFPSKSH

SEQ ID NO: 2232219 - protein, 17 aa, Cryptosporidium parvum
IHGKYAIYGTSIEKLKL

SEQ ID NO: 2232220 - protein, 28 aa, Cryptosporidium parvum
IHGRLCYRRTSILVLYNLYKCFTLNIVS

SEQ ID NO: 2232221 - protein, 18 aa, Cryptosporidium parvum
IHGSLKIPYHPDGPEGKC

SEQ ID NO: 2232222 - protein, 20 aa, Cryptosporidium parvum
IHIHRPFLFSSKMVHTDFKS

SEQ ID NO: 2232223 - protein, 20 aa, Cryptosporidium parvum
IHIKFPIRGSQSFKNADVGE

SEQ ID NO: 2232224 - protein, 22 aa, Cryptosporidium parvum
IHKKRITPIIISRNSSSNKRSI

SEQ ID NO: 2232225 - protein, 18 aa, Cryptosporidium parvum
IHLFLFFVLFSEFKYGEI

SEQ ID NO: 2232226 - protein, 17 aa, Cryptosporidium parvum
IHLQLGIDHQDEYMNPI

SEQ ID NO: 2232227 - protein, 27 aa, Cryptosporidium parvum
IHNVFNWKLKILINFKRIFLETYESNK

SEQ ID NO: 2232228 - protein, 24 aa, Cryptosporidium parvum
IHPFLLQLLFDFIKLYNIEEIIKG

SEQ ID NO: 2232229 - protein, 21 aa, Cryptosporidium parvum
IHPVLTRKNALAIFYSFIPYI

SEQ ID NO: 2232230 - protein, 18 aa, Cryptosporidium parvum
IHQLILLKEDNNILVEVI

SEQ ID NO: 2232231 - protein, 26 aa, Cryptosporidium parvum
IHRMKFNEVDAAVIIKQVLSGVTYLH

SEQ ID NO: 2232232 - protein, 21 aa, Cryptosporidium parvum
IHSHKDFRIFATMNPSGDYGK

SEQ ID NO: 2232233 - protein, 21 aa, Cryptosporidium parvum
IHSIRCFRSNDLILAGIIRLL

SEQ ID NO: 2232234 - protein, 20 aa, Cryptosporidium parvum
IHSLMKYFSGIHFLHAALLC

SEQ ID NO: 2232235 - protein, 24 aa, Cryptosporidium parvum
IHSLVLVCIICYIITEFKNDNDHK

SEQ ID NO: 2232236 - protein, 24 aa, Cryptosporidium parvum
IHYKSGTHIAVWPVNPIEKVLQFI

SEQ ID NO: 2232237 - protein, 18 aa, Cryptosporidium parvum
IIAAFFKRFNKPRNQITI

SEQ ID NO: 2232238 - protein, 17 aa, Cryptosporidium parvum
IIAEIWTIISSKVLENK

SEQ ID NO: 2232239 - protein, 17 aa, Cryptosporidium parvum
IICGSLLSLNGLIEDIS

SEQ ID NO: 2232240 - protein, 18 aa, Cryptosporidium parvum
IICLSVWLLHGTYLGCSL

SEQ ID NO: 2232241 - protein, 18 aa, Cryptosporidium parvum
IICSSFGLLGFYSITKNN

SEQ ID NO: 2232242 - protein, 18 aa, Cryptosporidium parvum
IIDGFRYIQHASHIGKVI

SEQ ID NO: 2232243 - protein, 29 aa, Cryptosporidium parvum
IIDLFTFRVRIFLAFSLFIAIVFFFCLKR

SEQ ID NO: 2232244 - protein, 26 aa, Cryptosporidium parvum
IIDLILNIILYRVFISGILVNDQLNK

SEQ ID NO: 2232245 - protein, 17 aa, Cryptosporidium parvum
IIDNFCKLCETHKKLFI

SEQ ID NO: 2232246 - protein, 18 aa, Cryptosporidium parvum
IIDRGPFDLKHGLRRFYK

SEQ ID NO: 2232247 - protein, 24 aa, Cryptosporidium parvum
IIEAKWQAILGVTLLKIGNVFVSF

SEQ ID NO: 2232248 - protein, 25 aa, Cryptosporidium parvum
IIEALRKGHWTKMFCFGVFAMEMFI

SEQ ID NO: 2232249 - protein, 17 aa, Cryptosporidium parvum
IIECLLPFIPLSWTKFF

SEQ ID NO: 2232250 - protein, 25 aa, Cryptosporidium parvum
IIEDWWKRREQLFLSVDELIWSNPK

SEQ ID NO: 2232251 - protein, 25 aa, Cryptosporidium parvum
IIEEACKLIGLLTIKPYIEDINYKE

SEQ ID NO: 2232252 - protein, 18 aa, Cryptosporidium parvum
IIERGKTLLQYRFHINDS

SEQ ID NO: 2232253 - protein, 18 aa, Cryptosporidium parvum
IIFISSIIFTFKLKFFLG

SEQ ID NO: 2232254 - protein, 27 aa, Cryptosporidium parvum
IIFMLKQGMFGDWTRFGELGYDAYRNV

SEQ ID NO: 2232255 - protein, 17 aa, Cryptosporidium parvum
IIFQFLFNEYNHVSTKT

SEQ ID NO: 2232256 - protein, 25 aa, Cryptosporidium parvum
IIFSKRLKYVYLYHRVEIKCILFRQ

SEQ ID NO: 2232257 - protein, 22 aa, Cryptosporidium parvum
IIFSLLCIFVHILKQFLQKKGF

SEQ ID NO: 2232258 - protein, 19 aa, Cryptosporidium parvum
IIGDISVFRRYFHQNQKNN

SEQ ID NO: 2232259 - protein, 33 aa, Cryptosporidium parvum; identical to SEQ ID NO: 2124036

SEQ ID NO: 2232260 - protein, 18 aa, Cryptosporidium parvum
IIGFCIIPSGILFSKPNA

SEQ ID NO: 2232261 - protein, 23 aa, Cryptosporidium parvum
IIGSIYWNKDVCRWETNNEIDLY

SEQ ID NO: 2232262 - protein, 19 aa, Cryptosporidium parvum
IIGVYPCYVFIQTKELRDY

SEQ ID NO: 2232263 - protein, 17 aa, Cryptosporidium parvum
IIHDINNFFGLKKGVQL

SEQ ID NO: 2232264 - protein, 19 aa, Cryptosporidium parvum
IIHVGRLGKMVLSPRQEHI

SEQ ID NO: 2232265 - protein, 19 aa, Cryptosporidium parvum
IIHVLRVNFELGNDNLKTQ

SEQ ID NO: 2232266 - protein, 19 aa, Cryptosporidium parvum
IIIAESFNILISGRYLSNI

SEQ ID NO: 2232267 - protein, 18 aa, Cryptosporidium parvum
IIIASIFGIMEILLNRMV

SEQ ID NO: 2232268 - protein, 26 aa, Cryptosporidium parvum
IIICNIKPLNICSGVLSRIISIFGQF

SEQ ID NO: 2232269 - protein, 23 aa, Cryptosporidium parvum
IIIDLFYLKSMKIWKIDHELRIT

SEQ ID NO: 2232270 - protein, 17 aa, Cryptosporidium parvum
IIIFLSVYQKVILRNST

SEQ ID NO: 2232271 - protein, 25 aa, Cryptosporidium parvum
IIIIGIWLAWIFRYKRQTEIYDMDH

SEQ ID NO: 2232272 - protein, 27 aa, Cryptosporidium parvum
IIIILKEIWIGMGIKNLLLINILRNKE

SEQ ID NO: 2232273 - protein, 17 aa, Cryptosporidium parvum
IIINHGWYYGILLLIIS

SEQ ID NO: 2232274 - protein, 20 aa, Cryptosporidium parvum
IIINIYHIWFNSYIGLLYCN

SEQ ID NO: 2232275 - protein, 18 aa, Cryptosporidium parvum
IIKDKFGKILFKTSYSLV

SEQ ID NO: 2232276 - protein, 24 aa, Cryptosporidium parvum
IIKPWCIEILSLLMEFRDTTRSIV

SEQ ID NO: 2232277 - protein, 27 aa, Cryptosporidium parvum
IILFGVCLAAFIFGIGIFMIANFGGNL

SEQ ID NO: 2232278 - protein, 17 aa, Cryptosporidium parvum
IILGIILETRWVIWRYA

SEQ ID NO: 2232279 - protein, 27 aa, Cryptosporidium parvum
IILKKTPFREILLWTTLFSIPIYILPL

SEQ ID NO: 2232280 - protein, 18 aa, Cryptosporidium parvum
IILKRCIVESVMPNIQSQ

SEQ ID NO: 2232281 - protein, 23 aa, Cryptosporidium parvum
IILKSGDLFAILASILTYYNIKY

SEQ ID NO: 2232282 - protein, 25 aa, Cryptosporidium parvum
IILLAIDCFFSFFRHILLNHPHNVS

SEQ ID NO: 2232283 - protein, 25 aa, Cryptosporidium parvum
IILLDRLASLWFGSYIHITNLKRLP

SEQ ID NO: 2232284 - protein, 18 aa, Cryptosporidium parvum
IILLLRFISIFDLSDAKD

SEQ ID NO: 2232285 - protein, 20 aa, Cryptosporidium parvum
IILLNCFNYIKENLKVENKE

SEQ ID NO: 2232286 - protein, 22 aa, Cryptosporidium parvum
IILLRRMIPLTLLGSENSLTNN

SEQ ID NO: 2232287 - protein, 25 aa, Cryptosporidium parvum
IILLSLLAFVVWFLLAYYDKVDPAR

SEQ ID NO: 2232288 - protein, 17 aa, Cryptosporidium parvum
IILMVTFMTYKIVCQRY

SEQ ID NO: 2232289 - protein, 24 aa, Cryptosporidium parvum
IILNDLYDIWFLKFTENEPEMTKY

SEQ ID NO: 2232290 - protein, 24 aa, Cryptosporidium parvum
IILNGWRVAPAITYQYYQKSTLKS

SEQ ID NO: 2232291 - protein, 24 aa, Cryptosporidium parvum
IILQCFDCGLIYYTDLPLNKQQLG

SEQ ID NO: 2232292 - protein, 17 aa, Cryptosporidium parvum
IILQEVILREDQIRLCI

SEQ ID NO: 2232293 - protein, 17 aa, Cryptosporidium parvum
IILRIFSIILKRRNSNI

SEQ ID NO: 2232294 - protein, 17 aa, Cryptosporidium parvum
IILVLPICRALETLLEK

SEQ ID NO: 2232295 - protein, 17 aa, Cryptosporidium parvum
IILYDIFTEIKIWRIEN

SEQ ID NO: 2232296 - protein, 23 aa, Cryptosporidium parvum
IIMERINIGNLCHKNDKSECINV

SEQ ID NO: 2232297 - protein, 18 aa, Cryptosporidium parvum
IIMFKRISFDKVNSILSY

SEQ ID NO: 2232298 - protein, 17 aa, Cryptosporidium parvum
IIMGGVFFSLPRAGEND

SEQ ID NO: 2232299 - protein, 19 aa, Cryptosporidium parvum
IIMIIKYKFQANMEEILSK

SEQ ID NO: 2232300 - protein, 28 aa, Cryptosporidium parvum
IINCFECFAKFLGHFLIAFVFFAISFLY

SEQ ID NO: 2232301 - protein, 19 aa, Cryptosporidium parvum
IINFFKKIVKFFCKNNYQC

SEQ ID NO: 2232302 - protein, 23 aa, Cryptosporidium parvum
IINGKEIYPLVSLEIKTQQLKLE

SEQ ID NO: 2232303 - protein, 26 aa, Cryptosporidium parvum
IINKSDLLGLMLFRLGLINEALLIYE

SEQ ID NO: 2232304 - protein, 27 aa, Cryptosporidium parvum
IINNIYFFLSEVIFFELITRIQNFCSN

SEQ ID NO: 2232305 - protein, 22 aa, Cryptosporidium parvum
IINRFDYPYLLGVITSKKKVLL

SEQ ID NO: 2232306 - protein, 22 aa, Cryptosporidium parvum
IINTFFRSGTKFEVISNEIELI

SEQ ID NO: 2232307 - protein, 25 aa, Cryptosporidium parvum
IIPFKEWYQHLSHFKTNFEKMFTCS

SEQ ID NO: 2232308 - protein, 23 aa, Cryptosporidium parvum
IIPISLRVNLEMAKIVFSSQINN

SEQ ID NO: 2232309 - protein, 19 aa, Cryptosporidium parvum
IIQDFSFRSANVHSFIFSL

SEQ ID NO: 2232310 - protein, 26 aa, Cryptosporidium parvum
IIQIADPIGIMWLELNGINLGEERFP

SEQ ID NO: 2232311 - protein, 18 aa, Cryptosporidium parvum
IIRDGVFQGFSWLTILVI

SEQ ID NO: 2232312 - protein, 22 aa, Cryptosporidium parvum
IIRNGKMAFKFIYSNQTIPMYK

SEQ ID NO: 2232313 - protein, 22 aa, Cryptosporidium parvum
IIRYFPPGMKWMDGSISQDIPH

SEQ ID NO: 2232314 - protein, 24 aa, Cryptosporidium parvum
IIRYSRIPIIDIFNTFSNKKAQFS

SEQ ID NO: 2232315 - protein, 20 aa, Cryptosporidium parvum
IISAFPAIITNLLFGIFDIV

SEQ ID NO: 2232316 - protein, 18 aa, Cryptosporidium parvum
IISAFRFLKQINKSPNPE

SEQ ID NO: 2232317 - protein, 21 aa, Cryptosporidium parvum
IISAGCIRGKVIWDMNMQEQI

SEQ ID NO: 2232318 - protein, 23 aa, Cryptosporidium parvum
IISDEFFIEMQIERQLGYVVEAK

SEQ ID NO: 2232319 - protein, 22 aa, Cryptosporidium parvum
IISDLLLPYSIKQLIIEKEESY

SEQ ID NO: 2232320 - protein, 24 aa, Cryptosporidium parvum
IISFICVFASFGLGIVPTAWKLVS

SEQ ID NO: 2232321 - protein, 21 aa, Cryptosporidium parvum
IISFISIPFIKPGITSDIISL

SEQ ID NO: 2232322 - protein, 22 aa, Cryptosporidium parvum
IISGIAILFAFAFVILIALNGE

SEQ ID NO: 2232323 - protein, 17 aa, Cryptosporidium parvum
IISILWILSANYCNLFK

SEQ ID NO: 2232324 - protein, 20 aa, Cryptosporidium parvum
IISLANFYYLYSLKDKSAET

SEQ ID NO: 2232325 - protein, 23 aa, Cryptosporidium parvum
IISNRLSFIYGIKGPSVTIDTAC

SEQ ID NO: 2232326 - protein, 24 aa, Cryptosporidium parvum
IISPIKIIGVWVLLQRNMGFSANL

SEQ ID NO: 2232327 - protein, 23 aa, Cryptosporidium parvum
IISSELLSALTIKPVNVFNKFAI

SEQ ID NO: 2232328 - protein, 19 aa, Cryptosporidium parvum
IISSIEILDVDWTVKEFLL

SEQ ID NO: 2232329 - protein, 17 aa, Cryptosporidium parvum
IISSTHFPWEFKYVYKA

SEQ ID NO: 2232330 - protein, 24 aa, Cryptosporidium parvum
IITKRIANCILTYWDNFSFHKIFK

SEQ ID NO: 2232331 - protein, 17 aa, Cryptosporidium parvum
IITPHFFYDIIFGLTNI

SEQ ID NO: 2232332 - protein, 17 aa, Cryptosporidium parvum
IITQGKFSFARVRSTTI

SEQ ID NO: 2232333 - protein, 24 aa, Cryptosporidium parvum
IITRNIFKYFSWKNLIRNINLTYS

SEQ ID NO: 2232334 - protein, 18 aa, Cryptosporidium parvum
IITTLIFGLIVYIKRINS

SEQ ID NO: 2232335 - protein, 24 aa, Cryptosporidium parvum
IITTQFYRRLYVFLFGIVLFFILL

SEQ ID NO: 2232336 - protein, 18 aa, Cryptosporidium parvum
IIVILKLGFGINHFEVLF

SEQ ID NO: 2232337 - protein, 21 aa, Cryptosporidium parvum
IIVPIKFRVDFNVENVIDEFK

SEQ ID NO: 2232338 - protein, 17 aa, Cryptosporidium parvum
IIVSFLFLFNASHIVRI

SEQ ID NO: 2232339 - protein, 23 aa, Cryptosporidium parvum
IIWMSILEPWQWSPPSSLNSSNR

SEQ ID NO: 2232340 - protein, 23 aa, Cryptosporidium parvum
IIYKGELFETAFLTVDQSGLGIL

SEQ ID NO: 2232341 - protein, 23 aa, Cryptosporidium parvum
IIYKLCYNISYLSPYSMIDTLNN

SEQ ID NO: 2232342 - protein, 26 aa, Cryptosporidium parvum
IIYLLNKILFWFIVISIFAFCISVAT

SEQ ID NO: 2232343 - protein, 27 aa, Cryptosporidium parvum
IIYRLEYETINLLNLFLQGEFEIFESI

SEQ ID NO: 2232344 - protein, 18 aa, Cryptosporidium parvum
IIYRRRLEKESNTFLNDL

SEQ ID NO: 2232345 - protein, 26 aa, Cryptosporidium parvum
IIYTCINKLNIVSAIFKILDQKNVFD

SEQ ID NO: 2232346 - protein, 29 aa, Cryptosporidium parvum
IIYYNHWLFDKVAPFPVFATWVQQIVGVF

SEQ ID NO: 2232347 - protein, 19 aa, Cryptosporidium parvum
IKAALKLLDIELEMVEFED

SEQ ID NO: 2232348 - protein, 19 aa, Cryptosporidium parvum
IKAIQCWVDYFNLWLIYFF

SEQ ID NO: 2232349 - protein, 23 aa, Cryptosporidium parvum
IKALAGSIYRPAESRFMDLLNHE

SEQ ID NO: 2232350 - protein, 19 aa, Cryptosporidium parvum
IKALLRYASILNEVSSFLN

SEQ ID NO: 2232351 - protein, 25 aa, Cryptosporidium parvum
IKAPRCPKLRSLLCCCSASSENEDD

SEQ ID NO: 2232352 - protein, 25 aa, Cryptosporidium parvum
IKASDIIIRLSLRYINFELNMGEVN

SEQ ID NO: 2232353 - protein, 20 aa, Cryptosporidium parvum
IKAVEICNALSKEFNIDFPA

SEQ ID NO: 2232354 - protein, 17 aa, Cryptosporidium parvum
IKAYNKDICIVRDNEGR

SEQ ID NO: 2232355 - protein, 20 aa, Cryptosporidium parvum
IKCIETIYLSSIILLYTQLK

SEQ ID NO: 2232356 - protein, 22 aa, Cryptosporidium parvum
IKCIRVYSAIYFYVQEGTEKCF

SEQ ID NO: 2232357 - protein, 19 aa, Cryptosporidium parvum
IKDPETWKLADREIDSLKR

SEQ ID NO: 2232358 - protein, 24 aa, Cryptosporidium parvum
IKDPSLRYGPNVKRKTPRKRIIPI

SEQ ID NO: 2232359 - protein, 19 aa, Cryptosporidium parvum
IKDYLLLMTHQLYQLNNEL

SEQ ID NO: 2232360 - protein, 20 aa, Cryptosporidium parvum
IKEAEREGGYLNSKDESQEC

SEQ ID NO: 2232361 - protein, 17 aa, Cryptosporidium parvum
IKEALKVLSTCLPSSGN

SEQ ID NO: 2232362 - protein, 22 aa, Cryptosporidium parvum
IKEKNTKCLINIFKLSKFSRNE

SEQ ID NO: 2232363 - protein, 21 aa, Cryptosporidium parvum
IKELKICGFKTYRDETTISFH

SEQ ID NO: 2232364 - protein, 24 aa, Cryptosporidium parvum
IKEYEERSIFPLAEGLKLIKKLDI

SEQ ID NO: 2232365 - protein, 21 aa, Cryptosporidium parvum
IKFAPLDLKDLISIEKNHGSM

SEQ ID NO: 2232366 - protein, 26 aa, Cryptosporidium parvum
IKFFLEISGYSVIYLHEFESQKKYNN

SEQ ID NO: 2232367 - protein, 24 aa, Cryptosporidium parvum
IKFPRILERLLYKACKLVNLMEIP

SEQ ID NO: 2232368 - protein, 18 aa, Cryptosporidium parvum
IKGALLVAKKPLYFDEII

SEQ ID NO: 2232369 - protein, 23 aa, Cryptosporidium parvum
IKGLFRKATCLINITTNNNNDSI

SEQ ID NO: 2232370 - protein, 17 aa, Cryptosporidium parvum
IKGNIVFETNNNPLIIS

SEQ ID NO: 2232371 - protein, 19 aa, Cryptosporidium parvum
IKHIEIFVRTWFKFLELSV

SEQ ID NO: 2232372 - protein, 20 aa, Cryptosporidium parvum
IKHPFLVRMFGTFKDDRYLY

SEQ ID NO: 2232373 - protein, 36 aa, Cryptosporidium parvum
IKHVPCDPNYLLTCFKYLLEKDWIYSIDSINKMMNK

SEQ ID NO: 2232374 - protein, 22 aa, Cryptosporidium parvum
IKIGDFGLARLMFDGDSKTNNG

SEQ ID NO: 2232375 - protein, 17 aa, Cryptosporidium parvum
IKIIRYIYNSQIQTKNS

SEQ ID NO: 2232376 - protein, 37 aa, Cryptosporidium parvum
IKIKVPICQLCGYDAYCRSGGIMKKTVDGFWAHIRCA

SEQ ID NO: 2232377 - protein, 38 aa, Cryptosporidium parvum; identical to SEQ ID NO: 2124095

SEQ ID NO: 2232378 - protein, 24 aa, Cryptosporidium parvum
IKINLPKYPKYISMLYGFLAGLIG

SEQ ID NO: 2232379 - protein, 21 aa, Cryptosporidium parvum
IKIPGNDAIQMIISGDQNKYL

SEQ ID NO: 2232380 - protein, 17 aa, Cryptosporidium parvum
IKIPNIIPIHIILNRIG

SEQ ID NO: 2232381 - protein, 24 aa, Cryptosporidium parvum
IKIRNIRELAEMTGCDNVKVIRDG

SEQ ID NO: 2232382 - protein, 23 aa, Cryptosporidium parvum
IKISRPSILYLLSYHDHSDIAIV

SEQ ID NO: 2232383 - protein, 25 aa, Cryptosporidium parvum
IKITPYYILSILFSLDIPRKEIYNQ

SEQ ID NO: 2232384 - protein, 18 aa, Cryptosporidium parvum
IKKCYNCYESCEYEYGII

SEQ ID NO: 2232385 - protein, 22 aa, Cryptosporidium parvum
IKKDDFIMIYSFYGHLNNIKSV

SEQ ID NO: 2232386 - protein, 18 aa, Cryptosporidium parvum
IKKGTGLNRQICNNYDDT

SEQ ID NO: 2232387 - protein, 23 aa, Cryptosporidium parvum
IKKILLIICPYITFFTQNKRKSF

SEQ ID NO: 2232388 - protein, 18 aa, Cryptosporidium parvum
IKKIVTFYFLYRGEYKRD

SEQ ID NO: 2232389 - protein, 20 aa, Cryptosporidium parvum
IKKLLIPLLVRLEGPTLELS

SEQ ID NO: 2232390 - protein, 26 aa, Cryptosporidium parvum
IKKLYMELWYNGWLALLKLVQCMNPH

SEQ ID NO: 2232391 - protein, 19 aa, Cryptosporidium parvum
IKLDELFKENGFIRVTNSY

SEQ ID NO: 2232392 - protein, 23 aa, Cryptosporidium parvum
IKLELPIYINILFITITSLLLTQ

SEQ ID NO: 2232393 - protein, 19 aa, Cryptosporidium parvum
IKLICCTTFQWQMVFQFIK

SEQ ID NO: 2232394 - protein, 21 aa, Cryptosporidium parvum
IKLLFLLLLEVCAYKFTNGVP

SEQ ID NO: 2232395 - protein, 19 aa, Cryptosporidium parvum
IKLLPCIKMLTVSCFTFSN

SEQ ID NO: 2232396 - protein, 22 aa, Cryptosporidium parvum
IKLLSPNLWLPLGIFPSKCLFK

SEQ ID NO: 2232397 - protein, 19 aa, Cryptosporidium parvum
IKLLTCIINNQLIQEINST

SEQ ID NO: 2232398 - protein, 20 aa, Cryptosporidium parvum
IKLLVIFLVIIIKIGVVNTE

SEQ ID NO: 2232399 - protein, 18 aa, Cryptosporidium parvum
IKLPISLMLDNPTLDEVI

SEQ ID NO: 2232400 - protein, 23 aa, Cryptosporidium parvum
IKLPKYKLLLTFLLILGSSIVSY

SEQ ID NO: 2232401 - protein, 27 aa, Cryptosporidium parvum
IKLRERLRCNSFKWFLENVNPEAEVKS

SEQ ID NO: 2232402 - protein, 36 aa, Cryptosporidium parvum
IKLRQQMWLRRPRWFVYEIIPLVILFTKIFSSVDYY

SEQ ID NO: 2232403 - protein, 19 aa, Cryptosporidium parvum
IKLSPIALKDSEPVVLCVL

SEQ ID NO: 2232404 - protein, 17 aa, Cryptosporidium parvum
IKMPCNGRIEYPISESS

SEQ ID NO: 2232405 - protein, 20 aa, Cryptosporidium parvum
IKMVLELFVIILIVNYLLLH

SEQ ID NO: 2232406 - protein, 20 aa, Cryptosporidium parvum
IKNCRLEAFNTSFIGCLEAI

SEQ ID NO: 2232407 - protein, 24 aa, Cryptosporidium parvum
IKNFCILTFVGLLFGYITCLTILL

SEQ ID NO: 2232408 - protein, 22 aa, Cryptosporidium parvum
IKNGAPILRRKAMKQIVETARD

SEQ ID NO: 2232409 - protein, 25 aa, Cryptosporidium parvum
IKNILKFILHWSIAFIMFISTIFPF

SEQ ID NO: 2232410 - protein, 27 aa, Cryptosporidium parvum
IKNMLPYKLRFFIGFSSISSLFGSFGQ

SEQ ID NO: 2232411 - protein, 19 aa, Cryptosporidium parvum
IKNQICNYIAFTPKLEMNY

SEQ ID NO: 2232412 - protein, 24 aa, Cryptosporidium parvum
IKNQRIIEWSKLHLSDNIIIIDDL

SEQ ID NO: 2232413 - protein, 18 aa, Cryptosporidium parvum
IKNSCLNPILSVIDDHCK

SEQ ID NO: 2232414 - protein, 18 aa, Cryptosporidium parvum
IKNYSVNIFDEFTLASLP

SEQ ID NO: 2232415 - protein, 21 aa, Cryptosporidium parvum
IKPFIIRKIIEMINENQIKKQ

SEQ ID NO: 2232416 - protein, 18 aa, Cryptosporidium parvum
IKPICLKFISSYREYQRF

SEQ ID NO: 2232417 - protein, 20 aa, Cryptosporidium parvum
IKPKLCVSAPVKAISCYLLS

SEQ ID NO: 2232418 - protein, 17 aa, Cryptosporidium parvum
IKPSICGINELYSKKYD

SEQ ID NO: 2232419 - protein, 20 aa, Cryptosporidium parvum
IKQFFFCFFIEESLKANIKE

SEQ ID NO: 2232420 - protein, 18 aa, Cryptosporidium parvum
IKQFFKAFLSNSFPLPAL

SEQ ID NO: 2232421 - protein, 24 aa, Cryptosporidium parvum
IKRLHIEFLIPIFIYVLFYLVSIL

SEQ ID NO: 2232422 - protein, 25 aa, Cryptosporidium parvum
IKRLRAECFYSMLYQDIKFHEQPNQ

SEQ ID NO: 2232423 - protein, 17 aa, Cryptosporidium parvum
IKRRYESYISLNSDNSF

SEQ ID NO: 2232424 - protein, 22 aa, Cryptosporidium parvum
IKRTEFDLLIGQMIADISDVKI

SEQ ID NO: 2232425 - protein, 19 aa, Cryptosporidium parvum
IKSACKLAGVHENILKMKN

SEQ ID NO: 2232426 - protein, 26 aa, Cryptosporidium parvum
IKSALNICGFGSYLERSDSLNLESEL

SEQ ID NO: 2232427 - protein, 18 aa, Cryptosporidium parvum
IKSDSKMEFLINNDMFSS

SEQ ID NO: 2232428 - protein, 26 aa, Cryptosporidium parvum
IKSEMSNVIMLYGFLETIEIKMNTNE

SEQ ID NO: 2232429 - protein, 30 aa, Cryptosporidium parvum
IKSFFKLIFCILSSFLLLIKLQIFKFIGIS

SEQ ID NO: 2232430 - protein, 26 aa, Cryptosporidium parvum
IKSILFKCFIVFAMNIFLKPYKHLLT

SEQ ID NO: 2232431 - protein, 18 aa, Cryptosporidium parvum
IKSLLGIIKEQFFLEVKI

SEQ ID NO: 2232432 - protein, 21 aa, Cryptosporidium parvum
IKSLRYFQDQLFKFLIQKNHR

SEQ ID NO: 2232433 - protein, 21 aa, Cryptosporidium parvum
IKSNCIKRSTQLRGVKNLLMH

SEQ ID NO: 2232434 - protein, 21 aa, Cryptosporidium parvum
IKSPVMAGGLFAMKRDYFWHL

SEQ ID NO: 2232435 - protein, 25 aa, Cryptosporidium parvum
IKSRHYKGTGLVIFGLLFIILFGIK

SEQ ID NO: 2232436 - protein, 19 aa, Cryptosporidium parvum
IKSYSWERYFIKNIDSHRE

SEQ ID NO: 2232437 - protein, 23 aa, Cryptosporidium parvum
IKTESGLSYKSRVIYLTEKGGAS

SEQ ID NO: 2232438 - protein, 22 aa, Cryptosporidium parvum
IKTFCKGKCMSLLKESLNEYKK

SEQ ID NO: 2232439 - protein, 21 aa, Cryptosporidium parvum
IKTLPKQGIVFIIGGGNFTEA

SEQ ID NO: 2232440 - protein, 17 aa, Cryptosporidium parvum
IKTPSIYNLGSIIRTIS

SEQ ID NO: 2232441 - protein, 18 aa, Cryptosporidium parvum
IKTSIITFFTWIIVLANL

SEQ ID NO: 2232442 - protein, 34 aa, Cryptosporidium parvum
IKTSIPLIGKNIDCFSCQMLYSTFLVLFNIYSNT

SEQ ID NO: 2232443 - protein, 18 aa, Cryptosporidium parvum
IKTYLLFLDICVLNVIKN

SEQ ID NO: 2232444 - protein, 18 aa, Cryptosporidium parvum
IKVFLNHPMYCYKALLYI

SEQ ID NO: 2232445 - protein, 30 aa, Cryptosporidium parvum
IKVLKYELVITLLTGWSLICDRNRRFEMHL

SEQ ID NO: 2232446 - protein, 18 aa, Cryptosporidium parvum
IKVNEEFQPFIFNLFSLL

SEQ ID NO: 2232447 - protein, 17 aa, Cryptosporidium parvum
IKVNFELLINVPKSPIT

SEQ ID NO: 2232448 - protein, 27 aa, Cryptosporidium parvum
IKVQEGFWKKHFIYIGMNPPQIVTNSG

SEQ ID NO: 2232449 - protein, 17 aa, Cryptosporidium parvum
IKVREAEMIILRNIIKN

SEQ ID NO: 2232450 - protein, 22 aa, Cryptosporidium parvum
IKVVWFTLELNYYLYLREISKK

SEQ ID NO: 2232451 - protein, 17 aa, Cryptosporidium parvum
IKYDFVLNQQYTFKFAI

SEQ ID NO: 2232452 - protein, 25 aa, Cryptosporidium parvum
IKYFIKLLKMRSIDSIFWMIAFIGT

SEQ ID NO: 2232453 - protein, 21 aa, Cryptosporidium parvum
IKYGNSGGCIKLIYDSLYTFI

SEQ ID NO: 2232454 - protein, 17 aa, Cryptosporidium parvum
IKYLKGFIKIPELSGKL

SEQ ID NO: 2232455 - protein, 18 aa, Cryptosporidium parvum
IKYNYLFDFIIQILGNIN

SEQ ID NO: 2232456 - protein, 18 aa, Cryptosporidium parvum
IKYPIAVNYLYPKKIISL

SEQ ID NO: 2232457 - protein, 18 aa, Cryptosporidium parvum
IKYQILINKLNPMYITEK

SEQ ID NO: 2232458 - protein, 25 aa, Cryptosporidium parvum
ILAIQCIILAFGIFVFISLLYYLLS

SEQ ID NO: 2232459 - protein, 23 aa, Cryptosporidium parvum
ILANRISFYNGFAGPSITIDTAC

SEQ ID NO: 2232460 - protein, 20 aa, Cryptosporidium parvum
ILCLNRLGSNLPILYKEDGI

SEQ ID NO: 2232461 - protein, 25 aa, Cryptosporidium parvum
ILCNCCYKESYNLNTFDLIFYIQNQ

SEQ ID NO: 2232462 - protein, 17 aa, Cryptosporidium parvum
ILCNSIYIICSFCHLSC

SEQ ID NO: 2232463 - protein, 20 aa, Cryptosporidium parvum
ILCSDLIIEFGKRISSKDRG

SEQ ID NO: 2232464 - protein, 18 aa, Cryptosporidium parvum
ILDIKSIILKFNYKQKSP

SEQ ID NO: 2232465 - protein, 18 aa, Cryptosporidium parvum
ILDIYAKLIIVVSPFGAI

SEQ ID NO: 2232466 - protein, 18 aa, Cryptosporidium parvum
ILDLDGLSIYTAREATDG

SEQ ID NO: 2232467 - protein, 22 aa, Cryptosporidium parvum
ILDLMERVLFLWAIRNPASGYV

SEQ ID NO: 2232468 - protein, 18 aa, Cryptosporidium parvum
ILDPYLLLRFIKLSFEEL

SEQ ID NO: 2232469 - protein, 26 aa, Cryptosporidium parvum
ILDQKKFCNHYFKPMNIEVPGTILRS

SEQ ID NO: 2232470 - protein, 18 aa, Cryptosporidium parvum
ILDRNVLFSRLFWLDIAY

SEQ ID NO: 2232471 - protein, 22 aa, Cryptosporidium parvum
ILDRYYRIFNSISFSGENNVLK

SEQ ID NO: 2232472 - protein, 18 aa, Cryptosporidium parvum
ILDYMVVKCMDSFSRLFS

SEQ ID NO: 2232473 - protein, 19 aa, Cryptosporidium parvum
ILEEQVWALLPGFFDEPLD

SEQ ID NO: 2232474 - protein, 25 aa, Cryptosporidium parvum
ILEKLEPRASISLAKTRTKGTGWAR

SEQ ID NO: 2232475 - protein, 27 aa, Cryptosporidium parvum
ILERDCGWRRPRITIPPPVDSIDASPL

SEQ ID NO: 2232476 - protein, 18 aa, Cryptosporidium parvum
ILERFSLSTHKIFLFFHT

SEQ ID NO: 2232477 - protein, 18 aa, Cryptosporidium parvum
ILESNSFIISRNRNQKSG

SEQ ID NO: 2232478 - protein, 28 aa, Cryptosporidium parvum
ILETFCRYRRNIGLPGQVAFWNYNSEQV

SEQ ID NO: 2232479 - protein, 18 aa, Cryptosporidium parvum
ILEYTRIISNCTCLSIFE

SEQ ID NO: 2232480 - protein, 19 aa, Cryptosporidium parvum
ILFCLCMTGSLLTYKYIFD

SEQ ID NO: 2232481 - protein, 18 aa, Cryptosporidium parvum
ILFDCLFIIPCLLIFLSD

SEQ ID NO: 2232482 - protein, 29 aa, Cryptosporidium parvum
ILFELFLSYFLEHIIKLLKIHKLINGETN

SEQ ID NO: 2232483 - protein, 20 aa, Cryptosporidium parvum
ILFESWRTSNRFDYFISCLF

SEQ ID NO: 2232484 - protein, 18 aa, Cryptosporidium parvum
ILFILKYLTSFIIVSISQ

SEQ ID NO: 2232485 - protein, 17 aa, Cryptosporidium parvum
ILFKLGTMGLIPVNRGD

SEQ ID NO: 2232486 - protein, 25 aa, Cryptosporidium parvum
ILFKTEIYLIRILDFGIKLRYTQFK

SEQ ID NO: 2232487 - protein, 18 aa, Cryptosporidium parvum
ILFQLVAYIFAARVLSTL

SEQ ID NO: 2232488 - protein, 17 aa, Cryptosporidium parvum
ILFVFLFSVARLSISAI

SEQ ID NO: 2232489 - protein, 30 aa, Cryptosporidium parvum; identical to SEQ ID NO: 2124156

SEQ ID NO: 2232490 - protein, 25 aa, Cryptosporidium parvum
ILFYKYRLLIRLILNKERIILNNKS

SEQ ID NO: 2232491 - protein, 20 aa, Cryptosporidium parvum
ILFYLCRVLYSIGKSASQRE

SEQ ID NO: 2232492 - protein, 18 aa, Cryptosporidium parvum
ILGLCIIAGSLFLIGGRS

SEQ ID NO: 2232493 - protein, 19 aa, Cryptosporidium parvum
ILGLLRLHALLGSYYIAIE

SEQ ID NO: 2232494 - protein, 18 aa, Cryptosporidium parvum
ILGLRFVIVLVLSALLYP

SEQ ID NO: 2232495 - protein, 18 aa, Cryptosporidium parvum
ILGNIPNIALYIFNSATE

SEQ ID NO: 2232496 - protein, 17 aa, Cryptosporidium parvum
ILGNYKLDSGFISLDGI

SEQ ID NO: 2232497 - protein, 22 aa, Cryptosporidium parvum
ILHAFLAIYWIYKCIRNSKQLI

SEQ ID NO: 2232498 - protein, 23 aa, Cryptosporidium parvum
ILHEFCGRIEFSRNCEALLEEIL

SEQ ID NO: 2232499 - protein, 23 aa, Cryptosporidium parvum
ILHIKRLKFPIYSIITQFTENYQ

SEQ ID NO: 2232500 - protein, 17 aa, Cryptosporidium parvum
ILHSCFELNPGYIYINH

SEQ ID NO: 2232501 - protein, 17 aa, Cryptosporidium parvum
ILHYIYFVEIINHIFVE

SEQ ID NO: 2232502 - protein, 23 aa, Cryptosporidium parvum
ILICVPPELKLQIPPGSQNSDHI

SEQ ID NO: 2232503 - protein, 17 aa, Cryptosporidium parvum
ILIECYNVILLKFQTLF

SEQ ID NO: 2232504 - protein, 17 aa, Cryptosporidium parvum
ILIELAWIPSTFRNLFW

SEQ ID NO: 2232505 - protein, 18 aa, Cryptosporidium parvum
ILIKQCMDYYLLRYYVYR

SEQ ID NO: 2232506 - protein, 17 aa, Cryptosporidium parvum
ILILKLLSIQNYEKSIE

SEQ ID NO: 2232507 - protein, 24 aa, Cryptosporidium parvum
ILILSSLECLGMWLYNPKYSSLLY

SEQ ID NO: 2232508 - protein, 25 aa, Cryptosporidium parvum
ILINKCPFLALLLLYISSHRRHLKE

SEQ ID NO: 2232509 - protein, 18 aa, Cryptosporidium parvum
ILITRSIILSICLIMFTI

SEQ ID NO: 2232510 - protein, 21 aa, Cryptosporidium parvum
ILITSCCRLLFDSPEDVRPVL

SEQ ID NO: 2232511 - protein, 23 aa, Cryptosporidium parvum
ILIYEMVVGFPPFYDDEPMGIYQ

SEQ ID NO: 2232512 - protein, 25 aa, Cryptosporidium parvum
ILKFILNYCKKCFENIMNGESVNKR

SEQ ID NO: 2232513 - protein, 21 aa, Cryptosporidium parvum
ILKKTHLFMSTKYYSKHSKNI

SEQ ID NO: 2232514 - protein, 21 aa, Cryptosporidium parvum
ILKMEKAIMAPNCFDNKFILA

SEQ ID NO: 2232515 - protein, 17 aa, Cryptosporidium parvum
ILKQFCSAFDSIQLSPK

SEQ ID NO: 2232516 - protein, 20 aa, Cryptosporidium parvum
ILKQRYMLRNAIEKLNEIKY

SEQ ID NO: 2232517 - protein, 24 aa, Cryptosporidium parvum
ILLAESSPILSFRVEVEDTEKNNP

SEQ ID NO: 2232518 - protein, 17 aa, Cryptosporidium parvum
ILLCAAGAIVVLTTFRK

SEQ ID NO: 2232519 - protein, 17 aa, Cryptosporidium parvum
ILLCTSVGQMADKIVLE

SEQ ID NO: 2232520 - protein, 24 aa, Cryptosporidium parvum
ILLELLCPRFTTAMERIHVLDSFR

SEQ ID NO: 2232521 - protein, 18 aa, Cryptosporidium parvum
ILLEYPYSYFLPLLSCFQ

SEQ ID NO: 2232522 - protein, 18 aa, Cryptosporidium parvum
ILLIEIFIGIAISAWKLW

SEQ ID NO: 2232523 - protein, 26 aa, Cryptosporidium parvum
ILLIIYCVFCGLTTSAIQQSICIRFI

SEQ ID NO: 2232524 - protein, 24 aa, Cryptosporidium parvum
ILLIKEIFSYLSIIEKSELNINSC

SEQ ID NO: 2232525 - protein, 18 aa, Cryptosporidium parvum
ILLIWFMTIMLVYEAIQR

SEQ ID NO: 2232526 - protein, 17 aa, Cryptosporidium parvum
ILLKAIWISCFLVSSSA

SEQ ID NO: 2232527 - protein, 21 aa, Cryptosporidium parvum
ILLLFRWVILLMYIVAQLFLP

SEQ ID NO: 2232528 - protein, 20 aa, Cryptosporidium parvum
ILLNELKILYNQKINFKLDN

SEQ ID NO: 2232529 - protein, 21 aa, Cryptosporidium parvum
ILLPFILEIYYLIPNFVSFYS

SEQ ID NO: 2232530 - protein, 17 aa, Cryptosporidium parvum
ILLPLIGLLTEISTFRD

SEQ ID NO: 2232531 - protein, 24 aa, Cryptosporidium parvum
ILLRIIFMIILLRYIPWGSHYFFY

SEQ ID NO: 2232532 - protein, 19 aa, Cryptosporidium parvum
ILLSIPVIILWVFSELFSR

SEQ ID NO: 2232533 - protein, 17 aa, Cryptosporidium parvum
ILLSLVGRMPCHSSNIL

SEQ ID NO: 2232534 - protein, 26 aa, Cryptosporidium parvum
ILLTLCFTWASLGVFVSHITFMIFYG

SEQ ID NO: 2232535 - protein, 18 aa, Cryptosporidium parvum
ILLWKLLSNLNESGLLCR

SEQ ID NO: 2232536 - protein, 17 aa, Cryptosporidium parvum
ILMCVFESLNFNSHLVL

SEQ ID NO: 2232537 - protein, 19 aa, Cryptosporidium parvum
ILMNLSCKSFCTKKQNLDN

SEQ ID NO: 2232538 - protein, 19 aa, Cryptosporidium parvum
ILNGYILICGNALTMPMEI

SEQ ID NO: 2232539 - protein, 26 aa, Cryptosporidium parvum
ILNIFYKLIVVFSIIIHSNRWLQDNS

SEQ ID NO: 2232540 - protein, 18 aa, Cryptosporidium parvum
ILNIPDIYIQATAKKILK

SEQ ID NO: 2232541 - protein, 20 aa, Cryptosporidium parvum
ILNLFFKVVISISRSLVHIP

SEQ ID NO: 2232542 - protein, 34 aa, Cryptosporidium parvum
ILNNRLFSLWLFVQKRLTTIQIAIKVMKESKELT

SEQ ID NO: 2232543 - protein, 21 aa, Cryptosporidium parvum
ILNSLRCLVLLLYSRSNETIE

SEQ ID NO: 2232544 - protein, 26 aa, Cryptosporidium parvum
ILPHISCPICKVWCLDKEDFSDHVRN

SEQ ID NO: 2232545 - protein, 22 aa, Cryptosporidium parvum
ILPIFLELFIIKNIYANNIEPN

SEQ ID NO: 2232546 - protein, 25 aa, Cryptosporidium parvum
ILPKKIAEMIFEFHYLLEISLKYLL

SEQ ID NO: 2232547 - protein, 28 aa, Cryptosporidium parvum
ILPMLVIASNFCWDCVKSSKGKVSDSSG

SEQ ID NO: 2232548 - protein, 18 aa, Cryptosporidium parvum
ILPNRPQLITSIKPFIIR

SEQ ID NO: 2232549 - protein, 24 aa, Cryptosporidium parvum
ILPYGKFCIEKCLGDKEFIIKLIG

SEQ ID NO: 2232550 - protein, 17 aa, Cryptosporidium parvum
ILQCNLLKNDAYNQNHN

SEQ ID NO: 2232551 - protein, 18 aa, Cryptosporidium parvum
ILQFCKKHNITLSELEDE

SEQ ID NO: 2232552 - protein, 25 aa, Cryptosporidium parvum
ILQIFKLVFGSKCPKISDYFVPMYT

SEQ ID NO: 2232553 - protein, 25 aa, Cryptosporidium parvum
ILQYSEIFLPFVMLAYVILRMIYEW

SEQ ID NO: 2232554 - protein, 17 aa, Cryptosporidium parvum
ILRDFLEYLSHEYELER

SEQ ID NO: 2232555 - protein, 19 aa, Cryptosporidium parvum
ILRHIKLRHNWVLYETPEY

SEQ ID NO: 2232556 - protein, 18 aa, Cryptosporidium parvum
ILRLFKILTKNTNEYKSF

SEQ ID NO: 2232557 - protein, 34 aa, Cryptosporidium parvum
ILRLGSLWQGIFLRFYIWAVLWAIMIIFTTFKTL

SEQ ID NO: 2232558 - protein, 18 aa, Cryptosporidium parvum
ILSFISVIFVGGIGVYIP

SEQ ID NO: 2232559 - protein, 18 aa, Cryptosporidium parvum
ILSIFSLKIHQLRRQIYN

SEQ ID NO: 2232560 - protein, 18 aa, Cryptosporidium parvum
ILSKEIFAPVSNKKLQCR

SEQ ID NO: 2232561 - protein, 18 aa, Cryptosporidium parvum
ILSKHSINILIPVSNEFR

SEQ ID NO: 2232562 - protein, 18 aa, Cryptosporidium parvum
ILSKLYVKLPYSDLSNII

SEQ ID NO: 2232563 - protein, 27 aa, Cryptosporidium parvum
ILSKVIAVICLIVWVINFRNFQDPAHG

SEQ ID NO: 2232564 - protein, 23 aa, Cryptosporidium parvum
ILSLCIKYCPFLLIHAASLSPAV

SEQ ID NO: 2232565 - protein, 18 aa, Cryptosporidium parvum
ILSLICCRYSVPKEEDFT

SEQ ID NO: 2232566 - protein, 29 aa, Cryptosporidium parvum
ILSLRPACRRMAQKCLITLSNITGVSVAT

SEQ ID NO: 2232567 - protein, 24 aa, Cryptosporidium parvum
ILTELFPSIVIVVSFWQKISPSTL

SEQ ID NO: 2232568 - protein, 20 aa, Cryptosporidium parvum
ILTNRIKIWSNIDVKQKDYF

SEQ ID NO: 2232569 - protein, 19 aa, Cryptosporidium parvum
ILVETNKYYLIFSLAFFIL

SEQ ID NO: 2232570 - protein, 24 aa, Cryptosporidium parvum
ILVGWIAYCILNISKITLDTAMGF

SEQ ID NO: 2232571 - protein, 17 aa, Cryptosporidium parvum
ILVLCLNGVRSYYISTV

SEQ ID NO: 2232572 - protein, 18 aa, Cryptosporidium parvum
ILVLRKLIFFNMIAMFTS

SEQ ID NO: 2232573 - protein, 17 aa, Cryptosporidium parvum
ILVPIIFNWHDNVPGVI

SEQ ID NO: 2232574 - protein, 26 aa, Cryptosporidium parvum
ILVPVILCYISLPLFVKFVAKANLNE

SEQ ID NO: 2232575 - protein, 27 aa, Cryptosporidium parvum
ILVSGYRGCAIYDLINSRWRLFCDLNH

SEQ ID NO: 2232576 - protein, 18 aa, Cryptosporidium parvum
ILVTVCTTVQLILKEEYR

SEQ ID NO: 2232577 - protein, 18 aa, Cryptosporidium parvum
ILYDGSWLSIGKMEESIE

SEQ ID NO: 2232578 - protein, 24 aa, Cryptosporidium parvum
ILYGLCLGLLFLGKREACETTLEA

SEQ ID NO: 2232579 - protein, 24 aa, Cryptosporidium parvum
ILYKIKQPIGWMLYDPLLPIKFFG

SEQ ID NO: 2232580 - protein, 21 aa, Cryptosporidium parvum
ILYLPFQCYLGIKDTDNLLGI

SEQ ID NO: 2232581 - protein, 17 aa, Cryptosporidium parvum
ILYPSKYSFGLYDQLPI

SEQ ID NO: 2232582 - protein, 19 aa, Cryptosporidium parvum
ILYSCCIGCYIESIKENPR

SEQ ID NO: 2232583 - protein, 21 aa, Cryptosporidium parvum
IMDISFGKFFGFYKSSQIQIN

SEQ ID NO: 2232584 - protein, 24 aa, Cryptosporidium parvum
IMEKHGYIPIHVNLNISKNCNNSK

SEQ ID NO: 2232585 - protein, 19 aa, Cryptosporidium parvum
IMGQCLTGEFGLFSMMNCN

SEQ ID NO: 2232586 - protein, 17 aa, Cryptosporidium parvum
IMGTAVGIIPKVGMITI

SEQ ID NO: 2232587 - protein, 19 aa, Cryptosporidium parvum
IMIVSSLWQQLDFLYYTLT

SEQ ID NO: 2232588 - protein, 20 aa, Cryptosporidium parvum
IMIVYKIQYLYKKCIIKNEM

SEQ ID NO: 2232589 - protein, 22 aa, Cryptosporidium parvum
IMKSSRFYKVLLDITLLEDQNL

SEQ ID NO: 2232590 - protein, 20 aa, Cryptosporidium parvum
IMLETSKGERCWKLRDPNEM

SEQ ID NO: 2232591 - protein, 17 aa, Cryptosporidium parvum
IMLKPKFNNEKEITNNT

SEQ ID NO: 2232592 - protein, 19 aa, Cryptosporidium parvum
IMLYFFSLSSMRNFNGQPK

SEQ ID NO: 2232593 - protein, 32 aa, Cryptosporidium parvum
IMMIIIRLGVYSSIFYYKMVLFKSKIDTNEFD

SEQ ID NO: 2232594 - protein, 22 aa, Cryptosporidium parvum
IMNGDFGSSIVIDFINNNLENI

SEQ ID NO: 2232595 - protein, 20 aa, Cryptosporidium parvum
IMNGTIAGIVSGISASESLL

SEQ ID NO: 2232596 - protein, 26 aa, Cryptosporidium parvum
IMNSFPYHRFKCYSNNLSIVSIIFFQ

SEQ ID NO: 2232597 - protein, 20 aa, Cryptosporidium parvum
IMREYLLKVLINDSCGNTKK

SEQ ID NO: 2232598 - protein, 19 aa, Cryptosporidium parvum
IMTVIPWILTIALFGLLRL

SEQ ID NO: 2232599 - protein, 25 aa, Cryptosporidium parvum
IMYMLLISLGWRVLRDSLLSMEAKL

SEQ ID NO: 2232600 - protein, 21 aa, Cryptosporidium parvum
INAPSIFGIIWNFLKPLIDER

SEQ ID NO: 2232601 - protein, 17 aa, Cryptosporidium parvum
INCRRWVTKDNPSVRPE

SEQ ID NO: 2232602 - protein, 23 aa, Cryptosporidium parvum
INDFKPRVNQILVNKNIKEPNSG

SEQ ID NO: 2232603 - protein, 27 aa, Cryptosporidium parvum
INDSMKCAFDFLFRGIRRVQRLVELSQ

SEQ ID NO: 2232604 - protein, 20 aa, Cryptosporidium parvum
INDTTAFEFLIYYFGLISDK

SEQ ID NO: 2232605 - protein, 22 aa, Cryptosporidium parvum
INDWIHFEISFIINIARMNQID

SEQ ID NO: 2232606 - protein, 22 aa, Cryptosporidium parvum
INECVDWYSVIFTSRSFGQLII

SEQ ID NO: 2232607 - protein, 19 aa, Cryptosporidium parvum
INELLRLLKIESLNKDGIK

SEQ ID NO: 2232608 - protein, 18 aa, Cryptosporidium parvum
INEREGYNFSRCYVFILT

SEQ ID NO: 2232609 - protein, 19 aa, Cryptosporidium parvum
INERTCIEILYKLIKKKGL

SEQ ID NO: 2232610 - protein, 21 aa, Cryptosporidium parvum
INESFKFLGKVVYSCNTNILG

SEQ ID NO: 2232611 - protein, 18 aa, Cryptosporidium parvum
INETISWNLIRDSNGKLI

SEQ ID NO: 2232612 - protein, 18 aa, Cryptosporidium parvum
INEYFPMHRRLFSGHQKI

SEQ ID NO: 2232613 - protein, 17 aa, Cryptosporidium parvum
INFGYGIEEEQEEENEE

SEQ ID NO: 2232614 - protein, 24 aa, Cryptosporidium parvum
INFLKLQKQLPCLKQIPKNDKFLF

SEQ ID NO: 2232615 - protein, 23 aa, Cryptosporidium parvum
INFRKKLRLNLKYIHNATKSRYL

SEQ ID NO: 2232616 - protein, 17 aa, Cryptosporidium parvum
INFYSIPSSEMFSTQIV

SEQ ID NO: 2232617 - protein, 18 aa, Cryptosporidium parvum
INGLAFIYRYHGIKLRWD

SEQ ID NO: 2232618 - protein, 19 aa, Cryptosporidium parvum
INGVTMQVLVRWLTSIDYL

SEQ ID NO: 2232619 - protein, 17 aa, Cryptosporidium parvum
INHGWYYGILLLIISIS

SEQ ID NO: 2232620 - protein, 18 aa, Cryptosporidium parvum
INIAIIWIFILRLFGQFS

SEQ ID NO: 2232621 - protein, 17 aa, Cryptosporidium parvum
INIFNGWADFLESRTQS

SEQ ID NO: 2232622 - protein, 19 aa, Cryptosporidium parvum
INIHQLFACTVFNDNKRQE

SEQ ID NO: 2232623 - protein, 21 aa, Cryptosporidium parvum
INIIALFGHFISIYWLNYKNP

SEQ ID NO: 2232624 - protein, 30 aa, Cryptosporidium parvum
INIIFCSFVISLACCAVGNFASSFIYKELP

SEQ ID NO: 2232625 - protein, 20 aa, Cryptosporidium parvum
INIIKIRLPILYNAFNNKDS

SEQ ID NO: 2232626 - protein, 17 aa, Cryptosporidium parvum
INIISGIVIRKKIIRQN

SEQ ID NO: 2232627 - protein, 18 aa, Cryptosporidium parvum
INILPKFIENGLINKLNI

SEQ ID NO: 2232628 - protein, 19 aa, Cryptosporidium parvum
INILRRHKIKISRVSVSVM

SEQ ID NO: 2232629 - protein, 20 aa, Cryptosporidium parvum
INILRRRHKVAPSKAQIIRV

SEQ ID NO: 2232630 - protein, 18 aa, Cryptosporidium parvum
ININKGYFVYSFFEKLKY

SEQ ID NO: 2232631 - protein, 23 aa, Cryptosporidium parvum
ININVGVFQSCEFIILECLLSCC

SEQ ID NO: 2232632 - protein, 19 aa, Cryptosporidium parvum
INIPIIYLSLFISQRLNIC

SEQ ID NO: 2232633 - protein, 17 aa, Cryptosporidium parvum
INKELIRELKLEDIPIN

SEQ ID NO: 2232634 - protein, 25 aa, Cryptosporidium parvum
INKKFKEYLGLAVDYRFISSDKDES

SEQ ID NO: 2232635 - protein, 25 aa, Cryptosporidium parvum
INKKSRFPFYGTFITLVSCENINRM

SEQ ID NO: 2232636 - protein, 17 aa, Cryptosporidium parvum
INKVFKFNPQINWEDLP

SEQ ID NO: 2232637 - protein, 27 aa, Cryptosporidium parvum
INLDLSAKCQLALPIFIHISKLTLSKW

SEQ ID NO: 2232638 - protein, 19 aa, Cryptosporidium parvum
INLDNIVLRGCILRSTEWA

SEQ ID NO: 2232639 - protein, 20 aa, Cryptosporidium parvum
INLHIPFHFIIVAEGKTTDK

SEQ ID NO: 2232640 - protein, 25 aa, Cryptosporidium parvum
INLKIHFKDAIAILPCTLSDPIQVV

SEQ ID NO: 2232641 - protein, 19 aa, Cryptosporidium parvum
INLKNPYLLILHLICLTVE

SEQ ID NO: 2232642 - protein, 19 aa, Cryptosporidium parvum
INLLAIVISLYIISISSVV

SEQ ID NO: 2232643 - protein, 19 aa, Cryptosporidium parvum
INLLKILRQVELMTCLSSA

SEQ ID NO: 2232644 - protein, 17 aa, Cryptosporidium parvum
INLLRDIIKTVVTDDKI

SEQ ID NO: 2232645 - protein, 17 aa, Cryptosporidium parvum
INLLRFALQIHKIGSSF

SEQ ID NO: 2232646 - protein, 17 aa, Cryptosporidium parvum
INLPCGYIPNPGDLCPI

SEQ ID NO: 2232647 - protein, 19 aa, Cryptosporidium parvum
INLRMQLEFPKLPCDILGV

SEQ ID NO: 2232648 - protein, 20 aa, Cryptosporidium parvum
INLRRTEMFNSKLITNELEF

SEQ ID NO: 2232649 - protein, 23 aa, Cryptosporidium parvum
INMFKDCIERCKSNLKQAQYKSG

SEQ ID NO: 2232650 - protein, 18 aa, Cryptosporidium parvum
INMNFGINGEEILSKNSE

SEQ ID NO: 2232651 - protein, 17 aa, Cryptosporidium parvum
INMNWKYLLISIVVLNV

SEQ ID NO: 2232652 - protein, 17 aa, Cryptosporidium parvum
INNFFGLKKGVQLFSNH

SEQ ID NO: 2232653 - protein, 18 aa, Cryptosporidium parvum
INNFKVERILGITATAPS

SEQ ID NO: 2232654 - protein, 17 aa, Cryptosporidium parvum
INNGMIFFDSKRFILEI

SEQ ID NO: 2232655 - protein, 21 aa, Cryptosporidium parvum
INNHKSCLIILSKGLGIFNII

SEQ ID NO: 2232656 - protein, 17 aa, Cryptosporidium parvum
INNHLIPFILYSINFGI

SEQ ID NO: 2232657 - protein, 23 aa, Cryptosporidium parvum
INNKFTFCLKLLSYIKHNSEIQT

SEQ ID NO: 2232658 - protein, 26 aa, Cryptosporidium parvum
INNLGGLGCLKHGGILSGSEPIRAAT

SEQ ID NO: 2232659 - protein, 18 aa, Cryptosporidium parvum
INNPTGFWLLFIPTFGSL

SEQ ID NO: 2232660 - protein, 24 aa, Cryptosporidium parvum
INNRIPCMAFDIIMHTVSPQNKDI

SEQ ID NO: 2232661 - protein, 22 aa, Cryptosporidium parvum
INPKPEICLLRIRVREKGFLKR

SEQ ID NO: 2232662 - protein, 28 aa, Cryptosporidium parvum
INPLSWFKHRHTIGSLKGDLLVPPTSAS

SEQ ID NO: 2232663 - protein, 18 aa, Cryptosporidium parvum
INPPISIKDYFARLSEYF

SEQ ID NO: 2232664 - protein, 19 aa, Cryptosporidium parvum
INQEYLFSWISLKSQKENQ

SEQ ID NO: 2232665 - protein, 23 aa, Cryptosporidium parvum
INQRMYYNIGHTITAMQGIHIMY

SEQ ID NO: 2232666 - protein, 18 aa, Cryptosporidium parvum
INQYLPISITRMGNENEE

SEQ ID NO: 2232667 - protein, 17 aa, Cryptosporidium parvum
INRGCYMRQIVKSIRLL

SEQ ID NO: 2232668 - protein, 24 aa, Cryptosporidium parvum
INRNILCGLPIYSLFTDEFELTKK

SEQ ID NO: 2232669 - protein, 19 aa, Cryptosporidium parvum
INSIDFISCLLKHLHQHNV

SEQ ID NO: 2232670 - protein, 26 aa, Cryptosporidium parvum
INSIFKSRINPLIKYFDIKPEISDNN

SEQ ID NO: 2232671 - protein, 26 aa, Cryptosporidium parvum
INSLPIKTIRLWNVVPISTLLLSASL

SEQ ID NO: 2232672 - protein, 24 aa, Cryptosporidium parvum
INSNCIRLRSDIPYKSTKIKSPIC

SEQ ID NO: 2232673 - protein, 20 aa, Cryptosporidium parvum
INSNFTWRSTIYDIIIFDKI

SEQ ID NO: 2232674 - protein, 23 aa, Cryptosporidium parvum
INSNPWIPFGTFKDVILAGREYN

SEQ ID NO: 2232675 - protein, 26 aa, Cryptosporidium parvum
INSPKIFWLKNIQYYWNKRINMRRHE

SEQ ID NO: 2232676 - protein, 21 aa, Cryptosporidium parvum
INSRWRLFCDLNHELLLCKPN

SEQ ID NO: 2232677 - protein, 18 aa, Cryptosporidium parvum
INSSKCIRKIVLKENESF

SEQ ID NO: 2232678 - protein, 22 aa, Cryptosporidium parvum
INSTILLCFSLMLCISSIKLFF

SEQ ID NO: 2232679 - protein, 37 aa, Cryptosporidium parvum
INSVLKPRFAQICLDAWFKMRIKILLTIPITLINIVL

SEQ ID NO: 2232680 - protein, 17 aa, Cryptosporidium parvum
INSYAFGVFSFFDLAFD

SEQ ID NO: 2232681 - protein, 19 aa, Cryptosporidium parvum
INSYTRFNPILLNELLFKL

SEQ ID NO: 2232682 - protein, 26 aa, Cryptosporidium parvum
INTFKNFFLRISLRNQNTIQTLETDF

SEQ ID NO: 2232683 - protein, 23 aa, Cryptosporidium parvum
INTLEIGEFILLRTMDSINEIFV

SEQ ID NO: 2232684 - protein, 25 aa, Cryptosporidium parvum
INTYLGNCLIELPNICNIMQIKEVL

SEQ ID NO: 2232685 - protein, 28 aa, Cryptosporidium parvum
INVEDYSAYCLRRIDGFPLSEFEAVRPL

SEQ ID NO: 2232686 - protein, 25 aa, Cryptosporidium parvum
INVIISLFRRFWMKNDAIRFFNSLY

SEQ ID NO: 2232687 - protein, 19 aa, Cryptosporidium parvum
INVSLNWIGLKNCIIDLIF

SEQ ID NO: 2232688 - protein, 25 aa, Cryptosporidium parvum
INWDGEYYLRISYYNDYEYEHQHAF

SEQ ID NO: 2232689 - protein, 27 aa, Cryptosporidium parvum
INYIRLFKIWINRMEKVNNNNNLDEMK

SEQ ID NO: 2232690 - protein, 24 aa, Cryptosporidium parvum
INYLKSYWLVVIFGVGFSYAGMYS

SEQ ID NO: 2232691 - protein, 17 aa, Cryptosporidium parvum
INYPFKYKFEIEKENFV

SEQ ID NO: 2232692 - protein, 24 aa, Cryptosporidium parvum
INYSISTWIAGFIVTFLSLFLQPL

SEQ ID NO: 2232693 - protein, 17 aa, Cryptosporidium parvum
INYSLGEYVPVVTRAKY

SEQ ID NO: 2232694 - protein, 28 aa, Cryptosporidium parvum
INYYKKLYLRPWWHSEFVSQIDLENNTT

SEQ ID NO: 2232695 - protein, 19 aa, Cryptosporidium parvum
IPASVETWGEYTLNENSSC

SEQ ID NO: 2232696 - protein, 21 aa, Cryptosporidium parvum
IPATATVPIIFSLNTLFTSVS

SEQ ID NO: 2232697 - protein, 26 aa, Cryptosporidium parvum
IPCEAVGALCKLRYPDGKKITINTEY

SEQ ID NO: 2232698 - protein, 20 aa, Cryptosporidium parvum
IPCSILFLKALESCIDDENI

SEQ ID NO: 2232699 - protein, 22 aa, Cryptosporidium parvum
IPELSISISRRFILFSYVEGIR

SEQ ID NO: 2232700 - protein, 24 aa, Cryptosporidium parvum
IPERILFGKLIFFLLGLLNIMYIK

SEQ ID NO: 2232701 - protein, 21 aa, Cryptosporidium parvum
IPFFISQAFYSFLYCLIYLIF

SEQ ID NO: 2232702 - protein, 27 aa, Cryptosporidium parvum
IPFLPEMKRMIFGILIVITNWVCNFDA

SEQ ID NO: 2232703 - protein, 19 aa, Cryptosporidium parvum
IPFNSQMSGFDYGDSYIPE

SEQ ID NO: 2232704 - protein, 19 aa, Cryptosporidium parvum
IPGQPRWSAKFRSDIRRQA

SEQ ID NO: 2232705 - protein, 17 aa, Cryptosporidium parvum
IPICSLLFFSNNLIAMS

SEQ ID NO: 2232706 - protein, 23 aa, Cryptosporidium parvum
IPIEIPSSLPITLLDDKNYKLIM

SEQ ID NO: 2232707 - protein, 20 aa, Cryptosporidium parvum
IPIFGRRNVLTFGNSHSLSN

SEQ ID NO: 2232708 - protein, 19 aa, Cryptosporidium parvum
IPIIICIISLSTNIFDINS

SEQ ID NO: 2232709 - protein, 26 aa, Cryptosporidium parvum
IPIKCGVLKLFLSLALSSSKKKFIKQ

SEQ ID NO: 2232710 - protein, 19 aa, Cryptosporidium parvum
IPINSWRAIPDLPERSQLD

SEQ ID NO: 2232711 - protein, 21 aa, Cryptosporidium parvum
IPIPPSIYINHNWPINMAYVN

SEQ ID NO: 2232712 - protein, 17 aa, Cryptosporidium parvum
IPISVIHEITIYDIFKV

SEQ ID NO: 2232713 - protein, 22 aa, Cryptosporidium parvum
IPIYIQEFFRNEGIWKVIAKLS

SEQ ID NO: 2232714 - protein, 17 aa, Cryptosporidium parvum
IPKIRWVPKSKGLRPLI

SEQ ID NO: 2232715 - protein, 17 aa, Cryptosporidium parvum
IPLAFIIYYRRQKKYAS

SEQ ID NO: 2232716 - protein, 19 aa, Cryptosporidium parvum
IPLELMFCHFFHTKYVYDL

SEQ ID NO: 2232717 - protein, 18 aa, Cryptosporidium parvum
IPLFPSYTLIGLFGDSIE

SEQ ID NO: 2232718 - protein, 21 aa, Cryptosporidium parvum
IPLIFRQFIDISYMYDKFKTI

SEQ ID NO: 2232719 - protein, 20 aa, Cryptosporidium parvum
IPLKEGVIIVGYDRIETKLM

SEQ ID NO: 2232720 - protein, 28 aa, Cryptosporidium parvum
IPLMNCFTILLSRIIYWYSTTKLYSEKI

SEQ ID NO: 2232721 - protein, 18 aa, Cryptosporidium parvum
IPLPNYLIGMQFLQIVSY

SEQ ID NO: 2232722 - protein, 24 aa, Cryptosporidium parvum
IPLRWISFFLFKWRLELDESFVGG

SEQ ID NO: 2232723 - protein, 17 aa, Cryptosporidium parvum
IPLSVYSLLAEISLLIA

SEQ ID NO: 2232724 - protein, 18 aa, Cryptosporidium parvum
IPLTLIIIIRGERIQSEL

SEQ ID NO: 2232725 - protein, 30 aa, Cryptosporidium parvum; identical to SEQ ID NO: 2124308

SEQ ID NO: 2232726 - protein, 17 aa, Cryptosporidium parvum
IPLTNLITWLVIEIIED

SEQ ID NO: 2232727 - protein, 23 aa, Cryptosporidium parvum
IPNEPCNFLLYNIQDRISISNSC

SEQ ID NO: 2232728 - protein, 18 aa, Cryptosporidium parvum
IPNIIPIHIILNRIGGDM

SEQ ID NO: 2232729 - protein, 28 aa, Cryptosporidium parvum
IPNLLFQFYCEWSWTLLQLLDIVSLYII

SEQ ID NO: 2232730 - protein, 22 aa, Cryptosporidium parvum
IPNLYRYIALLLIELCSCIIVS

SEQ ID NO: 2232731 - protein, 17 aa, Cryptosporidium parvum
IPNNFLNEVYQVPKKLE

SEQ ID NO: 2232732 - protein, 18 aa, Cryptosporidium parvum
IPNRFPKLVTPSVGRNWE

SEQ ID NO: 2232733 - protein, 18 aa, Cryptosporidium parvum
IPNSRYSPVLPLQKSGFI

SEQ ID NO: 2232734 - protein, 19 aa, Cryptosporidium parvum
IPPDESWRSFRSKTMKCRA

SEQ ID NO: 2232735 - protein, 20 aa, Cryptosporidium parvum
IPPRKGFGIVSSRLLESFGN

SEQ ID NO: 2232736 - protein, 26 aa, Cryptosporidium parvum
IPPVAGHNSCSIIVGVSGDGKIHVSP

SEQ ID NO: 2232737 - protein, 25 aa, Cryptosporidium parvum
IPPYSRRSIPLSWFLLSDMEPSIVP

SEQ ID NO: 2232738 - protein, 27 aa, Cryptosporidium parvum
IPQAICSRYGLYIGGFFSPFIRLIQII

SEQ ID NO: 2232739 - protein, 18 aa, Cryptosporidium parvum
IPQFDRIIIAGAISCIAD

SEQ ID NO: 2232740 - protein, 32 aa, Cryptosporidium parvum; identical to SEQ ID NO: 2124315

SEQ ID NO: 2232741 - protein, 27 aa, Cryptosporidium parvum
IPSEVKWLVDLSEIWNEHPVEILLINI

SEQ ID NO: 2232742 - protein, 25 aa, Cryptosporidium parvum
IPSFFGHNVLSFWFSFYNTALIISM

SEQ ID NO: 2232743 - protein, 21 aa, Cryptosporidium parvum
IPSKELEVIISKRSNIPVSYS

SEQ ID NO: 2232744 - protein, 18 aa, Cryptosporidium parvum
IPSKIRLEIEGDEDSSSN

SEQ ID NO: 2232745 - protein, 18 aa, Cryptosporidium parvum
IPSLLSLRNSSFIHKTRQ

SEQ ID NO: 2232746 - protein, 22 aa, Cryptosporidium parvum
IPSPESILFSPFCNISDANEDA

SEQ ID NO: 2232747 - protein, 18 aa, Cryptosporidium parvum
IPSSEMFSTQIVVTDFYL

SEQ ID NO: 2232748 - protein, 27 aa, Cryptosporidium parvum
IPSTMSILLRFLINKLISLESEIHSKN

SEQ ID NO: 2232749 - protein, 26 aa, Cryptosporidium parvum
IPSVSKWRVKVMLKEELGSFTGDNCP

SEQ ID NO: 2232750 - protein, 18 aa, Cryptosporidium parvum
IPSYLWYLPSDKIFPFPI

SEQ ID NO: 2232751 - protein, 22 aa, Cryptosporidium parvum
IPTCPLASPSERLRCVFESLQE

SEQ ID NO: 2232752 - protein, 30 aa, Cryptosporidium parvum; identical to SEQ ID NO: 2124320

SEQ ID NO: 2232753 - protein, 28 aa, Cryptosporidium parvum
IPTILVCIFKKKWLVAFLAFIAGLISSI

SEQ ID NO: 2232754 - protein, 17 aa, Cryptosporidium parvum
IPTLRDSQSYRRSVYNS

SEQ ID NO: 2232755 - protein, 18 aa, Cryptosporidium parvum
IPVCPEGFVSKGSECYLA

SEQ ID NO: 2232756 - protein, 22 aa, Cryptosporidium parvum
IPVEKFSTVALIGFLVSQYKHF

SEQ ID NO: 2232757 - protein, 18 aa, Cryptosporidium parvum
IPVERWFQRQDNFEASVT

SEQ ID NO: 2232758 - protein, 20 aa, Cryptosporidium parvum
IPVFIYGFFTLWSGTRLYFD

SEQ ID NO: 2232759 - protein, 17 aa, Cryptosporidium parvum
IPVFRDIISRDELIEKG

SEQ ID NO: 2232760 - protein, 19 aa, Cryptosporidium parvum
IPVSCLMLSQYIIYISSEL

SEQ ID NO: 2232761 - protein, 19 aa, Cryptosporidium parvum
IPVWIRWLGWISTVRYTYT

SEQ ID NO: 2232762 - protein, 17 aa, Cryptosporidium parvum
IPYFIVYELEKIVFDKI

SEQ ID NO: 2232763 - protein, 19 aa, Cryptosporidium parvum
IPYWYTLLAKYSFYGIPII

SEQ ID NO: 2232764 - protein, 18 aa, Cryptosporidium parvum
IQCAYKYTRLNNSRNLYS

SEQ ID NO: 2232765 - protein, 26 aa, Cryptosporidium parvum
IQDESYLRFEILREFIKNNAKSFQRT

SEQ ID NO: 2232766 - protein, 21 aa, Cryptosporidium parvum
IQDHDSCFSILFKDSRIKIGI

SEQ ID NO: 2232767 - protein, 19 aa, Cryptosporidium parvum
IQDKFKLAFLSIKSCTSLS

SEQ ID NO: 2232768 - protein, 19 aa, Cryptosporidium parvum
IQEALKFIGCHNSLSNLEM

SEQ ID NO: 2232769 - protein, 17 aa, Cryptosporidium parvum
IQEFKRNSGSLVNNKRP

SEQ ID NO: 2232770 - protein, 18 aa, Cryptosporidium parvum
IQERLVILTGIMSFIIGF

SEQ ID NO: 2232771 - protein, 25 aa, Cryptosporidium parvum
IQETCLMLRMLLHLYSGMRTRTQFL

SEQ ID NO: 2232772 - protein, 26 aa, Cryptosporidium parvum
IQFILLPCRIFVASLLMYRNIGESAI

SEQ ID NO: 2232773 - protein, 22 aa, Cryptosporidium parvum
IQFKSGQLFTIYLIIILISSIF

SEQ ID NO: 2232774 - protein, 17 aa, Cryptosporidium parvum
IQGEITDSLGLIVDENG

SEQ ID NO: 2232775 - protein, 24 aa, Cryptosporidium parvum
IQGSRKGSALFASFDSSMIRSSGI

SEQ ID NO: 2232776 - protein, 18 aa, Cryptosporidium parvum
IQGVKGFENLLIRMASYT

SEQ ID NO: 2232777 - protein, 20 aa, Cryptosporidium parvum
IQHTDYWVLKLINRGCYMRQ

SEQ ID NO: 2232778 - protein, 19 aa, Cryptosporidium parvum
IQIELKFHIDMLYNIITLI

SEQ ID NO: 2232779 - protein, 18 aa, Cryptosporidium parvum
IQIILFPLLKPISVILDK

SEQ ID NO: 2232780 - protein, 26 aa, Cryptosporidium parvum
IQINIKTWFFWIVYSFLVFIIYFSAD

SEQ ID NO: 2232781 - protein, 20 aa, Cryptosporidium parvum
IQIPEARMYYAFQMSIEQIH

SEQ ID NO: 2232782 - protein, 24 aa, Cryptosporidium parvum
IQIQICIIDLLKLVQDNSLILLSI

SEQ ID NO: 2232783 - protein, 25 aa, Cryptosporidium parvum
IQKCIKILLEKGLHEILKFNPNIEL

SEQ ID NO: 2232784 - protein, 22 aa, Cryptosporidium parvum
IQKSLLKWLLGVGLVSSSFEVQ

SEQ ID NO: 2232785 - protein, 19 aa, Cryptosporidium parvum
IQKVSLCRFDDEYLMTILF

SEQ ID NO: 2232786 - protein, 17 aa, Cryptosporidium parvum
IQLEIGFKHEELKLISL

SEQ ID NO: 2232787 - protein, 17 aa, Cryptosporidium parvum
IQLFLNLVVDSIVALSP

SEQ ID NO: 2232788 - protein, 24 aa, Cryptosporidium parvum
IQLICSLCVIIIIFNKDWISGQNT

SEQ ID NO: 2232789 - protein, 21 aa, Cryptosporidium parvum
IQLIFRSQLFFTLFTFVISLL

SEQ ID NO: 2232790 - protein, 18 aa, Cryptosporidium parvum
IQLKEAFAVFDGDSTGKI

SEQ ID NO: 2232791 - protein, 24 aa, Cryptosporidium parvum
IQLLEPRIQLILSEQRQISQLATL

SEQ ID NO: 2232792 - protein, 23 aa, Cryptosporidium parvum
IQLSALKCYFSLSLQGFTETMAV

SEQ ID NO: 2232793 - protein, 23 aa, Cryptosporidium parvum
IQLSNLMFNYWYLKILLIIIERI

SEQ ID NO: 2232794 - protein, 17 aa, Cryptosporidium parvum
IQLYNLVIFLLERKKDI

SEQ ID NO: 2232795 - protein, 24 aa, Cryptosporidium parvum
IQNKLCKNEVSFYITIEAPYKTML

SEQ ID NO: 2232796 - protein, 18 aa, Cryptosporidium parvum
IQNSRLILLNSIEDFSGI

SEQ ID NO: 2232797 - protein, 25 aa, Cryptosporidium parvum
IQPSLRPLVPLALDRSIREILQVVI

SEQ ID NO: 2232798 - protein, 25 aa, Cryptosporidium parvum
IQSHGRIGMMQGIPPHMGGAGQGIP

SEQ ID NO: 2232799 - protein, 23 aa, Cryptosporidium parvum
IQTHYTIIPSFFIQRQIEYQLVA

SEQ ID NO: 2232800 - protein, 17 aa, Cryptosporidium parvum
IQTRRAILKSLDEDSLG

SEQ ID NO: 2232801 - protein, 17 aa, Cryptosporidium parvum
IQVFEYIKKISLPKTDL

SEQ ID NO: 2232802 - protein, 19 aa, Cryptosporidium parvum
IQVSIAIGVTTWKILALNI

SEQ ID NO: 2232803 - protein, 23 aa, Cryptosporidium parvum
IQYCKCSGCVSNVENIRRKHRSF

SEQ ID NO: 2232804 - protein, 18 aa, Cryptosporidium parvum
IQYKMLIVYINFLYNNKS

SEQ ID NO: 2232805 - protein, 24 aa, Cryptosporidium parvum
IQYYWNKRINMRRHEYGFYGYRRK

SEQ ID NO: 2232806 - protein, 23 aa, Cryptosporidium parvum
IRAKLSSVLSCFVIIGGVIVGIS

SEQ ID NO: 2232807 - protein, 21 aa, Cryptosporidium parvum
IRANMKYLRLYSKAIHSNSLD

SEQ ID NO: 2232808 - protein, 20 aa, Cryptosporidium parvum
IRDSACYIIWSLARGVPPKV

SEQ ID NO: 2232809 - protein, 19 aa, Cryptosporidium parvum
IRECLELMDNKLLLLPKNR

SEQ ID NO: 2232810 - protein, 21 aa, Cryptosporidium parvum
IREIFKNEIFNSMKMGRYYQC

SEQ ID NO: 2232811 - protein, 18 aa, Cryptosporidium parvum
IREKEIFLDIFSRGISII

SEQ ID NO: 2232812 - protein, 17 aa, Cryptosporidium parvum
IRESIYLHLTRYYLVMI

SEQ ID NO: 2232813 - protein, 19 aa, Cryptosporidium parvum
IRETFKIQHAMNGIEVSNW

SEQ ID NO: 2232814 - protein, 22 aa, Cryptosporidium parvum
IRFIQKCLPKWEPISEISKESL

SEQ ID NO: 2232815 - protein, 28 aa, Cryptosporidium parvum
IRFSFIGKVCSIEFYLYNPLSFPIVCES

SEQ ID NO: 2232816 - protein, 19 aa, Cryptosporidium parvum
IRFSVFLCGPDMLDSPVIT

SEQ ID NO: 2232817 - protein, 17 aa, Cryptosporidium parvum
IRFTFIFDYEIQQILNF

SEQ ID NO: 2232818 - protein, 21 aa, Cryptosporidium parvum
IRGFSWLPMYHDMGLVGFIVS

SEQ ID NO: 2232819 - protein, 17 aa, Cryptosporidium parvum
IRGGISFITSSNKLKSI

SEQ ID NO: 2232820 - protein, 19 aa, Cryptosporidium parvum
IRGKLRTTFYGYLISNNET

SEQ ID NO: 2232821 - protein, 27 aa, Cryptosporidium parvum
IRGKPMILCPYRWTKLQNIIQKINIRR

SEQ ID NO: 2232822 - protein, 23 aa, Cryptosporidium parvum
IRGLKDYFREVALIKSYFLHNSR

SEQ ID NO: 2232823 - protein, 25 aa, Cryptosporidium parvum
IRGNNFCFLTLWKKIEELTQQKASE

SEQ ID NO: 2232824 - protein, 24 aa, Cryptosporidium parvum
IRHKEMYPELPLSTTFMIESSKKP

SEQ ID NO: 2232825 - protein, 19 aa, Cryptosporidium parvum
IRHVKSIMSNVTFYEYYKK

SEQ ID NO: 2232826 - protein, 17 aa, Cryptosporidium parvum
IRIFHSGSYSGLRTSFD

SEQ ID NO: 2232827 - protein, 20 aa, Cryptosporidium parvum
IRIGQWSAIVHLHALDSEDG

SEQ ID NO: 2232828 - protein, 18 aa, Cryptosporidium parvum
IRIKSFYISIVYGSKEEN

SEQ ID NO: 2232829 - protein, 17 aa, Cryptosporidium parvum
IRITHRYNTNYEKLHKQ

SEQ ID NO: 2232830 - protein, 18 aa, Cryptosporidium parvum
IRIYLIKYLKGFIKIPEL

SEQ ID NO: 2232831 - protein, 19 aa, Cryptosporidium parvum
IRKAMKYNISSNHIRKLRE

SEQ ID NO: 2232832 - protein, 31 aa, Cryptosporidium parvum
IRKEEIRHLGIWRFLNQFGLVLATLCVSLSP

SEQ ID NO: 2232833 - protein, 22 aa, Cryptosporidium parvum
IRKEESCLLLGPLDLIDLDSKV

SEQ ID NO: 2232834 - protein, 17 aa, Cryptosporidium parvum
IRKGSVSGWSEFNKMVS

SEQ ID NO: 2232835 - protein, 22 aa, Cryptosporidium parvum
IRKKNCSLRKPHFNEEINRLIK

SEQ ID NO: 2232836 - protein, 18 aa, Cryptosporidium parvum
IRKYIEFRGKRKGYSGKN

SEQ ID NO: 2232837 - protein, 17 aa, Cryptosporidium parvum
IRLAKYENREYNSIVYK

SEQ ID NO: 2232838 - protein, 26 aa, Cryptosporidium parvum
IRLDVMNCLSWILKHYTKTSHHPELF

SEQ ID NO: 2232839 - protein, 25 aa, Cryptosporidium parvum
IRLILEGGGIPSVFLQSISDWTGSD

SEQ ID NO: 2232840 - protein, 17 aa, Cryptosporidium parvum
IRLPILYNAFNNKDSTN

SEQ ID NO: 2232841 - protein, 22 aa, Cryptosporidium parvum
IRLPSELLISQGFLRNQKNSNG

SEQ ID NO: 2232842 - protein, 21 aa, Cryptosporidium parvum
IRMKILGAKVVCVEFGDKTLK

SEQ ID NO: 2232843 - protein, 17 aa, Cryptosporidium parvum
IRNILIWKSKKESNIKL

SEQ ID NO: 2232844 - protein, 19 aa, Cryptosporidium parvum
IRNKCLISLNCADPNHEQL

SEQ ID NO: 2232845 - protein, 26 aa, Cryptosporidium parvum
IRNNFKLKVVFIYDLKFQFGNNTNSS

SEQ ID NO: 2232846 - protein, 25 aa, Cryptosporidium parvum
IRNPMHILWCRLISLATNIFVSLEK

SEQ ID NO: 2232847 - protein, 17 aa, Cryptosporidium parvum
IRNTLSLVGNWIGYQMS

SEQ ID NO: 2232848 - protein, 21 aa, Cryptosporidium parvum
IRNVVSFKFQAAISEIFRKCI

SEQ ID NO: 2232849 - protein, 25 aa, Cryptosporidium parvum
IRPKSVEWFNGLFFDHSMKKTTLFY

SEQ ID NO: 2232850 - protein, 18 aa, Cryptosporidium parvum
IRPVYRRIYPEPSLYIFF

SEQ ID NO: 2232851 - protein, 22 aa, Cryptosporidium parvum
IRQDIWILFNHIIGRLFDKSRV

SEQ ID NO: 2232852 - protein, 19 aa, Cryptosporidium parvum
IRQLCIRQNNKFGMFPTII

SEQ ID NO: 2232853 - protein, 20 aa, Cryptosporidium parvum
IRRFLRVFKEVADFSTSELN

SEQ ID NO: 2232854 - protein, 18 aa, Cryptosporidium parvum
IRRFRAARIENRYFEIVI

SEQ ID NO: 2232855 - protein, 24 aa, Cryptosporidium parvum
IRRHIEEVLLIIAYEIFGMEKNNC

SEQ ID NO: 2232856 - protein, 21 aa, Cryptosporidium parvum
IRRLILAFIMFFFMLDFIGSM

SEQ ID NO: 2232857 - protein, 17 aa, Cryptosporidium parvum
IRRMSSFSIITVIFASI

SEQ ID NO: 2232858 - protein, 23 aa, Cryptosporidium parvum
IRSAGFPTALSIRLNELANVFTN

SEQ ID NO: 2232859 - protein, 27 aa, Cryptosporidium parvum
IRSVLPIIFSESIKNCRLEAFNTSFIG

SEQ ID NO: 2232860 - protein, 18 aa, Cryptosporidium parvum
IRTFSMGMLFRLKKHIIC

SEQ ID NO: 2232861 - protein, 25 aa, Cryptosporidium parvum
IRTIKLLNWESFVYKNLVELRTYEM

SEQ ID NO: 2232862 - protein, 19 aa, Cryptosporidium parvum
IRTKKQLGYVVSAKYDIIV

SEQ ID NO: 2232863 - protein, 18 aa, Cryptosporidium parvum
IRTWWKYTCKITGESQDI

SEQ ID NO: 2232864 - protein, 21 aa, Cryptosporidium parvum
IRYFPTQAFGFAFKDMIRDMM

SEQ ID NO: 2232865 - protein, 25 aa, Cryptosporidium parvum
IRYIFKELPQVFMILNTLKNTVSGT

SEQ ID NO: 2232866 - protein, 17 aa, Cryptosporidium parvum
IRYNKMKLSNLIIPGRG

SEQ ID NO: 2232867 - protein, 17 aa, Cryptosporidium parvum
IRYRSTIDISNKIIKDS

SEQ ID NO: 2232868 - protein, 23 aa, Cryptosporidium parvum
ISAGSSACFFALLAGIIVLLLEN

SEQ ID NO: 2232869 - protein, 19 aa, Cryptosporidium parvum
ISAKLGWTTFISLLVSAIL

SEQ ID NO: 2232870 - protein, 21 aa, Cryptosporidium parvum
ISALGTLFCTIYFAVSLSIAG

SEQ ID NO: 2232871 - protein, 20 aa, Cryptosporidium parvum
ISAMPYYSAFILTIISFCYF

SEQ ID NO: 2232872 - protein, 24 aa, Cryptosporidium parvum
ISCEDCAYSSWSPWSECSVTCQGG

SEQ ID NO: 2232873 - protein, 23 aa, Cryptosporidium parvum
ISCGCIAAVFGPIVIYSYNFHPL

SEQ ID NO: 2232874 - protein, 27 aa, Cryptosporidium parvum
ISCIKLSKGCYWVPWVSFLYNESVNNF

SEQ ID NO: 2232875 - protein, 20 aa, Cryptosporidium parvum
ISCPCVIGITVPIAVLISTS

SEQ ID NO: 2232876 - protein, 23 aa, Cryptosporidium parvum
ISCSPCQYSEWTMWGECSATCGS

SEQ ID NO: 2232877 - protein, 25 aa, Cryptosporidium parvum
ISCVAGKHGWCIPQQKITNDEYIDL

SEQ ID NO: 2232878 - protein, 25 aa, Cryptosporidium parvum
ISDISFCYRFVRIWLDFPTILLPIP

SEQ ID NO: 2232879 - protein, 25 aa, Cryptosporidium parvum
ISDNKCPPGFNFAYDIWRKQKNKKT

SEQ ID NO: 2232880 - protein, 26 aa, Cryptosporidium parvum
ISDSIELSGRFLLRLKEINYLNICYW

SEQ ID NO: 2232881 - protein, 18 aa, Cryptosporidium parvum
ISDYPRFKTILYDVELFD

SEQ ID NO: 2232882 - protein, 29 aa, Cryptosporidium parvum
ISEEFPWSRLKYMYEKAILRKSNLDYKEF

SEQ ID NO: 2232883 - protein, 17 aa, Cryptosporidium parvum
ISEFIYRSEHIPISFPF

SEQ ID NO: 2232884 - protein, 18 aa, Cryptosporidium parvum
ISEFNWLNPNLKKLRYTL

SEQ ID NO: 2232885 - protein, 25 aa, Cryptosporidium parvum
ISERLRLIEHWNIHFMAELAEDEYF

SEQ ID NO: 2232886 - protein, 18 aa, Cryptosporidium parvum
ISFEWLLKQSTLFINLNI

SEQ ID NO: 2232887 - protein, 18 aa, Cryptosporidium parvum
ISFGCCWRYESKKRIHGR

SEQ ID NO: 2232888 - protein, 26 aa, Cryptosporidium parvum
ISFIIFRLGFIPGVYVTIIGFLSVVI

SEQ ID NO: 2232889 - protein, 22 aa, Cryptosporidium parvum
ISFKDCDYFFAIFDPLCEISSD

SEQ ID NO: 2232890 - protein, 28 aa, Cryptosporidium parvum
ISFLEGIIFPGWLIPGWSKLSKKILKSS

SEQ ID NO: 2232891 - protein, 26 aa, Cryptosporidium parvum
ISFLSFILGFSFKFFSRIPRSYFFSP

SEQ ID NO: 2232892 - protein, 22 aa, Cryptosporidium parvum
ISFNLPMELFRYNIEDISNTYN

SEQ ID NO: 2232893 - protein, 17 aa, Cryptosporidium parvum
ISFVPVVRFCTWIVLLA

SEQ ID NO: 2232894 - protein, 17 aa, Cryptosporidium parvum
ISFYCFLDNKTISEDIG

SEQ ID NO: 2232895 - protein, 17 aa, Cryptosporidium parvum
ISFYSLFLFAFGSPFSE

SEQ ID NO: 2232896 - protein, 19 aa, Cryptosporidium parvum
ISGCSALDAIIKWRMTKSK

SEQ ID NO: 2232897 - protein, 22 aa, Cryptosporidium parvum
ISGDSRFIWNRNISLPVLISGV

SEQ ID NO: 2232898 - protein, 27 aa, Cryptosporidium parvum
ISGFIFSRNMFWLANWTGRKKLLDSSE

SEQ ID NO: 2232899 - protein, 30 aa, Cryptosporidium parvum; identical to SEQ ID NO: 2124421

SEQ ID NO: 2232900 - protein, 20 aa, Cryptosporidium parvum
ISGTIPWSSLTFMTMYLQYC

SEQ ID NO: 2232901 - protein, 18 aa, Cryptosporidium parvum
ISGYAGNINLILKLFSDL

SEQ ID NO: 2232902 - protein, 20 aa, Cryptosporidium parvum
ISHIRINHMFELDRPKTTAI

SEQ ID NO: 2232903 - protein, 18 aa, Cryptosporidium parvum
ISIEQLIRMHLRTDCLGF

SEQ ID NO: 2232904 - protein, 20 aa, Cryptosporidium parvum
ISIFTLIYRYLDIMNIPERR

SEQ ID NO: 2232905 - protein, 25 aa, Cryptosporidium parvum
ISIGKEVFCFNVFQLDIWNDEINSS

SEQ ID NO: 2232906 - protein, 20 aa, Cryptosporidium parvum
ISIICFLSMAYAVPVYFILL

SEQ ID NO: 2232907 - protein, 23 aa, Cryptosporidium parvum
ISIISCYYKTISFQRVQDLLNLD

SEQ ID NO: 2232908 - protein, 27 aa, Cryptosporidium parvum
ISIKKLKISVFNWFTFIIFVIYILLIG

SEQ ID NO: 2232909 - protein, 24 aa, Cryptosporidium parvum
ISIKMASFRLCKAIQDKLNPINIE

SEQ ID NO: 2232910 - protein, 18 aa, Cryptosporidium parvum
ISIKQAKSGARFYILTKN

SEQ ID NO: 2232911 - protein, 26 aa, Cryptosporidium parvum
ISIKRLAAYLLLCFVIGNGLGPLILF

SEQ ID NO: 2232912 - protein, 27 aa, Cryptosporidium parvum
ISILHLFLVWICEFVFDYKSKIPIFYH

SEQ ID NO: 2232913 - protein, 18 aa, Cryptosporidium parvum
ISILNCIKLISNLETISI

SEQ ID NO: 2232914 - protein, 24 aa, Cryptosporidium parvum
ISILNCLYGLFPPQLEYVEVFETK

SEQ ID NO: 2232915 - protein, 24 aa, Cryptosporidium parvum
ISILRGNNLLTIFFTNLFNQCIEQ

SEQ ID NO: 2232916 - protein, 21 aa, Cryptosporidium parvum
ISIPLCEYLKEYKRRQKITNE

SEQ ID NO: 2232917 - protein, 28 aa, Cryptosporidium parvum
ISIRFKSNIITFIWKPLYYLLTFFTFNF

SEQ ID NO: 2232918 - protein, 17 aa, Cryptosporidium parvum
ISISFYSLFLFAFGSPF

SEQ ID NO: 2232919 - protein, 26 aa, Cryptosporidium parvum
ISISLWKTIFPWIWNNLEHQQRNELT

SEQ ID NO: 2232920 - protein, 24 aa, Cryptosporidium parvum
ISITNYPLSVFIILGSNLEIGVFI

SEQ ID NO: 2232921 - protein, 20 aa, Cryptosporidium parvum
ISIVICFKNVFSQGEELINN

SEQ ID NO: 2232922 - protein, 19 aa, Cryptosporidium parvum
ISIWDRIQLNLDRGDDTGA

SEQ ID NO: 2232923 - protein, 23 aa, Cryptosporidium parvum
ISKAGQLFIGFMVFIGSVISFTS

SEQ ID NO: 2232924 - protein, 17 aa, Cryptosporidium parvum
ISKCDGYCISSCAEVIV

SEQ ID NO: 2232925 - protein, 17 aa, Cryptosporidium parvum
ISKELLKKLMTKCKERK

SEQ ID NO: 2232926 - protein, 17 aa, Cryptosporidium parvum
ISKGLLFIFENTILENE

SEQ ID NO: 2232927 - protein, 20 aa, Cryptosporidium parvum
ISKHIFVIFNYWILPIMAPK

SEQ ID NO: 2232928 - protein, 22 aa, Cryptosporidium parvum
ISKKAWRITFDDTLVCSQINNS

SEQ ID NO: 2232929 - protein, 17 aa, Cryptosporidium parvum
ISKLSSKDKLNFYYMGK

SEQ ID NO: 2232930 - protein, 24 aa, Cryptosporidium parvum
ISKMFKYAFQWLSGFLTNNDIIQN

SEQ ID NO: 2232931 - protein, 27 aa, Cryptosporidium parvum
ISKNYIIEMLFSFDFLNNIFSMFLASI

SEQ ID NO: 2232932 - protein, 21 aa, Cryptosporidium parvum
ISKQVLSKCFIPQKSGHLINT

SEQ ID NO: 2232933 - protein, 17 aa, Cryptosporidium parvum
ISKRHSVLFKYFGSLEN

SEQ ID NO: 2232934 - protein, 19 aa, Cryptosporidium parvum
ISLFFTERYRCIIFFCVIV

SEQ ID NO: 2232935 - protein, 25 aa, Cryptosporidium parvum
ISLIMVIGFSIRKYRKLRKGGEQVR

SEQ ID NO: 2232936 - protein, 18 aa, Cryptosporidium parvum
ISLINIFSLQGREYNAKF

SEQ ID NO: 2232937 - protein, 27 aa, Cryptosporidium parvum
ISLKHCLEKNWKCYSHKNIKNTNDQEM

SEQ ID NO: 2232938 - protein, 22 aa, Cryptosporidium parvum
ISLKKLRSLITIIPQEPNILTG

SEQ ID NO: 2232939 - protein, 20 aa, Cryptosporidium parvum
ISLKPSYKFPDYNKCIDILL

SEQ ID NO: 2232940 - protein, 23 aa, Cryptosporidium parvum
ISLKRRLHNTLQFFKSYSQSSNA

SEQ ID NO: 2232941 - protein, 19 aa, Cryptosporidium parvum
ISLLIATSFSYMKAQNEIE

SEQ ID NO: 2232942 - protein, 17 aa, Cryptosporidium parvum
ISLLILYFLIFLGNVKS

SEQ ID NO: 2232943 - protein, 21 aa, Cryptosporidium parvum
ISLLLCCSSQIIPISETQMTN

SEQ ID NO: 2232944 - protein, 24 aa, Cryptosporidium parvum
ISLLPYYLKISWYIYYLSTISDET

SEQ ID NO: 2232945 - protein, 28 aa, Cryptosporidium parvum
ISLNLILEVYPAWIPITVRLFEGSETNP

SEQ ID NO: 2232946 - protein, 22 aa, Cryptosporidium parvum
ISLPLCFIGGLFGQRRSKNYFK

SEQ ID NO: 2232947 - protein, 22 aa, Cryptosporidium parvum
ISLPSSLILYGRVTKEDTYING

SEQ ID NO: 2232948 - protein, 24 aa, Cryptosporidium parvum
ISLRGITGVCFFLGLYDDMVPADL

SEQ ID NO: 2232949 - protein, 20 aa, Cryptosporidium parvum
ISLRYESRIADSIMEMEQSS

SEQ ID NO: 2232950 - protein, 18 aa, Cryptosporidium parvum
ISLTYRFGSQIASRIHQD

SEQ ID NO: 2232951 - protein, 22 aa, Cryptosporidium parvum
ISLYFLSLLPWYTIDQNVNDAL

SEQ ID NO: 2232952 - protein, 17 aa, Cryptosporidium parvum
ISMFVLFFRCGERNRQH

SEQ ID NO: 2232953 - protein, 17 aa, Cryptosporidium parvum
ISMLCYAFSLADIVPTD

SEQ ID NO: 2232954 - protein, 20 aa, Cryptosporidium parvum
ISNFFASFVYYSFGDDTTSP

SEQ ID NO: 2232955 - protein, 28 aa, Cryptosporidium parvum
ISNKDAIKWVDFDFCYNRVDLNSLEEKV

SEQ ID NO: 2232956 - protein, 23 aa, Cryptosporidium parvum
ISNLFKVHGLVAFTKWICGCFEE

SEQ ID NO: 2232957 - protein, 29 aa, Cryptosporidium parvum
ISNLIFEILKGLIILLFFVKQRKRLCIVL

SEQ ID NO: 2232958 - protein, 25 aa, Cryptosporidium parvum
ISNLPEFKGKLSNILELIFEALQKY

SEQ ID NO: 2232959 - protein, 23 aa, Cryptosporidium parvum
ISNSEIPSWFVGILTLPTLKEGI

SEQ ID NO: 2232960 - protein, 26 aa, Cryptosporidium parvum
ISNSEVILYYCLLRDLYSSRRSELII

SEQ ID NO: 2232961 - protein, 18 aa, Cryptosporidium parvum
ISPAIGRDPLFVDFLNDF

SEQ ID NO: 2232962 - protein, 19 aa, Cryptosporidium parvum
ISPGYHFWVAELVKRRNSI

SEQ ID NO: 2232963 - protein, 26 aa, Cryptosporidium parvum
ISPIVSMCLIELTNIYDILELEYNSI

SEQ ID NO: 2232964 - protein, 17 aa, Cryptosporidium parvum
ISPLALKGSNRFPILTV

SEQ ID NO: 2232965 - protein, 24 aa, Cryptosporidium parvum
ISPQSVIEGVCWLFSTNSYSNVVD

SEQ ID NO: 2232966 - protein, 19 aa, Cryptosporidium parvum
ISPSNLFAFFTFIHALLIS

SEQ ID NO: 2232967 - protein, 17 aa, Cryptosporidium parvum
ISPWKPVFIDSSDLRFW

SEQ ID NO: 2232968 - protein, 18 aa, Cryptosporidium parvum
ISQKIVYELISKKWVKLI

SEQ ID NO: 2232969 - protein, 27 aa, Cryptosporidium parvum
ISQKSFRIVVIAPWMEHIPRFARFDLK

SEQ ID NO: 2232970 - protein, 20 aa, Cryptosporidium parvum
ISQLQLWFPQTIASLRSHFA

SEQ ID NO: 2232971 - protein, 29 aa, Cryptosporidium parvum
ISRFTLYYIKHNITLIFAISVGLTCAIVY

SEQ ID NO: 2232972 - protein, 19 aa, Cryptosporidium parvum
ISRIQGFDYSKIISKKQIL

SEQ ID NO: 2232973 - protein, 19 aa, Cryptosporidium parvum
ISRYKKRCVQQIAAFSKTN

SEQ ID NO: 2232974 - protein, 19 aa, Cryptosporidium parvum
ISSCHPSQFLFKCSWHPIK

SEQ ID NO: 2232975 - protein, 25 aa, Cryptosporidium parvum
ISSCKASACNGCLTISKYNVFTGLA

SEQ ID NO: 2232976 - protein, 26 aa, Cryptosporidium parvum
ISSCPGRPFFEWSRLPGRKKNLEIDT

SEQ ID NO: 2232977 - protein, 22 aa, Cryptosporidium parvum
ISSDFLRKISVLKLCVYDTNPE

SEQ ID NO: 2232978 - protein, 17 aa, Cryptosporidium parvum
ISSFGFGGTNAHVIIEC

SEQ ID NO: 2232979 - protein, 19 aa, Cryptosporidium parvum
ISSGALLYVALGEMILDEF

SEQ ID NO: 2232980 - protein, 19 aa, Cryptosporidium parvum
ISSHPLYIVFLIVEIIIQS

SEQ ID NO: 2232981 - protein, 29 aa, Cryptosporidium parvum
ISSILKPIPIQLFISWKLENHEFNNIKSL

SEQ ID NO: 2232982 - protein, 18 aa, Cryptosporidium parvum
ISSIVICCSNSFSSLIKY

SEQ ID NO: 2232983 - protein, 25 aa, Cryptosporidium parvum
ISSKCSALIQSFWLGIADNVDPELI

SEQ ID NO: 2232984 - protein, 24 aa, Cryptosporidium parvum
ISSLEVLRIFPFDYNRRLMSIIVH

SEQ ID NO: 2232985 - protein, 28 aa, Cryptosporidium parvum
ISSLFFLLCLVIRRIYMRRLNNYATTRN

SEQ ID NO: 2232986 - protein, 25 aa, Cryptosporidium parvum
ISSLKIIIISSILPRLIHFLGASES

SEQ ID NO: 2232987 - protein, 20 aa, Cryptosporidium parvum
ISSLMIKLAECLSLSDTFAG

SEQ ID NO: 2232988 - protein, 28 aa, Cryptosporidium parvum
ISSLNILTILTLEWIYFNIFLRYYYSSI

SEQ ID NO: 2232989 - protein, 18 aa, Cryptosporidium parvum
ISSMCIAVAHFWGMAQIT

SEQ ID NO: 2232990 - protein, 19 aa, Cryptosporidium parvum
ISSPIFHIICTDFEDQANS

SEQ ID NO: 2232991 - protein, 25 aa, Cryptosporidium parvum
ISSREWKASKLIFLPSSDKHLERPP

SEQ ID NO: 2232992 - protein, 18 aa, Cryptosporidium parvum
ISSSLLVYMMLKVISTRS

SEQ ID NO: 2232993 - protein, 22 aa, Cryptosporidium parvum
ISSTDGYIWVKLDSLMKLFQGL

SEQ ID NO: 2232994 - protein, 18 aa, Cryptosporidium parvum
ISSVLMFPYNVYRLISKS

SEQ ID NO: 2232995 - protein, 27 aa, Cryptosporidium parvum
ISTILLIPCIFLARELELIMGSAAFNT

SEQ ID NO: 2232996 - protein, 22 aa, Cryptosporidium parvum
ISTMLGYYCVWDVDPKLHTPLM

SEQ ID NO: 2232997 - protein, 19 aa, Cryptosporidium parvum
ISTSVSISRYFSRKRSTIT

SEQ ID NO: 2232998 - protein, 23 aa, Cryptosporidium parvum
ISTTLPIFTGWSLNDKSPNYFIR

SEQ ID NO: 2232999 - protein, 26 aa, Cryptosporidium parvum
ISTYDIIDLIGLKAYFFSILKDQETI

SEQ ID NO: 2233000 - protein, 19 aa, Cryptosporidium parvum
ISVFYFLYKKKEVISRENN

SEQ ID NO: 2233001 - protein, 21 aa, Cryptosporidium parvum
ISVILEYMEPLILLHEQNTDY

SEQ ID NO: 2233002 - protein, 23 aa, Cryptosporidium parvum
ISVRFNDCNGIKAWEMNRICSML

SEQ ID NO: 2233003 - protein, 19 aa, Cryptosporidium parvum
ISVYCIYDSLVILVYICKL

SEQ ID NO: 2233004 - protein, 27 aa, Cryptosporidium parvum
ISYFFNKFRIRAMFANRQLKRIFHSRT

SEQ ID NO: 2233005 - protein, 18 aa, Cryptosporidium parvum
ISYLKWGQLCILFDENQI

SEQ ID NO: 2233006 - protein, 18 aa, Cryptosporidium parvum
ISYLKWYFVGINKLLTSD

SEQ ID NO: 2233007 - protein, 35 aa, Cryptosporidium parvum
ISYLYFQVCSKCIKWKILMVLIVWYNLITTFKNNQ

SEQ ID NO: 2233008 - protein, 17 aa, Cryptosporidium parvum
ISYNLGLNGPSMTVDTA

SEQ ID NO: 2233009 - protein, 29 aa, Cryptosporidium parvum
ISYYIKKCMNPYHYISWLTYIENNQDFFK

SEQ ID NO: 2233010 - protein, 26 aa, Cryptosporidium parvum
ITAFYINFLFIWSCVYIALVLLFFTI

SEQ ID NO: 2233011 - protein, 18 aa, Cryptosporidium parvum
ITAIKRGFDKKVIFSLLL

SEQ ID NO: 2233012 - protein, 19 aa, Cryptosporidium parvum
ITAMQGIHIMYEISKMIDS

SEQ ID NO: 2233013 - protein, 17 aa, Cryptosporidium parvum
ITCGTWLVYLYELKRCH

SEQ ID NO: 2233014 - protein, 18 aa, Cryptosporidium parvum
ITCSVIYGILLYNRENLP

SEQ ID NO: 2233015 - protein, 24 aa, Cryptosporidium parvum
ITDIIRIVGIFRFSRNKALTTDYT

SEQ ID NO: 2233016 - protein, 18 aa, Cryptosporidium parvum
ITDILMYCDMFFGIIMSI

SEQ ID NO: 2233017 - protein, 18 aa, Cryptosporidium parvum
ITDLPISILIQAALSCGS

SEQ ID NO: 2233018 - protein, 18 aa, Cryptosporidium parvum
ITDSLGLIVDENGIKRRT

SEQ ID NO: 2233019 - protein, 23 aa, Cryptosporidium parvum
ITECCAIIGGIFAFSGMIDIFFF

SEQ ID NO: 2233020 - protein, 27 aa, Cryptosporidium parvum
ITESCCLPEMITFSSFVHLLSSLVDNI

SEQ ID NO: 2233021 - protein, 29 aa, Cryptosporidium parvum
ITFGAFKANSFFFFSWIFMVILPLLISLT

SEQ ID NO: 2233022 - protein, 17 aa, Cryptosporidium parvum
ITFHPYCLISNSDGIGF

SEQ ID NO: 2233023 - protein, 24 aa, Cryptosporidium parvum
ITFMLSCITLLYLLLERYLEKCIS

SEQ ID NO: 2233024 - protein, 23 aa, Cryptosporidium parvum
ITFPIILGCTILVYEISKFASLC

SEQ ID NO: 2233025 - protein, 23 aa, Cryptosporidium parvum
ITFYFRLDFIMSINPQVSQFLRQ

SEQ ID NO: 2233026 - protein, 25 aa, Cryptosporidium parvum
ITGFSLNYHNGWRYSLLAPCLLLLI

SEQ ID NO: 2233027 - protein, 25 aa, Cryptosporidium parvum
ITGICLTLAGSVWYGFAKSLNCNSG

SEQ ID NO: 2233028 - protein, 18 aa, Cryptosporidium parvum
ITGPCCWLDDKFKHLPSL

SEQ ID NO: 2233029 - protein, 24 aa, Cryptosporidium parvum
ITGQCLRLLHKLHNTFELEYLDLS

SEQ ID NO: 2233030 - protein, 28 aa, Cryptosporidium parvum
ITGSKLKRFFAEFIIRMEDFDVSVIPLF

SEQ ID NO: 2233031 - protein, 22 aa, Cryptosporidium parvum
ITHHLKLCWVFIFCLSLFGMLD

SEQ ID NO: 2233032 - protein, 31 aa, Cryptosporidium parvum
ITIGGVIGVSGWIPMISHLSLGKDSPLNNEI

SEQ ID NO: 2233033 - protein, 27 aa, Cryptosporidium parvum
ITIPERPSIPLGYIRLSIYVLGENDLV

SEQ ID NO: 2233034 - protein, 30 aa, Cryptosporidium parvum
ITKCRCKAKEAINRIIIEASSRKKLRNISS

SEQ ID NO: 2233035 - protein, 23 aa, Cryptosporidium parvum
ITKYNSFCSYYFNIINNIEYKND

SEQ ID NO: 2233036 - protein, 17 aa, Cryptosporidium parvum
ITLCSTIQYIGYCENHE

SEQ ID NO: 2233037 - protein, 17 aa, Cryptosporidium parvum
ITLFWILKLNKQISEPF

SEQ ID NO: 2233038 - protein, 21 aa, Cryptosporidium parvum
ITLLCVFSIMTLHEPKEETDT

SEQ ID NO: 2233039 - protein, 19 aa, Cryptosporidium parvum
ITLLKDLQAYIGFDNAQTL

SEQ ID NO: 2233040 - protein, 18 aa, Cryptosporidium parvum
ITLPCFLIIWCSCIEQLI

SEQ ID NO: 2233041 - protein, 17 aa, Cryptosporidium parvum
ITLPYDYHEPLYLLGIT

SEQ ID NO: 2233042 - protein, 18 aa, Cryptosporidium parvum
ITMNFCKNLSQALLNIKP

SEQ ID NO: 2233043 - protein, 23 aa, Cryptosporidium parvum
ITMYCMHVAFMLVLRSGGCMALL

SEQ ID NO: 2233044 - protein, 20 aa, Cryptosporidium parvum
ITNFLWPRIVFAISSSSSSA

SEQ ID NO: 2233045 - protein, 26 aa, Cryptosporidium parvum
ITNKVSIFNFEFLKKLKYKGQISKDI

SEQ ID NO: 2233046 - protein, 27 aa, Cryptosporidium parvum
ITPYEWKCRWRGLHFKVYTLRFPNSFF

SEQ ID NO: 2233047 - protein, 17 aa, Cryptosporidium parvum
ITQEISKNYIIEMLFSF

SEQ ID NO: 2233048 - protein, 32 aa, Cryptosporidium parvum
ITQWHPKKRICVFHLLRLCLEHGLQDQTSISV

SEQ ID NO: 2233049 - protein, 24 aa, Cryptosporidium parvum
ITQYIYKPWMGFLYLETDNNNSSK

SEQ ID NO: 2233050 - protein, 20 aa, Cryptosporidium parvum
ITRFRPVKDNVYSGSSKYTL

SEQ ID NO: 2233051 - protein, 23 aa, Cryptosporidium parvum
ITRIPRVDCSIGIHDRNKNFEFV

SEQ ID NO: 2233052 - protein, 23 aa, Cryptosporidium parvum
ITRLIHCAKAIIIDEGLPEYKIE

SEQ ID NO: 2233053 - protein, 18 aa, Cryptosporidium parvum
ITRMCFTDLFDIFYDSFD

SEQ ID NO: 2233054 - protein, 22 aa, Cryptosporidium parvum
ITRYNPYFLGWILSELIALLTN

SEQ ID NO: 2233055 - protein, 23 aa, Cryptosporidium parvum
ITSEWLYEVPFEISPARFRRMKK

SEQ ID NO: 2233056 - protein, 19 aa, Cryptosporidium parvum
ITSLFSWITIFVVVLFAIS

SEQ ID NO: 2233057 - protein, 17 aa, Cryptosporidium parvum
ITSNGDYYIIEFTEQNS

SEQ ID NO: 2233058 - protein, 21 aa, Cryptosporidium parvum
ITSYNCKRGIFTLSNSGITCE

SEQ ID NO: 2233059 - protein, 19 aa, Cryptosporidium parvum
ITTRFKFRKNMGIAVIEEA

SEQ ID NO: 2233060 - protein, 25 aa, Cryptosporidium parvum
ITTSFGFLCIFSLIQFTQDLFQEKF

SEQ ID NO: 2233061 - protein, 18 aa, Cryptosporidium parvum
ITTSGIWFSNNGSFSKSV

SEQ ID NO: 2233062 - protein, 21 aa, Cryptosporidium parvum
ITVNFLDGFKLLVNKLSLYRC

SEQ ID NO: 2233063 - protein, 17 aa, Cryptosporidium parvum
ITYEINQYLPISITRMG

SEQ ID NO: 2233064 - protein, 28 aa, Cryptosporidium parvum
ITYKNLWKSIRIISHFLLNELSLKKGDR

SEQ ID NO: 2233065 - protein, 22 aa, Cryptosporidium parvum
ITYYPDRMWGITVPIYMLFLPF

SEQ ID NO: 2233066 - protein, 24 aa, Cryptosporidium parvum
IVCDPKYKESILYPIVLFLADAMY

SEQ ID NO: 2233067 - protein, 17 aa, Cryptosporidium parvum
IVDDLLEFWDKVIDTQN

SEQ ID NO: 2233068 - protein, 17 aa, Cryptosporidium parvum
IVDREVWKEKLFSKEQI

SEQ ID NO: 2233069 - protein, 24 aa, Cryptosporidium parvum
IVFITLYIIFGIIFVIKNDIESKI

SEQ ID NO: 2233070 - protein, 23 aa, Cryptosporidium parvum
IVFKSEILKKFFIEERVNLSIEF

SEQ ID NO: 2233071 - protein, 23 aa, Cryptosporidium parvum
IVFPPCPILLFSLRDINSNSQNK

SEQ ID NO: 2233072 - protein, 25 aa, Cryptosporidium parvum
IVGEPLEMCMFEFSGWVLCDDYNRN

SEQ ID NO: 2233073 - protein, 21 aa, Cryptosporidium parvum
IVGFIRLLVVLSFGAVPALLN

SEQ ID NO: 2233074 - protein, 25 aa, Cryptosporidium parvum
IVGTIRPKISFGIFDTISLCLDSCN

SEQ ID NO: 2233075 - protein, 17 aa, Cryptosporidium parvum
IVIKFIIIHYLKNFGID

SEQ ID NO: 2233076 - protein, 26 aa, Cryptosporidium parvum
IVIQRFPPVILVFDIVEQGRLYYKQL

SEQ ID NO: 2233077 - protein, 17 aa, Cryptosporidium parvum
IVIYSCTLSNIFSSAWI

SEQ ID NO: 2233078 - protein, 24 aa, Cryptosporidium parvum
IVKPRGEKGFSWDPIFKPNGHSLA

SEQ ID NO: 2233079 - protein, 23 aa, Cryptosporidium parvum
IVKRIVLVGNLFKVRKSKAVVRN

SEQ ID NO: 2233080 - protein, 23 aa, Cryptosporidium parvum
IVKSMLWSGVYIWATTKMYRKNN

SEQ ID NO: 2233081 - protein, 18 aa, Cryptosporidium parvum
IVLFLIIFFYISSFLCVS

SEQ ID NO: 2233082 - protein, 18 aa, Cryptosporidium parvum
IVLMKKFKNQSCWNSFKS

SEQ ID NO: 2233083 - protein, 17 aa, Cryptosporidium parvum
IVLPGLYYKPYSYTTNL

SEQ ID NO: 2233084 - protein, 19 aa, Cryptosporidium parvum
IVLPHHRATLFAMFSLFET

SEQ ID NO: 2233085 - protein, 23 aa, Cryptosporidium parvum
IVLRFCRKRSIEYTKIIIKKIPY

SEQ ID NO: 2233086 - protein, 17 aa, Cryptosporidium parvum
IVLRIRKYNSFGGAEFF

SEQ ID NO: 2233087 - protein, 23 aa, Cryptosporidium parvum
IVLTLVFSWLFNLRECKEVNTSN

SEQ ID NO: 2233088 - protein, 17 aa, Cryptosporidium parvum
IVLYRIILKKTPFREIL

SEQ ID NO: 2233089 - protein, 18 aa, Cryptosporidium parvum
IVMFCSFLTLLINQEHFA

SEQ ID NO: 2233090 - protein, 33 aa, Cryptosporidium parvum
IVNHDLLIRWFQLGIWFPFYRIHNSMNSISRDF

SEQ ID NO: 2233091 - protein, 18 aa, Cryptosporidium parvum
IVNLCYDISWSKKTAACI

SEQ ID NO: 2233092 - protein, 18 aa, Cryptosporidium parvum
IVNLHIRETFKIQHAMNG

SEQ ID NO: 2233093 - protein, 33 aa, Cryptosporidium parvum
IVNVLFLKLIFLFSCSLCSIVFTQTVSNNKSIR

SEQ ID NO: 2233094 - protein, 18 aa, Cryptosporidium parvum
IVPFLMDHLIHYSILVKN

SEQ ID NO: 2233095 - protein, 18 aa, Cryptosporidium parvum
IVPLPPMYRFFTSLENLK

SEQ ID NO: 2233096 - protein, 17 aa, Cryptosporidium parvum
IVQRHSFVMKRSTGNNN

SEQ ID NO: 2233097 - protein, 27 aa, Cryptosporidium parvum
IVQVFRRMISIFSWFFTGIVILLMVGI

SEQ ID NO: 2233098 - protein, 19 aa, Cryptosporidium parvum
IVRIKGINLFMSKFPQNQS

SEQ ID NO: 2233099 - protein, 32 aa, Cryptosporidium parvum; identical to SEQ ID NO: 2124544

SEQ ID NO: 2233100 - protein, 21 aa, Cryptosporidium parvum
IVRQICDKFSIIFSTINQNLK

SEQ ID NO: 2233101 - protein, 26 aa, Cryptosporidium parvum
IVSCFLLGIIVYYSFKDVEILNSQDE

SEQ ID NO: 2233102 - protein, 20 aa, Cryptosporidium parvum
IVSPLFKAKLIDPLWSSTKF

SEQ ID NO: 2233103 - protein, 27 aa, Cryptosporidium parvum
IVSRLCVRIEGSLIWIALDRVIRHKEM

SEQ ID NO: 2233104 - protein, 17 aa, Cryptosporidium parvum
IVSRSKLLYNIDSPTRA

SEQ ID NO: 2233105 - protein, 17 aa, Cryptosporidium parvum
IVTEAAYGLPVDPKTGF

SEQ ID NO: 2233106 - protein, 17 aa, Cryptosporidium parvum
IVVCAGFLIGSLDRSTL

SEQ ID NO: 2233107 - protein, 19 aa, Cryptosporidium parvum
IVVSFLYFLFNYKKNENNQ

SEQ ID NO: 2233108 - protein, 19 aa, Cryptosporidium parvum
IVVVSVFDFDVTKSESLSK

SEQ ID NO: 2233109 - protein, 25 aa, Cryptosporidium parvum
IVWQQLRDVLLLTGMSLKYPTWSGE

SEQ ID NO: 2233110 - protein, 20 aa, Cryptosporidium parvum
IVYAPFWFFYINSVGKILSR

SEQ ID NO: 2233111 - protein, 20 aa, Cryptosporidium parvum
IWDKERRVSLSIRFDSKSSI

SEQ ID NO: 2233112 - protein, 18 aa, Cryptosporidium parvum
IWFNSQFDFQGYDRKNLP

SEQ ID NO: 2233113 - protein, 24 aa, Cryptosporidium parvum
IWFVKFYAPWCGHCRHLYPEILKV

SEQ ID NO: 2233114 - protein, 19 aa, Cryptosporidium parvum
IWGGLRGGVSLALAMSLES

SEQ ID NO: 2233115 - protein, 28 aa, Cryptosporidium parvum
IWIRESNKFGSWVYIPPNISIPFHPLDS

SEQ ID NO: 2233116 - protein, 17 aa, Cryptosporidium parvum
IWLRSSSLIPMKTNILL

SEQ ID NO: 2233117 - protein, 25 aa, Cryptosporidium parvum
IWLVSRLAKIVEFYEMIRIIQEEGK

SEQ ID NO: 2233118 - protein, 20 aa, Cryptosporidium parvum
IWNVLFQFILLRIKLPVSTI

SEQ ID NO: 2233119 - protein, 21 aa, Cryptosporidium parvum
IWRRRVMNSVHILKNVKNVDI

SEQ ID NO: 2233120 - protein, 25 aa, Cryptosporidium parvum
IWSILELLLSFGLVAIQVYYIKSYF

SEQ ID NO: 2233121 - protein, 18 aa, Cryptosporidium parvum
IWVSPILHRQIKRVNSQL

SEQ ID NO: 2233122 - protein, 24 aa, Cryptosporidium parvum
IYAIKRLKKSVVIRQKQVDHITNE

SEQ ID NO: 2233123 - protein, 17 aa, Cryptosporidium parvum
IYCDLCNNWYHWYCLGL

SEQ ID NO: 2233124 - protein, 22 aa, Cryptosporidium parvum
IYCSCYPGWGGFYCSYPYLSSQ

SEQ ID NO: 2233125 - protein, 24 aa, Cryptosporidium parvum
IYDEWKNLIDISFKYEDPTSTSDQ

SEQ ID NO: 2233126 - protein, 18 aa, Cryptosporidium parvum
IYDFRIARNEFKISSFND

SEQ ID NO: 2233127 - protein, 20 aa, Cryptosporidium parvum
IYDGFNYVYRSFILKLVIKL

SEQ ID NO: 2233128 - protein, 18 aa, Cryptosporidium parvum
IYDHQLLESKAWWICGIP

SEQ ID NO: 2233129 - protein, 20 aa, Cryptosporidium parvum
IYDLALSWNERGTREKLSKM

SEQ ID NO: 2233130 - protein, 19 aa, Cryptosporidium parvum
IYDLRVLKSTGIISRNQWL

SEQ ID NO: 2233131 - protein, 18 aa, Cryptosporidium parvum
IYEEIRFKMCGTSQNSNP

SEQ ID NO: 2233132 - protein, 20 aa, Cryptosporidium parvum
IYEGATCLCIDAWKQSYYTI

SEQ ID NO: 2233133 - protein, 21 aa, Cryptosporidium parvum
IYERNEFIIEYSIKIAHLDFN

SEQ ID NO: 2233134 - protein, 23 aa, Cryptosporidium parvum
IYFCDGCYQPAHHSCVNPKQPFR

SEQ ID NO: 2233135 - protein, 18 aa, Cryptosporidium parvum
IYFIRNWNEEFSKPEAVK

SEQ ID NO: 2233136 - protein, 17 aa, Cryptosporidium parvum
IYFKMMDIIEDFENYNN

SEQ ID NO: 2233137 - protein, 19 aa, Cryptosporidium parvum
IYFNIFLRYYYSSIDLINK

SEQ ID NO: 2233138 - protein, 17 aa, Cryptosporidium parvum
IYFPSSIITGMSIASQN

SEQ ID NO: 2233139 - protein, 17 aa, Cryptosporidium parvum
IYFVEIINHIFVEALVN

SEQ ID NO: 2233140 - protein, 17 aa, Cryptosporidium parvum
IYGGRKVLSQAFRNRFV

SEQ ID NO: 2233141 - protein, 29 aa, Cryptosporidium parvum
IYHKTLSCKLVRLLVERELPPGFYQGVFK

SEQ ID NO: 2233142 - protein, 19 aa, Cryptosporidium parvum
IYIARAAFPGNIMNDYDLC

SEQ ID NO: 2233143 - protein, 24 aa, Cryptosporidium parvum
IYIFSRLDISFFYHYIRGQGLLKL

SEQ ID NO: 2233144 - protein, 19 aa, Cryptosporidium parvum
IYIGLCCCHNIVPQITNNG

SEQ ID NO: 2233145 - protein, 30 aa, Cryptosporidium parvum; identical to SEQ ID NO: 2124570

SEQ ID NO: 2233146 - protein, 18 aa, Cryptosporidium parvum
IYIIFYIIFFYIQVVYSL

SEQ ID NO: 2233147 - protein, 18 aa, Cryptosporidium parvum
IYIIPIITLKSNEMNLGT

SEQ ID NO: 2233148 - protein, 18 aa, Cryptosporidium parvum
IYILLSFRAAPQLYGSPI

SEQ ID NO: 2233149 - protein, 23 aa, Cryptosporidium parvum
IYKFKWVLIYLILLIFSAYIQLN

SEQ ID NO: 2233150 - protein, 19 aa, Cryptosporidium parvum
IYKIIKNWWIKNRRDKQQF

SEQ ID NO: 2233151 - protein, 24 aa, Cryptosporidium parvum
IYKLKEIFQDLPIKNKDNDLFNTL

SEQ ID NO: 2233152 - protein, 20 aa, Cryptosporidium parvum
IYKPKRWFHAFSPRYLSFGF

SEQ ID NO: 2233153 - protein, 17 aa, Cryptosporidium parvum
IYKSQGLSGFFKGYLTY

SEQ ID NO: 2233154 - protein, 20 aa, Cryptosporidium parvum
IYLAFLFGGLIQRCLIHQIR

SEQ ID NO: 2233155 - protein, 17 aa, Cryptosporidium parvum
IYLCIIILIITGLISII

SEQ ID NO: 2233156 - protein, 19 aa, Cryptosporidium parvum
IYLIKIIVNNVFKYIDSGE

SEQ ID NO: 2233157 - protein, 23 aa, Cryptosporidium parvum
IYLIKLFIFRVNNEIKNYFNCIN

SEQ ID NO: 2233158 - protein, 18 aa, Cryptosporidium parvum
IYLILKIINFLPPKIRQL

SEQ ID NO: 2233159 - protein, 18 aa, Cryptosporidium parvum
IYLLLNYNNEYFKSSLLI

SEQ ID NO: 2233160 - protein, 18 aa, Cryptosporidium parvum
IYLMKLLYTECGYTFISK

SEQ ID NO: 2233161 - protein, 29 aa, Cryptosporidium parvum
IYLSAEMSYRLWSIVYFIMTGIRISEYKY

SEQ ID NO: 2233162 - protein, 26 aa, Cryptosporidium parvum
IYMERLIEIFYIYLIIPNFQENNIII

SEQ ID NO: 2233163 - protein, 17 aa, Cryptosporidium parvum
IYMVLKESLDLLYSYLG

SEQ ID NO: 2233164 - protein, 19 aa, Cryptosporidium parvum
IYNELKYEILISSPSCIIK

SEQ ID NO: 2233165 - protein, 23 aa, Cryptosporidium parvum
IYNFIIKKYINWFLIPAADIFGL

SEQ ID NO: 2233166 - protein, 17 aa, Cryptosporidium parvum
IYNLGSIIRTISKIDSK

SEQ ID NO: 2233167 - protein, 18 aa, Cryptosporidium parvum
IYNQLSIVSIEYAEMMLL

SEQ ID NO: 2233168 - protein, 25 aa, Cryptosporidium parvum
IYNRLKLLVIDEAHIYTGHFGINTS

SEQ ID NO: 2233169 - protein, 17 aa, Cryptosporidium parvum
IYNSIYLLSINTLNILL

SEQ ID NO: 2233170 - protein, 24 aa, Cryptosporidium parvum
IYNSKLKLLLGLYKLEISNIEDSS

SEQ ID NO: 2233171 - protein, 20 aa, Cryptosporidium parvum
IYNSRFLLRCKMKDSENIVS

SEQ ID NO: 2233172 - protein, 17 aa, Cryptosporidium parvum
IYPNCKVQISWLDIGFN

SEQ ID NO: 2233173 - protein, 18 aa, Cryptosporidium parvum
IYRYHGIKLRWDVTSGVS

SEQ ID NO: 2233174 - protein, 21 aa, Cryptosporidium parvum
IYSAALILLELLCPRFTTAME

SEQ ID NO: 2233175 - protein, 18 aa, Cryptosporidium parvum
IYSIIGFPTYFKIFDKTP

SEQ ID NO: 2233176 - protein, 19 aa, Cryptosporidium parvum
IYSIRVCSAPLFAFLPFDI

SEQ ID NO: 2233177 - protein, 22 aa, Cryptosporidium parvum
IYSITDFNSFFGYLGIGTNDLV

SEQ ID NO: 2233178 - protein, 24 aa, Cryptosporidium parvum
IYSKNCQFIPPGIEEGFPLLRKLE

SEQ ID NO: 2233179 - protein, 18 aa, Cryptosporidium parvum
IYSLERLVALISMENINI

SEQ ID NO: 2233180 - protein, 18 aa, Cryptosporidium parvum
IYSLLYLYNSVIIIPEKI

SEQ ID NO: 2233181 - protein, 24 aa, Cryptosporidium parvum
IYSLPNHRLLKTLVPITIPERPSI

SEQ ID NO: 2233182 - protein, 25 aa, Cryptosporidium parvum
IYSSASFLASIKFSKAMVEISSEKK

SEQ ID NO: 2233183 - protein, 18 aa, Cryptosporidium parvum
IYTSEPFVLLWLITFLSW

SEQ ID NO: 2233184 - protein, 18 aa, Cryptosporidium parvum
IYTVRWRQYHAVAASALT

SEQ ID NO: 2233185 - protein, 22 aa, Cryptosporidium parvum
IYVQLKLLLFVNKILYNYDILI

SEQ ID NO: 2233186 - protein, 17 aa, Cryptosporidium parvum
IYVSLFLFLIPQILNDL

SEQ ID NO: 2233187 - protein, 19 aa, Cryptosporidium parvum
IYVSYPLFYLIALLLSSII

SEQ ID NO: 2233188 - protein, 18 aa, Cryptosporidium parvum
IYVWFNWINNNNIVRILA

SEQ ID NO: 2233189 - protein, 23 aa, Cryptosporidium parvum
IYWNSRLYFWSPITFYTIGVLIL

SEQ ID NO: 2233190 - protein, 19 aa, Cryptosporidium parvum
IYYFFIRYFINGCRSLRSC

SEQ ID NO: 2233191 - protein, 17 aa, Cryptosporidium parvum
IYYKRPVQKVPLEEKLT

SEQ ID NO: 2233192 - protein, 17 aa, Cryptosporidium parvum
IYYNLVENFPLLYFNRA

SEQ ID NO: 2233193 - protein, 25 aa, Cryptosporidium parvum
KAASFKVFAARVVRRNLSLGSSQLY

SEQ ID NO: 2233194 - protein, 34 aa, Cryptosporidium parvum
KADVIMRLMCNFTFRLFACLFFIVVVILGIMFGK

SEQ ID NO: 2233195 - protein, 18 aa, Cryptosporidium parvum
KAEASFWVTEEIDLSQDT

SEQ ID NO: 2233196 - protein, 22 aa, Cryptosporidium parvum
KAFKEDYCRYVILTFLLIALDA

SEQ ID NO: 2233197 - protein, 17 aa, Cryptosporidium parvum
KAFTPRPYSSVNVDEQM

SEQ ID NO: 2233198 - protein, 24 aa, Cryptosporidium parvum
KAFVDDCIFYMGFNLVDYKGNKVS

SEQ ID NO: 2233199 - protein, 21 aa, Cryptosporidium parvum
KAGALIAFGLISIRIKNDCDP

SEQ ID NO: 2233200 - protein, 28 aa, Cryptosporidium parvum
KAGRVMSTKTFFCWVWKSLYQGTVIMLG

SEQ ID NO: 2233201 - protein, 17 aa, Cryptosporidium parvum
KAHKRFKKMFIISETCQ

SEQ ID NO: 2233202 - protein, 19 aa, Cryptosporidium parvum
KAIDDCIYHSNSILEHCNK

SEQ ID NO: 2233203 - protein, 19 aa, Cryptosporidium parvum
KAIYGDNLLYFKKKIIPKM

SEQ ID NO: 2233204 - protein, 26 aa, Cryptosporidium parvum
KAKDCFPMSLSCTIFILLSNLCLKYV

SEQ ID NO: 2233205 - protein, 17 aa, Cryptosporidium parvum
KALEELMLMALDKDTGS

SEQ ID NO: 2233206 - protein, 19 aa, Cryptosporidium parvum
KALETYGGIFGKIGKNELS

SEQ ID NO: 2233207 - protein, 21 aa, Cryptosporidium parvum
KALNCFHCSTSMFRNSEISSH

SEQ ID NO: 2233208 - protein, 19 aa, Cryptosporidium parvum
KALPCCGLLDPLKPVQGYF

SEQ ID NO: 2233209 - protein, 21 aa, Cryptosporidium parvum
KALQIWSIICIIFNILIYQIT

SEQ ID NO: 2233210 - protein, 23 aa, Cryptosporidium parvum
KALSRLQGTWGIAVLHKDYKDLM

SEQ ID NO: 2233211 - protein, 23 aa, Cryptosporidium parvum
KALYRFISIWSGFLLIFNILILL

SEQ ID NO: 2233212 - protein, 24 aa, Cryptosporidium parvum
KAMKPWKINSILIKAIKYLSKEPE

SEQ ID NO: 2233213 - protein, 19 aa, Cryptosporidium parvum
KAMKYLNNRWQIICIYDNE

SEQ ID NO: 2233214 - protein, 20 aa, Cryptosporidium parvum
KANILNSIFEWKQCINSITA

SEQ ID NO: 2233215 - protein, 19 aa, Cryptosporidium parvum
KANITSWAHWTFSHDAMSR

SEQ ID NO: 2233216 - protein, 21 aa, Cryptosporidium parvum
KANNFMAIWLDAQRIIIKTPD

SEQ ID NO: 2233217 - protein, 31 aa, Cryptosporidium parvum
KASELRFSKEIEFISLIYPKGWLLYSEDATT

SEQ ID NO: 2233218 - protein, 19 aa, Cryptosporidium parvum
KASLCIPNQLLVERLYSIE

SEQ ID NO: 2233219 - protein, 19 aa, Cryptosporidium parvum
KASNGRTILQFFITEDQLG

SEQ ID NO: 2233220 - protein, 18 aa, Cryptosporidium parvum
KASRVLSLNGSFPSNLDF

SEQ ID NO: 2233221 - protein, 24 aa, Cryptosporidium parvum
KATKYIFIYMIFALLLKKLEDNSH

SEQ ID NO: 2233222 - protein, 23 aa, Cryptosporidium parvum
KAYRDSLKYTRNCRNNCKYCKRN

SEQ ID NO: 2233223 - protein, 22 aa, Cryptosporidium parvum
KAYRMLCEVVGMAAMDYISSGQ

SEQ ID NO: 2233224 - protein, 22 aa, Cryptosporidium parvum
KCDDFLALFGWMLLLLYCGVLI

SEQ ID NO: 2233225 - protein, 18 aa, Cryptosporidium parvum
KCEGCGKIDSSPILCHNS

SEQ ID NO: 2233226 - protein, 27 aa, Cryptosporidium parvum
KCESYPEFLFCIPIKPASNILGCELDT

SEQ ID NO: 2233227 - protein, 19 aa, Cryptosporidium parvum
KCINLALSSMEHIHPSMVT

SEQ ID NO: 2233228 - protein, 17 aa, Cryptosporidium parvum
KCIPDILNEISLNSQGK

SEQ ID NO: 2233229 - protein, 17 aa, Cryptosporidium parvum
KCIPPVKPIFCMLICIL

SEQ ID NO: 2233230 - protein, 25 aa, Cryptosporidium parvum
KCKFSNVCQVAFYRGLVLCCSMIHD

SEQ ID NO: 2233231 - protein, 20 aa, Cryptosporidium parvum
KCPTRISSQLFLFDSDANLC

SEQ ID NO: 2233232 - protein, 19 aa, Cryptosporidium parvum
KCRATFHRSYLKHFRQEDI

SEQ ID NO: 2233233 - protein, 18 aa, Cryptosporidium parvum
KCSHEFPTYDIIANYSVF

SEQ ID NO: 2233234 - protein, 22 aa, Cryptosporidium parvum
KCSTLKLPARYLIRSQNNSDFS

SEQ ID NO: 2233235 - protein, 18 aa, Cryptosporidium parvum
KCTVIRSGIINIIPAYNL

SEQ ID NO: 2233236 - protein, 21 aa, Cryptosporidium parvum
KDCFTFLKQLLFYQINYSNNK

SEQ ID NO: 2233237 - protein, 17 aa, Cryptosporidium parvum
KDCMKRNLVCCGEKNSV

SEQ ID NO: 2233238 - protein, 25 aa, Cryptosporidium parvum
KDDNLISAWVFVRFLIIGLYVGIAT

SEQ ID NO: 2233239 - protein, 24 aa, Cryptosporidium parvum
KDEFCFCSCRAIPIVYTNYDYHQK

SEQ ID NO: 2233240 - protein, 20 aa, Cryptosporidium parvum
KDELKWAYLDHLITTPIGAS

SEQ ID NO: 2233241 - protein, 20 aa, Cryptosporidium parvum
KDETPCFLLSKGRFSEAEEL

SEQ ID NO: 2233242 - protein, 17 aa, Cryptosporidium parvum
KDFLPNTKWIIPTSKYR

SEQ ID NO: 2233243 - protein, 25 aa, Cryptosporidium parvum
KDFLRICIYLELFVQSILLSECVIR

SEQ ID NO: 2233244 - protein, 18 aa, Cryptosporidium parvum
KDGFELRNKCYLEEYKSF

SEQ ID NO: 2233245 - protein, 26 aa, Cryptosporidium parvum
KDGKWKLIAYRGITVSTISFWITDMG

SEQ ID NO: 2233246 - protein, 17 aa, Cryptosporidium parvum
KDGLFLLYFQKRANKLK

SEQ ID NO: 2233247 - protein, 17 aa, Cryptosporidium parvum
KDGYLDFYGDLHILLTP

SEQ ID NO: 2233248 - protein, 25 aa, Cryptosporidium parvum
KDHFILCAFNGLPLSSLSIKESLER

SEQ ID NO: 2233249 - protein, 17 aa, Cryptosporidium parvum
KDIALFYYVIHYLPIQK

SEQ ID NO: 2233250 - protein, 23 aa, Cryptosporidium parvum
KDIARLALYIVCISDFSSIIQAS

SEQ ID NO: 2233251 - protein, 19 aa, Cryptosporidium parvum
KDIFLWSFQQKGLIKIAEI

SEQ ID NO: 2233252 - protein, 25 aa, Cryptosporidium parvum
KDIIFEFGKELGMNSLSFKLIYIHK

SEQ ID NO: 2233253 - protein, 23 aa, Cryptosporidium parvum
KDIQILSSWSFFTGQHTEFKNID

SEQ ID NO: 2233254 - protein, 18 aa, Cryptosporidium parvum
KDISSSFPVGSLGRSVKF

SEQ ID NO: 2233255 - protein, 28 aa, Cryptosporidium parvum
KDIVNLGIIVWLKLIVRFQNIYMKEKNK

SEQ ID NO: 2233256 - protein, 23 aa, Cryptosporidium parvum
KDIYSCRIWILILLAVFESTGEY

SEQ ID NO: 2233257 - protein, 21 aa, Cryptosporidium parvum
KDKCLWFSASNQLDMPDSNLH

SEQ ID NO: 2233258 - protein, 20 aa, Cryptosporidium parvum
KDKILRIITAIKRGFDKKVI

SEQ ID NO: 2233259 - protein, 18 aa, Cryptosporidium parvum
KDKLGCPINCNSKITGVL

SEQ ID NO: 2233260 - protein, 19 aa, Cryptosporidium parvum
KDKRIKITPYYILSILFSL

SEQ ID NO: 2233261 - protein, 19 aa, Cryptosporidium parvum
KDLAPPDKYECVFPSINSE

SEQ ID NO: 2233262 - protein, 24 aa, Cryptosporidium parvum
KDLESSDLFGIMAPVELKPRTIEN

SEQ ID NO: 2233263 - protein, 18 aa, Cryptosporidium parvum
KDLRIMSELYRERIMVFS

SEQ ID NO: 2233264 - protein, 18 aa, Cryptosporidium parvum
KDLSDWVSILKRPNLIFL

SEQ ID NO: 2233265 - protein, 25 aa, Cryptosporidium parvum
KDLSILRFVFSYHKFFNPQNETRYP

SEQ ID NO: 2233266 - protein, 21 aa, Cryptosporidium parvum
KDLTNYLSIYRKWIYHSSSVI

SEQ ID NO: 2233267 - protein, 17 aa, Cryptosporidium parvum
KDPKISYWLIIYTVKHL

SEQ ID NO: 2233268 - protein, 22 aa, Cryptosporidium parvum
KDQETILAFPGLLNIDMVNSNY

SEQ ID NO: 2233269 - protein, 30 aa, Cryptosporidium parvum; identical to SEQ ID NO: 2174409

SEQ ID NO: 2233270 - protein, 24 aa, Cryptosporidium parvum
KDQLSEIWKIITLDSGKCPVNSLK

SEQ ID NO: 2233271 - protein, 24 aa, Cryptosporidium parvum
KDRHLLRTLTFIFLFICTTVTYFV

SEQ ID NO: 2233272 - protein, 23 aa, Cryptosporidium parvum
KDRVVELWIEMDLSGIRKGFVRN

SEQ ID NO: 2233273 - protein, 20 aa, Cryptosporidium parvum
KDSEDFLLVLVIYSKLWLNG

SEQ ID NO: 2233274 - protein, 20 aa, Cryptosporidium parvum
KDTIMYYIIFLKYVIIVTKL

SEQ ID NO: 2233275 - protein, 32 aa, Cryptosporidium parvum
KDTQPWYLQSTFIFSFVGIIFLLIAGAIAIFY

SEQ ID NO: 2233276 - protein, 19 aa, Cryptosporidium parvum
KDVKCKYCSKYSGNQFLTI

SEQ ID NO: 2233277 - protein, 25 aa, Cryptosporidium parvum
KDVLTRMKGLVAFKEQLSHLLETPD

SEQ ID NO: 2233278 - protein, 17 aa, Cryptosporidium parvum
KDVMIGYILNILLNLVI

SEQ ID NO: 2233279 - protein, 23 aa, Cryptosporidium parvum
KDWDWKNKQLIGFDGNVLQVEGK

SEQ ID NO: 2233280 - protein, 31 aa, Cryptosporidium parvum
KDYFEFPIQILFWFGYENTRLVAYKIKSQVL

SEQ ID NO: 2233281 - protein, 17 aa, Cryptosporidium parvum
KDYPNGLTLELSLTKLP

SEQ ID NO: 2233282 - protein, 23 aa, Cryptosporidium parvum
KDYSLLSVRGHPIYADVGGFLIS

SEQ ID NO: 2233283 - protein, 27 aa, Cryptosporidium parvum
KDYVWIACSFLSFLLVNYYITKWIWGS

SEQ ID NO: 2233284 - protein, 28 aa, Cryptosporidium parvum
KDYYEERRWKIYAARRLSQMVQNYWRKK

SEQ ID NO: 2233285 - protein, 17 aa, Cryptosporidium parvum
KEAIFLFAEYLLLISSI

SEQ ID NO: 2233286 - protein, 24 aa, Cryptosporidium parvum
KEAKCMKQGQFLICNMHISQYQDK

SEQ ID NO: 2233287 - protein, 24 aa, Cryptosporidium parvum
KEARHVLDIVKIRISDSILNRLLK

SEQ ID NO: 2233288 - protein, 18 aa, Cryptosporidium parvum
KEDLMKISGYAGNINLIL

SEQ ID NO: 2233289 - protein, 22 aa, Cryptosporidium parvum
KEDRNILWSSDFVLERESPFEA

SEQ ID NO: 2233290 - protein, 24 aa, Cryptosporidium parvum
KEECGTSFVMWFGEGTPAATLKCG

SEQ ID NO: 2233291 - protein, 18 aa, Cryptosporidium parvum
KEEFTWDIIISVYTHTNS

SEQ ID NO: 2233292 - protein, 20 aa, Cryptosporidium parvum
KEEGLECFDIPQTFSNIKLT

SEQ ID NO: 2233293 - protein, 19 aa, Cryptosporidium parvum
KEEMKRLPLGDYVTYNNDL

SEQ ID NO: 2233294 - protein, 22 aa, Cryptosporidium parvum
KEEMWPILKLYYSKKPLLFTLH

SEQ ID NO: 2233295 - protein, 23 aa, Cryptosporidium parvum
KEEQYIRIGLTIKFLHLTLKLIL

SEQ ID NO: 2233296 - protein, 20 aa, Cryptosporidium parvum
KEFHYCKIDRNIGPQAQILD

SEQ ID NO: 2233297 - protein, 17 aa, Cryptosporidium parvum
KEFKNSFKYRSKTQKDL

SEQ ID NO: 2233298 - protein, 21 aa, Cryptosporidium parvum
KEFMDSPIFIIWCANHIRSRL

SEQ ID NO: 2233299 - protein, 21 aa, Cryptosporidium parvum
KEFRSNGLSHFGRVDVGKIDI

SEQ ID NO: 2233300 - protein, 20 aa, Cryptosporidium parvum
KEFTNSWPLTLDHSLMESLT

SEQ ID NO: 2233301 - protein, 22 aa, Cryptosporidium parvum
KEGLHLYIFLGLAALGLVRSNL

SEQ ID NO: 2233302 - protein, 20 aa, Cryptosporidium parvum
KEGLSFDLLCELLNNMRIQL

SEQ ID NO: 2233303 - protein, 25 aa, Cryptosporidium parvum
KEHLKRRRIDVILTIATLFGTSSTL

SEQ ID NO: 2233304 - protein, 19 aa, Cryptosporidium parvum
KEIFDFEIIQGFENIQGSN

SEQ ID NO: 2233305 - protein, 25 aa, Cryptosporidium parvum
KEIFNSVIVGIEISSKISISSEFLT

SEQ ID NO: 2233306 - protein, 17 aa, Cryptosporidium parvum
KEIIRLILEGGGIPSVF

SEQ ID NO: 2233307 - protein, 19 aa, Cryptosporidium parvum
KEILINVLLHDSMVPYYDL

SEQ ID NO: 2233308 - protein, 23 aa, Cryptosporidium parvum
KEILKCLRLKIKSKIKNQDNNNN

SEQ ID NO: 2233309 - protein, 23 aa, Cryptosporidium parvum
KEIPWKSESKILIPGNNTFLNTE

SEQ ID NO: 2233310 - protein, 19 aa, Cryptosporidium parvum
KEISMCFLNLLNSIANFEN

SEQ ID NO: 2233311 - protein, 19 aa, Cryptosporidium parvum
KEISNILWDIHSISFISTT

SEQ ID NO: 2233312 - protein, 18 aa, Cryptosporidium parvum
KEITFFWTTLLLLGETDT

SEQ ID NO: 2233313 - protein, 27 aa, Cryptosporidium parvum
KEIYDEWRKLLYISFKYEDPTSTFDQC

SEQ ID NO: 2233314 - protein, 25 aa, Cryptosporidium parvum
KEKELRKPFFASFKYFKKKKNELEQ

SEQ ID NO: 2233315 - protein, 19 aa, Cryptosporidium parvum
KELLLLLRKYIRTNGSCLQ

SEQ ID NO: 2233316 - protein, 23 aa, Cryptosporidium parvum
KELTNRMNSVFSMDEAIDLLTKC

SEQ ID NO: 2233317 - protein, 21 aa, Cryptosporidium parvum
KELVPRLTPILKNRHEKVQEN

SEQ ID NO: 2233318 - protein, 22 aa, Cryptosporidium parvum
KEMELGLSYKLLSDKIVGISKM

SEQ ID NO: 2233319 - protein, 19 aa, Cryptosporidium parvum
KENAEWVFELALQGQMLVS

SEQ ID NO: 2233320 - protein, 30 aa, Cryptosporidium parvum
KENIVFKLDMEILFNMAREFWMIPLNISSR

SEQ ID NO: 2233321 - protein, 20 aa, Cryptosporidium parvum
KENRLITILVHNQILTSTSI

SEQ ID NO: 2233322 - protein, 21 aa, Cryptosporidium parvum
KEPNSGFGLIDFIGELISCWT

SEQ ID NO: 2233323 - protein, 19 aa, Cryptosporidium parvum
KEPSKVFGICKKKRILNPS

SEQ ID NO: 2233324 - protein, 24 aa, Cryptosporidium parvum
KEQLDLFFSYGLRKSSSNYNMMAD

SEQ ID NO: 2233325 - protein, 17 aa, Cryptosporidium parvum
KEQRIILNYPKSSRPYG

SEQ ID NO: 2233326 - protein, 18 aa, Cryptosporidium parvum
KEQWNFIYEYSLQSRNQK

SEQ ID NO: 2233327 - protein, 19 aa, Cryptosporidium parvum
KERLKEGGLGNFLLGLAGS

SEQ ID NO: 2233328 - protein, 18 aa, Cryptosporidium parvum
KERPCIIVNIHSGNETEI

SEQ ID NO: 2233329 - protein, 23 aa, Cryptosporidium parvum
KESELFDNLAFNFPFKSLYLMNA

SEQ ID NO: 2233330 - protein, 25 aa, Cryptosporidium parvum
KESFKCVYSPKVQGLWNIHQITQYL

SEQ ID NO: 2233331 - protein, 26 aa, Cryptosporidium parvum
KESFWSFKLPLIIKNIIFFIYWKIIK

SEQ ID NO: 2233332 - protein, 18 aa, Cryptosporidium parvum
KESHGILQASNWEQNLAS

SEQ ID NO: 2233333 - protein, 20 aa, Cryptosporidium parvum
KESHKGLIWLGASATAEFFA

SEQ ID NO: 2233334 - protein, 20 aa, Cryptosporidium parvum
KESILVFNLYFYFELNNYIC

SEQ ID NO: 2233335 - protein, 29 aa, Cryptosporidium parvum
KESIWSNLLRICDGIKFDSFVEAESEFTQ

SEQ ID NO: 2233336 - protein, 27 aa, Cryptosporidium parvum
KETLGELAERVWGRSGLILVDTSIFFS

SEQ ID NO: 2233337 - protein, 22 aa, Cryptosporidium parvum
KEVQKRFVICPLDVVVVQGKSN

SEQ ID NO: 2233338 - protein, 21 aa, Cryptosporidium parvum
KEVSNKIAFIFTGQGSQFENM

SEQ ID NO: 2233339 - protein, 17 aa, Cryptosporidium parvum
KEWFKNSILNSNKTVEI

SEQ ID NO: 2233340 - protein, 31 aa, Cryptosporidium parvum; identical to SEQ ID NO: 2124674

SEQ ID NO: 2233341 - protein, 19 aa, Cryptosporidium parvum
KEYEMYAKLLSNIDTNQGQ

SEQ ID NO: 2233342 - protein, 21 aa, Cryptosporidium parvum
KEYFNQLEFIFIELIPRSKNK

SEQ ID NO: 2233343 - protein, 19 aa, Cryptosporidium parvum
KFAILFTFGSFFFMASFAV

SEQ ID NO: 2233344 - protein, 21 aa, Cryptosporidium parvum
KFCFLYILYFFTFYFSMVVTI

SEQ ID NO: 2233345 - protein, 18 aa, Cryptosporidium parvum
KFDCSLGTIHNFHFEENN

SEQ ID NO: 2233346 - protein, 22 aa, Cryptosporidium parvum
KFFNSRLITIYILFFNIYLNKF

SEQ ID NO: 2233347 - protein, 20 aa, Cryptosporidium parvum
KFFRCSSILKSSKYDFKTGN

SEQ ID NO: 2233348 - protein, 22 aa, Cryptosporidium parvum
KFHSELLYGCLLTYGIYLVYLI

SEQ ID NO: 2233349 - protein, 30 aa, Cryptosporidium parvum; identical to SEQ ID NO: 2124679

SEQ ID NO: 2233350 - protein, 18 aa, Cryptosporidium parvum
KFIELGIFGYNWDTIPFS

SEQ ID NO: 2233351 - protein, 22 aa, Cryptosporidium parvum
KFIHPINRLFACIKNKKILNSE

SEQ ID NO: 2233352 - protein, 27 aa, Cryptosporidium parvum
KFIKEKLKIMYLIRLYTLFLDFQGKFL

SEQ ID NO: 2233353 - protein, 17 aa, Cryptosporidium parvum
KFILLSYQLTHFLLFFI

SEQ ID NO: 2233354 - protein, 18 aa, Cryptosporidium parvum
KFIRNIKLICCTTFQWQM

SEQ ID NO: 2233355 - protein, 19 aa, Cryptosporidium parvum
KFISIGLKENILFQKIMNS

SEQ ID NO: 2233356 - protein, 24 aa, Cryptosporidium parvum
KFKELKCSYDLVFKGLTDIGETLD

SEQ ID NO: 2233357 - protein, 24 aa, Cryptosporidium parvum
KFKEYRMAENLSICFEMVSLFILT

SEQ ID NO: 2233358 - protein, 18 aa, Cryptosporidium parvum
KFKIIIMGQAFRFWNALL

SEQ ID NO: 2233359 - protein, 39 aa, Cryptosporidium parvum; identical to SEQ ID NO: 2124685

SEQ ID NO: 2233360 - protein, 24 aa, Cryptosporidium parvum
KFLKLGDIYLIQSLNLVGSYLERF

SEQ ID NO: 2233361 - protein, 27 aa, Cryptosporidium parvum
KFLLESSCCPLNLIRFCDNKQLLNAAI

SEQ ID NO: 2233362 - protein, 25 aa, Cryptosporidium parvum
KFLQNRLNLLASRNLLNHYVNSNEN

SEQ ID NO: 2233363 - protein, 17 aa, Cryptosporidium parvum
KFLRSKIIREFLFPITS

SEQ ID NO: 2233364 - protein, 25 aa, Cryptosporidium parvum
KFNIWRFLLSTAILLVSIFLSHVAK

SEQ ID NO: 2233365 - protein, 20 aa, Cryptosporidium parvum
KFNVCVLNDGKVEWSGSYSD

SEQ ID NO: 2233366 - protein, 21 aa, Cryptosporidium parvum
KFQAKEFFNFFVSETSSKLNW

SEQ ID NO: 2233367 - protein, 18 aa, Cryptosporidium parvum
KFQKSNCEVFSKEFKNII

SEQ ID NO: 2233368 - protein, 25 aa, Cryptosporidium parvum
KFQVNDIYKRVCYFYSPKNTTKTPK

SEQ ID NO: 2233369 - protein, 20 aa, Cryptosporidium parvum
KFRPLGMAIGRNISLLHPRT

SEQ ID NO: 2233370 - protein, 21 aa, Cryptosporidium parvum
KFSATFARILLLWWYSIPDIR

SEQ ID NO: 2233371 - protein, 17 aa, Cryptosporidium parvum
KFSEIKGNMDFDQNDLV

SEQ ID NO: 2233372 - protein, 19 aa, Cryptosporidium parvum
KFSEREEIDIAQKESSEAS

SEQ ID NO: 2233373 - protein, 26 aa, Cryptosporidium parvum
KFSIELFKRYECSELVDLLDQESRNF

SEQ ID NO: 2233374 - protein, 19 aa, Cryptosporidium parvum
KFSIGFYAAIFVALLPTGI

SEQ ID NO: 2233375 - protein, 30 aa, Cryptosporidium parvum
KFSKAFNFIKLISILTFFIWIVISQIYEEI

SEQ ID NO: 2233376 - protein, 23 aa, Cryptosporidium parvum
KFSKIILSLGCKLNIDNLSKPDC

SEQ ID NO: 2233377 - protein, 20 aa, Cryptosporidium parvum
KFSKLDSLISRYEYLSKTKK

SEQ ID NO: 2233378 - protein, 18 aa, Cryptosporidium parvum
KFSKNCCDHSQSIDIYFS

SEQ ID NO: 2233379 - protein, 29 aa, Cryptosporidium parvum
KFSLIANYGLPGFLLLILALILTLYFLHV

SEQ ID NO: 2233380 - protein, 19 aa, Cryptosporidium parvum
KFSVKCIKGSSIEEYEYGH

SEQ ID NO: 2233381 - protein, 19 aa, Cryptosporidium parvum
KFTSFNLKQVLDCFHPKGG

SEQ ID NO: 2233382 - protein, 20 aa, Cryptosporidium parvum
KFYFEAIIIRTWILWIPIIK

SEQ ID NO: 2233383 - protein, 20 aa, Cryptosporidium parvum
KFYIEEFGIILTYHMSQIEE

SEQ ID NO: 2233384 - protein, 18 aa, Cryptosporidium parvum
KFYLFYLFIYYYYFFFFT

SEQ ID NO: 2233385 - protein, 25 aa, Cryptosporidium parvum
KFYSLRIGFKLKNELNSFIIVFCIY

SEQ ID NO: 2233386 - protein, 34 aa, Cryptosporidium parvum; identical to SEQ ID NO: 2174626

SEQ ID NO: 2233387 - protein, 22 aa, Cryptosporidium parvum
KGELKINSILLLHSGSKIRIGG

SEQ ID NO: 2233388 - protein, 18 aa, Cryptosporidium parvum
KGELVSSGSLIFRRDIQL

SEQ ID NO: 2233389 - protein, 20 aa, Cryptosporidium parvum
KGERCWKLRDPNEMSRFPTI

SEQ ID NO: 2233390 - protein, 24 aa, Cryptosporidium parvum
KGESSILIWDCNKYIIKDNTKNYS

SEQ ID NO: 2233391 - protein, 26 aa, Cryptosporidium parvum
KGFDSLEWIGPMGFLPFDNIKSILIN

SEQ ID NO: 2233392 - protein, 18 aa, Cryptosporidium parvum
KGFDSTFFTKSRNEFENA

SEQ ID NO: 2233393 - protein, 20 aa, Cryptosporidium parvum
KGFDTLWYVSFARFMLLLSS

SEQ ID NO: 2233394 - protein, 17 aa, Cryptosporidium parvum
KGFSCLAYVRIKEERFL

SEQ ID NO: 2233395 - protein, 19 aa, Cryptosporidium parvum
KGGELFDEIIHRMKFNEVD

SEQ ID NO: 2233396 - protein, 19 aa, Cryptosporidium parvum
KGGFEDWSLYGYNVSHILC

SEQ ID NO: 2233397 - protein, 23 aa, Cryptosporidium parvum
KGGWNLKAYKCIDLIEKLFEVIT

SEQ ID NO: 2233398 - protein, 20 aa, Cryptosporidium parvum
KGILDWGQEYVRNIVGEITL

SEQ ID NO: 2233399 - protein, 26 aa, Cryptosporidium parvum
KGINFKVFDYDQAFILIIKYTDLLIK

SEQ ID NO: 2233400 - protein, 22 aa, Cryptosporidium parvum
KGKCNSCIIPIHHVSTLGVFYD

SEQ ID NO: 2233401 - protein, 21 aa, Cryptosporidium parvum
KGKNIKASWSSYIRGSPYLKI

SEQ ID NO: 2233402 - protein, 25 aa, Cryptosporidium parvum
KGLLEFYLKIERIWKRSFIEDEKIR

SEQ ID NO: 2233403 - protein, 18 aa, Cryptosporidium parvum
KGLLPGFERKAPKFASVY

SEQ ID NO: 2233404 - protein, 29 aa, Cryptosporidium parvum
KGNLHSGAICSICLTVCFSPFGLYGQKCI

SEQ ID NO: 2233405 - protein, 19 aa, Cryptosporidium parvum
KGPGSIIGTCILMPDKQGS

SEQ ID NO: 2233406 - protein, 21 aa, Cryptosporidium parvum
KGPLVICFHGLLSSISSFKQL

SEQ ID NO: 2233407 - protein, 18 aa, Cryptosporidium parvum
KGQHLIKFKRPSHSYGLF

SEQ ID NO: 2233408 - protein, 19 aa, Cryptosporidium parvum
KGQKSFRVLSQVATANLFL

SEQ ID NO: 2233409 - protein, 17 aa, Cryptosporidium parvum
KGSTLLVIPHFSNNFNI

SEQ ID NO: 2233410 - protein, 21 aa, Cryptosporidium parvum
KGYRILALGSKYSCINEVNNH

SEQ ID NO: 2233411 - protein, 19 aa, Cryptosporidium parvum
KHCIIICLLNYYKYIKKTT

SEQ ID NO: 2233412 - protein, 25 aa, Cryptosporidium parvum
KHDFVFKLFYKKGYYYLDSSFTSLT

SEQ ID NO: 2233413 - protein, 27 aa, Cryptosporidium parvum
KHEDCIRLSSFLTRFISDSIEIIFEPE

SEQ ID NO: 2233414 - protein, 24 aa, Cryptosporidium parvum
KHELFGIHYLFGFNFVKSNQLFKQ

SEQ ID NO: 2233415 - protein, 17 aa, Cryptosporidium parvum
KHEPIWRIFLSQFTSLV

SEQ ID NO: 2233416 - protein, 19 aa, Cryptosporidium parvum
KHFLLFLAYVFLFCAYSLI

SEQ ID NO: 2233417 - protein, 19 aa, Cryptosporidium parvum
KHIKDWFEDRTICPMVNCK

SEQ ID NO: 2233418 - protein, 17 aa, Cryptosporidium parvum
KHIPLQHFILYILVCNA

SEQ ID NO: 2233419 - protein, 18 aa, Cryptosporidium parvum
KHKLSICIAEYNKIFDTL

SEQ ID NO: 2233420 - protein, 27 aa, Cryptosporidium parvum
KHKPILKRKFEDLKHYLEYHLYPENPQ

SEQ ID NO: 2233421 - protein, 21 aa, Cryptosporidium parvum
KHKQRISTCIVGNVPNYSVAN

SEQ ID NO: 2233422 - protein, 18 aa, Cryptosporidium parvum
KHNLVFSGSGSIIGGANQ

SEQ ID NO: 2233423 - protein, 17 aa, Cryptosporidium parvum
KHRIRIGQWSAIVHLHA

SEQ ID NO: 2233424 - protein, 24 aa, Cryptosporidium parvum
KHRLSCLRVFVQLIKKLDEKEYAL

SEQ ID NO: 2233425 - protein, 29 aa, Cryptosporidium parvum
KHRSFSNRFSLKMILQVALLGIMWSLTYY

SEQ ID NO: 2233426 - protein, 25 aa, Cryptosporidium parvum
KHSSCSSCGNAFKGRVKESQLGIGI

SEQ ID NO: 2233427 - protein, 20 aa, Cryptosporidium parvum
KHTLVMCYSEIIKLDDSILS

SEQ ID NO: 2233428 - protein, 19 aa, Cryptosporidium parvum
KHYQLSYEFALLIQNKLLK

SEQ ID NO: 2233429 - protein, 20 aa, Cryptosporidium parvum
KIAKEFIYKKIGTITQCVRA

SEQ ID NO: 2233430 - protein, 19 aa, Cryptosporidium parvum
KIASRTPILRDFLEYLSHE

SEQ ID NO: 2233431 - protein, 18 aa, Cryptosporidium parvum
KIDKRLVSEIDQLSIDSY

SEQ ID NO: 2233432 - protein, 19 aa, Cryptosporidium parvum
KIECFIKSDIFSFTILSND

SEQ ID NO: 2233433 - protein, 33 aa, Cryptosporidium parvum
KIEFTEWKCHGGFFCAAAVYIAEDYIDSIAAGD

SEQ ID NO: 2233434 - protein, 26 aa, Cryptosporidium parvum
KIEKRIDIINSLFIELTKGFPRVEIS

SEQ ID NO: 2233435 - protein, 22 aa, Cryptosporidium parvum
KIELEMFSFLPKILEFQVKDGI

SEQ ID NO: 2233436 - protein, 23 aa, Cryptosporidium parvum
KIELTFWCVFFLMLNVIISIALR

SEQ ID NO: 2233437 - protein, 17 aa, Cryptosporidium parvum
KIFHLFLIALFFPQILS

SEQ ID NO: 2233438 - protein, 22 aa, Cryptosporidium parvum
KIFPSHPALVLYASNAEFYLGY

SEQ ID NO: 2233439 - protein, 18 aa, Cryptosporidium parvum
KIFSHSLVPLLIIFDLMD

SEQ ID NO: 2233440 - protein, 24 aa, Cryptosporidium parvum
KIGAILLCGLFVYDIFWVFGTDVM

SEQ ID NO: 2233441 - protein, 23 aa, Cryptosporidium parvum
KIGEIKVSLEFNFINIFNKCFTF

SEQ ID NO: 2233442 - protein, 25 aa, Cryptosporidium parvum
KIGQSMSIAAFFGCLVILIVLVNNV

SEQ ID NO: 2233443 - protein, 17 aa, Cryptosporidium parvum
KIGRKKNKGYGWTLTII

SEQ ID NO: 2233444 - protein, 37 aa, Cryptosporidium parvum
KIHFLRCNYSLSMATKWSIAEAFVLGGISVFGVAIIA

SEQ ID NO: 2233445 - protein, 32 aa, Cryptosporidium parvum; identical to SEQ ID NO: 2124740

SEQ ID NO: 2233446 - protein, 24 aa, Cryptosporidium parvum
KIIDIVYLLPLWFDLMRLPDKILR

SEQ ID NO: 2233447 - protein, 17 aa, Cryptosporidium parvum
KIIKLGKNRVFCRTFLI

SEQ ID NO: 2233448 - protein, 25 aa, Cryptosporidium parvum
KIILFVLRISIIISNYTKHLIRYYE

SEQ ID NO: 2233449 - protein, 25 aa, Cryptosporidium parvum
KIIPVPDWMRPLLFTKSPNEALVGK

SEQ ID NO: 2233450 - protein, 18 aa, Cryptosporidium parvum
KIISEFWNNSLLAFRNKL

SEQ ID NO: 2233451 - protein, 23 aa, Cryptosporidium parvum
KIISKLRFYDGVHFYNTIGTDTT

SEQ ID NO: 2233452 - protein, 25 aa, Cryptosporidium parvum
KIISWVKELCEILGIQTDENSNMGR

SEQ ID NO: 2233453 - protein, 17 aa, Cryptosporidium parvum
KIIYRLSAKDGKILATY

SEQ ID NO: 2233454 - protein, 23 aa, Cryptosporidium parvum
KIKADCIPHFGYTIGRTLSERDL

SEQ ID NO: 2233455 - protein, 23 aa, Cryptosporidium parvum
KIKIAELCLFISLYSYYAKDEVS

SEQ ID NO: 2233456 - protein, 26 aa, Cryptosporidium parvum
KIKIDATRSTLIFTFLTEKTNKFFDC

SEQ ID NO: 2233457 - protein, 19 aa, Cryptosporidium parvum
KIKIYFKNRIKSLREKKLL

SEQ ID NO: 2233458 - protein, 24 aa, Cryptosporidium parvum
KIKLLDFILLLPLKLETIIISQDS

SEQ ID NO: 2233459 - protein, 25 aa, Cryptosporidium parvum
KIKQEIRINIKLLYATMEELESMKK

SEQ ID NO: 2233460 - protein, 19 aa, Cryptosporidium parvum
KIKSEFKWIMSGTPLPISI

SEQ ID NO: 2233461 - protein, 27 aa, Cryptosporidium parvum
KILCKKACKPFNLLSFSLPDLGQSNLD

SEQ ID NO: 2233462 - protein, 18 aa, Cryptosporidium parvum
KILIALMIATAFGSLSRI

SEQ ID NO: 2233463 - protein, 24 aa, Cryptosporidium parvum
KILIERLYRLLGLESVVLENKDLR

SEQ ID NO: 2233464 - protein, 23 aa, Cryptosporidium parvum
KILKSKGITFWDLFVKPIQKDEN

SEQ ID NO: 2233465 - protein, 17 aa, Cryptosporidium parvum
KILNFAKMILLNRSIFA

SEQ ID NO: 2233466 - protein, 18 aa, Cryptosporidium parvum
KILPAFVFNIFNYSDKLR

SEQ ID NO: 2233467 - protein, 23 aa, Cryptosporidium parvum
KILQEMYDRFKILTNCFNGTVEI

SEQ ID NO: 2233468 - protein, 18 aa, Cryptosporidium parvum
KILSCHIIPLILEQKRLS

SEQ ID NO: 2233469 - protein, 21 aa, Cryptosporidium parvum
KILTFLLCMGTSILFLSLSFM

SEQ ID NO: 2233470 - protein, 25 aa, Cryptosporidium parvum
KIMLSRLQYEIGLLQSEKYYFDSPK

SEQ ID NO: 2233471 - protein, 34 aa, Cryptosporidium parvum
KINAFPFKFPQLLYRRIISILPIMFHSSKPNYRI

SEQ ID NO: 2233472 - protein, 18 aa, Cryptosporidium parvum
KINEIWNLFLKFGPPKIS

SEQ ID NO: 2233473 - protein, 24 aa, Cryptosporidium parvum
KINLYRALLYSSFTKKPLLLTISE

SEQ ID NO: 2233474 - protein, 21 aa, Cryptosporidium parvum
KINTIWAIFRVQFLVLLLFLN

SEQ ID NO: 2233475 - protein, 27 aa, Cryptosporidium parvum
KIPELSGKLWLLWYVSFKQKDCQMRII

SEQ ID NO: 2233476 - protein, 27 aa, Cryptosporidium parvum
KIPGVLRLLVRLNMMYYYECRINTLIL

SEQ ID NO: 2233477 - protein, 23 aa, Cryptosporidium parvum
KIPPEPKFVPSILDTIRDTLAPL

SEQ ID NO: 2233478 - protein, 24 aa, Cryptosporidium parvum
KIPRIYVIFIIFIIFFSNVECLLK

SEQ ID NO: 2233479 - protein, 18 aa, Cryptosporidium parvum
KIPYNRWDSGLFFSENIN

SEQ ID NO: 2233480 - protein, 18 aa, Cryptosporidium parvum
KIPYSRGRISHFGTPIQF

SEQ ID NO: 2233481 - protein, 19 aa, Cryptosporidium parvum
KIQHCIIKSILIIIIMKIF

SEQ ID NO: 2233482 - protein, 18 aa, Cryptosporidium parvum
KIQTCLKTSIFKRLIESK

SEQ ID NO: 2233483 - protein, 20 aa, Cryptosporidium parvum
KIRISDSILNRLLKMESKKK

SEQ ID NO: 2233484 - protein, 24 aa, Cryptosporidium parvum
KIRKCKELLQLIAAIRQDVLGDFP

SEQ ID NO: 2233485 - protein, 18 aa, Cryptosporidium parvum
KIRLSVSGSVVFSSITLT

SEQ ID NO: 2233486 - protein, 20 aa, Cryptosporidium parvum
KIRNTELFIGPLSFFQTNTK

SEQ ID NO: 2233487 - protein, 17 aa, Cryptosporidium parvum
KIRRILYFILIHILIFN

SEQ ID NO: 2233488 - protein, 24 aa, Cryptosporidium parvum
KIRTFPFNTLSSFSYLKEISETRT

SEQ ID NO: 2233489 - protein, 17 aa, Cryptosporidium parvum
KIRWVPKSKGLRPLINL

SEQ ID NO: 2233490 - protein, 30 aa, Cryptosporidium parvum
KISANAIRISMRILLLFLFALIFSISSING

SEQ ID NO: 2233491 - protein, 18 aa, Cryptosporidium parvum
KISDLMRSLDIFIFKTII

SEQ ID NO: 2233492 - protein, 19 aa, Cryptosporidium parvum
KISDSFLTMRAVKILNYVE

SEQ ID NO: 2233493 - protein, 27 aa, Cryptosporidium parvum
KISGILKFLSIVICELISGSILQQYFR

SEQ ID NO: 2233494 - protein, 17 aa, Cryptosporidium parvum
KISIYQKNCQSIASNVL

SEQ ID NO: 2233495 - protein, 38 aa, Cryptosporidium parvum
KISMELTPLFLLKISIFCWYFFEKLERWLSTFDQVILI

SEQ ID NO: 2233496 - protein, 19 aa, Cryptosporidium parvum
KISMIKMKSGILVGILFAA

SEQ ID NO: 2233497 - protein, 29 aa, Cryptosporidium parvum
KISQQRGYIRLSIKQGFLGSAINNLVQYS

SEQ ID NO: 2233498 - protein, 27 aa, Cryptosporidium parvum
KITAIYGNECPAWFNITSFSPTENIED

SEQ ID NO: 2233499 - protein, 18 aa, Cryptosporidium parvum
KITCRTDFILLWKNTNNK

SEQ ID NO: 2233500 - protein, 18 aa, Cryptosporidium parvum
KITFLKKLFSRISNDDVN

SEQ ID NO: 2233501 - protein, 20 aa, Cryptosporidium parvum
KITFNDCLDGKKITLLKATG

SEQ ID NO: 2233502 - protein, 23 aa, Cryptosporidium parvum
KIVEILLFVLFEIHIPKQIYSCK

SEQ ID NO: 2233503 - protein, 18 aa, Cryptosporidium parvum
KIVEPFRLFSTITLTPYI

SEQ ID NO: 2233504 - protein, 21 aa, Cryptosporidium parvum
KIVFDEFVNFFLINLTKHEPY

SEQ ID NO: 2233505 - protein, 21 aa, Cryptosporidium parvum
KIVRACSVALGFVMYSRGGEE

SEQ ID NO: 2233506 - protein, 29 aa, Cryptosporidium parvum
KIVTCYKVNLLVALLICFLLCNTVLTSNS

SEQ ID NO: 2233507 - protein, 17 aa, Cryptosporidium parvum
KIYELFNNIYLTFEKCS

SEQ ID NO: 2233508 - protein, 17 aa, Cryptosporidium parvum
KIYGRICGTAVNQDGKS

SEQ ID NO: 2233509 - protein, 23 aa, Cryptosporidium parvum
KIYKNKTEIFGIIEIDSLNREID

SEQ ID NO: 2233510 - protein, 19 aa, Cryptosporidium parvum
KIYLTYSIFIWYIFLNALI

SEQ ID NO: 2233511 - protein, 24 aa, Cryptosporidium parvum
KIYVWYNFGVNFITSYNCKRGIFT

SEQ ID NO: 2233512 - protein, 24 aa, Cryptosporidium parvum
KKAGCAPWRGAILNNYIDQILSTW

SEQ ID NO: 2233513 - protein, 23 aa, Cryptosporidium parvum
KKALDMASRLGISHSLLSNIERR

SEQ ID NO: 2233514 - protein, 21 aa, Cryptosporidium parvum
KKALQDFNRGLSLNITKVPKM

SEQ ID NO: 2233515 - protein, 18 aa, Cryptosporidium parvum
KKAMRERIRENKKRKLKV

SEQ ID NO: 2233516 - protein, 24 aa, Cryptosporidium parvum
KKAPVRRCGRNCLCFETNQGDFTS

SEQ ID NO: 2233517 - protein, 20 aa, Cryptosporidium parvum
KKDRFTLFMQRIQERNISII

SEQ ID NO: 2233518 - protein, 23 aa, Cryptosporidium parvum
KKEGILGLSGRIFLSRLIQELFK

SEQ ID NO: 2233519 - protein, 21 aa, Cryptosporidium parvum
KKEGLFNFLFLFQKLNGRPTE

SEQ ID NO: 2233520 - protein, 35 aa, Cryptosporidium parvum
KKESIALNWNSWYFFPEQIIDLSLVKIQDFLILDK

SEQ ID NO: 2233521 - protein, 19 aa, Cryptosporidium parvum
KKETIKFTDIILREYISTI

SEQ ID NO: 2233522 - protein, 23 aa, Cryptosporidium parvum
KKFIFELISLIGYQKNKELSNIT

SEQ ID NO: 2233523 - protein, 21 aa, Cryptosporidium parvum
KKFSENGIILWNDLKKCILNL

SEQ ID NO: 2233524 - protein, 21 aa, Cryptosporidium parvum
KKFSKRMSIGGRFRRDKKIGN

SEQ ID NO: 2233525 - protein, 35 aa, Cryptosporidium parvum
KKFSLGWNLWLGITISCIVLIWTAIYASRLLNIAH

SEQ ID NO: 2233526 - protein, 19 aa, Cryptosporidium parvum
KKGLTRRALSLLQPSRPTS

SEQ ID NO: 2233527 - protein, 22 aa, Cryptosporidium parvum
KKGQRYGFLEAMQYFNPKYVGI

SEQ ID NO: 2233528 - protein, 18 aa, Cryptosporidium parvum
KKGVLVGGVNYKIGEMDD

SEQ ID NO: 2233529 - protein, 23 aa, Cryptosporidium parvum
KKIFLSWTGFIFVLREIIEKAIF

SEQ ID NO: 2233530 - protein, 17 aa, Cryptosporidium parvum
KKIFQKISFFWVTPYFC

SEQ ID NO: 2233531 - protein, 25 aa, Cryptosporidium parvum
KKIKCNKIQISFIMIYLIFEFNEYF

SEQ ID NO: 2233532 - protein, 25 aa, Cryptosporidium parvum
KKILPRFYRYLGLYYSLICISRMKR

SEQ ID NO: 2233533 - protein, 31 aa, Cryptosporidium parvum; identical to SEQ ID NO: 2124786

SEQ ID NO: 2233534 - protein, 25 aa, Cryptosporidium parvum
KKIVSSLRFKLDYIMNQLEIKSEMS

SEQ ID NO: 2233535 - protein, 25 aa, Cryptosporidium parvum
KKIWKPPETFLRNTTKYWVHPNNVV

SEQ ID NO: 2233536 - protein, 19 aa, Cryptosporidium parvum
KKKKLFGFSGNLFKSKSSP

SEQ ID NO: 2233537 - protein, 21 aa, Cryptosporidium parvum
KKKLGESILSFSSHSELVKFL

SEQ ID NO: 2233538 - protein, 19 aa, Cryptosporidium parvum
KKKSYYGSITIQLTRRLQS

SEQ ID NO: 2233539 - protein, 25 aa, Cryptosporidium parvum
KKKYQNWLAVQFVKQYSALFYLDDQ

SEQ ID NO: 2233540 - protein, 23 aa, Cryptosporidium parvum
KKLFPTFLRLSLSPVNFDISESP

SEQ ID NO: 2233541 - protein, 17 aa, Cryptosporidium parvum
KKLFPTFSSRFGWRRVE

SEQ ID NO: 2233542 - protein, 18 aa, Cryptosporidium parvum
KKLGIMFEKHYVPGKLYL

SEQ ID NO: 2233543 - protein, 20 aa, Cryptosporidium parvum
KKLKEVIQSHGFLKEDHEDL

SEQ ID NO: 2233544 - protein, 19 aa, Cryptosporidium parvum
KKLKLHLMLEKKVLLVLYM

SEQ ID NO: 2233545 - protein, 19 aa, Cryptosporidium parvum
KKLLNRIDCHTNLFDITNG

SEQ ID NO: 2233546 - protein, 18 aa, Cryptosporidium parvum
KKLLQGMFELDLINSQTL

SEQ ID NO: 2233547 - protein, 21 aa, Cryptosporidium parvum
KKLLWTFRILSGILLLFYFVI

SEQ ID NO: 2233548 - protein, 20 aa, Cryptosporidium parvum
KKLQKWKKYTGMVLEKYLYL

SEQ ID NO: 2233549 - protein, 22 aa, Cryptosporidium parvum
KKLQPLFPVFGIILGISKNDQS

SEQ ID NO: 2233550 - protein, 30 aa, Cryptosporidium parvum
KKLSKLIVFSERFEAIILCKLLIKKFNSEK

SEQ ID NO: 2233551 - protein, 21 aa, Cryptosporidium parvum
KKLTILIHLFIIYFLVIYNNE

SEQ ID NO: 2233552 - protein, 20 aa, Cryptosporidium parvum
KKLWIIEQMDTFSSQEDIPF

SEQ ID NO: 2233553 - protein, 19 aa, Cryptosporidium parvum
KKLYLLILLHSVDISNPLM

SEQ ID NO: 2233554 - protein, 23 aa, Cryptosporidium parvum
KKMNLKLIIYLSNVFEYRNNQQS

SEQ ID NO: 2233555 - protein, 22 aa, Cryptosporidium parvum
KKNCICNYCRITSLRRYLYLHT

SEQ ID NO: 2233556 - protein, 24 aa, Cryptosporidium parvum
KKNLKEWFIYLFNALYDFIIYQLP

SEQ ID NO: 2233557 - protein, 29 aa, Cryptosporidium parvum
KKNSILYKWGIEYDKPYLIALPHIFKDSD

SEQ ID NO: 2233558 - protein, 18 aa, Cryptosporidium parvum
KKNYKRLKKVLKLQRKKK

SEQ ID NO: 2233559 - protein, 17 aa, Cryptosporidium parvum
KKQIKFPVFVSCAQQLV

SEQ ID NO: 2233560 - protein, 21 aa, Cryptosporidium parvum
KKRFLLMRNYEGWQCLICKRI

SEQ ID NO: 2233561 - protein, 21 aa, Cryptosporidium parvum
KKRHPGTKWPLAINTTLQKRQ

SEQ ID NO: 2233562 - protein, 18 aa, Cryptosporidium parvum
KKRMLIEILEEMPCESAV

SEQ ID NO: 2233563 - protein, 28 aa, Cryptosporidium parvum
KKRSQLKKVISYIIQLFLNLVVDSIVAL

SEQ ID NO: 2233564 - protein, 22 aa, Cryptosporidium parvum
KKSFKGKSVSILELLCYQNFSF

SEQ ID NO: 2233565 - protein, 20 aa, Cryptosporidium parvum
KKSILAFSIIVALNIWFSNA

SEQ ID NO: 2233566 - protein, 24 aa, Cryptosporidium parvum
KKSKGIVIKQIFGIVKLFSSFIDN

SEQ ID NO: 2233567 - protein, 22 aa, Cryptosporidium parvum
KKSLRFNCLDLYIQYKLFTESK

SEQ ID NO: 2233568 - protein, 20 aa, Cryptosporidium parvum
KKSLYIEIDFGKFANKKEDF

SEQ ID NO: 2233569 - protein, 32 aa, Cryptosporidium parvum
KKSTIRIEAYWWLIDRISCCSRFYSTRPGNFR

SEQ ID NO: 2233570 - protein, 22 aa, Cryptosporidium parvum
KKTDQGWWLLALILNVVDLISI

SEQ ID NO: 2233571 - protein, 18 aa, Cryptosporidium parvum
KKTNLSISLLDILFDHFK

SEQ ID NO: 2233572 - protein, 17 aa, Cryptosporidium parvum
KKTRRSLKLVFGSKLIF

SEQ ID NO: 2233573 - protein, 21 aa, Cryptosporidium parvum
KKTSLKYSLKIMLGSVLAVLL

SEQ ID NO: 2233574 - protein, 18 aa, Cryptosporidium parvum
KKTYYGICLIINILLLVY

SEQ ID NO: 2233575 - protein, 19 aa, Cryptosporidium parvum
KKVEYLKSIGIKFVSSSRD

SEQ ID NO: 2233576 - protein, 18 aa, Cryptosporidium parvum
KKVFSIAVGNVIFKQSFD

SEQ ID NO: 2233577 - protein, 27 aa, Cryptosporidium parvum
KKVGFFEVWLLLSLWKRYPARIYRHMM

SEQ ID NO: 2233578 - protein, 22 aa, Cryptosporidium parvum
KKVIDRCFLLAFVELIKILVEG

SEQ ID NO: 2233579 - protein, 25 aa, Cryptosporidium parvum
KKVKRFKLTRGKRVLFIGYQKSPVS

SEQ ID NO: 2233580 - protein, 24 aa, Cryptosporidium parvum
KKVLKLVYELSYFALPKDTLNIRK

SEQ ID NO: 2233581 - protein, 17 aa, Cryptosporidium parvum
KKVLKTFKIFSLIIGDY

SEQ ID NO: 2233582 - protein, 21 aa, Cryptosporidium parvum
KKWLEEFIHNCVINNKKIIHS

SEQ ID NO: 2233583 - protein, 21 aa, Cryptosporidium parvum
KKYEWGNEISQWVDLESSNYN

SEQ ID NO: 2233584 - protein, 18 aa, Cryptosporidium parvum
KKYKSLIINHSFNDQDYE

SEQ ID NO: 2233585 - protein, 19 aa, Cryptosporidium parvum
KKYLDYTFRLRWYGENEGS

SEQ ID NO: 2233586 - protein, 52 aa, Cryptosporidium parvum; identical to SEQ ID NO: 2124815

SEQ ID NO: 2233587 - protein, 18 aa, Cryptosporidium parvum
KKYVIKMDPLRQVILKNE

SEQ ID NO: 2233588 - protein, 23 aa, Cryptosporidium parvum
KLAFKLTSLLPFVKRGSIQKLFD

SEQ ID NO: 2233589 - protein, 27 aa, Cryptosporidium parvum
KLCGKEPILRFDFLVSQLMSSSSQNDI

SEQ ID NO: 2233590 - protein, 28 aa, Cryptosporidium parvum
KLCGLEADISYSRGRFVINVQSYSSNFE

SEQ ID NO: 2233591 - protein, 24 aa, Cryptosporidium parvum
KLDFFVKHLLEYILINQTLNIKKK

SEQ ID NO: 2233592 - protein, 22 aa, Cryptosporidium parvum
KLDIEASCGLLRGKTKIDHILN

SEQ ID NO: 2233593 - protein, 19 aa, Cryptosporidium parvum
KLDQAICVWEKYHSTVNSC

SEQ ID NO: 2233594 - protein, 21 aa, Cryptosporidium parvum
KLDTVDCIKLHKGANDNVQTK

SEQ ID NO: 2233595 - protein, 22 aa, Cryptosporidium parvum
KLEDLRIGEYVLIRDLNTMKFK

SEQ ID NO: 2233596 - protein, 24 aa, Cryptosporidium parvum
KLEKFLMKACFSIIECLLPFIPLS

SEQ ID NO: 2233597 - protein, 18 aa, Cryptosporidium parvum
KLEYKKEAHIIFMFRQYY

SEQ ID NO: 2233598 - protein, 19 aa, Cryptosporidium parvum
KLFEFLHAGIPFGAIGAFM

SEQ ID NO: 2233599 - protein, 24 aa, Cryptosporidium parvum
KLFISAIIYSCFGTFLTAKLGMNI

SEQ ID NO: 2233600 - protein, 17 aa, Cryptosporidium parvum
KLFKILNDFNIPILQEN

SEQ ID NO: 2233601 - protein, 19 aa, Cryptosporidium parvum
KLFNIIIKPWCIEILSLLM

SEQ ID NO: 2233602 - protein, 18 aa, Cryptosporidium parvum
KLFPKYKALLIKQIIAKE

SEQ ID NO: 2233603 - protein, 20 aa, Cryptosporidium parvum
KLFSIYKCFLSISYQFSECL

SEQ ID NO: 2233604 - protein, 17 aa, Cryptosporidium parvum
KLFSRISNDDVNLISTL

SEQ ID NO: 2233605 - protein, 26 aa, Cryptosporidium parvum
KLFVLICSPYCSYKLLSSERIFEIWE

SEQ ID NO: 2233606 - protein, 24 aa, Cryptosporidium parvum
KLFYLPGKLLLTIGNHYFVIDESN

SEQ ID NO: 2233607 - protein, 29 aa, Cryptosporidium parvum
KLFYQVYRPSILIFGIFLYLFVSNSNQAN

SEQ ID NO: 2233608 - protein, 18 aa, Cryptosporidium parvum
KLGCIMVSGSCQINQQDL

SEQ ID NO: 2233609 - protein, 17 aa, Cryptosporidium parvum
KLGIIVRIHASKYVSED

SEQ ID NO: 2233610 - protein, 20 aa, Cryptosporidium parvum
KLGLLNSIKACFLINKVSEF

SEQ ID NO: 2233611 - protein, 25 aa, Cryptosporidium parvum
KLGMVGYNFFYRDISLELQLNGSIA

SEQ ID NO: 2233612 - protein, 19 aa, Cryptosporidium parvum
KLGPFSHLWFHRTTFANPK

SEQ ID NO: 2233613 - protein, 24 aa, Cryptosporidium parvum
KLHILMDIEFVYYFFIRLKNKQMI

SEQ ID NO: 2233614 - protein, 19 aa, Cryptosporidium parvum
KLIAEISCNSRNSNSSSYS

SEQ ID NO: 2233615 - protein, 29 aa, Cryptosporidium parvum
KLIKSFIGRLFINICSFDDAKSYYSAMIY

SEQ ID NO: 2233616 - protein, 25 aa, Cryptosporidium parvum
KLILELIRINLEFGIYGINQYNYDL

SEQ ID NO: 2233617 - protein, 19 aa, Cryptosporidium parvum
KLILTLSFAPLFVTCLYDS

SEQ ID NO: 2233618 - protein, 22 aa, Cryptosporidium parvum
KLINWIDGILLYAMKNGDWVIL

SEQ ID NO: 2233619 - protein, 26 aa, Cryptosporidium parvum
KLINYWLGICPIELIIHEVFLIQNII

SEQ ID NO: 2233620 - protein, 26 aa, Cryptosporidium parvum
KLIPLITEFIEFIFSSHEAITLMDDR

SEQ ID NO: 2233621 - protein, 19 aa, Cryptosporidium parvum
KLIQIEWLYIIIMCKSLGM

SEQ ID NO: 2233622 - protein, 18 aa, Cryptosporidium parvum
KLIQIFRFTLKISSNGIE

SEQ ID NO: 2233623 - protein, 19 aa, Cryptosporidium parvum
KLIVKRSVDNMSILFKILD

SEQ ID NO: 2233624 - protein, 18 aa, Cryptosporidium parvum
KLIYKATKYIFIYMIFAL

SEQ ID NO: 2233625 - protein, 21 aa, Cryptosporidium parvum
KLKFIKFKIENEIPGNSPINK

SEQ ID NO: 2233626 - protein, 18 aa, Cryptosporidium parvum
KLKFILYESKCICFILNG

SEQ ID NO: 2233627 - protein, 19 aa, Cryptosporidium parvum
KLKKIPCCHLCRSPIEIAW

SEQ ID NO: 2233628 - protein, 24 aa, Cryptosporidium parvum
KLKKKINILFERLFSNDGISHIYL

SEQ ID NO: 2233629 - protein, 23 aa, Cryptosporidium parvum
KLKKKTPLSWVWNNQIYDQKSES

SEQ ID NO: 2233630 - protein, 28 aa, Cryptosporidium parvum
KLKLMIEKRVCLLDIALIQKHLLASSSN

SEQ ID NO: 2233631 - protein, 24 aa, Cryptosporidium parvum
KLLEANVIRFWNRILAKELKNVAN

SEQ ID NO: 2233632 - protein, 17 aa, Cryptosporidium parvum
KLLECIQSSELIPRVES

SEQ ID NO: 2233633 - protein, 17 aa, Cryptosporidium parvum
KLLEPKITLYDIPEPTK

SEQ ID NO: 2233634 - protein, 18 aa, Cryptosporidium parvum
KLLIRFIPFHLFSITGMT

SEQ ID NO: 2233635 - protein, 19 aa, Cryptosporidium parvum
KLLKEMLVLVSPDQLAHSK

SEQ ID NO: 2233636 - protein, 17 aa, Cryptosporidium parvum
KLLLLLKKDIHFLILGI

SEQ ID NO: 2233637 - protein, 34 aa, Cryptosporidium parvum
KLLNLYIELGFKFSRMPLQLVIEPLRVEQAHREL

SEQ ID NO: 2233638 - protein, 17 aa, Cryptosporidium parvum
KLLNYLRSFMQKSKIIQ

SEQ ID NO: 2233639 - protein, 18 aa, Cryptosporidium parvum
KLLPNDWYQWLIMHQEIS

SEQ ID NO: 2233640 - protein, 17 aa, Cryptosporidium parvum
KLLQISIAFSNSLSNYL

SEQ ID NO: 2233641 - protein, 23 aa, Cryptosporidium parvum
KLLRAEEMYILLFAFYYSIYQTL

SEQ ID NO: 2233642 - protein, 19 aa, Cryptosporidium parvum
KLLRSSAISVFYVTSISLS

SEQ ID NO: 2233643 - protein, 23 aa, Cryptosporidium parvum
KLLSQPITIAWGISKCLSLAENA

SEQ ID NO: 2233644 - protein, 18 aa, Cryptosporidium parvum
KLLTHYKLITSIKLQAEA

SEQ ID NO: 2233645 - protein, 20 aa, Cryptosporidium parvum
KLLVEFIFLIILLISKEIPC

SEQ ID NO: 2233646 - protein, 17 aa, Cryptosporidium parvum
KLMKFFRPIEMNYFGDN

SEQ ID NO: 2233647 - protein, 24 aa, Cryptosporidium parvum
KLNAELMTKLLFFSIKEIMVGLHI

SEQ ID NO: 2233648 - protein, 23 aa, Cryptosporidium parvum
KLNFCTFEFMLSPTLIGVPNTRV

SEQ ID NO: 2233649 - protein, 22 aa, Cryptosporidium parvum
KLNFKSRINNVTFQNHIREENQ

SEQ ID NO: 2233650 - protein, 24 aa, Cryptosporidium parvum
KLNHCMGEALLAKYMGKKKLIAET

SEQ ID NO: 2233651 - protein, 18 aa, Cryptosporidium parvum
KLNIIFISSIIFTFKLKF

SEQ ID NO: 2233652 - protein, 19 aa, Cryptosporidium parvum
KLNKEIFLKFLADQIEILK

SEQ ID NO: 2233653 - protein, 23 aa, Cryptosporidium parvum
KLNKSAFYFVRFNLLLHLAAIVI

SEQ ID NO: 2233654 - protein, 20 aa, Cryptosporidium parvum
KLNLYSYIRWLKTSLQKAYY

SEQ ID NO: 2233655 - protein, 23 aa, Cryptosporidium parvum
KLNVRPILFLWIFFLISMVYTFS

SEQ ID NO: 2233656 - protein, 18 aa, Cryptosporidium parvum
KLPGIPSLQKSSIVKALN

SEQ ID NO: 2233657 - protein, 18 aa, Cryptosporidium parvum
KLPLSVKVFPAIFIITSG

SEQ ID NO: 2233658 - protein, 18 aa, Cryptosporidium parvum
KLPLTIIVIAHRLSSVRN

SEQ ID NO: 2233659 - protein, 18 aa, Cryptosporidium parvum
KLPLYWENIEELVISGII

SEQ ID NO: 2233660 - protein, 28 aa, Cryptosporidium parvum
KLQCDQWKLYPCEVVPFSKIEEWYENKA

SEQ ID NO: 2233661 - protein, 25 aa, Cryptosporidium parvum
KLQRKWGLDFCYELGDSNGEECRVK

SEQ ID NO: 2233662 - protein, 25 aa, Cryptosporidium parvum
KLQVSDMWYQWILDIINKSDLLGLM

SEQ ID NO: 2233663 - protein, 19 aa, Cryptosporidium parvum
KLRLILKNYQRKKCNERNK

SEQ ID NO: 2233664 - protein, 21 aa, Cryptosporidium parvum
KLRNFYSVFLINGLDVKVPEL

SEQ ID NO: 2233665 - protein, 17 aa, Cryptosporidium parvum
KLRPHIVEGLRMIPNQN

SEQ ID NO: 2233666 - protein, 26 aa, Cryptosporidium parvum
KLSFPESICYIWNIKGHNALGEIQDP

SEQ ID NO: 2233667 - protein, 21 aa, Cryptosporidium parvum
KLSIRGGVGGLNLVKDLAIGV

SEQ ID NO: 2233668 - protein, 18 aa, Cryptosporidium parvum
KLSKVIKLNELKKMKETD

SEQ ID NO: 2233669 - protein, 27 aa, Cryptosporidium parvum
KLSLEFLKQVCGLKWIKDISALHPREQ

SEQ ID NO: 2233670 - protein, 18 aa, Cryptosporidium parvum
KLSPKILKEEKFDEDMIN

SEQ ID NO: 2233671 - protein, 22 aa, Cryptosporidium parvum
KLSRHPSLRGKFVMEDNTNLNL

SEQ ID NO: 2233672 - protein, 23 aa, Cryptosporidium parvum
KLTISPLYLLGMNLKGKNITELS

SEQ ID NO: 2233673 - protein, 19 aa, Cryptosporidium parvum
KLTLFKLLIFVSLLVAIYV

SEQ ID NO: 2233674 - protein, 19 aa, Cryptosporidium parvum
KLTPLLKVTNSLPFPIQIR

SEQ ID NO: 2233675 - protein, 18 aa, Cryptosporidium parvum
KLTSKKIRSLIEKIYQFQ

SEQ ID NO: 2233676 - protein, 26 aa, Cryptosporidium parvum
KLTYQYFLNWFKKIYKNSNLFMLAVQ

SEQ ID NO: 2233677 - protein, 26 aa, Cryptosporidium parvum
KLVCQDFINFILLWLRFGEIPLEGKI

SEQ ID NO: 2233678 - protein, 17 aa, Cryptosporidium parvum
KLVEKIINYESYNEYIV

SEQ ID NO: 2233679 - protein, 20 aa, Cryptosporidium parvum
KLVLGTLCWMWIDKERTKLE

SEQ ID NO: 2233680 - protein, 18 aa, Cryptosporidium parvum
KLYCWFIIHKKFDRYSHG

SEQ ID NO: 2233681 - protein, 19 aa, Cryptosporidium parvum
KLYIERSVMESLNLDIPPK

SEQ ID NO: 2233682 - protein, 18 aa, Cryptosporidium parvum
KLYLQLGNYIGRKDENIY

SEQ ID NO: 2233683 - protein, 26 aa, Cryptosporidium parvum
KLYSEFHKKKCLGYALISFSDIKEKP

SEQ ID NO: 2233684 - protein, 21 aa, Cryptosporidium parvum
KLYYVEGGQWGELSMLLDRSF

SEQ ID NO: 2233685 - protein, 24 aa, Cryptosporidium parvum
KMASCILNGRIGRISVDDTISNAL

SEQ ID NO: 2233686 - protein, 19 aa, Cryptosporidium parvum
KMEICSFTPKAMAHIFWSF

SEQ ID NO: 2233687 - protein, 20 aa, Cryptosporidium parvum
KMHFKHFWINFLSNYFNFRN

SEQ ID NO: 2233688 - protein, 18 aa, Cryptosporidium parvum
KMIDGIRINKQRALLTTS

SEQ ID NO: 2233689 - protein, 21 aa, Cryptosporidium parvum
KMIKVIILSLIDVYSQDQIQN

SEQ ID NO: 2233690 - protein, 18 aa, Cryptosporidium parvum
KMILPIIFPENILMNNSQ

SEQ ID NO: 2233691 - protein, 22 aa, Cryptosporidium parvum
KMIYTKLGICYNGRSDTSTNVT

SEQ ID NO: 2233692 - protein, 26 aa, Cryptosporidium parvum
KMKSGEKIIRKQVHILERLAWELTGF

SEQ ID NO: 2233693 - protein, 23 aa, Cryptosporidium parvum
KMLEIARIGSIFFDNNNDSILLV

SEQ ID NO: 2233694 - protein, 19 aa, Cryptosporidium parvum
KMLFLMVLWIKHYLSNKVE

SEQ ID NO: 2233695 - protein, 20 aa, Cryptosporidium parvum
KMMICGVAGRVFGISCLLII

SEQ ID NO: 2233696 - protein, 17 aa, Cryptosporidium parvum
KMNELKLIISLDSLDIL

SEQ ID NO: 2233697 - protein, 19 aa, Cryptosporidium parvum
KMSISRDLLIEKFHLSLFP

SEQ ID NO: 2233698 - protein, 23 aa, Cryptosporidium parvum
KMVPRIISLIDMDAFFAQVCHVE

SEQ ID NO: 2233699 - protein, 25 aa, Cryptosporidium parvum
KMYIDFPIRNFWKIAKTPIDMESPQ

SEQ ID NO: 2233700 - protein, 24 aa, Cryptosporidium parvum
KNANFLLKHPFILLKAKRPNSLGI

SEQ ID NO: 2233701 - protein, 24 aa, Cryptosporidium parvum
KNCSFMNKKIRDMTFALPLTDHIG

SEQ ID NO: 2233702 - protein, 35 aa, Cryptosporidium parvum; identical to SEQ ID NO: 2124877

SEQ ID NO: 2233703 - protein, 19 aa, Cryptosporidium parvum
KNDCLERLLKFSIISILWI

SEQ ID NO: 2233704 - protein, 23 aa, Cryptosporidium parvum
KNDEIREVFNFENLQILIQNIIK

SEQ ID NO: 2233705 - protein, 18 aa, Cryptosporidium parvum
KNDKCISFEWLLKQSTLF

SEQ ID NO: 2233706 - protein, 21 aa, Cryptosporidium parvum
KNDRIRNLFCTKIGINDIHEG

SEQ ID NO: 2233707 - protein, 21 aa, Cryptosporidium parvum
KNDVFCLAMVFLSLSLIYEPK

SEQ ID NO: 2233708 - protein, 26 aa, Cryptosporidium parvum
KNEFFKFMVHFIFSLIIFQIVNNINM

SEQ ID NO: 2233709 - protein, 18 aa, Cryptosporidium parvum
KNEIKDEYDFLISPHHLL

SEQ ID NO: 2233710 - protein, 18 aa, Cryptosporidium parvum
KNELIDFSPVFHILFERL

SEQ ID NO: 2233711 - protein, 23 aa, Cryptosporidium parvum
KNELTLLGLIGFLDPPRPGVEKA

SEQ ID NO: 2233712 - protein, 27 aa, Cryptosporidium parvum
KNERKSIKILYSWCETFEHIKEEYESE

SEQ ID NO: 2233713 - protein, 18 aa, Cryptosporidium parvum
KNEYLSIIIDYLYSNIFE

SEQ ID NO: 2233714 - protein, 18 aa, Cryptosporidium parvum
KNFIGFTLLSIIVSCDIW

SEQ ID NO: 2233715 - protein, 17 aa, Cryptosporidium parvum
KNFKEILQLLINILLVI

SEQ ID NO: 2233716 - protein, 23 aa, Cryptosporidium parvum
KNFKLNRKLIIFFEGRRIKGNKI

SEQ ID NO: 2233717 - protein, 22 aa, Cryptosporidium parvum
KNFKSHIASTIFKELSKDFNRT

SEQ ID NO: 2233718 - protein, 18 aa, Cryptosporidium parvum
KNFMRLTNEFSFNTISEL

SEQ ID NO: 2233719 - protein, 24 aa, Cryptosporidium parvum
KNFNFCRSFPLFFYPLSIIMQNKM

SEQ ID NO: 2233720 - protein, 29 aa, Cryptosporidium parvum
KNFPVRLSFKILACFPFCSSSKRMGILLE

SEQ ID NO: 2233721 - protein, 18 aa, Cryptosporidium parvum
KNGHPVGPFKTRECRSGS

SEQ ID NO: 2233722 - protein, 17 aa, Cryptosporidium parvum
KNGPRLLSNNLHESIYI

SEQ ID NO: 2233723 - protein, 18 aa, Cryptosporidium parvum
KNGPRSGMLGGPIQHSAE

SEQ ID NO: 2233724 - protein, 17 aa, Cryptosporidium parvum
KNHFSIFSLFNKHKLQL

SEQ ID NO: 2233725 - protein, 18 aa, Cryptosporidium parvum
KNICLLASEIIRRNGVSY

SEQ ID NO: 2233726 - protein, 19 aa, Cryptosporidium parvum
KNIKGELNANVSSQSEEEE

SEQ ID NO: 2233727 - protein, 43 aa, Cryptosporidium parvum
KNILKYTRKAFLNTLPYSVFRLRDFAEIFPVSASGKVIDSVLL

SEQ ID NO: 2233728 - protein, 17 aa, Cryptosporidium parvum
KNIPLTNLITWLVIEII

SEQ ID NO: 2233729 - protein, 23 aa, Cryptosporidium parvum
KNISSTFCLPSFINYYRNKVKSK

SEQ ID NO: 2233730 - protein, 24 aa, Cryptosporidium parvum
KNKDEYFVEFSLIFENFYIHLLVN

SEQ ID NO: 2233731 - protein, 22 aa, Cryptosporidium parvum
KNKDKIVEFLIHFQTSRTDPQF

SEQ ID NO: 2233732 - protein, 17 aa, Cryptosporidium parvum
KNKEFTNSWPLTLDHSL

SEQ ID NO: 2233733 - protein, 17 aa, Cryptosporidium parvum
KNKEKFNIWRFLLSTAI

SEQ ID NO: 2233734 - protein, 20 aa, Cryptosporidium parvum
KNKELCLILIRFNPAENNVC

SEQ ID NO: 2233735 - protein, 23 aa, Cryptosporidium parvum
KNKFESLLYCLSDSNFFYNINKE

SEQ ID NO: 2233736 - protein, 19 aa, Cryptosporidium parvum
KNKLMDIGRFCDIFEKIHI

SEQ ID NO: 2233737 - protein, 27 aa, Cryptosporidium parvum
KNKLSYFYSREEFYVYQAIFNYSISLI

SEQ ID NO: 2233738 - protein, 18 aa, Cryptosporidium parvum
KNKSWKILLKKPLGDKFQ

SEQ ID NO: 2233739 - protein, 25 aa, Cryptosporidium parvum
KNLDLLRYAYIKGTEYRTKSSEYIM

SEQ ID NO: 2233740 - protein, 23 aa, Cryptosporidium parvum
KNLEDRLLWSFTIPEFKIKLPSL

SEQ ID NO: 2233741 - protein, 31 aa, Cryptosporidium parvum; identical to SEQ ID NO: 2124892

SEQ ID NO: 2233742 - protein, 17 aa, Cryptosporidium parvum
KNLFPQIEFEEEKEINK

SEQ ID NO: 2233743 - protein, 23 aa, Cryptosporidium parvum
KNLFRFKIFVVTLLYISRSIIET

SEQ ID NO: 2233744 - protein, 25 aa, Cryptosporidium parvum
KNLGRIIFYLGLRFIKNEKVRAELT

SEQ ID NO: 2233745 - protein, 18 aa, Cryptosporidium parvum
KNLHDWYYIVSDIDTYES

SEQ ID NO: 2233746 - protein, 18 aa, Cryptosporidium parvum
KNLIDVVVGIAFDSEFSH

SEQ ID NO: 2233747 - protein, 17 aa, Cryptosporidium parvum
KNLPLILEEEFTLSQFQ

SEQ ID NO: 2233748 - protein, 27 aa, Cryptosporidium parvum
KNLQSSFGFVEGMGIPTSVSRTSTSRG

SEQ ID NO: 2233749 - protein, 22 aa, Cryptosporidium parvum
KNLRITTRIRKGSVSGWSEFNK

SEQ ID NO: 2233750 - protein, 17 aa, Cryptosporidium parvum
KNMIKDYLLLMTHQLYQ

SEQ ID NO: 2233751 - protein, 29 aa, Cryptosporidium parvum
KNNELKHLFKIPMNYLPYIPKDTGESDEK

SEQ ID NO: 2233752 - protein, 33 aa, Cryptosporidium parvum; identical to SEQ ID NO: 2124896

SEQ ID NO: 2233753 - protein, 23 aa, Cryptosporidium parvum
KNNNLRVLGNWIHEFEDFEDVIR

SEQ ID NO: 2233754 - protein, 26 aa, Cryptosporidium parvum
KNPHIWLKVISKYRIAATAAPNFAFD

SEQ ID NO: 2233755 - protein, 20 aa, Cryptosporidium parvum
KNPLKKFLEKIKKKRNLGLT

SEQ ID NO: 2233756 - protein, 18 aa, Cryptosporidium parvum
KNPSLKHVISFKSENDKQ

SEQ ID NO: 2233757 - protein, 27 aa, Cryptosporidium parvum
KNQKIEIPFDFIADFPNMMVFKDTNSI

SEQ ID NO: 2233758 - protein, 22 aa, Cryptosporidium parvum
KNQVEMKLCFGLLEKTYSETFK

SEQ ID NO: 2233759 - protein, 19 aa, Cryptosporidium parvum
KNRGLGFGMIQLSSCVGRV

SEQ ID NO: 2233760 - protein, 19 aa, Cryptosporidium parvum
KNRIILGSMTDYLYTELLE

SEQ ID NO: 2233761 - protein, 26 aa, Cryptosporidium parvum
KNRLFKIRLNTIIGEFYSPLLNGTRI

SEQ ID NO: 2233762 - protein, 22 aa, Cryptosporidium parvum
KNRNHFWLPLLQVYGRSIVNVL

SEQ ID NO: 2233763 - protein, 35 aa, Cryptosporidium parvum
KNRYCFSSLKYKYGLKLYWIRKVSKTLKFLKLTNQ

SEQ ID NO: 2233764 - protein, 23 aa, Cryptosporidium parvum
KNSDDICCGINFNGNNLGNDLNY

SEQ ID NO: 2233765 - protein, 20 aa, Cryptosporidium parvum
KNSDQLFGHMIERWDQPIFT

SEQ ID NO: 2233766 - protein, 30 aa, Cryptosporidium parvum
KNSIYNLFLLRVLDLKSWLSQYRKQYIEET

SEQ ID NO: 2233767 - protein, 25 aa, Cryptosporidium parvum
KNSKGQSCGPLLFAGASFALEASLS

SEQ ID NO: 2233768 - protein, 18 aa, Cryptosporidium parvum
KNSLKRKKCQNFHANDNS

SEQ ID NO: 2233769 - protein, 26 aa, Cryptosporidium parvum
KNSMLRLSRFKLFSCIESLLDGKLKM

SEQ ID NO: 2233770 - protein, 22 aa, Cryptosporidium parvum
KNSRWFVFGKPMGIDIPEGKQQ

SEQ ID NO: 2233771 - protein, 20 aa, Cryptosporidium parvum
KNSYFLALNILTSFTIFQNQ

SEQ ID NO: 2233772 - protein, 19 aa, Cryptosporidium parvum
KNTKIRVHYNFSKDSFLVN

SEQ ID NO: 2233773 - protein, 18 aa, Cryptosporidium parvum
KNVYNFLLSIGVKKIVMK

SEQ ID NO: 2233774 - protein, 21 aa, Cryptosporidium parvum
KNWQPRRLVISSNVYYRTRPL

SEQ ID NO: 2233775 - protein, 18 aa, Cryptosporidium parvum
KNYCKLSKVIKLNELKKM

SEQ ID NO: 2233776 - protein, 24 aa, Cryptosporidium parvum
KNYNTTCLKEIVIMIKLAENNLTA

SEQ ID NO: 2233777 - protein, 17 aa, Cryptosporidium parvum
KNYRHFFLLLFFVTMLL

SEQ ID NO: 2233778 - protein, 20 aa, Cryptosporidium parvum
KNYSALFCNLNMKKLYEKIE

SEQ ID NO: 2233779 - protein, 19 aa, Cryptosporidium parvum
KPFLSRIVSVLIQDVRLKF

SEQ ID NO: 2233780 - protein, 17 aa, Cryptosporidium parvum
KPFQNWRSFTYITLIWV

SEQ ID NO: 2233781 - protein, 18 aa, Cryptosporidium parvum
KPHILDPLIYNSKKLINK

SEQ ID NO: 2233782 - protein, 20 aa, Cryptosporidium parvum
KPIFDMSSGYTFNVLASIVI

SEQ ID NO: 2233783 - protein, 18 aa, Cryptosporidium parvum
KPIVARCYILSARGLLPP

SEQ ID NO: 2233784 - protein, 20 aa, Cryptosporidium parvum
KPIYKLCIVGAGPSGCYLAK

SEQ ID NO: 2233785 - protein, 18 aa, Cryptosporidium parvum
KPKCEPHDSAFIQFTSGS

SEQ ID NO: 2233786 - protein, 18 aa, Cryptosporidium parvum
KPKHKKKKLFGFSGNLFK

SEQ ID NO: 2233787 - protein, 24 aa, Cryptosporidium parvum
KPKHRLKSKFPIRRNKDKNTNINH

SEQ ID NO: 2233788 - protein, 22 aa, Cryptosporidium parvum
KPKLQLCICRILTMIPVYAIIS

SEQ ID NO: 2233789 - protein, 20 aa, Cryptosporidium parvum
KPLFHSYIRISANEMLRYSS

SEQ ID NO: 2233790 - protein, 25 aa, Cryptosporidium parvum
KPLKSELYVALGFGFYSHALLNLLS

SEQ ID NO: 2233791 - protein, 19 aa, Cryptosporidium parvum
KPLLGREWIQREKSKKQTS

SEQ ID NO: 2233792 - protein, 21 aa, Cryptosporidium parvum
KPLLWRLVLIHDLNKCIQVVG

SEQ ID NO: 2233793 - protein, 20 aa, Cryptosporidium parvum
KPLTHICGGWNLGKFERILL

SEQ ID NO: 2233794 - protein, 22 aa, Cryptosporidium parvum
KPRFLPNLMMTIIFSTCTDLLT

SEQ ID NO: 2233795 - protein, 18 aa, Cryptosporidium parvum
KPRIGLAVVSILFSILAL

SEQ ID NO: 2233796 - protein, 19 aa, Cryptosporidium parvum
KPRYDRIVGNISIDPRPYG

SEQ ID NO: 2233797 - protein, 43 aa, Cryptosporidium parvum
KQATISGSRSCGWKQGYSIDSSTGFRVDSITGLPTDPYSNCPF

SEQ ID NO: 2233798 - protein, 18 aa, Cryptosporidium parvum
KQFSVIIRDFLKNYTCNK

SEQ ID NO: 2233799 - protein, 26 aa, Cryptosporidium parvum
KQGITGSIKMVWGLCYEYFISNGSNE

SEQ ID NO: 2233800 - protein, 23 aa, Cryptosporidium parvum
KQGSVALPNFQSGALGCPVSASI

SEQ ID NO: 2233801 - protein, 21 aa, Cryptosporidium parvum
KQICELFIFHMYRNLGGFILR

SEQ ID NO: 2233802 - protein, 28 aa, Cryptosporidium parvum
KQIDSLFSLKHSFLWPHNNATLISAISM

SEQ ID NO: 2233803 - protein, 19 aa, Cryptosporidium parvum
KQIDWYSVKFYLKLKQIEC

SEQ ID NO: 2233804 - protein, 19 aa, Cryptosporidium parvum
KQIIMQMIILFKNLVSVLI

SEQ ID NO: 2233805 - protein, 24 aa, Cryptosporidium parvum
KQKDYFIIWGCNYLSQISTYLSIP

SEQ ID NO: 2233806 - protein, 24 aa, Cryptosporidium parvum
KQKVIERLMLYFIIFVLLLANIYV

SEQ ID NO: 2233807 - protein, 17 aa, Cryptosporidium parvum
KQLDPFKGTFAMLSHNI

SEQ ID NO: 2233808 - protein, 19 aa, Cryptosporidium parvum
KQLFPGMGFIQYVQTSYMT

SEQ ID NO: 2233809 - protein, 18 aa, Cryptosporidium parvum
KQLISMLVLFCVYLTGRS

SEQ ID NO: 2233810 - protein, 19 aa, Cryptosporidium parvum
KQLKCHIFSDILFDKDTGE

SEQ ID NO: 2233811 - protein, 18 aa, Cryptosporidium parvum
KQLMEFVEQFIFTYGKLK

SEQ ID NO: 2233812 - protein, 21 aa, Cryptosporidium parvum
KQMDIWKCTAWDLKNGDSNNT

SEQ ID NO: 2233813 - protein, 19 aa, Cryptosporidium parvum
KQNCNVHSLLNSKSIRNRQ

SEQ ID NO: 2233814 - protein, 26 aa, Cryptosporidium parvum
KQNELLIRLIIYFKIIIEEKLDIYFE

SEQ ID NO: 2233815 - protein, 23 aa, Cryptosporidium parvum
KQNLESILSLPLRVTLQELDIED

SEQ ID NO: 2233816 - protein, 26 aa, Cryptosporidium parvum
KQPVYECIKLIITKFLLLILVSIVGG

SEQ ID NO: 2233817 - protein, 27 aa, Cryptosporidium parvum
KQRLGFARMLIKKSPIWILDEPTSALD

SEQ ID NO: 2233818 - protein, 23 aa, Cryptosporidium parvum
KQSPCYYLFFSVKAIKASIATET

SEQ ID NO: 2233819 - protein, 26 aa, Cryptosporidium parvum
KQVSEILIELSVNFILFLTSLLAWIF

SEQ ID NO: 2233820 - protein, 23 aa, Cryptosporidium parvum
KQWRVNLIFKSFLFYFKSKITSG

SEQ ID NO: 2233821 - protein, 27 aa, Cryptosporidium parvum
KQYPDSLWKKSPLKTWVHSVEKTRYCT

SEQ ID NO: 2233822 - protein, 21 aa, Cryptosporidium parvum
KRCNATLVYKFSKFQHGMAIL

SEQ ID NO: 2233823 - protein, 26 aa, Cryptosporidium parvum
KREDCSWSDLMVLNFFLTAFKGLAML

SEQ ID NO: 2233824 - protein, 21 aa, Cryptosporidium parvum
KRFKGPKWNALAYHFKSALSY

SEQ ID NO: 2233825 - protein, 19 aa, Cryptosporidium parvum
KRFKIVVRPLNGRDLTVEA

SEQ ID NO: 2233826 - protein, 29 aa, Cryptosporidium parvum
KRFRNLLEASFCRLPIRMLIHSANISTHY

SEQ ID NO: 2233827 - protein, 21 aa, Cryptosporidium parvum
KRGEMEIEISILPLSLAESSP

SEQ ID NO: 2233828 - protein, 20 aa, Cryptosporidium parvum
KRGGLPCLSVLRLLPPNLLG

SEQ ID NO: 2233829 - protein, 20 aa, Cryptosporidium parvum
KRGHPHFGQMWNFTKLDDEF

SEQ ID NO: 2233830 - protein, 24 aa, Cryptosporidium parvum
KRGKKAYFRIFFNIVLKGKPLYTI

SEQ ID NO: 2233831 - protein, 27 aa, Cryptosporidium parvum
KRGWKLILHRFIWEYKLSRAINRITFT

SEQ ID NO: 2233832 - protein, 25 aa, Cryptosporidium parvum
KRHISALKAGHWYFLIFTTLIASIV

SEQ ID NO: 2233833 - protein, 22 aa, Cryptosporidium parvum
KRHKRCFKNAGKEIYIIPIITL

SEQ ID NO: 2233834 - protein, 21 aa, Cryptosporidium parvum
KRIHKLNSFSHIEFDLNTAPI

SEQ ID NO: 2233835 - protein, 17 aa, Cryptosporidium parvum
KRILDEFNIEMKNLSEF

SEQ ID NO: 2233836 - protein, 21 aa, Cryptosporidium parvum
KRILKAKNFYDTLGVPKDADD

SEQ ID NO: 2233837 - protein, 23 aa, Cryptosporidium parvum
KRILSKNQSCFIINKKLIDERTL

SEQ ID NO: 2233838 - protein, 17 aa, Cryptosporidium parvum
KRILSPKFGEFNNGNQI

SEQ ID NO: 2233839 - protein, 23 aa, Cryptosporidium parvum
KRIRLGSLENLYAIGFDSENNTF

SEQ ID NO: 2233840 - protein, 22 aa, Cryptosporidium parvum
KRKIPGWSALILLISFIFSVLC

SEQ ID NO: 2233841 - protein, 19 aa, Cryptosporidium parvum
KRKIPVIYKIKSFFKLIFC

SEQ ID NO: 2233842 - protein, 20 aa, Cryptosporidium parvum
KRKISLVDFDRLVERFYNDE

SEQ ID NO: 2233843 - protein, 18 aa, Cryptosporidium parvum
KRKLSFKSKKKITPSYIN

SEQ ID NO: 2233844 - protein, 20 aa, Cryptosporidium parvum
KRKQENWDYLNALNDASDNL

SEQ ID NO: 2233845 - protein, 25 aa, Cryptosporidium parvum
KRKTPRKRIIPIFIKNRTPRKASNN

SEQ ID NO: 2233846 - protein, 20 aa, Cryptosporidium parvum
KRKVQSITIVSKIILARIDL

SEQ ID NO: 2233847 - protein, 20 aa, Cryptosporidium parvum
KRKVTVREVIAFSISTVGII

SEQ ID NO: 2233848 - protein, 18 aa, Cryptosporidium parvum
KRKYLSIFRGGSISGNNY

SEQ ID NO: 2233849 - protein, 23 aa, Cryptosporidium parvum
KRLARLDLLRVFDSTLKYVSNKS

SEQ ID NO: 2233850 - protein, 22 aa, Cryptosporidium parvum
KRLFSSLIEQCCRYIIRNLRTM

SEQ ID NO: 2233851 - protein, 21 aa, Cryptosporidium parvum
KRLGLYVLMGSVLYILAIKNK

SEQ ID NO: 2233852 - protein, 20 aa, Cryptosporidium parvum
KRLKGFENMKERSYCENAFD

SEQ ID NO: 2233853 - protein, 22 aa, Cryptosporidium parvum
KRLNSNISKLAFIVKKMTRGGR

SEQ ID NO: 2233854 - protein, 17 aa, Cryptosporidium parvum
KRLRDLGKISNEEDEED

SEQ ID NO: 2233855 - protein, 20 aa, Cryptosporidium parvum
KRLTFPSNLPIKQFFFCFFI

SEQ ID NO: 2233856 - protein, 38 aa, Cryptosporidium parvum; identical to SEQ ID NO: 2124954

SEQ ID NO: 2233857 - protein, 21 aa, Cryptosporidium parvum
KRLWLSGFSEIFSFCSSYFSQ

SEQ ID NO: 2233858 - protein, 29 aa, Cryptosporidium parvum
KRLYRYKYAVFVAFCFCMNISLNNMCLKD

SEQ ID NO: 2233859 - protein, 21 aa, Cryptosporidium parvum
KRMPYLNLLGLLIINSSFILR

SEQ ID NO: 2233860 - protein, 25 aa, Cryptosporidium parvum
KRQRSVISLPRKGDCPVLEESRDCL

SEQ ID NO: 2233861 - protein, 17 aa, Cryptosporidium parvum
KRRLFEIDSSTRGNKMV

SEQ ID NO: 2233862 - protein, 20 aa, Cryptosporidium parvum
KRSAEIQVGSVFDIFPVLYP

SEQ ID NO: 2233863 - protein, 23 aa, Cryptosporidium parvum
KRSDLYGPFWLNITMAMLIGTYS

SEQ ID NO: 2233864 - protein, 19 aa, Cryptosporidium parvum
KRSLIPNIPTFVLNDREYI

SEQ ID NO: 2233865 - protein, 19 aa, Cryptosporidium parvum
KRSLLSVLLMKLALMNYYD

SEQ ID NO: 2233866 - protein, 23 aa, Cryptosporidium parvum
KRTYFPIVLVSGIAYIATQILNK

SEQ ID NO: 2233867 - protein, 32 aa, Cryptosporidium parvum
KRWFEEDPRYTLECLKLLILNKSLFCNRELPE

SEQ ID NO: 2233868 - protein, 19 aa, Cryptosporidium parvum
KRYFLHLEIPSIEKELQDL

SEQ ID NO: 2233869 - protein, 19 aa, Cryptosporidium parvum
KRYLLDFLISHVPINQQTS

SEQ ID NO: 2233870 - protein, 17 aa, Cryptosporidium parvum
KSAFSYMLSRLLYSFAN

SEQ ID NO: 2233871 - protein, 22 aa, Cryptosporidium parvum
KSANRLSTMFILSNVIEDIPFE

SEQ ID NO: 2233872 - protein, 24 aa, Cryptosporidium parvum
KSCGRKWNKFIVFINFISFLSIIT

SEQ ID NO: 2233873 - protein, 22 aa, Cryptosporidium parvum
KSDHEFASFVVGIISQIIQYSP

SEQ ID NO: 2233874 - protein, 19 aa, Cryptosporidium parvum
KSDYSFGAYERFTTYQNST

SEQ ID NO: 2233875 - protein, 22 aa, Cryptosporidium parvum
KSEIDLGIDQSRIFLIGFSQGS

SEQ ID NO: 2233876 - protein, 21 aa, Cryptosporidium parvum
KSEIEFPMIIFVLSTTGQGEV

SEQ ID NO: 2233877 - protein, 21 aa, Cryptosporidium parvum
KSEILNLSDLMAYDVATDVAQ

SEQ ID NO: 2233878 - protein, 22 aa, Cryptosporidium parvum
KSELHWPIGEKIPLDLSGDLDQ

SEQ ID NO: 2233879 - protein, 18 aa, Cryptosporidium parvum
KSESIPFDFSEFQLEIIS

SEQ ID NO: 2233880 - protein, 18 aa, Cryptosporidium parvum
KSEVDWPAERGMELEPDG

SEQ ID NO: 2233881 - protein, 21 aa, Cryptosporidium parvum
KSEYCPLFIFDDIFSNLDHFV

SEQ ID NO: 2233882 - protein, 25 aa, Cryptosporidium parvum
KSFCFTFLVLFYLCVYLYLYEEKIV

SEQ ID NO: 2233883 - protein, 17 aa, Cryptosporidium parvum
KSFFDNILLLKAGKTAE

SEQ ID NO: 2233884 - protein, 25 aa, Cryptosporidium parvum
KSFKGKFVDIYFCVGIGNHNNFHGN

SEQ ID NO: 2233885 - protein, 22 aa, Cryptosporidium parvum
KSFNEWSQYHILQLIFQNLSNI

SEQ ID NO: 2233886 - protein, 18 aa, Cryptosporidium parvum
KSFNNGFTLFNIQQPFES

SEQ ID NO: 2233887 - protein, 25 aa, Cryptosporidium parvum
KSFSFERLDYVLAHCKSNLTICSGN

SEQ ID NO: 2233888 - protein, 18 aa, Cryptosporidium parvum
KSFSTILPYKPIKDLSER

SEQ ID NO: 2233889 - protein, 19 aa, Cryptosporidium parvum
KSGDLHSGELVQLNGDVDL

SEQ ID NO: 2233890 - protein, 17 aa, Cryptosporidium parvum
KSGEIIFLESYQQLNYT

SEQ ID NO: 2233891 - protein, 22 aa, Cryptosporidium parvum
KSGLLPILIGISGWLRNNDDIF

SEQ ID NO: 2233892 - protein, 25 aa, Cryptosporidium parvum
KSGLLYWISMHFSWGKTFRTENNST

SEQ ID NO: 2233893 - protein, 17 aa, Cryptosporidium parvum
KSGRGPVDYLLTGTASI

SEQ ID NO: 2233894 - protein, 19 aa, Cryptosporidium parvum
KSGWCLFHSFFQVVSKDWL

SEQ ID NO: 2233895 - protein, 18 aa, Cryptosporidium parvum
KSHWGVFWYILPIILILF

SEQ ID NO: 2233896 - protein, 31 aa, Cryptosporidium parvum
KSIDHINMFWVSRFPIMGKYTCNTRSDDCMI

SEQ ID NO: 2233897 - protein, 25 aa, Cryptosporidium parvum
KSIDSFRPKSCFPCDKYLELKCMTY

SEQ ID NO: 2233898 - protein, 27 aa, Cryptosporidium parvum
KSIELFLFRKVFEFMNLILEYNFQEFF

SEQ ID NO: 2233899 - protein, 17 aa, Cryptosporidium parvum
KSIGCKFDSSRVKSKQN

SEQ ID NO: 2233900 - protein, 20 aa, Cryptosporidium parvum
KSIILCLCMELVVSISNKNY

SEQ ID NO: 2233901 - protein, 25 aa, Cryptosporidium parvum
KSIISNRISYVFGLKGPSITIDAAC

SEQ ID NO: 2233902 - protein, 30 aa, Cryptosporidium parvum; identical to SEQ ID NO: 2124986

SEQ ID NO: 2233903 - protein, 26 aa, Cryptosporidium parvum
KSILRLVVPVLLRILMIKRISFNKTF

SEQ ID NO: 2233904 - protein, 21 aa, Cryptosporidium parvum
KSINFKPLILLSQFLTSSHAI

SEQ ID NO: 2233905 - protein, 17 aa, Cryptosporidium parvum
KSIPPWNESCRRGHPKI

SEQ ID NO: 2233906 - protein, 30 aa, Cryptosporidium parvum
KSIRTILDYGIKPWFLFSVSSVNSIRLMHK

SEQ ID NO: 2233907 - protein, 27 aa, Cryptosporidium parvum
KSITLPFLCFPLSIFIMNNVIKIKSDE

SEQ ID NO: 2233908 - protein, 20 aa, Cryptosporidium parvum
KSIYPSWYYFLVAFYNLIGR

SEQ ID NO: 2233909 - protein, 18 aa, Cryptosporidium parvum
KSKAKLCNWANYKDFTQK

SEQ ID NO: 2233910 - protein, 22 aa, Cryptosporidium parvum
KSKARKVGFGFSDFDSSIKQNS

SEQ ID NO: 2233911 - protein, 23 aa, Cryptosporidium parvum
KSKFKRHRMIRILKSDWDKFYSG

SEQ ID NO: 2233912 - protein, 21 aa, Cryptosporidium parvum
KSKIFEFLDVISLPNEISLLS

SEQ ID NO: 2233913 - protein, 21 aa, Cryptosporidium parvum
KSKIGISLSFFGKRKPSKSTK

SEQ ID NO: 2233914 - protein, 21 aa, Cryptosporidium parvum
KSKTLLLYSIVEYIFEEYITD

SEQ ID NO: 2233915 - protein, 17 aa, Cryptosporidium parvum
KSLGFKDFVNFVREALE

SEQ ID NO: 2233916 - protein, 24 aa, Cryptosporidium parvum
KSLISILFGPKWVRPENIQLFSAN

SEQ ID NO: 2233917 - protein, 18 aa, Cryptosporidium parvum
KSLLFPFSIFSILSSEHI

SEQ ID NO: 2233918 - protein, 18 aa, Cryptosporidium parvum
KSLLGNWIVGDKPGEFKW

SEQ ID NO: 2233919 - protein, 17 aa, Cryptosporidium parvum
KSLSLTGSFGFGWLSKG

SEQ ID NO: 2233920 - protein, 20 aa, Cryptosporidium parvum
KSLWKEKNFLSVSLEKSEFI

SEQ ID NO: 2233921 - protein, 20 aa, Cryptosporidium parvum
KSLYSRFLVINDIGNTFELV

SEQ ID NO: 2233922 - protein, 18 aa, Cryptosporidium parvum
KSMIDFIILRSIFGNGLL

SEQ ID NO: 2233923 - protein, 19 aa, Cryptosporidium parvum
KSMKIWKIDHELRITNIGS

SEQ ID NO: 2233924 - protein, 20 aa, Cryptosporidium parvum
KSMNKLGVFEVHIVTHLCRT

SEQ ID NO: 2233925 - protein, 17 aa, Cryptosporidium parvum
KSNCLEEKVSQYFTVYK

SEQ ID NO: 2233926 - protein, 26 aa, Cryptosporidium parvum
KSNEDLELWNLLGYKNAPKGLGVMFS

SEQ ID NO: 2233927 - protein, 19 aa, Cryptosporidium parvum
KSNESSCFDHLLIEDVGVL

SEQ ID NO: 2233928 - protein, 17 aa, Cryptosporidium parvum
KSNIKDVHFMEMDHFIY

SEQ ID NO: 2233929 - protein, 21 aa, Cryptosporidium parvum
KSNLKGLFHGVLCHVVCLSRL

SEQ ID NO: 2233930 - protein, 18 aa, Cryptosporidium parvum
KSNQLFSYELCYFEALNM

SEQ ID NO: 2233931 - protein, 18 aa, Cryptosporidium parvum
KSNSMAFAGEIVGKFKCN

SEQ ID NO: 2233932 - protein, 23 aa, Cryptosporidium parvum
KSNTCSFASFTFSKDIAVSRIFS

SEQ ID NO: 2233933 - protein, 23 aa, Cryptosporidium parvum
KSPEIRLSNFLKLNHYSTEIQYQ

SEQ ID NO: 2233934 - protein, 17 aa, Cryptosporidium parvum
KSPIAYASQIPWIPNGS

SEQ ID NO: 2233935 - protein, 17 aa, Cryptosporidium parvum
KSPIPKYSSELFDFEKD

SEQ ID NO: 2233936 - protein, 21 aa, Cryptosporidium parvum
KSPRFLLNQNHLFSNESLKSE

SEQ ID NO: 2233937 - protein, 27 aa, Cryptosporidium parvum
KSQMIKDRHFLGAYTIFGSLLTALLLL

SEQ ID NO: 2233938 - protein, 20 aa, Cryptosporidium parvum
KSQVGFLNFVCLPLFQELCY

SEQ ID NO: 2233939 - protein, 32 aa, Cryptosporidium parvum
KSRLLEALLEVIPYEFLVIWINSHTISKEQYD

SEQ ID NO: 2233940 - protein, 21 aa, Cryptosporidium parvum
KSRRNFTWRFSFITILIHQII

SEQ ID NO: 2233941 - protein, 23 aa, Cryptosporidium parvum
KSRSTSYTNMWFKGYMHSFKQVF

SEQ ID NO: 2233942 - protein, 20 aa, Cryptosporidium parvum
KSSAKFLYERLIQALKLPSP

SEQ ID NO: 2233943 - protein, 19 aa, Cryptosporidium parvum
KSSCNAPPPSGFILKDKHL

SEQ ID NO: 2233944 - protein, 18 aa, Cryptosporidium parvum
KSSDPFYWVRVILASNRG

SEQ ID NO: 2233945 - protein, 20 aa, Cryptosporidium parvum
KSSFPISVDMVRDATQKMIQ

SEQ ID NO: 2233946 - protein, 21 aa, Cryptosporidium parvum
KSSFTSDVIKDFIQQIVSVSV

SEQ ID NO: 2233947 - protein, 17 aa, Cryptosporidium parvum
KSSINLPAYFPCSDSNL

SEQ ID NO: 2233948 - protein, 19 aa, Cryptosporidium parvum
KSSKFKYWILVAIILIGQV

SEQ ID NO: 2233949 - protein, 19 aa, Cryptosporidium parvum
KSSLFSAILRLFDPSFGAI

SEQ ID NO: 2233950 - protein, 25 aa, Cryptosporidium parvum
KSSLQRIEFIKSYFWSELKNLSISI

SEQ ID NO: 2233951 - protein, 22 aa, Cryptosporidium parvum
KSSRFSLSIMHLLGDLKVFDST

SEQ ID NO: 2233952 - protein, 17 aa, Cryptosporidium parvum
KSSRLSKRNNWKITANN

SEQ ID NO: 2233953 - protein, 29 aa, Cryptosporidium parvum
KSTKLYFYRELKFTLQRLISNWNNNLNTI

SEQ ID NO: 2233954 - protein, 17 aa, Cryptosporidium parvum
KSTLKWLEMFYFEPNMA

SEQ ID NO: 2233955 - protein, 20 aa, Cryptosporidium parvum
KSTWKISVERLTNKQCIILG

SEQ ID NO: 2233956 - protein, 26 aa, Cryptosporidium parvum
KSVDHLPWRFLVYKALNTFIDDIFSF

SEQ ID NO: 2233957 - protein, 22 aa, Cryptosporidium parvum
KSVKATEYFYVIQKCIKILLEK

SEQ ID NO: 2233958 - protein, 20 aa, Cryptosporidium parvum
KSVPIMLGISLIPISHNISK

SEQ ID NO: 2233959 - protein, 24 aa, Cryptosporidium parvum
KSVVNKIVISWSFIDNKNVEITDF

SEQ ID NO: 2233960 - protein, 20 aa, Cryptosporidium parvum
KSYFLRQKMLLLTTGILEYI

SEQ ID NO: 2233961 - protein, 25 aa, Cryptosporidium parvum
KSYIGWRNVEFFEYLASILRFLEVF

SEQ ID NO: 2233962 - protein, 23 aa, Cryptosporidium parvum
KSYKECINMLIEFYYLNRKLILF

SEQ ID NO: 2233963 - protein, 25 aa, Cryptosporidium parvum
KSYKLPIKFPLAMHKINIENFGLRF

SEQ ID NO: 2233964 - protein, 18 aa, Cryptosporidium parvum
KSYQLWMEVEILIKNTTS

SEQ ID NO: 2233965 - protein, 18 aa, Cryptosporidium parvum
KSYREYLDGIYLGYFYTW

SEQ ID NO: 2233966 - protein, 17 aa, Cryptosporidium parvum
KSYSCIFHLKIILNAIN

SEQ ID NO: 2233967 - protein, 23 aa, Cryptosporidium parvum
KSYSDKWLRRKWVDVKYTTLLSF

SEQ ID NO: 2233968 - protein, 25 aa, Cryptosporidium parvum
KSYYKTASLFSFGGIACSELLKKAY

SEQ ID NO: 2233969 - protein, 19 aa, Cryptosporidium parvum
KTACSYIKNLLMKIVPVRN

SEQ ID NO: 2233970 - protein, 24 aa, Cryptosporidium parvum
KTAKQCQERWNFLNRDEIDGSSIE

SEQ ID NO: 2233971 - protein, 21 aa, Cryptosporidium parvum
KTCVAEYAIAMALKSNQRVVY

SEQ ID NO: 2233972 - protein, 20 aa, Cryptosporidium parvum
KTDYLWDEMIDFINNNKKSK

SEQ ID NO: 2233973 - protein, 25 aa, Cryptosporidium parvum
KTFWNEFIFCLALKALMVVLTTYLN

SEQ ID NO: 2233974 - protein, 21 aa, Cryptosporidium parvum
KTGNSLTRYGLRVVKHKDPNL

SEQ ID NO: 2233975 - protein, 23 aa, Cryptosporidium parvum
KTGRFLPKLLSPIIAAYNEFEER

SEQ ID NO: 2233976 - protein, 27 aa, Cryptosporidium parvum
KTIFRILLKRSIHVDKFWSSVPSESQY

SEQ ID NO: 2233977 - protein, 20 aa, Cryptosporidium parvum
KTIMLFFRKIIGIFFLINLI

SEQ ID NO: 2233978 - protein, 20 aa, Cryptosporidium parvum
KTIVRVAGGWVRDKILRFIY

SEQ ID NO: 2233979 - protein, 24 aa, Cryptosporidium parvum
KTKEKIRLIFVWFKSINRQVKYPI

SEQ ID NO: 2233980 - protein, 25 aa, Cryptosporidium parvum
KTKKLFIERFWLLNPFHFSINISND

SEQ ID NO: 2233981 - protein, 22 aa, Cryptosporidium parvum
KTKLHAIAVLLLFIRLLEISLF

SEQ ID NO: 2233982 - protein, 17 aa, Cryptosporidium parvum
KTLETICDHFSTKSNSA

SEQ ID NO: 2233983 - protein, 26 aa, Cryptosporidium parvum
KTLGPPPIRRIYDLKISLNKFSINLI

SEQ ID NO: 2233984 - protein, 24 aa, Cryptosporidium parvum
KTLLRAAEYLALIHGFSRIVVISG

SEQ ID NO: 2233985 - protein, 17 aa, Cryptosporidium parvum
KTLTCPKGFIRCALSQP

SEQ ID NO: 2233986 - protein, 25 aa, Cryptosporidium parvum
KTMDIRYIFKYGYGEFFEIDFRNFS

SEQ ID NO: 2233987 - protein, 17 aa, Cryptosporidium parvum
KTNFEKMFTCSLFGFGM

SEQ ID NO: 2233988 - protein, 19 aa, Cryptosporidium parvum
KTNRLPRQIPRQKWYNSQK

SEQ ID NO: 2233989 - protein, 34 aa, Cryptosporidium parvum; identical to SEQ ID NO: 2125053

SEQ ID NO: 2233990 - protein, 18 aa, Cryptosporidium parvum
KTQNIACMCMGNTLGGGL

SEQ ID NO: 2233991 - protein, 26 aa, Cryptosporidium parvum
KTRECRSGSGFICLKLGFCRTEANLT

SEQ ID NO: 2233992 - protein, 23 aa, Cryptosporidium parvum
KTRTKGTGWARKGGGGGGVGKKL

SEQ ID NO: 2233993 - protein, 20 aa, Cryptosporidium parvum
KTSLFIVTFILNYVNINTSK

SEQ ID NO: 2233994 - protein, 19 aa, Cryptosporidium parvum
KTSSFDGLVAFFKTFSDIH

SEQ ID NO: 2233995 - protein, 19 aa, Cryptosporidium parvum
KTTPEVFIRAFKFQSTKYL

SEQ ID NO: 2233996 - protein, 17 aa, Cryptosporidium parvum
KTYCRLEKFSSEELSSH

SEQ ID NO: 2233997 - protein, 25 aa, Cryptosporidium parvum
KVDEFPDKIKILSILEKAKISRSSE

SEQ ID NO: 2233998 - protein, 17 aa, Cryptosporidium parvum
KVEIGVASIDRFTHFSL

SEQ ID NO: 2233999 - protein, 18 aa, Cryptosporidium parvum
KVELVRCLADVADALRSS

SEQ ID NO: 2234000 - protein, 24 aa, Cryptosporidium parvum
KVFWFQCLMVLLLKVFFDVLQTLA

SEQ ID NO: 2234001 - protein, 23 aa, Cryptosporidium parvum
KVGAMWIPMYFHFLEWESDKNNL

SEQ ID NO: 2234002 - protein, 23 aa, Cryptosporidium parvum
KVGCQNCKVVILNYLNICNTILK

SEQ ID NO: 2234003 - protein, 18 aa, Cryptosporidium parvum
KVGKEVMFKDNLVGGYLI

SEQ ID NO: 2234004 - protein, 20 aa, Cryptosporidium parvum
KVGRRSCSPSNVFLNRSKKF

SEQ ID NO: 2234005 - protein, 20 aa, Cryptosporidium parvum
KVIFKHRMLFVSFLVLGLAL

SEQ ID NO: 2234006 - protein, 24 aa, Cryptosporidium parvum
KVITTCWRIHSLINMKIQAEIVLL

SEQ ID NO: 2234007 - protein, 25 aa, Cryptosporidium parvum
KVKNKFWWKNIKYTLILGCLVSLIF

SEQ ID NO: 2234008 - protein, 22 aa, Cryptosporidium parvum
KVLACIQHLILLSNFLKDDWNP

SEQ ID NO: 2234009 - protein, 21 aa, Cryptosporidium parvum
KVLGDTYCPILIDFNKDKDTN

SEQ ID NO: 2234010 - protein, 26 aa, Cryptosporidium parvum
KVLKVASLCPACFCRPLSGIQSFVLK

SEQ ID NO: 2234011 - protein, 32 aa, Cryptosporidium parvum
KVLNCFNDIYKIYGFIAVCCIELKEKKTLTHF

SEQ ID NO: 2234012 - protein, 24 aa, Cryptosporidium parvum
KVLSGEALRVLGIAILPLTSEDFF

SEQ ID NO: 2234013 - protein, 18 aa, Cryptosporidium parvum
KVLSQAFRNRFVEIYFDE

SEQ ID NO: 2234014 - protein, 24 aa, Cryptosporidium parvum
KVLVFCIVLNILNLSFVTSKNTLN

SEQ ID NO: 2234015 - protein, 18 aa, Cryptosporidium parvum
KVPLRLSEVIKKYQVQYK

SEQ ID NO: 2234016 - protein, 29 aa, Cryptosporidium parvum
KVPPRPKKSPIMTRDWWIFGNIPHAIFEA

SEQ ID NO: 2234017 - protein, 20 aa, Cryptosporidium parvum
KVPVILILELFQFIKDETST

SEQ ID NO: 2234018 - protein, 24 aa, Cryptosporidium parvum
KVQLKRFDFISIINEVMKEFEGIN

SEQ ID NO: 2234019 - protein, 28 aa, Cryptosporidium parvum
KVRLYRLGKIFKVWRLIKKNNKSIKISD

SEQ ID NO: 2234020 - protein, 26 aa, Cryptosporidium parvum
KVSNSIICLCIRLLTLAQYPPFWTSC

SEQ ID NO: 2234021 - protein, 24 aa, Cryptosporidium parvum
KVSPLEIFITPHFVSDIYSLLYLY

SEQ ID NO: 2234022 - protein, 27 aa, Cryptosporidium parvum
KVSVGKMHKCLEYSLIEFNQLDLKDSS

SEQ ID NO: 2234023 - protein, 20 aa, Cryptosporidium parvum
KVTASLWYQAKLIFGFDDEL

SEQ ID NO: 2234024 - protein, 25 aa, Cryptosporidium parvum
KVVPKFLICIPVLAYLFFQVSKKYA

SEQ ID NO: 2234025 - protein, 22 aa, Cryptosporidium parvum
KVWKSSPIWLHLKPSDTKNPKE

SEQ ID NO: 2234026 - protein, 18 aa, Cryptosporidium parvum
KWCQEFYIDGQIMGISSY

SEQ ID NO: 2234027 - protein, 18 aa, Cryptosporidium parvum
KWIDCFKSDAKSIPSSIK

SEQ ID NO: 2234028 - protein, 19 aa, Cryptosporidium parvum
KWIQLSTFIPVDIKYIENL

SEQ ID NO: 2234029 - protein, 21 aa, Cryptosporidium parvum
KWKNDHYYTKWEEFNQPPNEM

SEQ ID NO: 2234030 - protein, 31 aa, Cryptosporidium parvum; identical to SEQ ID NO: 2125089

SEQ ID NO: 2234031 - protein, 27 aa, Cryptosporidium parvum
KWNEISHPFLLKRMLSPIINLNKIVKD

SEQ ID NO: 2234032 - protein, 18 aa, Cryptosporidium parvum
KWNQELLQDLALGGRELV

SEQ ID NO: 2234033 - protein, 20 aa, Cryptosporidium parvum
KWNYIYSVDLFKLNSISWSK

SEQ ID NO: 2234034 - protein, 17 aa, Cryptosporidium parvum
KWRSITWEVQMHGMGLI

SEQ ID NO: 2234035 - protein, 21 aa, Cryptosporidium parvum
KWSKGESFASILENTSFYEGS

SEQ ID NO: 2234036 - protein, 20 aa, Cryptosporidium parvum
KWTIPYKKFITLYFYQLPTL

SEQ ID NO: 2234037 - protein, 22 aa, Cryptosporidium parvum
KYAFWSCSFVHLAPEVEKLFQS

SEQ ID NO: 2234038 - protein, 23 aa, Cryptosporidium parvum
KYAKLLFQFLIFFIDNVCTLVLC

SEQ ID NO: 2234039 - protein, 24 aa, Cryptosporidium parvum
KYCHLPRKTLDIVFDVDLTLLTMV

SEQ ID NO: 2234040 - protein, 21 aa, Cryptosporidium parvum
KYDWNCNKLLLFKFLDNLISI

SEQ ID NO: 2234041 - protein, 23 aa, Cryptosporidium parvum
KYEEFKLLLTKVLGKIDRDSFQS

SEQ ID NO: 2234042 - protein, 20 aa, Cryptosporidium parvum
KYEFEVFGGSLLHLNPIKWK

SEQ ID NO: 2234043 - protein, 22 aa, Cryptosporidium parvum
KYEVKLRGSFTCKPWQEHLKLN

SEQ ID NO: 2234044 - protein, 30 aa, Cryptosporidium parvum
KYFNSINCCFNLVVYLCWMFIPDEYLNQIN

SEQ ID NO: 2234045 - protein, 17 aa, Cryptosporidium parvum
KYFSIKIMEYGATISNL

SEQ ID NO: 2234046 - protein, 28 aa, Cryptosporidium parvum
KYGDYSIKLSLFFFNSMGIRLFPNPNYC

SEQ ID NO: 2234047 - protein, 29 aa, Cryptosporidium parvum
KYICIFSFKVIMFRFFLLISRQGKTRLEK

SEQ ID NO: 2234048 - protein, 19 aa, Cryptosporidium parvum
KYIELRYSLIPYWYTLLAK

SEQ ID NO: 2234049 - protein, 17 aa, Cryptosporidium parvum
KYIKELFYLISKSNLSY

SEQ ID NO: 2234050 - protein, 17 aa, Cryptosporidium parvum
KYIKEYATRLFELLMKA

SEQ ID NO: 2234051 - protein, 19 aa, Cryptosporidium parvum
KYILLLTINMNWKYLLISI

SEQ ID NO: 2234052 - protein, 18 aa, Cryptosporidium parvum
KYIVNPFIRISKNIVTIR

SEQ ID NO: 2234053 - protein, 18 aa, Cryptosporidium parvum
KYIVYLIFWVVVKFFESI

SEQ ID NO: 2234054 - protein, 29 aa, Cryptosporidium parvum
KYKRKYMYWIWRRWRYLLSAKERMPILVE

SEQ ID NO: 2234055 - protein, 24 aa, Cryptosporidium parvum
KYLLPGFVYWLLIFVIKNFDKLEL

SEQ ID NO: 2234056 - protein, 31 aa, Cryptosporidium parvum
KYLSNLWLLSLINKDPWLSIISILNYSSVNN

SEQ ID NO: 2234057 - protein, 25 aa, Cryptosporidium parvum
KYLTICIPKLLLAASNYQIMKLSNL

SEQ ID NO: 2234058 - protein, 19 aa, Cryptosporidium parvum
KYNICSTITQIIIVQLIKI

SEQ ID NO: 2234059 - protein, 19 aa, Cryptosporidium parvum
KYNSPLIINVCFSKSKKLR

SEQ ID NO: 2234060 - protein, 22 aa, Cryptosporidium parvum
KYNVAEGIYLPIIYPSDFWCIE

SEQ ID NO: 2234061 - protein, 26 aa, Cryptosporidium parvum
KYPFPEKILFSMLVALTRLYGVSEVR

SEQ ID NO: 2234062 - protein, 21 aa, Cryptosporidium parvum
KYPIDPFVQYAFRVANSQING

SEQ ID NO: 2234063 - protein, 25 aa, Cryptosporidium parvum
KYPKALRIINDIRFSVFLCGPDMLD

SEQ ID NO: 2234064 - protein, 22 aa, Cryptosporidium parvum
KYPPMLHNWFFKKFSTKSSYIW

SEQ ID NO: 2234065 - protein, 18 aa, Cryptosporidium parvum
KYQLSHFNKWYNQRIESQ

SEQ ID NO: 2234066 - protein, 26 aa, Cryptosporidium parvum
KYSANLEMLFRKNFIRNLHDVEEIFH

SEQ ID NO: 2234067 - protein, 28 aa, Cryptosporidium parvum
KYSDHLPCAVWLPWIPQLIAGIDRIEGS

SEQ ID NO: 2234068 - protein, 24 aa, Cryptosporidium parvum
KYSGCKYNLLQFVFVSLWTRSKRF

SEQ ID NO: 2234069 - protein, 23 aa, Cryptosporidium parvum
KYSLIWSSRLVKYIMELITHSEN

SEQ ID NO: 2234070 - protein, 19 aa, Cryptosporidium parvum
KYSNLFPDFDLKLLKDINL

SEQ ID NO: 2234071 - protein, 19 aa, Cryptosporidium parvum
KYSSVLRSLLYPKKHFDTN

SEQ ID NO: 2234072 - protein, 19 aa, Cryptosporidium parvum
KYSVDIVIGALRYDLISSD

SEQ ID NO: 2234073 - protein, 17 aa, Cryptosporidium parvum
KYTGMVLEKYLYLLDRL

SEQ ID NO: 2234074 - protein, 20 aa, Cryptosporidium parvum
KYTKSTAVWSMFGYIVGLGD

SEQ ID NO: 2234075 - protein, 21 aa, Cryptosporidium parvum
KYTLILGCLVSLIFIIAFANL

SEQ ID NO: 2234076 - protein, 26 aa, Cryptosporidium parvum
KYVGGSKLWWKNWIFNQNKFDDLYDS

SEQ ID NO: 2234077 - protein, 18 aa, Cryptosporidium parvum
KYVRPVPGITEYGLSNPI

SEQ ID NO: 2234078 - protein, 21 aa, Cryptosporidium parvum
KYWWYENEFTWSREILSRKAA

SEQ ID NO: 2234079 - protein, 19 aa, Cryptosporidium parvum
KYYLIFSLAFFILHSSFQM

SEQ ID NO: 2234080 - protein, 19 aa, Cryptosporidium parvum
KYYREFLAFVYYRCIYGAE

SEQ ID NO: 2234081 - protein, 18 aa, Cryptosporidium parvum
LAALRLAVIGLENNWKIL

SEQ ID NO: 2234082 - protein, 23 aa, Cryptosporidium parvum
LAARRYQCCFDQIKGGYYFQYDF

SEQ ID NO: 2234083 - protein, 24 aa, Cryptosporidium parvum
LAEFFRVPINFNFTQIDSIFSNNK

SEQ ID NO: 2234084 - protein, 19 aa, Cryptosporidium parvum
LAEGLKLIKKLDILNKADC

SEQ ID NO: 2234085 - protein, 20 aa, Cryptosporidium parvum
LAENVILNIFCKFNSIVNKY

SEQ ID NO: 2234086 - protein, 21 aa, Cryptosporidium parvum
LAFEGIKIGIELSMASNITFF

SEQ ID NO: 2234087 - protein, 17 aa, Cryptosporidium parvum
LAFSIFQIFTAMSFPGL

SEQ ID NO: 2234088 - protein, 25 aa, Cryptosporidium parvum
LAGGPSYFIPFAIFGYYKTRADVNA

SEQ ID NO: 2234089 - protein, 19 aa, Cryptosporidium parvum
LAHNMLALVALQFTIMKAL

SEQ ID NO: 2234090 - protein, 24 aa, Cryptosporidium parvum
LAHTICIIYAFFIYFGPKIMEKRK

SEQ ID NO: 2234091 - protein, 17 aa, Cryptosporidium parvum
LAIAEWLIEVVGMKNIL

SEQ ID NO: 2234092 - protein, 23 aa, Cryptosporidium parvum
LAIESCQFVNYIPIYLVCHCDSW

SEQ ID NO: 2234093 - protein, 18 aa, Cryptosporidium parvum
LAIGRIGSVLSDMVSPII

SEQ ID NO: 2234094 - protein, 19 aa, Cryptosporidium parvum
LAIIISRLRVLALPYIAVV

SEQ ID NO: 2234095 - protein, 26 aa, Cryptosporidium parvum
LAISCSSYEGPDCKFTSFNLKQVLDC

SEQ ID NO: 2234096 - protein, 30 aa, Cryptosporidium parvum
LAISLFIILCYWHTLNIFQFMYIFTPAICI

SEQ ID NO: 2234097 - protein, 17 aa, Cryptosporidium parvum
LAIYGIIVSLVLISSPS

SEQ ID NO: 2234098 - protein, 17 aa, Cryptosporidium parvum
LAKIFLKSRSEFIDIEY

SEQ ID NO: 2234099 - protein, 20 aa, Cryptosporidium parvum
LAKNRGHYITSILFFMEANL

SEQ ID NO: 2234100 - protein, 19 aa, Cryptosporidium parvum
LAKYENREYNSIVYKLYWK

SEQ ID NO: 2234101 - protein, 18 aa, Cryptosporidium parvum
LALECLFHATTMGYRVVF

SEQ ID NO: 2234102 - protein, 21 aa, Cryptosporidium parvum
LALKCVKMINVPHLVESVIAL

SEQ ID NO: 2234103 - protein, 20 aa, Cryptosporidium parvum
LALLFCYEVVCKIIVELFTK

SEQ ID NO: 2234104 - protein, 17 aa, Cryptosporidium parvum
LALLSCISKQLEAELER

SEQ ID NO: 2234105 - protein, 19 aa, Cryptosporidium parvum
LALPLVFVLFVGAVKDGWE

SEQ ID NO: 2234106 - protein, 29 aa, Cryptosporidium parvum
LALVGIIIIDFIFRRFGALTLFDNITNIT

SEQ ID NO: 2234107 - protein, 18 aa, Cryptosporidium parvum
LAMPFQFESEILLVLFCL

SEQ ID NO: 2234108 - protein, 23 aa, Cryptosporidium parvum
LANIEHFRFYTIRNITGNITDVI

SEQ ID NO: 2234109 - protein, 18 aa, Cryptosporidium parvum
LAPIKLRQQMWLRRPRWF

SEQ ID NO: 2234110 - protein, 36 aa, Cryptosporidium parvum
LAPYWSNRALVFISLWLECFFLCFFYRSTKSSFEQF

SEQ ID NO: 2234111 - protein, 24 aa, Cryptosporidium parvum
LAQITSSGLLSCRYETNYFMENII

SEQ ID NO: 2234112 - protein, 18 aa, Cryptosporidium parvum
LARCGRVSALKVIISSFI

SEQ ID NO: 2234113 - protein, 17 aa, Cryptosporidium parvum
LARIVGISFAFIFIILS

SEQ ID NO: 2234114 - protein, 24 aa, Cryptosporidium parvum
LARLLELLCFCFNVTLGEKLLQHL

SEQ ID NO: 2234115 - protein, 18 aa, Cryptosporidium parvum
LARTCLKAADIGHGALKW

SEQ ID NO: 2234116 - protein, 29 aa, Cryptosporidium parvum
LASCIPAYCLRPLCQHILPSFHDADKITA

SEQ ID NO: 2234117 - protein, 26 aa, Cryptosporidium parvum
LASEACSICLEPVFGLYTRCISCKHG

SEQ ID NO: 2234118 - protein, 27 aa, Cryptosporidium parvum
LASPHPKIKLGFLKWFNEKLPKDLFGR

SEQ ID NO: 2234119 - protein, 22 aa, Cryptosporidium parvum
LASQRFANGFIHISPDAYGDGP

SEQ ID NO: 2234120 - protein, 17 aa, Cryptosporidium parvum
LATFHFGVKYENDGHKN

SEQ ID NO: 2234121 - protein, 18 aa, Cryptosporidium parvum
LATFTIWVIFGIQHLCLP

SEQ ID NO: 2234122 - protein, 21 aa, Cryptosporidium parvum
LAVNLPIFFLHNDGIKLMKSI

SEQ ID NO: 2234123 - protein, 24 aa, Cryptosporidium parvum
LCACALIHLILWNGIKESFKHKKN

SEQ ID NO: 2234124 - protein, 18 aa, Cryptosporidium parvum
LCAIASVIPTEAPTTKYS

SEQ ID NO: 2234125 - protein, 17 aa, Cryptosporidium parvum
LCDCIKGFDSLEWIGPM

SEQ ID NO: 2234126 - protein, 21 aa, Cryptosporidium parvum
LCELFRIELDKELLISLFNET

SEQ ID NO: 2234127 - protein, 18 aa, Cryptosporidium parvum
LCEPDFKKPLPIIKGEYL

SEQ ID NO: 2234128 - protein, 24 aa, Cryptosporidium parvum
LCGAKIKMKPALHISKSHLIFQTK

SEQ ID NO: 2234129 - protein, 19 aa, Cryptosporidium parvum
LCGTPEYIAPEVLLNKGHG

SEQ ID NO: 2234130 - protein, 19 aa, Cryptosporidium parvum
LCIGFECINYRGSCININI

SEQ ID NO: 2234131 - protein, 27 aa, Cryptosporidium parvum
LCIILKPPFWYCPIEGTGMDEDEQDEE

SEQ ID NO: 2234132 - protein, 19 aa, Cryptosporidium parvum
LCIPNNFSAVKLVSVLSVF

SEQ ID NO: 2234133 - protein, 27 aa, Cryptosporidium parvum
LCIRRFRAISRFEAFRILSTLFNDENI

SEQ ID NO: 2234134 - protein, 19 aa, Cryptosporidium parvum
LCIVGAGPSGCYLAKYLLA

SEQ ID NO: 2234135 - protein, 22 aa, Cryptosporidium parvum
LCIVSWMPLMLENCSPALSDSE

SEQ ID NO: 2234136 - protein, 19 aa, Cryptosporidium parvum
LCKLLKPAPPIPLPVSQVL

SEQ ID NO: 2234137 - protein, 17 aa, Cryptosporidium parvum
LCLELGIVLDIEDIHQI

SEQ ID NO: 2234138 - protein, 28 aa, Cryptosporidium parvum
LCLVKASRKEVFFNVPINFDNTIIHLNS

SEQ ID NO: 2234139 - protein, 18 aa, Cryptosporidium parvum
LCMACILFLAFACKPVFR

SEQ ID NO: 2234140 - protein, 20 aa, Cryptosporidium parvum
LCMTGSLLTYKYIFDGVFDH

SEQ ID NO: 2234141 - protein, 21 aa, Cryptosporidium parvum
LCNIIRFTIHSSYGDKYFCLY

SEQ ID NO: 2234142 - protein, 18 aa, Cryptosporidium parvum
LCNTELPNAVSLSNKEVL

SEQ ID NO: 2234143 - protein, 26 aa, Cryptosporidium parvum
LCRFNYKVEISLLFAQIIVLVLLTLL

SEQ ID NO: 2234144 - protein, 17 aa, Cryptosporidium parvum
LCSCYDMGDMLELLRSY

SEQ ID NO: 2234145 - protein, 26 aa, Cryptosporidium parvum
LCSGENIILNKGCLNIVFDYERDNPN

SEQ ID NO: 2234146 - protein, 19 aa, Cryptosporidium parvum
LCSHPCSKDNSSVNDIDYL

SEQ ID NO: 2234147 - protein, 19 aa, Cryptosporidium parvum
LCSICRSGSIKIEHSEDDS

SEQ ID NO: 2234148 - protein, 19 aa, Cryptosporidium parvum
LCSIIPFEGYLPYDRSGDW

SEQ ID NO: 2234149 - protein, 17 aa, Cryptosporidium parvum
LCSLLRDDLHAFSVHRA

SEQ ID NO: 2234150 - protein, 19 aa, Cryptosporidium parvum
LCSLRTALVQWILSSSSNQ

SEQ ID NO: 2234151 - protein, 19 aa, Cryptosporidium parvum
LCSSTFWGQDCNHPTIKSS

SEQ ID NO: 2234152 - protein, 28 aa, Cryptosporidium parvum
LCTLKQYRFFSIYALKCLKNQVNLLDKL

SEQ ID NO: 2234153 - protein, 21 aa, Cryptosporidium parvum
LCTPFHFLLEIFPVSSNTSGC

SEQ ID NO: 2234154 - protein, 19 aa, Cryptosporidium parvum
LDCDIKLLLIDPVVPVKLS

SEQ ID NO: 2234155 - protein, 20 aa, Cryptosporidium parvum
LDDLMAIPVTLLVRIIILSN

SEQ ID NO: 2234156 - protein, 27 aa, Cryptosporidium parvum
LDDPTRIALRVGRILSVEKHPTADKLY

SEQ ID NO: 2234157 - protein, 34 aa, Cryptosporidium parvum
LDDQFRLTCDIWIHPICLEWLIIARVQVFSLNNV

SEQ ID NO: 2234158 - protein, 18 aa, Cryptosporidium parvum
LDDYRYKLSLQELLRLLI

SEQ ID NO: 2234159 - protein, 24 aa, Cryptosporidium parvum
LDEFKLEIVRKVILTSPARLRLQI

SEQ ID NO: 2234160 - protein, 19 aa, Cryptosporidium parvum
LDEIINWDDLNFMDEMPSL

SEQ ID NO: 2234161 - protein, 24 aa, Cryptosporidium parvum
LDELCIRSSVLPLSRQSWKESDVG

SEQ ID NO: 2234162 - protein, 19 aa, Cryptosporidium parvum
LDEVIEWERQYSIEVIEPD

SEQ ID NO: 2234163 - protein, 28 aa, Cryptosporidium parvum
LDEVSWQLLFRYMEYIDRILDIGLGPMV

SEQ ID NO: 2234164 - protein, 19 aa, Cryptosporidium parvum
LDFDFINWLGDYSGYYLPF

SEQ ID NO: 2234165 - protein, 19 aa, Cryptosporidium parvum
LDFENQFLFCLSNRNFQIL

SEQ ID NO: 2234166 - protein, 17 aa, Cryptosporidium parvum
LDFIGFSKSIFWTLYII

SEQ ID NO: 2234167 - protein, 19 aa, Cryptosporidium parvum
LDFILFTSIQIIKRDHNNF

SEQ ID NO: 2234168 - protein, 21 aa, Cryptosporidium parvum
LDFLRGSRIFGMISESIGSLC

SEQ ID NO: 2234169 - protein, 26 aa, Cryptosporidium parvum
LDFPTILLPIPLQWAKLSNISQKLLI

SEQ ID NO: 2234170 - protein, 30 aa, Cryptosporidium parvum; identical to SEQ ID NO: 2125166

SEQ ID NO: 2234171 - protein, 17 aa, Cryptosporidium parvum
LDGQWKVLLALENKDNF

SEQ ID NO: 2234172 - protein, 25 aa, Cryptosporidium parvum
LDGVEDCLICYSIVHPQYRSLPRKR

SEQ ID NO: 2234173 - protein, 17 aa, Cryptosporidium parvum
LDIDFSRAVRAVSLTKG

SEQ ID NO: 2234174 - protein, 17 aa, Cryptosporidium parvum
LDIFRVEKDLNLEEDTI

SEQ ID NO: 2234175 - protein, 25 aa, Cryptosporidium parvum
LDILKPRPVLVYNMSSYYIPEHLLL

SEQ ID NO: 2234176 - protein, 17 aa, Cryptosporidium parvum
LDIPAPRGPLFVLGNNF

SEQ ID NO: 2234177 - protein, 17 aa, Cryptosporidium parvum
LDISLIYNRLMELGIQY

SEQ ID NO: 2234178 - protein, 17 aa, Cryptosporidium parvum
LDIVKFLGHKVAISEFD

SEQ ID NO: 2234179 - protein, 23 aa, Cryptosporidium parvum
LDKKFRLLDGFGKMKNLWNKYGY

SEQ ID NO: 2234180 - protein, 21 aa, Cryptosporidium parvum
LDKKLKISIDFRSSSINNHDQ

SEQ ID NO: 2234181 - protein, 18 aa, Cryptosporidium parvum
LDKLELLPMDSYKLIPFD

SEQ ID NO: 2234182 - protein, 19 aa, Cryptosporidium parvum
LDLFKKLVIQGDLFSDLTS

SEQ ID NO: 2234183 - protein, 19 aa, Cryptosporidium parvum
LDLICRVPIQCKLTINQKF

SEQ ID NO: 2234184 - protein, 19 aa, Cryptosporidium parvum
LDLIFNFHKAYFILDEIIL

SEQ ID NO: 2234185 - protein, 20 aa, Cryptosporidium parvum
LDLIKCSDFVMALFGFNDEF

SEQ ID NO: 2234186 - protein, 19 aa, Cryptosporidium parvum
LDLISSLRVELELNNYDEN

SEQ ID NO: 2234187 - protein, 21 aa, Cryptosporidium parvum
LDLLFLLPIIYNFLSIPNRTL

SEQ ID NO: 2234188 - protein, 27 aa, Cryptosporidium parvum
LDLLIFPIRFLLTWILLKEHVGSVATS

SEQ ID NO: 2234189 - protein, 20 aa, Cryptosporidium parvum
LDLLKTGLYIIFIFERNAFF

SEQ ID NO: 2234190 - protein, 25 aa, Cryptosporidium parvum
LDLLYPYILGPIFKACRQYTNPKLT

SEQ ID NO: 2234191 - protein, 24 aa, Cryptosporidium parvum
LDLPMKVVDMLGAGIPIISFSYPT

SEQ ID NO: 2234192 - protein, 21 aa, Cryptosporidium parvum
LDMLLELFTVVFGNSPQAESI

SEQ ID NO: 2234193 - protein, 17 aa, Cryptosporidium parvum
LDPGDLFKMIECRIQNF

SEQ ID NO: 2234194 - protein, 25 aa, Cryptosporidium parvum
LDPNRLRVAFRIIFLDEQGDIEPGI

SEQ ID NO: 2234195 - protein, 18 aa, Cryptosporidium parvum
LDQFNLWTTDIWLNIIVA

SEQ ID NO: 2234196 - protein, 20 aa, Cryptosporidium parvum
LDQIKETRSVAVNQTTTTIE

SEQ ID NO: 2234197 - protein, 20 aa, Cryptosporidium parvum
LDRIYAMPISVLIEFILDEN

SEQ ID NO: 2234198 - protein, 18 aa, Cryptosporidium parvum
LDRLIPVSKLLKHEDSEI

SEQ ID NO: 2234199 - protein, 23 aa, Cryptosporidium parvum
LDSCICLPGFFKLESTNSCISCP

SEQ ID NO: 2234200 - protein, 21 aa, Cryptosporidium parvum
LDSCNGALCELLFDILPINIQ

SEQ ID NO: 2234201 - protein, 20 aa, Cryptosporidium parvum
LDSFFRMEFNSVELTESILL

SEQ ID NO: 2234202 - protein, 30 aa, Cryptosporidium parvum
LDSFQRWIWDKGDLQCWASVLNRFDDYINS

SEQ ID NO: 2234203 - protein, 17 aa, Cryptosporidium parvum
LDSLPAQVPSIFHQRCC

SEQ ID NO: 2234204 - protein, 22 aa, Cryptosporidium parvum
LDSTFPSLLIWVRFFHQTILKN

SEQ ID NO: 2234205 - protein, 21 aa, Cryptosporidium parvum
LDTMLPSFIVERLLIDQKNNP

SEQ ID NO: 2234206 - protein, 25 aa, Cryptosporidium parvum
LDTSMMFCPLTKIGMSQSLLPRFEA

SEQ ID NO: 2234207 - protein, 19 aa, Cryptosporidium parvum
LDVFNIFKEPFPISWVNLY

SEQ ID NO: 2234208 - protein, 24 aa, Cryptosporidium parvum
LDVIKHVIQLILIVAPTLDPGNED

SEQ ID NO: 2234209 - protein, 23 aa, Cryptosporidium parvum
LDVIRGILWKDICNNGCDISTYI

SEQ ID NO: 2234210 - protein, 22 aa, Cryptosporidium parvum
LDVPGSPRWSARGRALIRKEAR

SEQ ID NO: 2234211 - protein, 17 aa, Cryptosporidium parvum
LDWCNEHSYHWDVEIIS

SEQ ID NO: 2234212 - protein, 24 aa, Cryptosporidium parvum
LDYEKCTKFLLSMDTWLDESTINS

SEQ ID NO: 2234213 - protein, 20 aa, Cryptosporidium parvum
LDYFIWFFLEFFYPKESIEH

SEQ ID NO: 2234214 - protein, 24 aa, Cryptosporidium parvum
LEALITRWSNILVDMFIQSDNYRD

SEQ ID NO: 2234215 - protein, 17 aa, Cryptosporidium parvum
LEAQYLYSVHRYEECLS

SEQ ID NO: 2234216 - protein, 19 aa, Cryptosporidium parvum
LEASAGIAGLIKLLLSLRN

SEQ ID NO: 2234217 - protein, 25 aa, Cryptosporidium parvum
LECVFILYCSFALPSLLFSSFSLMI

SEQ ID NO: 2234218 - protein, 21 aa, Cryptosporidium parvum
LEDIPINLILDATCKSPPGIK

SEQ ID NO: 2234219 - protein, 17 aa, Cryptosporidium parvum
LEEDLRVPTEFDNTCRV

SEQ ID NO: 2234220 - protein, 27 aa, Cryptosporidium parvum
LEEEGLRIFWKGPIHTVPTINLTLVQR

SEQ ID NO: 2234221 - protein, 18 aa, Cryptosporidium parvum
LEEFFPKVMLKLSKDLTH

SEQ ID NO: 2234222 - protein, 21 aa, Cryptosporidium parvum
LEEFNLGIDLIRATISLNIPE

SEQ ID NO: 2234223 - protein, 21 aa, Cryptosporidium parvum
LEEFYSLLIQIFWKKTKFLNN

SEQ ID NO: 2234224 - protein, 32 aa, Cryptosporidium parvum
LEEIGIAFRIPFKWLPSASEKLSFLSKLKISG

SEQ ID NO: 2234225 - protein, 23 aa, Cryptosporidium parvum
LEELKRKYDVVVLAVGGLQSFHT

SEQ ID NO: 2234226 - protein, 18 aa, Cryptosporidium parvum
LEETFGIVGPATVFHKMK

SEQ ID NO: 2234227 - protein, 21 aa, Cryptosporidium parvum
LEEVYRCIGMLAVIIDDYDFE

SEQ ID NO: 2234228 - protein, 52 aa, Cryptosporidium parvum
LEFPYGWPRNIDIALRYALKGATKFNCGFCYTMMGLLFAWGYPPIINNTHGW

SEQ ID NO: 2234229 - protein, 24 aa, Cryptosporidium parvum
LEFSIFFIRFYKNIARHDSIPYFI

SEQ ID NO: 2234230 - protein, 25 aa, Cryptosporidium parvum
LEFVRKMGDTLGWISIFTNSTASHV

SEQ ID NO: 2234231 - protein, 19 aa, Cryptosporidium parvum
LEGAAGIAGLIKLILVLNY

SEQ ID NO: 2234232 - protein, 20 aa, Cryptosporidium parvum
LEGLFFNYIFYFKNDNYNNY

SEQ ID NO: 2234233 - protein, 21 aa, Cryptosporidium parvum
LEGSPRITGVLINGSEYQAPL

SEQ ID NO: 2234234 - protein, 21 aa, Cryptosporidium parvum
LEIFRSRILIAGARLSIILND

SEQ ID NO: 2234235 - protein, 19 aa, Cryptosporidium parvum
LEIGESVLISAHTSAGKTC

SEQ ID NO: 2234236 - protein, 18 aa, Cryptosporidium parvum
LEIIHCMHMGMAPFFTGM

SEQ ID NO: 2234237 - protein, 21 aa, Cryptosporidium parvum
LEIIRSLEIMYYKGYSEEKVD

SEQ ID NO: 2234238 - protein, 21 aa, Cryptosporidium parvum
LEILFRYICMKSVKKIFLSWT

SEQ ID NO: 2234239 - protein, 23 aa, Cryptosporidium parvum
LEILFWIAFCLLLMVGYKYLSDG

SEQ ID NO: 2234240 - protein, 24 aa, Cryptosporidium parvum
LEINSLPPSFSWTKAWKDITSEGL

SEQ ID NO: 2234241 - protein, 21 aa, Cryptosporidium parvum
LEKCPTYYKITAKMLEHPFHQ

SEQ ID NO: 2234242 - protein, 20 aa, Cryptosporidium parvum
LEKFKILPIEVEHMDPQQRL

SEQ ID NO: 2234243 - protein, 17 aa, Cryptosporidium parvum
LEKFQGYWVLLRSNSDS

SEQ ID NO: 2234244 - protein, 19 aa, Cryptosporidium parvum
LEKIIPCSEKLEALLGEYV

SEQ ID NO: 2234245 - protein, 25 aa, Cryptosporidium parvum
LEKILKIDPIFTCLVTVKLSNLIND

SEQ ID NO: 2234246 - protein, 24 aa, Cryptosporidium parvum
LEKKCLICKIIRTIFESLETELFL

SEQ ID NO: 2234247 - protein, 19 aa, Cryptosporidium parvum
LELAANWLLEKNFQNSSST

SEQ ID NO: 2234248 - protein, 17 aa, Cryptosporidium parvum
LELDESFVGGPLLDDFF

SEQ ID NO: 2234249 - protein, 18 aa, Cryptosporidium parvum
LELEGILELYNWVQKYDQ

SEQ ID NO: 2234250 - protein, 19 aa, Cryptosporidium parvum
LELGIKQISIFPGEIPGAA

SEQ ID NO: 2234251 - protein, 23 aa, Cryptosporidium parvum
LELLISFITDFFKAVLNFIESFS

SEQ ID NO: 2234252 - protein, 22 aa, Cryptosporidium parvum
LELLKCELDDFGFKNNLLAQIF

SEQ ID NO: 2234253 - protein, 21 aa, Cryptosporidium parvum
LELMKRKRGKSRNKKKKQKKQ

SEQ ID NO: 2234254 - protein, 19 aa, Cryptosporidium parvum
LELRYKPEMPLVLNSISCN

SEQ ID NO: 2234255 - protein, 23 aa, Cryptosporidium parvum
LELSRSVWRSVQLILSIILDEHE

SEQ ID NO: 2234256 - protein, 18 aa, Cryptosporidium parvum
LELVKYRYLAPLTVDIGE

SEQ ID NO: 2234257 - protein, 31 aa, Cryptosporidium parvum
LEMHIKKVNPWFAVILCISLLNGISIWDRIQ

SEQ ID NO: 2234258 - protein, 25 aa, Cryptosporidium parvum
LEMISCPFIDCMSDLIKNPEFSMDH

SEQ ID NO: 2234259 - protein, 17 aa, Cryptosporidium parvum
LEMLHAIYAKIKLREYQ

SEQ ID NO: 2234260 - protein, 27 aa, Cryptosporidium parvum
LENFFKSKLPILIEKIFLMLRNGSEKH

SEQ ID NO: 2234261 - protein, 17 aa, Cryptosporidium parvum
LENHEFNNIKSLKFISI

SEQ ID NO: 2234262 - protein, 27 aa, Cryptosporidium parvum
LENICWKSQCYVDILPLDFCDVNHSLL

SEQ ID NO: 2234263 - protein, 31 aa, Cryptosporidium parvum; identical to SEQ ID NO: 2125217

SEQ ID NO: 2234264 - protein, 26 aa, Cryptosporidium parvum
LENKLSINIIHEFYLSLEIDEINYEI

SEQ ID NO: 2234265 - protein, 18 aa, Cryptosporidium parvum
LENLKIILPNTLVMEKLK

SEQ ID NO: 2234266 - protein, 17 aa, Cryptosporidium parvum
LENLRLCLNRIRNSVSY

SEQ ID NO: 2234267 - protein, 26 aa, Cryptosporidium parvum
LENVVESFLGFASRLCTDVQHTLPQL

SEQ ID NO: 2234268 - protein, 26 aa, Cryptosporidium parvum
LENWRNSRWQFLYVLLVIIASLIGIS

SEQ ID NO: 2234269 - protein, 25 aa, Cryptosporidium parvum
LEPESGTSPNEWIWTLGTCVQIENA

SEQ ID NO: 2234270 - protein, 20 aa, Cryptosporidium parvum
LEPIFYCSKGIINQQHNIFI

SEQ ID NO: 2234271 - protein, 18 aa, Cryptosporidium parvum
LEPSCLISANTKLFTILI

SEQ ID NO: 2234272 - protein, 17 aa, Cryptosporidium parvum
LEPSLILTSGWIFIRCA

SEQ ID NO: 2234273 - protein, 20 aa, Cryptosporidium parvum
LEQIPAYLFINGGTKLIRFS

SEQ ID NO: 2234274 - protein, 23 aa, Cryptosporidium parvum
LEQMRLSLLCKDFVRLQIFAKKI

SEQ ID NO: 2234275 - protein, 25 aa, Cryptosporidium parvum
LEQVEYRWNFLINILEFVNKNEGNK

SEQ ID NO: 2234276 - protein, 24 aa, Cryptosporidium parvum
LERAIKDFILFPARITCDVPSGDI

SEQ ID NO: 2234277 - protein, 17 aa, Cryptosporidium parvum
LERGIRLLKPRLRQLTI

SEQ ID NO: 2234278 - protein, 21 aa, Cryptosporidium parvum
LERKFLYRPNVPVIGNAKLWW

SEQ ID NO: 2234279 - protein, 25 aa, Cryptosporidium parvum
LERLDLLICSLLEYCLKDEHSKRSN

SEQ ID NO: 2234280 - protein, 20 aa, Cryptosporidium parvum
LERLLKFSIISILWILSANY

SEQ ID NO: 2234281 - protein, 20 aa, Cryptosporidium parvum
LERLSELGLGPNINVFHIHK

SEQ ID NO: 2234282 - protein, 25 aa, Cryptosporidium parvum
LESFTRFRIIFSRERAKGLYGPATY

SEQ ID NO: 2234283 - protein, 23 aa, Cryptosporidium parvum
LESKARFKLAKIMISSFIYSPVD

SEQ ID NO: 2234284 - protein, 21 aa, Cryptosporidium parvum
LESMKKCVSYFGNLISMISKE

SEQ ID NO: 2234285 - protein, 20 aa, Cryptosporidium parvum
LESYSWYLFGFFGKKNIILL

SEQ ID NO: 2234286 - protein, 24 aa, Cryptosporidium parvum
LETECLKSGLAVLRIDMPGHGLSS

SEQ ID NO: 2234287 - protein, 20 aa, Cryptosporidium parvum
LETHMGLALMQQAEWSKAQE

SEQ ID NO: 2234288 - protein, 20 aa, Cryptosporidium parvum
LEVCAYKFTNGVPIASEAKV

SEQ ID NO: 2234289 - protein, 18 aa, Cryptosporidium parvum
LEVFEIYPNTSFDLLPYD

SEQ ID NO: 2234290 - protein, 20 aa, Cryptosporidium parvum
LEVFSIVWTFWNPEWDEDEQ

SEQ ID NO: 2234291 - protein, 43 aa, Cryptosporidium parvum; identical to SEQ ID NO: 2125229

SEQ ID NO: 2234292 - protein, 23 aa, Cryptosporidium parvum
LEVKIEIIHFTRECSVEERTILQ

SEQ ID NO: 2234293 - protein, 22 aa, Cryptosporidium parvum
LEYETIKLFNIIGSTGNPKDTG

SEQ ID NO: 2234294 - protein, 20 aa, Cryptosporidium parvum
LFAAICVIRGIMVFILSPLL

SEQ ID NO: 2234295 - protein, 23 aa, Cryptosporidium parvum
LFASRKYLSFIFNYYKPILLWIF

SEQ ID NO: 2234296 - protein, 24 aa, Cryptosporidium parvum
LFCKFSQTFFTQGLISYFHFNASD

SEQ ID NO: 2234297 - protein, 26 aa, Cryptosporidium parvum
LFCPISDTFCNLSIKFSDLSNIDRYK

SEQ ID NO: 2234298 - protein, 22 aa, Cryptosporidium parvum
LFDVPFRLEASFLLENSNVNVN

SEQ ID NO: 2234299 - protein, 19 aa, Cryptosporidium parvum
LFEGCRVVSLGIPSVFNFI

SEQ ID NO: 2234300 - protein, 18 aa, Cryptosporidium parvum
LFELIFRATAQDVILESE

SEQ ID NO: 2234301 - protein, 18 aa, Cryptosporidium parvum
LFELKLWDERTCLCKIDD

SEQ ID NO: 2234302 - protein, 24 aa, Cryptosporidium parvum
LFESIRLSILNLFGYFYNHFQTLI

SEQ ID NO: 2234303 - protein, 26 aa, Cryptosporidium parvum
LFESKNGLKYFCWDIQAVREIITAHY

SEQ ID NO: 2234304 - protein, 26 aa, Cryptosporidium parvum
LFESYLKFWWIIGSCEYYNNHPAGNV

SEQ ID NO: 2234305 - protein, 34 aa, Cryptosporidium parvum
LFEVNSLICWNKLIPNFLLCYSEVNSIYNENIYN

SEQ ID NO: 2234306 - protein, 20 aa, Cryptosporidium parvum
LFFEDYRITKIMTNFSKDKN

SEQ ID NO: 2234307 - protein, 23 aa, Cryptosporidium parvum
LFFLLHFQNIFTYRRRLTALHLR

SEQ ID NO: 2234308 - protein, 17 aa, Cryptosporidium parvum
LFFLRFLFVLLFILCHL

SEQ ID NO: 2234309 - protein, 19 aa, Cryptosporidium parvum
LFFNIIFSIFILKQQISTI

SEQ ID NO: 2234310 - protein, 18 aa, Cryptosporidium parvum
LFFYVVKFTCIYVLLLGS

SEQ ID NO: 2234311 - protein, 17 aa, Cryptosporidium parvum
LFGHKGFLNSPYSRTIL

SEQ ID NO: 2234312 - protein, 18 aa, Cryptosporidium parvum
LFGLVIIFYKYEIVSSEH

SEQ ID NO: 2234313 - protein, 17 aa, Cryptosporidium parvum
LFGYIWRKSAGYLNSEW

SEQ ID NO: 2234314 - protein, 24 aa, Cryptosporidium parvum
LFHLFLRREVAILSAKRHDAFLHF

SEQ ID NO: 2234315 - protein, 18 aa, Cryptosporidium parvum
LFIAIVFFFCLKRRVSSY

SEQ ID NO: 2234316 - protein, 19 aa, Cryptosporidium parvum
LFICSEFILETSILTMFHS

SEQ ID NO: 2234317 - protein, 22 aa, Cryptosporidium parvum
LFIFFCGISIILGTVPSFPILP

SEQ ID NO: 2234318 - protein, 25 aa, Cryptosporidium parvum
LFIFGLIIYSVWVLRLEPTANEEEM

SEQ ID NO: 2234319 - protein, 17 aa, Cryptosporidium parvum
LFIFHWLIFLPSFVLDE

SEQ ID NO: 2234320 - protein, 17 aa, Cryptosporidium parvum
LFIFTTIFECLRIKLLI

SEQ ID NO: 2234321 - protein, 17 aa, Cryptosporidium parvum
LFIIYFLVIYNNEWNSL

SEQ ID NO: 2234322 - protein, 19 aa, Cryptosporidium parvum
LFIQRECIYDQSICFQSLE

SEQ ID NO: 2234323 - protein, 23 aa, Cryptosporidium parvum
LFITDYRLGISLFSYFNIEYYPL

SEQ ID NO: 2234324 - protein, 24 aa, Cryptosporidium parvum
LFIYNFWRCSILVSKSEYIVTSVL

SEQ ID NO: 2234325 - protein, 19 aa, Cryptosporidium parvum
LFKDIAIRKSIYMLTFNII

SEQ ID NO: 2234326 - protein, 23 aa, Cryptosporidium parvum
LFKKGKVCSMIKEIYSKNKKDKK

SEQ ID NO: 2234327 - protein, 24 aa, Cryptosporidium parvum
LFKNEGICGVGFVVEASESSPSHS

SEQ ID NO: 2234328 - protein, 17 aa, Cryptosporidium parvum
LFKPEILGQLQIPLFPD

SEQ ID NO: 2234329 - protein, 24 aa, Cryptosporidium parvum
LFKTLKYIRSLECSNQLKEHNGNN

SEQ ID NO: 2234330 - protein, 30 aa, Cryptosporidium parvum
LFLCKDLDMEGRFVLISAMTNFLGYPNSYT

SEQ ID NO: 2234331 - protein, 20 aa, Cryptosporidium parvum
LFLINIIWAFLWALDSNYLT

SEQ ID NO: 2234332 - protein, 18 aa, Cryptosporidium parvum
LFLLSLLFFIVFLSGIYF

SEQ ID NO: 2234333 - protein, 18 aa, Cryptosporidium parvum
LFLQISIADLSVIILPVS

SEQ ID NO: 2234334 - protein, 27 aa, Cryptosporidium parvum
LFLRGYKEILCRIMVGWSNNIDKSLFE

SEQ ID NO: 2234335 - protein, 25 aa, Cryptosporidium parvum
LFMDFWEFIKRNALIKNGKFLQYYC

SEQ ID NO: 2234336 - protein, 23 aa, Cryptosporidium parvum
LFMSAWGPTCFRPKAQESHFHFV

SEQ ID NO: 2234337 - protein, 25 aa, Cryptosporidium parvum
LFNEKRLATSILKTVPLIFVFLDIM

SEQ ID NO: 2234338 - protein, 20 aa, Cryptosporidium parvum
LFPDYEVKSSRIWRITISLI

SEQ ID NO: 2234339 - protein, 18 aa, Cryptosporidium parvum
LFPGTVIFIDKAMRIPAD

SEQ ID NO: 2234340 - protein, 19 aa, Cryptosporidium parvum
LFPMLPKIFEALSVRLETP

SEQ ID NO: 2234341 - protein, 25 aa, Cryptosporidium parvum
LFPSWEYGLSLPLPVPFNHPDLLLN

SEQ ID NO: 2234342 - protein, 17 aa, Cryptosporidium parvum
LFPYANMIIPGIINQWM

SEQ ID NO: 2234343 - protein, 17 aa, Cryptosporidium parvum
LFPYLSYLYQNNSYVKL

SEQ ID NO: 2234344 - protein, 22 aa, Cryptosporidium parvum
LFQCLLSKFGIDRHGPEALKIY

SEQ ID NO: 2234345 - protein, 26 aa, Cryptosporidium parvum
LFQGLLCALLFIGEAIGGVKASNIAH

SEQ ID NO: 2234346 - protein, 17 aa, Cryptosporidium parvum
LFQPCLGSLYTYSNKNL

SEQ ID NO: 2234347 - protein, 23 aa, Cryptosporidium parvum
LFQRLGMNGILYIIGAIKKSIQL

SEQ ID NO: 2234348 - protein, 23 aa, Cryptosporidium parvum
LFQRNQIKVAIHFYEMITSNRSN

SEQ ID NO: 2234349 - protein, 22 aa, Cryptosporidium parvum
LFRILFGKILCEILGMFIADRL

SEQ ID NO: 2234350 - protein, 21 aa, Cryptosporidium parvum
LFRQLLCTLITLLGVSSVWFN

SEQ ID NO: 2234351 - protein, 22 aa, Cryptosporidium parvum
LFSETAFYFSFYDDIVNSSESI

SEQ ID NO: 2234352 - protein, 26 aa, Cryptosporidium parvum
LFSKEFNGFICFYRKTGISSYQEYIS

SEQ ID NO: 2234353 - protein, 19 aa, Cryptosporidium parvum
LFSKSCLNISIIENINAMK

SEQ ID NO: 2234354 - protein, 26 aa, Cryptosporidium parvum
LFSNLIFLKEKFNLLANKFNTSLKIF

SEQ ID NO: 2234355 - protein, 20 aa, Cryptosporidium parvum
LFSVAWLKVSSPIFIAVCLA

SEQ ID NO: 2234356 - protein, 24 aa, Cryptosporidium parvum
LFSYIDFFKYFLIYFSFHMFFEYL

SEQ ID NO: 2234357 - protein, 22 aa, Cryptosporidium parvum
LFVFSWPISKFLDYFIGENGKT

SEQ ID NO: 2234358 - protein, 25 aa, Cryptosporidium parvum
LFVILQIYIKFEFAGANSVGKLGYY

SEQ ID NO: 2234359 - protein, 29 aa, Cryptosporidium parvum
LFVWQVNRAVYWAGMLQRYINKGPRLLKD

SEQ ID NO: 2234360 - protein, 19 aa, Cryptosporidium parvum
LFYIFNWIYRFYAQHYVNW

SEQ ID NO: 2234361 - protein, 28 aa, Cryptosporidium parvum
LFYIIYKYIFRYFIHSCRLLHNTYISEI

SEQ ID NO: 2234362 - protein, 17 aa, Cryptosporidium parvum
LFYILSMITKIIKDRAG

SEQ ID NO: 2234363 - protein, 17 aa, Cryptosporidium parvum
LFYKYSFNILVFLLIQI

SEQ ID NO: 2234364 - protein, 17 aa, Cryptosporidium parvum
LFYSFIVWPLCWSIITF

SEQ ID NO: 2234365 - protein, 26 aa, Cryptosporidium parvum
LFYVVFTILIGFIFIIGILGAFFYLG

SEQ ID NO: 2234366 - protein, 19 aa, Cryptosporidium parvum
LFYWLRILLPETRTNQKDK

SEQ ID NO: 2234367 - protein, 28 aa, Cryptosporidium parvum
LGACVISSLGIFCISAKGFVSVGAIAIA

SEQ ID NO: 2234368 - protein, 19 aa, Cryptosporidium parvum
LGAIKTSCGLQKWDVSTQY

SEQ ID NO: 2234369 - protein, 24 aa, Cryptosporidium parvum
LGCRPCYLMFGAVFILVLIVSMGY

SEQ ID NO: 2234370 - protein, 20 aa, Cryptosporidium parvum
LGDIRRGIHFGMLRTDASRG

SEQ ID NO: 2234371 - protein, 24 aa, Cryptosporidium parvum
LGDITLFLLRLIRFRSEEFSLYHI

SEQ ID NO: 2234372 - protein, 19 aa, Cryptosporidium parvum
LGEGWKYKSHKVLDFSGQN

SEQ ID NO: 2234373 - protein, 17 aa, Cryptosporidium parvum
LGEICVNCSQNLHNDSE

SEQ ID NO: 2234374 - protein, 17 aa, Cryptosporidium parvum
LGEKSLNIDFIDPLSHL

SEQ ID NO: 2234375 - protein, 26 aa, Cryptosporidium parvum
LGERKWDVMESIALATFHFGVKYEND

SEQ ID NO: 2234376 - protein, 25 aa, Cryptosporidium parvum
LGFDACLMMQFDVLEVMNSLANYIL

SEQ ID NO: 2234377 - protein, 17 aa, Cryptosporidium parvum
LGFKPKYDYIFNGNKDY

SEQ ID NO: 2234378 - protein, 19 aa, Cryptosporidium parvum
LGFSPTFMGSLRLTYGIAG

SEQ ID NO: 2234379 - protein, 28 aa, Cryptosporidium parvum
LGGAVLFGCSFSRVEARIQMKAYGSIVS

SEQ ID NO: 2234380 - protein, 19 aa, Cryptosporidium parvum
LGGVKKRPLVKKTPRPVFL

SEQ ID NO: 2234381 - protein, 24 aa, Cryptosporidium parvum
LGIFPHLNILFSLVTLQSKYYQSI

SEQ ID NO: 2234382 - protein, 17 aa, Cryptosporidium parvum
LGIIIGQLFSYINSPLI

SEQ ID NO: 2234383 - protein, 25 aa, Cryptosporidium parvum
LGIKVKLTSLISCAIIISGVLIGAF

SEQ ID NO: 2234384 - protein, 31 aa, Cryptosporidium parvum
LGILYKLFLEFYFKLKFIIHLIYSFINGEHL

SEQ ID NO: 2234385 - protein, 19 aa, Cryptosporidium parvum
LGLCEGNFCMGEMKGEEYG

SEQ ID NO: 2234386 - protein, 18 aa, Cryptosporidium parvum
LGLERIIQLAWEFYSNNN

SEQ ID NO: 2234387 - protein, 17 aa, Cryptosporidium parvum
LGLESLFYWKINKSRIN

SEQ ID NO: 2234388 - protein, 20 aa, Cryptosporidium parvum
LGLFLKLNQFLLLKENDIVD

SEQ ID NO: 2234389 - protein, 24 aa, Cryptosporidium parvum
LGLFSYEDFMDWHSKKGLTRRALS

SEQ ID NO: 2234390 - protein, 17 aa, Cryptosporidium parvum
LGLKQTQIISGFMESHN

SEQ ID NO: 2234391 - protein, 23 aa, Cryptosporidium parvum
LGLMGFGSCDAELYDELRNVLYM

SEQ ID NO: 2234392 - protein, 17 aa, Cryptosporidium parvum
LGLMKLYPFHLDVNGSL

SEQ ID NO: 2234393 - protein, 32 aa, Cryptosporidium parvum
LGLPSEVYIELSVGSWTYWVIPNFQKKISDSF

SEQ ID NO: 2234394 - protein, 29 aa, Cryptosporidium parvum
LGMLILAILFWFRRYKWKKNLEDDQNTEV

SEQ ID NO: 2234395 - protein, 18 aa, Cryptosporidium parvum
LGNVLFWITFCFCGQPIA

SEQ ID NO: 2234396 - protein, 26 aa, Cryptosporidium parvum
LGQGGWQPPPCYWSLMKHPAVVNSIQ

SEQ ID NO: 2234397 - protein, 23 aa, Cryptosporidium parvum
LGQKQLICLARAILRKSKIILLD

SEQ ID NO: 2234398 - protein, 25 aa, Cryptosporidium parvum
LGRKHLRLATPFSKKQWIVNKIPVN

SEQ ID NO: 2234399 - protein, 17 aa, Cryptosporidium parvum
LGSGLLFLPETLNVNDN

SEQ ID NO: 2234400 - protein, 20 aa, Cryptosporidium parvum
LGSLCGVFVGRYVSNLVSIF

SEQ ID NO: 2234401 - protein, 21 aa, Cryptosporidium parvum
LGSLFIICFLVLNYLVSDRKN

SEQ ID NO: 2234402 - protein, 18 aa, Cryptosporidium parvum
LGSNLPILYKEDGIENDT

SEQ ID NO: 2234403 - protein, 18 aa, Cryptosporidium parvum
LGSPFWMAPEIILGSGTR

SEQ ID NO: 2234404 - protein, 17 aa, Cryptosporidium parvum
LGSRAGGLITDRYLDGL

SEQ ID NO: 2234405 - protein, 19 aa, Cryptosporidium parvum
LGSSAFALFSFFDEYELVL

SEQ ID NO: 2234406 - protein, 17 aa, Cryptosporidium parvum
LGSSPEYILLIQVFVWL

SEQ ID NO: 2234407 - protein, 18 aa, Cryptosporidium parvum
LGVCWGILVETDIYMDTI

SEQ ID NO: 2234408 - protein, 21 aa, Cryptosporidium parvum
LGVQISWRLVFFIEYLGPIII

SEQ ID NO: 2234409 - protein, 29 aa, Cryptosporidium parvum
LGVQLPIRLTLKMIYELSVFANHSSLLRR

SEQ ID NO: 2234410 - protein, 19 aa, Cryptosporidium parvum
LGVSCFCLNLQKSLSTIDS

SEQ ID NO: 2234411 - protein, 28 aa, Cryptosporidium parvum
LGYGDFSIRFFSIFSVIVNYFFIFIILF

SEQ ID NO: 2234412 - protein, 20 aa, Cryptosporidium parvum
LGYPKAYTIRTWNSNRNKTL

SEQ ID NO: 2234413 - protein, 26 aa, Cryptosporidium parvum
LHDLEHSRPWYVGECITVNSMIPKMD

SEQ ID NO: 2234414 - protein, 25 aa, Cryptosporidium parvum
LHEIRGSSFMTVWNMKISKENSNEN

SEQ ID NO: 2234415 - protein, 23 aa, Cryptosporidium parvum
LHFNSLRKYVCMASEIFDNWITL

SEQ ID NO: 2234416 - protein, 22 aa, Cryptosporidium parvum
LHGIAECMYSIYQKNGICGLYS

SEQ ID NO: 2234417 - protein, 28 aa, Cryptosporidium parvum
LHGLCSSAVEWERFLILVNKKDFLPNTK

SEQ ID NO: 2234418 - protein, 21 aa, Cryptosporidium parvum
LHGPDLGKLIEIRKCVSSQDC

SEQ ID NO: 2234419 - protein, 22 aa, Cryptosporidium parvum
LHILLWPHLIHFIYELLPVAIT

SEQ ID NO: 2234420 - protein, 19 aa, Cryptosporidium parvum
LHIRCIPGWEQDESLKSKL

SEQ ID NO: 2234421 - protein, 26 aa, Cryptosporidium parvum
LHKLGESWWKLGAIERSQSVYSKLIT

SEQ ID NO: 2234422 - protein, 32 aa, Cryptosporidium parvum; identical to SEQ ID NO: 2125315

SEQ ID NO: 2234423 - protein, 22 aa, Cryptosporidium parvum
LHLEYKKVFKLFVIGDLGKEES

SEQ ID NO: 2234424 - protein, 25 aa, Cryptosporidium parvum
LHLGCPGPCEFSEWSGWSLCSYYKN

SEQ ID NO: 2234425 - protein, 17 aa, Cryptosporidium parvum
LHLIVPIYLKYLRHKNI

SEQ ID NO: 2234426 - protein, 39 aa, Cryptosporidium parvum
LHLKRRLTKRLGIKLLKLLRLLLEFTKEYGYIKDIESNS

SEQ ID NO: 2234427 - protein, 18 aa, Cryptosporidium parvum
LHLPNLILDIWKTFDDLQ

SEQ ID NO: 2234428 - protein, 23 aa, Cryptosporidium parvum
LHLWLNLTIIWVWNLIYFLKKFN

SEQ ID NO: 2234429 - protein, 17 aa, Cryptosporidium parvum
LHMAIFLAIFMNKTQNS

SEQ ID NO: 2234430 - protein, 28 aa, Cryptosporidium parvum
LHMDRFSYKHIHRYLKLNSARLCQKLSL

SEQ ID NO: 2234431 - protein, 25 aa, Cryptosporidium parvum
LHNHGIEIVNWLKHLFDINSKVSRS

SEQ ID NO: 2234432 - protein, 23 aa, Cryptosporidium parvum
LHNKRYAHIFSIILMGASVLFIK

SEQ ID NO: 2234433 - protein, 19 aa, Cryptosporidium parvum
LHSALCINHIIIIWLILFI

SEQ ID NO: 2234434 - protein, 18 aa, Cryptosporidium parvum
LHTAWGYPLPSSPLKKSD

SEQ ID NO: 2234435 - protein, 18 aa, Cryptosporidium parvum
LHTTRFLILVLVILSNIG

SEQ ID NO: 2234436 - protein, 25 aa, Cryptosporidium parvum
LHYIGHSLPFPVVIYLLSNQFSSEK

SEQ ID NO: 2234437 - protein, 20 aa, Cryptosporidium parvum
LHYLDWLKTLAVWLVVFVHV

SEQ ID NO: 2234438 - protein, 18 aa, Cryptosporidium parvum
LIAAFIRMLLILQERNKE

SEQ ID NO: 2234439 - protein, 23 aa, Cryptosporidium parvum
LIAALPGIITFLFFFISSFGFQV

SEQ ID NO: 2234440 - protein, 24 aa, Cryptosporidium parvum
LIAIPLFMPCNGRVAWGKEHGKVF

SEQ ID NO: 2234441 - protein, 18 aa, Cryptosporidium parvum
LIALAFPFTQEFWKVHGV

SEQ ID NO: 2234442 - protein, 18 aa, Cryptosporidium parvum
LIALFSCFTIAAITQYLS

SEQ ID NO: 2234443 - protein, 17 aa, Cryptosporidium parvum
LIALLSIILRLTNDLNM

SEQ ID NO: 2234444 - protein, 17 aa, Cryptosporidium parvum
LIALPILCLCIPAKILE

SEQ ID NO: 2234445 - protein, 24 aa, Cryptosporidium parvum
LIASSGFCNLMLYYDNQYVSNSLL

SEQ ID NO: 2234446 - protein, 19 aa, Cryptosporidium parvum
LIDNCRRLQSEYKYLTKKL

SEQ ID NO: 2234447 - protein, 24 aa, Cryptosporidium parvum
LIDPRQMEHWENLHGMLYEDNKTA

SEQ ID NO: 2234448 - protein, 29 aa, Cryptosporidium parvum
LIEEFFYSGAFELCCEFLRIKGENDMKTM

SEQ ID NO: 2234449 - protein, 18 aa, Cryptosporidium parvum
LIEEYIRCNNSCPITKSE

SEQ ID NO: 2234450 - protein, 17 aa, Cryptosporidium parvum
LIEGCNDLGGVRLISNV

SEQ ID NO: 2234451 - protein, 24 aa, Cryptosporidium parvum
LIEGIICSVEYCQCLQYTMSSSGL

SEQ ID NO: 2234452 - protein, 24 aa, Cryptosporidium parvum
LIEICKYPQFIVEIFQNYDCNIYC

SEQ ID NO: 2234453 - protein, 19 aa, Cryptosporidium parvum
LIELSLFAIIEWISNCLSN

SEQ ID NO: 2234454 - protein, 19 aa, Cryptosporidium parvum
LIERHRLILINYYSYLGRY

SEQ ID NO: 2234455 - protein, 25 aa, Cryptosporidium parvum
LIEVYIPPFICNHFIRKDSDSEEKE

SEQ ID NO: 2234456 - protein, 19 aa, Cryptosporidium parvum
LIFCFGSDVLFNISIALLD

SEQ ID NO: 2234457 - protein, 18 aa, Cryptosporidium parvum
LIFDEINMNFGINGEEIL

SEQ ID NO: 2234458 - protein, 25 aa, Cryptosporidium parvum
LIFFFKNAYKFICRITDLVTLQQKI

SEQ ID NO: 2234459 - protein, 19 aa, Cryptosporidium parvum
LIFFYYLEWETGSRLSYLK

SEQ ID NO: 2234460 - protein, 26 aa, Cryptosporidium parvum
LIFIPCLLCFYSYYPKFEFIIEITIM

SEQ ID NO: 2234461 - protein, 22 aa, Cryptosporidium parvum
LIFNILRPLKINFFELLIEAIM

SEQ ID NO: 2234462 - protein, 18 aa, Cryptosporidium parvum
LIFPKIGQFFYGKRLYSL

SEQ ID NO: 2234463 - protein, 18 aa, Cryptosporidium parvum
LIFSCSFAIKYRPLVFDN

SEQ ID NO: 2234464 - protein, 24 aa, Cryptosporidium parvum
LIFTLWEFFWFLSVKISRKHATSI

SEQ ID NO: 2234465 - protein, 18 aa, Cryptosporidium parvum
LIGIKYLKQVKWTWSNVI

SEQ ID NO: 2234466 - protein, 25 aa, Cryptosporidium parvum
LIGIQCFIFLIFLILVIYNFYRKRL

SEQ ID NO: 2234467 - protein, 20 aa, Cryptosporidium parvum
LIGLVPMLLSVVKYKFTNPN

SEQ ID NO: 2234468 - protein, 22 aa, Cryptosporidium parvum
LIGSSLAGFVGRLILHPFDTLK

SEQ ID NO: 2234469 - protein, 22 aa, Cryptosporidium parvum
LIGYCIPTYFILFTDYVEELFI

SEQ ID NO: 2234470 - protein, 26 aa, Cryptosporidium parvum
LIGYRCFIEAGMLRSFVFSILPSNQA

SEQ ID NO: 2234471 - protein, 23 aa, Cryptosporidium parvum
LIHLLRKLLTWNIEQKNDLLEIL

SEQ ID NO: 2234472 - protein, 19 aa, Cryptosporidium parvum
LIICIWNVNIGFGHNDDPA

SEQ ID NO: 2234473 - protein, 25 aa, Cryptosporidium parvum
LIIDFLKQMLFLRGFFALTKDSILM

SEQ ID NO: 2234474 - protein, 24 aa, Cryptosporidium parvum
LIIDSSIRLKFWEYLFEELIPVIQ

SEQ ID NO: 2234475 - protein, 17 aa, Cryptosporidium parvum
LIIGLYLFDSNETSWIL

SEQ ID NO: 2234476 - protein, 18 aa, Cryptosporidium parvum
LIIICISLPFTECERIHE

SEQ ID NO: 2234477 - protein, 19 aa, Cryptosporidium parvum
LIILIKYIISIGIIEEACK

SEQ ID NO: 2234478 - protein, 18 aa, Cryptosporidium parvum
LIILKRWIYYLFYSTLSW

SEQ ID NO: 2234479 - protein, 23 aa, Cryptosporidium parvum
LIINCIFGILFILFKQGIIVRWI

SEQ ID NO: 2234480 - protein, 18 aa, Cryptosporidium parvum
LIINEYIDLVIISHYHLD

SEQ ID NO: 2234481 - protein, 24 aa, Cryptosporidium parvum
LIIPFRMILVITMLTRTMGDSVLS

SEQ ID NO: 2234482 - protein, 24 aa, Cryptosporidium parvum
LIIPRLCNSFHIFIKMDSLFSRIN

SEQ ID NO: 2234483 - protein, 26 aa, Cryptosporidium parvum
LIISCIIGGFCFCGATGANRNHGNMP

SEQ ID NO: 2234484 - protein, 18 aa, Cryptosporidium parvum
LIIWCTTSSILSLFNTLF

SEQ ID NO: 2234485 - protein, 17 aa, Cryptosporidium parvum
LIKEYIYDFYIEDSEVF

SEQ ID NO: 2234486 - protein, 25 aa, Cryptosporidium parvum
LIKFKRPSHSYGLFEEDYDINNYHH

SEQ ID NO: 2234487 - protein, 18 aa, Cryptosporidium parvum
LIKGELWVQTKNRNNGYC

SEQ ID NO: 2234488 - protein, 26 aa, Cryptosporidium parvum
LIKNNEFRSSGILEYISPYSPLIILS

SEQ ID NO: 2234489 - protein, 17 aa, Cryptosporidium parvum
LIKSLIFSWKIFSERMD

SEQ ID NO: 2234490 - protein, 26 aa, Cryptosporidium parvum
LIKYTSLPLDWIFKGLKNQSYDHNIP

SEQ ID NO: 2234491 - protein, 17 aa, Cryptosporidium parvum
LILCYFNEFSQLITKSL

SEQ ID NO: 2234492 - protein, 24 aa, Cryptosporidium parvum
LILDNIRVLWDYRQKTLGMEVTMD

SEQ ID NO: 2234493 - protein, 19 aa, Cryptosporidium parvum
LILDPQWWTDVNISDSARH

SEQ ID NO: 2234494 - protein, 19 aa, Cryptosporidium parvum
LILEKCIDDILYLKKYNKE

SEQ ID NO: 2234495 - protein, 17 aa, Cryptosporidium parvum
LILESITSFGMSIIFYI

SEQ ID NO: 2234496 - protein, 18 aa, Cryptosporidium parvum
LILEWFIVLVTKFLISYL

SEQ ID NO: 2234497 - protein, 23 aa, Cryptosporidium parvum
LILFSIILIIGWVESSSNSLQME

SEQ ID NO: 2234498 - protein, 18 aa, Cryptosporidium parvum
LILIRFTFIFDYEIQQIL

SEQ ID NO: 2234499 - protein, 17 aa, Cryptosporidium parvum
LILIYIFVGITFITVGI

SEQ ID NO: 2234500 - protein, 23 aa, Cryptosporidium parvum
LILKFWFKRFRLTSNNFFDEYSS

SEQ ID NO: 2234501 - protein, 20 aa, Cryptosporidium parvum
LILLSFSFVWFFKTLSFHHV

SEQ ID NO: 2234502 - protein, 17 aa, Cryptosporidium parvum
LILLWTLDNGIIGVFCK

SEQ ID NO: 2234503 - protein, 18 aa, Cryptosporidium parvum
LILMPSISSVIIVIIILC

SEQ ID NO: 2234504 - protein, 24 aa, Cryptosporidium parvum
LILQELKPRLGTIQSNGSVFYCSQ

SEQ ID NO: 2234505 - protein, 19 aa, Cryptosporidium parvum
LILSDIWIHSIRCFRSNDL

SEQ ID NO: 2234506 - protein, 18 aa, Cryptosporidium parvum
LILTCLIATYLAFLSFST

SEQ ID NO: 2234507 - protein, 27 aa, Cryptosporidium parvum
LILTLSFMKFFYVFCFDESSNSIKESL

SEQ ID NO: 2234508 - protein, 20 aa, Cryptosporidium parvum
LILVIYNFYRKRLLRKRLMN

SEQ ID NO: 2234509 - protein, 25 aa, Cryptosporidium parvum
LILYFLEPFFETFFYLRETLDKCAY

SEQ ID NO: 2234510 - protein, 25 aa, Cryptosporidium parvum
LIMNIKIFFFFILKLYQFIRFPLNV

SEQ ID NO: 2234511 - protein, 21 aa, Cryptosporidium parvum
LIMSRKLYSRFEELLPIVEQV

SEQ ID NO: 2234512 - protein, 17 aa, Cryptosporidium parvum
LINFLRGSVLSNKQIYC

SEQ ID NO: 2234513 - protein, 18 aa, Cryptosporidium parvum
LININRINLYLVLNNGNN

SEQ ID NO: 2234514 - protein, 22 aa, Cryptosporidium parvum
LINISEKFLLITAINLIGIIYT

SEQ ID NO: 2234515 - protein, 23 aa, Cryptosporidium parvum
LINLSGCLLRLGMPSDYPNAVMR

SEQ ID NO: 2234516 - protein, 24 aa, Cryptosporidium parvum
LINLSKRLSFIIDLIISKSTESQL

SEQ ID NO: 2234517 - protein, 24 aa, Cryptosporidium parvum
LINNLSILLVWNFLEINDTTAFEF

SEQ ID NO: 2234518 - protein, 22 aa, Cryptosporidium parvum
LINSGIPCFRGETIKKLKERLL

SEQ ID NO: 2234519 - protein, 18 aa, Cryptosporidium parvum
LIPEMTILISIRELNGNN

SEQ ID NO: 2234520 - protein, 18 aa, Cryptosporidium parvum
LIPFINVEVLIIFANKVL

SEQ ID NO: 2234521 - protein, 19 aa, Cryptosporidium parvum
LIPMGSMVFHSLLLLIASV

SEQ ID NO: 2234522 - protein, 17 aa, Cryptosporidium parvum
LIPRYAGIFDCLRRVSK

SEQ ID NO: 2234523 - protein, 23 aa, Cryptosporidium parvum
LIPSEYLLYLIFRISSESYSDSL

SEQ ID NO: 2234524 - protein, 21 aa, Cryptosporidium parvum
LIQICICIFYAIPLILIYEML

SEQ ID NO: 2234525 - protein, 17 aa, Cryptosporidium parvum
LIQKNHRTTTLKVPIYN

SEQ ID NO: 2234526 - protein, 18 aa, Cryptosporidium parvum
LIQLRDIICFLSSIQDEL

SEQ ID NO: 2234527 - protein, 21 aa, Cryptosporidium parvum
LIQMSFWPWNFLITTTLQLIF

SEQ ID NO: 2234528 - protein, 18 aa, Cryptosporidium parvum
LIQSMLVFPEFVSLLKEN

SEQ ID NO: 2234529 - protein, 23 aa, Cryptosporidium parvum
LIRIIFFLVYFFIYGGFVYSFSF

SEQ ID NO: 2234530 - protein, 27 aa, Cryptosporidium parvum
LIRIQRLEIFDGLYLFFNTNDQIIPRI

SEQ ID NO: 2234531 - protein, 19 aa, Cryptosporidium parvum
LIRIWDISPAIGRDPLFVD

SEQ ID NO: 2234532 - protein, 18 aa, Cryptosporidium parvum
LIRKEARFLTHLTGKSLC

SEQ ID NO: 2234533 - protein, 17 aa, Cryptosporidium parvum
LIRKHLKQFADINKEGT

SEQ ID NO: 2234534 - protein, 17 aa, Cryptosporidium parvum
LIRRSLITLIFIQGVLV

SEQ ID NO: 2234535 - protein, 24 aa, Cryptosporidium parvum
LIRYYENYTRMGLGKVLNMNMNKN

SEQ ID NO: 2234536 - protein, 19 aa, Cryptosporidium parvum
LISDCSFISPFISAALSSN

SEQ ID NO: 2234537 - protein, 24 aa, Cryptosporidium parvum
LISDSKLTLTRYIGMNPQKVKITL

SEQ ID NO: 2234538 - protein, 25 aa, Cryptosporidium parvum
LISGVDPRWITPLIQGYFCNQAIII

SEQ ID NO: 2234539 - protein, 26 aa, Cryptosporidium parvum
LISIFSFELLYYIFLKNERFPVKTYK

SEQ ID NO: 2234540 - protein, 23 aa, Cryptosporidium parvum
LISKKWVKLIPNFKVLNKSLNIL

SEQ ID NO: 2234541 - protein, 19 aa, Cryptosporidium parvum
LISMTFRRVVHWKTSAISF

SEQ ID NO: 2234542 - protein, 20 aa, Cryptosporidium parvum
LISNRISYNLGLNGPSMTVD

SEQ ID NO: 2234543 - protein, 21 aa, Cryptosporidium parvum
LISRIPILLRRMVLYSEIGDI

SEQ ID NO: 2234544 - protein, 17 aa, Cryptosporidium parvum
LISSNIFIERSIDKNNT

SEQ ID NO: 2234545 - protein, 23 aa, Cryptosporidium parvum
LISSSLRLLASISSLSKIHKQEI

SEQ ID NO: 2234546 - protein, 19 aa, Cryptosporidium parvum
LISTLGYKYTSIVLCDFAL

SEQ ID NO: 2234547 - protein, 25 aa, Cryptosporidium parvum
LISVCFIVFVNICYILYKNSSIERY

SEQ ID NO: 2234548 - protein, 23 aa, Cryptosporidium parvum
LITCKCLGCKINPNFRKKSNALN

SEQ ID NO: 2234549 - protein, 18 aa, Cryptosporidium parvum
LITNEYYGILLFNQIQPY

SEQ ID NO: 2234550 - protein, 17 aa, Cryptosporidium parvum
LITSIKPFIIRKIIEMI

SEQ ID NO: 2234551 - protein, 26 aa, Cryptosporidium parvum
LITVMCLTNLLGLKDKFFLIFYSSQV

SEQ ID NO: 2234552 - protein, 18 aa, Cryptosporidium parvum
LITYDMINRLLISQISSK

SEQ ID NO: 2234553 - protein, 17 aa, Cryptosporidium parvum
LIVCTLALLIIGIIIII

SEQ ID NO: 2234554 - protein, 25 aa, Cryptosporidium parvum
LIVHWDLSKDSGFEVLKNLRKRFYS

SEQ ID NO: 2234555 - protein, 21 aa, Cryptosporidium parvum
LIVPIYLKYLRHKNINGNSKN

SEQ ID NO: 2234556 - protein, 18 aa, Cryptosporidium parvum
LIVTCTWAFQFEPLLESN

SEQ ID NO: 2234557 - protein, 24 aa, Cryptosporidium parvum
LIVTGEIRFFFILFDINQGIFKIC

SEQ ID NO: 2234558 - protein, 17 aa, Cryptosporidium parvum
LIYCLLMVLLYDSLLDF

SEQ ID NO: 2234559 - protein, 27 aa, Cryptosporidium parvum
LIYCLWAGQISLLWKLQLTLNKEENGY

SEQ ID NO: 2234560 - protein, 20 aa, Cryptosporidium parvum
LIYCSYCSIQRAGVKQINTL

SEQ ID NO: 2234561 - protein, 28 aa, Cryptosporidium parvum
LIYDIIQMCRPWQIHGVLYWIGDPNGSK

SEQ ID NO: 2234562 - protein, 24 aa, Cryptosporidium parvum
LIYGEAIGLLGYMHALGIGTSPDL

SEQ ID NO: 2234563 - protein, 17 aa, Cryptosporidium parvum
LIYGNGFHLYKKLDLSS

SEQ ID NO: 2234564 - protein, 25 aa, Cryptosporidium parvum
LIYILLFEIIYGWLLNFDIVPNSIS

SEQ ID NO: 2234565 - protein, 22 aa, Cryptosporidium parvum
LIYKALKFKLPAPRVQQIISEA

SEQ ID NO: 2234566 - protein, 17 aa, Cryptosporidium parvum
LIYRLASFHPSIIFVLD

SEQ ID NO: 2234567 - protein, 19 aa, Cryptosporidium parvum
LIYRYLDIMNIPERRFVNQ

SEQ ID NO: 2234568 - protein, 23 aa, Cryptosporidium parvum
LKAAVFENVDWIILVTHYSIYSS

SEQ ID NO: 2234569 - protein, 19 aa, Cryptosporidium parvum
LKAGFPHIVLTTLLNANKI

SEQ ID NO: 2234570 - protein, 21 aa, Cryptosporidium parvum
LKALDLISAQVLHKKGCEIID

SEQ ID NO: 2234571 - protein, 18 aa, Cryptosporidium parvum
LKALIALHRRTGEFDNAP

SEQ ID NO: 2234572 - protein, 19 aa, Cryptosporidium parvum
LKAPLYFQLLPARLLITYI

SEQ ID NO: 2234573 - protein, 25 aa, Cryptosporidium parvum
LKASNICNFYFGKVICTWIENKEYI

SEQ ID NO: 2234574 - protein, 19 aa, Cryptosporidium parvum
LKASTRFGLLPIKTIQMLK

SEQ ID NO: 2234575 - protein, 19 aa, Cryptosporidium parvum
LKAVGGFGAGQAESSTEGS

SEQ ID NO: 2234576 - protein, 21 aa, Cryptosporidium parvum
LKCKLRRGLINRLIEHTRVLA

SEQ ID NO: 2234577 - protein, 22 aa, Cryptosporidium parvum
LKCNICDLNSLFNIINKIKGKY

SEQ ID NO: 2234578 - protein, 27 aa, Cryptosporidium parvum
LKCPILMVLHIWKAYVYFNYKENNLEL

SEQ ID NO: 2234579 - protein, 19 aa, Cryptosporidium parvum
LKDEFVSICLVRDIHNSKE

SEQ ID NO: 2234580 - protein, 17 aa, Cryptosporidium parvum
LKDEGNWGIYHEIGHNR

SEQ ID NO: 2234581 - protein, 19 aa, Cryptosporidium parvum
LKDPFFRQEMSPILRIKWL

SEQ ID NO: 2234582 - protein, 27 aa, Cryptosporidium parvum
LKDQLPLCYSISMTIELIRLMVEQDIG

SEQ ID NO: 2234583 - protein, 25 aa, Cryptosporidium parvum
LKDRPSVLEFNKWVKLSGGRVRGTK

SEQ ID NO: 2234584 - protein, 29 aa, Cryptosporidium parvum
LKDYSIIWKLCLIFLLGATDSQLSFMRSQ

SEQ ID NO: 2234585 - protein, 18 aa, Cryptosporidium parvum
LKEAFGEDIVIPLLIMTS

SEQ ID NO: 2234586 - protein, 23 aa, Cryptosporidium parvum
LKEELLRSMTLCYTNIGNPQIIR

SEQ ID NO: 2234587 - protein, 29 aa, Cryptosporidium parvum
LKEFLINYYAKIIWSPVIFILTTNKTASS

SEQ ID NO: 2234588 - protein, 39 aa, Cryptosporidium parvum
LKEINYLNICYWIQFIGWLCSSKGIYLSRFISSIIELSK

SEQ ID NO: 2234589 - protein, 17 aa, Cryptosporidium parvum
LKELLGFDDNVSDENDD

SEQ ID NO: 2234590 - protein, 20 aa, Cryptosporidium parvum
LKELNYLKEILVFKFTTKDE

SEQ ID NO: 2234591 - protein, 24 aa, Cryptosporidium parvum
LKENIMEFHIKKNLDLEFFTSRIQ

SEQ ID NO: 2234592 - protein, 23 aa, Cryptosporidium parvum
LKERKWLKFINNLIIIIDKLLGE

SEQ ID NO: 2234593 - protein, 23 aa, Cryptosporidium parvum
LKESEIWIQMLIGFVTVVKATVG

SEQ ID NO: 2234594 - protein, 34 aa, Cryptosporidium parvum; identical to SEQ ID NO: 2176340

SEQ ID NO: 2234595 - protein, 24 aa, Cryptosporidium parvum
LKEYEFKFKVDRIIDQEHKLIREL

SEQ ID NO: 2234596 - protein, 25 aa, Cryptosporidium parvum
LKFFIQEIFLSLGILIGNIEVEHIT

SEQ ID NO: 2234597 - protein, 18 aa, Cryptosporidium parvum
LKFLGGYSNSYWVFQKLL

SEQ ID NO: 2234598 - protein, 17 aa, Cryptosporidium parvum
LKFPELEKSGILEQYSD

SEQ ID NO: 2234599 - protein, 20 aa, Cryptosporidium parvum
LKFQIELACTNFDFCNQETN

SEQ ID NO: 2234600 - protein, 24 aa, Cryptosporidium parvum
LKGKGLRIYKPLIKVFWFQCLMVL

SEQ ID NO: 2234601 - protein, 21 aa, Cryptosporidium parvum
LKGKIGDPFFIQVINDEKFIK

SEQ ID NO: 2234602 - protein, 18 aa, Cryptosporidium parvum
LKGTKIGDSCLVESFIDV

SEQ ID NO: 2234603 - protein, 19 aa, Cryptosporidium parvum
LKGTLFYFGGLFVIIVKST

SEQ ID NO: 2234604 - protein, 26 aa, Cryptosporidium parvum
LKHILKCKPFEWYIGKFRPAFERQGE

SEQ ID NO: 2234605 - protein, 17 aa, Cryptosporidium parvum
LKHLFDINSKVSRSSVI

SEQ ID NO: 2234606 - protein, 23 aa, Cryptosporidium parvum
LKHLMKQSCSPFIKDIHKCIGEL

SEQ ID NO: 2234607 - protein, 19 aa, Cryptosporidium parvum
LKHNLCDINDAIINKEEIS

SEQ ID NO: 2234608 - protein, 17 aa, Cryptosporidium parvum
LKHSNKFLLIFNQSENL

SEQ ID NO: 2234609 - protein, 20 aa, Cryptosporidium parvum
LKHYLTILLHMDRFSYKHIH

SEQ ID NO: 2234610 - protein, 22 aa, Cryptosporidium parvum
LKIDRLRDVFDQCLESLISWKK

SEQ ID NO: 2234611 - protein, 20 aa, Cryptosporidium parvum
LKIGKPLYIRTLKISDIIVT

SEQ ID NO: 2234612 - protein, 30 aa, Cryptosporidium parvum
LKIIKNNCELLIFTSFRFYVYILVELKKKK

SEQ ID NO: 2234613 - protein, 22 aa, Cryptosporidium parvum
LKIISRAAAKVREMETSRQPFM

SEQ ID NO: 2234614 - protein, 21 aa, Cryptosporidium parvum
LKILPKIVGLPSYLSRLPSFS

SEQ ID NO: 2234615 - protein, 24 aa, Cryptosporidium parvum
LKILPQDIMIRIGMTNPPYILDQI

SEQ ID NO: 2234616 - protein, 19 aa, Cryptosporidium parvum
LKIMPEIDLELLIDEHSQR

SEQ ID NO: 2234617 - protein, 22 aa, Cryptosporidium parvum
LKINFLPFIFRNIASYIVMNSI

SEQ ID NO: 2234618 - protein, 20 aa, Cryptosporidium parvum
LKIPKWPKRLCVTSNQNFDE

SEQ ID NO: 2234619 - protein, 19 aa, Cryptosporidium parvum
LKISFGHIRMNIWQVLIRF

SEQ ID NO: 2234620 - protein, 23 aa, Cryptosporidium parvum
LKKADDIESIFSFDKKIGEGSFG

SEQ ID NO: 2234621 - protein, 17 aa, Cryptosporidium parvum
LKKCHQENLELLSKKKA

SEQ ID NO: 2234622 - protein, 27 aa, Cryptosporidium parvum
LKKEILELPPSLWYVVLPQLLSRCQHP

SEQ ID NO: 2234623 - protein, 21 aa, Cryptosporidium parvum
LKKENIFNFPILIQEYNFDNL

SEQ ID NO: 2234624 - protein, 21 aa, Cryptosporidium parvum
LKKFKESFGIGSEYVKGVSLI

SEQ ID NO: 2234625 - protein, 17 aa, Cryptosporidium parvum
LKKGIYGLDCGDISLEL

SEQ ID NO: 2234626 - protein, 19 aa, Cryptosporidium parvum
LKKIFEMFVELQIINQDLK

SEQ ID NO: 2234627 - protein, 24 aa, Cryptosporidium parvum
LKKKCIIGLLLHSVWMKMKSQEEC

SEQ ID NO: 2234628 - protein, 21 aa, Cryptosporidium parvum
LKKKLIFHSRLLNTLVIILIG

SEQ ID NO: 2234629 - protein, 25 aa, Cryptosporidium parvum
LKKKLKCKPFRWFLDNVAPETYITQ

SEQ ID NO: 2234630 - protein, 20 aa, Cryptosporidium parvum
LKKLFKRVLTSLVKDDEFTK

SEQ ID NO: 2234631 - protein, 25 aa, Cryptosporidium parvum
LKKLGGISELSSFCIISRNNEEIII

SEQ ID NO: 2234632 - protein, 22 aa, Cryptosporidium parvum
LKKLYLEILRRYYLKIFEEKKS

SEQ ID NO: 2234633 - protein, 21 aa, Cryptosporidium parvum
LKKRDIFKLFNHLHCICQFNP

SEQ ID NO: 2234634 - protein, 23 aa, Cryptosporidium parvum
LKKRQNFVVSVLFILFVVIIIYI

SEQ ID NO: 2234635 - protein, 18 aa, Cryptosporidium parvum
LKKTGFSGSGPRSDSASA

SEQ ID NO: 2234636 - protein, 32 aa, Cryptosporidium parvum
LKKYDNISGFEFFLSKISIRFQSWKLKFILYE

SEQ ID NO: 2234637 - protein, 24 aa, Cryptosporidium parvum
LKLCLSRLTFNLYRLAVFCQTAIK

SEQ ID NO: 2234638 - protein, 17 aa, Cryptosporidium parvum
LKLDHCVLNGPENHSSI

SEQ ID NO: 2234639 - protein, 22 aa, Cryptosporidium parvum
LKLENFWTKFWLWPNQLFLTYT

SEQ ID NO: 2234640 - protein, 21 aa, Cryptosporidium parvum
LKLFMLRNLSVIKMTAFAFAL

SEQ ID NO: 2234641 - protein, 18 aa, Cryptosporidium parvum
LKLFYIIIVICITSIIYF

SEQ ID NO: 2234642 - protein, 19 aa, Cryptosporidium parvum
LKLGADLCHIFCTPEAAIP

SEQ ID NO: 2234643 - protein, 18 aa, Cryptosporidium parvum
LKLHPAISVTILGFGYTL

SEQ ID NO: 2234644 - protein, 18 aa, Cryptosporidium parvum
LKLIISLDSLDILFRIIV

SEQ ID NO: 2234645 - protein, 32 aa, Cryptosporidium parvum
LKLILSLFFCLLLIWSRIIYKPWINTEEVADT

SEQ ID NO: 2234646 - protein, 24 aa, Cryptosporidium parvum
LKLKEVGTLFGFDARLLNFDLKIF

SEQ ID NO: 2234647 - protein, 17 aa, Cryptosporidium parvum
LKLKLRWVSSSIINRSL

SEQ ID NO: 2234648 - protein, 22 aa, Cryptosporidium parvum
LKLKYSGPVKRIFSRENNGLTV

SEQ ID NO: 2234649 - protein, 21 aa, Cryptosporidium parvum
LKLLFYFTVTALIYNKANAET

SEQ ID NO: 2234650 - protein, 25 aa, Cryptosporidium parvum
LKLLKELFNAVLYLFNPCWTFTLSS

SEQ ID NO: 2234651 - protein, 24 aa, Cryptosporidium parvum
LKLLLDFLDYTVFLYGDFSAGSCP

SEQ ID NO: 2234652 - protein, 21 aa, Cryptosporidium parvum
LKLLSPEIIKQIMLANKIVLN

SEQ ID NO: 2234653 - protein, 21 aa, Cryptosporidium parvum
LKLLTRKKIYNQLCEPDFKKP

SEQ ID NO: 2234654 - protein, 19 aa, Cryptosporidium parvum
LKLLTSLFMIFQISGGNSF

SEQ ID NO: 2234655 - protein, 17 aa, Cryptosporidium parvum
LKLLVYIYTKWTKTRGD

SEQ ID NO: 2234656 - protein, 18 aa, Cryptosporidium parvum
LKLSKLVNYNKKRLSRPL

SEQ ID NO: 2234657 - protein, 21 aa, Cryptosporidium parvum
LKLYMDYLLGIKYKGKNIKAS

SEQ ID NO: 2234658 - protein, 20 aa, Cryptosporidium parvum
LKMAGWQLNLDWQTYNLKCM

SEQ ID NO: 2234659 - protein, 18 aa, Cryptosporidium parvum
LKMLKAIGLVPIKNSLGL

SEQ ID NO: 2234660 - protein, 20 aa, Cryptosporidium parvum
LKMLYNWDLWGPCIILLVLS

SEQ ID NO: 2234661 - protein, 19 aa, Cryptosporidium parvum
LKMSLFAYFALKKAESYDF

SEQ ID NO: 2234662 - protein, 25 aa, Cryptosporidium parvum
LKNAELLKPFFGSKFHIILNRTSIS

SEQ ID NO: 2234663 - protein, 21 aa, Cryptosporidium parvum
LKNEIEIYDFIPLDKNLNEYP

SEQ ID NO: 2234664 - protein, 20 aa, Cryptosporidium parvum
LKNEIFSEILLLLDNMLSEL

SEQ ID NO: 2234665 - protein, 20 aa, Cryptosporidium parvum
LKNGILLFGVIIRILKGERS

SEQ ID NO: 2234666 - protein, 25 aa, Cryptosporidium parvum
LKNHKRLKISAMKFVDLASLLDIPE

SEQ ID NO: 2234667 - protein, 17 aa, Cryptosporidium parvum
LKNKLYIERSVMESLNL

SEQ ID NO: 2234668 - protein, 17 aa, Cryptosporidium parvum
LKNKVDITYSYKAVLNS

SEQ ID NO: 2234669 - protein, 17 aa, Cryptosporidium parvum
LKNNLTQQFPFNGSLLL

SEQ ID NO: 2234670 - protein, 24 aa, Cryptosporidium parvum
LKNQGCSINSWYLGEINEEGRPHG

SEQ ID NO: 2234671 - protein, 19 aa, Cryptosporidium parvum
LKNTFEIIAKIFPSHPALV

SEQ ID NO: 2234672 - protein, 25 aa, Cryptosporidium parvum
LKPFRDFCLEWAKFLTVPAGKGTLY

SEQ ID NO: 2234673 - protein, 17 aa, Cryptosporidium parvum
LKPGYQIEGELGSSSKK

SEQ ID NO: 2234674 - protein, 22 aa, Cryptosporidium parvum
LKPHPDGLILGGIVPNGNIVDI

SEQ ID NO: 2234675 - protein, 34 aa, Cryptosporidium parvum
LKPLLSINLKKYFRFTAVELTDFSRFLVLLLSIY

SEQ ID NO: 2234676 - protein, 17 aa, Cryptosporidium parvum
LKPLLSPSEKVYGRLSR

SEQ ID NO: 2234677 - protein, 17 aa, Cryptosporidium parvum
LKPPILPHISCPICKVW

SEQ ID NO: 2234678 - protein, 20 aa, Cryptosporidium parvum
LKPPKIITGKITYKLPKKIK

SEQ ID NO: 2234679 - protein, 20 aa, Cryptosporidium parvum
LKPRAMRGITSNGMLLCASS

SEQ ID NO: 2234680 - protein, 20 aa, Cryptosporidium parvum
LKQGAFRNVACSYNYHPVSP

SEQ ID NO: 2234681 - protein, 19 aa, Cryptosporidium parvum
LKQKCLVKLKDNRILNSEN

SEQ ID NO: 2234682 - protein, 19 aa, Cryptosporidium parvum
LKQKIFRFLDFGKQTYGGE

SEQ ID NO: 2234683 - protein, 26 aa, Cryptosporidium parvum
LKQQEYRLVTNLGRYSKCLVSGVLYR

SEQ ID NO: 2234684 - protein, 25 aa, Cryptosporidium parvum
LKRIRLKHIFLIFIFTVLYVSCFLM

SEQ ID NO: 2234685 - protein, 20 aa, Cryptosporidium parvum
LKRSFAVIILLFEFDIKLLS

SEQ ID NO: 2234686 - protein, 20 aa, Cryptosporidium parvum
LKRYRSINIQKLFDQLILTV

SEQ ID NO: 2234687 - protein, 23 aa, Cryptosporidium parvum
LKSCIQSIGGILFLNEIVTFQSI

SEQ ID NO: 2234688 - protein, 19 aa, Cryptosporidium parvum
LKSDISGVVVYAIEDKTQV

SEQ ID NO: 2234689 - protein, 18 aa, Cryptosporidium parvum
LKSDIVFHSLQCYVNQMI

SEQ ID NO: 2234690 - protein, 21 aa, Cryptosporidium parvum
LKSFGINCSMLKPFCSKTLEE

SEQ ID NO: 2234691 - protein, 19 aa, Cryptosporidium parvum
LKSGCYIQSLLLSDEDDNM

SEQ ID NO: 2234692 - protein, 18 aa, Cryptosporidium parvum
LKSIRTVSMLNISKELSE

SEQ ID NO: 2234693 - protein, 24 aa, Cryptosporidium parvum
LKSIWKIGNLVPYVTSNINSIISR

SEQ ID NO: 2234694 - protein, 24 aa, Cryptosporidium parvum
LKSLYDMIGLLPLVINDSSFNWEN

SEQ ID NO: 2234695 - protein, 21 aa, Cryptosporidium parvum
LKSQLKKVFKLFSSMISFLEG

SEQ ID NO: 2234696 - protein, 18 aa, Cryptosporidium parvum
LKSSGGFKLMTKNVPILK

SEQ ID NO: 2234697 - protein, 19 aa, Cryptosporidium parvum
LKSSLFLSNIVKHKRETWI

SEQ ID NO: 2234698 - protein, 19 aa, Cryptosporidium parvum
LKSSLLVIYTKLFKLKLDS

SEQ ID NO: 2234699 - protein, 25 aa, Cryptosporidium parvum
LKSSYIRFMISISMYCLSITDDNIK

SEQ ID NO: 2234700 - protein, 19 aa, Cryptosporidium parvum
LKSTFSLEFDEKRKLLLDL

SEQ ID NO: 2234701 - protein, 20 aa, Cryptosporidium parvum
LKTFSCLKLHSLLVKVKYIY

SEQ ID NO: 2234702 - protein, 23 aa, Cryptosporidium parvum
LKTKIKSFCAMLGKPSTEIEHFK

SEQ ID NO: 2234703 - protein, 23 aa, Cryptosporidium parvum
LKTKLEYLGHVGIEYRIQNKVPK

SEQ ID NO: 2234704 - protein, 22 aa, Cryptosporidium parvum
LKTQIHWVLLLLILKADKYKER

SEQ ID NO: 2234705 - protein, 21 aa, Cryptosporidium parvum
LKTRSRTICEFIARILNPNFY

SEQ ID NO: 2234706 - protein, 19 aa, Cryptosporidium parvum
LKTTPIFVSIRIHTEKPST

SEQ ID NO: 2234707 - protein, 29 aa, Cryptosporidium parvum
LKTVAYYPFKLVVAFLLVIGNVSPVQGYS

SEQ ID NO: 2234708 - protein, 17 aa, Cryptosporidium parvum
LKTWVRSHFTRFFTNSN

SEQ ID NO: 2234709 - protein, 26 aa, Cryptosporidium parvum
LKVLLVMSRRFFPGIGNLININTHIK

SEQ ID NO: 2234710 - protein, 21 aa, Cryptosporidium parvum
LKVVELISPVGKWLKVTKTVS

SEQ ID NO: 2234711 - protein, 30 aa, Cryptosporidium parvum; identical to SEQ ID NO: 2125444

SEQ ID NO: 2234712 - protein, 17 aa, Cryptosporidium parvum
LKYEILISSPSCIIKTL

SEQ ID NO: 2234713 - protein, 19 aa, Cryptosporidium parvum
LKYFPSLNGMFFEKNEDNI

SEQ ID NO: 2234714 - protein, 21 aa, Cryptosporidium parvum
LKYFSEVFVNFEISIEKFVEA

SEQ ID NO: 2234715 - protein, 17 aa, Cryptosporidium parvum
LKYKSCENGKEYQWEIS

SEQ ID NO: 2234716 - protein, 38 aa, Cryptosporidium parvum; identical to SEQ ID NO: 2125446

SEQ ID NO: 2234717 - protein, 19 aa, Cryptosporidium parvum
LKYLKEYFTPIKYEIEQED

SEQ ID NO: 2234718 - protein, 25 aa, Cryptosporidium parvum
LKYLKGDFFIYYQLRNFYQNNKSFI

SEQ ID NO: 2234719 - protein, 19 aa, Cryptosporidium parvum
LKYLVLRIIFNSNKTRLDK

SEQ ID NO: 2234720 - protein, 19 aa, Cryptosporidium parvum
LKYNYLIRPVYVFGECLSF

SEQ ID NO: 2234721 - protein, 17 aa, Cryptosporidium parvum
LKYSSEFLGQLSEYILP

SEQ ID NO: 2234722 - protein, 24 aa, Cryptosporidium parvum
LKYSTELGIILGLESSFTINLTVL

SEQ ID NO: 2234723 - protein, 29 aa, Cryptosporidium parvum
LKYVIGMLLGVFFGIWILSICFKGETKKQ

SEQ ID NO: 2234724 - protein, 18 aa, Cryptosporidium parvum
LKYVKFTLENALKPSNFI

SEQ ID NO: 2234725 - protein, 18 aa, Cryptosporidium parvum
LKYWKRLNSELDEFIERK

SEQ ID NO: 2234726 - protein, 20 aa, Cryptosporidium parvum
LKYWPSRFSKQLYHDNVQEL

SEQ ID NO: 2234727 - protein, 24 aa, Cryptosporidium parvum
LLAFIGGAGLCYLAGLEHTSTASA

SEQ ID NO: 2234728 - protein, 26 aa, Cryptosporidium parvum
LLAFSARIATYYSYIINDWNDQIDNL

SEQ ID NO: 2234729 - protein, 24 aa, Cryptosporidium parvum
LLALIRLSLFLPFVPSNCLLGLTD

SEQ ID NO: 2234730 - protein, 17 aa, Cryptosporidium parvum
LLASYSHPILRERIEYF

SEQ ID NO: 2234731 - protein, 17 aa, Cryptosporidium parvum
LLCFVFKSNPTFINYLL

SEQ ID NO: 2234732 - protein, 18 aa, Cryptosporidium parvum
LLCKLPYNQHFNAAKTFG

SEQ ID NO: 2234733 - protein, 31 aa, Cryptosporidium parvum
LLDDDFLKLLISWYKNRILKFEKHKIENSLE

SEQ ID NO: 2234734 - protein, 25 aa, Cryptosporidium parvum
LLDGFEVLFGLFLPQLVHDHVGLSY

SEQ ID NO: 2234735 - protein, 18 aa, Cryptosporidium parvum
LLDIIKMRMMQISVIKWA

SEQ ID NO: 2234736 - protein, 17 aa, Cryptosporidium parvum
LLDTLVIHRDLFLDTNK

SEQ ID NO: 2234737 - protein, 19 aa, Cryptosporidium parvum
LLDVIPYPIGVTFSQLLVG

SEQ ID NO: 2234738 - protein, 19 aa, Cryptosporidium parvum
LLEDLIKLVLQLGNNILLS

SEQ ID NO: 2234739 - protein, 19 aa, Cryptosporidium parvum
LLEIFSCIVLKKASKYKNY

SEQ ID NO: 2234740 - protein, 20 aa, Cryptosporidium parvum
LLEISLKYLLCNRYDSSELK

SEQ ID NO: 2234741 - protein, 21 aa, Cryptosporidium parvum
LLEKLSRFKIQFENESPGTGA

SEQ ID NO: 2234742 - protein, 18 aa, Cryptosporidium parvum
LLERWQKLAQHPCIVSYR

SEQ ID NO: 2234743 - protein, 19 aa, Cryptosporidium parvum
LLERYLEKCISRKNSHNKL

SEQ ID NO: 2234744 - protein, 18 aa, Cryptosporidium parvum
LLESKAWWICGIPLSVYS

SEQ ID NO: 2234745 - protein, 19 aa, Cryptosporidium parvum
LLESLNFHPYMELIKEILE

SEQ ID NO: 2234746 - protein, 22 aa, Cryptosporidium parvum
LLETRPTFYDFLPSDCSCYDSQ

SEQ ID NO: 2234747 - protein, 22 aa, Cryptosporidium parvum
LLEVLDFTVGIFPTVLLISKLD

SEQ ID NO: 2234748 - protein, 19 aa, Cryptosporidium parvum
LLEYIRFLPEAVLGAIISQ

SEQ ID NO: 2234749 - protein, 18 aa, Cryptosporidium parvum
LLFESLRMSSNMRVAYGV

SEQ ID NO: 2234750 - protein, 24 aa, Cryptosporidium parvum
LLFFRLDCLDGIVSEILLLNYISK

SEQ ID NO: 2234751 - protein, 23 aa, Cryptosporidium parvum
LLFKNDIKMIIFKPMLKIQENIN

SEQ ID NO: 2234752 - protein, 17 aa, Cryptosporidium parvum
LLFLSSITTVIVDYLLG

SEQ ID NO: 2234753 - protein, 25 aa, Cryptosporidium parvum
LLFPTMIWINVIRSFILPKDYKLNF

SEQ ID NO: 2234754 - protein, 30 aa, Cryptosporidium parvum
LLFQCIELLLNRISTIFSFENKHANNKSKN

SEQ ID NO: 2234755 - protein, 17 aa, Cryptosporidium parvum
LLFSDGKIELCNKSNSL

SEQ ID NO: 2234756 - protein, 21 aa, Cryptosporidium parvum
LLGDCLNRISADHGRPLVGQI

SEQ ID NO: 2234757 - protein, 27 aa, Cryptosporidium parvum
LLGEGRVGVATSLWGIFSEFNVPLGDP

SEQ ID NO: 2234758 - protein, 17 aa, Cryptosporidium parvum
LLGEIIFLICELVNDKY

SEQ ID NO: 2234759 - protein, 26 aa, Cryptosporidium parvum
LLGIFFKMNFLLGQSLILVGIYIISR

SEQ ID NO: 2234760 - protein, 17 aa, Cryptosporidium parvum
LLGNEVFDMDSEVETKV

SEQ ID NO: 2234761 - protein, 22 aa, Cryptosporidium parvum
LLGRAACTFGGSSFDISINKIN

SEQ ID NO: 2234762 - protein, 18 aa, Cryptosporidium parvum
LLGYLFGIHRWYKYLTGD

SEQ ID NO: 2234763 - protein, 24 aa, Cryptosporidium parvum
LLGYPRFEGYFSLPEKINGSQKKV

SEQ ID NO: 2234764 - protein, 25 aa, Cryptosporidium parvum
LLHMYFGDIELCFSKFNYGNDHISN

SEQ ID NO: 2234765 - protein, 18 aa, Cryptosporidium parvum
LLHPRTSGLLEILTANDR

SEQ ID NO: 2234766 - protein, 19 aa, Cryptosporidium parvum
LLHSLYMILSLCYLFASHS

SEQ ID NO: 2234767 - protein, 19 aa, Cryptosporidium parvum
LLICFSHTINQFFFSMCFW

SEQ ID NO: 2234768 - protein, 19 aa, Cryptosporidium parvum
LLICRCIDNLFDFFVYSIL

SEQ ID NO: 2234769 - protein, 19 aa, Cryptosporidium parvum
LLIFLLFEIHYLKRRINML

SEQ ID NO: 2234770 - protein, 24 aa, Cryptosporidium parvum
LLIGCRHIDLFFNFFSKFTEKKIA

SEQ ID NO: 2234771 - protein, 28 aa, Cryptosporidium parvum
LLIHYDDCPIIWKSMPFHIYKNDTLHIE

SEQ ID NO: 2234772 - protein, 22 aa, Cryptosporidium parvum
LLIIMSIIINFWQVPKKMYRQM

SEQ ID NO: 2234773 - protein, 24 aa, Cryptosporidium parvum
LLIITCLFSYYSIQIVYSLYLVQL

SEQ ID NO: 2234774 - protein, 19 aa, Cryptosporidium parvum
LLIKLQIFKFIGISYRNKQ

SEQ ID NO: 2234775 - protein, 24 aa, Cryptosporidium parvum
LLILEFSSSLFLTLWLMLIALSGY

SEQ ID NO: 2234776 - protein, 22 aa, Cryptosporidium parvum
LLILNPRLALSSRMPRFSEEVK

SEQ ID NO: 2234777 - protein, 26 aa, Cryptosporidium parvum
LLIMILITGSIQWAFWNTALSKYQAI

SEQ ID NO: 2234778 - protein, 18 aa, Cryptosporidium parvum
LLIRLLGINICFDTHFIY

SEQ ID NO: 2234779 - protein, 20 aa, Cryptosporidium parvum
LLISCGLGITGIISILQERI

SEQ ID NO: 2234780 - protein, 25 aa, Cryptosporidium parvum
LLISSYYLNINWGYIYKLIPGISNF

SEQ ID NO: 2234781 - protein, 22 aa, Cryptosporidium parvum
LLIWNYYQGIAFRMVKLSEDYF

SEQ ID NO: 2234782 - protein, 23 aa, Cryptosporidium parvum
LLKAKRPNSLGIFIQMISGVQQN

SEQ ID NO: 2234783 - protein, 24 aa, Cryptosporidium parvum
LLKDLFEKGVRFLVFIQDTNALVF

SEQ ID NO: 2234784 - protein, 17 aa, Cryptosporidium parvum
LLKECLIPFKDLLLKSF

SEQ ID NO: 2234785 - protein, 22 aa, Cryptosporidium parvum
LLKHGRLAIGIYRPIRVDDHQF

SEQ ID NO: 2234786 - protein, 26 aa, Cryptosporidium parvum
LLKQRRFKNEISRCCEKFNSDPSNFL

SEQ ID NO: 2234787 - protein, 25 aa, Cryptosporidium parvum
LLKSKECPFCKNTIETLFFTSNPRY

SEQ ID NO: 2234788 - protein, 24 aa, Cryptosporidium parvum
LLKSKYSTLWVRSEYQIFVTPNTV

SEQ ID NO: 2234789 - protein, 19 aa, Cryptosporidium parvum
LLKSLIFSKIRLMKNKIDD

SEQ ID NO: 2234790 - protein, 25 aa, Cryptosporidium parvum
LLKSWGYITMCYFVEKYPFPEKILF

SEQ ID NO: 2234791 - protein, 20 aa, Cryptosporidium parvum
LLLEIPEIFNEDKLSVTLKE

SEQ ID NO: 2234792 - protein, 26 aa, Cryptosporidium parvum
LLLEIRIGFRAARYFHNSLLLGYLGA

SEQ ID NO: 2234793 - protein, 18 aa, Cryptosporidium parvum
LLLFEMLGIILSIPDSSL

SEQ ID NO: 2234794 - protein, 17 aa, Cryptosporidium parvum
LLLFERFLLVKYTNEDF

SEQ ID NO: 2234795 - protein, 19 aa, Cryptosporidium parvum
LLLIMSICLVFTKSEYFNV

SEQ ID NO: 2234796 - protein, 17 aa, Cryptosporidium parvum
LLLKSILKEKFFCDEIF

SEQ ID NO: 2234797 - protein, 17 aa, Cryptosporidium parvum
LLLLLLLISIDFIQCED

SEQ ID NO: 2234798 - protein, 17 aa, Cryptosporidium parvum
LLLLLSVYSPYELLLFL

SEQ ID NO: 2234799 - protein, 19 aa, Cryptosporidium parvum
LLLRSGVKNKAVFKAPNVS

SEQ ID NO: 2234800 - protein, 19 aa, Cryptosporidium parvum
LLLSDVCARSCNYCSPSQG

SEQ ID NO: 2234801 - protein, 18 aa, Cryptosporidium parvum
LLLSFFVILFICFGVIDM

SEQ ID NO: 2234802 - protein, 44 aa, Cryptosporidium parvum; identical to SEQ ID NO: 2125498

SEQ ID NO: 2234803 - protein, 26 aa, Cryptosporidium parvum
LLMDNFVNECCRPEVIVVGLNTIREI

SEQ ID NO: 2234804 - protein, 18 aa, Cryptosporidium parvum
LLMFKVKQLVSVNEEDGN

SEQ ID NO: 2234805 - protein, 27 aa, Cryptosporidium parvum
LLMIPPICLFAWFWLFQYYRHASRELF

SEQ ID NO: 2234806 - protein, 25 aa, Cryptosporidium parvum
LLMKESRLWSTLFRLLMSCNDLNSN

SEQ ID NO: 2234807 - protein, 21 aa, Cryptosporidium parvum
LLMSILGRWIFNHQLNINSYL

SEQ ID NO: 2234808 - protein, 29 aa, Cryptosporidium parvum
LLNEIIRLNFKYSPKFIVEVFLNSLDSSG

SEQ ID NO: 2234809 - protein, 30 aa, Cryptosporidium parvum; identical to SEQ ID NO: 2125503

SEQ ID NO: 2234810 - protein, 30 aa, Cryptosporidium parvum
LLNHPSIFHLLKLIIGILFCQGQDQDQDHE

SEQ ID NO: 2234811 - protein, 18 aa, Cryptosporidium parvum
LLNIYGFCELEKKISHKI

SEQ ID NO: 2234812 - protein, 26 aa, Cryptosporidium parvum
LLNKGHGKPVDWWTLGILIYEMVVGF

SEQ ID NO: 2234813 - protein, 22 aa, Cryptosporidium parvum
LLNLSSLLVRRSFLTSNSKQFL

SEQ ID NO: 2234814 - protein, 23 aa, Cryptosporidium parvum
LLNNWIDLCYLYLLDLEDNPKLR

SEQ ID NO: 2234815 - protein, 36 aa, Cryptosporidium parvum
LLNSCKIIDKWYEEVLPKWGTHWNCNSMPVSIHNLS

SEQ ID NO: 2234816 - protein, 18 aa, Cryptosporidium parvum
LLNSFKPLTHICGGWNLG

SEQ ID NO: 2234817 - protein, 17 aa, Cryptosporidium parvum
LLNSLSFKSLRDSIPKF

SEQ ID NO: 2234818 - protein, 18 aa, Cryptosporidium parvum
LLNVICTILMFKCADEVN

SEQ ID NO: 2234819 - protein, 23 aa, Cryptosporidium parvum
LLPRVIFIFVIQCLSLIIVANSL

SEQ ID NO: 2234820 - protein, 18 aa, Cryptosporidium parvum
LLPTSPINVASRISVDNP

SEQ ID NO: 2234821 - protein, 20 aa, Cryptosporidium parvum
LLQFDYKIARNIILNDSIYY

SEQ ID NO: 2234822 - protein, 18 aa, Cryptosporidium parvum
LLRCIKSEIETIINALVH

SEQ ID NO: 2234823 - protein, 20 aa, Cryptosporidium parvum
LLRNCNRSLLSFQVYANHQY

SEQ ID NO: 2234824 - protein, 22 aa, Cryptosporidium parvum
LLRSRLTFFFEHYLPEILEFLQ

SEQ ID NO: 2234825 - protein, 18 aa, Cryptosporidium parvum
LLRVMEWLYLQGYSLEEQ

SEQ ID NO: 2234826 - protein, 22 aa, Cryptosporidium parvum
LLSCFQCIITITVCHIFSAALS

SEQ ID NO: 2234827 - protein, 17 aa, Cryptosporidium parvum
LLSGKFVNLSGVEYCAL

SEQ ID NO: 2234828 - protein, 27 aa, Cryptosporidium parvum
LLSIEYIKKLQIVFECEHNIEVLLQLS

SEQ ID NO: 2234829 - protein, 21 aa, Cryptosporidium parvum
LLSIGFKFKEKILIGNSDLET

SEQ ID NO: 2234830 - protein, 28 aa, Cryptosporidium parvum
LLSKCISNCPGFLPIMLHLIIPKNENML

SEQ ID NO: 2234831 - protein, 18 aa, Cryptosporidium parvum
LLSNLNESGLLCRASTLF

SEQ ID NO: 2234832 - protein, 18 aa, Cryptosporidium parvum
LLSQRIVYYFTNNRIGFG

SEQ ID NO: 2234833 - protein, 19 aa, Cryptosporidium parvum
LLSVFFVWDASNYSEEYGF

SEQ ID NO: 2234834 - protein, 18 aa, Cryptosporidium parvum
LLSYEWPQPLKRLVSFLK

SEQ ID NO: 2234835 - protein, 26 aa, Cryptosporidium parvum
LLTESWRFPISFSSSFNMVKPEKLYM

SEQ ID NO: 2234836 - protein, 22 aa, Cryptosporidium parvum
LLVAMLPRKVLVDFQEDKLKLA

SEQ ID NO: 2234837 - protein, 19 aa, Cryptosporidium parvum
LLVCILKIGVTKSMDIYLA

SEQ ID NO: 2234838 - protein, 19 aa, Cryptosporidium parvum
LLVGISIPIFKEFLLRKDI

SEQ ID NO: 2234839 - protein, 17 aa, Cryptosporidium parvum
LLVGNVMAASPCPNMEN

SEQ ID NO: 2234840 - protein, 18 aa, Cryptosporidium parvum
LLVICLNAGTGFVVVAVL

SEQ ID NO: 2234841 - protein, 23 aa, Cryptosporidium parvum
LLVIPSPFLKKLGLQLILEVSDN

SEQ ID NO: 2234842 - protein, 21 aa, Cryptosporidium parvum
LLVLFDIFGTLLINQLFNQLH

SEQ ID NO: 2234843 - protein, 17 aa, Cryptosporidium parvum
LLVLVFTIICGFGVIES

SEQ ID NO: 2234844 - protein, 24 aa, Cryptosporidium parvum
LLVRCVLGYIWSYYKVIFLSNESV

SEQ ID NO: 2234845 - protein, 27 aa, Cryptosporidium parvum
LLVRILLGAALMSFFFALIGDNAYEEG

SEQ ID NO: 2234846 - protein, 17 aa, Cryptosporidium parvum
LLVVLSFGAVPALLNYK

SEQ ID NO: 2234847 - protein, 36 aa, Cryptosporidium parvum
LLVVLSYQLPFYFACWFHFKYGKLIIGNSVSKTPYF

SEQ ID NO: 2234848 - protein, 17 aa, Cryptosporidium parvum
LLVVVSLFFIIPLHIYP

SEQ ID NO: 2234849 - protein, 17 aa, Cryptosporidium parvum
LLWSFASMESFSRKSKA

SEQ ID NO: 2234850 - protein, 19 aa, Cryptosporidium parvum
LLYDCKINSLFTVSFKYNS

SEQ ID NO: 2234851 - protein, 18 aa, Cryptosporidium parvum
LLYFKKKIIPKMTILDLI

SEQ ID NO: 2234852 - protein, 29 aa, Cryptosporidium parvum
LLYKQKLIWLRIHLTVGIIDSEGFLNKVH

SEQ ID NO: 2234853 - protein, 24 aa, Cryptosporidium parvum
LLYNLKEVFIFSAVAVSSSLSFML

SEQ ID NO: 2234854 - protein, 25 aa, Cryptosporidium parvum
LLYRRFKSNMLVNILGQWQELDVGG

SEQ ID NO: 2234855 - protein, 20 aa, Cryptosporidium parvum
LMDHLIHYSILVKNNYIGIS

SEQ ID NO: 2234856 - protein, 22 aa, Cryptosporidium parvum
LMFFISVIIFGLFILAIALIPR

SEQ ID NO: 2234857 - protein, 18 aa, Cryptosporidium parvum
LMGGSIIRAFRCGHVFLN

SEQ ID NO: 2234858 - protein, 17 aa, Cryptosporidium parvum
LMGSAVGRYKCRVGETS

SEQ ID NO: 2234859 - protein, 18 aa, Cryptosporidium parvum
LMHCISMGTLDWIHCIQA

SEQ ID NO: 2234860 - protein, 27 aa, Cryptosporidium parvum
LMHEIEKRLGIVIARDEVMSMVYIMLN

SEQ ID NO: 2234861 - protein, 18 aa, Cryptosporidium parvum
LMIKRISFNKTFQVTGRN

SEQ ID NO: 2234862 - protein, 18 aa, Cryptosporidium parvum
LMLENCSPALSDSEIIMP

SEQ ID NO: 2234863 - protein, 24 aa, Cryptosporidium parvum
LMLIPELMSGLFVIILMACIDIGL

SEQ ID NO: 2234864 - protein, 22 aa, Cryptosporidium parvum
LMMFCFENWGYFLLGNNFQLLD

SEQ ID NO: 2234865 - protein, 18 aa, Cryptosporidium parvum
LMNICIIPIFSIDIFYFR

SEQ ID NO: 2234866 - protein, 17 aa, Cryptosporidium parvum
LMNRGGGLIGIHNKGFE

SEQ ID NO: 2234867 - protein, 22 aa, Cryptosporidium parvum
LMNTCRIRHGALTLALEHWVED

SEQ ID NO: 2234868 - protein, 19 aa, Cryptosporidium parvum
LMPLWPIVLAELIKIFRLK

SEQ ID NO: 2234869 - protein, 25 aa, Cryptosporidium parvum
LMRGARFVYRCLRMDGHFVTPQTAY

SEQ ID NO: 2234870 - protein, 25 aa, Cryptosporidium parvum
LMRSLDIFIFKTIINKCYKNLLDDR

SEQ ID NO: 2234871 - protein, 18 aa, Cryptosporidium parvum
LMSIWYGTPLFMSRYIAD

SEQ ID NO: 2234872 - protein, 22 aa, Cryptosporidium parvum
LMTLCAAAMFPFSLRKELQTTR

SEQ ID NO: 2234873 - protein, 17 aa, Cryptosporidium parvum
LMVYSIISFIIGLFAGW

SEQ ID NO: 2234874 - protein, 23 aa, Cryptosporidium parvum
LMYKQDYCLLILRRALSSTNRRV

SEQ ID NO: 2234875 - protein, 26 aa, Cryptosporidium parvum
LMYMDPPSAFKCMLNLINSFDFLFIS

SEQ ID NO: 2234876 - protein, 19 aa, Cryptosporidium parvum
LMYQVKFVSIYLMFLMRNF

SEQ ID NO: 2234877 - protein, 19 aa, Cryptosporidium parvum
LNALFWLFFISNGWLAMYS

SEQ ID NO: 2234878 - protein, 17 aa, Cryptosporidium parvum
LNAMGIVLEARRSDLLI

SEQ ID NO: 2234879 - protein, 27 aa, Cryptosporidium parvum
LNCILDCIRLALPVSPNFLKKIKFKNC

SEQ ID NO: 2234880 - protein, 19 aa, Cryptosporidium parvum
LNCIVPFIIYSEILRDGSL

SEQ ID NO: 2234881 - protein, 17 aa, Cryptosporidium parvum
LNCSIFGSILVQCDLKL

SEQ ID NO: 2234882 - protein, 20 aa, Cryptosporidium parvum
LNDWPLAWGDILDADPYRVI

SEQ ID NO: 2234883 - protein, 17 aa, Cryptosporidium parvum
LNFKLKISLNYINLRYE

SEQ ID NO: 2234884 - protein, 21 aa, Cryptosporidium parvum
LNFLIFFKWLTPIEGYNKPSI

SEQ ID NO: 2234885 - protein, 18 aa, Cryptosporidium parvum
LNFRDVLNVMGLYPGDPG

SEQ ID NO: 2234886 - protein, 18 aa, Cryptosporidium parvum
LNGCSPYLSLSIYAIIQN

SEQ ID NO: 2234887 - protein, 24 aa, Cryptosporidium parvum
LNGGLIYRFFRIIANRVYGNQYGS

SEQ ID NO: 2234888 - protein, 17 aa, Cryptosporidium parvum
LNGILRSLILTKLELLE

SEQ ID NO: 2234889 - protein, 18 aa, Cryptosporidium parvum
LNGVWGIPKTICMNHCEP

SEQ ID NO: 2234890 - protein, 17 aa, Cryptosporidium parvum
LNHAVIMIGYGINDNGD

SEQ ID NO: 2234891 - protein, 19 aa, Cryptosporidium parvum
LNHHLILIFLLKNELIIPY

SEQ ID NO: 2234892 - protein, 24 aa, Cryptosporidium parvum
LNHIMLWFGLIIFWAITQIYGKSP

SEQ ID NO: 2234893 - protein, 18 aa, Cryptosporidium parvum
LNHLIIYLRNIIKARISS

SEQ ID NO: 2234894 - protein, 17 aa, Cryptosporidium parvum
LNHRSGVISFFPEDMGL

SEQ ID NO: 2234895 - protein, 18 aa, Cryptosporidium parvum
LNHYYLLNEYLKSVNVYQ

SEQ ID NO: 2234896 - protein, 18 aa, Cryptosporidium parvum
LNICTKAFNKICLYDVEI

SEQ ID NO: 2234897 - protein, 17 aa, Cryptosporidium parvum
LNIFCKFNSIVNKYIDK

SEQ ID NO: 2234898 - protein, 17 aa, Cryptosporidium parvum
LNIGNLILNHKNIKEPI

SEQ ID NO: 2234899 - protein, 28 aa, Cryptosporidium parvum
LNIIPCLEWTSTMSYTFTPYFFDVINKL

SEQ ID NO: 2234900 - protein, 18 aa, Cryptosporidium parvum
LNILAVNLPIFFLHNDGI

SEQ ID NO: 2234901 - protein, 31 aa, Cryptosporidium parvum
LNILLKLSCPTIFFKVCELMCSIEDYFKSNI

SEQ ID NO: 2234902 - protein, 26 aa, Cryptosporidium parvum
LNILPPIRIYELWKGTPMDIRQILFN

SEQ ID NO: 2234903 - protein, 18 aa, Cryptosporidium parvum
LNINSFILILVISIFFSS

SEQ ID NO: 2234904 - protein, 24 aa, Cryptosporidium parvum
LNIPSQIKLVSRFRCEQAKDDILD

SEQ ID NO: 2234905 - protein, 19 aa, Cryptosporidium parvum
LNITSSCWIDSDMHVRKTI

SEQ ID NO: 2234906 - protein, 39 aa, Cryptosporidium parvum
LNIVYKQLMGIFRFKLCYVWKFSILNSYCLAIINNQQSE

SEQ ID NO: 2234907 - protein, 22 aa, Cryptosporidium parvum
LNIYQLWSGLWITILRDVPFTA

SEQ ID NO: 2234908 - protein, 17 aa, Cryptosporidium parvum
LNKDLRLLYSLISQQLY

SEQ ID NO: 2234909 - protein, 18 aa, Cryptosporidium parvum
LNKFGPKIHQVLEVIDSL

SEQ ID NO: 2234910 - protein, 27 aa, Cryptosporidium parvum
LNKKFFVRKGEVILRILENYYPPIFES

SEQ ID NO: 2234911 - protein, 20 aa, Cryptosporidium parvum
LNKKLKFIFHKNMSGNSVRV

SEQ ID NO: 2234912 - protein, 22 aa, Cryptosporidium parvum
LNKKVMNFWGLETNKLINDHYN

SEQ ID NO: 2234913 - protein, 18 aa, Cryptosporidium parvum
LNKQLPYLVANIVESLDF

SEQ ID NO: 2234914 - protein, 21 aa, Cryptosporidium parvum
LNKRSPILYNFFVKLKAKDDK

SEQ ID NO: 2234915 - protein, 22 aa, Cryptosporidium parvum
LNKSFKYIWLIYHRNNLLPHQR

SEQ ID NO: 2234916 - protein, 17 aa, Cryptosporidium parvum
LNLALLFCYEVVCKIIV

SEQ ID NO: 2234917 - protein, 25 aa, Cryptosporidium parvum
LNLDLRSSYLLPNHSFSKFGIYLNN

SEQ ID NO: 2234918 - protein, 27 aa, Cryptosporidium parvum
LNLPECCLRCIEFTSRMFVFIQKVPII

SEQ ID NO: 2234919 - protein, 27 aa, Cryptosporidium parvum
LNLPLFLIFLCVFRVLSNFFLTVILLN

SEQ ID NO: 2234920 - protein, 17 aa, Cryptosporidium parvum
LNLPMQIQRLLLFTHYF

SEQ ID NO: 2234921 - protein, 21 aa, Cryptosporidium parvum
LNLPSCLKHNHDILDFQKTCI

SEQ ID NO: 2234922 - protein, 27 aa, Cryptosporidium parvum
LNLSPCMIFHYSVLFSYLVFILKTTPW

SEQ ID NO: 2234923 - protein, 32 aa, Cryptosporidium parvum; identical to SEQ ID NO: 2125594

SEQ ID NO: 2234924 - protein, 35 aa, Cryptosporidium parvum
LNNYYWKLLLFIIIRRHSLIFFKLNSKSILLTNFT

SEQ ID NO: 2234925 - protein, 24 aa, Cryptosporidium parvum
LNPIRLDLLLTFRTRKDRGRRPNS

SEQ ID NO: 2234926 - protein, 26 aa, Cryptosporidium parvum
LNPLCSPILSSFCCIVLTISLDSIYS

SEQ ID NO: 2234927 - protein, 23 aa, Cryptosporidium parvum
LNPPVVICNKGFLYNKEAVINKL

SEQ ID NO: 2234928 - protein, 27 aa, Cryptosporidium parvum
LNRFCQEIYFPIGIIISVYCIYDSLVI

SEQ ID NO: 2234929 - protein, 22 aa, Cryptosporidium parvum
LNRNSLAYVLYIWSEFEESNSI

SEQ ID NO: 2234930 - protein, 34 aa, Cryptosporidium parvum
LNRPEFVYRIKIVELKLGFLLQLAFFRLWSVNLA

SEQ ID NO: 2234931 - protein, 20 aa, Cryptosporidium parvum
LNSARLCQKLSLLAQSTLLY

SEQ ID NO: 2234932 - protein, 25 aa, Cryptosporidium parvum
LNSCCKLISDHYIKMSIHRDKSKYK

SEQ ID NO: 2234933 - protein, 22 aa, Cryptosporidium parvum
LNSETRYSWAILSSTINSLNHL

SEQ ID NO: 2234934 - protein, 18 aa, Cryptosporidium parvum
LNSFIIVFCIYFTSFITV

SEQ ID NO: 2234935 - protein, 22 aa, Cryptosporidium parvum
LNSKLLIVKVVQLFNLFFMFFA

SEQ ID NO: 2234936 - protein, 26 aa, Cryptosporidium parvum
LNSKLYFIHPISFMRRNHINSYYYEG

SEQ ID NO: 2234937 - protein, 25 aa, Cryptosporidium parvum
LNSYFPADFAWTFSLYLETTAMLPQ

SEQ ID NO: 2234938 - protein, 18 aa, Cryptosporidium parvum
LNTCIGEKNYRHFFLLLF

SEQ ID NO: 2234939 - protein, 17 aa, Cryptosporidium parvum
LNTCKTIANIGVEILDR

SEQ ID NO: 2234940 - protein, 41 aa, Cryptosporidium parvum
LNTLKLKKCFKMFLSVCGTSLSAIFGFFKTLFCVPNLNNRA

SEQ ID NO: 2234941 - protein, 23 aa, Cryptosporidium parvum
LNTPFKILVKFSRSSVTSSKITL

SEQ ID NO: 2234942 - protein, 23 aa, Cryptosporidium parvum
LNTPVKLPLLFGSILMFVLLINV

SEQ ID NO: 2234943 - protein, 18 aa, Cryptosporidium parvum
LNVCVDIDECMELSVCPS

SEQ ID NO: 2234944 - protein, 24 aa, Cryptosporidium parvum
LNVIKTARYSLLFFLPKNLYDQFN

SEQ ID NO: 2234945 - protein, 21 aa, Cryptosporidium parvum
LNYFGEYLCFYSLRELMNIEI

SEQ ID NO: 2234946 - protein, 20 aa, Cryptosporidium parvum
LPAYFPCSDSNLLFELWNGE

SEQ ID NO: 2234947 - protein, 20 aa, Cryptosporidium parvum
LPDFTKYWERELKRCNIISD

SEQ ID NO: 2234948 - protein, 25 aa, Cryptosporidium parvum
LPDHALIPIRHVGPYGAHSNSTWVF

SEQ ID NO: 2234949 - protein, 21 aa, Cryptosporidium parvum
LPEACKFKLLSYFLTPSEFVF

SEQ ID NO: 2234950 - protein, 19 aa, Cryptosporidium parvum
LPEDSCLFFGTRIFGQLLL

SEQ ID NO: 2234951 - protein, 26 aa, Cryptosporidium parvum
LPEKKPTLPSSMPWAPNSSSFHIPQN

SEQ ID NO: 2234952 - protein, 20 aa, Cryptosporidium parvum
LPELEFPGLNIRDLGRLYFY

SEQ ID NO: 2234953 - protein, 19 aa, Cryptosporidium parvum
LPENCEIIGIATLEDIIEE

SEQ ID NO: 2234954 - protein, 21 aa, Cryptosporidium parvum
LPFIFLRDIENLGFLSVLANI

SEQ ID NO: 2234955 - protein, 21 aa, Cryptosporidium parvum
LPGPYVKWFLKSVGAQGLYNM

SEQ ID NO: 2234956 - protein, 17 aa, Cryptosporidium parvum
LPHFNLNSLEISGFNLY

SEQ ID NO: 2234957 - protein, 19 aa, Cryptosporidium parvum
LPHLMLKLDTLAVEPNSKF

SEQ ID NO: 2234958 - protein, 20 aa, Cryptosporidium parvum
LPICRQKINLVVYVNGSPLE

SEQ ID NO: 2234959 - protein, 24 aa, Cryptosporidium parvum
LPIFELKLDNLRLIIRTKHTSNSK

SEQ ID NO: 2234960 - protein, 21 aa, Cryptosporidium parvum
LPIILCVLILYILHRNGIRTE

SEQ ID NO: 2234961 - protein, 24 aa, Cryptosporidium parvum
LPIISRPDLLIALESSPISTSHNW

SEQ ID NO: 2234962 - protein, 22 aa, Cryptosporidium parvum
LPIKDHYSWISTYRELEHKFDN

SEQ ID NO: 2234963 - protein, 18 aa, Cryptosporidium parvum
LPILFRYVKESNNNNFDW

SEQ ID NO: 2234964 - protein, 19 aa, Cryptosporidium parvum
LPIPCFETSSTRVVNFLRL

SEQ ID NO: 2234965 - protein, 19 aa, Cryptosporidium parvum
LPIWLARELYSRGFVGIDY

SEQ ID NO: 2234966 - protein, 18 aa, Cryptosporidium parvum
LPKAFCGYEKKLFNEHNS

SEQ ID NO: 2234967 - protein, 22 aa, Cryptosporidium parvum
LPKEEMSLLLSVIIDPLVNVKL

SEQ ID NO: 2234968 - protein, 21 aa, Cryptosporidium parvum
LPKFDYKWTISKNISEKLLNR

SEQ ID NO: 2234969 - protein, 20 aa, Cryptosporidium parvum
LPKFLQVSLQGIDISDPMKI

SEQ ID NO: 2234970 - protein, 17 aa, Cryptosporidium parvum
LPKGVDMVNSYRLFSID

SEQ ID NO: 2234971 - protein, 26 aa, Cryptosporidium parvum
LPKKSGYKFEYSWYPPISQGKLIDSV

SEQ ID NO: 2234972 - protein, 19 aa, Cryptosporidium parvum
LPKSNILGLRYPNYRRDRH

SEQ ID NO: 2234973 - protein, 18 aa, Cryptosporidium parvum
LPLIDRYLELSISSQKSN

SEQ ID NO: 2234974 - protein, 18 aa, Cryptosporidium parvum
LPLISIFLSFLFPPIGCI

SEQ ID NO: 2234975 - protein, 22 aa, Cryptosporidium parvum
LPLLEIPTIFSFTPNLELLGST

SEQ ID NO: 2234976 - protein, 17 aa, Cryptosporidium parvum
LPLLLIKLIDCEIRSRI

SEQ ID NO: 2234977 - protein, 25 aa, Cryptosporidium parvum
LPLPKNLEIFSWWYRFILSTPSRVF

SEQ ID NO: 2234978 - protein, 20 aa, Cryptosporidium parvum
LPLRTDHRIFSFMKQSINTK

SEQ ID NO: 2234979 - protein, 19 aa, Cryptosporidium parvum
LPMDCFIIKSKPELKECRH

SEQ ID NO: 2234980 - protein, 18 aa, Cryptosporidium parvum
LPMSCVFSLKSEEVNRLV

SEQ ID NO: 2234981 - protein, 22 aa, Cryptosporidium parvum
LPMYHDMGLVGFIVSTVIIGSE

SEQ ID NO: 2234982 - protein, 36 aa, Cryptosporidium parvum
LPNGRVYYFPRDHVCDFKYCNVEGVSFISDNMIVTV

SEQ ID NO: 2234983 - protein, 25 aa, Cryptosporidium parvum
LPNYLCSTYPMLIFMRHLLQNRKRF

SEQ ID NO: 2234984 - protein, 25 aa, Cryptosporidium parvum
LPPLMALVPRAFRYRQGQDILAPHD

SEQ ID NO: 2234985 - protein, 21 aa, Cryptosporidium parvum
LPPTGGWGLGIDRLIMFLADK

SEQ ID NO: 2234986 - protein, 24 aa, Cryptosporidium parvum
LPQISSIIRWRLNTPSPRARQTAA

SEQ ID NO: 2234987 - protein, 19 aa, Cryptosporidium parvum
LPQPIKYSLIYPPNHPNSD

SEQ ID NO: 2234988 - protein, 21 aa, Cryptosporidium parvum
LPRIRFGYKTLPTVVDITRYN

SEQ ID NO: 2234989 - protein, 21 aa, Cryptosporidium parvum
LPRKRCHTCNNIFHSECIYKW

SEQ ID NO: 2234990 - protein, 21 aa, Cryptosporidium parvum
LPRRLDLEYLQSIIYVGDIYK

SEQ ID NO: 2234991 - protein, 19 aa, Cryptosporidium parvum
LPRYENWLYREMVVEEHDI

SEQ ID NO: 2234992 - protein, 20 aa, Cryptosporidium parvum
LPSCENLVFLGIESIGILQC

SEQ ID NO: 2234993 - protein, 21 aa, Cryptosporidium parvum
LPSCINLSIRLLETSFSSDWI

SEQ ID NO: 2234994 - protein, 23 aa, Cryptosporidium parvum
LPSDLDPTTFLLIDSTGKKFSPY

SEQ ID NO: 2234995 - protein, 26 aa, Cryptosporidium parvum
LPSEILKYIKCNIIPTINNNINSLKE

SEQ ID NO: 2234996 - protein, 19 aa, Cryptosporidium parvum
LPSEYSWLLSNDITMMSKA

SEQ ID NO: 2234997 - protein, 18 aa, Cryptosporidium parvum
LPSLGLRNPKIWMMGIIL

SEQ ID NO: 2234998 - protein, 19 aa, Cryptosporidium parvum
LPSSLRIKILVEIQDNNSE

SEQ ID NO: 2234999 - protein, 18 aa, Cryptosporidium parvum
LPSTFFAVFFVFKQLFTS

SEQ ID NO: 2235000 - protein, 19 aa, Cryptosporidium parvum
LPSVYLRDYMYLKLNNGIK

SEQ ID NO: 2235001 - protein, 21 aa, Cryptosporidium parvum
LPTDGWMLLGMKRYLMRQMAK

SEQ ID NO: 2235002 - protein, 28 aa, Cryptosporidium parvum
LPTLEFSNWLLTNWVFRTISNLPILFSD

SEQ ID NO: 2235003 - protein, 17 aa, Cryptosporidium parvum
LPVLLGLISDEFGLDEM

SEQ ID NO: 2235004 - protein, 17 aa, Cryptosporidium parvum
LPYNQHFNAAKTFGQVF

SEQ ID NO: 2235005 - protein, 21 aa, Cryptosporidium parvum
LQAEIGIRLFLNILDSNNQSN

SEQ ID NO: 2235006 - protein, 18 aa, Cryptosporidium parvum
LQAFKMWAPDSNNLTIIP

SEQ ID NO: 2235007 - protein, 22 aa, Cryptosporidium parvum
LQAGFRRFYICPIVSNCPRISS

SEQ ID NO: 2235008 - protein, 18 aa, Cryptosporidium parvum
LQAYIGFDNAQTLGVVND

SEQ ID NO: 2235009 - protein, 23 aa, Cryptosporidium parvum
LQCEIKFFLKPERNIQIPYSQIV

SEQ ID NO: 2235010 - protein, 26 aa, Cryptosporidium parvum
LQDLEAITAMLDRLCVNNINSISNST

SEQ ID NO: 2235011 - protein, 25 aa, Cryptosporidium parvum
LQFIIFPFQTFFSFNLESKVKTEKQ

SEQ ID NO: 2235012 - protein, 18 aa, Cryptosporidium parvum
LQFILVLLTWEIFPQEKT

SEQ ID NO: 2235013 - protein, 17 aa, Cryptosporidium parvum
LQFKFKINMLNYILNSQ

SEQ ID NO: 2235014 - protein, 25 aa, Cryptosporidium parvum
LQGEFEIFESINLTWFSKEKIENRK

SEQ ID NO: 2235015 - protein, 22 aa, Cryptosporidium parvum
LQGPFIKDCICNSLMSFIQAIS

SEQ ID NO: 2235016 - protein, 17 aa, Cryptosporidium parvum
LQIIFKKLFNPHETLII

SEQ ID NO: 2235017 - protein, 17 aa, Cryptosporidium parvum
LQILACNDGKWSLPGPD

SEQ ID NO: 2235018 - protein, 18 aa, Cryptosporidium parvum
LQILKVFIYERYFKAQSA

SEQ ID NO: 2235019 - protein, 20 aa, Cryptosporidium parvum
LQKFRVVPMEGEVEIRIRAI

SEQ ID NO: 2235020 - protein, 18 aa, Cryptosporidium parvum
LQKGGRYQGSMRETKAIG

SEQ ID NO: 2235021 - protein, 22 aa, Cryptosporidium parvum
LQKITTCLLFRGRRTIRRSDYN

SEQ ID NO: 2235022 - protein, 27 aa, Cryptosporidium parvum
LQKMIKGFVFESCIKIIWSLQLSIWYK

SEQ ID NO: 2235023 - protein, 30 aa, Cryptosporidium parvum; identical to SEQ ID NO: 2125655

SEQ ID NO: 2235024 - protein, 19 aa, Cryptosporidium parvum
LQLDPLVFVKTAIPPTASS

SEQ ID NO: 2235025 - protein, 24 aa, Cryptosporidium parvum
LQLLHFRLSMITYWLFAHPSMVPP

SEQ ID NO: 2235026 - protein, 23 aa, Cryptosporidium parvum
LQLLIVWTIFLGIIVLFFHLIYK

SEQ ID NO: 2235027 - protein, 31 aa, Cryptosporidium parvum
LQLSIWYKYNVIYRKHIFVLDLSKFHLDFKQ

SEQ ID NO: 2235028 - protein, 19 aa, Cryptosporidium parvum
LQMRMLLFVNFFLKREKLR

SEQ ID NO: 2235029 - protein, 20 aa, Cryptosporidium parvum
LQNKPNFLGFGIRNLEYNEI

SEQ ID NO: 2235030 - protein, 19 aa, Cryptosporidium parvum
LQPFIFILYNDVSWRIRSN

SEQ ID NO: 2235031 - protein, 18 aa, Cryptosporidium parvum
LQPFKNGFFKFAIEHESE

SEQ ID NO: 2235032 - protein, 17 aa, Cryptosporidium parvum
LQPKLAEVLRCGIWSEI

SEQ ID NO: 2235033 - protein, 19 aa, Cryptosporidium parvum
LQQAFPFGFLTRVSDCNRL

SEQ ID NO: 2235034 - protein, 26 aa, Cryptosporidium parvum
LQQQMFLRFVWGRSRLPSKGAQWECN

SEQ ID NO: 2235035 - protein, 22 aa, Cryptosporidium parvum
LQQRLSAILNDFCRQVTELKQV

SEQ ID NO: 2235036 - protein, 26 aa, Cryptosporidium parvum
LQRFLFWNFREFYRFHESYYFTVNHT

SEQ ID NO: 2235037 - protein, 28 aa, Cryptosporidium parvum
LQSGLRPMPHLKIEEMQSLLVMIEKHYK

SEQ ID NO: 2235038 - protein, 26 aa, Cryptosporidium parvum
LQSKVLLIRYCIKSAVMNEFCGNFAL

SEQ ID NO: 2235039 - protein, 20 aa, Cryptosporidium parvum
LQSLEFILTIIFSLISEKER

SEQ ID NO: 2235040 - protein, 21 aa, Cryptosporidium parvum
LQSLISIALGHWFEATNQTFT

SEQ ID NO: 2235041 - protein, 17 aa, Cryptosporidium parvum
LQSLVIWISRFKYEISS

SEQ ID NO: 2235042 - protein, 18 aa, Cryptosporidium parvum
LQSQLLLCFVFKSNPTFI

SEQ ID NO: 2235043 - protein, 20 aa, Cryptosporidium parvum
LQSSELFSGNLLSLISELGP

SEQ ID NO: 2235044 - protein, 24 aa, Cryptosporidium parvum
LQSSLSSAIIRWYDSIDYSKLLLN

SEQ ID NO: 2235045 - protein, 19 aa, Cryptosporidium parvum
LQSTLKFLILNLHQVTSVL

SEQ ID NO: 2235046 - protein, 17 aa, Cryptosporidium parvum
LQTIEKFIFPFIGDQNC

SEQ ID NO: 2235047 - protein, 18 aa, Cryptosporidium parvum
LQVLKFTGFYKIIANRMQ

SEQ ID NO: 2235048 - protein, 21 aa, Cryptosporidium parvum
LRALISYSLVLLCGILAYNFE

SEQ ID NO: 2235049 - protein, 17 aa, Cryptosporidium parvum
LRALLILLSLILGFLSI

SEQ ID NO: 2235050 - protein, 30 aa, Cryptosporidium parvum
LRAYYPFILICIFSLTIIDVIRFSVGFIIK

SEQ ID NO: 2235051 - protein, 18 aa, Cryptosporidium parvum
LRDGSNFLAFTNELDVHS

SEQ ID NO: 2235052 - protein, 18 aa, Cryptosporidium parvum
LRDKECYEESFSLYERSI

SEQ ID NO: 2235053 - protein, 17 aa, Cryptosporidium parvum
LRDLLIQSLRNSGRSEL

SEQ ID NO: 2235054 - protein, 18 aa, Cryptosporidium parvum
LRDLRQVVGLHSFERPSI

SEQ ID NO: 2235055 - protein, 24 aa, Cryptosporidium parvum
LRDSIPKFWSLLFDIMLGPDLDSK

SEQ ID NO: 2235056 - protein, 17 aa, Cryptosporidium parvum
LRDSQSYRRSVYNSNGD

SEQ ID NO: 2235057 - protein, 22 aa, Cryptosporidium parvum
LREAMLQSFWCIHALQHALITA

SEQ ID NO: 2235058 - protein, 26 aa, Cryptosporidium parvum
LREFGCTRVQLGIQHTDYWVLKLINR

SEQ ID NO: 2235059 - protein, 18 aa, Cryptosporidium parvum
LREKIASIVRPLTTQIMI

SEQ ID NO: 2235060 - protein, 20 aa, Cryptosporidium parvum
LRFYKCISYPLPNPSDINDS

SEQ ID NO: 2235061 - protein, 21 aa, Cryptosporidium parvum
LRGGVSMALAMVFEGDTSVPG

SEQ ID NO: 2235062 - protein, 19 aa, Cryptosporidium parvum
LRHSGCVALNGILRSLILT

SEQ ID NO: 2235063 - protein, 19 aa, Cryptosporidium parvum
LRIFGLTSICENGSSTLEL

SEQ ID NO: 2235064 - protein, 26 aa, Cryptosporidium parvum
LRIIRELYRYRGLRTFWTGLLPTMMF

SEQ ID NO: 2235065 - protein, 25 aa, Cryptosporidium parvum
LRILSRDILIEFARKEKDTIKSSSL

SEQ ID NO: 2235066 - protein, 18 aa, Cryptosporidium parvum
LRIPTDVLELGRYKLCGS

SEQ ID NO: 2235067 - protein, 20 aa, Cryptosporidium parvum
LRISDFNGVLKILITMNSIL

SEQ ID NO: 2235068 - protein, 20 aa, Cryptosporidium parvum
LRITDKLAISEEVLKKTLET

SEQ ID NO: 2235069 - protein, 20 aa, Cryptosporidium parvum
LRITDLLNQCIGWASKGLQI

SEQ ID NO: 2235070 - protein, 21 aa, Cryptosporidium parvum
LRKAFSKPFVCSEKDLPWLKP

SEQ ID NO: 2235071 - protein, 21 aa, Cryptosporidium parvum
LRKALKLFLIREWSLTRRLIQ

SEQ ID NO: 2235072 - protein, 23 aa, Cryptosporidium parvum
LRKLPRQAAWSFVSMLKSNSSER

SEQ ID NO: 2235073 - protein, 19 aa, Cryptosporidium parvum
LRKLSKFTGVVWSCSQITN

SEQ ID NO: 2235074 - protein, 28 aa, Cryptosporidium parvum
LRKMYRYVMDFLEEFGMRYCDYVFVNSI

SEQ ID NO: 2235075 - protein, 20 aa, Cryptosporidium parvum
LRKSIDFKPLNNMENDYGND

SEQ ID NO: 2235076 - protein, 25 aa, Cryptosporidium parvum
LRKSKSCLGISCKMQEIYLIVFCSR

SEQ ID NO: 2235077 - protein, 20 aa, Cryptosporidium parvum
LRKSLKTVRGISVVSLGRGI

SEQ ID NO: 2235078 - protein, 20 aa, Cryptosporidium parvum
LRKTLFTEFIPKISNEEKKW

SEQ ID NO: 2235079 - protein, 17 aa, Cryptosporidium parvum
LRLALPLISGYFILLPI

SEQ ID NO: 2235080 - protein, 20 aa, Cryptosporidium parvum
LRLKADLMWNYTPNIISNIL

SEQ ID NO: 2235081 - protein, 17 aa, Cryptosporidium parvum
LRLKGIISNKLYPNYYI

SEQ ID NO: 2235082 - protein, 18 aa, Cryptosporidium parvum
LRLLYSLISQQLYLIGGN

SEQ ID NO: 2235083 - protein, 19 aa, Cryptosporidium parvum
LRLNCVGILDLTRVDESKT

SEQ ID NO: 2235084 - protein, 17 aa, Cryptosporidium parvum
LRLSEVIKKYQVQYKNS

SEQ ID NO: 2235085 - protein, 17 aa, Cryptosporidium parvum
LRLSNCDSNFCLYQNED

SEQ ID NO: 2235086 - protein, 19 aa, Cryptosporidium parvum
LRLYREINPSLNFNDNPLG

SEQ ID NO: 2235087 - protein, 18 aa, Cryptosporidium parvum
LRMIHFIGRKGISLDKDA

SEQ ID NO: 2235088 - protein, 29 aa, Cryptosporidium parvum
LRNAPKRTGYRPVPGVLIYPQNFREPRVL

SEQ ID NO: 2235089 - protein, 21 aa, Cryptosporidium parvum
LRNEAKIFLNWSKPTISVNRN

SEQ ID NO: 2235090 - protein, 19 aa, Cryptosporidium parvum
LRNEISVFELIKFENQRFI

SEQ ID NO: 2235091 - protein, 17 aa, Cryptosporidium parvum
LRNIIKNLHDWYYIVSD

SEQ ID NO: 2235092 - protein, 21 aa, Cryptosporidium parvum
LRNINIVFILWIYNFVLEQRI

SEQ ID NO: 2235093 - protein, 17 aa, Cryptosporidium parvum
LRNMIEASFTFRTDIGG

SEQ ID NO: 2235094 - protein, 31 aa, Cryptosporidium parvum
LRNNDDIFMPWKIAFNGVEWMESYTVEFEPE

SEQ ID NO: 2235095 - protein, 27 aa, Cryptosporidium parvum
LRPDKYSILLSRVLWLLPHDSPDGKYL

SEQ ID NO: 2235096 - protein, 26 aa, Cryptosporidium parvum
  misc_feature (25)..(25): Xaa can be any naturally occurring amino acid
LRPSSTCMFILMSIFDHMVLFGEIXN

SEQ ID NO: 2235097 - protein, 17 aa, Cryptosporidium parvum
LRPSVPLSGQSLDSFPK

SEQ ID NO: 2235098 - protein, 17 aa, Cryptosporidium parvum
LRQLEHILGRYGEAEAK

SEQ ID NO: 2235099 - protein, 19 aa, Cryptosporidium parvum
LRQYCNLITMYGDSQDGAL

SEQ ID NO: 2235100 - protein, 26 aa, Cryptosporidium parvum
LRRKENFPLYLLGGIFELMLDDLRKV

SEQ ID NO: 2235101 - protein, 20 aa, Cryptosporidium parvum
LRRQAARPVISYTFKQLRHS

SEQ ID NO: 2235102 - protein, 25 aa, Cryptosporidium parvum
LRSFMWSSYLPFVYVVGRYYGHESI

SEQ ID NO: 2235103 - protein, 19 aa, Cryptosporidium parvum
LRSGGCMALLISNGLVMLL

SEQ ID NO: 2235104 - protein, 19 aa, Cryptosporidium parvum
LRSILGVRFIINLDIIEKI

SEQ ID NO: 2235105 - protein, 18 aa, Cryptosporidium parvum
LRSIYILVLYQLILFNIL

SEQ ID NO: 2235106 - protein, 19 aa, Cryptosporidium parvum
LRSKARYRFNIDSPFFEVA

SEQ ID NO: 2235107 - protein, 27 aa, Cryptosporidium parvum
LRSKLKLWIKNWYIIDLILKVVKTQGE

SEQ ID NO: 2235108 - protein, 20 aa, Cryptosporidium parvum
LRSLFTCVLIISFVYASNYY

SEQ ID NO: 2235109 - protein, 20 aa, Cryptosporidium parvum
LRSLLYPKKHFDTNYSEGWT

SEQ ID NO: 2235110 - protein, 18 aa, Cryptosporidium parvum
LRSLSANIFLEIHRLLEE

SEQ ID NO: 2235111 - protein, 18 aa, Cryptosporidium parvum
LRSMEFLISILIIIIIPF

SEQ ID NO: 2235112 - protein, 23 aa, Cryptosporidium parvum
LRSRPLDLRHCYSHSITSNNFHD

SEQ ID NO: 2235113 - protein, 17 aa, Cryptosporidium parvum
LRTLFTLIDDRSYLFIF

SEQ ID NO: 2235114 - protein, 18 aa, Cryptosporidium parvum
LRVKPLINVSGWTLSLSL

SEQ ID NO: 2235115 - protein, 19 aa, Cryptosporidium parvum
LRVLLLKVHYQSLMPLWPI

SEQ ID NO: 2235116 - protein, 26 aa, Cryptosporidium parvum
LRVPTEFDNTCRVLFSSVAEDGGDCF

SEQ ID NO: 2235117 - protein, 18 aa, Cryptosporidium parvum
LRYIVPSVFAIFAALFVL

SEQ ID NO: 2235118 - protein, 17 aa, Cryptosporidium parvum
LRYKLSPKLLENSSNSS

SEQ ID NO: 2235119 - protein, 17 aa, Cryptosporidium parvum
LRYLLKSKECPFCKNTI

SEQ ID NO: 2235120 - protein, 19 aa, Cryptosporidium parvum
LRYLLSSYRLFDPLENSSF

SEQ ID NO: 2235121 - protein, 20 aa, Cryptosporidium parvum
LRYSLIPYWYTLLAKYSFYG

SEQ ID NO: 2235122 - protein, 21 aa, Cryptosporidium parvum
LRYYWIKLLVLFEEIGMFVTL

SEQ ID NO: 2235123 - protein, 21 aa, Cryptosporidium parvum
LSAAPRSAFTIDIPDVSVILD

SEQ ID NO: 2235124 - protein, 17 aa, Cryptosporidium parvum
LSAEGGRTVAYFNSAVL

SEQ ID NO: 2235125 - protein, 23 aa, Cryptosporidium parvum
LSAKEVFHLLLIHTVNSTTNIVN

SEQ ID NO: 2235126 - protein, 20 aa, Cryptosporidium parvum
LSALELCGSLIQTLHEVVIP

SEQ ID NO: 2235127 - protein, 18 aa, Cryptosporidium parvum
LSALIIITLLLSFGSALF

SEQ ID NO: 2235128 - protein, 24 aa, Cryptosporidium parvum
LSAPLRGSVLFGHLQTIMPGGFSI

SEQ ID NO: 2235129 - protein, 18 aa, Cryptosporidium parvum
LSCIILLVLSVAWGETSK

SEQ ID NO: 2235130 - protein, 37 aa, Cryptosporidium parvum; identical to SEQ ID NO: 2125716

SEQ ID NO: 2235131 - protein, 19 aa, Cryptosporidium parvum
LSDIFKFKQINNINHKYNK

SEQ ID NO: 2235132 - protein, 33 aa, Cryptosporidium parvum; identical to SEQ ID NO: 2125718

SEQ ID NO: 2235133 - protein, 20 aa, Cryptosporidium parvum
LSELQIFLFFGSRFSSSSLV

SEQ ID NO: 2235134 - protein, 18 aa, Cryptosporidium parvum
LSEMISMEIQFRDIIQKS

SEQ ID NO: 2235135 - protein, 17 aa, Cryptosporidium parvum
LSEPTLISGYEFYVTIF

SEQ ID NO: 2235136 - protein, 17 aa, Cryptosporidium parvum
LSESFNVIRGFCLCEGY

SEQ ID NO: 2235137 - protein, 20 aa, Cryptosporidium parvum
LSESIFRFSSYFHSPLLNND

SEQ ID NO: 2235138 - protein, 17 aa, Cryptosporidium parvum
LSESILQPHMASIVCEA

SEQ ID NO: 2235139 - protein, 19 aa, Cryptosporidium parvum
LSESLKYPSFDNIIEIISY

SEQ ID NO: 2235140 - protein, 18 aa, Cryptosporidium parvum
LSETFSIYVLEYVDKPLA

SEQ ID NO: 2235141 - protein, 22 aa, Cryptosporidium parvum
LSEWDLAMATIPVRKSVVLVPG

SEQ ID NO: 2235142 - protein, 27 aa, Cryptosporidium parvum
LSFAGPRIDLQLAFDNSERFILVYQHL

SEQ ID NO: 2235143 - protein, 30 aa, Cryptosporidium parvum
LSFAWYCLFVLYFTGCVKFLEKWIRYADET

SEQ ID NO: 2235144 - protein, 21 aa, Cryptosporidium parvum
LSFDLLCFVPLVISGIKLPSI

SEQ ID NO: 2235145 - protein, 23 aa, Cryptosporidium parvum
LSFEIPSTVPFNIPIKDQLRNKL

SEQ ID NO: 2235146 - protein, 27 aa, Cryptosporidium parvum
LSFLPTIPICPFCKQENGFVPSKELFI

SEQ ID NO: 2235147 - protein, 30 aa, Cryptosporidium parvum; identical to SEQ ID NO: 2125729

SEQ ID NO: 2235148 - protein, 17 aa, Cryptosporidium parvum
LSFREIFIIFSQNNKNI

SEQ ID NO: 2235149 - protein, 22 aa, Cryptosporidium parvum
LSFSSSVIWSCISNFPFIQTLI

SEQ ID NO: 2235150 - protein, 20 aa, Cryptosporidium parvum
LSFSWMKWSMHVRGYQITNS

SEQ ID NO: 2235151 - protein, 19 aa, Cryptosporidium parvum
LSFTRIVGVVLFTSDSNFS

SEQ ID NO: 2235152 - protein, 19 aa, Cryptosporidium parvum
LSFYPLYSLVITSRNSYSN

SEQ ID NO: 2235153 - protein, 23 aa, Cryptosporidium parvum
LSGCAFGGVMLVQNWTMFDGVIL

SEQ ID NO: 2235154 - protein, 18 aa, Cryptosporidium parvum
LSGFEFVLLTSKRLQYKD

SEQ ID NO: 2235155 - protein, 26 aa, Cryptosporidium parvum
LSGFKLFLDRCHCIFSSVFQDQDTIS

SEQ ID NO: 2235156 - protein, 24 aa, Cryptosporidium parvum
LSGFYGHLYFIFALLLIGVSFYFA

SEQ ID NO: 2235157 - protein, 31 aa, Cryptosporidium parvum
LSGILLSCAFFALYLICWIFAYVKDLSDWVS

SEQ ID NO: 2235158 - protein, 20 aa, Cryptosporidium parvum
LSGISLRSQILYSIALISKL

SEQ ID NO: 2235159 - protein, 17 aa, Cryptosporidium parvum
LSGLNCGKGCFEYNNNS

SEQ ID NO: 2235160 - protein, 19 aa, Cryptosporidium parvum
LSGSSLNGAVCMFKAVLPL

SEQ ID NO: 2235161 - protein, 19 aa, Cryptosporidium parvum
LSHIGNPFIYEAVITNHTS

SEQ ID NO: 2235162 - protein, 18 aa, Cryptosporidium parvum
LSHLNSWIQKIFIPLIKT

SEQ ID NO: 2235163 - protein, 18 aa, Cryptosporidium parvum
LSHPWFRYSKSNNEPICI

SEQ ID NO: 2235164 - protein, 23 aa, Cryptosporidium parvum
LSICTEYPIITSFILMLNSGLTI

SEQ ID NO: 2235165 - protein, 20 aa, Cryptosporidium parvum
LSIECMKDIGAFLVSLSKRF

SEQ ID NO: 2235166 - protein, 19 aa, Cryptosporidium parvum
LSIFSRIILDFFYQHVNMD

SEQ ID NO: 2235167 - protein, 24 aa, Cryptosporidium parvum
LSIICCMIGFFLINSLGNFVNLVG

SEQ ID NO: 2235168 - protein, 18 aa, Cryptosporidium parvum
LSIILITAPVPWARWYVE

SEQ ID NO: 2235169 - protein, 18 aa, Cryptosporidium parvum
LSIISTCILSLILSLIWI

SEQ ID NO: 2235170 - protein, 17 aa, Cryptosporidium parvum
LSILRCSKNGLKNFSKN

SEQ ID NO: 2235171 - protein, 18 aa, Cryptosporidium parvum
LSILRSGNAIPYPEPQGS

SEQ ID NO: 2235172 - protein, 17 aa, Cryptosporidium parvum
LSILRSLFRSITPGGKA

SEQ ID NO: 2235173 - protein, 30 aa, Cryptosporidium parvum; identical to SEQ ID NO: 2125752

SEQ ID NO: 2235174 - protein, 18 aa, Cryptosporidium parvum
LSITIWNYLLNPFYVCHI

SEQ ID NO: 2235175 - protein, 18 aa, Cryptosporidium parvum
LSIVPGRRLHIFSESLNV

SEQ ID NO: 2235176 - protein, 20 aa, Cryptosporidium parvum
LSIYRKWIYHSSSVIRHFSS

SEQ ID NO: 2235177 - protein, 30 aa, Cryptosporidium parvum; identical to SEQ ID NO: 2125754

SEQ ID NO: 2235178 - protein, 20 aa, Cryptosporidium parvum
LSKIRWLSLLLLTIGAVLVQ

SEQ ID NO: 2235179 - protein, 22 aa, Cryptosporidium parvum
LSKKLPDIFLIITGKGPNKNSW

SEQ ID NO: 2235180 - protein, 21 aa, Cryptosporidium parvum
LSKSCTNLGLISLFEEQICGL

SEQ ID NO: 2235181 - protein, 18 aa, Cryptosporidium parvum
LSLDLSFINGDNFGIGIK

SEQ ID NO: 2235182 - protein, 25 aa, Cryptosporidium parvum
LSLDWPTNGNILFKNVVLRYNPDEP

SEQ ID NO: 2235183 - protein, 25 aa, Cryptosporidium parvum
LSLEIQCLNSLRLIENGLISIVHLI

SEQ ID NO: 2235184 - protein, 18 aa, Cryptosporidium parvum
LSLEWGDKFIEIHREIKN

SEQ ID NO: 2235185 - protein, 25 aa, Cryptosporidium parvum
LSLIKDKISFIIIIWCPLIIINYSN

SEQ ID NO: 2235186 - protein, 24 aa, Cryptosporidium parvum
LSLKEIELIPCISNDLVLSYSDPL

SEQ ID NO: 2235187 - protein, 26 aa, Cryptosporidium parvum
LSLKKGDRIILCYTPGIDFIYSFYGC

SEQ ID NO: 2235188 - protein, 17 aa, Cryptosporidium parvum
LSLLFFRLDCLDGIVSE

SEQ ID NO: 2235189 - protein, 26 aa, Cryptosporidium parvum
LSLLLVKINMTYKCEIFYIDAELLIT

SEQ ID NO: 2235190 - protein, 31 aa, Cryptosporidium parvum; identical to SEQ ID NO: 2125763

SEQ ID NO: 2235191 - protein, 28 aa, Cryptosporidium parvum
LSLSEIYRLCFLESGSIRHFFLTCFFIS

SEQ ID NO: 2235192 - protein, 18 aa, Cryptosporidium parvum
LSLSILAFCKMESSPTLH

SEQ ID NO: 2235193 - protein, 18 aa, Cryptosporidium parvum
LSLSKGFNIELERYESVG

SEQ ID NO: 2235194 - protein, 19 aa, Cryptosporidium parvum
LSLSSFKIVLSRKFTKNVE

SEQ ID NO: 2235195 - protein, 19 aa, Cryptosporidium parvum
LSLYCSMLCLIIFSVSSSG

SEQ ID NO: 2235196 - protein, 24 aa, Cryptosporidium parvum
LSLYHFKKRILFFNNNNNGYDIKM

SEQ ID NO: 2235197 - protein, 18 aa, Cryptosporidium parvum
LSLYPGNRGSSLLLKAIK

SEQ ID NO: 2235198 - protein, 21 aa, Cryptosporidium parvum
LSMFSEFFKSPLFDENYAEKE

SEQ ID NO: 2235199 - protein, 21 aa, Cryptosporidium parvum
LSNDLRRSWYRRFGTVENNLD

SEQ ID NO: 2235200 - protein, 23 aa, Cryptosporidium parvum
LSNEISMDLQVFFTDGLFSSRVL

SEQ ID NO: 2235201 - protein, 22 aa, Cryptosporidium parvum
LSNINFNGCFLLIKQPSTEKSL

SEQ ID NO: 2235202 - protein, 23 aa, Cryptosporidium parvum
LSNKRLLIGILYELELAFCGVIG

SEQ ID NO: 2235203 - protein, 18 aa, Cryptosporidium parvum
LSNLLLIYQIFTFIFGSI

SEQ ID NO: 2235204 - protein, 23 aa, Cryptosporidium parvum
LSNQRWVVITIKYLLGTEFTSRI

SEQ ID NO: 2235205 - protein, 24 aa, Cryptosporidium parvum
LSNQWKTGIDFMYSKYGQYDLMIA

SEQ ID NO: 2235206 - protein, 18 aa, Cryptosporidium parvum
LSNTFSVPWIATNESMYD

SEQ ID NO: 2235207 - protein, 18 aa, Cryptosporidium parvum
LSNVDIWQLYLLAVIQKY

SEQ ID NO: 2235208 - protein, 26 aa, Cryptosporidium parvum
LSNVFPCVIIPLKVQKIFSILSNHTM

SEQ ID NO: 2235209 - protein, 18 aa, Cryptosporidium parvum
LSNYRWMQTIALALPYEI

SEQ ID NO: 2235210 - protein, 17 aa, Cryptosporidium parvum
LSPIIGIVQGHYSSSDN

SEQ ID NO: 2235211 - protein, 20 aa, Cryptosporidium parvum
LSPKLKFGYFHMLSSQYEEG

SEQ ID NO: 2235212 - protein, 19 aa, Cryptosporidium parvum
LSQDMGWVSFMCLLSTFMT

SEQ ID NO: 2235213 - protein, 29 aa, Cryptosporidium parvum
LSRMLWSRYIFCCLLFFIWYICTWFVGAH

SEQ ID NO: 2235214 - protein, 19 aa, Cryptosporidium parvum
LSRQSCTIANIGQFIGGEM

SEQ ID NO: 2235215 - protein, 18 aa, Cryptosporidium parvum
LSRVCVKNSAGKKFQRNF

SEQ ID NO: 2235216 - protein, 25 aa, Cryptosporidium parvum
LSRVILLCFGCIWISENLDKNTKLS

SEQ ID NO: 2235217 - protein, 18 aa, Cryptosporidium parvum
LSSAFLGRKHLRLATPFS

SEQ ID NO: 2235218 - protein, 21 aa, Cryptosporidium parvum
LSSAFQCFAFLLLASKVNTQC

SEQ ID NO: 2235219 - protein, 17 aa, Cryptosporidium parvum
LSSDIERKLYPDGPNSN

SEQ ID NO: 2235220 - protein, 18 aa, Cryptosporidium parvum
LSSIQIFLGNCYINTRTI

SEQ ID NO: 2235221 - protein, 38 aa, Cryptosporidium parvum; identical to SEQ ID NO: 2177225

SEQ ID NO: 2235222 - protein, 28 aa, Cryptosporidium parvum
LSSLKVYPLFARGWITWAQYTDRLLYIH

SEQ ID NO: 2235223 - protein, 23 aa, Cryptosporidium parvum
LSSPVYFGSVWLRVNGTRWILLE

SEQ ID NO: 2235224 - protein, 27 aa, Cryptosporidium parvum
LSSSIAIKHGFDLIPIYIAGAKDGTYL

SEQ ID NO: 2235225 - protein, 17 aa, Cryptosporidium parvum
LSSTFPMDIPLAGKLKV

SEQ ID NO: 2235226 - protein, 24 aa, Cryptosporidium parvum
LSSVLSCFPFSYSSFHDIIMACNR

SEQ ID NO: 2235227 - protein, 17 aa, Cryptosporidium parvum
LSSVSGYALLLDDDSVE

SEQ ID NO: 2235228 - protein, 20 aa, Cryptosporidium parvum
LSSYKWNISYDQPFSSQISQ

SEQ ID NO: 2235229 - protein, 17 aa, Cryptosporidium parvum
LSVIKMTAFAFALISSL

SEQ ID NO: 2235230 - protein, 21 aa, Cryptosporidium parvum
LSVIVSAVFSAPAVPLRGTLK

SEQ ID NO: 2235231 - protein, 25 aa, Cryptosporidium parvum
LSVKVFPAIFIITSGYQYEMYSKIY

SEQ ID NO: 2235232 - protein, 20 aa, Cryptosporidium parvum
LSVLYRYFISPFDGVMGTPA

SEQ ID NO: 2235233 - protein, 17 aa, Cryptosporidium parvum
LSYSFRSGTGFEDDSEI

SEQ ID NO: 2235234 - protein, 17 aa, Cryptosporidium parvum
LSYSVIMPFNYIAGPLI

SEQ ID NO: 2235235 - protein, 17 aa, Cryptosporidium parvum
LSYTTFDHFFLIRSYDF

SEQ ID NO: 2235236 - protein, 25 aa, Cryptosporidium parvum
LSYYLEWGALATFWFNFIALIPLAN

SEQ ID NO: 2235237 - protein, 19 aa, Cryptosporidium parvum
LSYYNVCKSFILNNKTSIF

SEQ ID NO: 2235238 - protein, 17 aa, Cryptosporidium parvum
LTCPYCNTFSNIILPFK

SEQ ID NO: 2235239 - protein, 38 aa, Cryptosporidium parvum
LTDEEIKCGFCFSKCCCWPVWSGSIISFAAYMVMAFLA

SEQ ID NO: 2235240 - protein, 26 aa, Cryptosporidium parvum
LTEDFLLVFMNFSLVRILSSNSYGNT

SEQ ID NO: 2235241 - protein, 18 aa, Cryptosporidium parvum
LTESCERLQLLMESNESE

SEQ ID NO: 2235242 - protein, 18 aa, Cryptosporidium parvum
LTFFITIWNYVISRNNGF

SEQ ID NO: 2235243 - protein, 18 aa, Cryptosporidium parvum
LTFGSTCFDQTKMMNYPF

SEQ ID NO: 2235244 - protein, 21 aa, Cryptosporidium parvum
LTFTYLCAFAYGESTLSAITL

SEQ ID NO: 2235245 - protein, 19 aa, Cryptosporidium parvum
LTFVIQLLFKSLIKHCQII

SEQ ID NO: 2235246 - protein, 17 aa, Cryptosporidium parvum
LTGEFGLFSMMNCNEDK

SEQ ID NO: 2235247 - protein, 17 aa, Cryptosporidium parvum
LTGLASYYEILELFENY

SEQ ID NO: 2235248 - protein, 27 aa, Cryptosporidium parvum
LTGYLIKLLRLFPQRKTYIIKAICSLL

SEQ ID NO: 2235249 - protein, 18 aa, Cryptosporidium parvum
LTICGHLIHYKCVGQYYK

SEQ ID NO: 2235250 - protein, 18 aa, Cryptosporidium parvum
LTIGMDFSLLFPLLQDKL

SEQ ID NO: 2235251 - protein, 24 aa, Cryptosporidium parvum
LTIIPGFCVSGTIGSKIINGAKRV

SEQ ID NO: 2235252 - protein, 19 aa, Cryptosporidium parvum
LTIISFCYFTLLFITKSSI

SEQ ID NO: 2235253 - protein, 29 aa, Cryptosporidium parvum
LTILRNILKLIVELIELPKLIESFVSANM

SEQ ID NO: 2235254 - protein, 24 aa, Cryptosporidium parvum
LTIMALKILMFLPLILSNIGYIQK

SEQ ID NO: 2235255 - protein, 17 aa, Cryptosporidium parvum
LTIPIYFLLLRDQERAT

SEQ ID NO: 2235256 - protein, 23 aa, Cryptosporidium parvum
LTISIYGIMLIYWPSKEALQPYQ

SEQ ID NO: 2235257 - protein, 20 aa, Cryptosporidium parvum
LTISKYNVFTGLALNGDDGW

SEQ ID NO: 2235258 - protein, 27 aa, Cryptosporidium parvum
LTISSFLFIWVLYCFSIIKYLKGDQHI

SEQ ID NO: 2235259 - protein, 17 aa, Cryptosporidium parvum
LTITLVIIAHKWVEGIA

SEQ ID NO: 2235260 - protein, 27 aa, Cryptosporidium parvum
LTKGFPRVEISIPIKRFCICSVSGLIG

SEQ ID NO: 2235261 - protein, 18 aa, Cryptosporidium parvum
LTLDGWELLIDPTIYLRN

SEQ ID NO: 2235262 - protein, 23 aa, Cryptosporidium parvum
LTLEGKDAISFIIESGNKKLLNK

SEQ ID NO: 2235263 - protein, 25 aa, Cryptosporidium parvum
LTLLAISMFLLWFLLGSLINSDNIL

SEQ ID NO: 2235264 - protein, 18 aa, Cryptosporidium parvum
LTLQGCSGIEDILQHRAQ

SEQ ID NO: 2235265 - protein, 25 aa, Cryptosporidium parvum
LTLQSFCLDWFYRDLNMIYEKVKLN

SEQ ID NO: 2235266 - protein, 17 aa, Cryptosporidium parvum
LTLRDLRQVVGLHSFER

SEQ ID NO: 2235267 - protein, 28 aa, Cryptosporidium parvum
LTLRNLFGLYCHVVFSLCKFVSVIINAI

SEQ ID NO: 2235268 - protein, 25 aa, Cryptosporidium parvum
LTLSFFLWKCMDEIASDDISTFTII

SEQ ID NO: 2235269 - protein, 18 aa, Cryptosporidium parvum
LTLSRIAFSYVAFSFYQR

SEQ ID NO: 2235270 - protein, 23 aa, Cryptosporidium parvum
LTLWEYLPLVAILSGCTGIFIIF

SEQ ID NO: 2235271 - protein, 17 aa, Cryptosporidium parvum
LTLWLMLIALSGYSVKN

SEQ ID NO: 2235272 - protein, 24 aa, Cryptosporidium parvum
LTLWRSGAVGFFIWKYSQINLKQN

SEQ ID NO: 2235273 - protein, 24 aa, Cryptosporidium parvum
LTMLELNLALGCFETNYRKSESII

SEQ ID NO: 2235274 - protein, 23 aa, Cryptosporidium parvum
LTMLPPKFSRNSWINHLPENLQN

SEQ ID NO: 2235275 - protein, 19 aa, Cryptosporidium parvum
LTNDLNMCKVLSYTYIESL

SEQ ID NO: 2235276 - protein, 20 aa, Cryptosporidium parvum
LTNITSLSHLNSWIQKIFIP

SEQ ID NO: 2235277 - protein, 19 aa, Cryptosporidium parvum
LTNLITWLVIEIIEDLSRS

SEQ ID NO: 2235278 - protein, 18 aa, Cryptosporidium parvum
LTNLTCPYCNTFSNIILP

SEQ ID NO: 2235279 - protein, 18 aa, Cryptosporidium parvum
LTQQFGRCGRDHKTKSIK

SEQ ID NO: 2235280 - protein, 17 aa, Cryptosporidium parvum
LTSFPTVAPITISVFSR

SEQ ID NO: 2235281 - protein, 20 aa, Cryptosporidium parvum
LTVCVRPWWGEPIKNGNLGN

SEQ ID NO: 2235282 - protein, 17 aa, Cryptosporidium parvum
LTVELILNTKIENCNSK

SEQ ID NO: 2235283 - protein, 26 aa, Cryptosporidium parvum
LTVPARLKSLLPYMGQLISPMLNALE

SEQ ID NO: 2235284 - protein, 23 aa, Cryptosporidium parvum
LTYLDIFWMKWSRQLNETNDSLI

SEQ ID NO: 2235285 - protein, 17 aa, Cryptosporidium parvum
LTYSTARLGIFRLLCDY

SEQ ID NO: 2235286 - protein, 17 aa, Cryptosporidium parvum
LTYYFRIAPHAMITLLC

SEQ ID NO: 2235287 - protein, 20 aa, Cryptosporidium parvum
LVALTRLYGVSEVRLTVRRA

SEQ ID NO: 2235288 - protein, 19 aa, Cryptosporidium parvum
LVAMFLLEYIRFLPEAVLG

SEQ ID NO: 2235289 - protein, 22 aa, Cryptosporidium parvum
LVDKLKFAITIATPILSVLACI

SEQ ID NO: 2235290 - protein, 18 aa, Cryptosporidium parvum
LVEEKLRTLFTLIDDRSY

SEQ ID NO: 2235291 - protein, 20 aa, Cryptosporidium parvum
LVEFDKFSSIYKFESAGQKE

SEQ ID NO: 2235292 - protein, 20 aa, Cryptosporidium parvum
LVEISELITSVTIPSVEDIY

SEQ ID NO: 2235293 - protein, 19 aa, Cryptosporidium parvum
LVENGHPFLISKIIEEELG

SEQ ID NO: 2235294 - protein, 18 aa, Cryptosporidium parvum
LVFAWGIGQYGCLGTGEL

SEQ ID NO: 2235295 - protein, 21 aa, Cryptosporidium parvum
LVFGEALAIYGVIIGIIMGTT

SEQ ID NO: 2235296 - protein, 24 aa, Cryptosporidium parvum
LVFKNNLSNFGFNIAFINYIYQNS

SEQ ID NO: 2235297 - protein, 18 aa, Cryptosporidium parvum
LVFLLGNREFDVFRRLYS

SEQ ID NO: 2235298 - protein, 18 aa, Cryptosporidium parvum
LVFSFPVSCHSFRKSLAV

SEQ ID NO: 2235299 - protein, 24 aa, Cryptosporidium parvum
LVFVCLCSAYSIWIGTPINEGIFI

SEQ ID NO: 2235300 - protein, 23 aa, Cryptosporidium parvum
LVGKISGLILEFDMNMLSDKISF

SEQ ID NO: 2235301 - protein, 24 aa, Cryptosporidium parvum
LVGRLLERVICRFSEISNRKKEDS

SEQ ID NO: 2235302 - protein, 24 aa, Cryptosporidium parvum
LVHFPRLLIYFLIAMHRVIFLHII

SEQ ID NO: 2235303 - protein, 17 aa, Cryptosporidium parvum
LVIAILMSLRISCYKCD

SEQ ID NO: 2235304 - protein, 23 aa, Cryptosporidium parvum
LVICKFQILEIILKALKSVLKAF

SEQ ID NO: 2235305 - protein, 18 aa, Cryptosporidium parvum
LVIDSGTTLSYFPEHIFI

SEQ ID NO: 2235306 - protein, 23 aa, Cryptosporidium parvum
LVIFCLPIMFKLIVNLSSDSKKK

SEQ ID NO: 2235307 - protein, 22 aa, Cryptosporidium parvum
LVIFYFVCCNLHKLDTVDCIKL

SEQ ID NO: 2235308 - protein, 24 aa, Cryptosporidium parvum
LVIREFPVSFGIPVITLQKLNVRP

SEQ ID NO: 2235309 - protein, 23 aa, Cryptosporidium parvum
LVIYNILFDWYMIDLRSIERELD

SEQ ID NO: 2235310 - protein, 18 aa, Cryptosporidium parvum
LVKQGKFRALSMGIYSTT

SEQ ID NO: 2235311 - protein, 17 aa, Cryptosporidium parvum
LVKRYLLDFLISHVPIN

SEQ ID NO: 2235312 - protein, 25 aa, Cryptosporidium parvum
LVKVFREAFLKEKVCIDQIQGDCFN

SEQ ID NO: 2235313 - protein, 26 aa, Cryptosporidium parvum
LVLAACTRISWQLFKELMLCSPLITG

SEQ ID NO: 2235314 - protein, 18 aa, Cryptosporidium parvum
LVLFDLGIERFLGSSAFA

SEQ ID NO: 2235315 - protein, 26 aa, Cryptosporidium parvum
LVLFEEIGMFVTLFSMFLTLLAISMF

SEQ ID NO: 2235316 - protein, 21 aa, Cryptosporidium parvum
LVLKLALKIYFPSSIITGMSI

SEQ ID NO: 2235317 - protein, 18 aa, Cryptosporidium parvum
LVLLCGILAYNFEDELGS

SEQ ID NO: 2235318 - protein, 18 aa, Cryptosporidium parvum
LVLMICIDYNPYFISGRN

SEQ ID NO: 2235319 - protein, 22 aa, Cryptosporidium parvum
LVLPICRALETLLEKKTYISFL

SEQ ID NO: 2235320 - protein, 25 aa, Cryptosporidium parvum
LVLYMEFISYILLAMPFQFESEILL

SEQ ID NO: 2235321 - protein, 24 aa, Cryptosporidium parvum
LVMKRIFFCPTFILQYLMLSTTFF

SEQ ID NO: 2235322 - protein, 26 aa, Cryptosporidium parvum
LVMNICLLIALAPWTLPIFLIMMGLI

SEQ ID NO: 2235323 - protein, 26 aa, Cryptosporidium parvum
LVNNVGVFKLCFKRRIINEEDSNDEI

SEQ ID NO: 2235324 - protein, 19 aa, Cryptosporidium parvum
LVNSFIMEIFKSCRTCSQF

SEQ ID NO: 2235325 - protein, 19 aa, Cryptosporidium parvum
LVPIAYWRLSQGMTPSITV

SEQ ID NO: 2235326 - protein, 25 aa, Cryptosporidium parvum
LVPILTFLIFFNFVDSSSIDHAQVK

SEQ ID NO: 2235327 - protein, 25 aa, Cryptosporidium parvum
LVPLPCLGFLTSVFEGEVSPEYTIA

SEQ ID NO: 2235328 - protein, 27 aa, Cryptosporidium parvum
LVPVFICIPCLIWVWCSDHCLQILKYR

SEQ ID NO: 2235329 - protein, 30 aa, Cryptosporidium parvum; identical to SEQ ID NO: 2125842

SEQ ID NO: 2235330 - protein, 17 aa, Cryptosporidium parvum
LVQKYCYSGYFQQFYYK

SEQ ID NO: 2235331 - protein, 24 aa, Cryptosporidium parvum
LVRRPESIYIYSYLQYRGSIPIVW

SEQ ID NO: 2235332 - protein, 19 aa, Cryptosporidium parvum
LVSEELWSSILTRVSSMMC

SEQ ID NO: 2235333 - protein, 23 aa, Cryptosporidium parvum
LVSKLYLLVPIWKSILSNYTIEK

SEQ ID NO: 2235334 - protein, 17 aa, Cryptosporidium parvum
LVSLGIVMFCSFLTLLI

SEQ ID NO: 2235335 - protein, 21 aa, Cryptosporidium parvum
LVSSGSLIFRRDIQLPLIKPT

SEQ ID NO: 2235336 - protein, 25 aa, Cryptosporidium parvum
LVSSYTLPIIWLLKSMNLSDSISIN

SEQ ID NO: 2235337 - protein, 23 aa, Cryptosporidium parvum
LVSTRVISCLDISKTKRNYDSIN

SEQ ID NO: 2235338 - protein, 19 aa, Cryptosporidium parvum
LVSYLFLVAFFFTRNIILP

SEQ ID NO: 2235339 - protein, 19 aa, Cryptosporidium parvum
LVTLNLLWERVIPIRDYLK

SEQ ID NO: 2235340 - protein, 25 aa, Cryptosporidium parvum
LVTNLLKQCLAGIVVKSRSNKLEKY

SEQ ID NO: 2235341 - protein, 31 aa, Cryptosporidium parvum
LVWSFLNPLGFLWVLIIQRFRIFLYIINNLL

SEQ ID NO: 2235342 - protein, 26 aa, Cryptosporidium parvum
LVYYMMIYDLEWTWKYILSTKNGRFL

SEQ ID NO: 2235343 - protein, 27 aa, Cryptosporidium parvum
LWEFQFSRLYFKLARGDCRIIFSNSWL

SEQ ID NO: 2235344 - protein, 18 aa, Cryptosporidium parvum
LWERVIPIRDYLKSNHKL

SEQ ID NO: 2235345 - protein, 18 aa, Cryptosporidium parvum
LWFDLMRLPDKILRSKLL

SEQ ID NO: 2235346 - protein, 18 aa, Cryptosporidium parvum
LWIIFFFHCSHIVMYNGV

SEQ ID NO: 2235347 - protein, 21 aa, Cryptosporidium parvum
LWKERGIEMINDWAKENFEIV

SEQ ID NO: 2235348 - protein, 26 aa, Cryptosporidium parvum
LWKRYPARIYRHMMKTSSTWIVPFLM

SEQ ID NO: 2235349 - protein, 26 aa, Cryptosporidium parvum
LWLRFGEIPLEGKISFCNLTQNDSKI

SEQ ID NO: 2235350 - protein, 19 aa, Cryptosporidium parvum
LWNAISWYSTDKILRDYSE

SEQ ID NO: 2235351 - protein, 21 aa, Cryptosporidium parvum
LWNEVKQVFELNGQKIKKFSE

SEQ ID NO: 2235352 - protein, 19 aa, Cryptosporidium parvum
LWNICTMFLLELPNFLSTF

SEQ ID NO: 2235353 - protein, 17 aa, Cryptosporidium parvum
LWNKYGYTSIFTYFTIY

SEQ ID NO: 2235354 - protein, 22 aa, Cryptosporidium parvum
LWPEAIKVVLNIGLHLEKPESS

SEQ ID NO: 2235355 - protein, 25 aa, Cryptosporidium parvum
LWPQRRGAGVLALLAFLTSIAVAGV

SEQ ID NO: 2235356 - protein, 25 aa, Cryptosporidium parvum
LWVVEGLSFISMCIAYSVVESYSTC

SEQ ID NO: 2235357 - protein, 20 aa, Cryptosporidium parvum
LWYLPSDKIFPFPITSNKCS

SEQ ID NO: 2235358 - protein, 23 aa, Cryptosporidium parvum
LYANPHSILFLFNIIPPLLSCSS

SEQ ID NO: 2235359 - protein, 32 aa, Cryptosporidium parvum
LYCQNMMFAWLRLRLDFLLPVVLTSINVLFPI

SEQ ID NO: 2235360 - protein, 23 aa, Cryptosporidium parvum
LYDFTSNCIFEILSEKDIPLLTE

SEQ ID NO: 2235361 - protein, 19 aa, Cryptosporidium parvum
LYEIISFHYNKYLQKLREQ

SEQ ID NO: 2235362 - protein, 23 aa, Cryptosporidium parvum
LYEKRLPSLQTWTNIDKMMILNI

SEQ ID NO: 2235363 - protein, 19 aa, Cryptosporidium parvum
LYFNYKWTKERIVCDIQIS

SEQ ID NO: 2235364 - protein, 23 aa, Cryptosporidium parvum
LYFTHGFWTILFYFGLTANILAS

SEQ ID NO: 2235365 - protein, 23 aa, Cryptosporidium parvum
LYFTRPVEYLFIRDCNQCNIYCL

SEQ ID NO: 2235366 - protein, 22 aa, Cryptosporidium parvum
LYGLGCNLLLFSKYHEIEHEHL

SEQ ID NO: 2235367 - protein, 26 aa, Cryptosporidium parvum
LYGLPVCPLPSMPFNKMAIYNQSQIY

SEQ ID NO: 2235368 - protein, 18 aa, Cryptosporidium parvum
LYGNCQGELFNNRDLNKK

SEQ ID NO: 2235369 - protein, 22 aa, Cryptosporidium parvum
LYGQKCIWCNRTYHDECAENNK

SEQ ID NO: 2235370 - protein, 25 aa, Cryptosporidium parvum
LYIILKFFILFIFFVYLKTRHDLIK

SEQ ID NO: 2235371 - protein, 19 aa, Cryptosporidium parvum
LYIIPCILFLIAHSRFESQ

SEQ ID NO: 2235372 - protein, 26 aa, Cryptosporidium parvum
LYILFLLKLVMLIGFGSYYFNKRKQE

SEQ ID NO: 2235373 - protein, 22 aa, Cryptosporidium parvum
LYILGCFSIDCLALKKNNLNKV

SEQ ID NO: 2235374 - protein, 24 aa, Cryptosporidium parvum
LYILPLWCGCCILNHFNRDGRSFQ

SEQ ID NO: 2235375 - protein, 18 aa, Cryptosporidium parvum
LYIMGDIFHVLKALYSKL

SEQ ID NO: 2235376 - protein, 17 aa, Cryptosporidium parvum
LYIRTLKISDIIVTITI

SEQ ID NO: 2235377 - protein, 27 aa, Cryptosporidium parvum
LYISLKNILKMISFTPISWKKRPDPIC

SEQ ID NO: 2235378 - protein, 18 aa, Cryptosporidium parvum
LYIVWKLLLYITLGVSIM

SEQ ID NO: 2235379 - protein, 30 aa, Cryptosporidium parvum
LYKHVKTVYVWPRNALGLFKSLFDRSEFER

SEQ ID NO: 2235380 - protein, 17 aa, Cryptosporidium parvum
LYKRIPYLFEVLYINLG

SEQ ID NO: 2235381 - protein, 41 aa, Cryptosporidium parvum
LYKYLNSFRLFMKMPSFISTIYILIGLLMKIEISYSKFEFL

SEQ ID NO: 2235382 - protein, 23 aa, Cryptosporidium parvum
LYLFNPCWTFTLSSKTDIFDKEK

SEQ ID NO: 2235383 - protein, 17 aa, Cryptosporidium parvum
LYLHFINISLRRLTHLH

SEQ ID NO: 2235384 - protein, 17 aa, Cryptosporidium parvum
LYLLCPTIPPRVLSNEQ

SEQ ID NO: 2235385 - protein, 24 aa, Cryptosporidium parvum
LYLMLWRFLEQQFESVLSVLDIAT

SEQ ID NO: 2235386 - protein, 18 aa, Cryptosporidium parvum
LYLNIGIIDPERYYSLLL

SEQ ID NO: 2235387 - protein, 17 aa, Cryptosporidium parvum
LYLRFVRQTIIRNFVRS

SEQ ID NO: 2235388 - protein, 17 aa, Cryptosporidium parvum
LYMLDGLVFNLRKQGFL

SEQ ID NO: 2235389 - protein, 17 aa, Cryptosporidium parvum
LYMPWKAPKNGKAVWNG

SEQ ID NO: 2235390 - protein, 28 aa, Cryptosporidium parvum
LYNMGCALIAVLLASLILMPSISSVIIV

SEQ ID NO: 2235391 - protein, 21 aa, Cryptosporidium parvum
LYNSLRLLFLSSITTVIVDYL

SEQ ID NO: 2235392 - protein, 22 aa, Cryptosporidium parvum
LYPGNFAKYSFWLTVINLLILN

SEQ ID NO: 2235393 - protein, 22 aa, Cryptosporidium parvum
LYPHFIERYFAIFAPNLVSCLN

SEQ ID NO: 2235394 - protein, 28 aa, Cryptosporidium parvum
LYPRSSKRLKLIAVVPFKGIFSTNTIQL

SEQ ID NO: 2235395 - protein, 23 aa, Cryptosporidium parvum
LYQELDFVLLAPIFSFLKTFDFS

SEQ ID NO: 2235396 - protein, 23 aa, Cryptosporidium parvum
LYREIMPSMLHRSLMSKDAAMNM

SEQ ID NO: 2235397 - protein, 18 aa, Cryptosporidium parvum
LYSACIVACITTGNKDLD

SEQ ID NO: 2235398 - protein, 24 aa, Cryptosporidium parvum
LYSAELRLPFLSAKERREKVRILL

SEQ ID NO: 2235399 - protein, 26 aa, Cryptosporidium parvum
LYSFYRIGIIVPEGFWVAEQRGTQSY

SEQ ID NO: 2235400 - protein, 18 aa, Cryptosporidium parvum
LYSQLGISALFGISVVIA

SEQ ID NO: 2235401 - protein, 21 aa, Cryptosporidium parvum
LYTECGYTFISKSNFVIKDWF

SEQ ID NO: 2235402 - protein, 23 aa, Cryptosporidium parvum
LYTLPCLINQLSLNDKFEQIVFI

SEQ ID NO: 2235403 - protein, 25 aa, Cryptosporidium parvum
LYTRCISCKHGGHIKHIKDWFEDRT

SEQ ID NO: 2235404 - protein, 29 aa, Cryptosporidium parvum
LYWTKRGPIKFCIVCGENIQINSDFFDRL

SEQ ID NO: 2235405 - protein, 18 aa, Cryptosporidium parvum
LYWYLTILGLLSYSVIMP

SEQ ID NO: 2235406 - protein, 18 aa, Cryptosporidium parvum
LYYKLDPFLKEWKNPDIQ

SEQ ID NO: 2235407 - protein, 33 aa, Cryptosporidium parvum
MAFLLRGFLLIKFIRWVIMKDPFNNVQLEIFNK

SEQ ID NO: 2235408 - protein, 26 aa, Cryptosporidium parvum
MALKQLKLKIGIHSGRVISGVVGTNK

SEQ ID NO: 2235409 - protein, 18 aa, Cryptosporidium parvum
MAQITFLWGFGLVAIPLK

SEQ ID NO: 2235410 - protein, 21 aa, Cryptosporidium parvum
MASKFSHIPQHFSLVCKCLAA

SEQ ID NO: 2235411 - protein, 19 aa, Cryptosporidium parvum
MASTMTLTIIAFLLFILLI

SEQ ID NO: 2235412 - protein, 18 aa, Cryptosporidium parvum
MAYKSITTSGIWFSNNGS

SEQ ID NO: 2235413 - protein, 17 aa, Cryptosporidium parvum
MCDLQCFNEACNWDRGD

SEQ ID NO: 2235414 - protein, 19 aa, Cryptosporidium parvum
MCIFIPINWLWTEDSSLKY

SEQ ID NO: 2235415 - protein, 19 aa, Cryptosporidium parvum
MDCALKGICWENQDKNIHF

SEQ ID NO: 2235416 - protein, 17 aa, Cryptosporidium parvum
MDEAIDLLTKCSETLRK

SEQ ID NO: 2235417 - protein, 23 aa, Cryptosporidium parvum
MDFRLKVTIEEFVKFSYSLRFLG

SEQ ID NO: 2235418 - protein, 23 aa, Cryptosporidium parvum
MDHHCPWINNCVGFYNRKFFIQL

SEQ ID NO: 2235419 - protein, 24 aa, Cryptosporidium parvum
MDHHCPWISNCVGWGNHKHLLLLI

SEQ ID NO: 2235420 - protein, 24 aa, Cryptosporidium parvum
MDHSKSYFKICKILFSIYMNLAKN

SEQ ID NO: 2235421 - protein, 23 aa, Cryptosporidium parvum
MDIEGQNIWQFIVSRSKLLYNID

SEQ ID NO: 2235422 - protein, 21 aa, Cryptosporidium parvum
MDIGRFCDIFEKIHIYMIGVL

SEQ ID NO: 2235423 - protein, 24 aa, Cryptosporidium parvum
MDILQEIKLFINYFKDVKDSIIYY

SEQ ID NO: 2235424 - protein, 17 aa, Cryptosporidium parvum
MDKGRLSTNFDQDKQEE

SEQ ID NO: 2235425 - protein, 17 aa, Cryptosporidium parvum
MDLRKSIDFKPLNNMEN

SEQ ID NO: 2235426 - protein, 26 aa, Cryptosporidium parvum
MDPFEFKQCFPNVEFRLFGIGRLDNF

SEQ ID NO: 2235427 - protein, 22 aa, Cryptosporidium parvum
MDRNLDCISPIYSPILNINLSE

SEQ ID NO: 2235428 - protein, 17 aa, Cryptosporidium parvum
MDSCFLGCIIFILTYVA

SEQ ID NO: 2235429 - protein, 25 aa, Cryptosporidium parvum
MDSLECFLHGLRLQWVEFQNKFYKG

SEQ ID NO: 2235430 - protein, 18 aa, Cryptosporidium parvum
MDSLHGCVNYLDKHGEQL

SEQ ID NO: 2235431 - protein, 19 aa, Cryptosporidium parvum
MDSLLEFFEKQLLMNISEK

SEQ ID NO: 2235432 - protein, 18 aa, Cryptosporidium parvum
MDTLEIYFPIIIPNQNSV

SEQ ID NO: 2235433 - protein, 26 aa, Cryptosporidium parvum
MDYYLLRYYVYRIITFLFMISNLPEF

SEQ ID NO: 2235434 - protein, 17 aa, Cryptosporidium parvum
MECYKGGELFDEIIHRM

SEQ ID NO: 2235435 - protein, 22 aa, Cryptosporidium parvum
MEDLAYFIGMIFSKILLQIFNI

SEQ ID NO: 2235436 - protein, 24 aa, Cryptosporidium parvum
MEDSTVEIFLRFGSVLTGTEVTPR

SEQ ID NO: 2235437 - protein, 25 aa, Cryptosporidium parvum
MEECTNLARLGLRTLVFSYKIISKE

SEQ ID NO: 2235438 - protein, 27 aa, Cryptosporidium parvum
MEFNSVELTESILLMIITNIQLWWKEV

SEQ ID NO: 2235439 - protein, 17 aa, Cryptosporidium parvum
MEFSEIMLFLQNSPTKN

SEQ ID NO: 2235440 - protein, 26 aa, Cryptosporidium parvum
MEIFKSCRTCSQFSIPSLTNCMREVR

SEQ ID NO: 2235441 - protein, 27 aa, Cryptosporidium parvum
MELITFPFSLLFLFGISNMFVDAKSIY

SEQ ID NO: 2235442 - protein, 24 aa, Cryptosporidium parvum
MENIKLMLKKGGPLFIINPFGEGL

SEQ ID NO: 2235443 - protein, 24 aa, Cryptosporidium parvum
MENLSAFILYKSHIPYKCTKEQYQ

SEQ ID NO: 2235444 - protein, 17 aa, Cryptosporidium parvum
MESFLDLQFSIIMDNSN

SEQ ID NO: 2235445 - protein, 18 aa, Cryptosporidium parvum
MESSFSMEGEWSSEEKQL

SEQ ID NO: 2235446 - protein, 23 aa, Cryptosporidium parvum
MEYAEGGSLYGLYSKYGSFPEEL

SEQ ID NO: 2235447 - protein, 25 aa, Cryptosporidium parvum
MFAEKRNLILVFAILVNIILISMAN

SEQ ID NO: 2235448 - protein, 18 aa, Cryptosporidium parvum
MFAGGSLIFFKKFGKKKR

SEQ ID NO: 2235449 - protein, 19 aa, Cryptosporidium parvum
MFCFGVFAMEMFIDRFISF

SEQ ID NO: 2235450 - protein, 17 aa, Cryptosporidium parvum
MFDEITQDFGIRCPYFL

SEQ ID NO: 2235451 - protein, 25 aa, Cryptosporidium parvum
MFDIDLAFNIGMRFIPNMKNKLEVS

SEQ ID NO: 2235452 - protein, 17 aa, Cryptosporidium parvum
MFGSAMILNSIKTEAHN

SEQ ID NO: 2235453 - protein, 22 aa, Cryptosporidium parvum
MFKSCAQTAGGFIIFHDHASVH

SEQ ID NO: 2235454 - protein, 17 aa, Cryptosporidium parvum
MFLARGFIEMVAKNLPL

SEQ ID NO: 2235455 - protein, 20 aa, Cryptosporidium parvum
MFLLELPNFLSTFFFVAGGL

SEQ ID NO: 2235456 - protein, 24 aa, Cryptosporidium parvum
MFSDLRIQVIILNIILPIFLELFI

SEQ ID NO: 2235457 - protein, 17 aa, Cryptosporidium parvum
MFSTIHLNRMLKSSQSL

SEQ ID NO: 2235458 - protein, 23 aa, Cryptosporidium parvum
MFTRKMIVLFLFAGFLGLFPGSF

SEQ ID NO: 2235459 - protein, 18 aa, Cryptosporidium parvum
MFVLEVFSIVWTFWNPEW

SEQ ID NO: 2235460 - protein, 19 aa, Cryptosporidium parvum
MFYNYKFGKDIYLCSIIYS

SEQ ID NO: 2235461 - protein, 18 aa, Cryptosporidium parvum
MGCIGGFITSFFKGVKYS

SEQ ID NO: 2235462 - protein, 23 aa, Cryptosporidium parvum
MGFFPVKFFPILFFSITINNGLF

SEQ ID NO: 2235463 - protein, 21 aa, Cryptosporidium parvum
MGFSRILSCISLCVIIPLFTV

SEQ ID NO: 2235464 - protein, 23 aa, Cryptosporidium parvum
MGGDPKLTFSQFFDILKHGDDSG

SEQ ID NO: 2235465 - protein, 25 aa, Cryptosporidium parvum
MGIVLEARRSDLLIKILKQVLEIIN

SEQ ID NO: 2235466 - protein, 22 aa, Cryptosporidium parvum
MGKFGKFLLEFSLISTAISFGS

SEQ ID NO: 2235467 - protein, 18 aa, Cryptosporidium parvum
MGLAEFLINNGFDKDALN

SEQ ID NO: 2235468 - protein, 24 aa, Cryptosporidium parvum
MGLLFELMCYLGLTMISYNYTNQL

SEQ ID NO: 2235469 - protein, 24 aa, Cryptosporidium parvum
MGLYPICYFSPLTILSDLVQNLQI

SEQ ID NO: 2235470 - protein, 19 aa, Cryptosporidium parvum
MGMAIEMIHLILTTLYFYG

SEQ ID NO: 2235471 - protein, 17 aa, Cryptosporidium parvum
MGRDIPNRFPKLVTPSV

SEQ ID NO: 2235472 - protein, 26 aa, Cryptosporidium parvum
MGTLNCIFGLISINLLAIVISLYIIS

SEQ ID NO: 2235473 - protein, 23 aa, Cryptosporidium parvum
MHLEELLSISCLFLQDQNVSSKN

SEQ ID NO: 2235474 - protein, 19 aa, Cryptosporidium parvum
MHMGMAPFFTGMLMSYSLQ

SEQ ID NO: 2235475 - protein, 21 aa, Cryptosporidium parvum
MHPSCIQCWNIFTLQLIEDFR

SEQ ID NO: 2235476 - protein, 18 aa, Cryptosporidium parvum
MHSFLKFFIQEIFLSLGI

SEQ ID NO: 2235477 - protein, 17 aa, Cryptosporidium parvum
MHSPCFDLSSSKFLSCW

SEQ ID NO: 2235478 - protein, 28 aa, Cryptosporidium parvum
MIACSKIILWFVHFFRGFNGDEHISETL

SEQ ID NO: 2235479 - protein, 34 aa, Cryptosporidium parvum; identical to SEQ ID NO: 2125943

SEQ ID NO: 2235480 - protein, 17 aa, Cryptosporidium parvum
MIECRIQNFIFFNFLLY

SEQ ID NO: 2235481 - protein, 28 aa, Cryptosporidium parvum
MIEPDWGILRFFLLFFLSGVGGNLAVAV

SEQ ID NO: 2235482 - protein, 22 aa, Cryptosporidium parvum
MILCTQNIYFWIISLERITNYQ

SEQ ID NO: 2235483 - protein, 19 aa, Cryptosporidium parvum
MILSIFRRGGFYFSTNPNV

SEQ ID NO: 2235484 - protein, 25 aa, Cryptosporidium parvum
MILSLGWRGPFYIFGLIGVIWSIVW

SEQ ID NO: 2235485 - protein, 28 aa, Cryptosporidium parvum
MINVFSRSDWVLAFFYRYMQWGFHVAGI

SEQ ID NO: 2235486 - protein, 26 aa, Cryptosporidium parvum
MIPGLKRINPIFVDRFILYSFISIEQ

SEQ ID NO: 2235487 - protein, 20 aa, Cryptosporidium parvum
MIPSIWYLEIIHCMHMGMAP

SEQ ID NO: 2235488 - protein, 18 aa, Cryptosporidium parvum
MIQDCLLRNIGKTKYLLF

SEQ ID NO: 2235489 - protein, 22 aa, Cryptosporidium parvum
MIQMELCIGVTLRSWLGDASRS

SEQ ID NO: 2235490 - protein, 23 aa, Cryptosporidium parvum
MISIMCIFIFIGVSLHVVKLKKI

SEQ ID NO: 2235491 - protein, 24 aa, Cryptosporidium parvum
MISRLTAILLSFTYVLFLFFQLYT

SEQ ID NO: 2235492 - protein, 26 aa, Cryptosporidium parvum
MITIENSFPWFIPVKTSVQFFDLNST

SEQ ID NO: 2235493 - protein, 20 aa, Cryptosporidium parvum
MIVAGIWWILALFSRSYHYL

SEQ ID NO: 2235494 - protein, 32 aa, Cryptosporidium parvum
MIVTPFSGLHIFWSIIFSKYILNEEIKSRHYK

SEQ ID NO: 2235495 - protein, 22 aa, Cryptosporidium parvum
MIYCCVSSLLTILKILSNGNKY

SEQ ID NO: 2235496 - protein, 18 aa, Cryptosporidium parvum
MIYLFFLDIFRVEKDLNL

SEQ ID NO: 2235497 - protein, 21 aa, Cryptosporidium parvum
MKAFEELKCHWLFGNHTNALD

SEQ ID NO: 2235498 - protein, 20 aa, Cryptosporidium parvum
MKDIGAFLVSLSKRFEDQLG

SEQ ID NO: 2235499 - protein, 21 aa, Cryptosporidium parvum
MKELIDFLSKYIFECSINQII

SEQ ID NO: 2235500 - protein, 26 aa, Cryptosporidium parvum
MKFVDFPLLFLRRFLPKKRSSLNLFI

SEQ ID NO: 2235501 - protein, 21 aa, Cryptosporidium parvum
MKGDLLLEENLELLLDKIAEY

SEQ ID NO: 2235502 - protein, 25 aa, Cryptosporidium parvum
MKHPRAVRFVFAWMLIAQVLRNYDT

SEQ ID NO: 2235503 - protein, 23 aa, Cryptosporidium parvum
MKIFSGLKLLFWNLDKIGDIFGK

SEQ ID NO: 2235504 - protein, 18 aa, Cryptosporidium parvum
MKIQEFYAPITSSLDSKK

SEQ ID NO: 2235505 - protein, 17 aa, Cryptosporidium parvum
MKKAIGYSDSGNYNHEY

SEQ ID NO: 2235506 - protein, 20 aa, Cryptosporidium parvum
MKLLKICIVVVFITIPVMFY

SEQ ID NO: 2235507 - protein, 24 aa, Cryptosporidium parvum
MKNITLIINCLFALGYKKIALVKM

SEQ ID NO: 2235508 - protein, 33 aa, Cryptosporidium parvum
MKRKELFILAPFKFILNWILSKYVLFMIGLSSF

SEQ ID NO: 2235509 - protein, 27 aa, Cryptosporidium parvum
MKRVRPCLRIMVTLIKSFIGTGIIFLP

SEQ ID NO: 2235510 - protein, 20 aa, Cryptosporidium parvum
MKRYLMRQMAKKLCGEDLVK

SEQ ID NO: 2235511 - protein, 18 aa, Cryptosporidium parvum
MKTYLVPLPCLGFLTSVF

SEQ ID NO: 2235512 - protein, 19 aa, Cryptosporidium parvum
MKYVALFCLIIQTVAVIFF

SEQ ID NO: 2235513 - protein, 20 aa, Cryptosporidium parvum
MLALVALQFTIMKALNSKLL

SEQ ID NO: 2235514 - protein, 25 aa, Cryptosporidium parvum
MLAQEFLIMLNWYIYNAMGSDPSIR

SEQ ID NO: 2235515 - protein, 22 aa, Cryptosporidium parvum
MLESAFSFGIGCGYYQDPDNLA

SEQ ID NO: 2235516 - protein, 20 aa, Cryptosporidium parvum
MLESLYWFFNFYSFTETYQQ

SEQ ID NO: 2235517 - protein, 23 aa, Cryptosporidium parvum
MLFCGLEAFFSSIFPCKYRPYSY

SEQ ID NO: 2235518 - protein, 25 aa, Cryptosporidium parvum
MLFLHIFGLVLTRNFFEILSATYSI

SEQ ID NO: 2235519 - protein, 18 aa, Cryptosporidium parvum
MLFSRKYILPTFVTLVIT

SEQ ID NO: 2235520 - protein, 26 aa, Cryptosporidium parvum
MLICTFRIIFMVSFFYFVFPTVVSSE

SEQ ID NO: 2235521 - protein, 20 aa, Cryptosporidium parvum
MLIILKVSWEACLYLNNSVI

SEQ ID NO: 2235522 - protein, 24 aa, Cryptosporidium parvum
MLILFRAGPIGGMILMIPYMISNL

SEQ ID NO: 2235523 - protein, 20 aa, Cryptosporidium parvum
MLITCSWMLLLLSYFFGAGY

SEQ ID NO: 2235524 - protein, 21 aa, Cryptosporidium parvum
MLIVLNLIKLILLSYKNNGTR

SEQ ID NO: 2235525 - protein, 22 aa, Cryptosporidium parvum
MLKELREFVDQYIFIANKDQFD

SEQ ID NO: 2235526 - protein, 21 aa, Cryptosporidium parvum
MLLECKFNVFRYLDVKKSEFF

SEQ ID NO: 2235527 - protein, 17 aa, Cryptosporidium parvum
MLLLQLYFKDGQFIDSA

SEQ ID NO: 2235528 - protein, 17 aa, Cryptosporidium parvum
MLRILDLNIHIRKDNEK

SEQ ID NO: 2235529 - protein, 23 aa, Cryptosporidium parvum
MLRKLERLIDFLVPYFLLESAKI

SEQ ID NO: 2235530 - protein, 22 aa, Cryptosporidium parvum
MLSCGIAIELITLMLIPELMSG

SEQ ID NO: 2235531 - protein, 27 aa, Cryptosporidium parvum
MLSKLNCCASLKCAITLFNSLLPNVIS

SEQ ID NO: 2235532 - protein, 17 aa, Cryptosporidium parvum
MLTFSWFTKIMDKAYNS

SEQ ID NO: 2235533 - protein, 17 aa, Cryptosporidium parvum
MMLCPTVVHSYFKNKSD

SEQ ID NO: 2235534 - protein, 20 aa, Cryptosporidium parvum
MMNRPELLGIIINAIGDHYL

SEQ ID NO: 2235535 - protein, 17 aa, Cryptosporidium parvum
MMNRVCLFKAAKSEPKE

SEQ ID NO: 2235536 - protein, 26 aa, Cryptosporidium parvum
MMSSFLDIYIKLGLGNEFLFNLLFLN

SEQ ID NO: 2235537 - protein, 22 aa, Cryptosporidium parvum
MNAPCSVSFWLFPINLDKYQDK

SEQ ID NO: 2235538 - protein, 29 aa, Cryptosporidium parvum
MNICPLCCPISEIAVLFLLSLVSNNTKIE

SEQ ID NO: 2235539 - protein, 24 aa, Cryptosporidium parvum
MNILRCYYFFVAIVYEIISTSNCV

SEQ ID NO: 2235540 - protein, 17 aa, Cryptosporidium parvum
MNLDPGDLFKMIECRIQ

SEQ ID NO: 2235541 - protein, 17 aa, Cryptosporidium parvum
MNNMRFLIGKRHFSVLI

SEQ ID NO: 2235542 - protein, 18 aa, Cryptosporidium parvum
MNPKFIISVGDNFYQRGV

SEQ ID NO: 2235543 - protein, 18 aa, Cryptosporidium parvum
MNQIPSLLFDGANCLFLK

SEQ ID NO: 2235544 - protein, 18 aa, Cryptosporidium parvum
MNQLWITLIPEIICELVY

SEQ ID NO: 2235545 - protein, 26 aa, Cryptosporidium parvum
MNRGFIPFILCGDLSPINNIDPSTLT

SEQ ID NO: 2235546 - protein, 36 aa, Cryptosporidium parvum
MNSLKSRKDFYLLWEELIEFTNFIYLYCFTNNNSNV

SEQ ID NO: 2235547 - protein, 18 aa, Cryptosporidium parvum
MNSLLFLKINLGFNPQTL

SEQ ID NO: 2235548 - protein, 28 aa, Cryptosporidium parvum
MNSTELYFTLGICKKLNKLLNCKYTDLH

SEQ ID NO: 2235549 - protein, 24 aa, Cryptosporidium parvum
MNVIKELIEPGGLICKPLVEDYYS

SEQ ID NO: 2235550 - protein, 24 aa, Cryptosporidium parvum
MNVQKLKYIFTFATRNLRTPDIDT

SEQ ID NO: 2235551 - protein, 18 aa, Cryptosporidium parvum
MNVSDCLSQILSRDKLDL

SEQ ID NO: 2235552 - protein, 19 aa, Cryptosporidium parvum
MNYEPDWKSSLERIHTNWE

SEQ ID NO: 2235553 - protein, 17 aa, Cryptosporidium parvum
MPCNGRIEYPISESSFV

SEQ ID NO: 2235554 - protein, 35 aa, Cryptosporidium parvum
MPRHNELKTNFCFLSELDLAFCVCIGLYRDGCQKG

SEQ ID NO: 2235555 - protein, 29 aa, Cryptosporidium parvum
MPVLLACWSVCIILSILDLYYLNNMDKNW

SEQ ID NO: 2235556 - protein, 19 aa, Cryptosporidium parvum
MQIQACWRSFLTRFGASLC

SEQ ID NO: 2235557 - protein, 26 aa, Cryptosporidium parvum
MQIRILASISRYLCIYEIKSFEEFEN

SEQ ID NO: 2235558 - protein, 27 aa, Cryptosporidium parvum
MQISVIKWASFRIQFFSGPLVIFLYLA

SEQ ID NO: 2235559 - protein, 19 aa, Cryptosporidium parvum
MQVLVRWLTSIDYLNWISS

SEQ ID NO: 2235560 - protein, 17 aa, Cryptosporidium parvum
MRAAVFLSVNSVSLVLF

SEQ ID NO: 2235561 - protein, 26 aa, Cryptosporidium parvum
MRFLIGKRHFSVLIYTHINWIEDEIR

SEQ ID NO: 2235562 - protein, 23 aa, Cryptosporidium parvum
MRFVKFCFFIGIIGSIITASIGF

SEQ ID NO: 2235563 - protein, 20 aa, Cryptosporidium parvum
MRHLTEKILINFKGKNSISE

SEQ ID NO: 2235564 - protein, 17 aa, Cryptosporidium parvum
MRINSYIYIPANLLLLI

SEQ ID NO: 2235565 - protein, 28 aa, Cryptosporidium parvum
MRKYKVPICLKSIVNHYVRILKSYSDKW

SEQ ID NO: 2235566 - protein, 20 aa, Cryptosporidium parvum
MRLSTLCYLPIHTRSSNKSG

SEQ ID NO: 2235567 - protein, 19 aa, Cryptosporidium parvum
MRNLLKLILTLSFAPLFVT

SEQ ID NO: 2235568 - protein, 18 aa, Cryptosporidium parvum
MRPDLIMRSIIPAVMAGI

SEQ ID NO: 2235569 - protein, 21 aa, Cryptosporidium parvum
MRQAGLLYRSFGRYFCQEAVN

SEQ ID NO: 2235570 - protein, 21 aa, Cryptosporidium parvum
MRRYIVLGLFYFCIGESLSEI

SEQ ID NO: 2235571 - protein, 24 aa, Cryptosporidium parvum
MRTSSKFLVYFPSILIESLRSKEF

SEQ ID NO: 2235572 - protein, 18 aa, Cryptosporidium parvum
MRVPKMFIAMGLFITLLC

SEQ ID NO: 2235573 - protein, 19 aa, Cryptosporidium parvum
MRYCDYVFVNSIFTRKVYI

SEQ ID NO: 2235574 - protein, 23 aa, Cryptosporidium parvum
MSILFKILDYFLLTNKTEVFISE

SEQ ID NO: 2235575 - protein, 28 aa, Cryptosporidium parvum
MSKFRPQIMPIILKWSKGESFASILENT

SEQ ID NO: 2235576 - protein, 20 aa, Cryptosporidium parvum
MSKNLIKMTIIREIVYKKSK

SEQ ID NO: 2235577 - protein, 17 aa, Cryptosporidium parvum
MSLKLSKLVNYNKKRLS

SEQ ID NO: 2235578 - protein, 20 aa, Cryptosporidium parvum
MSLLFYIIFQKFREINQKTE

SEQ ID NO: 2235579 - protein, 30 aa, Cryptosporidium parvum
MSLLMNCIMYLLSHYYRKVSILYNEEGCTT

SEQ ID NO: 2235580 - protein, 20 aa, Cryptosporidium parvum
MSNARLNYNILLNSILENSR

SEQ ID NO: 2235581 - protein, 17 aa, Cryptosporidium parvum
MSNLEIISLYWIINPVY

SEQ ID NO: 2235582 - protein, 24 aa, Cryptosporidium parvum
MSPFIARLLWFVCYITGTIYMFIW

SEQ ID NO: 2235583 - protein, 23 aa, Cryptosporidium parvum
MSPILRIKWLRLIIDEGHNIGNS

SEQ ID NO: 2235584 - protein, 20 aa, Cryptosporidium parvum
MSPQISLIFHYWGVQQHTAK

SEQ ID NO: 2235585 - protein, 22 aa, Cryptosporidium parvum
MSRRSWERGGTRFNARGIDENA

SEQ ID NO: 2235586 - protein, 17 aa, Cryptosporidium parvum
MSSGYTFNVLASIVILP

SEQ ID NO: 2235587 - protein, 19 aa, Cryptosporidium parvum
MSVNRVILYYSLFEEHYLD

SEQ ID NO: 2235588 - protein, 18 aa, Cryptosporidium parvum
MSVTCGIRSNGILNSIPL

SEQ ID NO: 2235589 - protein, 19 aa, Cryptosporidium parvum
MSYTGCIPENLTLFNNVYE

SEQ ID NO: 2235590 - protein, 18 aa, Cryptosporidium parvum
MSYVPKILNFIDRGGNLM

SEQ ID NO: 2235591 - protein, 19 aa, Cryptosporidium parvum
MSYYNCFHEFLKIILSSDD

SEQ ID NO: 2235592 - protein, 19 aa, Cryptosporidium parvum
MTDKGRFSVVSLYETRTSN

SEQ ID NO: 2235593 - protein, 24 aa, Cryptosporidium parvum
MTKHKANGVSLFINSLLNLMFMEL

SEQ ID NO: 2235594 - protein, 25 aa, Cryptosporidium parvum
MTLKCGSCAVVLTRRYVITIFLIFF

SEQ ID NO: 2235595 - protein, 25 aa, Cryptosporidium parvum
MTPPGRLGVGLGFGNYNIGIGINSG

SEQ ID NO: 2235596 - protein, 17 aa, Cryptosporidium parvum
MTPRFAFAATIVVCAVT

SEQ ID NO: 2235597 - protein, 18 aa, Cryptosporidium parvum
MTSNMFKSFSMEDLQSGL

SEQ ID NO: 2235598 - protein, 17 aa, Cryptosporidium parvum
MTVCAIIYGIAFTIKKD

SEQ ID NO: 2235599 - protein, 26 aa, Cryptosporidium parvum
MTVLSCFIKKLIRISLFTSMNNTVWI

SEQ ID NO: 2235600 - protein, 17 aa, Cryptosporidium parvum
MTVVCLFGICAPSSAFL

SEQ ID NO: 2235601 - protein, 22 aa, Cryptosporidium parvum
MVEQDIGCTFEFGKYIMNHLCR

SEQ ID NO: 2235602 - protein, 24 aa, Cryptosporidium parvum
MVETLKARMLDITRDFKDTLQKRT

SEQ ID NO: 2235603 - protein, 19 aa, Cryptosporidium parvum
MVIPGNLILSLVLANTPQK

SEQ ID NO: 2235604 - protein, 18 aa, Cryptosporidium parvum
MVLQNLLLLFSLYQFIGI

SEQ ID NO: 2235605 - protein, 18 aa, Cryptosporidium parvum
MVLWIKHYLSNKVENKSE

SEQ ID NO: 2235606 - protein, 24 aa, Cryptosporidium parvum
MVNELKIAVNIIREGKFDPYSSHK

SEQ ID NO: 2235607 - protein, 19 aa, Cryptosporidium parvum
MVNFFPYIYLRVDELDVIN

SEQ ID NO: 2235608 - protein, 17 aa, Cryptosporidium parvum
MVSLFILTQFIFSNQST

SEQ ID NO: 2235609 - protein, 25 aa, Cryptosporidium parvum
MVVSYSLHCLIELCKFGIIDYDKCI

SEQ ID NO: 2235610 - protein, 24 aa, Cryptosporidium parvum
MVYSCLKRGGKVLIPVFAIGRAQE

SEQ ID NO: 2235611 - protein, 20 aa, Cryptosporidium parvum
MWLLEFYSKSFLIGESTGIR

SEQ ID NO: 2235612 - protein, 27 aa, Cryptosporidium parvum
MWSVLGIKLIRYFDFRIKNGLLYDCKI

SEQ ID NO: 2235613 - protein, 25 aa, Cryptosporidium parvum
MWVKTSFPGIIFAFLQLEKNWIIDF

SEQ ID NO: 2235614 - protein, 20 aa, Cryptosporidium parvum
MYDQPSFRGMSILNKLEANN

SEQ ID NO: 2235615 - protein, 24 aa, Cryptosporidium parvum
MYFLSILVLFSWISIVIGGEGNLD

SEQ ID NO: 2235616 - protein, 22 aa, Cryptosporidium parvum
MYIPSRFLLGLIPQIFLETHEF

SEQ ID NO: 2235617 - protein, 18 aa, Cryptosporidium parvum
MYKYKIKYNSILKEKDML

SEQ ID NO: 2235618 - protein, 22 aa, Cryptosporidium parvum
MYLGEFYFNLLYELFPSTNEAD

SEQ ID NO: 2235619 - protein, 23 aa, Cryptosporidium parvum
MYLNKCRYYFPKEVWEITETAFS

SEQ ID NO: 2235620 - protein, 19 aa, Cryptosporidium parvum
MYLVFKIVHFFNEKSHEFG

SEQ ID NO: 2235621 - protein, 20 aa, Cryptosporidium parvum
MYSFRRIGKVLSEQFELGKL

SEQ ID NO: 2235622 - protein, 25 aa, Cryptosporidium parvum
MYWIYYRIFHGIPFELFEICQIKEM

SEQ ID NO: 2235623 - protein, 27 aa, Cryptosporidium parvum
MYYDDYCLMCFLIRPLINSLAARLRNT

SEQ ID NO: 2235624 - protein, 21 aa, Cryptosporidium parvum
NAFSKVCICNYVPNIFLPLSV

SEQ ID NO: 2235625 - protein, 20 aa, Cryptosporidium parvum
NAKDGRFCLYNSKFNIFDCL

SEQ ID NO: 2235626 - protein, 31 aa, Cryptosporidium parvum
NAKRLREFILLIKRLIHRNGESFLSKVSSMT

SEQ ID NO: 2235627 - protein, 18 aa, Cryptosporidium parvum
NAKRSGIVGARLAGINAC

SEQ ID NO: 2235628 - protein, 17 aa, Cryptosporidium parvum
NAKVEWNSIPIARISSP

SEQ ID NO: 2235629 - protein, 24 aa, Cryptosporidium parvum
NALGILRDRIRVVSNDKFQDQPNE

SEQ ID NO: 2235630 - protein, 25 aa, Cryptosporidium parvum
NANILDRIYKIFSFSQKHNIKTDKA

SEQ ID NO: 2235631 - protein, 19 aa, Cryptosporidium parvum
NARILCSFELISVDEVKQY

SEQ ID NO: 2235632 - protein, 20 aa, Cryptosporidium parvum
NARTCRICAVGDGGNDVGMI

SEQ ID NO: 2235633 - protein, 24 aa, Cryptosporidium parvum
NASHIVRIFSFFIFFSYASCIYST

SEQ ID NO: 2235634 - protein, 24 aa, Cryptosporidium parvum
NASKRRLYNYCIRQFERSLYECEK

SEQ ID NO: 2235635 - protein, 18 aa, Cryptosporidium parvum
NCCLIALSVSLLFGINLS

SEQ ID NO: 2235636 - protein, 19 aa, Cryptosporidium parvum
NCDKLKWLRDKYPSIYRQT

SEQ ID NO: 2235637 - protein, 18 aa, Cryptosporidium parvum
NCEIGYSLSRLCFEIDGN

SEQ ID NO: 2235638 - protein, 19 aa, Cryptosporidium parvum
NCHDFYYNREELGYLPVLN

SEQ ID NO: 2235639 - protein, 20 aa, Cryptosporidium parvum
NCHRLLFFLIHVIRRLYEEV

SEQ ID NO: 2235640 - protein, 22 aa, Cryptosporidium parvum
NCILLRTIFCPNLDIVKEKLCN

SEQ ID NO: 2235641 - protein, 18 aa, Cryptosporidium parvum
NCISEIFEYYIQILRMTT

SEQ ID NO: 2235642 - protein, 20 aa, Cryptosporidium parvum
NCLCIWDIWTNLSYNLPIIS

SEQ ID NO: 2235643 - protein, 17 aa, Cryptosporidium parvum
NCMFGDWSSWSTCQDDC

SEQ ID NO: 2235644 - protein, 28 aa, Cryptosporidium parvum
NCMTSMPTCTCKKCKQAGSPSSGTEENS

SEQ ID NO: 2235645 - protein, 21 aa, Cryptosporidium parvum
NCNIQDFVSCFNILCRSVTKE

SEQ ID NO: 2235646 - protein, 19 aa, Cryptosporidium parvum
NCRSRYLINDAAVYYKKPV

SEQ ID NO: 2235647 - protein, 19 aa, Cryptosporidium parvum
NCSECKICHLFFEENSKHC

SEQ ID NO: 2235648 - protein, 21 aa, Cryptosporidium parvum
NCSIDKFLLLFEMLGIILSIP

SEQ ID NO: 2235649 - protein, 19 aa, Cryptosporidium parvum
NCTIPIEYLLNMDINISFE

SEQ ID NO: 2235650 - protein, 23 aa, Cryptosporidium parvum
NDCISLRMKFFIKALYKKLGKFK

SEQ ID NO: 2235651 - protein, 23 aa, Cryptosporidium parvum
NDCLRMFSKCILKYSKMTTSQFN

SEQ ID NO: 2235652 - protein, 25 aa, Cryptosporidium parvum
NDDTHVRFRFKVKDVGNTISVRCRK

SEQ ID NO: 2235653 - protein, 24 aa, Cryptosporidium parvum
NDFLFKIFPFLSIFNEGSKRIMDE

SEQ ID NO: 2235654 - protein, 18 aa, Cryptosporidium parvum
NDFYAFFMITWSSCMIIT

SEQ ID NO: 2235655 - protein, 18 aa, Cryptosporidium parvum
NDGFGGGVNRIVGGGGGV

SEQ ID NO: 2235656 - protein, 21 aa, Cryptosporidium parvum
NDGISHIYLLLVIILLVNLGI

SEQ ID NO: 2235657 - protein, 18 aa, Cryptosporidium parvum
NDGRSIRITHRYNTNYEK

SEQ ID NO: 2235658 - protein, 19 aa, Cryptosporidium parvum
NDHIIKDVINLGGNTTLDV

SEQ ID NO: 2235659 - protein, 22 aa, Cryptosporidium parvum
NDICLSCDLTAAVYLLLFALKQ

SEQ ID NO: 2235660 - protein, 17 aa, Cryptosporidium parvum
NDKIINWFWDVLSELTV

SEQ ID NO: 2235661 - protein, 23 aa, Cryptosporidium parvum
NDKIISLLMLFKSWIPFLENEFN

SEQ ID NO: 2235662 - protein, 21 aa, Cryptosporidium parvum
NDKLRSICKVELLDESNEKYS

SEQ ID NO: 2235663 - protein, 19 aa, Cryptosporidium parvum
NDKRYGWGGTVAVFTSDQS

SEQ ID NO: 2235664 - protein, 18 aa, Cryptosporidium parvum
NDLCYAYSSQTSWIPQGT

SEQ ID NO: 2235665 - protein, 25 aa, Cryptosporidium parvum
NDLLKLKKHEIFNFNSVNSPRNELK

SEQ ID NO: 2235666 - protein, 18 aa, Cryptosporidium parvum
NDLTFSILGPLWTHILNY

SEQ ID NO: 2235667 - protein, 20 aa, Cryptosporidium parvum
NDMLKYAALSIFSEFYYYWS

SEQ ID NO: 2235668 - protein, 25 aa, Cryptosporidium parvum
NDNFKISNVFSRIFLSYYNVCKSFI

SEQ ID NO: 2235669 - protein, 23 aa, Cryptosporidium parvum
NDNFPLSVCIHALENCKDNLELA

SEQ ID NO: 2235670 - protein, 24 aa, Cryptosporidium parvum
NDNSEKLPVFALVDIFHVPPESRQ

SEQ ID NO: 2235671 - protein, 20 aa, Cryptosporidium parvum
NDPIKMSICTLLLSIEVINL

SEQ ID NO: 2235672 - protein, 28 aa, Cryptosporidium parvum
NDQINMNMTWVWGFMRSLRMELSSKVKI

SEQ ID NO: 2235673 - protein, 18 aa, Cryptosporidium parvum
NDQLFSINSMQSLARLIK

SEQ ID NO: 2235674 - protein, 18 aa, Cryptosporidium parvum
NDRAREYIDILGREVNLQ

SEQ ID NO: 2235675 - protein, 23 aa, Cryptosporidium parvum
NDRKDIWTWFSVYLVILKTFRRF

SEQ ID NO: 2235676 - protein, 25 aa, Cryptosporidium parvum
NDSWFNLDLLREFLMDENVTSSSTD

SEQ ID NO: 2235677 - protein, 27 aa, Cryptosporidium parvum
NDTCIKLFPKHSIKMFKVLGVNLTEEE

SEQ ID NO: 2235678 - protein, 17 aa, Cryptosporidium parvum
NDTFPLFKIIQDEAKYH

SEQ ID NO: 2235679 - protein, 32 aa, Cryptosporidium parvum; identical to SEQ ID NO: 2126088

SEQ ID NO: 2235680 - protein, 17 aa, Cryptosporidium parvum
NDYKKIIIAESFNILIS

SEQ ID NO: 2235681 - protein, 22 aa, Cryptosporidium parvum
NDYRKYLENWADTVQVLLQGPG

SEQ ID NO: 2235682 - protein, 25 aa, Cryptosporidium parvum
NEDIWRNIFGLIWVIFYTKPFKPKD

SEQ ID NO: 2235683 - protein, 19 aa, Cryptosporidium parvum
NEELGCLKEVGNFQIGELY

SEQ ID NO: 2235684 - protein, 17 aa, Cryptosporidium parvum
NEFKRLQKIDASYTEKE

SEQ ID NO: 2235685 - protein, 17 aa, Cryptosporidium parvum
NEFMLKELREFVDQYIF

SEQ ID NO: 2235686 - protein, 22 aa, Cryptosporidium parvum
NEFNFRKDSLFFRFNHVTHELS

SEQ ID NO: 2235687 - protein, 20 aa, Cryptosporidium parvum
NEFTDLFLFRNKIPINLLIN

SEQ ID NO: 2235688 - protein, 22 aa, Cryptosporidium parvum
NEGFCPNTLLELHKNLRPIYIY

SEQ ID NO: 2235689 - protein, 23 aa, Cryptosporidium parvum
NEIFSMNSFHMFGIIAWIPFKIH

SEQ ID NO: 2235690 - protein, 22 aa, Cryptosporidium parvum
NEIIHLDFYIRTNFKILTRLCR

SEQ ID NO: 2235691 - protein, 18 aa, Cryptosporidium parvum
NEIKELYVSKEFNNKCEN

SEQ ID NO: 2235692 - protein, 26 aa, Cryptosporidium parvum
NEINCLFNKLWESIRIYIKGKEGVSE

SEQ ID NO: 2235693 - protein, 25 aa, Cryptosporidium parvum
NEINGVYLTWLRPSIISKNAESVQM

SEQ ID NO: 2235694 - protein, 22 aa, Cryptosporidium parvum
NEKELKNLILINHNMFLVNNKL

SEQ ID NO: 2235695 - protein, 25 aa, Cryptosporidium parvum
NEKHIKSRFGPNIATKYIINVINDP

SEQ ID NO: 2235696 - protein, 24 aa, Cryptosporidium parvum
NEKLRMKISILFASVLLDHISLKK

SEQ ID NO: 2235697 - protein, 30 aa, Cryptosporidium parvum
NEKMIKRIGLKLGVEIGGPILILKNEDMEK

SEQ ID NO: 2235698 - protein, 17 aa, Cryptosporidium parvum
NEKRLKGFENMKERSYC

SEQ ID NO: 2235699 - protein, 17 aa, Cryptosporidium parvum
NEKYIVYLIFWVVVKFF

SEQ ID NO: 2235700 - protein, 24 aa, Cryptosporidium parvum
NEKYNIWDIFSIVCDPKYKESILY

SEQ ID NO: 2235701 - protein, 22 aa, Cryptosporidium parvum
NELELIFNHSLEIFQKLANSDI

SEQ ID NO: 2235702 - protein, 25 aa, Cryptosporidium parvum
NELFINKKLRIVNCKHSINSPKRIA

SEQ ID NO: 2235703 - protein, 27 aa, Cryptosporidium parvum
NELIQIFNLICYFLDLKEEIILDKNQD

SEQ ID NO: 2235704 - protein, 17 aa, Cryptosporidium parvum
NELLKLPSTYILDNKIV

SEQ ID NO: 2235705 - protein, 25 aa, Cryptosporidium parvum
NELMYCFFCRIFIYLKKIKINNSII

SEQ ID NO: 2235706 - protein, 20 aa, Cryptosporidium parvum
NELYFVTIFYGLQFALNRIF

SEQ ID NO: 2235707 - protein, 19 aa, Cryptosporidium parvum
NENLCLLEDLIKLVLQLGN

SEQ ID NO: 2235708 - protein, 25 aa, Cryptosporidium parvum
NEPPMTRYLLWIDIYEISCRPAFDG

SEQ ID NO: 2235709 - protein, 17 aa, Cryptosporidium parvum
NEQFFRWSSTEHILSDQ

SEQ ID NO: 2235710 - protein, 17 aa, Cryptosporidium parvum
NESIPILKILSRRAQQF

SEQ ID NO: 2235711 - protein, 22 aa, Cryptosporidium parvum
NESRLSALLEEFFPKVMLKLSK

SEQ ID NO: 2235712 - protein, 25 aa, Cryptosporidium parvum
NETEIYPIFRACSKIEFEKLCPNLC

SEQ ID NO: 2235713 - protein, 21 aa, Cryptosporidium parvum
NETRLYFSMDGTQRLILPKLH

SEQ ID NO: 2235714 - protein, 24 aa, Cryptosporidium parvum
NEVDDFRQIIGWIKNQPWSNGKVG

SEQ ID NO: 2235715 - protein, 29 aa, Cryptosporidium parvum
NEVLLRICSVGLNFRDVLNVMGLYPGDPG

SEQ ID NO: 2235716 - protein, 18 aa, Cryptosporidium parvum
NEVPRLSLLHDLQQRKHF

SEQ ID NO: 2235717 - protein, 21 aa, Cryptosporidium parvum
NEVTRFPFAILEVKLQSEQPI

SEQ ID NO: 2235718 - protein, 20 aa, Cryptosporidium parvum
NEYFKSSLLIFDSLQMLTFN

SEQ ID NO: 2235719 - protein, 23 aa, Cryptosporidium parvum
NEYKYSIIIKVNFELLINVPKSP

SEQ ID NO: 2235720 - protein, 25 aa, Cryptosporidium parvum
NEYLSKFYLFLAKELEVLEPKTPEE

SEQ ID NO: 2235721 - protein, 25 aa, Cryptosporidium parvum
NEYSEKYFVLIIEILYTFTMTNSMI

SEQ ID NO: 2235722 - protein, 22 aa, Cryptosporidium parvum
NEYYKLKINDFLKDIIKENENL

SEQ ID NO: 2235723 - protein, 21 aa, Cryptosporidium parvum
NFCNINEDWLGWGGSISGHGI

SEQ ID NO: 2235724 - protein, 29 aa, Cryptosporidium parvum
NFEISIPEWRIEIIPIKTNHTIKDANVKI

SEQ ID NO: 2235725 - protein, 18 aa, Cryptosporidium parvum
NFEIWKTDGIYRNENDRS

SEQ ID NO: 2235726 - protein, 18 aa, Cryptosporidium parvum
NFFFPTIIAIIINSFILI

SEQ ID NO: 2235727 - protein, 23 aa, Cryptosporidium parvum
NFFKRKQISVPFPCANYPKNLQS

SEQ ID NO: 2235728 - protein, 30 aa, Cryptosporidium parvum
NFFRIPRSIPISLRLKLNRGTGLLFSEPNL

SEQ ID NO: 2235729 - protein, 22 aa, Cryptosporidium parvum
NFGLECLEMDYYINLIDMLCEI

SEQ ID NO: 2235730 - protein, 25 aa, Cryptosporidium parvum
NFHLDCIRNGTYLEIYEQWKCDSCT

SEQ ID NO: 2235731 - protein, 23 aa, Cryptosporidium parvum
NFHLRRYTCSEGMNNSFDMNCFI

SEQ ID NO: 2235732 - protein, 18 aa, Cryptosporidium parvum
NFIDWKGHTLVVKRYASL

SEQ ID NO: 2235733 - protein, 28 aa, Cryptosporidium parvum
NFIEDCLKLNFKGSLIFQNNESNKVEQT

SEQ ID NO: 2235734 - protein, 32 aa, Cryptosporidium parvum
NFIFQKTIYCWKSIEIYKIIIKQCFSKDEPLF

SEQ ID NO: 2235735 - protein, 26 aa, Cryptosporidium parvum
NFIPKYLFEQFCRPVNFYFLVISLLQ

SEQ ID NO: 2235736 - protein, 24 aa, Cryptosporidium parvum
NFIQIKNSWAFFIYLIFFTSIFLI

SEQ ID NO: 2235737 - protein, 20 aa, Cryptosporidium parvum
NFLMAKNCFLVALELDPNHT

SEQ ID NO: 2235738 - protein, 24 aa, Cryptosporidium parvum
NFLPPKIRQLLTFYIVKSYVNNHS

SEQ ID NO: 2235739 - protein, 19 aa, Cryptosporidium parvum
NFLSTFFFVAGGLSFIRFF

SEQ ID NO: 2235740 - protein, 23 aa, Cryptosporidium parvum
NFPCMATSMIFNLIQILRDENKI

SEQ ID NO: 2235741 - protein, 24 aa, Cryptosporidium parvum
NFPSSFYFEPCIKEFCVSKKSFSK

SEQ ID NO: 2235742 - protein, 27 aa, Cryptosporidium parvum
NFPTERCVLLMLGILQRMVYIPSVSAL

SEQ ID NO: 2235743 - protein, 19 aa, Cryptosporidium parvum
NFQCLFITTASCFATQSTQ

SEQ ID NO: 2235744 - protein, 23 aa, Cryptosporidium parvum
NFQRKCPYCSFREHSKCQNKCCK

SEQ ID NO: 2235745 - protein, 20 aa, Cryptosporidium parvum
NFSKVFTFFNFVWKIILFFI

SEQ ID NO: 2235746 - protein, 30 aa, Cryptosporidium parvum
NFTGAYILYRWRLTQELRVQFRKKFVWIIL

SEQ ID NO: 2235747 - protein, 19 aa, Cryptosporidium parvum
NFTIFGMGDRCFGNERFNI

SEQ ID NO: 2235748 - protein, 18 aa, Cryptosporidium parvum
NFTNFCRKLFISESTDQR

SEQ ID NO: 2235749 - protein, 25 aa, Cryptosporidium parvum
NFTPEPLWILCFIYGTFIALTDSYT

SEQ ID NO: 2235750 - protein, 19 aa, Cryptosporidium parvum
NFVCLPLFQELCYVDVEGD

SEQ ID NO: 2235751 - protein, 19 aa, Cryptosporidium parvum
NFVIKDWFASQSIFKFYLL

SEQ ID NO: 2235752 - protein, 18 aa, Cryptosporidium parvum
NFVLKGKIGDPFFIQVIN

SEQ ID NO: 2235753 - protein, 18 aa, Cryptosporidium parvum
NFYECWWDHIILDIFGCN

SEQ ID NO: 2235754 - protein, 18 aa, Cryptosporidium parvum
NGDIKLKKIFKFDNESNE

SEQ ID NO: 2235755 - protein, 19 aa, Cryptosporidium parvum
NGDNIFLKINWKNNIQKFI

SEQ ID NO: 2235756 - protein, 22 aa, Cryptosporidium parvum
NGDPLYRRFVVSSSISTSTNFS

SEQ ID NO: 2235757 - protein, 25 aa, Cryptosporidium parvum
NGDQYIINKCELLILIFRNKVNHIL

SEQ ID NO: 2235758 - protein, 27 aa, Cryptosporidium parvum
NGECEAKGATYVGVIGKDGRIENGMAF

SEQ ID NO: 2235759 - protein, 20 aa, Cryptosporidium parvum
NGESEIKGNIVFETNNNPLI

SEQ ID NO: 2235760 - protein, 26 aa, Cryptosporidium parvum
NGESKPTLIGKFKLDVFNIFKEPFPI

SEQ ID NO: 2235761 - protein, 19 aa, Cryptosporidium parvum
NGGYLCLGALVISIIVGIV

SEQ ID NO: 2235762 - protein, 18 aa, Cryptosporidium parvum
NGIFEYYLWPEKMEDPKY

SEQ ID NO: 2235763 - protein, 23 aa, Cryptosporidium parvum
NGIPMDFRILILNSLTSACQNMA

SEQ ID NO: 2235764 - protein, 25 aa, Cryptosporidium parvum
NGKCLPFSCLFILQILVALATITWV

SEQ ID NO: 2235765 - protein, 23 aa, Cryptosporidium parvum
NGKSSLESFEFVVPERKKEKSQE

SEQ ID NO: 2235766 - protein, 24 aa, Cryptosporidium parvum
NGLKKCVLALIYIFKTGSKTCSYR

SEQ ID NO: 2235767 - protein, 19 aa, Cryptosporidium parvum
NGLLKHVFSIMILDTQMLN

SEQ ID NO: 2235768 - protein, 22 aa, Cryptosporidium parvum
NGLNDLVCNLSLIGGSKKIDQT

SEQ ID NO: 2235769 - protein, 18 aa, Cryptosporidium parvum
NGLPNICMVSDFFYPGLG

SEQ ID NO: 2235770 - protein, 18 aa, Cryptosporidium parvum
NGLTPFYFLLKDGMSTNT

SEQ ID NO: 2235771 - protein, 22 aa, Cryptosporidium parvum
NGLWKVKLSIYILSTLLCGLCV

SEQ ID NO: 2235772 - protein, 18 aa, Cryptosporidium parvum
NGMGRLSSVSGYALLLDD

SEQ ID NO: 2235773 - protein, 24 aa, Cryptosporidium parvum
NGMGYVYFHGCEGFERNFRLAFHH

SEQ ID NO: 2235774 - protein, 20 aa, Cryptosporidium parvum
NGMTCTSCATTIKNLLLHYK

SEQ ID NO: 2235775 - protein, 19 aa, Cryptosporidium parvum
NGNPRLTLINLYNNTGGAG

SEQ ID NO: 2235776 - protein, 31 aa, Cryptosporidium parvum; identical to SEQ ID NO: 2126133

SEQ ID NO: 2235777 - protein, 19 aa, Cryptosporidium parvum
NGQRARVSLARSIYQNYIN

SEQ ID NO: 2235778 - protein, 26 aa, Cryptosporidium parvum
NGRIWNLAADLEMSFGTLESSRALIE

SEQ ID NO: 2235779 - protein, 31 aa, Cryptosporidium parvum
NGSNIIPFSWRIEFVIICLTTMFLTVSLFSL

SEQ ID NO: 2235780 - protein, 22 aa, Cryptosporidium parvum
NGTISHRFGLWLAAQRLSEQKT

SEQ ID NO: 2235781 - protein, 19 aa, Cryptosporidium parvum
NGYRTLCFAKKELSENEVI

SEQ ID NO: 2235782 - protein, 24 aa, Cryptosporidium parvum
NHCKLRKDFYMDIKKCRRRNKKEN

SEQ ID NO: 2235783 - protein, 18 aa, Cryptosporidium parvum
NHCYSVFTIVKSKGGESF

SEQ ID NO: 2235784 - protein, 22 aa, Cryptosporidium parvum
NHDAWIPLLRSMTYQDPEFRPS

SEQ ID NO: 2235785 - protein, 19 aa, Cryptosporidium parvum
NHEEFQYEISFIDIIPSSD

SEQ ID NO: 2235786 - protein, 30 aa, Cryptosporidium parvum; identical to SEQ ID NO: 2126143

SEQ ID NO: 2235787 - protein, 19 aa, Cryptosporidium parvum
NHIHSRISLLYLSKKPVMN

SEQ ID NO: 2235788 - protein, 18 aa, Cryptosporidium parvum
NHILNVFIQGLGHEFFSM

SEQ ID NO: 2235789 - protein, 22 aa, Cryptosporidium parvum
NHKEIFWNSDIINFNKNNIDSS

SEQ ID NO: 2235790 - protein, 19 aa, Cryptosporidium parvum
NHKIPVDFVFGRGPDIWNI

SEQ ID NO: 2235791 - protein, 25 aa, Cryptosporidium parvum
NHKTIDILKLWSIGSESTVLSLIKE

SEQ ID NO: 2235792 - protein, 17 aa, Cryptosporidium parvum
NHLDWIINVSLISCITT

SEQ ID NO: 2235793 - protein, 25 aa, Cryptosporidium parvum
NHRLKIARFYSFIKLGVLQFVILKP

SEQ ID NO: 2235794 - protein, 22 aa, Cryptosporidium parvum
NHSELFEFIFLEGVEMMYVSSL

SEQ ID NO: 2235795 - protein, 17 aa, Cryptosporidium parvum
NHVIFAGTNIILTRSSI

SEQ ID NO: 2235796 - protein, 17 aa, Cryptosporidium parvum
NICFWSLKLENTQFKDS

SEQ ID NO: 2235797 - protein, 24 aa, Cryptosporidium parvum
NICILKKMRFFFLISDDNNDDEDK

SEQ ID NO: 2235798 - protein, 30 aa, Cryptosporidium parvum
NICNSCTRQECLSCTSMAYCSQCPGLEDLS

SEQ ID NO: 2235799 - protein, 17 aa, Cryptosporidium parvum
NIDDIFESLSLLLYSTN

SEQ ID NO: 2235800 - protein, 20 aa, Cryptosporidium parvum
NIEISKFFIERYCDPSYENE

SEQ ID NO: 2235801 - protein, 19 aa, Cryptosporidium parvum
NIEKLFSLNIGNLILNHKN

SEQ ID NO: 2235802 - protein, 19 aa, Cryptosporidium parvum
NIFDYPLTYELLRGLPHSV

SEQ ID NO: 2235803 - protein, 19 aa, Cryptosporidium parvum
NIFLPLSVMMLRVPYFTLK

SEQ ID NO: 2235804 - protein, 32 aa, Cryptosporidium parvum
NIGLEPWILLALRCIGGLVFLSTISIFSLIRE

SEQ ID NO: 2235805 - protein, 19 aa, Cryptosporidium parvum
NIGYYRWGFSNGSNVKYSV

SEQ ID NO: 2235806 - protein, 19 aa, Cryptosporidium parvum
NIHCLEMYGYPTIEGTIAS

SEQ ID NO: 2235807 - protein, 24 aa, Cryptosporidium parvum
NIIFPLCKLINYFIILQVLIGAIS

SEQ ID NO: 2235808 - protein, 18 aa, Cryptosporidium parvum
NIILKIKYSSYFLALNQI

SEQ ID NO: 2235809 - protein, 23 aa, Cryptosporidium parvum
NIIPDIINLISFNNKKNIINQTN

SEQ ID NO: 2235810 - protein, 24 aa, Cryptosporidium parvum
NIIRKEKEQVLEFFNLKNISFYSF

SEQ ID NO: 2235811 - protein, 23 aa, Cryptosporidium parvum
NIIYRATTIFLIFSDGKKLGHEI

SEQ ID NO: 2235812 - protein, 26 aa, Cryptosporidium parvum
NIKANVCDYIVWFDLDIVITNKFFSI

SEQ ID NO: 2235813 - protein, 19 aa, Cryptosporidium parvum
NIKDLFLQFSQEISTKTYN

SEQ ID NO: 2235814 - protein, 21 aa, Cryptosporidium parvum
NILCDGFGVSFLSNTNKEITY

SEQ ID NO: 2235815 - protein, 20 aa, Cryptosporidium parvum
NILCGILVAAAAMWVLYYYV

SEQ ID NO: 2235816 - protein, 28 aa, Cryptosporidium parvum
NILEAYSNFKWVFAIFILKPSILFLCRV

SEQ ID NO: 2235817 - protein, 20 aa, Cryptosporidium parvum
NILFGAPFDPEWYAQVVDAC

SEQ ID NO: 2235818 - protein, 20 aa, Cryptosporidium parvum
NILRMFDYLINIVFLASYSI

SEQ ID NO: 2235819 - protein, 19 aa, Cryptosporidium parvum
NILSAKYPLGKKVKTQKAL

SEQ ID NO: 2235820 - protein, 20 aa, Cryptosporidium parvum
NILYLFEFLGKIVGKAIYEK

SEQ ID NO: 2235821 - protein, 23 aa, Cryptosporidium parvum
NINFPNRRGEFINDCKIVQVSQE

SEQ ID NO: 2235822 - protein, 25 aa, Cryptosporidium parvum
NINISLKLRECIFLVGEPGCGKSSL

SEQ ID NO: 2235823 - protein, 25 aa, Cryptosporidium parvum
NINKLYVFHCGNVFHKKCLYNSINN

SEQ ID NO: 2235824 - protein, 18 aa, Cryptosporidium parvum
NIPCSYRGILWNISVGNN

SEQ ID NO: 2235825 - protein, 21 aa, Cryptosporidium parvum
NIPEVPALYFIKPTEENIDKL

SEQ ID NO: 2235826 - protein, 21 aa, Cryptosporidium parvum
NIPNELKRIFGQMPAIKNICA

SEQ ID NO: 2235827 - protein, 22 aa, Cryptosporidium parvum
NIPNHCSILILSYLIISNSLER

SEQ ID NO: 2235828 - protein, 23 aa, Cryptosporidium parvum
NIPRSLICIDHVVIFVTLKKKKC

SEQ ID NO: 2235829 - protein, 27 aa, Cryptosporidium parvum
NIQKVVYCLYSLLGIAFILFKLGTMGL

SEQ ID NO: 2235830 - protein, 25 aa, Cryptosporidium parvum
NIQKWKLSLRFEKMMEFLILETKKR

SEQ ID NO: 2235831 - protein, 19 aa, Cryptosporidium parvum
NIQLWWKEVLTNYYLDMAH

SEQ ID NO: 2235832 - protein, 19 aa, Cryptosporidium parvum
NIRILGELFLLNYTITNMN

SEQ ID NO: 2235833 - protein, 23 aa, Cryptosporidium parvum
NISENQPLIGIVVGTGVNACYLE

SEQ ID NO: 2235834 - protein, 23 aa, Cryptosporidium parvum
NISKELSERVKVDAIKEINQSIL

SEQ ID NO: 2235835 - protein, 24 aa, Cryptosporidium parvum
NISQKELFGAIAMGDAENMRAAVF

SEQ ID NO: 2235836 - protein, 23 aa, Cryptosporidium parvum
NISRSGDFIFSRKWKLEIQTNFN

SEQ ID NO: 2235837 - protein, 25 aa, Cryptosporidium parvum
NISSLCVLYAHIASIYGQVFSIDDL

SEQ ID NO: 2235838 - protein, 24 aa, Cryptosporidium parvum
NISSLRLSTAFSFAAFLICSLTLC

SEQ ID NO: 2235839 - protein, 22 aa, Cryptosporidium parvum
NITCTRKYFVLGYLKSSLFLSN

SEQ ID NO: 2235840 - protein, 24 aa, Cryptosporidium parvum
NIVIFWEKRLETFQLTKNIPLTNL

SEQ ID NO: 2235841 - protein, 23 aa, Cryptosporidium parvum
NIYKEIIDRIIIQSTETLKKLQR

SEQ ID NO: 2235842 - protein, 26 aa, Cryptosporidium parvum
NIYKMNRYKLLVTHWLEINGKVIISS

SEQ ID NO: 2235843 - protein, 20 aa, Cryptosporidium parvum
NIYKTIGFWMFTYCFFLSYN

SEQ ID NO: 2235844 - protein, 28 aa, Cryptosporidium parvum
NIYLKLELCGGCIEHFILAFQMISSIIT

SEQ ID NO: 2235845 - protein, 17 aa, Cryptosporidium parvum
NIYNDFVSRTCLSHLLR

SEQ ID NO: 2235846 - protein, 23 aa, Cryptosporidium parvum
NIYNKECRFCFGVETDHSPLITP

SEQ ID NO: 2235847 - protein, 21 aa, Cryptosporidium parvum
NKAILTFNSFIHIIKYFCSNF

SEQ ID NO: 2235848 - protein, 23 aa, Cryptosporidium parvum
NKCIPPFLDSMIMLRNDGSPNPD

SEQ ID NO: 2235849 - protein, 22 aa, Cryptosporidium parvum
NKDEIMNLLSLGEIQFQNFSTL

SEQ ID NO: 2235850 - protein, 18 aa, Cryptosporidium parvum
NKDSFRFNYTIFSISISF

SEQ ID NO: 2235851 - protein, 26 aa, Cryptosporidium parvum
NKEQLFRKELEKCIIEQGLDLVKQLP

SEQ ID NO: 2235852 - protein, 23 aa, Cryptosporidium parvum
NKESDFWKFFGVNMLSGGLAGAA

SEQ ID NO: 2235853 - protein, 30 aa, Cryptosporidium parvum
NKFEILDCYSNYYKDCCLASILNNWIKINS

SEQ ID NO: 2235854 - protein, 23 aa, Cryptosporidium parvum
NKFLFPLFSPRSSSSFFAQEEFS

SEQ ID NO: 2235855 - protein, 30 aa, Cryptosporidium parvum
NKFLLECNGELAVGFFKFTMAIFDEYQSEV

SEQ ID NO: 2235856 - protein, 18 aa, Cryptosporidium parvum
NKHLKVIGDFGCGTAKIG

SEQ ID NO: 2235857 - protein, 23 aa, Cryptosporidium parvum
NKHPNWLISLLGPTFVYLTPNLF

SEQ ID NO: 2235858 - protein, 27 aa, Cryptosporidium parvum
NKIILNIRYESVISVSLERSFDSDLDF

SEQ ID NO: 2235859 - protein, 20 aa, Cryptosporidium parvum
NKIIVCALIMELIEVLSKKL

SEQ ID NO: 2235860 - protein, 17 aa, Cryptosporidium parvum
NKISDFLSHPFSPGCIL

SEQ ID NO: 2235861 - protein, 23 aa, Cryptosporidium parvum
NKISEKNIAFGIPTLNLKLNTRS

SEQ ID NO: 2235862 - protein, 20 aa, Cryptosporidium parvum
NKISLFSAMEVFSIYIQTKF

SEQ ID NO: 2235863 - protein, 19 aa, Cryptosporidium parvum
NKIVAFIDKLIDLIISVIR

SEQ ID NO: 2235864 - protein, 33 aa, Cryptosporidium parvum
NKKFTLFYFFFRWITYYVEMEIAANYERIIISL

SEQ ID NO: 2235865 - protein, 25 aa, Cryptosporidium parvum
NKKMLSKCIIIFSILYENDIKNDQI

SEQ ID NO: 2235866 - protein, 25 aa, Cryptosporidium parvum
NKKPEAINIIGIFNVWNFKKNSPEN

SEQ ID NO: 2235867 - protein, 22 aa, Cryptosporidium parvum
NKKQCAYTIHYLEGSSLSGSYF

SEQ ID NO: 2235868 - protein, 19 aa, Cryptosporidium parvum
NKKSPIFPRRSIDSNKGHY

SEQ ID NO: 2235869 - protein, 18 aa, Cryptosporidium parvum
NKKWPIKLNLLLIDPEWV

SEQ ID NO: 2235870 - protein, 26 aa, Cryptosporidium parvum
NKKYKKSMWLFFGIGIVQMTLSLFLD

SEQ ID NO: 2235871 - protein, 17 aa, Cryptosporidium parvum
NKLHLVWLDRFNLNMNK

SEQ ID NO: 2235872 - protein, 32 aa, Cryptosporidium parvum
NKLIWSCIQNSFEIFTILSMHNIFKSKLLIYK

SEQ ID NO: 2235873 - protein, 32 aa, Cryptosporidium parvum; identical to SEQ ID NO: 2126196

SEQ ID NO: 2235874 - protein, 22 aa, Cryptosporidium parvum
NKLPLWVSWIKYISFQRYSYSA

SEQ ID NO: 2235875 - protein, 20 aa, Cryptosporidium parvum
NKLRNSFNFVGETIIEVPLI

SEQ ID NO: 2235876 - protein, 17 aa, Cryptosporidium parvum
NKLRWKVENTGAERSSS

SEQ ID NO: 2235877 - protein, 24 aa, Cryptosporidium parvum
NKLRYFYGRHLWLLSSKVNLNNLC

SEQ ID NO: 2235878 - protein, 20 aa, Cryptosporidium parvum
NKLRYIYNFGSSQYSNKYDQ

SEQ ID NO: 2235879 - protein, 28 aa, Cryptosporidium parvum
NKLSKWYTWCLHCHHGGCFKHISEWFEC

SEQ ID NO: 2235880 - protein, 19 aa, Cryptosporidium parvum
NKLSQIFYNYNFISLYDNN

SEQ ID NO: 2235881 - protein, 25 aa, Cryptosporidium parvum
NKLYFELLNGLNLVKFDLFQYNIYL

SEQ ID NO: 2235882 - protein, 25 aa, Cryptosporidium parvum
NKMSRRMALGSSISMFDQLKLKEKN

SEQ ID NO: 2235883 - protein, 17 aa, Cryptosporidium parvum
NKNAILFYLEVFGDICS

SEQ ID NO: 2235884 - protein, 27 aa, Cryptosporidium parvum
NKNFLKWILKELNCETSTFVDYETSKI

SEQ ID NO: 2235885 - protein, 27 aa, Cryptosporidium parvum
NKNHYKCSFSFNFNECILTISQEFIQV

SEQ ID NO: 2235886 - protein, 18 aa, Cryptosporidium parvum
NKNICCGIINKGKNMINQ

SEQ ID NO: 2235887 - protein, 23 aa, Cryptosporidium parvum
NKNINVLCRIHLDINKILKTPNS

SEQ ID NO: 2235888 - protein, 18 aa, Cryptosporidium parvum
NKNNCIIYPMIENISISA

SEQ ID NO: 2235889 - protein, 24 aa, Cryptosporidium parvum
NKNPEYCHWFAFYLVKNRASKEKN

SEQ ID NO: 2235890 - protein, 25 aa, Cryptosporidium parvum
NKNPKIKLTHIIKGGSLSMIKDEKI

SEQ ID NO: 2235891 - protein, 17 aa, Cryptosporidium parvum
NKPREILSPKISIRGAN

SEQ ID NO: 2235892 - protein, 19 aa, Cryptosporidium parvum
NKQGLFRNFCEYYKNQYEK

SEQ ID NO: 2235893 - protein, 20 aa, Cryptosporidium parvum
NKRFKSVLSNYCNRIKNTQQ

SEQ ID NO: 2235894 - protein, 21 aa, Cryptosporidium parvum
NKRIRFVAIRPIGNIIAIGYS

SEQ ID NO: 2235895 - protein, 21 aa, Cryptosporidium parvum
NKRLNKKNCKSLFDDTQDFSK

SEQ ID NO: 2235896 - protein, 21 aa, Cryptosporidium parvum
NKRSGAFSFFGKSLAVVQAEQ

SEQ ID NO: 2235897 - protein, 20 aa, Cryptosporidium parvum
NKRSGFKRSFGGDSQKHSHL

SEQ ID NO: 2235898 - protein, 25 aa, Cryptosporidium parvum
NKRVIEVILLLTFYKRIEKYNNAKK

SEQ ID NO: 2235899 - protein, 18 aa, Cryptosporidium parvum
NKSFISFQAFTMDKLISA

SEQ ID NO: 2235900 - protein, 22 aa, Cryptosporidium parvum
NKSIYRYLLVQYLIRKNRSRSE

SEQ ID NO: 2235901 - protein, 24 aa, Cryptosporidium parvum
NKSLNILPFKGFEILDKYFNNSIL

SEQ ID NO: 2235902 - protein, 19 aa, Cryptosporidium parvum
NKSMRYLKVAGATILGGVV

SEQ ID NO: 2235903 - protein, 20 aa, Cryptosporidium parvum
NKSRISKIWKALSNSEPSII

SEQ ID NO: 2235904 - protein, 26 aa, Cryptosporidium parvum
NKTNCLIEFNKFRLFLLLDNEEREFF

SEQ ID NO: 2235905 - protein, 24 aa, Cryptosporidium parvum
NKVALNFLCFILVFYTSYQPDISK

SEQ ID NO: 2235906 - protein, 23 aa, Cryptosporidium parvum
NKVVSYCRLKGFTTPGALVNGYF

SEQ ID NO: 2235907 - protein, 19 aa, Cryptosporidium parvum
NKWLSEVIVNVVFSINGCI

SEQ ID NO: 2235908 - protein, 19 aa, Cryptosporidium parvum
NLAKAVGLATMIATMRPDI

SEQ ID NO: 2235909 - protein, 22 aa, Cryptosporidium parvum
NLCIVVGLLSYFMIYSDHEIEF

SEQ ID NO: 2235910 - protein, 27 aa, Cryptosporidium parvum
NLDIPNIIWKLILGESVSLNDLKQIDW

SEQ ID NO: 2235911 - protein, 25 aa, Cryptosporidium parvum
NLDLPIQLLDNFLLSWIIEHVEQKK

SEQ ID NO: 2235912 - protein, 25 aa, Cryptosporidium parvum
NLEFPMSKFWMMGFFDAFSSILTLL

SEQ ID NO: 2235913 - protein, 23 aa, Cryptosporidium parvum
NLEHILISLSICLLKKKFQSKTK

SEQ ID NO: 2235914 - protein, 29 aa, Cryptosporidium parvum
NLEIFKMQIFNPVKWYKKQEAIRRANQTP

SEQ ID NO: 2235915 - protein, 22 aa, Cryptosporidium parvum
NLELISRINLNYMESENYNINY

SEQ ID NO: 2235916 - protein, 20 aa, Cryptosporidium parvum
NLELKVTVFTSIDKKYIRVN

SEQ ID NO: 2235917 - protein, 26 aa, Cryptosporidium parvum
NLENVFRPKVFGAINLHYAIKNMLPY

SEQ ID NO: 2235918 - protein, 21 aa, Cryptosporidium parvum
NLFKSKAYVLKLLQLDIDPKT

SEQ ID NO: 2235919 - protein, 18 aa, Cryptosporidium parvum
NLFKTCLNQNILSDEKSF

SEQ ID NO: 2235920 - protein, 18 aa, Cryptosporidium parvum
NLFLDIEVLFSFITARVD

SEQ ID NO: 2235921 - protein, 18 aa, Cryptosporidium parvum
NLFLKFITLFILKGGTGF

SEQ ID NO: 2235922 - protein, 19 aa, Cryptosporidium parvum
NLFLLFAAICVIRGIMVFI

SEQ ID NO: 2235923 - protein, 25 aa, Cryptosporidium parvum
NLFWGDWPPSYSWVFFLGNILFYEI

SEQ ID NO: 2235924 - protein, 20 aa, Cryptosporidium parvum
NLGCDGGFYSNGWSYLLEQN

SEQ ID NO: 2235925 - protein, 23 aa, Cryptosporidium parvum
NLGISYLELAKFWTRFKNTSFNP

SEQ ID NO: 2235926 - protein, 21 aa, Cryptosporidium parvum
NLGNEFEFVFGSFIKMRPYKP

SEQ ID NO: 2235927 - protein, 24 aa, Cryptosporidium parvum
NLGREFNNILAIVILSFAWYCLFV

SEQ ID NO: 2235928 - protein, 23 aa, Cryptosporidium parvum
NLHSKYCFFTHLNAPQDFQISIG

SEQ ID NO: 2235929 - protein, 26 aa, Cryptosporidium parvum
NLIDWKDLKKFGVIYILTENFKFQEF

SEQ ID NO: 2235930 - protein, 20 aa, Cryptosporidium parvum
NLIIFCFSIMQVILGKKVNI

SEQ ID NO: 2235931 - protein, 17 aa, Cryptosporidium parvum
NLILAWFNLGKRVFLKE

SEQ ID NO: 2235932 - protein, 19 aa, Cryptosporidium parvum
NLINRLQIISGNNNDILGL

SEQ ID NO: 2235933 - protein, 21 aa, Cryptosporidium parvum
NLIPAEFTWSDYIRNIPILIE

SEQ ID NO: 2235934 - protein, 17 aa, Cryptosporidium parvum
NLIPYSRWNCELENDSI

SEQ ID NO: 2235935 - protein, 22 aa, Cryptosporidium parvum
NLIQVMEIIRFNFLSDSAKNVY

SEQ ID NO: 2235936 - protein, 19 aa, Cryptosporidium parvum
NLKMSLLSYYGLVLSIDQK

SEQ ID NO: 2235937 - protein, 25 aa, Cryptosporidium parvum
NLKNSISFNNLWFKDEEIIEQNSTV

SEQ ID NO: 2235938 - protein, 18 aa, Cryptosporidium parvum
NLKPRLIKNTSIPGILDS

SEQ ID NO: 2235939 - protein, 17 aa, Cryptosporidium parvum
NLKYFFTQWGWWFCIER

SEQ ID NO: 2235940 - protein, 21 aa, Cryptosporidium parvum
NLLESKGRISIHDISKTMKIS

SEQ ID NO: 2235941 - protein, 19 aa, Cryptosporidium parvum
NLLGARTLLRFIIQTDHIF

SEQ ID NO: 2235942 - protein, 23 aa, Cryptosporidium parvum
NLLIKRIRGNYTFDVGIGDFSKK

SEQ ID NO: 2235943 - protein, 24 aa, Cryptosporidium parvum
NLLQVPHWFNFMAIESESQQEITN

SEQ ID NO: 2235944 - protein, 25 aa, Cryptosporidium parvum
NLMEYRSLRISEWVVIVDQLEIDKK

SEQ ID NO: 2235945 - protein, 30 aa, Cryptosporidium parvum
NLMFGFLCKLSRFLPFSSLVFQKIADNLSL

SEQ ID NO: 2235946 - protein, 17 aa, Cryptosporidium parvum
NLMGITILDYLKFSLEL

SEQ ID NO: 2235947 - protein, 19 aa, Cryptosporidium parvum
NLMKRWNNYFFKYKLWLFV

SEQ ID NO: 2235948 - protein, 22 aa, Cryptosporidium parvum
NLNCLYLLLRLLILLISDVVKL

SEQ ID NO: 2235949 - protein, 19 aa, Cryptosporidium parvum
NLNKVCCKISNYESTIFEV

SEQ ID NO: 2235950 - protein, 23 aa, Cryptosporidium parvum
NLNNFRFIFSLATFSVSAPYIQR

SEQ ID NO: 2235951 - protein, 17 aa, Cryptosporidium parvum
NLNNIICIFDIRFMKNE

SEQ ID NO: 2235952 - protein, 18 aa, Cryptosporidium parvum
NLPIKQFFFCFFIEESLK

SEQ ID NO: 2235953 - protein, 25 aa, Cryptosporidium parvum
NLPSNLRKAYSMHILQLMSFLQQVT

SEQ ID NO: 2235954 - protein, 18 aa, Cryptosporidium parvum
NLPSSIILTIQMVNQYSL

SEQ ID NO: 2235955 - protein, 17 aa, Cryptosporidium parvum
NLQKLHCKSSREIAIGI

SEQ ID NO: 2235956 - protein, 20 aa, Cryptosporidium parvum
NLRALWGILQCNLLKNDAYN

SEQ ID NO: 2235957 - protein, 18 aa, Cryptosporidium parvum
NLREKFILVEIGGLFSVY

SEQ ID NO: 2235958 - protein, 26 aa, Cryptosporidium parvum
NLRIYSKYVHEFMGPILMGLLDGGFG

SEQ ID NO: 2235959 - protein, 18 aa, Cryptosporidium parvum
NLRYIKIIIEVDSKLSDF

SEQ ID NO: 2235960 - protein, 20 aa, Cryptosporidium parvum
NLSKVKLPNLLRRVSGRRQI

SEQ ID NO: 2235961 - protein, 27 aa, Cryptosporidium parvum
NLSVVCLIFPFFLSWTVVGTVWLKNIE

SEQ ID NO: 2235962 - protein, 17 aa, Cryptosporidium parvum
NLTCSSSSCFDQIDKTK

SEQ ID NO: 2235963 - protein, 18 aa, Cryptosporidium parvum
NLTLKWAKPSLDVSKDFW

SEQ ID NO: 2235964 - protein, 20 aa, Cryptosporidium parvum
NLTPRLKILGSLGIATSIYY

SEQ ID NO: 2235965 - protein, 24 aa, Cryptosporidium parvum
NLVLKTLLLLLLEYLIINFPGVSS

SEQ ID NO: 2235966 - protein, 26 aa, Cryptosporidium parvum
NLVNRPSNIFSILITSCCRLLFDSPE

SEQ ID NO: 2235967 - protein, 19 aa, Cryptosporidium parvum
NLYLSCLLGAIKTSCGLQK

SEQ ID NO: 2235968 - protein, 29 aa, Cryptosporidium parvum
NLYNKFKLPNHILYAIKYMNKMISNIHTI

SEQ ID NO: 2235969 - protein, 25 aa, Cryptosporidium parvum
NLYVLKEKVLWIGNLEISFNSTKLA

SEQ ID NO: 2235970 - protein, 38 aa, Cryptosporidium parvum; identical to SEQ ID NO: 2126255

SEQ ID NO: 2235971 - protein, 31 aa, Cryptosporidium parvum
NMDGRICWKNSKCLKSKMTINMNSSSHIMRN

SEQ ID NO: 2235972 - protein, 17 aa, Cryptosporidium parvum
NMFEIYNSIYLLSINTL

SEQ ID NO: 2235973 - protein, 23 aa, Cryptosporidium parvum
NMGSLRMANAVFRSFSSRANEDD

SEQ ID NO: 2235974 - protein, 23 aa, Cryptosporidium parvum
NMHQCLRLLVVSKKTSCNIENIF

SEQ ID NO: 2235975 - protein, 20 aa, Cryptosporidium parvum
NMIEASFTFRTDIGGGGNGY

SEQ ID NO: 2235976 - protein, 31 aa, Cryptosporidium parvum; identical to SEQ ID NO: 2126257

SEQ ID NO: 2235977 - protein, 17 aa, Cryptosporidium parvum
NMNDIKAALKLLDIELE

SEQ ID NO: 2235978 - protein, 30 aa, Cryptosporidium parvum
NMQKVKFSLCSISFWREIVTLYKKLKEVIQ

SEQ ID NO: 2235979 - protein, 18 aa, Cryptosporidium parvum
NMVEPMAMLIERYFNTET

SEQ ID NO: 2235980 - protein, 18 aa, Cryptosporidium parvum
NMVKALIEHSTWEIISLV

SEQ ID NO: 2235981 - protein, 18 aa, Cryptosporidium parvum
NMVWLYCYLMSANTPSKL

SEQ ID NO: 2235982 - protein, 19 aa, Cryptosporidium parvum
NMYNLFGLCNLMAVLIELF

SEQ ID NO: 2235983 - protein, 19 aa, Cryptosporidium parvum
NNDPRRVALLQVIVSLVFL

SEQ ID NO: 2235984 - protein, 22 aa, Cryptosporidium parvum
NNDSRCCLTMNKKYFNCENEIC

SEQ ID NO: 2235985 - protein, 24 aa, Cryptosporidium parvum
NNFKRKSFEWKNFPIYDSNKPIIV

SEQ ID NO: 2235986 - protein, 25 aa, Cryptosporidium parvum
NNFKRLCWNLLKILYLFTLLLFILS

SEQ ID NO: 2235987 - protein, 24 aa, Cryptosporidium parvum
NNFPKLCQNYWKKSVKSLISKYKT

SEQ ID NO: 2235988 - protein, 25 aa, Cryptosporidium parvum
NNGQSCLECRYHLNKALIYTSRIST

SEQ ID NO: 2235989 - protein, 20 aa, Cryptosporidium parvum
NNHCENCFIESFGPKERYEW

SEQ ID NO: 2235990 - protein, 24 aa, Cryptosporidium parvum
NNHVGDILLCIDIVKLCDSKMVPP

SEQ ID NO: 2235991 - protein, 17 aa, Cryptosporidium parvum
NNIELENTFSFLLYHYH

SEQ ID NO: 2235992 - protein, 17 aa, Cryptosporidium parvum
NNIFKLFLLIIPNLLFQ

SEQ ID NO: 2235993 - protein, 23 aa, Cryptosporidium parvum
NNIKEVILFPAMRNVKQNAQHSN

SEQ ID NO: 2235994 - protein, 27 aa, Cryptosporidium parvum
NNILVSSFFFVKACFLFVSAIGRVHSR

SEQ ID NO: 2235995 - protein, 17 aa, Cryptosporidium parvum
NNIPRKSPFNISESNNQ

SEQ ID NO: 2235996 - protein, 24 aa, Cryptosporidium parvum
NNIQVYFFLCFSIHILYFSRMVRH

SEQ ID NO: 2235997 - protein, 17 aa, Cryptosporidium parvum
NNIRYHLDIAYIWLYLR

SEQ ID NO: 2235998 - protein, 39 aa, Cryptosporidium parvum
NNKELRWNFYWCIMTLLCLIHFCSYSASFARNEGKVVRF

SEQ ID NO: 2235999 - protein, 22 aa, Cryptosporidium parvum
NNKKFCKIFDQFHFNTIQPHNL

SEQ ID NO: 2236000 - protein, 23 aa, Cryptosporidium parvum
NNKYRIEAIIMKFLKHKQKSSLL

SEQ ID NO: 2236001 - protein, 26 aa, Cryptosporidium parvum
NNLGECPLRRVIYGFMTKIRLLLIES

SEQ ID NO: 2236002 - protein, 21 aa, Cryptosporidium parvum
NNLHWGFIVNFVLSLSSIIHY

SEQ ID NO: 2236003 - protein, 18 aa, Cryptosporidium parvum
NNLIKEFPDRSSFLNREN

SEQ ID NO: 2236004 - protein, 27 aa, Cryptosporidium parvum
NNLKKLVFLLRWCCDRNFASISKQALY

SEQ ID NO: 2236005 - protein, 22 aa, Cryptosporidium parvum
NNLKSSISYGVFPYLWEGLLDM

SEQ ID NO: 2236006 - protein, 26 aa, Cryptosporidium parvum
NNLLICISCGSILCTEYSCCNETETS

SEQ ID NO: 2236007 - protein, 23 aa, Cryptosporidium parvum
NNLPAPMFMFIFSLFSLIIGMIL

SEQ ID NO: 2236008 - protein, 24 aa, Cryptosporidium parvum
NNLRRFPWININSHPLVKLETDRK

SEQ ID NO: 2236009 - protein, 29 aa, Cryptosporidium parvum
NNLTQQFPFNGSLLLNGKVANITTFDILP

SEQ ID NO: 2236010 - protein, 19 aa, Cryptosporidium parvum
NNMPYLITFGLIKFNPVDY

SEQ ID NO: 2236011 - protein, 25 aa, Cryptosporidium parvum
NNNHIGRLLTLFGISLNHQLQFLDD

SEQ ID NO: 2236012 - protein, 26 aa, Cryptosporidium parvum
NNNINELWPFFYLHYNYIQKKLIISS

SEQ ID NO: 2236013 - protein, 26 aa, Cryptosporidium parvum
NNNKWKVSNIWVIFTLENNSRVYPIE

SEQ ID NO: 2236014 - protein, 40 aa, Cryptosporidium parvum
NNNYFSIVKFFWKLAYLVLFILCWVVFPILLEYELSGDFD

SEQ ID NO: 2236015 - protein, 17 aa, Cryptosporidium parvum
NNPLLLMYINLYNNKNL

SEQ ID NO: 2236016 - protein, 19 aa, Cryptosporidium parvum
NNPLYCCLNNYLIQLKDES

SEQ ID NO: 2236017 - protein, 24 aa, Cryptosporidium parvum
NNPRFIVYWDLYGIILNWIITFYF

SEQ ID NO: 2236018 - protein, 20 aa, Cryptosporidium parvum
NNQCSLKFRIYVRKILISLI

SEQ ID NO: 2236019 - protein, 23 aa, Cryptosporidium parvum
NNRFYSKIKVILKYVKFTLENAL

SEQ ID NO: 2236020 - protein, 21 aa, Cryptosporidium parvum
NNRNGILLCYSLLSLNLLNIE

SEQ ID NO: 2236021 - protein, 19 aa, Cryptosporidium parvum
NNRPVLILLDRDIDLSTMI

SEQ ID NO: 2236022 - protein, 26 aa, Cryptosporidium parvum
NNSEFDGNINFKEWVVNGADEHLLNN

SEQ ID NO: 2236023 - protein, 24 aa, Cryptosporidium parvum
NNSEFWWSNSYRVYMEMLITESKD

SEQ ID NO: 2236024 - protein, 28 aa, Cryptosporidium parvum
NNSLSVPIIDLWRILALHPQSSDIHKKT

SEQ ID NO: 2236025 - protein, 25 aa, Cryptosporidium parvum
NNTRTADIWNLYGMIDADPLSSTES

SEQ ID NO: 2236026 - protein, 19 aa, Cryptosporidium parvum
NNVEFLKNIEFIFTIPETH

SEQ ID NO: 2236027 - protein, 25 aa, Cryptosporidium parvum
NNVMGHFKPAIWIERSKYDFDTNKY

SEQ ID NO: 2236028 - protein, 23 aa, Cryptosporidium parvum
NNVPDAFGVHYSRDVLMSMNALI

SEQ ID NO: 2236029 - protein, 18 aa, Cryptosporidium parvum
NNYFLNIRKFELILFNDI

SEQ ID NO: 2236030 - protein, 23 aa, Cryptosporidium parvum
NNYLKEIFYIVGPNMNICNESCC

SEQ ID NO: 2236031 - protein, 26 aa, Cryptosporidium parvum
NNYYCKGLNLLKKREIKAINNDFNSE

SEQ ID NO: 2236032 - protein, 29 aa, Cryptosporidium parvum
NPAFKMIVSTVLMCLGSTPYGAIAVLVVV

SEQ ID NO: 2236033 - protein, 26 aa, Cryptosporidium parvum
NPENIKNCWGLTWKKSNNILDKIEKK

SEQ ID NO: 2236034 - protein, 18 aa, Cryptosporidium parvum
NPERKLSIRGGVGGLNLV

SEQ ID NO: 2236035 - protein, 19 aa, Cryptosporidium parvum
NPFDCEIQFGVGRRYNRSE

SEQ ID NO: 2236036 - protein, 24 aa, Cryptosporidium parvum
NPIGRIGTIVSRIFQAFNQPVGEG

SEQ ID NO: 2236037 - protein, 30 aa, Cryptosporidium parvum
NPIIKFELPCMAIMSCFSPKDDLKMVISGV

SEQ ID NO: 2236038 - protein, 27 aa, Cryptosporidium parvum
NPILAFSILCLVFWYNLMKVTNVEFSD

SEQ ID NO: 2236039 - protein, 23 aa, Cryptosporidium parvum
NPILFDDCIPILGKMVIEELNRI

SEQ ID NO: 2236040 - protein, 26 aa, Cryptosporidium parvum
NPKGGYPLTWVVHSKYWFNSVGSELN

SEQ ID NO: 2236041 - protein, 22 aa, Cryptosporidium parvum
NPKPSGSCGMVIIETSEHLIFQ

SEQ ID NO: 2236042 - protein, 22 aa, Cryptosporidium parvum
NPKRNICVHIDNNLKIMPEIDL

SEQ ID NO: 2236043 - protein, 27 aa, Cryptosporidium parvum
NPLQIFRKRVEFLRKAFSKPFVCSEKD

SEQ ID NO: 2236044 - protein, 18 aa, Cryptosporidium parvum
NPNPIAFLPDHGVMPVKG

SEQ ID NO: 2236045 - protein, 20 aa, Cryptosporidium parvum
NPQIESWLAINIDKITSIYN

SEQ ID NO: 2236046 - protein, 24 aa, Cryptosporidium parvum
NPSNRYPYIYNFTLSFAGSCGDSR

SEQ ID NO: 2236047 - protein, 31 aa, Cryptosporidium parvum
NPTWDFFMSLPFPIPYLLILSVLHLIIIHTT

SEQ ID NO: 2236048 - protein, 18 aa, Cryptosporidium parvum
NPVPILTIILSWSSEVMR

SEQ ID NO: 2236049 - protein, 19 aa, Cryptosporidium parvum
NPWRKELYRSISERTSNTN

SEQ ID NO: 2236050 - protein, 20 aa, Cryptosporidium parvum
NQDAAFLCGCMTLHVLQFIL

SEQ ID NO: 2236051 - protein, 25 aa, Cryptosporidium parvum
NQDLTTFCIFRLVLNTVQSLIQWIR

SEQ ID NO: 2236052 - protein, 26 aa, Cryptosporidium parvum
NQFFFSMCFWGLFSAVLGPLSQKIAS

SEQ ID NO: 2236053 - protein, 34 aa, Cryptosporidium parvum
NQFFKHIISTFCAEKAFNFFLIILISNLNLTMYE

SEQ ID NO: 2236054 - protein, 18 aa, Cryptosporidium parvum
NQGFFKQELIGMYTGSFE

SEQ ID NO: 2236055 - protein, 26 aa, Cryptosporidium parvum
NQGIFKICLLLNFLIISGVLSILINF

SEQ ID NO: 2236056 - protein, 25 aa, Cryptosporidium parvum
NQHLIIPVIIQFLLSIAIPSKNEFN

SEQ ID NO: 2236057 - protein, 18 aa, Cryptosporidium parvum
NQIFPDYFIAINYLLSGM

SEQ ID NO: 2236058 - protein, 18 aa, Cryptosporidium parvum
NQIIPLISSYFIFDNLSI

SEQ ID NO: 2236059 - protein, 18 aa, Cryptosporidium parvum
NQILEEFVDYLLVLDSIF

SEQ ID NO: 2236060 - protein, 28 aa, Cryptosporidium parvum
NQILHFYCIKFLWKFLPLTSTKDFLEQY

SEQ ID NO: 2236061 - protein, 23 aa, Cryptosporidium parvum
NQKEIKGRIKIDINQQFWAEFVG

SEQ ID NO: 2236062 - protein, 24 aa, Cryptosporidium parvum
NQLLDHQYLFFGIIRMISGPRDKE

SEQ ID NO: 2236063 - protein, 26 aa, Cryptosporidium parvum
NQLYCVFDCIISVFLYYISKTNNFNL

SEQ ID NO: 2236064 - protein, 18 aa, Cryptosporidium parvum
NQQISWGFIFSRSIKSLN

SEQ ID NO: 2236065 - protein, 23 aa, Cryptosporidium parvum
NQRKKRIICMDSIFEHMDPNVTM

SEQ ID NO: 2236066 - protein, 29 aa, Cryptosporidium parvum
NQRSVFGIICKKASWFIVIYQEETVDTFC

SEQ ID NO: 2236067 - protein, 21 aa, Cryptosporidium parvum
NQSFLSSLLFCRFLQDYIENN

SEQ ID NO: 2236068 - protein, 24 aa, Cryptosporidium parvum
NQSYSLKMILGFILFSEQINGRTE

SEQ ID NO: 2236069 - protein, 22 aa, Cryptosporidium parvum
NQYFKHCITFIVSHDIRSLQYV

SEQ ID NO: 2236070 - protein, 18 aa, Cryptosporidium parvum
NQYLLLVAFIGMIMLVLL

SEQ ID NO: 2236071 - protein, 22 aa, Cryptosporidium parvum
NRARKELFRIYNIIHDNLIKDE

SEQ ID NO: 2236072 - protein, 29 aa, Cryptosporidium parvum
NRCNHIKRLAFLIFCCPENTFQLQLSLIL

SEQ ID NO: 2236073 - protein, 23 aa, Cryptosporidium parvum
NRDEIIQMISFLFQIIIQNNNTQ

SEQ ID NO: 2236074 - protein, 19 aa, Cryptosporidium parvum
NREGFKMIETRSIVPSYKL

SEQ ID NO: 2236075 - protein, 17 aa, Cryptosporidium parvum
NRELPELLLCAQSFQDS

SEQ ID NO: 2236076 - protein, 23 aa, Cryptosporidium parvum
NRESFKFRKRTAFDDATDNFFKR

SEQ ID NO: 2236077 - protein, 33 aa, Cryptosporidium parvum; identical to SEQ ID NO: 2126325

SEQ ID NO: 2236078 - protein, 25 aa, Cryptosporidium parvum
NRFFPYLLRHVKGWQPYQALLLQIF

SEQ ID NO: 2236079 - protein, 19 aa, Cryptosporidium parvum
NRFNEIFVPSLSMYQLKDD

SEQ ID NO: 2236080 - protein, 23 aa, Cryptosporidium parvum
NRFTYKHFVVYIVFYVIGTILNL

SEQ ID NO: 2236081 - protein, 19 aa, Cryptosporidium parvum
NRGGGLIGIHNKGFEHYEA

SEQ ID NO: 2236082 - protein, 19 aa, Cryptosporidium parvum
NRGLFLSEFIMDYPISSEF

SEQ ID NO: 2236083 - protein, 19 aa, Cryptosporidium parvum
NRHSRFNPELARRRIKENN

SEQ ID NO: 2236084 - protein, 25 aa, Cryptosporidium parvum
NRIIHLGDSCGFSLKKCGFYSIKGN

SEQ ID NO: 2236085 - protein, 23 aa, Cryptosporidium parvum
NRIIKPLFNRYFKLISSEDQNML

SEQ ID NO: 2236086 - protein, 19 aa, Cryptosporidium parvum
NRIILSIPASINFMSTSIL

SEQ ID NO: 2236087 - protein, 22 aa, Cryptosporidium parvum
NRIISLFKFKFFNEPLWNAISW

SEQ ID NO: 2236088 - protein, 20 aa, Cryptosporidium parvum
NRIKKRVLALHNLDLKNFKK

SEQ ID NO: 2236089 - protein, 27 aa, Cryptosporidium parvum
NRIKREEFIPILKCLDFSKMISKKEFL

SEQ ID NO: 2236090 - protein, 18 aa, Cryptosporidium parvum
NRISCCFICEGIDSSNMS

SEQ ID NO: 2236091 - protein, 23 aa, Cryptosporidium parvum
NRISSNWRLLGFQNDDPRFDFKC

SEQ ID NO: 2236092 - protein, 24 aa, Cryptosporidium parvum
NRKIKIHPNFRIFSSCIYTKQNNF

SEQ ID NO: 2236093 - protein, 17 aa, Cryptosporidium parvum
NRLDRIYAMPISVLIEF

SEQ ID NO: 2236094 - protein, 18 aa, Cryptosporidium parvum
NRLHLFKQILTFVNIIFN

SEQ ID NO: 2236095 - protein, 19 aa, Cryptosporidium parvum
NRLLPKVLRRTKVYLSKNN

SEQ ID NO: 2236096 - protein, 18 aa, Cryptosporidium parvum
NRLSCIYNSTKFFAINTF

SEQ ID NO: 2236097 - protein, 17 aa, Cryptosporidium parvum
NRLSLFLLTELKGRIIL

SEQ ID NO: 2236098 - protein, 19 aa, Cryptosporidium parvum
NRMALCKNYLISNYLFSSS

SEQ ID NO: 2236099 - protein, 24 aa, Cryptosporidium parvum
NRNEFNKELSLGVCWGILVETDIY

SEQ ID NO: 2236100 - protein, 18 aa, Cryptosporidium parvum
NRNICLVLESIIGFNKYE

SEQ ID NO: 2236101 - protein, 17 aa, Cryptosporidium parvum
NRPEFLYLKNENFMNNY

SEQ ID NO: 2236102 - protein, 23 aa, Cryptosporidium parvum
NRPTALPKSVCKYFPSSLKVRLL

SEQ ID NO: 2236103 - protein, 18 aa, Cryptosporidium parvum
NRRIKCPSIKSEIMTLKC

SEQ ID NO: 2236104 - protein, 19 aa, Cryptosporidium parvum
NRRRIKDIFYSREKGKTRR

SEQ ID NO: 2236105 - protein, 27 aa, Cryptosporidium parvum
NRSIVFASLCFYFRDSVSMSCTVLPGE

SEQ ID NO: 2236106 - protein, 17 aa, Cryptosporidium parvum
NRSLLSFQVYANHQYTE

SEQ ID NO: 2236107 - protein, 17 aa, Cryptosporidium parvum
NRTELLLGDIFSEISSL

SEQ ID NO: 2236108 - protein, 19 aa, Cryptosporidium parvum
NRTGMTIVYGFSGLGVIVN

SEQ ID NO: 2236109 - protein, 19 aa, Cryptosporidium parvum
NRTRTSGVIYFTTGVESSY

SEQ ID NO: 2236110 - protein, 21 aa, Cryptosporidium parvum
NRTSLQLIYIYLDYISRTKGY

SEQ ID NO: 2236111 - protein, 20 aa, Cryptosporidium parvum
NRVAPKFSINNRVLLLSPHP

SEQ ID NO: 2236112 - protein, 21 aa, Cryptosporidium parvum
NRVLIEFKRGLVFAINTVDIE

SEQ ID NO: 2236113 - protein, 22 aa, Cryptosporidium parvum
NRVSEFLSCWMRPRSYYDRFEK

SEQ ID NO: 2236114 - protein, 17 aa, Cryptosporidium parvum
NRWDSGLFFSENINSGK

SEQ ID NO: 2236115 - protein, 19 aa, Cryptosporidium parvum
NRYILKILLFTMFGEIFTS

SEQ ID NO: 2236116 - protein, 25 aa, Cryptosporidium parvum
NSAIFLRVSIGYDYMKNYILTNILI

SEQ ID NO: 2236117 - protein, 19 aa, Cryptosporidium parvum
NSCDPEFIFRLESSGKYIL

SEQ ID NO: 2236118 - protein, 21 aa, Cryptosporidium parvum
NSDIKYGFGRENSIYESNNVG

SEQ ID NO: 2236119 - protein, 24 aa, Cryptosporidium parvum
NSDLWSHPRIKEFISDNETNKLKT

SEQ ID NO: 2236120 - protein, 18 aa, Cryptosporidium parvum
NSDSCFSRAPFDLDGEDN

SEQ ID NO: 2236121 - protein, 18 aa, Cryptosporidium parvum
NSEFCKDIFLWSFQQKGL

SEQ ID NO: 2236122 - protein, 18 aa, Cryptosporidium parvum
NSELKIYSQRNVQKCAES

SEQ ID NO: 2236123 - protein, 17 aa, Cryptosporidium parvum
NSFCVKLLPTEIAESVG

SEQ ID NO: 2236124 - protein, 18 aa, Cryptosporidium parvum
NSFFKSEIPDLICSTLSV

SEQ ID NO: 2236125 - protein, 28 aa, Cryptosporidium parvum
NSFKKMKPACFVSSIFSLIRISFWYEWI

SEQ ID NO: 2236126 - protein, 20 aa, Cryptosporidium parvum
NSFPTFRISPLDSHSIDTKH

SEQ ID NO: 2236127 - protein, 24 aa, Cryptosporidium parvum
NSFSRKVIEFGYLLINIFKNFNFN

SEQ ID NO: 2236128 - protein, 27 aa, Cryptosporidium parvum
NSFVLYFRFGRINSFVTIYSELNGIET

SEQ ID NO: 2236129 - protein, 24 aa, Cryptosporidium parvum
NSGFLTHLPIEWDITTKLENDLLS

SEQ ID NO: 2236130 - protein, 38 aa, Cryptosporidium parvum
NSGKCCKLIRRFSEVWGGECGTMYRQGRDTTIKTFCKG

SEQ ID NO: 2236131 - protein, 32 aa, Cryptosporidium parvum
NSGRMESILNFLKLRCKGIGLDLRGNEKMIKR

SEQ ID NO: 2236132 - protein, 22 aa, Cryptosporidium parvum
NSHSKLPWFPTLSSALYLTEDA

SEQ ID NO: 2236133 - protein, 29 aa, Cryptosporidium parvum
NSICSFSSNLKCLFCFNKEDYNSIQKNED

SEQ ID NO: 2236134 - protein, 25 aa, Cryptosporidium parvum
NSIIPSYRRPLIFIYLLNVILFILR

SEQ ID NO: 2236135 - protein, 25 aa, Cryptosporidium parvum
NSIKYYSFEIEFRRTKLVIMELHYL

SEQ ID NO: 2236136 - protein, 17 aa, Cryptosporidium parvum
NSILGIIEINYLFYSFK

SEQ ID NO: 2236137 - protein, 17 aa, Cryptosporidium parvum
NSILNWFTISPKATDRS

SEQ ID NO: 2236138 - protein, 19 aa, Cryptosporidium parvum
NSIRRSSSFFKFDKSINDY

SEQ ID NO: 2236139 - protein, 21 aa, Cryptosporidium parvum
NSISNWKGSLMDLKDPLNSSE

SEQ ID NO: 2236140 - protein, 25 aa, Cryptosporidium parvum
NSKEARSAILLGLRVNKSSLILWRG

SEQ ID NO: 2236141 - protein, 31 aa, Cryptosporidium parvum
NSKKCYYFSYKLCIIYINFILKCDHPGSSEN

SEQ ID NO: 2236142 - protein, 17 aa, Cryptosporidium parvum
NSKQCYIIVFLLQKITT

SEQ ID NO: 2236143 - protein, 26 aa, Cryptosporidium parvum
NSLCEEWPSLLVIDFLEYYASSNRSA

SEQ ID NO: 2236144 - protein, 17 aa, Cryptosporidium parvum
NSLDIRNIIGIIPFCSS

SEQ ID NO: 2236145 - protein, 22 aa, Cryptosporidium parvum
NSLDPFVCKIVIERLFSKNGLL

SEQ ID NO: 2236146 - protein, 20 aa, Cryptosporidium parvum
NSLEAYCLIISSLSHDLDHP

SEQ ID NO: 2236147 - protein, 24 aa, Cryptosporidium parvum
NSLFEIFKLFLTTYFHNRKNKNIL

SEQ ID NO: 2236148 - protein, 38 aa, Cryptosporidium parvum
NSLFSSECDFSWLSNSWLNYYMNWFVCFCKKSLTLVNN

SEQ ID NO: 2236149 - protein, 20 aa, Cryptosporidium parvum
NSLKFVLKVSPLEIFITPHF

SEQ ID NO: 2236150 - protein, 24 aa, Cryptosporidium parvum
NSLLKRFIYLFIIFWSVIASTRSI

SEQ ID NO: 2236151 - protein, 24 aa, Cryptosporidium parvum
NSLLSYLQSFKWAELKETIINLSI

SEQ ID NO: 2236152 - protein, 22 aa, Cryptosporidium parvum
NSLMSCIVFLLGNEKIIEFDSF

SEQ ID NO: 2236153 - protein, 17 aa, Cryptosporidium parvum
NSLNIYVHYELVWETST

SEQ ID NO: 2236154 - protein, 19 aa, Cryptosporidium parvum
NSLNRIICLVIIHDRLDGM

SEQ ID NO: 2236155 - protein, 21 aa, Cryptosporidium parvum
NSLQVVDFVLRLIKDPVEIKI

SEQ ID NO: 2236156 - protein, 17 aa, Cryptosporidium parvum
NSLRDFCIIPSSYENWN

SEQ ID NO: 2236157 - protein, 17 aa, Cryptosporidium parvum
NSLYACNCNPKMNGTHR

SEQ ID NO: 2236158 - protein, 24 aa, Cryptosporidium parvum
NSNDWKRRMVPVLNPPNLNKVNQK

SEQ ID NO: 2236159 - protein, 24 aa, Cryptosporidium parvum
NSNELWKLDIAYFSFQKFGMDKSC

SEQ ID NO: 2236160 - protein, 24 aa, Cryptosporidium parvum
NSNLCLQPKIAILTRIGPISTGSI

SEQ ID NO: 2236161 - protein, 17 aa, Cryptosporidium parvum
NSNLMLSVFERYNRERE

SEQ ID NO: 2236162 - protein, 27 aa, Cryptosporidium parvum
NSNSPFGCLMFRLARTTLEQGLDYSIA

SEQ ID NO: 2236163 - protein, 18 aa, Cryptosporidium parvum
NSNVFRQHIIVLLRDFGL

SEQ ID NO: 2236164 - protein, 21 aa, Cryptosporidium parvum
NSPIMPIKLSPIALKDSEPVV

SEQ ID NO: 2236165 - protein, 19 aa, Cryptosporidium parvum
NSPLHFLSFLLNYKSTPIY

SEQ ID NO: 2236166 - protein, 27 aa, Cryptosporidium parvum
NSPRTDWRVSNILPLKSRHFYKDITNI

SEQ ID NO: 2236167 - protein, 23 aa, Cryptosporidium parvum
NSQEEVRYCFGLPNAVAAPIAMC

SEQ ID NO: 2236168 - protein, 18 aa, Cryptosporidium parvum
NSQIKFGINYLGKNNIKN

SEQ ID NO: 2236169 - protein, 18 aa, Cryptosporidium parvum
NSQTNWLALFKHSSNNER

SEQ ID NO: 2236170 - protein, 21 aa, Cryptosporidium parvum
NSRTPIVVTMPVRIAELAVFR

SEQ ID NO: 2236171 - protein, 22 aa, Cryptosporidium parvum
NSRYEEFDSFKIINEALENLSG

SEQ ID NO: 2236172 - protein, 17 aa, Cryptosporidium parvum
NSSECKHILNGHQHAVT

SEQ ID NO: 2236173 - protein, 24 aa, Cryptosporidium parvum
NSSFKIRRNIFLTDLISLKGIGDE

SEQ ID NO: 2236174 - protein, 24 aa, Cryptosporidium parvum
NSSFLVDICLSGAISHILLSEDQC

SEQ ID NO: 2236175 - protein, 20 aa, Cryptosporidium parvum
NSSILSGLFIYNKAYSSSIN

SEQ ID NO: 2236176 - protein, 21 aa, Cryptosporidium parvum
NSSPCPVDCVLSFWSPWTGCS

SEQ ID NO: 2236177 - protein, 23 aa, Cryptosporidium parvum
NSSYKLGIGNIWIPNPKRKDFGS

SEQ ID NO: 2236178 - protein, 22 aa, Cryptosporidium parvum
NSTAAFGLYWGCRNKDTIVSKH

SEQ ID NO: 2236179 - protein, 18 aa, Cryptosporidium parvum
NSTKCFRDNIANYIVNDD

SEQ ID NO: 2236180 - protein, 22 aa, Cryptosporidium parvum
NSTMFKDFWSPVSRDITPHTDW

SEQ ID NO: 2236181 - protein, 18 aa, Cryptosporidium parvum
NSTVPLVRLINLSMGLYN

SEQ ID NO: 2236182 - protein, 26 aa, Cryptosporidium parvum
NSTVSIRCSCRYCENCRKIQKICTKR

SEQ ID NO: 2236183 - protein, 17 aa, Cryptosporidium parvum
NSVELFLNLVIGMLSIT

SEQ ID NO: 2236184 - protein, 25 aa, Cryptosporidium parvum
NSVIFRYALEIQYIFYNKKRNSNIG

SEQ ID NO: 2236185 - protein, 23 aa, Cryptosporidium parvum
NSVINFLLVFFIMLFSSISIPHI

SEQ ID NO: 2236186 - protein, 31 aa, Cryptosporidium parvum
NSWFVKFYAPWCGHCKSLAPDWEELGSMADG

SEQ ID NO: 2236187 - protein, 21 aa, Cryptosporidium parvum
NSWGVSWGIGGFMNVSADSCD

SEQ ID NO: 2236188 - protein, 25 aa, Cryptosporidium parvum
NSWMPADIAWTFALYLESVVVLPQL

SEQ ID NO: 2236189 - protein, 24 aa, Cryptosporidium parvum
NSYPWKMHGDLGFLPNGERAWTPS

SEQ ID NO: 2236190 - protein, 18 aa, Cryptosporidium parvum
NSYSTLFFYILKAANRFK

SEQ ID NO: 2236191 - protein, 18 aa, Cryptosporidium parvum
NTCLPPLDTSMMFCPLTK

SEQ ID NO: 2236192 - protein, 19 aa, Cryptosporidium parvum
NTDFNGCRTFAIKKKHGKS

SEQ ID NO: 2236193 - protein, 19 aa, Cryptosporidium parvum
NTEGSFKCECLDRELIFDQ

SEQ ID NO: 2236194 - protein, 26 aa, Cryptosporidium parvum
NTEPGRVPAKWGFRVGDESKRRRYCK

SEQ ID NO: 2236195 - protein, 18 aa, Cryptosporidium parvum
NTFQSDIVKREHITAEQY

SEQ ID NO: 2236196 - protein, 19 aa, Cryptosporidium parvum
NTICYRRSLLNQVLPTILC

SEQ ID NO: 2236197 - protein, 18 aa, Cryptosporidium parvum
NTIFSICPVIMNRMKLPY

SEQ ID NO: 2236198 - protein, 23 aa, Cryptosporidium parvum
NTILEIYPIPSLILQDINGEKDE

SEQ ID NO: 2236199 - protein, 26 aa, Cryptosporidium parvum
NTINLRFPIEIQVVNWKRIPTMYIKY

SEQ ID NO: 2236200 - protein, 25 aa, Cryptosporidium parvum
NTISELFSVCAIRFHAEWLDIVKFL

SEQ ID NO: 2236201 - protein, 18 aa, Cryptosporidium parvum
NTLNRLFLQISIADLSVI

SEQ ID NO: 2236202 - protein, 36 aa, Cryptosporidium parvum
NTNLRFTALSAFNWYLISMGFEFSVLVLYLLEGFYI

SEQ ID NO: 2236203 - protein, 35 aa, Cryptosporidium parvum; identical to SEQ ID NO: 2126395

SEQ ID NO: 2236204 - protein, 20 aa, Cryptosporidium parvum
NTPFEKCYHICRELNNEFGM

SEQ ID NO: 2236205 - protein, 24 aa, Cryptosporidium parvum
NTPSEIILSWILNGCSPYLSLSIY

SEQ ID NO: 2236206 - protein, 25 aa, Cryptosporidium parvum
NTSFPRFSFGNLQSSIEIERLKIHP

SEQ ID NO: 2236207 - protein, 26 aa, Cryptosporidium parvum
NTTFCCRITLVTLVFISVSLIIVLIF

SEQ ID NO: 2236208 - protein, 24 aa, Cryptosporidium parvum
NTTSFEAFHIFKLFVANPNKSPGI

SEQ ID NO: 2236209 - protein, 18 aa, Cryptosporidium parvum
NTVFQIFPLFSLVFALLA

SEQ ID NO: 2236210 - protein, 25 aa, Cryptosporidium parvum
NTVLKFSLNLDQIFDDLCQYGYKEK

SEQ ID NO: 2236211 - protein, 19 aa, Cryptosporidium parvum
NTVNPDWHEALVFDAALPD

SEQ ID NO: 2236212 - protein, 17 aa, Cryptosporidium parvum
NTYAGVYRSNETKTTEP

SEQ ID NO: 2236213 - protein, 28 aa, Cryptosporidium parvum
NVDFWMCFGKETMISWIPILKYSTELGI

SEQ ID NO: 2236214 - protein, 20 aa, Cryptosporidium parvum
NVEMNCVLFSAPKLGSERGQ

SEQ ID NO: 2236215 - protein, 21 aa, Cryptosporidium parvum
NVFMKKCMNYFNGDAIQLMKY

SEQ ID NO: 2236216 - protein, 27 aa, Cryptosporidium parvum
NVFPLAWKVEFIFWNYFSILSMSLIYW

SEQ ID NO: 2236217 - protein, 20 aa, Cryptosporidium parvum
NVFSLIPIIYLNSKLWNVQK

SEQ ID NO: 2236218 - protein, 34 aa, Cryptosporidium parvum
NVFTGLALNGDDGWDFVTTILPKVGSISLSINSN

SEQ ID NO: 2236219 - protein, 26 aa, Cryptosporidium parvum
NVFYPRKDQLIPFSGRSSNLFDKIIE

SEQ ID NO: 2236220 - protein, 19 aa, Cryptosporidium parvum
NVGFCKDKLIGEDDSSWLY

SEQ ID NO: 2236221 - protein, 27 aa, Cryptosporidium parvum
NVGNLPLEVGFTFSFPIVQSKIASAKL

SEQ ID NO: 2236222 - protein, 20 aa, Cryptosporidium parvum
NVICNVFSVLVLKHGTASTG

SEQ ID NO: 2236223 - protein, 17 aa, Cryptosporidium parvum
NVIENLLSFSFIDEALR

SEQ ID NO: 2236224 - protein, 19 aa, Cryptosporidium parvum
NVIIIKIIIILKEIWIGMG

SEQ ID NO: 2236225 - protein, 19 aa, Cryptosporidium parvum
NVIPSCFDDASIHVRSSAC

SEQ ID NO: 2236226 - protein, 25 aa, Cryptosporidium parvum
NVIRKSIIFPKNWFNGIKSTENSLK

SEQ ID NO: 2236227 - protein, 26 aa, Cryptosporidium parvum
NVLERLRTTFLISLNISKSVLEVDEK

SEQ ID NO: 2236228 - protein, 25 aa, Cryptosporidium parvum
NVLFKLLCKVLFYQGDFLECSIVLE

SEQ ID NO: 2236229 - protein, 24 aa, Cryptosporidium parvum
NVLGITLLILVIWILITSFVIIFS

SEQ ID NO: 2236230 - protein, 18 aa, Cryptosporidium parvum
NVLLYGILITLFGYISLY

SEQ ID NO: 2236231 - protein, 27 aa, Cryptosporidium parvum
NVLPSILGRLALMFKDSIREFSIQGNP

SEQ ID NO: 2236232 - protein, 25 aa, Cryptosporidium parvum
NVNNLGIDCTVIFKNTENIEVFSRH

SEQ ID NO: 2236233 - protein, 17 aa, Cryptosporidium parvum
NVPVVRWDHKKYFSLNL

SEQ ID NO: 2236234 - protein, 22 aa, Cryptosporidium parvum
NVRNAICGFSLTGSDIGGFDGI

SEQ ID NO: 2236235 - protein, 25 aa, Cryptosporidium parvum
NVRSRQPLFISFWFIMAKYFSSILI

SEQ ID NO: 2236236 - protein, 25 aa, Cryptosporidium parvum
NVSKLICKILDYILYMFYIKIKYIN

SEQ ID NO: 2236237 - protein, 25 aa, Cryptosporidium parvum
NVSLDITRLLSFYTHEQLSKNKYLN

SEQ ID NO: 2236238 - protein, 21 aa, Cryptosporidium parvum
NVTGMKKCVSALIHSNTELAH

SEQ ID NO: 2236239 - protein, 24 aa, Cryptosporidium parvum
NVWILEGPHIWKVLIYDKMGQTIL

SEQ ID NO: 2236240 - protein, 24 aa, Cryptosporidium parvum
NVYELRYYLLFPHLETFENSCNDI

SEQ ID NO: 2236241 - protein, 22 aa, Cryptosporidium parvum
NVYRYNLFLSNGIHQVVFKVYY

SEQ ID NO: 2236242 - protein, 24 aa, Cryptosporidium parvum
NWCDRLVFHNCIGFELEYMEISIL

SEQ ID NO: 2236243 - protein, 23 aa, Cryptosporidium parvum
NWDKEFLKIINTFSISYLESDTI

SEQ ID NO: 2236244 - protein, 20 aa, Cryptosporidium parvum
NWFKEIYTFVQVYKTNSHLK

SEQ ID NO: 2236245 - protein, 44 aa, Cryptosporidium parvum
NWIDSIGIWNRIVFMMTNFIAIMSCYFLFIGLFEYNTRSVTFLL

SEQ ID NO: 2236246 - protein, 25 aa, Cryptosporidium parvum
NWNYCCQLCGYQVLLNNSAKKSREQ

SEQ ID NO: 2236247 - protein, 25 aa, Cryptosporidium parvum
NWQFSFKSNHHFFSILLLLPFTASS

SEQ ID NO: 2236248 - protein, 26 aa, Cryptosporidium parvum
NWQNRICRESCPAFLSLKEVFQNKPK

SEQ ID NO: 2236249 - protein, 29 aa, Cryptosporidium parvum
NWSLKRRVIDLIMEFPRSKSSILDLYITM

SEQ ID NO: 2236250 - protein, 18 aa, Cryptosporidium parvum
NWYTLKPIFDMSSGYTFN

SEQ ID NO: 2236251 - protein, 20 aa, Cryptosporidium parvum
NYCNLFKWVGIDQIIEKTEY

SEQ ID NO: 2236252 - protein, 19 aa, Cryptosporidium parvum
NYCYNSLDFVYRGLDRLIE

SEQ ID NO: 2236253 - protein, 18 aa, Cryptosporidium parvum
NYDFKLANFDSIELNLVK

SEQ ID NO: 2236254 - protein, 19 aa, Cryptosporidium parvum
NYEKHSGIEITKFFNSRLI

SEQ ID NO: 2236255 - protein, 20 aa, Cryptosporidium parvum
NYERIIISLINIFSLQGREY

SEQ ID NO: 2236256 - protein, 17 aa, Cryptosporidium parvum
NYFCHKGEECIIDSVPG

SEQ ID NO: 2236257 - protein, 23 aa, Cryptosporidium parvum
NYFVLSSTFCFNRNINHTRNSLE

SEQ ID NO: 2236258 - protein, 17 aa, Cryptosporidium parvum
NYGKITLSAYWLPQMHA

SEQ ID NO: 2236259 - protein, 17 aa, Cryptosporidium parvum
NYHYFWDPALLLNAFYS

SEQ ID NO: 2236260 - protein, 18 aa, Cryptosporidium parvum
NYIDCFEGYLEKIGQSLV

SEQ ID NO: 2236261 - protein, 21 aa, Cryptosporidium parvum
NYIFKIIKTLSLFLIIGTFLF

SEQ ID NO: 2236262 - protein, 18 aa, Cryptosporidium parvum
NYIIKILIYESFNQVEDP

SEQ ID NO: 2236263 - protein, 17 aa, Cryptosporidium parvum
NYIIMLICCDLEISTKY

SEQ ID NO: 2236264 - protein, 23 aa, Cryptosporidium parvum
NYIKRSRILNHINSLDLFREELL

SEQ ID NO: 2236265 - protein, 19 aa, Cryptosporidium parvum
NYIRLCLQGKTKLINNKLI

SEQ ID NO: 2236266 - protein, 17 aa, Cryptosporidium parvum
NYIYKIYLFIYSWSIFQ

SEQ ID NO: 2236267 - protein, 24 aa, Cryptosporidium parvum
NYKGILRKYLKSIGISNPIKVGVV

SEQ ID NO: 2236268 - protein, 17 aa, Cryptosporidium parvum
NYKILINCFFKIIEKLK

SEQ ID NO: 2236269 - protein, 18 aa, Cryptosporidium parvum
NYLGSLVCYVSGGYGLPM

SEQ ID NO: 2236270 - protein, 25 aa, Cryptosporidium parvum
NYLKSLCLKCHIPASPIFQTYIEIR

SEQ ID NO: 2236271 - protein, 19 aa, Cryptosporidium parvum
NYNGFKFNVCVLNDGKVEW

SEQ ID NO: 2236272 - protein, 20 aa, Cryptosporidium parvum
NYNLYYVWRYLKPNHKISFS

SEQ ID NO: 2236273 - protein, 20 aa, Cryptosporidium parvum
NYPIIYFASFIYKIKVKSSG

SEQ ID NO: 2236274 - protein, 18 aa, Cryptosporidium parvum
NYPRIIFYLEHETNQQKT

SEQ ID NO: 2236275 - protein, 23 aa, Cryptosporidium parvum
NYPSELLSALSFSLNVSSSPQSQ

SEQ ID NO: 2236276 - protein, 19 aa, Cryptosporidium parvum
NYQRKKCNERNKVASLFVG

SEQ ID NO: 2236277 - protein, 18 aa, Cryptosporidium parvum
NYTCKLRLILKNYQRKKC

SEQ ID NO: 2236278 - protein, 22 aa, Cryptosporidium parvum
NYTCNVLSLLVYFVSSLPEYSF

SEQ ID NO: 2236279 - protein, 24 aa, Cryptosporidium parvum
NYVNECFNFFIGVNTFNIRESDDE

SEQ ID NO: 2236280 - protein, 21 aa, Cryptosporidium parvum
NYYKPILLWIFRIKYNKNKAI

SEQ ID NO: 2236281 - protein, 17 aa, Cryptosporidium parvum
NYYPRICEITTDIISYI

SEQ ID NO: 2236282 - protein, 17 aa, Cryptosporidium parvum
PAAALANYYIYKLGLDV

SEQ ID NO: 2236283 - protein, 38 aa, Cryptosporidium parvum
PADHLKPDFFYAFNSMPGWIQNRFIFASAFMEEILVKH

SEQ ID NO: 2236284 - protein, 21 aa, Cryptosporidium parvum
PADLYDWLSCDDIDSVKNKIN

SEQ ID NO: 2236285 - protein, 26 aa, Cryptosporidium parvum
PADVRLFVIGVRMFRSLNSPTVSVSY

SEQ ID NO: 2236286 - protein, 23 aa, Cryptosporidium parvum
PAFDGEVILEFCIGPHSATTIAM

SEQ ID NO: 2236287 - protein, 20 aa, Cryptosporidium parvum
PAGNVLRSFSIRLFNNKEQY

SEQ ID NO: 2236288 - protein, 23 aa, Cryptosporidium parvum
PAIPWFLKPLFGMRRKPYLIFFS

SEQ ID NO: 2236289 - protein, 23 aa, Cryptosporidium parvum
PAKKCFKVLIKYIPVFVSSDNEL

SEQ ID NO: 2236290 - protein, 19 aa, Cryptosporidium parvum
PAPPIPLPVSQVLLSNFHR

SEQ ID NO: 2236291 - protein, 34 aa, Cryptosporidium parvum
PAPQMKFSRFRGRYWRSKMCIRQKETFLDDIPET

SEQ ID NO: 2236292 - protein, 21 aa, Cryptosporidium parvum
PATCVKDWWLIHISQSSRVLK

SEQ ID NO: 2236293 - protein, 21 aa, Cryptosporidium parvum
PAVGVVFGFLISVWLRAAQAL

SEQ ID NO: 2236294 - protein, 21 aa, Cryptosporidium parvum
PCCHLCRSPIEIAWQLNPNES

SEQ ID NO: 2236295 - protein, 20 aa, Cryptosporidium parvum
PCDVHLFLIGIRLRNQNDSN

SEQ ID NO: 2236296 - protein, 20 aa, Cryptosporidium parvum
PCDYCPYGASIMSLYNQAVN

SEQ ID NO: 2236297 - protein, 20 aa, Cryptosporidium parvum
PCELDFHPLISSNIFIERSI

SEQ ID NO: 2236298 - protein, 29 aa, Cryptosporidium parvum
PCEQVHYWFLAYWAFRIGSGQILWDMASK

SEQ ID NO: 2236299 - protein, 24 aa, Cryptosporidium parvum
PCGHGGVCLECLGDYISNNFKLKQ

SEQ ID NO: 2236300 - protein, 30 aa, Cryptosporidium parvum
PCHRSLRILIELPLALLHIFQLYPHFIERY

SEQ ID NO: 2236301 - protein, 20 aa, Cryptosporidium parvum
PCHSKCFMIVAGRLGSSLQR

SEQ ID NO: 2236302 - protein, 17 aa, Cryptosporidium parvum
PCILYFISTSKWLFMQH

SEQ ID NO: 2236303 - protein, 20 aa, Cryptosporidium parvum
PCNGDFMFHYIYKYEKSLSL

SEQ ID NO: 2236304 - protein, 34 aa, Cryptosporidium parvum
PCNLNYRQEVIWNFRFASILGFTMNIKDFILDDN

SEQ ID NO: 2236305 - protein, 20 aa, Cryptosporidium parvum
PCSDSNLLFELWNGESKPTL

SEQ ID NO: 2236306 - protein, 20 aa, Cryptosporidium parvum
PCSGCKGSSCTYSNLCNHSC

SEQ ID NO: 2236307 - protein, 20 aa, Cryptosporidium parvum
PCVRDSKFLVEMLLATECSS

SEQ ID NO: 2236308 - protein, 31 aa, Cryptosporidium parvum
PDDMALGRWFKFLNIKAINFNGFHQAESIHY

SEQ ID NO: 2236309 - protein, 27 aa, Cryptosporidium parvum
PDEQSCIRYRISWFEFLIGKRDRSYSE

SEQ ID NO: 2236310 - protein, 26 aa, Cryptosporidium parvum
PDFIKEWAEYEAESFIDRFRCLESEF

SEQ ID NO: 2236311 - protein, 25 aa, Cryptosporidium parvum
PDGIFKDYFCIQAINLWSDDQIVPN

SEQ ID NO: 2236312 - protein, 25 aa, Cryptosporidium parvum
PDIFIKEEILFLINYFKNNGFLEIE

SEQ ID NO: 2236313 - protein, 24 aa, Cryptosporidium parvum
PDIFSIRLILNLLKKEESLLFMIS

SEQ ID NO: 2236314 - protein, 18 aa, Cryptosporidium parvum
PDIIKGLIPRYAGIFDCL

SEQ ID NO: 2236315 - protein, 24 aa, Cryptosporidium parvum
PDITRLTMSFSYIFTSLAITCSVI

SEQ ID NO: 2236316 - protein, 24 aa, Cryptosporidium parvum
PDKILRSKLLKHIVSSIVNANIKK

SEQ ID NO: 2236317 - protein, 19 aa, Cryptosporidium parvum
PDLHICGSLETIKHKNTRL

SEQ ID NO: 2236318 - protein, 20 aa, Cryptosporidium parvum
PDLLWPLLIDAVNHLKLGSA

SEQ ID NO: 2236319 - protein, 19 aa, Cryptosporidium parvum
PDNIFKRSILRKFNSHDQS

SEQ ID NO: 2236320 - protein, 25 aa, Cryptosporidium parvum
PDPIDFRGLRGMLWSKINPEKFEMF

SEQ ID NO: 2236321 - protein, 20 aa, Cryptosporidium parvum
PDPLRINSVIVFNGENADFK

SEQ ID NO: 2236322 - protein, 17 aa, Cryptosporidium parvum
PDQLWKNKFWIRHVSPV

SEQ ID NO: 2236323 - protein, 27 aa, Cryptosporidium parvum
PDRTHHCRVCRTCVLKMDHHCPWISNC

SEQ ID NO: 2236324 - protein, 23 aa, Cryptosporidium parvum
PDSDECKCLSGLSSLDEEHDRMC

SEQ ID NO: 2236325 - protein, 17 aa, Cryptosporidium parvum
PDTMVSFWNRILLNNLN

SEQ ID NO: 2236326 - protein, 25 aa, Cryptosporidium parvum
PDVGYCQGMGFIVGVLLMYMSEEDS

SEQ ID NO: 2236327 - protein, 20 aa, Cryptosporidium parvum
PDVVFACMATLLSICNRSEQ

SEQ ID NO: 2236328 - protein, 19 aa, Cryptosporidium parvum
PDVVIGLTILAYRYNGLRR

SEQ ID NO: 2236329 - protein, 19 aa, Cryptosporidium parvum
PEAKLVLKLLKNGNFHCPI

SEQ ID NO: 2236330 - protein, 17 aa, Cryptosporidium parvum
PEANYCYYLESKQSGYK

SEQ ID NO: 2236331 - protein, 20 aa, Cryptosporidium parvum
PECLEEFLNGIVLNRSIPVG

SEQ ID NO: 2236332 - protein, 33 aa, Cryptosporidium parvum; identical to SEQ ID NO: 2126487

SEQ ID NO: 2236333 - protein, 22 aa, Cryptosporidium parvum
PEDWPSQGKIEFRNVDMTFYPN

SEQ ID NO: 2236334 - protein, 24 aa, Cryptosporidium parvum
PEEDGPWFRICDGLVERLIPKIEF

SEQ ID NO: 2236335 - protein, 23 aa, Cryptosporidium parvum
PEEIKMIIISSSLDFILEKSSNQ

SEQ ID NO: 2236336 - protein, 26 aa, Cryptosporidium parvum
PEEKELLELLASVLCYIHPQSFGDII

SEQ ID NO: 2236337 - protein, 19 aa, Cryptosporidium parvum
PEEQLLCTCLCKAIYSMLE

SEQ ID NO: 2236338 - protein, 19 aa, Cryptosporidium parvum
PEFLSRYEFYVEIKCNGTK

SEQ ID NO: 2236339 - protein, 31 aa, Cryptosporidium parvum; identical to SEQ ID NO: 2126492

SEQ ID NO: 2236340 - protein, 25 aa, Cryptosporidium parvum
PEIIRLKRNSSLWCSHYYSRRSSSN

SEQ ID NO: 2236341 - protein, 22 aa, Cryptosporidium parvum
PEISHPNILFIINKIIEIQYGA

SEQ ID NO: 2236342 - protein, 17 aa, Cryptosporidium parvum
PEKLLQISIAFSNSLSN

SEQ ID NO: 2236343 - protein, 24 aa, Cryptosporidium parvum
PEKRGIHTSSIFLYFTHNVSQEGN

SEQ ID NO: 2236344 - protein, 17 aa, Cryptosporidium parvum
PELIDDLFVKFFYIKPS

SEQ ID NO: 2236345 - protein, 24 aa, Cryptosporidium parvum
PELKVFFYDVFKRKPTYYLFHRKP

SEQ ID NO: 2236346 - protein, 22 aa, Cryptosporidium parvum
PELPEVRYAASYLNNRPSRFPL

SEQ ID NO: 2236347 - protein, 25 aa, Cryptosporidium parvum
PEQLLDCFYFIFIVFIFETISDTGF

SEQ ID NO: 2236348 - protein, 28 aa, Cryptosporidium parvum
PERFSSSIACKGFAYIFAMTTLIIAYAV

SEQ ID NO: 2236349 - protein, 31 aa, Cryptosporidium parvum
PERYYSLLLSKRRGPALIELIAFSRIYNFKV

SEQ ID NO: 2236350 - protein, 19 aa, Cryptosporidium parvum
PESKPIVGIIHAAGVLDDR

SEQ ID NO: 2236351 - protein, 25 aa, Cryptosporidium parvum
PESRQKCSTILGWLATKYPNNYVLM

SEQ ID NO: 2236352 - protein, 20 aa, Cryptosporidium parvum
PEVLGKIKSFVDFNGDKFTD

SEQ ID NO: 2236353 - protein, 22 aa, Cryptosporidium parvum
PEVLIFMSLAKVVIEWEESSIP

SEQ ID NO: 2236354 - protein, 19 aa, Cryptosporidium parvum
PEVQLSFKTRKFITDILMY

SEQ ID NO: 2236355 - protein, 32 aa, Cryptosporidium parvum
PEYLFPWGNDYLNSCLSFQCHRVREHKSWYRF

SEQ ID NO: 2236356 - protein, 17 aa, Cryptosporidium parvum
PEYLYPVTITIYSSASF

SEQ ID NO: 2236357 - protein, 26 aa, Cryptosporidium parvum
PEYNELFIKWLKRCNESKVIHQKYQL

SEQ ID NO: 2236358 - protein, 24 aa, Cryptosporidium parvum
PEYVKYWLNCLDNFNEVYTNYYLR

SEQ ID NO: 2236359 - protein, 25 aa, Cryptosporidium parvum
PFAELPFDGLVGLGFPDKNSKKNNI

SEQ ID NO: 2236360 - protein, 22 aa, Cryptosporidium parvum
PFCCRTRPTLTPSLNTATYGVI

SEQ ID NO: 2236361 - protein, 18 aa, Cryptosporidium parvum
PFDVSLLSICMGSDSKAK

SEQ ID NO: 2236362 - protein, 19 aa, Cryptosporidium parvum
PFERNYCTVYFNFFSIDEL

SEQ ID NO: 2236363 - protein, 27 aa, Cryptosporidium parvum
PFFARAWIAALPLTFISFFTHYSAAQS

SEQ ID NO: 2236364 - protein, 17 aa, Cryptosporidium parvum
PFFEICNLSNYYIAYDT

SEQ ID NO: 2236365 - protein, 36 aa, Cryptosporidium parvum
PFFSIPRLFDFLVFLDCLFCIPLFLIVLSDLIPALI

SEQ ID NO: 2236366 - protein, 20 aa, Cryptosporidium parvum
PFFWCEYLRYLNLSRNKFEE

SEQ ID NO: 2236367 - protein, 17 aa, Cryptosporidium parvum
PFGDPDVVFACMATLLS

SEQ ID NO: 2236368 - protein, 17 aa, Cryptosporidium parvum
PFHHSGYAIRRFTIESL

SEQ ID NO: 2236369 - protein, 18 aa, Cryptosporidium parvum
PFIFLGLFQSIFLFCSGE

SEQ ID NO: 2236370 - protein, 19 aa, Cryptosporidium parvum
PFILSNLFIFGLIIYSVWV

SEQ ID NO: 2236371 - protein, 24 aa, Cryptosporidium parvum
PFNNIEVVKGFRIIWYPYNNFSPT

SEQ ID NO: 2236372 - protein, 21 aa, Cryptosporidium parvum
PFSMSLFRLNIIHFSFIYNLK

SEQ ID NO: 2236373 - protein, 22 aa, Cryptosporidium parvum
PFSSSLNSMWSISRLEQMCGMS

SEQ ID NO: 2236374 - protein, 21 aa, Cryptosporidium parvum
PFWMAPEIILGSGTRIQTKTG

SEQ ID NO: 2236375 - protein, 20 aa, Cryptosporidium parvum
PFYKLVKMIDMFVVGNERKD

SEQ ID NO: 2236376 - protein, 22 aa, Cryptosporidium parvum
PGDLCPIPLKTNKDFVVRKQNL

SEQ ID NO: 2236377 - protein, 26 aa, Cryptosporidium parvum
PGDNFPGGIDFKHCFENIYSEKSLQI

SEQ ID NO: 2236378 - protein, 19 aa, Cryptosporidium parvum
PGEECPILITKEAVRKMKS

SEQ ID NO: 2236379 - protein, 20 aa, Cryptosporidium parvum
PGFGMMSSWILLNISGIILS

SEQ ID NO: 2236380 - protein, 25 aa, Cryptosporidium parvum
PGGAEIFGVLGMMVGVIGCLQSTEV

SEQ ID NO: 2236381 - protein, 21 aa, Cryptosporidium parvum
PGIHINYDFTPFLVKITESRR

SEQ ID NO: 2236382 - protein, 18 aa, Cryptosporidium parvum
PGIKEDSLEFALTAENVI

SEQ ID NO: 2236383 - protein, 26 aa, Cryptosporidium parvum
PGILNGAFCTRGFFIGSIINVHVIGD

SEQ ID NO: 2236384 - protein, 20 aa, Cryptosporidium parvum
PGILSFSFKPMRFSDNSPFR

SEQ ID NO: 2236385 - protein, 21 aa, Cryptosporidium parvum
PGLIRCLPQLLIHVDTSMRDA

SEQ ID NO: 2236386 - protein, 20 aa, Cryptosporidium parvum
PGPSRRRLSMMIATAGENSS

SEQ ID NO: 2236387 - protein, 20 aa, Cryptosporidium parvum
PGSRVGAVGPGFNLNQSGSG

SEQ ID NO: 2236388 - protein, 22 aa, Cryptosporidium parvum
PGTCIPICFGSLILEVSNSIKR

SEQ ID NO: 2236389 - protein, 23 aa, Cryptosporidium parvum
PGTEILRVFCGSPSVPSQAMEMT

SEQ ID NO: 2236390 - protein, 20 aa, Cryptosporidium parvum
PGTYISILTCSVDNKGRTIL

SEQ ID NO: 2236391 - protein, 22 aa, Cryptosporidium parvum
PHFEYAFKLCEELLIPIEKITH

SEQ ID NO: 2236392 - protein, 22 aa, Cryptosporidium parvum
PHIKESSSFFFNTYRNFKSKEY

SEQ ID NO: 2236393 - protein, 32 aa, Cryptosporidium parvum; identical to SEQ ID NO: 2126530

SEQ ID NO: 2236394 - protein, 17 aa, Cryptosporidium parvum
PHNETRLYFSMDGTQRL

SEQ ID NO: 2236395 - protein, 20 aa, Cryptosporidium parvum
PIAKWLKVIVPLVADCSDKS

SEQ ID NO: 2236396 - protein, 24 aa, Cryptosporidium parvum
PICRRLYLEKVYLIFQIFTLGIIS

SEQ ID NO: 2236397 - protein, 25 aa, Cryptosporidium parvum
PIEILFLFVCCIIFRILGDHSEILI

SEQ ID NO: 2236398 - protein, 34 aa, Cryptosporidium parvum
PIEKMLDKYTRMIYDYNSGLLLDSNDEPIPGSQA

SEQ ID NO: 2236399 - protein, 18 aa, Cryptosporidium parvum
PIELKDLYMTNICDLLRR

SEQ ID NO: 2236400 - protein, 24 aa, Cryptosporidium parvum
PIEMKGWKLLHGDIFRSPKYRMIL

SEQ ID NO: 2236401 - protein, 27 aa, Cryptosporidium parvum
PIEVISSFLRFFGLYIDQKWPSEEESY

SEQ ID NO: 2236402 - protein, 25 aa, Cryptosporidium parvum
PIFGLCCTRDSIILSGGGGGKDYGI

SEQ ID NO: 2236403 - protein, 26 aa, Cryptosporidium parvum
PIFLIMMGLILFKIFLPMISASRNLQ

SEQ ID NO: 2236404 - protein, 24 aa, Cryptosporidium parvum
PIFPKLLEFLYFNASEKYLQDSLL

SEQ ID NO: 2236405 - protein, 18 aa, Cryptosporidium parvum
PIFYAFYCVAKKYPPIIR

SEQ ID NO: 2236406 - protein, 30 aa, Cryptosporidium parvum
PIGIGRRSICWTAFDFTELVPCVLKLYRLD

SEQ ID NO: 2236407 - protein, 19 aa, Cryptosporidium parvum
PIGKRLGKHIKMDIEGQNI

SEQ ID NO: 2236408 - protein, 23 aa, Cryptosporidium parvum
PIGLKFKENLAMLGLKKEQGQMI

SEQ ID NO: 2236409 - protein, 26 aa, Cryptosporidium parvum
PIHLFPKRIIQLLNHIILSNQRQRVV

SEQ ID NO: 2236410 - protein, 22 aa, Cryptosporidium parvum
PIIIILRSFDLFTIVAPPALPA

SEQ ID NO: 2236411 - protein, 28 aa, Cryptosporidium parvum
PIINSRFKLAYSVLRERGFQNSKNKNTN

SEQ ID NO: 2236412 - protein, 18 aa, Cryptosporidium parvum
PIIPFKQVWDFAQTTMIQ

SEQ ID NO: 2236413 - protein, 24 aa, Cryptosporidium parvum
PIKRFCICSVSGLIGGYTNVLVQN

SEQ ID NO: 2236414 - protein, 23 aa, Cryptosporidium parvum
PILCQSYCNLWYDACYEDYFDNI

SEQ ID NO: 2236415 - protein, 25 aa, Cryptosporidium parvum
PILEKLRFIKWFVKVILENMDDYMD

SEQ ID NO: 2236416 - protein, 31 aa, Cryptosporidium parvum; identical to SEQ ID NO: 2126544

SEQ ID NO: 2236417 - protein, 25 aa, Cryptosporidium parvum
PILMICPQPNMPRHFIMKRNQIDAS

SEQ ID NO: 2236418 - protein, 21 aa, Cryptosporidium parvum
PILRLQVWNRGLLVFGDAISE

SEQ ID NO: 2236419 - protein, 30 aa, Cryptosporidium parvum
PIPLIVILFSCLKYLIVNCNSLPSPSDSKR

SEQ ID NO: 2236420 - protein, 24 aa, Cryptosporidium parvum
PIQDPRLFLSLCVTQYYKHLHLYI

SEQ ID NO: 2236421 - protein, 30 aa, Cryptosporidium parvum
PIQPSELFNEVYCDTCTAKYGAIHSGYQTS

SEQ ID NO: 2236422 - protein, 17 aa, Cryptosporidium parvum
PIRYPRFPAQKMRTNHS

SEQ ID NO: 2236423 - protein, 35 aa, Cryptosporidium parvum
PISDYCSLYCSKWEYLKILPVAPKSLFGINSKGEI

SEQ ID NO: 2236424 - protein, 19 aa, Cryptosporidium parvum
PITDCDYSMDWFSDNRGEQ

SEQ ID NO: 2236425 - protein, 24 aa, Cryptosporidium parvum
PITDDLWYLMAHFRNPDSKMEDKI

SEQ ID NO: 2236426 - protein, 18 aa, Cryptosporidium parvum
PITFLPINVFAIYKHLSC

SEQ ID NO: 2236427 - protein, 23 aa, Cryptosporidium parvum
PITKLCQAYHSLYDLLLGGINNN

SEQ ID NO: 2236428 - protein, 23 aa, Cryptosporidium parvum
PITQYDIQWAYMIVRSYSIEIDG

SEQ ID NO: 2236429 - protein, 28 aa, Cryptosporidium parvum
PITSIEIKSKFNTMVVIFPEFNDMEMSN

SEQ ID NO: 2236430 - protein, 21 aa, Cryptosporidium parvum
PIVILAGISVVFSLRSKVGII

SEQ ID NO: 2236431 - protein, 27 aa, Cryptosporidium parvum
PIVRYYCIHAGFGILYLFIFHWLIFLP

SEQ ID NO: 2236432 - protein, 17 aa, Cryptosporidium parvum
PIWRVCPSTCNKCKECS

SEQ ID NO: 2236433 - protein, 24 aa, Cryptosporidium parvum
PIYLMPCIYLGADVFYKGKLIYLD

SEQ ID NO: 2236434 - protein, 20 aa, Cryptosporidium parvum
PKAFARFAILTTISNIQNNK

SEQ ID NO: 2236435 - protein, 25 aa, Cryptosporidium parvum
PKAMAHIFWSFSLAELKSPINWLFW

SEQ ID NO: 2236436 - protein, 31 aa, Cryptosporidium parvum
PKDQWFILICVVGFFLSMFGTFLIDVKSPFS

SEQ ID NO: 2236437 - protein, 34 aa, Cryptosporidium parvum
PKDVILLPCRHCISCESCLRSLRQDKCPLCRTTF

SEQ ID NO: 2236438 - protein, 18 aa, Cryptosporidium parvum
PKESPGMISGPKYCSYKK

SEQ ID NO: 2236439 - protein, 38 aa, Cryptosporidium parvum
PKFCNSLCTLPFPGNDNWLLRRAFLPEVVVQRVAFCKE

SEQ ID NO: 2236440 - protein, 20 aa, Cryptosporidium parvum
PKFNIEILKFVNSLPKLRYI

SEQ ID NO: 2236441 - protein, 17 aa, Cryptosporidium parvum
PKGAPLLYVDGDGIPRI

SEQ ID NO: 2236442 - protein, 20 aa, Cryptosporidium parvum
PKGLFFLSGDVHWGQIFESD

SEQ ID NO: 2236443 - protein, 19 aa, Cryptosporidium parvum
PKIADFYPKEEISYKFKEP

SEQ ID NO: 2236444 - protein, 20 aa, Cryptosporidium parvum
PKIFPVFGKRPIEGEHFDHE

SEQ ID NO: 2236445 - protein, 17 aa, Cryptosporidium parvum
PKIGRLVRLVVGVESRR

SEQ ID NO: 2236446 - protein, 20 aa, Cryptosporidium parvum
PKIIEAYVVSLFELCRNDNA

SEQ ID NO: 2236447 - protein, 18 aa, Cryptosporidium parvum
PKIIEKFIDLKVIYYQYL

SEQ ID NO: 2236448 - protein, 19 aa, Cryptosporidium parvum
PKIKIMIVSSLWQQLDFLY

SEQ ID NO: 2236449 - protein, 18 aa, Cryptosporidium parvum
PKINAIVVYKGSKDEIPK

SEQ ID NO: 2236450 - protein, 27 aa, Cryptosporidium parvum
PKIPFLKCNLFIFKLGFFRLQIDDTGT

SEQ ID NO: 2236451 - protein, 17 aa, Cryptosporidium parvum
PKIPVLLISCGLGITGI

SEQ ID NO: 2236452 - protein, 19 aa, Cryptosporidium parvum
PKISYWLIIYTVKHLFISE

SEQ ID NO: 2236453 - protein, 17 aa, Cryptosporidium parvum
PKIYPFNRFIVDVRVLV

SEQ ID NO: 2236454 - protein, 28 aa, Cryptosporidium parvum
  misc_feature (28)..(28): Xaa can be any naturally occurring amino acid
PKKLEYLLNFSMLLCFDTILYDLTFLPX

SEQ ID NO: 2236455 - protein, 20 aa, Cryptosporidium parvum
PKKYSFCNSTLYKFQNLHAW

SEQ ID NO: 2236456 - protein, 17 aa, Cryptosporidium parvum
PKLHLVCTYCIMEKHGY

SEQ ID NO: 2236457 - protein, 20 aa, Cryptosporidium parvum
PKLIKITFLLSILISTILCL

SEQ ID NO: 2236458 - protein, 26 aa, Cryptosporidium parvum
PKLIRRKAARIVNIFYGPSLNELSLS

SEQ ID NO: 2236459 - protein, 19 aa, Cryptosporidium parvum
PKLIYEFFFCFSFSIYYLF

SEQ ID NO: 2236460 - protein, 19 aa, Cryptosporidium parvum
PKLSSGMCKSEMNLSLQKK

SEQ ID NO: 2236461 - protein, 26 aa, Cryptosporidium parvum
PKLVLHCILVLEFLIKNSIGLIENIV

SEQ ID NO: 2236462 - protein, 19 aa, Cryptosporidium parvum
PKMKIDLFSYLEIMDKLGE

SEQ ID NO: 2236463 - protein, 18 aa, Cryptosporidium parvum
PKNKFKHVCDKLLTNIVL

SEQ ID NO: 2236464 - protein, 18 aa, Cryptosporidium parvum
PKNWFFVDLINFQEITDF

SEQ ID NO: 2236465 - protein, 25 aa, Cryptosporidium parvum
PKPLRALCFVGGIFLSLASLLGIFS

SEQ ID NO: 2236466 - protein, 17 aa, Cryptosporidium parvum
PKQKCHYYLEDFKISLN

SEQ ID NO: 2236467 - protein, 17 aa, Cryptosporidium parvum
PKQPCMHDQDSSKVSRI

SEQ ID NO: 2236468 - protein, 18 aa, Cryptosporidium parvum
PKSCESFPLILSPLNLKI

SEQ ID NO: 2236469 - protein, 17 aa, Cryptosporidium parvum
PKSEFGEDLGFEYTILE

SEQ ID NO: 2236470 - protein, 24 aa, Cryptosporidium parvum
PKSIKEMYSYIVVYLKDFRQYKSE

SEQ ID NO: 2236471 - protein, 27 aa, Cryptosporidium parvum
PKSLFAAERVMLYWVRKTIYISTFVIL

SEQ ID NO: 2236472 - protein, 24 aa, Cryptosporidium parvum
PKSLKKIYLVSGGSHNDTWIKGGM

SEQ ID NO: 2236473 - protein, 18 aa, Cryptosporidium parvum
PKSLKYLELIFCEELDWK

SEQ ID NO: 2236474 - protein, 21 aa, Cryptosporidium parvum
PKSQLLFNILRKDIFLNSSNS

SEQ ID NO: 2236475 - protein, 19 aa, Cryptosporidium parvum
PKTDPYLFWADIYEISGLG

SEQ ID NO: 2236476 - protein, 25 aa, Cryptosporidium parvum
PKTGKLIDPESGIAIDNSVSGVFAT

SEQ ID NO: 2236477 - protein, 18 aa, Cryptosporidium parvum
PKVGFQIFNRLFGPNGLL

SEQ ID NO: 2236478 - protein, 24 aa, Cryptosporidium parvum
PKVKFSSLIFPWSAFLAVIISYVL

SEQ ID NO: 2236479 - protein, 20 aa, Cryptosporidium parvum
PKVNWKRTIVYFVRLNYLPR

SEQ ID NO: 2236480 - protein, 18 aa, Cryptosporidium parvum
PKVSSFKLLLLLKKDIHF

SEQ ID NO: 2236481 - protein, 19 aa, Cryptosporidium parvum
PKYISFCFFLGIMGSLHLM

SEQ ID NO: 2236482 - protein, 27 aa, Cryptosporidium parvum
PKYKFIINLSLLWFLAFSQEPETPNTT

SEQ ID NO: 2236483 - protein, 17 aa, Cryptosporidium parvum
PKYKISIIALYFGSLLS

SEQ ID NO: 2236484 - protein, 21 aa, Cryptosporidium parvum
PLDEIKFIFLDLVDKQEKELN

SEQ ID NO: 2236485 - protein, 25 aa, Cryptosporidium parvum
PLDELLCAIRTLFQMTIEISPINDE

SEQ ID NO: 2236486 - protein, 40 aa, Cryptosporidium parvum; identical to SEQ ID NO: 2126590

SEQ ID NO: 2236487 - protein, 18 aa, Cryptosporidium parvum
PLDSRLGTYYEFENEVKM

SEQ ID NO: 2236488 - protein, 18 aa, Cryptosporidium parvum
PLDVIKNYWIYKDSNEVF

SEQ ID NO: 2236489 - protein, 20 aa, Cryptosporidium parvum
PLEEICNLIEIIIRKMAQNG

SEQ ID NO: 2236490 - protein, 25 aa, Cryptosporidium parvum
PLEGLEMYCKTVWKCIVDCQELNIP

SEQ ID NO: 2236491 - protein, 18 aa, Cryptosporidium parvum
PLEIHGKYAIYGTSIEKL

SEQ ID NO: 2236492 - protein, 24 aa, Cryptosporidium parvum
PLEIQICSILEKILSFTKFSNLFD

SEQ ID NO: 2236493 - protein, 25 aa, Cryptosporidium parvum
PLEYSNLLCSLPYEYNQIIQMIDNI

SEQ ID NO: 2236494 - protein, 18 aa, Cryptosporidium parvum
PLFGCYFASIASAYNEQL

SEQ ID NO: 2236495 - protein, 17 aa, Cryptosporidium parvum
PLFHIYKATQMVILSIC

SEQ ID NO: 2236496 - protein, 31 aa, Cryptosporidium parvum
PLFSLAFKSSNRLEMRIESSGAVSNEKFVIP

SEQ ID NO: 2236497 - protein, 23 aa, Cryptosporidium parvum
PLIGCALIHWSLGFANTFGNTVP

SEQ ID NO: 2236498 - protein, 23 aa, Cryptosporidium parvum
PLIKFPIFAGMVVFAVKLPVEEL

SEQ ID NO: 2236499 - protein, 25 aa, Cryptosporidium parvum
PLIKILKRFINSFPLSDKHYSINTE

SEQ ID NO: 2236500 - protein, 19 aa, Cryptosporidium parvum
PLIPCGLSSITFYNDKFEI

SEQ ID NO: 2236501 - protein, 20 aa, Cryptosporidium parvum
PLIWIYRLRESFSKNRNHFW

SEQ ID NO: 2236502 - protein, 18 aa, Cryptosporidium parvum
PLKEAFFIHLKRFHRDIS

SEQ ID NO: 2236503 - protein, 17 aa, Cryptosporidium parvum
PLKSSLKDLLILKNEYL

SEQ ID NO: 2236504 - protein, 17 aa, Cryptosporidium parvum
PLLPQHIPLVLSSCLTI

SEQ ID NO: 2236505 - protein, 29 aa, Cryptosporidium parvum
PLLPTGNILFCYYCEQPLCQAYFEQSCFF

SEQ ID NO: 2236506 - protein, 23 aa, Cryptosporidium parvum
PLLTELRSLYGPPEFLNSENNIE

SEQ ID NO: 2236507 - protein, 25 aa, Cryptosporidium parvum
PLMNTNIYLKWSRLVYEELENQKKL

SEQ ID NO: 2236508 - protein, 21 aa, Cryptosporidium parvum
PLNHLECKEISNILWDIHSIS

SEQ ID NO: 2236509 - protein, 25 aa, Cryptosporidium parvum
PLNISSRALYCFGKNIAPFLNNPNP

SEQ ID NO: 2236510 - protein, 25 aa, Cryptosporidium parvum
PLPILKDALEYVSEFVIPIISNPLE

SEQ ID NO: 2236511 - protein, 19 aa, Cryptosporidium parvum
PLPRCVICLTEMSINVISN

SEQ ID NO: 2236512 - protein, 19 aa, Cryptosporidium parvum
PLQLIAYYLAIKRGINPDK

SEQ ID NO: 2236513 - protein, 28 aa, Cryptosporidium parvum
PLQWSRKEFILEFAVRVCKKHFSWKDCN

SEQ ID NO: 2236514 - protein, 19 aa, Cryptosporidium parvum
PLRDSLKCYNGVFQVPTLI

SEQ ID NO: 2236515 - protein, 18 aa, Cryptosporidium parvum
PLSALWLWVLMAGSAILA

SEQ ID NO: 2236516 - protein, 28 aa, Cryptosporidium parvum
PLSETFLYNYLESFPKLVKLCNVDKETS

SEQ ID NO: 2236517 - protein, 27 aa, Cryptosporidium parvum
PLTILPPRLRSIFSINYVKVDDSPESI

SEQ ID NO: 2236518 - protein, 17 aa, Cryptosporidium parvum
PLTNCAKNLSSLYKNLK

SEQ ID NO: 2236519 - protein, 42 aa, Cryptosporidium parvum; identical to SEQ ID NO: 2126611

SEQ ID NO: 2236520 - protein, 18 aa, Cryptosporidium parvum
PLYTKFNLVLGHLSFSGI

SEQ ID NO: 2236521 - protein, 21 aa, Cryptosporidium parvum
PMDHYQFYLVAGRKGFSLISM

SEQ ID NO: 2236522 - protein, 25 aa, Cryptosporidium parvum
PMEKSIKKKSSWRIHHSSENNYHNI

SEQ ID NO: 2236523 - protein, 29 aa, Cryptosporidium parvum
PMQKSELLCRLFFLYRGLRLTEERNEPTQ

SEQ ID NO: 2236524 - protein, 24 aa, Cryptosporidium parvum
PMVFSWPSGNSFLEYFKARKSAES

SEQ ID NO: 2236525 - protein, 18 aa, Cryptosporidium parvum
PNALNCSQLLVSKGLSTM

SEQ ID NO: 2236526 - protein, 18 aa, Cryptosporidium parvum
PNCKEIFDKPDGDNRPSS

SEQ ID NO: 2236527 - protein, 17 aa, Cryptosporidium parvum
PNCKVQISWLDIGFNLS

SEQ ID NO: 2236528 - protein, 19 aa, Cryptosporidium parvum
PNCRPKFPTKDSEDLHNNL

SEQ ID NO: 2236529 - protein, 19 aa, Cryptosporidium parvum
PNESLRLFSPYELQSLISG

SEQ ID NO: 2236530 - protein, 24 aa, Cryptosporidium parvum
PNGKLKGIIFDLSIIKNILIDYPT

SEQ ID NO: 2236531 - protein, 19 aa, Cryptosporidium parvum
PNIIHCMVRIILSLNGIEL

SEQ ID NO: 2236532 - protein, 18 aa, Cryptosporidium parvum
PNIKDLWEYPDLIMYAKM

SEQ ID NO: 2236533 - protein, 17 aa, Cryptosporidium parvum
PNILEMVLLPIRRDQIS

SEQ ID NO: 2236534 - protein, 18 aa, Cryptosporidium parvum
PNILKFLQLPIICDKTRN

SEQ ID NO: 2236535 - protein, 42 aa, Cryptosporidium parvum; identical to SEQ ID NO: 2126626

SEQ ID NO: 2236536 - protein, 18 aa, Cryptosporidium parvum
PNIQRWNLNYEEIIDGEL

SEQ ID NO: 2236537 - protein, 20 aa, Cryptosporidium parvum
PNKIELFSNLFFTFIEGTDF

SEQ ID NO: 2236538 - protein, 18 aa, Cryptosporidium parvum
PNKIKARFIIDELSQEDE

SEQ ID NO: 2236539 - protein, 20 aa, Cryptosporidium parvum
PNKLELFHYFSVLLAISKLN

SEQ ID NO: 2236540 - protein, 34 aa, Cryptosporidium parvum
PNLLNKYRFLSLLKLPKSHFEKIRQLIFEYRLSS

SEQ ID NO: 2236541 - protein, 25 aa, Cryptosporidium parvum
PNMGYSKICLREGRGYMLSESSSIV

SEQ ID NO: 2236542 - protein, 24 aa, Cryptosporidium parvum
PNMSESWIKFVSVWLANNQKESNS

SEQ ID NO: 2236543 - protein, 19 aa, Cryptosporidium parvum
PNPHLSKFSGLTKYKISSC

SEQ ID NO: 2236544 - protein, 17 aa, Cryptosporidium parvum
PNQRIALDTCFSALSDA

SEQ ID NO: 2236545 - protein, 18 aa, Cryptosporidium parvum
PNTGLPFDEDSGSLINPE

SEQ ID NO: 2236546 - protein, 28 aa, Cryptosporidium parvum
PNTNFPCKFWRHLALEMMNSKIFIDKCN

SEQ ID NO: 2236547 - protein, 19 aa, Cryptosporidium parvum
PNYNCIHQLILLKEDNNIL

SEQ ID NO: 2236548 - protein, 18 aa, Cryptosporidium parvum
PPFLVVFLLPFSPEGDIE

SEQ ID NO: 2236549 - protein, 18 aa, Cryptosporidium parvum
PPGLILKKNHCLRFAQAK

SEQ ID NO: 2236550 - protein, 19 aa, Cryptosporidium parvum
PPICILYAKLYWKENKSPV

SEQ ID NO: 2236551 - protein, 22 aa, Cryptosporidium parvum
PPIGSCFDCYRPNQTPAEVTNQ

SEQ ID NO: 2236552 - protein, 24 aa, Cryptosporidium parvum
PPIVQRVFYGLCLLDDSNVASTTR

SEQ ID NO: 2236553 - protein, 18 aa, Cryptosporidium parvum
PPKTSLSCDGVLLRPNER

SEQ ID NO: 2236554 - protein, 17 aa, Cryptosporidium parvum
PPLDTSMMFCPLTKIGM

SEQ ID NO: 2236555 - protein, 21 aa, Cryptosporidium parvum
PPLIFKHSFISISLTKISSTF

SEQ ID NO: 2236556 - protein, 18 aa, Cryptosporidium parvum
PPRNWPYQGRIEFHDLEL

SEQ ID NO: 2236557 - protein, 20 aa, Cryptosporidium parvum
PQFWFGGWTHILAIRDIFDK

SEQ ID NO: 2236558 - protein, 20 aa, Cryptosporidium parvum
PQIPGCPCDPLLETRPTFYD

SEQ ID NO: 2236559 - protein, 28 aa, Cryptosporidium parvum
PQKASCILPKLPEAFLFLSKKEDQVRKG

SEQ ID NO: 2236560 - protein, 19 aa, Cryptosporidium parvum
PQKSGHLINTLSIQSYVVL

SEQ ID NO: 2236561 - protein, 21 aa, Cryptosporidium parvum
PQLFISFILFYSEIESIDTQA

SEQ ID NO: 2236562 - protein, 24 aa, Cryptosporidium parvum
PQVFRLKVLHDIYRLICTLSTNSL

SEQ ID NO: 2236563 - protein, 19 aa, Cryptosporidium parvum
PREILKDILGLASVSEVNG

SEQ ID NO: 2236564 - protein, 25 aa, Cryptosporidium parvum
PRFLVFEFAYSILLRKDQVELIHKL

SEQ ID NO: 2236565 - protein, 18 aa, Cryptosporidium parvum
PRGECRAFDELSDGFLRG

SEQ ID NO: 2236566 - protein, 17 aa, Cryptosporidium parvum
PRGPLFVLGNNFIRKYY

SEQ ID NO: 2236567 - protein, 18 aa, Cryptosporidium parvum
PRIFSLSSGHILVSTVGI

SEQ ID NO: 2236568 - protein, 22 aa, Cryptosporidium parvum
PRIMTILRFYRSSSISDYLSEI

SEQ ID NO: 2236569 - protein, 17 aa, Cryptosporidium parvum
PRLVVINNRQVRNFSGN

SEQ ID NO: 2236570 - protein, 19 aa, Cryptosporidium parvum
PRNLIYLVISLRFTNEKIS

SEQ ID NO: 2236571 - protein, 25 aa, Cryptosporidium parvum
PRNSLFLTMFCCIGGDSSVARLKVS

SEQ ID NO: 2236572 - protein, 19 aa, Cryptosporidium parvum
PRPKFTVNKVLKLVLWLLG

SEQ ID NO: 2236573 - protein, 31 aa, Cryptosporidium parvum
PRPSIFKYSWLKMTRRYLSLSLKEVLINLCL

SEQ ID NO: 2236574 - protein, 25 aa, Cryptosporidium parvum
PRQEIRNCSLRSLFSALTTHCKYIK

SEQ ID NO: 2236575 - protein, 23 aa, Cryptosporidium parvum
PRRIEGISSLPFVQLTLGAFNSM

SEQ ID NO: 2236576 - protein, 20 aa, Cryptosporidium parvum
PRRLPQLLVLSIIGGLTVLG

SEQ ID NO: 2236577 - protein, 21 aa, Cryptosporidium parvum
PRSPLMGGWQFDYIVEYNLPL

SEQ ID NO: 2236578 - protein, 25 aa, Cryptosporidium parvum
PRSTLNYLLYRALKLPNDFGKTRNF

SEQ ID NO: 2236579 - protein, 25 aa, Cryptosporidium parvum
PRTHHCSVCKRCIFKMDHHCPWINN

SEQ ID NO: 2236580 - protein, 30 aa, Cryptosporidium parvum
PRTPECKARILCAFELVKIGDMMGNVLFSS

SEQ ID NO: 2236581 - protein, 21 aa, Cryptosporidium parvum
PRVSLFDWYRCINHPSYDDML

SEQ ID NO: 2236582 - protein, 18 aa, Cryptosporidium parvum
PSAEEAFKRIALAFQTLS

SEQ ID NO: 2236583 - protein, 17 aa, Cryptosporidium parvum
PSARFQILINLIILIDS

SEQ ID NO: 2236584 - protein, 23 aa, Cryptosporidium parvum
PSCIIKTLMHMKGPFFVNSAKKG

SEQ ID NO: 2236585 - protein, 27 aa, Cryptosporidium parvum
PSCMKETGIILGLLIMFFSCFVLFMTQ

SEQ ID NO: 2236586 - protein, 20 aa, Cryptosporidium parvum
PSDFDLVLERYIFGILTFLS

SEQ ID NO: 2236587 - protein, 24 aa, Cryptosporidium parvum
PSEYKFSILQIKAPRCPKLRSLLC

SEQ ID NO: 2236588 - protein, 25 aa, Cryptosporidium parvum
PSGLKRPCHPLALCINKEGSYSCVC

SEQ ID NO: 2236589 - protein, 20 aa, Cryptosporidium parvum
PSGQNCSDFKLILLSNQKNS

SEQ ID NO: 2236590 - protein, 24 aa, Cryptosporidium parvum
PSGVPRIYSIHAFGDVSYAITQSG

SEQ ID NO: 2236591 - protein, 22 aa, Cryptosporidium parvum
PSHPNLWAHLFIPEYGSEKTKE

SEQ ID NO: 2236592 - protein, 25 aa, Cryptosporidium parvum
PSIFRKSRGLFPVYSIAVFCAELHM

SEQ ID NO: 2236593 - protein, 26 aa, Cryptosporidium parvum
PSIICSSLECSNCNEIIDMNISHNHE

SEQ ID NO: 2236594 - protein, 18 aa, Cryptosporidium parvum
PSILFLCRVFTLQPNGFD

SEQ ID NO: 2236595 - protein, 27 aa, Cryptosporidium parvum
PSKDFLLKFVNICFTNVIGSSLFRRET

SEQ ID NO: 2236596 - protein, 26 aa, Cryptosporidium parvum
PSKELFICNGCWRVIPTSIDIDDSVI

SEQ ID NO: 2236597 - protein, 19 aa, Cryptosporidium parvum
PSKKKFKVPALEVLYKETF

SEQ ID NO: 2236598 - protein, 19 aa, Cryptosporidium parvum
PSKPCSWETVGPAARGLTC

SEQ ID NO: 2236599 - protein, 21 aa, Cryptosporidium parvum
PSLHIKRWAFDIEIVIIAQIL

SEQ ID NO: 2236600 - protein, 20 aa, Cryptosporidium parvum
PSLILTSGWIFIRCALGGPL

SEQ ID NO: 2236601 - protein, 32 aa, Cryptosporidium parvum
PSLIYTLILTFKWELFIIFSLVVLADTCLLAQ

SEQ ID NO: 2236602 - protein, 21 aa, Cryptosporidium parvum
PSLMALNLMEYRSLRISEWVV

SEQ ID NO: 2236603 - protein, 21 aa, Cryptosporidium parvum
PSLPNGLFIFFSKKRAIKCNK

SEQ ID NO: 2236604 - protein, 27 aa, Cryptosporidium parvum
PSLSYFTCIGSWLRHSRTLIYNTPNLQ

SEQ ID NO: 2236605 - protein, 30 aa, Cryptosporidium parvum
PSLVDDWCFSKCCKCGGEFDSYPNSPEMTD

SEQ ID NO: 2236606 - protein, 31 aa, Cryptosporidium parvum
PSMLFYYLQLCKRLSLGADFTMTSLIPDNLL

SEQ ID NO: 2236607 - protein, 25 aa, Cryptosporidium parvum
PSMLQLTLKCMLSIFTNFRSSTKTQ

SEQ ID NO: 2236608 - protein, 19 aa, Cryptosporidium parvum
PSNFFYFHLFYVVSSFIMY

SEQ ID NO: 2236609 - protein, 26 aa, Cryptosporidium parvum
PSNPLDVFCLYSLRPDTDPTRRGRLK

SEQ ID NO: 2236610 - protein, 26 aa, Cryptosporidium parvum
PSNSIDISYQFLFLIYRKILISKTKY

SEQ ID NO: 2236611 - protein, 24 aa, Cryptosporidium parvum
PSPRKSLRLQPDYNKDEDLNERRH

SEQ ID NO: 2236612 - protein, 18 aa, Cryptosporidium parvum
PSPYVVGLSTIFGGITHE

SEQ ID NO: 2236613 - protein, 18 aa, Cryptosporidium parvum
PSQIRFVHYFNFLLKHTF

SEQ ID NO: 2236614 - protein, 18 aa, Cryptosporidium parvum
PSSAFLESFFGHRTIFNG

SEQ ID NO: 2236615 - protein, 27 aa, Cryptosporidium parvum
PSSDAVPDRPTNTWWNKISGQTYQVDG

SEQ ID NO: 2236616 - protein, 18 aa, Cryptosporidium parvum
PSSFKIFFSPIPEPITIF

SEQ ID NO: 2236617 - protein, 27 aa, Cryptosporidium parvum
PSSILELFGGLPSYCLYYGTQSGNVRH

SEQ ID NO: 2236618 - protein, 21 aa, Cryptosporidium parvum
PSSIYRRLLTFILEKHPNIGK

SEQ ID NO: 2236619 - protein, 23 aa, Cryptosporidium parvum
PSTCNKCKECSAGCPEWFKGNTV

SEQ ID NO: 2236620 - protein, 24 aa, Cryptosporidium parvum
PSVFNFILPLSIEFILLFCDHSVI

SEQ ID NO: 2236621 - protein, 17 aa, Cryptosporidium parvum
PSWGLLLFWLFSALESS

SEQ ID NO: 2236622 - protein, 22 aa, Cryptosporidium parvum
PTACAIARSIGLLADEYEYKNS

SEQ ID NO: 2236623 - protein, 24 aa, Cryptosporidium parvum
PTCEGCPKSNLEIMTDAMSIISNS

SEQ ID NO: 2236624 - protein, 27 aa, Cryptosporidium parvum
PTCIGIKAIFYLKFSRLISTDGNVSNL

SEQ ID NO: 2236625 - protein, 18 aa, Cryptosporidium parvum
PTCSDIFERAIKIRKNQK

SEQ ID NO: 2236626 - protein, 24 aa, Cryptosporidium parvum
PTEHHKLALSRYVVDPHIDNVESH

SEQ ID NO: 2236627 - protein, 21 aa, Cryptosporidium parvum
PTEKSSPVQLCYPDLSMTLGF

SEQ ID NO: 2236628 - protein, 22 aa, Cryptosporidium parvum
PTIDVLLCLFICFNATQISTFL

SEQ ID NO: 2236629 - protein, 18 aa, Cryptosporidium parvum
PTIIEFGILLIITVINII

SEQ ID NO: 2236630 - protein, 18 aa, Cryptosporidium parvum
PTIIKPIHLWTGKQVFTS

SEQ ID NO: 2236631 - protein, 21 aa, Cryptosporidium parvum
PTILLIPAIVRKDITIGGRAT

SEQ ID NO: 2236632 - protein, 19 aa, Cryptosporidium parvum
PTLDFFPYMFKDCSKKDEN

SEQ ID NO: 2236633 - protein, 20 aa, Cryptosporidium parvum
PTLLRGCRKLFGSPSYKPKT

SEQ ID NO: 2236634 - protein, 23 aa, Cryptosporidium parvum
PTMCFQFWYPRTGGIRWLQVIKH

SEQ ID NO: 2236635 - protein, 17 aa, Cryptosporidium parvum
PTNFLRLLFNQWLFSNN

SEQ ID NO: 2236636 - protein, 24 aa, Cryptosporidium parvum
PTNKELRKGIEINYNNLSPIKEEL

SEQ ID NO: 2236637 - protein, 26 aa, Cryptosporidium parvum
PTQLISIELFGSVLIDEVSILTFVIS

SEQ ID NO: 2236638 - protein, 23 aa, Cryptosporidium parvum
PTRAARRGEWAFVVISGNHTPAE

SEQ ID NO: 2236639 - protein, 23 aa, Cryptosporidium parvum
PTSEGRQALLTAIHTLITRFPIR

SEQ ID NO: 2236640 - protein, 32 aa, Cryptosporidium parvum; identical to SEQ ID NO: 2126707

SEQ ID NO: 2236641 - protein, 18 aa, Cryptosporidium parvum
PTSKYRKITAIYGNECPA

SEQ ID NO: 2236642 - protein, 19 aa, Cryptosporidium parvum
PTSQFLAVFGLDEQMFVKG

SEQ ID NO: 2236643 - protein, 24 aa, Cryptosporidium parvum
PTTAEFLMVLGILLHKVGSEVALI

SEQ ID NO: 2236644 - protein, 25 aa, Cryptosporidium parvum
PTTGLPFNPPTGHLINPTNNNTMDS

SEQ ID NO: 2236645 - protein, 27 aa, Cryptosporidium parvum
PVAKDGGLPCIVWLLLAIVHCSVNGNK

SEQ ID NO: 2236646 - protein, 19 aa, Cryptosporidium parvum
PVDKSGIEKKFLIYKLLEN

SEQ ID NO: 2236647 - protein, 28 aa, Cryptosporidium parvum
PVILLFKDLKRWLALLWTTIESFHLYIE

SEQ ID NO: 2236648 - protein, 26 aa, Cryptosporidium parvum
PVIMNRMKLPYFAYQLLYTNLLEQEF

SEQ ID NO: 2236649 - protein, 18 aa, Cryptosporidium parvum
PVISYTFKQLRHSLLPKH

SEQ ID NO: 2236650 - protein, 21 aa, Cryptosporidium parvum
PVKEYYRFLDMESIAKESPYW

SEQ ID NO: 2236651 - protein, 26 aa, Cryptosporidium parvum
PVLKFFCIKLIIFMSFWQSIILSVLS

SEQ ID NO: 2236652 - protein, 22 aa, Cryptosporidium parvum
PVLKLHLKIALKINDDNDNQVK

SEQ ID NO: 2236653 - protein, 26 aa, Cryptosporidium parvum
PVLRLLKYWLHIRRLPVAKDGGLPCI

SEQ ID NO: 2236654 - protein, 17 aa, Cryptosporidium parvum
PVPRPMLPLPGNKTETS

SEQ ID NO: 2236655 - protein, 25 aa, Cryptosporidium parvum
PVSNEFRNDFGIYFDPLWFIDLPFM

SEQ ID NO: 2236656 - protein, 17 aa, Cryptosporidium parvum
PVTKLLLSFFVILFICF

SEQ ID NO: 2236657 - protein, 19 aa, Cryptosporidium parvum
PVTTLVFFSPRLVGKEATE

SEQ ID NO: 2236658 - protein, 17 aa, Cryptosporidium parvum
PWCKSLIPNIYSFVQDE

SEQ ID NO: 2236659 - protein, 19 aa, Cryptosporidium parvum
PWDYKRISLRFKGINGNLH

SEQ ID NO: 2236660 - protein, 18 aa, Cryptosporidium parvum
PWGPLCMAEVSLGPRTEC

SEQ ID NO: 2236661 - protein, 33 aa, Cryptosporidium parvum
PWIDCIGNLKSFKGNYIAPFGLFGHLKIYDFAL

SEQ ID NO: 2236662 - protein, 19 aa, Cryptosporidium parvum
PWIFEFIAIITKRIANCIL

SEQ ID NO: 2236663 - protein, 23 aa, Cryptosporidium parvum
PWISSKYSYKWNVISGTYGDVIC

SEQ ID NO: 2236664 - protein, 17 aa, Cryptosporidium parvum
PWKLWKNKPREILSPKI

SEQ ID NO: 2236665 - protein, 19 aa, Cryptosporidium parvum
PWLHEFLNALVCAWTLFSL

SEQ ID NO: 2236666 - protein, 24 aa, Cryptosporidium parvum
PWRFSEIVSVALFFVFGVIFFECD

SEQ ID NO: 2236667 - protein, 19 aa, Cryptosporidium parvum
PWWFYNIIIVLAVLAVGIF

SEQ ID NO: 2236668 - protein, 21 aa, Cryptosporidium parvum
PWYSMPDFIALLLEDILRITS

SEQ ID NO: 2236669 - protein, 26 aa, Cryptosporidium parvum
PYDIPFWLPETITFLANYSGNRNISQ

SEQ ID NO: 2236670 - protein, 19 aa, Cryptosporidium parvum
PYEPPLILCVDGYDCKVKG

SEQ ID NO: 2236671 - protein, 17 aa, Cryptosporidium parvum
PYFLSTFSIGIIFRLLY

SEQ ID NO: 2236672 - protein, 18 aa, Cryptosporidium parvum
PYGAHSNSTWVFRNNNGI

SEQ ID NO: 2236673 - protein, 29 aa, Cryptosporidium parvum
PYIHQFCSIKSPMLAPTFFSLHPCFVSEP

SEQ ID NO: 2236674 - protein, 39 aa, Cryptosporidium parvum
PYIQRINSWWNDIWLIRMRYPRCEGSTMRYFFVDTRSDG

SEQ ID NO: 2236675 - protein, 17 aa, Cryptosporidium parvum
PYLLILHLICLTVETYK

SEQ ID NO: 2236676 - protein, 20 aa, Cryptosporidium parvum
PYLSSLRIFVALRIFHFNNK

SEQ ID NO: 2236677 - protein, 18 aa, Cryptosporidium parvum
PYPIGVTFSQLLVGMMLA

SEQ ID NO: 2236678 - protein, 31 aa, Cryptosporidium parvum
PYSDFRGVGILALICLLYFSLAHPLESKLIH

SEQ ID NO: 2236679 - protein, 22 aa, Cryptosporidium parvum
PYTQNRWSVLFSVLNNGLVHLW

SEQ ID NO: 2236680 - protein, 21 aa, Cryptosporidium parvum
PYWSDGRMWINLVLVYIAMNI

SEQ ID NO: 2236681 - protein, 35 aa, Cryptosporidium parvum
PYYWKYILEPIRYIISIIFYFIWGIELTPKKEFDN

SEQ ID NO: 2236682 - protein, 21 aa, Cryptosporidium parvum
QADREIPIFFGSSRNSLYLKN

SEQ ID NO: 2236683 - protein, 19 aa, Cryptosporidium parvum
QAFMAFRMAIQKAVYFDTS

SEQ ID NO: 2236684 - protein, 26 aa, Cryptosporidium parvum
QAIIRKGRIESIGYFKPLKVPFLSWS

SEQ ID NO: 2236685 - protein, 19 aa, Cryptosporidium parvum
QAIQFRLQFIQQWSDIIAK

SEQ ID NO: 2236686 - protein, 20 aa, Cryptosporidium parvum
QALKSGFKINQEYNLQYLED

SEQ ID NO: 2236687 - protein, 19 aa, Cryptosporidium parvum
QALQTAGGFIFWGDKLKPA

SEQ ID NO: 2236688 - protein, 20 aa, Cryptosporidium parvum
QAMFFLNIIKIIFIIHFFTL

SEQ ID NO: 2236689 - protein, 18 aa, Cryptosporidium parvum
QANGFVFLDIGIDGFYNG

SEQ ID NO: 2236690 - protein, 25 aa, Cryptosporidium parvum
QAQMSVLIRCVRYYYGAHNGTRIPS

SEQ ID NO: 2236691 - protein, 18 aa, Cryptosporidium parvum
QAQQRLSSNLNYNPENNI

SEQ ID NO: 2236692 - protein, 19 aa, Cryptosporidium parvum
QAQYKSGGISPLIVSELNT

SEQ ID NO: 2236693 - protein, 25 aa, Cryptosporidium parvum
QCDWLKKKINILICESDLNTIHLPR

SEQ ID NO: 2236694 - protein, 26 aa, Cryptosporidium parvum
QCGNFGGGEKVLWCIIYEVLNANIKN

SEQ ID NO: 2236695 - protein, 25 aa, Cryptosporidium parvum
QCNAYCTYFYFPLITDMRIMSSIQL

SEQ ID NO: 2236696 - protein, 23 aa, Cryptosporidium parvum
QCQQCGTHLDAYYDPFKSITKRE

SEQ ID NO: 2236697 - protein, 23 aa, Cryptosporidium parvum
QCSKPWKLKFLNYFIPPLYDCYP

SEQ ID NO: 2236698 - protein, 20 aa, Cryptosporidium parvum
QCSSIMISLELLKVEAETFE

SEQ ID NO: 2236699 - protein, 20 aa, Cryptosporidium parvum
QCWNIFTLQLIEDFRENKDI

SEQ ID NO: 2236700 - protein, 24 aa, Cryptosporidium parvum
QDEKLIIILIEWILKNYLIHNEIS

SEQ ID NO: 2236701 - protein, 20 aa, Cryptosporidium parvum
QDELRVLDSNILKWKEDQFK

SEQ ID NO: 2236702 - protein, 19 aa, Cryptosporidium parvum
QDFYYRFNKGLKHYLAGNW

SEQ ID NO: 2236703 - protein, 20 aa, Cryptosporidium parvum
QDHHVKCCYVCIEKRKTMLL

SEQ ID NO: 2236704 - protein, 17 aa, Cryptosporidium parvum
QDIIINIYHIWFNSYIG

SEQ ID NO: 2236705 - protein, 20 aa, Cryptosporidium parvum
QDKCPLCRTTFSGFVVLPIK

SEQ ID NO: 2236706 - protein, 27 aa, Cryptosporidium parvum
QDKMKRFSFRWEEQFMKYCEKVQRRLQ

SEQ ID NO: 2236707 - protein, 24 aa, Cryptosporidium parvum
QDKNRFPLLRILRGKDYGPATKFL

SEQ ID NO: 2236708 - protein, 17 aa, Cryptosporidium parvum
QDLELCNLYIILELLGY

SEQ ID NO: 2236709 - protein, 23 aa, Cryptosporidium parvum
QDLLELFDSLILIKTLMNKKILK

SEQ ID NO: 2236710 - protein, 17 aa, Cryptosporidium parvum
QDLLTGILLQPLLRNYD

SEQ ID NO: 2236711 - protein, 22 aa, Cryptosporidium parvum
QDLNCFLVFCGVLDLCKGSTKN

SEQ ID NO: 2236712 - protein, 18 aa, Cryptosporidium parvum
QDQYLRRLISSYDLVLEE

SEQ ID NO: 2236713 - protein, 19 aa, Cryptosporidium parvum
QDSRLNLSLVKSNRIELYE

SEQ ID NO: 2236714 - protein, 17 aa, Cryptosporidium parvum
QDVLRSLIWSMNKRNEE

SEQ ID NO: 2236715 - protein, 23 aa, Cryptosporidium parvum
QDVWRCDIIFQIFQSFVDLSEVR

SEQ ID NO: 2236716 - protein, 21 aa, Cryptosporidium parvum
QEAKCKSLERGSGKSIVEKNI

SEQ ID NO: 2236717 - protein, 17 aa, Cryptosporidium parvum
QEDINWIISLVLSHSLQ

SEQ ID NO: 2236718 - protein, 26 aa, Cryptosporidium parvum
QEDIPFISGFLYGISLSGFFKADKSD

SEQ ID NO: 2236719 - protein, 23 aa, Cryptosporidium parvum
QEDNWVSIALKWGPGAYDSGSIA

SEQ ID NO: 2236720 - protein, 23 aa, Cryptosporidium parvum
QEEASRLSKLTNMTKEIKSSLVD

SEQ ID NO: 2236721 - protein, 28 aa, Cryptosporidium parvum
QEGLRMIKRSALMGSLRSFGLEFIQSDS

SEQ ID NO: 2236722 - protein, 17 aa, Cryptosporidium parvum
QEHIGAIFLSYGYFNIQ

SEQ ID NO: 2236723 - protein, 20 aa, Cryptosporidium parvum
QEHYCSIGYIPLDIPAPRGP

SEQ ID NO: 2236724 - protein, 29 aa, Cryptosporidium parvum
QEIEISLICYREFIRSFVIYKQGGLKSIT

SEQ ID NO: 2236725 - protein, 24 aa, Cryptosporidium parvum
QEIKEPAGMVWACCFANEMDFPMI

SEQ ID NO: 2236726 - protein, 21 aa, Cryptosporidium parvum
QEINSTLYLLVLRNLSIIFQQ

SEQ ID NO: 2236727 - protein, 17 aa, Cryptosporidium parvum
QEIRIITRILIFSISTL

SEQ ID NO: 2236728 - protein, 18 aa, Cryptosporidium parvum
QEISEIIHTGIMMSFATP

SEQ ID NO: 2236729 - protein, 18 aa, Cryptosporidium parvum
QEKGGFSLKNIWNYDKDA

SEQ ID NO: 2236730 - protein, 17 aa, Cryptosporidium parvum
QEKKSILAFSIIVALNI

SEQ ID NO: 2236731 - protein, 25 aa, Cryptosporidium parvum
QELIHEIWYSFQFSILPVILNIMIY

SEQ ID NO: 2236732 - protein, 17 aa, Cryptosporidium parvum
QELPKFLQVSLQGIDIS

SEQ ID NO: 2236733 - protein, 20 aa, Cryptosporidium parvum
QELPNSIGINCRIQSFGTLF

SEQ ID NO: 2236734 - protein, 21 aa, Cryptosporidium parvum
QEMCLIFGSILIYRARKRLQE

SEQ ID NO: 2236735 - protein, 22 aa, Cryptosporidium parvum
QENFVILEWLNKNCDEFFSLLL

SEQ ID NO: 2236736 - protein, 32 aa, Cryptosporidium parvum
QERFARLDIPRLCYTVHLLALISHISAHIGSL

SEQ ID NO: 2236737 - protein, 17 aa, Cryptosporidium parvum
QESRNFELYKDCESKFI

SEQ ID NO: 2236738 - protein, 26 aa, Cryptosporidium parvum
QETLFLWYSFYFLIIVSLYIIFRRLG

SEQ ID NO: 2236739 - protein, 17 aa, Cryptosporidium parvum
QEYKSGSLITYSRNYST

SEQ ID NO: 2236740 - protein, 27 aa, Cryptosporidium parvum
QEYRIATPLEYASRIVYGYTLHSQSYP

SEQ ID NO: 2236741 - protein, 19 aa, Cryptosporidium parvum
QFAKFFWHLLNSIREKYYP

SEQ ID NO: 2236742 - protein, 20 aa, Cryptosporidium parvum
QFDGAYIYNCLKFFREKWSS

SEQ ID NO: 2236743 - protein, 27 aa, Cryptosporidium parvum
QFDGGDCWKVDCKLSAWSSWSACSVTC

SEQ ID NO: 2236744 - protein, 18 aa, Cryptosporidium parvum
QFEFPWWFYNIIIVLAVL

SEQ ID NO: 2236745 - protein, 23 aa, Cryptosporidium parvum
QFGKILIMEICILYYDPKSFLDQ

SEQ ID NO: 2236746 - protein, 22 aa, Cryptosporidium parvum
QFIQCLLSNFSVRGGIFEKSFA

SEQ ID NO: 2236747 - protein, 17 aa, Cryptosporidium parvum
QFLNCIVPFIIYSEILR

SEQ ID NO: 2236748 - protein, 26 aa, Cryptosporidium parvum
QFMKIIDYILRFKLPQIYTLIEGNPF

SEQ ID NO: 2236749 - protein, 32 aa, Cryptosporidium parvum
QFMRDIISQIAFCYRISSVFLISKLNSLSRSY

SEQ ID NO: 2236750 - protein, 24 aa, Cryptosporidium parvum
QFQLCKVKQKYKRAFLTNTKGKNQ

SEQ ID NO: 2236751 - protein, 22 aa, Cryptosporidium parvum
QFRECTFVLIQIISYLPTIGTS

SEQ ID NO: 2236752 - protein, 19 aa, Cryptosporidium parvum
QFRGFIWMKLAEVENIKSE

SEQ ID NO: 2236753 - protein, 19 aa, Cryptosporidium parvum
QFSASFIVSISWVAAMFVS

SEQ ID NO: 2236754 - protein, 25 aa, Cryptosporidium parvum
QFVILCNIISLRLYHIHVINGEIQK

SEQ ID NO: 2236755 - protein, 19 aa, Cryptosporidium parvum
QFYISKWKKIDVINDPNNL

SEQ ID NO: 2236756 - protein, 24 aa, Cryptosporidium parvum
QGCKDCFREEISLLDRPSLELSKK

SEQ ID NO: 2236757 - protein, 24 aa, Cryptosporidium parvum
QGEILKYYLGWSLSSALGSNIEML

SEQ ID NO: 2236758 - protein, 25 aa, Cryptosporidium parvum
QGEYFRIILCSSILKIIDSHTLQKT

SEQ ID NO: 2236759 - protein, 17 aa, Cryptosporidium parvum
QGFLWINSLISFSSSIT

SEQ ID NO: 2236760 - protein, 22 aa, Cryptosporidium parvum
QGIMDLRMLLLQLYFKDGQFID

SEQ ID NO: 2236761 - protein, 20 aa, Cryptosporidium parvum
QGNSFSWGLFTFFFALGSMN

SEQ ID NO: 2236762 - protein, 27 aa, Cryptosporidium parvum
QGNSGKKEWKNICVASIKELEKEIEEI

SEQ ID NO: 2236763 - protein, 32 aa, Cryptosporidium parvum
QGQIFDMGSKVYIPYTKCVGVKHTTTTTTTTT

SEQ ID NO: 2236764 - protein, 19 aa, Cryptosporidium parvum
QGSAMALITSMIMRDITIG

SEQ ID NO: 2236765 - protein, 19 aa, Cryptosporidium parvum
QGSFGWCSGITLYGEGAIL

SEQ ID NO: 2236766 - protein, 21 aa, Cryptosporidium parvum
QHAPKLLSVYLQILNSLLSKK

SEQ ID NO: 2236767 - protein, 22 aa, Cryptosporidium parvum
QHELKLGLEFEKYLEKVDINDI

SEQ ID NO: 2236768 - protein, 17 aa, Cryptosporidium parvum
QHIPLVLSSCLTILVTV

SEQ ID NO: 2236769 - protein, 21 aa, Cryptosporidium parvum
QHLIGCIGFLFWSLVCNYLKP

SEQ ID NO: 2236770 - protein, 21 aa, Cryptosporidium parvum
QHLLYTIGIHFESVVTPWFRH

SEQ ID NO: 2236771 - protein, 24 aa, Cryptosporidium parvum
QHRFIGRRAALRFQDSIQEGESSS

SEQ ID NO: 2236772 - protein, 22 aa, Cryptosporidium parvum
QHWIYRNWVPLILGDKPSEIMG

SEQ ID NO: 2236773 - protein, 18 aa, Cryptosporidium parvum
QIASNFFLNGFRFTNISA

SEQ ID NO: 2236774 - protein, 18 aa, Cryptosporidium parvum
QICSRIGANIIATVGSIK

SEQ ID NO: 2236775 - protein, 25 aa, Cryptosporidium parvum
QIECTPCSRVFHIFRKKGVGYSSPP

SEQ ID NO: 2236776 - protein, 24 aa, Cryptosporidium parvum
QIEFPRLHLSFVRRERDRSNTLLT

SEQ ID NO: 2236777 - protein, 24 aa, Cryptosporidium parvum
QIEYMCLLNLLAFSFTMTNCTFFD

SEQ ID NO: 2236778 - protein, 25 aa, Cryptosporidium parvum
QIFGSILAILGIHFSKKRKLSFKSK

SEQ ID NO: 2236779 - protein, 26 aa, Cryptosporidium parvum
QIGLNRLGGFIGFMSLIVLVIIVIVA

SEQ ID NO: 2236780 - protein, 21 aa, Cryptosporidium parvum
QIGVCLILFTLGLEFSLKRVL

SEQ ID NO: 2236781 - protein, 20 aa, Cryptosporidium parvum
QIHCQYIFLCHGQIQNSSDR

SEQ ID NO: 2236782 - protein, 25 aa, Cryptosporidium parvum
QIIFEIADLPFIIIYSNIRKVKVFL

SEQ ID NO: 2236783 - protein, 24 aa, Cryptosporidium parvum
QIIKISSAVLVHFSFSIQVSEDDE

SEQ ID NO: 2236784 - protein, 24 aa, Cryptosporidium parvum
QIILKLSSTCIGFYSFLKDEENFK

SEQ ID NO: 2236785 - protein, 25 aa, Cryptosporidium parvum
QIINFLKKRVETYNIDYSKYYKTYK

SEQ ID NO: 2236786 - protein, 19 aa, Cryptosporidium parvum
QIIWLWDILENEFSTEEQG

SEQ ID NO: 2236787 - protein, 33 aa, Cryptosporidium parvum
QIKGGYYFQYDFVLRYIFLNSLKISTIAQFDSL

SEQ ID NO: 2236788 - protein, 19 aa, Cryptosporidium parvum
QIKTEVILQLLLSQTQIVA

SEQ ID NO: 2236789 - protein, 26 aa, Cryptosporidium parvum
QIKYSKEIIYSFEFPVIYQFQLILED

SEQ ID NO: 2236790 - protein, 21 aa, Cryptosporidium parvum
QILVYGCILLTSLIFITIYLF

SEQ ID NO: 2236791 - protein, 24 aa, Cryptosporidium parvum
QIMLLNCFIDFIQFRKLGPFSHLW

SEQ ID NO: 2236792 - protein, 17 aa, Cryptosporidium parvum
QINPGILSFSFKPMRFS

SEQ ID NO: 2236793 - protein, 17 aa, Cryptosporidium parvum
QIPKVWKSSPIWLHLKP

SEQ ID NO: 2236794 - protein, 21 aa, Cryptosporidium parvum
QIPMETLYNFISLRKSTHSTD

SEQ ID NO: 2236795 - protein, 31 aa, Cryptosporidium parvum; identical to SEQ ID NO: 2126799

SEQ ID NO: 2236796 - protein, 18 aa, Cryptosporidium parvum
QIQPRSPLMGGWQFDYIV

SEQ ID NO: 2236797 - protein, 24 aa, Cryptosporidium parvum
QIRFSGFTIQSGWLVSVSIDTLEL

SEQ ID NO: 2236798 - protein, 31 aa, Cryptosporidium parvum
QIRIMPNLNKRYIISSTLLKHLKEFSKSLED

SEQ ID NO: 2236799 - protein, 34 aa, Cryptosporidium parvum; identical to SEQ ID NO: 2126802

SEQ ID NO: 2236800 - protein, 22 aa, Cryptosporidium parvum
QISEALRFYSFLHLFNSGSEEN

SEQ ID NO: 2236801 - protein, 17 aa, Cryptosporidium parvum
QISFKIRNTELFIGPLS

SEQ ID NO: 2236802 - protein, 33 aa, Cryptosporidium parvum
QISIFPGEIPGAALLRKRVYRRLNNIEDIVNTF

SEQ ID NO: 2236803 - protein, 20 aa, Cryptosporidium parvum
QITEEEWVRFCVGIYDSRKK

SEQ ID NO: 2236804 - protein, 30 aa, Cryptosporidium parvum
QIWEPILEKCIFSVYYFYDHLILYDPYVKP

SEQ ID NO: 2236805 - protein, 23 aa, Cryptosporidium parvum
QIYEEIVCFVLLTCIAIIIYTFH

SEQ ID NO: 2236806 - protein, 19 aa, Cryptosporidium parvum
QIYFPSWSVAEFIKTLRDE

SEQ ID NO: 2236807 - protein, 23 aa, Cryptosporidium parvum
QKDLPFPVFMSWAQQLIGMAIMS

SEQ ID NO: 2236808 - protein, 25 aa, Cryptosporidium parvum
QKEPSSYWCAFPINMDEPYEWHFTI

SEQ ID NO: 2236809 - protein, 26 aa, Cryptosporidium parvum
QKHYFEFLDGILLKAIKEGHWLILDE

SEQ ID NO: 2236810 - protein, 18 aa, Cryptosporidium parvum
QKIFPFQLSPNISLVAPE

SEQ ID NO: 2236811 - protein, 22 aa, Cryptosporidium parvum
QKILRLISLIFSLFILGFIITS

SEQ ID NO: 2236812 - protein, 29 aa, Cryptosporidium parvum
QKITACPKFSIISGLLWKHNSVSWQSNES

SEQ ID NO: 2236813 - protein, 26 aa, Cryptosporidium parvum
QKKYGVECNFSFLKAQIQTFLKLYLE

SEQ ID NO: 2236814 - protein, 19 aa, Cryptosporidium parvum
QKLHCKSSREIAIGILSPF

SEQ ID NO: 2236815 - protein, 18 aa, Cryptosporidium parvum
QKLKAYPSRYEMLALITM

SEQ ID NO: 2236816 - protein, 18 aa, Cryptosporidium parvum
QKLLPLLRSIMVDRSYKI

SEQ ID NO: 2236817 - protein, 26 aa, Cryptosporidium parvum
QKMRGVCIYIKAKLPTAIEKFKNKSK

SEQ ID NO: 2236818 - protein, 23 aa, Cryptosporidium parvum
QKNICATISQAAYRIKNQRNWII

SEQ ID NO: 2236819 - protein, 20 aa, Cryptosporidium parvum
QKNQCLRNYLPNLIGPIKKV

SEQ ID NO: 2236820 - protein, 19 aa, Cryptosporidium parvum
QKNVFDFLLNYNINNDELK

SEQ ID NO: 2236821 - protein, 19 aa, Cryptosporidium parvum
QKREILSLPSSEFLVIREF

SEQ ID NO: 2236822 - protein, 19 aa, Cryptosporidium parvum
QKRIEIEESYIILLGKMIC

SEQ ID NO: 2236823 - protein, 19 aa, Cryptosporidium parvum
QKRRKLLRRFKKLDLENKK

SEQ ID NO: 2236824 - protein, 19 aa, Cryptosporidium parvum
QKSKIPLDFEISNSKYNND

SEQ ID NO: 2236825 - protein, 18 aa, Cryptosporidium parvum
QKSLCSYCDADIGVGKKV

SEQ ID NO: 2236826 - protein, 24 aa, Cryptosporidium parvum
QKSSIKFASLILGLSQYNTKILNI

SEQ ID NO: 2236827 - protein, 27 aa, Cryptosporidium parvum
QKTCIYRYGCFDQRIQVLNFEISPKIR

SEQ ID NO: 2236828 - protein, 22 aa, Cryptosporidium parvum
QKTFYYSYAIGIWRLIRTLFCG

SEQ ID NO: 2236829 - protein, 32 aa, Cryptosporidium parvum
QKTVSEWSRYIVKCILEGSSIRKEDYSHSFQI

SEQ ID NO: 2236830 - protein, 23 aa, Cryptosporidium parvum
QKYLGIEVYRIILIKEKKMPKTS

SEQ ID NO: 2236831 - protein, 26 aa, Cryptosporidium parvum
QLDFSINFWERFCNFLRKSTNKKFTL

SEQ ID NO: 2236832 - protein, 20 aa, Cryptosporidium parvum
QLEKCALLGLASPHPKIKLG

SEQ ID NO: 2236833 - protein, 17 aa, Cryptosporidium parvum
QLELRLISTYMYQSLSN

SEQ ID NO: 2236834 - protein, 25 aa, Cryptosporidium parvum
QLFILCFLSLIILFVIPLAFIIYYR

SEQ ID NO: 2236835 - protein, 24 aa, Cryptosporidium parvum
QLFIQIWRNLRLLYIEDNIYQGLD

SEQ ID NO: 2236836 - protein, 19 aa, Cryptosporidium parvum
QLFRLRWYGSNSGSKEKEI

SEQ ID NO: 2236837 - protein, 26 aa, Cryptosporidium parvum
QLFSRYRLGSNEFKILPTNNGKSDLG

SEQ ID NO: 2236838 - protein, 25 aa, Cryptosporidium parvum
QLFSYEYFTFMALFIYNFWRCSILV

SEQ ID NO: 2236839 - protein, 21 aa, Cryptosporidium parvum
QLGNWEFLEIIISDNKNNVEQ

SEQ ID NO: 2236840 - protein, 21 aa, Cryptosporidium parvum
QLIFHRIYFDLGTYSDHKLTQ

SEQ ID NO: 2236841 - protein, 18 aa, Cryptosporidium parvum
QLILPFFATSFYKNELAE

SEQ ID NO: 2236842 - protein, 18 aa, Cryptosporidium parvum
QLILTSWELLLKRISESE

SEQ ID NO: 2236843 - protein, 26 aa, Cryptosporidium parvum
QLIPELRTGPLFTYIAPLLLVLSITI

SEQ ID NO: 2236844 - protein, 18 aa, Cryptosporidium parvum
QLIRLSIPDWEPMKKLFN

SEQ ID NO: 2236845 - protein, 21 aa, Cryptosporidium parvum
QLKAVCVEAGMTALRRGATIL

SEQ ID NO: 2236846 - protein, 23 aa, Cryptosporidium parvum
QLKERKMNFSFLFNKKTLASSKL

SEQ ID NO: 2236847 - protein, 24 aa, Cryptosporidium parvum
QLKIDLITLLPIIFFLIQSIHFHI

SEQ ID NO: 2236848 - protein, 23 aa, Cryptosporidium parvum
QLKLLNCLIAFCKYLDISNNLAQ

SEQ ID NO: 2236849 - protein, 17 aa, Cryptosporidium parvum
QLNLDWQTYNLKCMPNL

SEQ ID NO: 2236850 - protein, 23 aa, Cryptosporidium parvum
QLPCLLESNIVNLCYDISWSKKT

SEQ ID NO: 2236851 - protein, 22 aa, Cryptosporidium parvum
QLRMKFLQLWNIYSNKNLIEKV

SEQ ID NO: 2236852 - protein, 17 aa, Cryptosporidium parvum
QLSLLFPKSLIDNISEK

SEQ ID NO: 2236853 - protein, 25 aa, Cryptosporidium parvum
QLSPKRPCWRIILLDDVIWNGVQSS

SEQ ID NO: 2236854 - protein, 22 aa, Cryptosporidium parvum
QLSSCKQFSEKIIFTVEDKDDA

SEQ ID NO: 2236855 - protein, 25 aa, Cryptosporidium parvum
QLSVGIKQLFCLTRAILRKSRILLL

SEQ ID NO: 2236856 - protein, 24 aa, Cryptosporidium parvum
QLTDRFFQMISFSFAEYLFEENYI

SEQ ID NO: 2236857 - protein, 25 aa, Cryptosporidium parvum
QLTLWEIMKQFYLINNLFFILKVLK

SEQ ID NO: 2236858 - protein, 27 aa, Cryptosporidium parvum
QMDSYFFQWFISLCENYQSIFLPLMGE

SEQ ID NO: 2236859 - protein, 24 aa, Cryptosporidium parvum
QMESLDWWWWLNIKDNFEGLLTQN

SEQ ID NO: 2236860 - protein, 20 aa, Cryptosporidium parvum
QMIILFKNLVSVLIAKDRKR

SEQ ID NO: 2236861 - protein, 21 aa, Cryptosporidium parvum
QMIMLRDGFRIIEISQCGVSL

SEQ ID NO: 2236862 - protein, 25 aa, Cryptosporidium parvum
QMRRSFFQFVISFCVVAVSLFGVSN

SEQ ID NO: 2236863 - protein, 24 aa, Cryptosporidium parvum
QNDILKLRWTNPLGEDVNDWESPG

SEQ ID NO: 2236864 - protein, 23 aa, Cryptosporidium parvum
QNELACLDEPFLPKSNNLSLYSY

SEQ ID NO: 2236865 - protein, 18 aa, Cryptosporidium parvum
QNFKRILSGNGIYKISGI

SEQ ID NO: 2236866 - protein, 18 aa, Cryptosporidium parvum
QNGLPLLVGNVMAASPCP

SEQ ID NO: 2236867 - protein, 19 aa, Cryptosporidium parvum
QNIDFCLKSGSSKALQRSL

SEQ ID NO: 2236868 - protein, 17 aa, Cryptosporidium parvum
QNIDGVMKSIPIFHQGS

SEQ ID NO: 2236869 - protein, 29 aa, Cryptosporidium parvum
QNIHEFVMFARFIRLFIRILEFNSSKKLQ

SEQ ID NO: 2236870 - protein, 25 aa, Cryptosporidium parvum
QNIPKEIFQLMIFIAQTCPYYYKYG

SEQ ID NO: 2236871 - protein, 22 aa, Cryptosporidium parvum
QNLFKVRWVIRGIYENNPWYSN

SEQ ID NO: 2236872 - protein, 20 aa, Cryptosporidium parvum
QNLIQIILIDGVYTLIHKLT

SEQ ID NO: 2236873 - protein, 22 aa, Cryptosporidium parvum
QNLLFKIVLEFDNILFNINFGI

SEQ ID NO: 2236874 - protein, 22 aa, Cryptosporidium parvum
QNLPVWLPLLVQGVTSCNILLR

SEQ ID NO: 2236875 - protein, 24 aa, Cryptosporidium parvum
QNLRWKKSDISIVIGVNLLISPQA

SEQ ID NO: 2236876 - protein, 24 aa, Cryptosporidium parvum
QNNSLPLLCLIPLGIVLHLVKFTS

SEQ ID NO: 2236877 - protein, 19 aa, Cryptosporidium parvum
QNSVSLCTPFHFLLEIFPV

SEQ ID NO: 2236878 - protein, 23 aa, Cryptosporidium parvum
QNTIYYKRCSSLFLNNQEIQDIL

SEQ ID NO: 2236879 - protein, 28 aa, Cryptosporidium parvum
QNVHRFKKSQGIFMIIRYYLNMNQDSQS

SEQ ID NO: 2236880 - protein, 25 aa, Cryptosporidium parvum
QNYHHFEWIPTYQIPYNFANLEIFK

SEQ ID NO: 2236881 - protein, 19 aa, Cryptosporidium parvum
QNYLKRRLIVQRSHQSYFL

SEQ ID NO: 2236882 - protein, 23 aa, Cryptosporidium parvum
QPCIPLHPRCRIIEDTGNKKSFT

SEQ ID NO: 2236883 - protein, 20 aa, Cryptosporidium parvum
QPFNSLPIFHKLVTNNIKFN

SEQ ID NO: 2236884 - protein, 19 aa, Cryptosporidium parvum
QPIVFCLFSDLKNQILYGK

SEQ ID NO: 2236885 - protein, 23 aa, Cryptosporidium parvum
QPLKRLVSFLKYEYVFDHDLETL

SEQ ID NO: 2236886 - protein, 19 aa, Cryptosporidium parvum
QPNIINHFFLKRDHYNTSS

SEQ ID NO: 2236887 - protein, 25 aa, Cryptosporidium parvum
QPNYRFPSALDRLAPLLTEDFLGQP

SEQ ID NO: 2236888 - protein, 28 aa, Cryptosporidium parvum
QPQGGPRTHLMMLIFFGGNILRGLFTNS

SEQ ID NO: 2236889 - protein, 18 aa, Cryptosporidium parvum
QPQNIPWWIYLLIIILGF

SEQ ID NO: 2236890 - protein, 25 aa, Cryptosporidium parvum
QPSPNEFLQYFSIAAGINSLIFSLS

SEQ ID NO: 2236891 - protein, 20 aa, Cryptosporidium parvum
QPYGFSFRRRFMDLMFKGTS

SEQ ID NO: 2236892 - protein, 28 aa, Cryptosporidium parvum
QPYQGGWKFGILVIQSFLIIVIDSIIRL

SEQ ID NO: 2236893 - protein, 23 aa, Cryptosporidium parvum
QQAAYSYFRLWSIWLTSSFCILI

SEQ ID NO: 2236894 - protein, 30 aa, Cryptosporidium parvum
QQIPSWWVVFWPCWFWCGVIFSFSTVFCVL

SEQ ID NO: 2236895 - protein, 17 aa, Cryptosporidium parvum
QQISTICIFGCGIVILG

SEQ ID NO: 2236896 - protein, 32 aa, Cryptosporidium parvum; identical to SEQ ID NO: 2126854

SEQ ID NO: 2236897 - protein, 17 aa, Cryptosporidium parvum
QQLTFIFNVIAENILNR

SEQ ID NO: 2236898 - protein, 18 aa, Cryptosporidium parvum
QQMRGCYNSNIVQNSHSN

SEQ ID NO: 2236899 - protein, 20 aa, Cryptosporidium parvum
QQQTCPICRAPITIRDEEPE

SEQ ID NO: 2236900 - protein, 26 aa, Cryptosporidium parvum
QRFARIRHPGIINVSFLWPAVDCEPS

SEQ ID NO: 2236901 - protein, 21 aa, Cryptosporidium parvum
QRITIIDTWSRLNCGALKIAS

SEQ ID NO: 2236902 - protein, 31 aa, Cryptosporidium parvum
QRKLLIDSFFGYWIFEFLERVLNLLENVVKP

SEQ ID NO: 2236903 - protein, 23 aa, Cryptosporidium parvum
QRKTYIIKAICSLLNSFDFQINE

SEQ ID NO: 2236904 - protein, 22 aa, Cryptosporidium parvum
QRLADLPLLISTIVEGNNSKIR

SEQ ID NO: 2236905 - protein, 17 aa, Cryptosporidium parvum
QRLVCKFISSFNKIVYD

SEQ ID NO: 2236906 - protein, 31 aa, Cryptosporidium parvum; identical to SEQ ID NO: 2179866

SEQ ID NO: 2236907 - protein, 26 aa, Cryptosporidium parvum
QRYPKPWYKVLKKIYDGFNYVYRSFI

SEQ ID NO: 2236908 - protein, 23 aa, Cryptosporidium parvum
QSCKFLQRRVELGIFVYFTGNLW

SEQ ID NO: 2236909 - protein, 23 aa, Cryptosporidium parvum
QSFRTDMWLSPIGMEHEKKTDHV

SEQ ID NO: 2236910 - protein, 23 aa, Cryptosporidium parvum
QSFRVWLCGGEIHVVRNSLVGHI

SEQ ID NO: 2236911 - protein, 22 aa, Cryptosporidium parvum
QSFSRPCLNFFESILNCLGNSS

SEQ ID NO: 2236912 - protein, 21 aa, Cryptosporidium parvum
QSFSYARSRAEAVENVQRMIG

SEQ ID NO: 2236913 - protein, 27 aa, Cryptosporidium parvum
QSFTDPIIFPWINDWIFPEISQDDDSE

SEQ ID NO: 2236914 - protein, 17 aa, Cryptosporidium parvum
QSIDLYTTMSILGYSLL

SEQ ID NO: 2236915 - protein, 25 aa, Cryptosporidium parvum
QSIESLKWVFSMLFFTSIGLVIDAT

SEQ ID NO: 2236916 - protein, 18 aa, Cryptosporidium parvum
QSIIKYLFFFIQIISLIY

SEQ ID NO: 2236917 - protein, 25 aa, Cryptosporidium parvum
QSIRQRLKIILSILSKDISKDYKSL

SEQ ID NO: 2236918 - protein, 17 aa, Cryptosporidium parvum
QSIRWIIHRICSDTDDG

SEQ ID NO: 2236919 - protein, 20 aa, Cryptosporidium parvum
QSKSYKVIVQYCIKNEDGKT

SEQ ID NO: 2236920 - protein, 22 aa, Cryptosporidium parvum
QSLILGEFMIIYLIIIAIEVSK

SEQ ID NO: 2236921 - protein, 33 aa, Cryptosporidium parvum
QSLLKLRQRIIFFSLNILPRWISTRKIPGLLFN

SEQ ID NO: 2236922 - protein, 26 aa, Cryptosporidium parvum
QSLLRKKLRLLIYIEDFYNEIKPKSQ

SEQ ID NO: 2236923 - protein, 17 aa, Cryptosporidium parvum
QSLRIFITIMKIPNLSG

SEQ ID NO: 2236924 - protein, 26 aa, Cryptosporidium parvum
QSLSLKPLLCYPIWGRDKEDSTSLLF

SEQ ID NO: 2236925 - protein, 23 aa, Cryptosporidium parvum
QSNPPALALRWLMNLYSLTNSYV

SEQ ID NO: 2236926 - protein, 19 aa, Cryptosporidium parvum
QSSDLKDVCSFSFHETLMI

SEQ ID NO: 2236927 - protein, 18 aa, Cryptosporidium parvum
QSTMGGRYGGTGILMSTS

SEQ ID NO: 2236928 - protein, 30 aa, Cryptosporidium parvum
QSTYQSICYIWLWDLFVEYFGGSEQIVTAI

SEQ ID NO: 2236929 - protein, 25 aa, Cryptosporidium parvum
QSVVKLDPFLICHCPNKSNLSRINS

SEQ ID NO: 2236930 - protein, 18 aa, Cryptosporidium parvum
QSYTLKRIGFITSSGSTI

SEQ ID NO: 2236931 - protein, 27 aa, Cryptosporidium parvum
QSYVVLPGRCAYGASKRACLSFFQALR

SEQ ID NO: 2236932 - protein, 24 aa, Cryptosporidium parvum
QTAAWACKHLALGVAGTGCNDALI

SEQ ID NO: 2236933 - protein, 17 aa, Cryptosporidium parvum
QTAYVSYLYYLGFSYMM

SEQ ID NO: 2236934 - protein, 23 aa, Cryptosporidium parvum
QTCPYYYKYGVCNKFIEKLLDEL

SEQ ID NO: 2236935 - protein, 24 aa, Cryptosporidium parvum
QTENLFFRAIEYLDKFTNTFQSIL

SEQ ID NO: 2236936 - protein, 24 aa, Cryptosporidium parvum
QTLFRCIHGILQIVNLCNLFSKFR

SEQ ID NO: 2236937 - protein, 18 aa, Cryptosporidium parvum
QTLFRLKSDIVFHSLQCY

SEQ ID NO: 2236938 - protein, 23 aa, Cryptosporidium parvum
QTLQKLASVLFFHLVNKSFIQDQ

SEQ ID NO: 2236939 - protein, 25 aa, Cryptosporidium parvum
QTLRYLIPKIKGYRSSSDIPVENET

SEQ ID NO: 2236940 - protein, 18 aa, Cryptosporidium parvum
QTLSDLLLCYSKSTNYKG

SEQ ID NO: 2236941 - protein, 17 aa, Cryptosporidium parvum
QTNTGVLDFELCELHEP

SEQ ID NO: 2236942 - protein, 17 aa, Cryptosporidium parvum
QTTVWGRNVILALVGII

SEQ ID NO: 2236943 - protein, 19 aa, Cryptosporidium parvum
QVDLSIWNNWISKFFIDRY

SEQ ID NO: 2236944 - protein, 17 aa, Cryptosporidium parvum
QVFPQLLNYTSFFFNSA

SEQ ID NO: 2236945 - protein, 18 aa, Cryptosporidium parvum
QVFQRKSSIALYINHTNK

SEQ ID NO: 2236946 - protein, 27 aa, Cryptosporidium parvum
QVIKRQKYSPIWWLYVSNIDILRRKFN

SEQ ID NO: 2236947 - protein, 26 aa, Cryptosporidium parvum
QVKKAGKFQLCLLQFYQDPNISGGEG

SEQ ID NO: 2236948 - protein, 25 aa, Cryptosporidium parvum
QVKWTWSNVICDFFCGLAEAALSIP

SEQ ID NO: 2236949 - protein, 19 aa, Cryptosporidium parvum
QVLDCFHPKGGFSSFGDLE

SEQ ID NO: 2236950 - protein, 24 aa, Cryptosporidium parvum
QVLNARRGLVRMIIDIILGKDTTK

SEQ ID NO: 2236951 - protein, 17 aa, Cryptosporidium parvum
QVLPAYRLSRAIDTLFP

SEQ ID NO: 2236952 - protein, 20 aa, Cryptosporidium parvum
QVLTLVCPISLLISSLYYLL

SEQ ID NO: 2236953 - protein, 23 aa, Cryptosporidium parvum
QVTESRILLYQGISEQVKAFENQ

SEQ ID NO: 2236954 - protein, 26 aa, Cryptosporidium parvum
QVVHPFCCKLLLRQRKDLFNASKMPI

SEQ ID NO: 2236955 - protein, 23 aa, Cryptosporidium parvum
QVYKILKGCAGFVPRQYIDSRVT

SEQ ID NO: 2236956 - protein, 27 aa, Cryptosporidium parvum
QWDDAVVIFRRIIRLFPSTNLSITSAT

SEQ ID NO: 2236957 - protein, 19 aa, Cryptosporidium parvum
QWGELSMLLDRSFWVQYLR

SEQ ID NO: 2236958 - protein, 23 aa, Cryptosporidium parvum
QWPSFGLLLRWNQRQKRRDNEKL

SEQ ID NO: 2236959 - protein, 18 aa, Cryptosporidium parvum
QYCHGWTQFGFVTWMPIY

SEQ ID NO: 2236960 - protein, 22 aa, Cryptosporidium parvum
QYCSTMKLPLNGVGKKNPVLQS

SEQ ID NO: 2236961 - protein, 18 aa, Cryptosporidium parvum
QYEQLSFMLEFRKVVEEL

SEQ ID NO: 2236962 - protein, 25 aa, Cryptosporidium parvum
QYFLSCFLFYPNIIHCMVRIILSLN

SEQ ID NO: 2236963 - protein, 19 aa, Cryptosporidium parvum
QYFWTELLGLCALSNEFPD

SEQ ID NO: 2236964 - protein, 21 aa, Cryptosporidium parvum
QYILRIESLNSFSSYEEHEIL

SEQ ID NO: 2236965 - protein, 27 aa, Cryptosporidium parvum
QYKELLPRIACLIILRKLVRSEQISYD

SEQ ID NO: 2236966 - protein, 18 aa, Cryptosporidium parvum
QYLIVIGSNFVKNEDDLE

SEQ ID NO: 2236967 - protein, 23 aa, Cryptosporidium parvum
QYLKSILYYTSRREIRRRLINHL

SEQ ID NO: 2236968 - protein, 17 aa, Cryptosporidium parvum
QYLRYAFAAPPEYLYPV

SEQ ID NO: 2236969 - protein, 23 aa, Cryptosporidium parvum
QYMEKWYSLYGVIIKEGDASGSN

SEQ ID NO: 2236970 - protein, 22 aa, Cryptosporidium parvum
QYNLNVCIFKGQDIAPIVGMYN

SEQ ID NO: 2236971 - protein, 18 aa, Cryptosporidium parvum
QYSESIINIFGLLLGTTF

SEQ ID NO: 2236972 - protein, 20 aa, Cryptosporidium parvum
QYSSVFIRRAVPISLAALSI

SEQ ID NO: 2236973 - protein, 26 aa, Cryptosporidium parvum
QYTLCLSPYALLCLWHPHSKSCSMYY

SEQ ID NO: 2236974 - protein, 17 aa, Cryptosporidium parvum
RACLSFFQALRKELNYT

SEQ ID NO: 2236975 - protein, 22 aa, Cryptosporidium parvum
RADQLTTLKLCLSRLTFNLYRL

SEQ ID NO: 2236976 - protein, 26 aa, Cryptosporidium parvum
RAEISRLEKILLFEVFSIGDEIRDNK

SEQ ID NO: 2236977 - protein, 18 aa, Cryptosporidium parvum
RAERRGWRSSKWRSTKFS

SEQ ID NO: 2236978 - protein, 26 aa, Cryptosporidium parvum
RAFQEAMSFLQLESMADIKLDFNKNT

SEQ ID NO: 2236979 - protein, 20 aa, Cryptosporidium parvum
RAGISGLISLVFQIISEEKV

SEQ ID NO: 2236980 - protein, 25 aa, Cryptosporidium parvum
RAKHSVKMGLNLAREYCEKNNLSWG

SEQ ID NO: 2236981 - protein, 26 aa, Cryptosporidium parvum
RALWKCLYGQFIMLIILKVSWEACLY

SEQ ID NO: 2236982 - protein, 21 aa, Cryptosporidium parvum
RAMNYGHWAWFNITGRTTGHL

SEQ ID NO: 2236983 - protein, 24 aa, Cryptosporidium parvum
RANIQSSINICWLSIISTCILSLI

SEQ ID NO: 2236984 - protein, 24 aa, Cryptosporidium parvum
RAPFGSLYPIHLVKEGTTDFTNFF

SEQ ID NO: 2236985 - protein, 18 aa, Cryptosporidium parvum
RAPHRGGCGQDKDNYSEL

SEQ ID NO: 2236986 - protein, 25 aa, Cryptosporidium parvum
RARSTVFCFFNYIFTDLSRAHDIVI

SEQ ID NO: 2236987 - protein, 23 aa, Cryptosporidium parvum
RASKYFPYKNIESSFSYQFEDCS

SEQ ID NO: 2236988 - protein, 25 aa, Cryptosporidium parvum
RAVNDGRILSSFFAALAYNYMTMSW

SEQ ID NO: 2236989 - protein, 20 aa, Cryptosporidium parvum
RCEKCGIQMKYGIYSKLDIN

SEQ ID NO: 2236990 - protein, 21 aa, Cryptosporidium parvum
RCITCGTSTSSCICVDCFQNG

SEQ ID NO: 2236991 - protein, 21 aa, Cryptosporidium parvum
RCIVALEPLIFVASKTLSDHR

SEQ ID NO: 2236992 - protein, 18 aa, Cryptosporidium parvum
RCKLSMIRQELMKIEDVK

SEQ ID NO: 2236993 - protein, 26 aa, Cryptosporidium parvum
RCKQFKSRIGMIKGLLIQTLKIQDQV

SEQ ID NO: 2236994 - protein, 26 aa, Cryptosporidium parvum
RCTLKEYYLLFDFVIFLFYIINAYKS

SEQ ID NO: 2236995 - protein, 25 aa, Cryptosporidium parvum
RCVIMSCIFLCILLFNTVDKYTNFG

SEQ ID NO: 2236996 - protein, 19 aa, Cryptosporidium parvum
RCYKVGNNIVNYVSSIINL

SEQ ID NO: 2236997 - protein, 17 aa, Cryptosporidium parvum
RDAVLIQTYLETCINCL

SEQ ID NO: 2236998 - protein, 24 aa, Cryptosporidium parvum
RDDTRTVIFLTRLLSRSNTINSIQ

SEQ ID NO: 2236999 - protein, 19 aa, Cryptosporidium parvum
RDEALKCGTKYSFPIITGL

SEQ ID NO: 2237000 - protein, 24 aa, Cryptosporidium parvum
RDERFRLLLDVIVLRSNFPCRFSP

SEQ ID NO: 2237001 - protein, 22 aa, Cryptosporidium parvum
RDFRECFEEFNIDNNVLSILIE

SEQ ID NO: 2237002 - protein, 20 aa, Cryptosporidium parvum
RDHYFPGLMTHIPKVSMHSG

SEQ ID NO: 2237003 - protein, 25 aa, Cryptosporidium parvum
RDIAMSLCDLVLICIDPSGQALSKR

SEQ ID NO: 2237004 - protein, 18 aa, Cryptosporidium parvum
RDIGRFINISSFLSRIGY

SEQ ID NO: 2237005 - protein, 23 aa, Cryptosporidium parvum
RDIKNLVFKTASLVKLFQYKMIT

SEQ ID NO: 2237006 - protein, 19 aa, Cryptosporidium parvum
RDIKSLTVLNEYIVTRRLF

SEQ ID NO: 2237007 - protein, 22 aa, Cryptosporidium parvum
RDILSFHSCLIFGLVRLLWNIV

SEQ ID NO: 2237008 - protein, 19 aa, Cryptosporidium parvum
RDIPFSIIQFSLWEKLNRT

SEQ ID NO: 2237009 - protein, 17 aa, Cryptosporidium parvum
RDIPNRFPKLVTPSVGR

SEQ ID NO: 2237010 - protein, 21 aa, Cryptosporidium parvum
RDISLELQLNGSIARVLIGHL

SEQ ID NO: 2237011 - protein, 18 aa, Cryptosporidium parvum
RDKFFRKKVVPILKSVNF

SEQ ID NO: 2237012 - protein, 20 aa, Cryptosporidium parvum
RDKLSIPFFPLEFINLVKNV

SEQ ID NO: 2237013 - protein, 23 aa, Cryptosporidium parvum
RDKSIHGSGTWEYSVQAVQAAMS

SEQ ID NO: 2237014 - protein, 29 aa, Cryptosporidium parvum
RDLFEIREMVFWFSPFMQISMPLSSDLEE

SEQ ID NO: 2237015 - protein, 20 aa, Cryptosporidium parvum
RDLFELLSKIFISKLKNKKI

SEQ ID NO: 2237016 - protein, 19 aa, Cryptosporidium parvum
RDLLKTGLFVDGTWDDHDY

SEQ ID NO: 2237017 - protein, 23 aa, Cryptosporidium parvum
RDLSELFRFGKTPKVSIQELFGF

SEQ ID NO: 2237018 - protein, 17 aa, Cryptosporidium parvum
RDPNEMSRFPTITLGFP

SEQ ID NO: 2237019 - protein, 19 aa, Cryptosporidium parvum
RDRIFPYLLTIIVFSASIE

SEQ ID NO: 2237020 - protein, 19 aa, Cryptosporidium parvum
RDTCAMAREPMKICQEPYK

SEQ ID NO: 2237021 - protein, 20 aa, Cryptosporidium parvum
RDYQKCMIPGLKRINPIFVD

SEQ ID NO: 2237022 - protein, 20 aa, Cryptosporidium parvum
REAAKFPITESRSFINHGEK

SEQ ID NO: 2237023 - protein, 33 aa, Cryptosporidium parvum
REALYKKTLKLAFKILRICMINTNILQEVKSNL

SEQ ID NO: 2237024 - protein, 24 aa, Cryptosporidium parvum
REDIRLGWNSSVFVEGVNKIMKIQ

SEQ ID NO: 2237025 - protein, 29 aa, Cryptosporidium parvum
REEPFMQLFCGLFFQLSYFITFAQILSDK

SEQ ID NO: 2237026 - protein, 25 aa, Cryptosporidium parvum
REFPGFSTPMLKDFDPNASRHHVAP

SEQ ID NO: 2237027 - protein, 23 aa, Cryptosporidium parvum
REHIPRLNGDYIINHKLFPTICT

SEQ ID NO: 2237028 - protein, 24 aa, Cryptosporidium parvum
REIASCIIFGISIFTFIAVSLGFV

SEQ ID NO: 2237029 - protein, 17 aa, Cryptosporidium parvum
REIEGGADSERYAVTML

SEQ ID NO: 2237030 - protein, 21 aa, Cryptosporidium parvum
REIEIWKGKSYPKVKQSGDIL

SEQ ID NO: 2237031 - protein, 21 aa, Cryptosporidium parvum
REILCSNLLDIIKMRMMQISV

SEQ ID NO: 2237032 - protein, 19 aa, Cryptosporidium parvum
REILGFASILLCKVSGIFM

SEQ ID NO: 2237033 - protein, 17 aa, Cryptosporidium parvum
REIPISVIHEITIYDIF

SEQ ID NO: 2237034 - protein, 19 aa, Cryptosporidium parvum
RELDKFFEIEESFDNIPTV

SEQ ID NO: 2237035 - protein, 17 aa, Cryptosporidium parvum
RELEEYNSFLLDYALFL

SEQ ID NO: 2237036 - protein, 18 aa, Cryptosporidium parvum
RELHIFCLSTHILKKDVE

SEQ ID NO: 2237037 - protein, 20 aa, Cryptosporidium parvum
RELILIRFFTTFKVDKSNDM

SEQ ID NO: 2237038 - protein, 24 aa, Cryptosporidium parvum
RELIPNGDAKLILRLSSDARSIAD

SEQ ID NO: 2237039 - protein, 31 aa, Cryptosporidium parvum
RELLCKYELIFRLVFHLKYINYLLNNIWILH

SEQ ID NO: 2237040 - protein, 17 aa, Cryptosporidium parvum
RENFALPFIWINNMILI

SEQ ID NO: 2237041 - protein, 18 aa, Cryptosporidium parvum
RENLPITLIFTIYGYSSL

SEQ ID NO: 2237042 - protein, 18 aa, Cryptosporidium parvum
REPKEFFANSGTGTKNFF

SEQ ID NO: 2237043 - protein, 24 aa, Cryptosporidium parvum
RERIIPIARLYKISDLMRSLDIFI

SEQ ID NO: 2237044 - protein, 17 aa, Cryptosporidium parvum
RESHSGEGHWLFENPIR

SEQ ID NO: 2237045 - protein, 18 aa, Cryptosporidium parvum
RETNYLGSLVCYVSGGYG

SEQ ID NO: 2237046 - protein, 23 aa, Cryptosporidium parvum
REYRKRIIFSLLSLGVAKLATIQ

SEQ ID NO: 2237047 - protein, 19 aa, Cryptosporidium parvum
REYRPCYTHRFASGCQALA

SEQ ID NO: 2237048 - protein, 26 aa, Cryptosporidium parvum
RFCIYRPLIKTLWRPTLEALLLRLCF

SEQ ID NO: 2237049 - protein, 19 aa, Cryptosporidium parvum
RFDFKCAELLTLENLVYFA

SEQ ID NO: 2237050 - protein, 20 aa, Cryptosporidium parvum
RFDHHCVWIDSCVGYGNQRA

SEQ ID NO: 2237051 - protein, 17 aa, Cryptosporidium parvum
RFDVVLCQWVRVRYAIM

SEQ ID NO: 2237052 - protein, 23 aa, Cryptosporidium parvum
RFELKILFQKILRDIVKEDTIIP

SEQ ID NO: 2237053 - protein, 25 aa, Cryptosporidium parvum
RFFMVYSRFVFRHSMAVIIAVTLIC

SEQ ID NO: 2237054 - protein, 24 aa, Cryptosporidium parvum
RFFRRIHYQLGRAFVCRNKLLYLV

SEQ ID NO: 2237055 - protein, 20 aa, Cryptosporidium parvum
RFGFEKSKMISSLFIKSISI

SEQ ID NO: 2237056 - protein, 21 aa, Cryptosporidium parvum
RFGSLLAKYKMNFLIPIIKRV

SEQ ID NO: 2237057 - protein, 29 aa, Cryptosporidium parvum
RFILEIDKLDILFFVNCEYMESFFKYFYQ

SEQ ID NO: 2237058 - protein, 17 aa, Cryptosporidium parvum
RFISFPQFLSAIINMSQ

SEQ ID NO: 2237059 - protein, 24 aa, Cryptosporidium parvum
RFKADMKDPLIIGGEIRTISSRDF

SEQ ID NO: 2237060 - protein, 18 aa, Cryptosporidium parvum
RFLELFALAIDRQEENPI

SEQ ID NO: 2237061 - protein, 21 aa, Cryptosporidium parvum
RFLFIDIWIGLLLFQIFLRIS

SEQ ID NO: 2237062 - protein, 20 aa, Cryptosporidium parvum
RFLLEAVDSQTQFGILSNMD

SEQ ID NO: 2237063 - protein, 20 aa, Cryptosporidium parvum
RFLTFSYRRSFLPLFLVFVF

SEQ ID NO: 2237064 - protein, 18 aa, Cryptosporidium parvum
RFNKGLKHYLAGNWYVSK

SEQ ID NO: 2237065 - protein, 17 aa, Cryptosporidium parvum
RFNKPRNQITIAIDGSV

SEQ ID NO: 2237066 - protein, 18 aa, Cryptosporidium parvum
RFNWHTCRNGLGGQEYDH

SEQ ID NO: 2237067 - protein, 23 aa, Cryptosporidium parvum
RFNYIYCFIHYLLHILSRIGMSH

SEQ ID NO: 2237068 - protein, 20 aa, Cryptosporidium parvum
RFSDKLQLIKSIKISTNSTD

SEQ ID NO: 2237069 - protein, 18 aa, Cryptosporidium parvum
RFSHHLGYSHLPSDVNKE

SEQ ID NO: 2237070 - protein, 18 aa, Cryptosporidium parvum
RFSQEFPPETFKPIQELG

SEQ ID NO: 2237071 - protein, 22 aa, Cryptosporidium parvum
RFTQLKTLSARTYNVFSQFTSD

SEQ ID NO: 2237072 - protein, 21 aa, Cryptosporidium parvum
RFYKKHFRKSNSLPIFSNYHI

SEQ ID NO: 2237073 - protein, 20 aa, Cryptosporidium parvum
RGDCRIIFSNSWLPYVNHSK

SEQ ID NO: 2237074 - protein, 22 aa, Cryptosporidium parvum
RGDDWFMLSIRVFCAIFLAGAI

SEQ ID NO: 2237075 - protein, 19 aa, Cryptosporidium parvum
RGFDKKVIFSLLLPEIKAY

SEQ ID NO: 2237076 - protein, 17 aa, Cryptosporidium parvum
RGFGCFGLNTAYTVKKN

SEQ ID NO: 2237077 - protein, 19 aa, Cryptosporidium parvum
RGFKALFIEIKRGVTDDDL

SEQ ID NO: 2237078 - protein, 17 aa, Cryptosporidium parvum
RGGPRCSRAPHPRLQTI

SEQ ID NO: 2237079 - protein, 18 aa, Cryptosporidium parvum
RGGRYIRRVGVTRTAHVT

SEQ ID NO: 2237080 - protein, 20 aa, Cryptosporidium parvum
RGICAELNESIPILKILSRR

SEQ ID NO: 2237081 - protein, 31 aa, Cryptosporidium parvum
RGILLSLIAFEWIKRNTLLFSEIKLVDKLKF

SEQ ID NO: 2237082 - protein, 21 aa, Cryptosporidium parvum
RGIRLLKPRLRQLTISERKLL

SEQ ID NO: 2237083 - protein, 23 aa, Cryptosporidium parvum
RGLFRTALEYCLLLISMDIAHDR

SEQ ID NO: 2237084 - protein, 20 aa, Cryptosporidium parvum
RGLMRGDLLLWRKSFEKSSS

SEQ ID NO: 2237085 - protein, 25 aa, Cryptosporidium parvum
RGLQRTSESPFVISGGSSGENQLPE

SEQ ID NO: 2237086 - protein, 26 aa, Cryptosporidium parvum
RGQGLLKLYFIFNMLEIFEKLFRSFG

SEQ ID NO: 2237087 - protein, 18 aa, Cryptosporidium parvum
RGQLKALIALHRRTGEFD

SEQ ID NO: 2237088 - protein, 23 aa, Cryptosporidium parvum
RGRSTRYSYKRMKYDVDDGFYKI

SEQ ID NO: 2237089 - protein, 22 aa, Cryptosporidium parvum
RGSMILPFSNLIVIGKLIVGKN

SEQ ID NO: 2237090 - protein, 17 aa, Cryptosporidium parvum
RGTLFRILFGKILCEIL

SEQ ID NO: 2237091 - protein, 20 aa, Cryptosporidium parvum
RGTYYAIKFLRLGIGANDDI

SEQ ID NO: 2237092 - protein, 24 aa, Cryptosporidium parvum
RGYPVCELKCIIRDLQNRVQWTRK

SEQ ID NO: 2237093 - protein, 18 aa, Cryptosporidium parvum
RHARLLLSTLEEFSYSSS

SEQ ID NO: 2237094 - protein, 23 aa, Cryptosporidium parvum
RHGPEALKIYSIVISTMPFLLII

SEQ ID NO: 2237095 - protein, 18 aa, Cryptosporidium parvum
RHIFHLECIDGWFKQNCV

SEQ ID NO: 2237096 - protein, 20 aa, Cryptosporidium parvum
RHLESYYKSSAEWSNYEKRQ

SEQ ID NO: 2237097 - protein, 25 aa, Cryptosporidium parvum
RHLQKRGIRCFAWVCNNEKEMNICK

SEQ ID NO: 2237098 - protein, 27 aa, Cryptosporidium parvum
RHSWGKRFIGLCTCIYDRINGRNKNNE

SEQ ID NO: 2237099 - protein, 18 aa, Cryptosporidium parvum
RHTYRYTPLLAYIASINI

SEQ ID NO: 2237100 - protein, 22 aa, Cryptosporidium parvum
RHYSRHFCVKNSKGQSCGPLLF

SEQ ID NO: 2237101 - protein, 24 aa, Cryptosporidium parvum
RHYYSKSGYWEMNFSSNKKDTIDE

SEQ ID NO: 2237102 - protein, 20 aa, Cryptosporidium parvum
RIAPELYLKQLIVGGLDKVY

SEQ ID NO: 2237103 - protein, 21 aa, Cryptosporidium parvum
RICEITTDIISYIWKNQYFNT

SEQ ID NO: 2237104 - protein, 25 aa, Cryptosporidium parvum
RIFIFPIKIASTFAIAIKTFDDHSM

SEQ ID NO: 2237105 - protein, 18 aa, Cryptosporidium parvum
RIFPKVIVQALNFTNSYG

SEQ ID NO: 2237106 - protein, 18 aa, Cryptosporidium parvum
RIFRSSSQKNEWQVMGKN

SEQ ID NO: 2237107 - protein, 26 aa, Cryptosporidium parvum
RIFSGQNLYIAMGILATVSIIVIVLM

SEQ ID NO: 2237108 - protein, 19 aa, Cryptosporidium parvum
RIFTRIAMDPIKNKRVITD

SEQ ID NO: 2237109 - protein, 19 aa, Cryptosporidium parvum
RIFVVGVIEYCKFQESLKG

SEQ ID NO: 2237110 - protein, 26 aa, Cryptosporidium parvum
RIGDLPVLMKLVGFEHLWKKRVVYLL

SEQ ID NO: 2237111 - protein, 19 aa, Cryptosporidium parvum
RIGEDISLFSSHLLLLICR

SEQ ID NO: 2237112 - protein, 22 aa, Cryptosporidium parvum
RIHEKRYWTHLIFIHADNNLES

SEQ ID NO: 2237113 - protein, 19 aa, Cryptosporidium parvum
RIHRLRIAQFGPLEEPEVK

SEQ ID NO: 2237114 - protein, 19 aa, Cryptosporidium parvum
RIIDDFGQTLGIDYRNDPD

SEQ ID NO: 2237115 - protein, 25 aa, Cryptosporidium parvum
RIIEEVCNFIKIILAKITIDSIFEE

SEQ ID NO: 2237116 - protein, 20 aa, Cryptosporidium parvum
RIISFSALSYLFFKLAISGS

SEQ ID NO: 2237117 - protein, 19 aa, Cryptosporidium parvum
RIITSFTRLFSKNNSKAKS

SEQ ID NO: 2237118 - protein, 27 aa, Cryptosporidium parvum
RIKHNVCITCSLLSLRSMEFLISILII

SEQ ID NO: 2237119 - protein, 17 aa, Cryptosporidium parvum
RIKIGIGSSSCFQKIDN

SEQ ID NO: 2237120 - protein, 19 aa, Cryptosporidium parvum
RIKKSFKTRVEDFKQGRQS

SEQ ID NO: 2237121 - protein, 19 aa, Cryptosporidium parvum
RIKLPVSTILSCFLILAGV

SEQ ID NO: 2237122 - protein, 18 aa, Cryptosporidium parvum
RIKLRDIKSLTVLNEYIV

SEQ ID NO: 2237123 - protein, 24 aa, Cryptosporidium parvum
RIKVLHNLFFRFYHYDSKANQEEL

SEQ ID NO: 2237124 - protein, 20 aa, Cryptosporidium parvum
RILGKLGGKNRWFLKDSAVL

SEQ ID NO: 2237125 - protein, 25 aa, Cryptosporidium parvum
RILGLRAPFYRLAMNTTTFPEDSQT

SEQ ID NO: 2237126 - protein, 18 aa, Cryptosporidium parvum
RILKEMNGNFFLENHERG

SEQ ID NO: 2237127 - protein, 25 aa, Cryptosporidium parvum
RILKGERSFPYYYVYEPLPYLESIQ

SEQ ID NO: 2237128 - protein, 25 aa, Cryptosporidium parvum
RILLTFFILRIIIRLFVTPIIKTLS

SEQ ID NO: 2237129 - protein, 24 aa, Cryptosporidium parvum
RILNFELPLWITRFAHSFQSGLLS

SEQ ID NO: 2237130 - protein, 19 aa, Cryptosporidium parvum
RILSGNGIYKISGIICLPL

SEQ ID NO: 2237131 - protein, 17 aa, Cryptosporidium parvum
RIMCFDKTGTLTNDHLD

SEQ ID NO: 2237132 - protein, 24 aa, Cryptosporidium parvum
RINTELWSIIKLEKEVFVSKLRSV

SEQ ID NO: 2237133 - protein, 20 aa, Cryptosporidium parvum
RIPYIPKNWDCEFIGIRPFN

SEQ ID NO: 2237134 - protein, 22 aa, Cryptosporidium parvum
RIQTFLFSRIYDYPILKDREFV

SEQ ID NO: 2237135 - protein, 36 aa, Cryptosporidium parvum; identical to SEQ ID NO: 2127022

SEQ ID NO: 2237136 - protein, 25 aa, Cryptosporidium parvum
RISELKRQNCILIFSKLNGVFLTVI

SEQ ID NO: 2237137 - protein, 19 aa, Cryptosporidium parvum
RISFDKVNSILSYFLRLLK

SEQ ID NO: 2237138 - protein, 19 aa, Cryptosporidium parvum
RISFNKTFQVTGRNHGNMA

SEQ ID NO: 2237139 - protein, 18 aa, Cryptosporidium parvum
RISILFVSIFSFIEIVSP

SEQ ID NO: 2237140 - protein, 19 aa, Cryptosporidium parvum
RISLARALYSLPIRYSAFS

SEQ ID NO: 2237141 - protein, 20 aa, Cryptosporidium parvum
RISLFTSMNNTVWIIALVNS

SEQ ID NO: 2237142 - protein, 17 aa, Cryptosporidium parvum
RISLRFKGINGNLHTCY

SEQ ID NO: 2237143 - protein, 17 aa, Cryptosporidium parvum
RISQDWSGSAINRSPDG

SEQ ID NO: 2237144 - protein, 19 aa, Cryptosporidium parvum
RISSIPLPPLHVSAADTDF

SEQ ID NO: 2237145 - protein, 17 aa, Cryptosporidium parvum
RISSISIIRLFIQRECI

SEQ ID NO: 2237146 - protein, 31 aa, Cryptosporidium parvum
RITLSYKRMFRFLFIIKIFPILILKVNCQIQ

SEQ ID NO: 2237147 - protein, 17 aa, Cryptosporidium parvum
RITSPWVNSCFITIISQ

SEQ ID NO: 2237148 - protein, 23 aa, Cryptosporidium parvum
RITSRIRRAFGMDISDLSCILLD

SEQ ID NO: 2237149 - protein, 19 aa, Cryptosporidium parvum
RIVGISFAFIFIILSINGG

SEQ ID NO: 2237150 - protein, 26 aa, Cryptosporidium parvum
RIWMHGAWLPSFKMVWGQIPHGLERG

SEQ ID NO: 2237151 - protein, 20 aa, Cryptosporidium parvum
RIYFLIFLLVCILKIGVTKS

SEQ ID NO: 2237152 - protein, 18 aa, Cryptosporidium parvum
RKDMRLMELAQLLNQRMS

SEQ ID NO: 2237153 - protein, 22 aa, Cryptosporidium parvum
RKDSFFSICFLLISAATGMGVL

SEQ ID NO: 2237154 - protein, 19 aa, Cryptosporidium parvum
RKEDVGMRGLRRGPGGKES

SEQ ID NO: 2237155 - protein, 27 aa, Cryptosporidium parvum
RKELEMLLNEWKKIVLLILFLSQVFTA

SEQ ID NO: 2237156 - protein, 19 aa, Cryptosporidium parvum
RKEMLFDINRLWIRNLGRD

SEQ ID NO: 2237157 - protein, 18 aa, Cryptosporidium parvum
RKFGFNVFVDGTRRTKLD

SEQ ID NO: 2237158 - protein, 21 aa, Cryptosporidium parvum
RKFNKEFFHLTTLDELINGSI

SEQ ID NO: 2237159 - protein, 18 aa, Cryptosporidium parvum
RKFRLGSSYSGFKKINIV

SEQ ID NO: 2237160 - protein, 21 aa, Cryptosporidium parvum
RKGCLCLSLRLSVFLHGLLNI

SEQ ID NO: 2237161 - protein, 18 aa, Cryptosporidium parvum
RKHFPRIRIFHSGSYSGL

SEQ ID NO: 2237162 - protein, 22 aa, Cryptosporidium parvum
RKIFKKRIPNLYNHFRNENVDE

SEQ ID NO: 2237163 - protein, 20 aa, Cryptosporidium parvum
RKIFRFPTIKLYKKREKANP

SEQ ID NO: 2237164 - protein, 21 aa, Cryptosporidium parvum
RKIIGFPILITRSIILSICLI

SEQ ID NO: 2237165 - protein, 17 aa, Cryptosporidium parvum
RKIIGIFFLINLIILTL

SEQ ID NO: 2237166 - protein, 19 aa, Cryptosporidium parvum
RKILEEGTFYPSRVFYDHG

SEQ ID NO: 2237167 - protein, 20 aa, Cryptosporidium parvum
RKINVCRSVFNNNEDFKSVI

SEQ ID NO: 2237168 - protein, 24 aa, Cryptosporidium parvum
RKISDPLCSLSILMSLLSLQITKK

SEQ ID NO: 2237169 - protein, 19 aa, Cryptosporidium parvum
RKISSFVPILEKLRFIKWF

SEQ ID NO: 2237170 - protein, 25 aa, Cryptosporidium parvum
RKKILRWYKYVSPWSTNKVANQISQ

SEQ ID NO: 2237171 - protein, 21 aa, Cryptosporidium parvum
RKLCLITVIFLVLCASEGDAI

SEQ ID NO: 2237172 - protein, 17 aa, Cryptosporidium parvum
RKLDIDFSRAVRAVSLT

SEQ ID NO: 2237173 - protein, 18 aa, Cryptosporidium parvum
RKLFKGILRDNCYIEKDM

SEQ ID NO: 2237174 - protein, 18 aa, Cryptosporidium parvum
RKLHSSEISEFIQLSLVE

SEQ ID NO: 2237175 - protein, 23 aa, Cryptosporidium parvum
RKLIPSLYAYSSLHGCIDQLIPT

SEQ ID NO: 2237176 - protein, 24 aa, Cryptosporidium parvum
RKLLKESYIILALMELLFGLFGII

SEQ ID NO: 2237177 - protein, 24 aa, Cryptosporidium parvum
RKLSGELPKFFVINSYFNENLQEW

SEQ ID NO: 2237178 - protein, 28 aa, Cryptosporidium parvum
RKLSLTRWFACFLLIFGVIMIPKKSKHS

SEQ ID NO: 2237179 - protein, 25 aa, Cryptosporidium parvum
RKLSTRIIYYLLEIAVKYSEETMGS

SEQ ID NO: 2237180 - protein, 18 aa, Cryptosporidium parvum
RKLVCPLFQDWVLELERE

SEQ ID NO: 2237181 - protein, 20 aa, Cryptosporidium parvum
RKMKTFSIPLFFTGETKEMM

SEQ ID NO: 2237182 - protein, 17 aa, Cryptosporidium parvum
RKMLLFLIIVIACSIAI

SEQ ID NO: 2237183 - protein, 18 aa, Cryptosporidium parvum
RKNHFLKRHFNITELNDT

SEQ ID NO: 2237184 - protein, 18 aa, Cryptosporidium parvum
RKNILMLIATVFGIFGAV

SEQ ID NO: 2237185 - protein, 17 aa, Cryptosporidium parvum
RKNLLEYLAASYSITLI

SEQ ID NO: 2237186 - protein, 35 aa, Cryptosporidium parvum
RKNRYCLYLFKEIYCKRSKVTIHYLTLIHFLNLLL

SEQ ID NO: 2237187 - protein, 34 aa, Cryptosporidium parvum
RKPCPYCKGCNDSRLDSLPIWVSPILHRQIKRVN

SEQ ID NO: 2237188 - protein, 17 aa, Cryptosporidium parvum
RKPTYYLFHRKPITISR

SEQ ID NO: 2237189 - protein, 23 aa, Cryptosporidium parvum
RKRERIKLIKYWYHYYSVYLNNY

SEQ ID NO: 2237190 - protein, 22 aa, Cryptosporidium parvum
RKRPLIVYFRRAMNLLTVSEAH

SEQ ID NO: 2237191 - protein, 17 aa, Cryptosporidium parvum
RKRQKFIKRGCDLSDSI

SEQ ID NO: 2237192 - protein, 20 aa, Cryptosporidium parvum
RKSEKLDFVNLVSLNGDLNI

SEQ ID NO: 2237193 - protein, 20 aa, Cryptosporidium parvum
RKSFDFWLKIMKIMEEKFPT

SEQ ID NO: 2237194 - protein, 17 aa, Cryptosporidium parvum
RKSFIIFQSISSVLYST

SEQ ID NO: 2237195 - protein, 24 aa, Cryptosporidium parvum
RKSIKGKELYSVRSIGIKKQNGIE

SEQ ID NO: 2237196 - protein, 20 aa, Cryptosporidium parvum
RKSLIWRLIPMGSMVFHSLL

SEQ ID NO: 2237197 - protein, 18 aa, Cryptosporidium parvum
RKSNGISEFGLFIRYFEI

SEQ ID NO: 2237198 - protein, 20 aa, Cryptosporidium parvum
RKTNTFIFFGLIRLVILFIS

SEQ ID NO: 2237199 - protein, 19 aa, Cryptosporidium parvum
RKTSFLLTKIDEIPTEEDR

SEQ ID NO: 2237200 - protein, 21 aa, Cryptosporidium parvum
RKTSLPIIFIRYIQYTLCLSP

SEQ ID NO: 2237201 - protein, 18 aa, Cryptosporidium parvum
RKTYIGTSFGDMVNPNKI

SEQ ID NO: 2237202 - protein, 22 aa, Cryptosporidium parvum
RKVSRKCKCIFSTADQIEELIN

SEQ ID NO: 2237203 - protein, 33 aa, Cryptosporidium parvum
RKWIILLIIIEFVIKINLLYGLRNNVFGQLVPQ

SEQ ID NO: 2237204 - protein, 22 aa, Cryptosporidium parvum
RKYHWSLCFFILSRSYDEIANI

SEQ ID NO: 2237205 - protein, 19 aa, Cryptosporidium parvum
RKYILPTFVTLVITVGVSG

SEQ ID NO: 2237206 - protein, 23 aa, Cryptosporidium parvum
RKYKLDILCEITFPISEYSDNLP

SEQ ID NO: 2237207 - protein, 25 aa, Cryptosporidium parvum
RKYNEIRLSSKFSFEEMTKCLFVDN

SEQ ID NO: 2237208 - protein, 25 aa, Cryptosporidium parvum
RKYYLNCVFIAYGIYSAYEAKIGRV

SEQ ID NO: 2237209 - protein, 20 aa, Cryptosporidium parvum
RLAGIQAFTCFIFFQIMNFL

SEQ ID NO: 2237210 - protein, 18 aa, Cryptosporidium parvum
RLAQCLNPSLPSGVHTKA

SEQ ID NO: 2237211 - protein, 24 aa, Cryptosporidium parvum
RLDKHLFDLFDFYISDGINNKIIV

SEQ ID NO: 2237212 - protein, 19 aa, Cryptosporidium parvum
RLENPIFIFKNGVIVAWSN

SEQ ID NO: 2237213 - protein, 21 aa, Cryptosporidium parvum
RLFKSWDILRNLVLNETRKKA

SEQ ID NO: 2237214 - protein, 22 aa, Cryptosporidium parvum
RLFLRNIWGSCIVKSLDWMFQP

SEQ ID NO: 2237215 - protein, 23 aa, Cryptosporidium parvum
RLFNCIPLYFTLMGYFFQNQNPK

SEQ ID NO: 2237216 - protein, 17 aa, Cryptosporidium parvum
RLFSLRYQTLSSISDKE

SEQ ID NO: 2237217 - protein, 19 aa, Cryptosporidium parvum
RLHYSHSLLELEKVSDENG

SEQ ID NO: 2237218 - protein, 19 aa, Cryptosporidium parvum
RLIFNIIIVFITLYIIFGI

SEQ ID NO: 2237219 - protein, 20 aa, Cryptosporidium parvum
RLIIWKRTFLPQFQNRNQRY

SEQ ID NO: 2237220 - protein, 19 aa, Cryptosporidium parvum
RLIQSICIPNGIVSSDNIH

SEQ ID NO: 2237221 - protein, 26 aa, Cryptosporidium parvum
RLIVFAFLWFFGFDFWILPNLFDEDT

SEQ ID NO: 2237222 - protein, 20 aa, Cryptosporidium parvum
RLKFRRIHIKLGDSANKELN

SEQ ID NO: 2237223 - protein, 17 aa, Cryptosporidium parvum
RLKLCGTNSPSLHDDLF

SEQ ID NO: 2237224 - protein, 18 aa, Cryptosporidium parvum
RLKYSVYLGGINTFKNFF

SEQ ID NO: 2237225 - protein, 18 aa, Cryptosporidium parvum
RLLAMALNDHMGLILDYT

SEQ ID NO: 2237226 - protein, 22 aa, Cryptosporidium parvum
RLLELLQHLIFYEIPRYSPIGL

SEQ ID NO: 2237227 - protein, 26 aa, Cryptosporidium parvum
RLLISKAVMFSSLFVRKLNESSIPNK

SEQ ID NO: 2237228 - protein, 17 aa, Cryptosporidium parvum
RLLKEKQFWLIFWLLFL

SEQ ID NO: 2237229 - protein, 18 aa, Cryptosporidium parvum
RLLLNRKKYKIILLDEPT

SEQ ID NO: 2237230 - protein, 18 aa, Cryptosporidium parvum
RLLLTLKSLYDMIGLLPL

SEQ ID NO: 2237231 - protein, 18 aa, Cryptosporidium parvum
RLLMDLKKIKSVRITLVC

SEQ ID NO: 2237232 - protein, 18 aa, Cryptosporidium parvum
RLLTGMILILVFGEALAI

SEQ ID NO: 2237233 - protein, 20 aa, Cryptosporidium parvum
RLLYHRMNPFNIIYRHFSNS

SEQ ID NO: 2237234 - protein, 20 aa, Cryptosporidium parvum
RLNIIHFSFIYNLKVLMEIR

SEQ ID NO: 2237235 - protein, 19 aa, Cryptosporidium parvum
RLNIVALLLLTGIDANIKL

SEQ ID NO: 2237236 - protein, 27 aa, Cryptosporidium parvum
RLNNINKLLSRRVFPYNNTLGILLHDL

SEQ ID NO: 2237237 - protein, 37 aa, Cryptosporidium parvum
RLNSIVRFYLSINILRGNFGKIWLWLVKLLNKNSPHR

SEQ ID NO: 2237238 - protein, 23 aa, Cryptosporidium parvum
RLPINCFHYWFIFGASVGYYTFH

SEQ ID NO: 2237239 - protein, 26 aa, Cryptosporidium parvum
RLPRFLEFYNLIGVNIFAVSYRGYGD

SEQ ID NO: 2237240 - protein, 19 aa, Cryptosporidium parvum
RLQCYVNLMITLRRLQLKL

SEQ ID NO: 2237241 - protein, 23 aa, Cryptosporidium parvum
RLQYKDGLDFARIIYSLERLVAL

SEQ ID NO: 2237242 - protein, 19 aa, Cryptosporidium parvum
RLRITSLQLLRQIILYGKD

SEQ ID NO: 2237243 - protein, 24 aa, Cryptosporidium parvum
RLRRHYHMKWSVLINHLLYILSPY

SEQ ID NO: 2237244 - protein, 17 aa, Cryptosporidium parvum
RLRVFTAAFSMIVAGIW

SEQ ID NO: 2237245 - protein, 20 aa, Cryptosporidium parvum
RLSLFEIWESGIARKLKTEK

SEQ ID NO: 2237246 - protein, 20 aa, Cryptosporidium parvum
RLSLKFPQPYLSLIENINRE

SEQ ID NO: 2237247 - protein, 29 aa, Cryptosporidium parvum
RLSQMVQNYWRKKMLNLERHISSKCSALI

SEQ ID NO: 2237248 - protein, 17 aa, Cryptosporidium parvum
RLSRAIDTLFPKFWVEN

SEQ ID NO: 2237249 - protein, 18 aa, Cryptosporidium parvum
RLTFEVFDDKVFVYMGML

SEQ ID NO: 2237250 - protein, 20 aa, Cryptosporidium parvum
RLVLNTVQSLIQWIRITSIN

SEQ ID NO: 2237251 - protein, 24 aa, Cryptosporidium parvum
RLVNCLKETILILFKSNKLEFLEN

SEQ ID NO: 2237252 - protein, 19 aa, Cryptosporidium parvum
RLYEYNGKKLPFSVAQIGL

SEQ ID NO: 2237253 - protein, 17 aa, Cryptosporidium parvum
RLYSILEEQVWALLPGF

SEQ ID NO: 2237254 - protein, 25 aa, Cryptosporidium parvum
RMANCVFGGVLICHGNFGDQAREFQ

SEQ ID NO: 2237255 - protein, 19 aa, Cryptosporidium parvum
RMEFVLDYFTNIKLSSPQS

SEQ ID NO: 2237256 - protein, 25 aa, Cryptosporidium parvum
RMETFYNRLRLILIQIGTFLDYHVQ

SEQ ID NO: 2237257 - protein, 19 aa, Cryptosporidium parvum
RMIGELAQIFQKVAGMVTQ

SEQ ID NO: 2237258 - protein, 23 aa, Cryptosporidium parvum
RMINLRYEWFISKLMDLTMMKKL

SEQ ID NO: 2237259 - protein, 20 aa, Cryptosporidium parvum
RMKDILKFHIHSSEYILNII

SEQ ID NO: 2237260 - protein, 22 aa, Cryptosporidium parvum
RMKSSTSMKNWSIFEERNHLDI

SEQ ID NO: 2237261 - protein, 17 aa, Cryptosporidium parvum
RMLSPIINLNKIVKDLS

SEQ ID NO: 2237262 - protein, 28 aa, Cryptosporidium parvum
RMNFNDHWRKGAGILPLNMLYNAPLKSL

SEQ ID NO: 2237263 - protein, 21 aa, Cryptosporidium parvum
RMPFHCSDPLLARDLLSVRNL

SEQ ID NO: 2237264 - protein, 27 aa, Cryptosporidium parvum
RMPNYRVKLGFGLHYGWAIEGAIGSEY

SEQ ID NO: 2237265 - protein, 17 aa, Cryptosporidium parvum
RMPPSMLQQPQLQRRVS

SEQ ID NO: 2237266 - protein, 25 aa, Cryptosporidium parvum
RMQAFRIWLSSVLPRMPFHCSDPLL

SEQ ID NO: 2237267 - protein, 21 aa, Cryptosporidium parvum
RMRELFKVGNLIEVVYNQEEE

SEQ ID NO: 2237268 - protein, 20 aa, Cryptosporidium parvum
RMVTISGGILFFAFAIGGIV

SEQ ID NO: 2237269 - protein, 18 aa, Cryptosporidium parvum
RMYYGMKLATVKDVISEN

SEQ ID NO: 2237270 - protein, 26 aa, Cryptosporidium parvum
RNAASCKIASLWKGYKTRKFMDSIIK

SEQ ID NO: 2237271 - protein, 24 aa, Cryptosporidium parvum
RNAICPNCKTLVRYGKTETGTSPC

SEQ ID NO: 2237272 - protein, 17 aa, Cryptosporidium parvum
RNASALAQYKPCITGTR

SEQ ID NO: 2237273 - protein, 23 aa, Cryptosporidium parvum
RNCRNNCKYCKRNSNSHIENHSF

SEQ ID NO: 2237274 - protein, 23 aa, Cryptosporidium parvum
RNDIKYRTNYSIVLSPIDDIKQL

SEQ ID NO: 2237275 - protein, 24 aa, Cryptosporidium parvum
RNDKDCYDWNFSTYINNLSLYHFK

SEQ ID NO: 2237276 - protein, 19 aa, Cryptosporidium parvum
RNDPDFGRISFQMQATMEQ

SEQ ID NO: 2237277 - protein, 17 aa, Cryptosporidium parvum
RNECCSLYERKFSQQTN

SEQ ID NO: 2237278 - protein, 18 aa, Cryptosporidium parvum
RNFELYKDCESKFINEMI

SEQ ID NO: 2237279 - protein, 25 aa, Cryptosporidium parvum
RNFISEWFLLVTFYSFFSFIHICFL

SEQ ID NO: 2237280 - protein, 19 aa, Cryptosporidium parvum
RNFWNWSTQMYTRISNKQA

SEQ ID NO: 2237281 - protein, 19 aa, Cryptosporidium parvum
RNGVSYLIIDFLKQMLFLR

SEQ ID NO: 2237282 - protein, 17 aa, Cryptosporidium parvum
RNIVNLVNRYLSIIEDE

SEQ ID NO: 2237283 - protein, 25 aa, Cryptosporidium parvum
RNIWIIPIANPWGFYHNKRTEEEID

SEQ ID NO: 2237284 - protein, 18 aa, Cryptosporidium parvum
RNKELIISYDIGSISNLY

SEQ ID NO: 2237285 - protein, 25 aa, Cryptosporidium parvum
RNMRRPSCFILVYREYTWKYINTDH

SEQ ID NO: 2237286 - protein, 17 aa, Cryptosporidium parvum
RNNEIISAFPAIITNLL

SEQ ID NO: 2237287 - protein, 17 aa, Cryptosporidium parvum
RNNFCNINEDWLGWGGS

SEQ ID NO: 2237288 - protein, 24 aa, Cryptosporidium parvum
RNNLKLITCYIEFLNECLLIGHSK

SEQ ID NO: 2237289 - protein, 24 aa, Cryptosporidium parvum
RNNPIMRLFFFIFVLAMFSPANIS

SEQ ID NO: 2237290 - protein, 21 aa, Cryptosporidium parvum
RNPKIWMMGIILSKYLFTVLG

SEQ ID NO: 2237291 - protein, 19 aa, Cryptosporidium parvum
RNQITIAIDGSVWTKIPKF

SEQ ID NO: 2237292 - protein, 25 aa, Cryptosporidium parvum
RNQKNCGSCWAFSAVAALEGATCAQ

SEQ ID NO: 2237293 - protein, 20 aa, Cryptosporidium parvum
RNRIFCLAFETAFEDVMISI

SEQ ID NO: 2237294 - protein, 23 aa, Cryptosporidium parvum
RNRKSEFLLAFLQDLHNFSKTNP

SEQ ID NO: 2237295 - protein, 30 aa, Cryptosporidium parvum
RNRKYLCYKYKFMLVPSMLILVIKNEITFD

SEQ ID NO: 2237296 - protein, 22 aa, Cryptosporidium parvum
RNRSGIWRLLLIRLSETNKEIM

SEQ ID NO: 2237297 - protein, 24 aa, Cryptosporidium parvum
RNSEKCMLGKQLVYTRKKQTAECY

SEQ ID NO: 2237298 - protein, 23 aa, Cryptosporidium parvum
RNSRLLVPLFCPISDTFCNLSIK

SEQ ID NO: 2237299 - protein, 19 aa, Cryptosporidium parvum
RNSVPRLSSFSLQEFDLEN

SEQ ID NO: 2237300 - protein, 32 aa, Cryptosporidium parvum
RNTLEIYWWYFSLVGRAWCIVLLISCILKSVF

SEQ ID NO: 2237301 - protein, 18 aa, Cryptosporidium parvum
RNVSILLIVIIFLFFWFL

SEQ ID NO: 2237302 - protein, 17 aa, Cryptosporidium parvum
RNYFDRLGFLEVETPML

SEQ ID NO: 2237303 - protein, 29 aa, Cryptosporidium parvum
RNYKLWITFILLCFFSVWISILESGILFS

SEQ ID NO: 2237304 - protein, 17 aa, Cryptosporidium parvum
RNYLNENIHLFYNKRDE

SEQ ID NO: 2237305 - protein, 24 aa, Cryptosporidium parvum
RNYNFKSSCNFDFRKSFTSLNLIL

SEQ ID NO: 2237306 - protein, 24 aa, Cryptosporidium parvum
RNYYRHIYSGFKYSAFGSFISSSI

SEQ ID NO: 2237307 - protein, 17 aa, Cryptosporidium parvum
RPDMMKIPVLFETIKLI

SEQ ID NO: 2237308 - protein, 19 aa, Cryptosporidium parvum
RPDTIGEILTRVSYKSPSD

SEQ ID NO: 2237309 - protein, 17 aa, Cryptosporidium parvum
RPFILTRSFWFGSHRYS

SEQ ID NO: 2237310 - protein, 23 aa, Cryptosporidium parvum
RPFRGHHCSDCGYCIQRFDHHCV

SEQ ID NO: 2237311 - protein, 19 aa, Cryptosporidium parvum
RPGVEKAITKCCEAGVRVI

SEQ ID NO: 2237312 - protein, 21 aa, Cryptosporidium parvum
RPKPWIEREFVIKIFGYESPQ

SEQ ID NO: 2237313 - protein, 26 aa, Cryptosporidium parvum
RPLILQELLCLFKRTTSPYISTEQEI

SEQ ID NO: 2237314 - protein, 18 aa, Cryptosporidium parvum
RPLKLIWIVPKTELQKVL

SEQ ID NO: 2237315 - protein, 17 aa, Cryptosporidium parvum
RPLQLVLRIPKDFSEEF

SEQ ID NO: 2237316 - protein, 22 aa, Cryptosporidium parvum
RPNIFAFEYIYLLSPVLSTLTK

SEQ ID NO: 2237317 - protein, 19 aa, Cryptosporidium parvum
RPPHVPQLIRGGRGEGESA

SEQ ID NO: 2237318 - protein, 24 aa, Cryptosporidium parvum
RPSTLCSIYPISAFSRIHETLLDA

SEQ ID NO: 2237319 - protein, 18 aa, Cryptosporidium parvum
RPTAREVLSHPWFRYSKS

SEQ ID NO: 2237320 - protein, 29 aa, Cryptosporidium parvum
RPTLEALLLRLCFDILVILSSIFLSYFST

SEQ ID NO: 2237321 - protein, 19 aa, Cryptosporidium parvum
RPVFPTRRPYSGILLTSSG

SEQ ID NO: 2237322 - protein, 19 aa, Cryptosporidium parvum
RPVFPTRRPYSGSLFTSSS

SEQ ID NO: 2237323 - protein, 17 aa, Cryptosporidium parvum
RQCALLFTGLVSNKHQI

SEQ ID NO: 2237324 - protein, 19 aa, Cryptosporidium parvum
RQDFGHYVGFEEFDVIFPA

SEQ ID NO: 2237325 - protein, 18 aa, Cryptosporidium parvum
RQDKVLTRIAVQLFTIDR

SEQ ID NO: 2237326 - protein, 22 aa, Cryptosporidium parvum
RQEKNHLFEVYDFGSNEKKDWI

SEQ ID NO: 2237327 - protein, 18 aa, Cryptosporidium parvum
RQEMSPILRIKWLRLIID

SEQ ID NO: 2237328 - protein, 19 aa, Cryptosporidium parvum
RQFDYEAISNLGFKYMMVF

SEQ ID NO: 2237329 - protein, 18 aa, Cryptosporidium parvum
RQFVYRLLEENFFLNSNM

SEQ ID NO: 2237330 - protein, 19 aa, Cryptosporidium parvum
RQGKLCNFIDWKGHTLVVK

SEQ ID NO: 2237331 - protein, 17 aa, Cryptosporidium parvum
RQIRFLIAEASFKRPII

SEQ ID NO: 2237332 - protein, 18 aa, Cryptosporidium parvum
RQITQIWLLGQETKIKNQ

SEQ ID NO: 2237333 - protein, 20 aa, Cryptosporidium parvum
RQKFIKRGCDLSDSIQIRRL

SEQ ID NO: 2237334 - protein, 18 aa, Cryptosporidium parvum
RQKMLLLTTGILEYIYQD

SEQ ID NO: 2237335 - protein, 19 aa, Cryptosporidium parvum
RQLEFIGMILYILKNITFD

SEQ ID NO: 2237336 - protein, 28 aa, Cryptosporidium parvum
RQLKTWCIVWLSRFLLTSVIRSMTIIIS

SEQ ID NO: 2237337 - protein, 21 aa, Cryptosporidium parvum
RQLRVCTTIAIAIISEICMPY

SEQ ID NO: 2237338 - protein, 20 aa, Cryptosporidium parvum
RQNKSICAKTMYNLNNKTDN

SEQ ID NO: 2237339 - protein, 18 aa, Cryptosporidium parvum
RRAFLLKVMEGIDDEYMK

SEQ ID NO: 2237340 - protein, 21 aa, Cryptosporidium parvum
RRDCRRQGVRYLCRGANSDGN

SEQ ID NO: 2237341 - protein, 26 aa, Cryptosporidium parvum
RREIRRRLINHLKHFGALNDDDIALI

SEQ ID NO: 2237342 - protein, 22 aa, Cryptosporidium parvum
RRFIYSRIAAFIDYHLKVYSQY

SEQ ID NO: 2237343 - protein, 23 aa, Cryptosporidium parvum
RRIRAKLLAERDVNWITRSEQFE

SEQ ID NO: 2237344 - protein, 18 aa, Cryptosporidium parvum
RRIRFVIIILNSVIISVI

SEQ ID NO: 2237345 - protein, 24 aa, Cryptosporidium parvum
RRITSSQLYIRWMELYKVDPPRSQ

SEQ ID NO: 2237346 - protein, 21 aa, Cryptosporidium parvum
RRKELENDLLLYYSSFNSNLM

SEQ ID NO: 2237347 - protein, 18 aa, Cryptosporidium parvum
RRKELSFEFPDNQKKNSN

SEQ ID NO: 2237348 - protein, 23 aa, Cryptosporidium parvum
RRKGRPRKTPLLSLTTLNKSSFK

SEQ ID NO: 2237349 - protein, 26 aa, Cryptosporidium parvum
RRKIKRAGLKLEQRFIESLIHIQIVD

SEQ ID NO: 2237350 - protein, 17 aa, Cryptosporidium parvum
RRKIPIALISLGLNSPF

SEQ ID NO: 2237351 - protein, 19 aa, Cryptosporidium parvum
RRKLGMPGNSLQWGAWAEQ

SEQ ID NO: 2237352 - protein, 18 aa, Cryptosporidium parvum
RRKLLGINIEKLLEWSSI

SEQ ID NO: 2237353 - protein, 21 aa, Cryptosporidium parvum
RRKQYDIGYNYTLERQARDLE

SEQ ID NO: 2237354 - protein, 29 aa, Cryptosporidium parvum
RRLTANRAWKIGKVLSFIYYTWFMFGFYW

SEQ ID NO: 2237355 - protein, 19 aa, Cryptosporidium parvum
RRNERCPAEDYCTENETFL

SEQ ID NO: 2237356 - protein, 20 aa, Cryptosporidium parvum
RRNGISIAILIGFLQVLFVI

SEQ ID NO: 2237357 - protein, 24 aa, Cryptosporidium parvum
RRNSSARQSIEWSGITIDHHHQSN

SEQ ID NO: 2237358 - protein, 26 aa, Cryptosporidium parvum
RRPVILRPIWILGVLFSCILNAILII

SEQ ID NO: 2237359 - protein, 19 aa, Cryptosporidium parvum
RRQSILIFYGIGVQLETEY

SEQ ID NO: 2237360 - protein, 19 aa, Cryptosporidium parvum
RRRPIKELPDRSMEKTFRS

SEQ ID NO: 2237361 - protein, 18 aa, Cryptosporidium parvum
RRSGSSKRRARKIMTKKG

SEQ ID NO: 2237362 - protein, 26 aa, Cryptosporidium parvum
RRSKSGWRSFLSIIIKSIRSFFQNES

SEQ ID NO: 2237363 - protein, 19 aa, Cryptosporidium parvum
RRSLIKLFLFLAAISACSV

SEQ ID NO: 2237364 - protein, 24 aa, Cryptosporidium parvum
RRSNKPKILRFFNSWDQPVNKKIL

SEQ ID NO: 2237365 - protein, 22 aa, Cryptosporidium parvum
RRTLETFPILIFAFTCQQNIFT

SEQ ID NO: 2237366 - protein, 19 aa, Cryptosporidium parvum
RRTLWCTIRLEWEQVHLNS

SEQ ID NO: 2237367 - protein, 18 aa, Cryptosporidium parvum
RRTPRIRDEYEFNYIYQM

SEQ ID NO: 2237368 - protein, 34 aa, Cryptosporidium parvum; identical to SEQ ID NO: 2127153

SEQ ID NO: 2237369 - protein, 22 aa, Cryptosporidium parvum
RRVALLQVIVSLVFLIPDKLIE

SEQ ID NO: 2237370 - protein, 19 aa, Cryptosporidium parvum
RRVLPSLGVTHLVAIYSGM

SEQ ID NO: 2237371 - protein, 18 aa, Cryptosporidium parvum
RRVYMLVALQVLFDLALS

SEQ ID NO: 2237372 - protein, 20 aa, Cryptosporidium parvum
RRWEEIRQDINLDGKISLLS

SEQ ID NO: 2237373 - protein, 20 aa, Cryptosporidium parvum
RRYESYISLNSDNSFITKIN

SEQ ID NO: 2237374 - protein, 18 aa, Cryptosporidium parvum
RRYFPNIFFYCTHLEIPL

SEQ ID NO: 2237375 - protein, 21 aa, Cryptosporidium parvum
RRYVFNYPKLKSYRKDTPYQV

SEQ ID NO: 2237376 - protein, 25 aa, Cryptosporidium parvum
RSAKFWHQWVSGLLWAAIAGPITLL

SEQ ID NO: 2237377 - protein, 20 aa, Cryptosporidium parvum
RSDIVLIIIRVLRCLPSKQF

SEQ ID NO: 2237378 - protein, 17 aa, Cryptosporidium parvum
RSECLNYSFTYDSPIPL

SEQ ID NO: 2237379 - protein, 23 aa, Cryptosporidium parvum
RSEHIPISFPFGSTISQNVNLRR

SEQ ID NO: 2237380 - protein, 21 aa, Cryptosporidium parvum
RSFAFDFKSPLSIHLTGRHQG

SEQ ID NO: 2237381 - protein, 20 aa, Cryptosporidium parvum
RSFEEFPIRIATFVELCNLS

SEQ ID NO: 2237382 - protein, 17 aa, Cryptosporidium parvum
RSFLSLESFESCFSEFQ

SEQ ID NO: 2237383 - protein, 19 aa, Cryptosporidium parvum
RSGDYCTVSIKLPVYMAVE

SEQ ID NO: 2237384 - protein, 21 aa, Cryptosporidium parvum
RSGNAIPYPEPQGSVRSQWDF

SEQ ID NO: 2237385 - protein, 20 aa, Cryptosporidium parvum
RSGSLIFTVIVSYFMLGQKQ

SEQ ID NO: 2237386 - protein, 19 aa, Cryptosporidium parvum
RSIDLIRPWLGKMDVIIIG

SEQ ID NO: 2237387 - protein, 18 aa, Cryptosporidium parvum
RSIKRLFENAFFYNTISN

SEQ ID NO: 2237388 - protein, 29 aa, Cryptosporidium parvum
RSINCLTIQFSFGLWLDYIDSFISHYNNG

SEQ ID NO: 2237389 - protein, 20 aa, Cryptosporidium parvum
RSIYRNERFCIYRPLIKTLW

SEQ ID NO: 2237390 - protein, 23 aa, Cryptosporidium parvum
RSKCCSSEIQFLISDTTSPFSIE

SEQ ID NO: 2237391 - protein, 20 aa, Cryptosporidium parvum
RSKERFKPLFQPCLGSLYTY

SEQ ID NO: 2237392 - protein, 20 aa, Cryptosporidium parvum
RSKIIGVLWLFRGASMSIIP

SEQ ID NO: 2237393 - protein, 24 aa, Cryptosporidium parvum
RSKNLKNSFPYVVVHPDHIKQNFN

SEQ ID NO: 2237394 - protein, 20 aa, Cryptosporidium parvum
RSKSEPWLRSKTKSRSKTRS

SEQ ID NO: 2237395 - protein, 19 aa, Cryptosporidium parvum
RSLLRTSMYFLKRSINFNY

SEQ ID NO: 2237396 - protein, 24 aa, Cryptosporidium parvum
RSLLTVIFCIVFLKLLKAKYGSFE

SEQ ID NO: 2237397 - protein, 18 aa, Cryptosporidium parvum
RSLRRFVFEKGAEFDLEN

SEQ ID NO: 2237398 - protein, 18 aa, Cryptosporidium parvum
RSLRSFLSLESFESCFSE

SEQ ID NO: 2237399 - protein, 20 aa, Cryptosporidium parvum
RSLTFPSVFFYLSQHLADMI

SEQ ID NO: 2237400 - protein, 19 aa, Cryptosporidium parvum
RSMGYFCYGIISIYVWYNH

SEQ ID NO: 2237401 - protein, 25 aa, Cryptosporidium parvum
RSNIKSCPVHTAFSYRYQDENFDIL

SEQ ID NO: 2237402 - protein, 19 aa, Cryptosporidium parvum
RSQKICGLILFDSIRMLVS

SEQ ID NO: 2237403 - protein, 19 aa, Cryptosporidium parvum
RSQLNVDFVPAFVHLLYHI

SEQ ID NO: 2237404 - protein, 24 aa, Cryptosporidium parvum
RSQWDFLLQEMTWMSKDYYEERRW

SEQ ID NO: 2237405 - protein, 17 aa, Cryptosporidium parvum
RSRFKYINENCFFVSVI

SEQ ID NO: 2237406 - protein, 17 aa, Cryptosporidium parvum
RSRSRSRSRRSSKSRVR

SEQ ID NO: 2237407 - protein, 17 aa, Cryptosporidium parvum
RSRVIPIVIRILLSKLG

SEQ ID NO: 2237408 - protein, 26 aa, Cryptosporidium parvum
RSSLEILDLLDLFGLVDKKKNLLYDQ

SEQ ID NO: 2237409 - protein, 17 aa, Cryptosporidium parvum
RSSPLNRCRLIISELQS

SEQ ID NO: 2237410 - protein, 17 aa, Cryptosporidium parvum
RSSPPKRRLFEIDSSTR

SEQ ID NO: 2237411 - protein, 18 aa, Cryptosporidium parvum
RSSRGFKVNFKYKNSSIN

SEQ ID NO: 2237412 - protein, 20 aa, Cryptosporidium parvum
RSSSSLPSVQAFTEAIEEST

SEQ ID NO: 2237413 - protein, 21 aa, Cryptosporidium parvum
RSTISEIFLFSELSLSGKGGH

SEQ ID NO: 2237414 - protein, 25 aa, Cryptosporidium parvum
RSTKRPGFIFNMWQSDFEKILHDME

SEQ ID NO: 2237415 - protein, 19 aa, Cryptosporidium parvum
RSTSRLAGYQKKLYKIDNH

SEQ ID NO: 2237416 - protein, 19 aa, Cryptosporidium parvum
RSYLWEFLDSEWKTLPQFY

SEQ ID NO: 2237417 - protein, 20 aa, Cryptosporidium parvum
RTANDLFEFAIKFQSSSASI

SEQ ID NO: 2237418 - protein, 24 aa, Cryptosporidium parvum
RTDEIGIPFGITIDFQSVKDDTVT

SEQ ID NO: 2237419 - protein, 18 aa, Cryptosporidium parvum
RTDMSIRIQIDLRMWLTN

SEQ ID NO: 2237420 - protein, 32 aa, Cryptosporidium parvum
RTELDDLCFCLSQERLNILGIRKEFDKIYESL

SEQ ID NO: 2237421 - protein, 34 aa, Cryptosporidium parvum
RTFFYGRLPQVFHLYFKFELIKCIQSTREAISKN

SEQ ID NO: 2237422 - protein, 18 aa, Cryptosporidium parvum
RTGGIRWLQVIKHTIELI

SEQ ID NO: 2237423 - protein, 17 aa, Cryptosporidium parvum
RTGLNILNMTDFQKCPE

SEQ ID NO: 2237424 - protein, 19 aa, Cryptosporidium parvum
RTHHCSICNKCILNMDHHC

SEQ ID NO: 2237425 - protein, 18 aa, Cryptosporidium parvum
RTIALLKPFIPLFPSYTL

SEQ ID NO: 2237426 - protein, 17 aa, Cryptosporidium parvum
RTIGAWNAILIIIQLFF

SEQ ID NO: 2237427 - protein, 18 aa, Cryptosporidium parvum
RTIVYFVRLNYLPRVLAN

SEQ ID NO: 2237428 - protein, 21 aa, Cryptosporidium parvum
RTKLVIMELHYLKASLCIPNQ

SEQ ID NO: 2237429 - protein, 19 aa, Cryptosporidium parvum
RTLLRFIIQTDHIFKDHNR

SEQ ID NO: 2237430 - protein, 35 aa, Cryptosporidium parvum
RTNCLDCLDRTNALQWYIAWTWFVDLILSISTCSL

SEQ ID NO: 2237431 - protein, 26 aa, Cryptosporidium parvum
RTNFKILTRLCRFFDIMLQTSTSVWF

SEQ ID NO: 2237432 - protein, 22 aa, Cryptosporidium parvum
RTRIPVSHIRTVRVICNGSPIL

SEQ ID NO: 2237433 - protein, 19 aa, Cryptosporidium parvum
RTRLAMALSSKSSFLQSAK

SEQ ID NO: 2237434 - protein, 20 aa, Cryptosporidium parvum
RTSPTSKWIDCFKSDAKSIP

SEQ ID NO: 2237435 - protein, 20 aa, Cryptosporidium parvum
RTVKGIRRYNWIKESDFSLD

SEQ ID NO: 2237436 - protein, 20 aa, Cryptosporidium parvum
RTYCRYILKKTMEDEINEDY

SEQ ID NO: 2237437 - protein, 24 aa, Cryptosporidium parvum
RVEIKCILFRQEIFNFKNDSFFNN

SEQ ID NO: 2237438 - protein, 24 aa, Cryptosporidium parvum
RVENLYCWYEVIVPAKPQYCSTMK

SEQ ID NO: 2237439 - protein, 27 aa, Cryptosporidium parvum
RVGESIWFTVLLCFILILLITSSIFEF

SEQ ID NO: 2237440 - protein, 20 aa, Cryptosporidium parvum
RVIATFIFLLFCILFALLAK

SEQ ID NO: 2237441 - protein, 21 aa, Cryptosporidium parvum
RVIETLGLMGIPIFHGAMSTQ

SEQ ID NO: 2237442 - protein, 18 aa, Cryptosporidium parvum
RVIIPIIVGNFKYNPENQ

SEQ ID NO: 2237443 - protein, 25 aa, Cryptosporidium parvum
RVINIKTHRNCILPLFDLLINHVNR

SEQ ID NO: 2237444 - protein, 20 aa, Cryptosporidium parvum
RVIPIWRGAWENHVASFWFA

SEQ ID NO: 2237445 - protein, 22 aa, Cryptosporidium parvum
RVIPKKMLNIIIENGRNSLQTN

SEQ ID NO: 2237446 - protein, 23 aa, Cryptosporidium parvum
RVITDLFLALIFNARNQIVLSGR

SEQ ID NO: 2237447 - protein, 25 aa, Cryptosporidium parvum
RVLGPEARLLLAWQSVVEAQSEFNE

SEQ ID NO: 2237448 - protein, 19 aa, Cryptosporidium parvum
RVLPCDSRHIFHLECIDGW

SEQ ID NO: 2237449 - protein, 18 aa, Cryptosporidium parvum
RVMYILLMMFVLEVFSIV

SEQ ID NO: 2237450 - protein, 18 aa, Cryptosporidium parvum
RVQDLLRVMEWLYLQGYS

SEQ ID NO: 2237451 - protein, 17 aa, Cryptosporidium parvum
RVQEMFKSRIYLEKNNE

SEQ ID NO: 2237452 - protein, 20 aa, Cryptosporidium parvum
RVQFRKKFVWIILEDLGEVD

SEQ ID NO: 2237453 - protein, 27 aa, Cryptosporidium parvum
RVQGGSCRRPSGILWMYKDTKDFGKPI

SEQ ID NO: 2237454 - protein, 19 aa, Cryptosporidium parvum
RVSDCNRLLMDLKKIKSVR

SEQ ID NO: 2237455 - protein, 25 aa, Cryptosporidium parvum
RVSFSNVNPSFEWEKLLEIRTPFYL

SEQ ID NO: 2237456 - protein, 30 aa, Cryptosporidium parvum
RVSNSPKLFGYSWIPYRIIKYYKNDKKIEE

SEQ ID NO: 2237457 - protein, 19 aa, Cryptosporidium parvum
RVSSIWVEYLSFMEDYENF

SEQ ID NO: 2237458 - protein, 25 aa, Cryptosporidium parvum
RVTANWRHGIRHLCGAIFTEPSKRN

SEQ ID NO: 2237459 - protein, 30 aa, Cryptosporidium parvum
RVVIEKTHLQVCFVWNRLLRGFQTPPKRNE

SEQ ID NO: 2237460 - protein, 22 aa, Cryptosporidium parvum
RVYSKSGALAFETFNNIKLVKS

SEQ ID NO: 2237461 - protein, 19 aa, Cryptosporidium parvum
RVYSLLSISIAITFGIVSF

SEQ ID NO: 2237462 - protein, 18 aa, Cryptosporidium parvum
RWIYYLFYSTLSWFSSSF

SEQ ID NO: 2237463 - protein, 25 aa, Cryptosporidium parvum
RWSNLKFLIKRLVDIGMDDLGITSL

SEQ ID NO: 2237464 - protein, 24 aa, Cryptosporidium parvum
RWVIWRYAILYLLGGISGNLASAV

SEQ ID NO: 2237465 - protein, 27 aa, Cryptosporidium parvum
RYALLKNFRLFVCSLFLIQIHKNNKLD

SEQ ID NO: 2237466 - protein, 18 aa, Cryptosporidium parvum
RYDIVLMSRRSWERGGTR

SEQ ID NO: 2237467 - protein, 18 aa, Cryptosporidium parvum
RYEECLDKLIDIVLKKEG

SEQ ID NO: 2237468 - protein, 19 aa, Cryptosporidium parvum
RYEIFSLIINHVLLDLRYC

SEQ ID NO: 2237469 - protein, 25 aa, Cryptosporidium parvum
RYETPALYILCFDWQKYPINTNNSN

SEQ ID NO: 2237470 - protein, 18 aa, Cryptosporidium parvum
RYFIKIAKILIMDHSNTL

SEQ ID NO: 2237471 - protein, 20 aa, Cryptosporidium parvum
RYFINGCRSLRSCYISEYSP

SEQ ID NO: 2237472 - protein, 21 aa, Cryptosporidium parvum
RYHIPEIMCYGTIKCYIPCFF

SEQ ID NO: 2237473 - protein, 17 aa, Cryptosporidium parvum
RYILPWDTYSDYNIKNI

SEQ ID NO: 2237474 - protein, 17 aa, Cryptosporidium parvum
RYIPVSFILNRISLDQL

SEQ ID NO: 2237475 - protein, 21 aa, Cryptosporidium parvum
RYKLCGSPFPKETTLPSKRLD

SEQ ID NO: 2237476 - protein, 25 aa, Cryptosporidium parvum
RYKNIKLRLFIKIDLSKVNNNDGKL

SEQ ID NO: 2237477 - protein, 19 aa, Cryptosporidium parvum
RYLAEQGLMELESLNPRIS

SEQ ID NO: 2237478 - protein, 19 aa, Cryptosporidium parvum
RYLYIMMEFVIGGEFFTYL

SEQ ID NO: 2237479 - protein, 20 aa, Cryptosporidium parvum
RYNIHLSSFLVLRDCIYIVF

SEQ ID NO: 2237480 - protein, 19 aa, Cryptosporidium parvum
RYNRAGVLGLISIILSHPY

SEQ ID NO: 2237481 - protein, 24 aa, Cryptosporidium parvum
RYNRILTKIAEEFQVKKGGKISQN

SEQ ID NO: 2237482 - protein, 20 aa, Cryptosporidium parvum
RYSFGRAMSDIMLILQCLPT

SEQ ID NO: 2237483 - protein, 29 aa, Cryptosporidium parvum
RYSKCLVSGVLYRKLLLMDSFEFNMPSQN

SEQ ID NO: 2237484 - protein, 19 aa, Cryptosporidium parvum
RYSNSYIDFAGWSEICFYN

SEQ ID NO: 2237485 - protein, 25 aa, Cryptosporidium parvum
RYSPFKGKVIEFLNGRMILNISDNI

SEQ ID NO: 2237486 - protein, 26 aa, Cryptosporidium parvum
RYSRKYILATGVTVWGFVTILLAFSS

SEQ ID NO: 2237487 - protein, 24 aa, Cryptosporidium parvum
RYYVICFTISLILTIMVLLYNFLG

SEQ ID NO: 2237488 - protein, 21 aa, Cryptosporidium parvum
SAGGTGFRSGWGNVISNAISL

SEQ ID NO: 2237489 - protein, 24 aa, Cryptosporidium parvum
SAGLLKYVQMWSILFFFIPMFGTG

SEQ ID NO: 2237490 - protein, 18 aa, Cryptosporidium parvum
SAIALVAVIMNPLFSLAF

SEQ ID NO: 2237491 - protein, 25 aa, Cryptosporidium parvum
SAIFSLEYFKQIGFKKDYENHTTNY

SEQ ID NO: 2237492 - protein, 17 aa, Cryptosporidium parvum
SAIKILAKRHFPELIST

SEQ ID NO: 2237493 - protein, 22 aa, Cryptosporidium parvum
SAIKLSLIFSSFVGLSHSISIS

SEQ ID NO: 2237494 - protein, 21 aa, Cryptosporidium parvum
SAILCIIVFTLGWKVTAINPG

SEQ ID NO: 2237495 - protein, 18 aa, Cryptosporidium parvum
SAIPIVLPGLYYKPYSYT

SEQ ID NO: 2237496 - protein, 25 aa, Cryptosporidium parvum
SAISGGLQWFWYSLILTLKMVFLVW

SEQ ID NO: 2237497 - protein, 21 aa, Cryptosporidium parvum
SAKFYLRVLEKLQNEYLSMSN

SEQ ID NO: 2237498 - protein, 18 aa, Cryptosporidium parvum
SALCFYLTPISDIIFSFL

SEQ ID NO: 2237499 - protein, 29 aa, Cryptosporidium parvum
SALPTILSFCIMFGLSFLFEIIGAFNKEP

SEQ ID NO: 2237500 - protein, 19 aa, Cryptosporidium parvum
SANTNFLLVDPKINAPCNS

SEQ ID NO: 2237501 - protein, 17 aa, Cryptosporidium parvum
SAPYRFGLISIFIYHFL

SEQ ID NO: 2237502 - protein, 24 aa, Cryptosporidium parvum
SARERFKIGIAIVINELENSNDWK

SEQ ID NO: 2237503 - protein, 20 aa, Cryptosporidium parvum
SARGRALIRKEARFLTHLTG

SEQ ID NO: 2237504 - protein, 27 aa, Cryptosporidium parvum
SARKRGFPIAIYRPGRIGGNSITGASN

SEQ ID NO: 2237505 - protein, 24 aa, Cryptosporidium parvum
SASFLSKFTFSWFTPIIDSAYDHI

SEQ ID NO: 2237506 - protein, 22 aa, Cryptosporidium parvum
SASFPYPFGFDPVWKGAVNEMS

SEQ ID NO: 2237507 - protein, 23 aa, Cryptosporidium parvum
SASFYKVAPWIPVYLETKNKFLI

SEQ ID NO: 2237508 - protein, 38 aa, Cryptosporidium parvum
SASICEARKSLRDCIVSWVFPRARRMGLMPQNSSKETP

SEQ ID NO: 2237509 - protein, 30 aa, Cryptosporidium parvum
SASICLKLGWRSVFYIPSIFVFLFGIIVLK

SEQ ID NO: 2237510 - protein, 23 aa, Cryptosporidium parvum
SATAEFFADIALCPMEMIKIKMQ

SEQ ID NO: 2237511 - protein, 23 aa, Cryptosporidium parvum
SATPIRIGNCIGIDNFKYELTSR

SEQ ID NO: 2237512 - protein, 19 aa, Cryptosporidium parvum
SAVHAIEMFIGEAISAITF

SEQ ID NO: 2237513 - protein, 18 aa, Cryptosporidium parvum
SAVSNVFDGVKILNDNGG

SEQ ID NO: 2237514 - protein, 17 aa, Cryptosporidium parvum
SAWHIFVVFTIPYILFR

SEQ ID NO: 2237515 - protein, 24 aa, Cryptosporidium parvum
SAWPWWIYLCLVLLSLVILGMTLI

SEQ ID NO: 2237516 - protein, 28 aa, Cryptosporidium parvum
SAYKKKRFRFNFGIIILHFILANIKNGI

SEQ ID NO: 2237517 - protein, 19 aa, Cryptosporidium parvum
SCAAYQWYSSIYTGTNNFD

SEQ ID NO: 2237518 - protein, 21 aa, Cryptosporidium parvum
SCASILISAVFLVFSLENFSE

SEQ ID NO: 2237519 - protein, 28 aa, Cryptosporidium parvum
SCDMRFYKFCLRLSCSRMLESQLAQYKI

SEQ ID NO: 2237520 - protein, 22 aa, Cryptosporidium parvum
SCETYFYFHFFFTTNSKPLTFF

SEQ ID NO: 2237521 - protein, 19 aa, Cryptosporidium parvum
SCFFKDLIPSENWRYIHGK

SEQ ID NO: 2237522 - protein, 20 aa, Cryptosporidium parvum
SCFLGCIIFILTYVASRALR

SEQ ID NO: 2237523 - protein, 17 aa, Cryptosporidium parvum
SCFQSNDGYFVFKEGKM

SEQ ID NO: 2237524 - protein, 22 aa, Cryptosporidium parvum
SCGELAIRVLIGLLKNELLQEE

SEQ ID NO: 2237525 - protein, 18 aa, Cryptosporidium parvum
SCGVMRPDLVMRSIIPAV

SEQ ID NO: 2237526 - protein, 19 aa, Cryptosporidium parvum
SCITLRTGTLLQCASLLVL

SEQ ID NO: 2237527 - protein, 19 aa, Cryptosporidium parvum
SCIWACIPSQRLQSLIEIA

SEQ ID NO: 2237528 - protein, 25 aa, Cryptosporidium parvum
SCKIIYKIILWLLKYSKNIDEPLSV

SEQ ID NO: 2237529 - protein, 17 aa, Cryptosporidium parvum
SCKKVIFSCFLLVIFLA

SEQ ID NO: 2237530 - protein, 20 aa, Cryptosporidium parvum
SCKYLIMLLNPWDLPIDCIS

SEQ ID NO: 2237531 - protein, 18 aa, Cryptosporidium parvum
SCLCSTTLRTNNRGPMII

SEQ ID NO: 2237532 - protein, 19 aa, Cryptosporidium parvum
SCLHYCLSKSLTNAHLLFI

SEQ ID NO: 2237533 - protein, 22 aa, Cryptosporidium parvum
SCLKCGNSFIYPSLSRVLFLIF

SEQ ID NO: 2237534 - protein, 19 aa, Cryptosporidium parvum
SCLLGTISILSYKENPFYQ

SEQ ID NO: 2237535 - protein, 19 aa, Cryptosporidium parvum
SCLMGISILLLSMLSSKIK

SEQ ID NO: 2237536 - protein, 22 aa, Cryptosporidium parvum
SCLPLNFLECELFSKYNGNIDI

SEQ ID NO: 2237537 - protein, 22 aa, Cryptosporidium parvum
SCLPNLRYLNGRELTALQRKRN

SEQ ID NO: 2237538 - protein, 21 aa, Cryptosporidium parvum
SCMDKRSSFEILIKTLNQAAS

SEQ ID NO: 2237539 - protein, 21 aa, Cryptosporidium parvum
SCNDLDLWLRYNAYLRKSRLE

SEQ ID NO: 2237540 - protein, 25 aa, Cryptosporidium parvum
SCNEIKVIYLISLIFRLFSKPRIKI

SEQ ID NO: 2237541 - protein, 22 aa, Cryptosporidium parvum
SCRRGHPKIYSYCSISLCRMIG

SEQ ID NO: 2237542 - protein, 22 aa, Cryptosporidium parvum
SCSFAIKYRPLVFDNILTETIK

SEQ ID NO: 2237543 - protein, 24 aa, Cryptosporidium parvum
SCSPFGKSISCFEPALYYDLVRFM

SEQ ID NO: 2237544 - protein, 22 aa, Cryptosporidium parvum
SCTGRRCGIFRTFSCSPTSVSL

SEQ ID NO: 2237545 - protein, 18 aa, Cryptosporidium parvum
SCVIEWNSSYHLLNIVQV

SEQ ID NO: 2237546 - protein, 23 aa, Cryptosporidium parvum
SCYEYLKRLKFKFIENRDLTNFI

SEQ ID NO: 2237547 - protein, 18 aa, Cryptosporidium parvum
SCYYDIFFPPPITNQPSM

SEQ ID NO: 2237548 - protein, 26 aa, Cryptosporidium parvum
SDAAAPWRILEYIYGLVCNIQPIDFV

SEQ ID NO: 2237549 - protein, 20 aa, Cryptosporidium parvum
SDAFKRGEAILHSYQRKHSP

SEQ ID NO: 2237550 - protein, 30 aa, Cryptosporidium parvum; identical to SEQ ID NO: 2180982

SEQ ID NO: 2237551 - protein, 23 aa, Cryptosporidium parvum
SDDPSSICQMILKSKSIVAQNPS

SEQ ID NO: 2237552 - protein, 21 aa, Cryptosporidium parvum
SDELITWAGRHQWKDPHLLAF

SEQ ID NO: 2237553 - protein, 24 aa, Cryptosporidium parvum
SDENLRLVPIFSFEDKPGTIDEGT

SEQ ID NO: 2237554 - protein, 27 aa, Cryptosporidium parvum
SDERFPWYVEPIIRPVYRRIYPEPSLY

SEQ ID NO: 2237555 - protein, 22 aa, Cryptosporidium parvum
SDEVRGGSKLSLRNVAITSDIP

SEQ ID NO: 2237556 - protein, 26 aa, Cryptosporidium parvum
SDFKIRRKHCIGGLSVVCKNKLNPKV

SEQ ID NO: 2237557 - protein, 23 aa, Cryptosporidium parvum
SDFSGEINIAFVINSGINNKLHN

SEQ ID NO: 2237558 - protein, 30 aa, Cryptosporidium parvum
SDGTAIFNWRFVFNIPVPCHFPILRLQVWN

SEQ ID NO: 2237559 - protein, 18 aa, Cryptosporidium parvum
SDIFPNIGTHFLEHNIIR

SEQ ID NO: 2237560 - protein, 17 aa, Cryptosporidium parvum
SDIFSFTILSNDKETDL

SEQ ID NO: 2237561 - protein, 19 aa, Cryptosporidium parvum
SDIQFFWGYSLAILAFLTS

SEQ ID NO: 2237562 - protein, 28 aa, Cryptosporidium parvum
SDIVLCSGIFEWYTPLSLNSTIVEIYPH

SEQ ID NO: 2237563 - protein, 20 aa, Cryptosporidium parvum
SDIWNEWFILIKKWETTKGI

SEQ ID NO: 2237564 - protein, 24 aa, Cryptosporidium parvum
SDIYRPLFKNIFIIGRRGWIQNSF

SEQ ID NO: 2237565 - protein, 22 aa, Cryptosporidium parvum
SDKSFKLSFKRKISGEYYEPFK

SEQ ID NO: 2237566 - protein, 26 aa, Cryptosporidium parvum
SDLEFYILYCRFLFLIPTIISLIMII

SEQ ID NO: 2237567 - protein, 20 aa, Cryptosporidium parvum
SDLFFKRPSKVFEEKKEEEE

SEQ ID NO: 2237568 - protein, 34 aa, Cryptosporidium parvum; identical to SEQ ID NO: 2181028

SEQ ID NO: 2237569 - protein, 24 aa, Cryptosporidium parvum
SDLSYIKVRSWRLFSKSHMYYGSS

SEQ ID NO: 2237570 - protein, 17 aa, Cryptosporidium parvum
SDLYYIFLLASNIKLNY

SEQ ID NO: 2237571 - protein, 17 aa, Cryptosporidium parvum
SDMNLDLICRVPIQCKL

SEQ ID NO: 2237572 - protein, 18 aa, Cryptosporidium parvum
SDNLAFAININYWSSIIS

SEQ ID NO: 2237573 - protein, 24 aa, Cryptosporidium parvum
SDPFKIFIWLCMYAHDPHIYNGVL

SEQ ID NO: 2237574 - protein, 26 aa, Cryptosporidium parvum
SDPGLLRKASIYNILSKLYVKLPYSD

SEQ ID NO: 2237575 - protein, 24 aa, Cryptosporidium parvum
SDPILFCSLIGIYLARDYSYIQSE

SEQ ID NO: 2237576 - protein, 25 aa, Cryptosporidium parvum
SDPKFIIQPEFKWVPLKVNNAKIPV

SEQ ID NO: 2237577 - protein, 17 aa, Cryptosporidium parvum
SDQEVDDEFTFDSDGHI

SEQ ID NO: 2237578 - protein, 25 aa, Cryptosporidium parvum
SDQSKIYASICGLLLGSVPSTSLNK

SEQ ID NO: 2237579 - protein, 23 aa, Cryptosporidium parvum
SDTYRLVLFLVQVFTGIQMLEVT

SEQ ID NO: 2237580 - protein, 17 aa, Cryptosporidium parvum
SDVLAIDLFTGRILSNS

SEQ ID NO: 2237581 - protein, 21 aa, Cryptosporidium parvum
SDYGGCCDCGDEQAWNRDGFC

SEQ ID NO: 2237582 - protein, 23 aa, Cryptosporidium parvum
SDYICCPFCKNVSVLYQGPQSIQ

SEQ ID NO: 2237583 - protein, 18 aa, Cryptosporidium parvum
SDYKRFKVGKEVMFKDNL

SEQ ID NO: 2237584 - protein, 17 aa, Cryptosporidium parvum
SDYYPLIKILKRFINSF

SEQ ID NO: 2237585 - protein, 25 aa, Cryptosporidium parvum
SEAAELRSQYILRRIKENNCIKNTN

SEQ ID NO: 2237586 - protein, 18 aa, Cryptosporidium parvum
SECKTCGSNPIPFFKAGI

SEQ ID NO: 2237587 - protein, 24 aa, Cryptosporidium parvum
SEDKLSLPILHYISIGRPFFAFNL

SEQ ID NO: 2237588 - protein, 25 aa, Cryptosporidium parvum
SEEACRIFRGFNYLREGGFIIRFTN

SEQ ID NO: 2237589 - protein, 18 aa, Cryptosporidium parvum
SEELKSDISGVVVYAIED

SEQ ID NO: 2237590 - protein, 20 aa, Cryptosporidium parvum
SEFAQCIPLSVIKQLERQLG

SEQ ID NO: 2237591 - protein, 20 aa, Cryptosporidium parvum
SEFDHLFILDNCFRSIDVPV

SEQ ID NO: 2237592 - protein, 17 aa, Cryptosporidium parvum
SEFELIKNIKLKNWEKI

SEQ ID NO: 2237593 - protein, 25 aa, Cryptosporidium parvum
SEFELLYATFCRTFGLEMEVVTYND

SEQ ID NO: 2237594 - protein, 19 aa, Cryptosporidium parvum
SEFGEDLGFEYTILESNKI

SEQ ID NO: 2237595 - protein, 20 aa, Cryptosporidium parvum
SEFIKLTVSLAMIFITTAKK

SEQ ID NO: 2237596 - protein, 23 aa, Cryptosporidium parvum
SEFKGCTILTIAHRIKTIINYDK

SEQ ID NO: 2237597 - protein, 17 aa, Cryptosporidium parvum
SEFLLNRILWIPEYENF

SEQ ID NO: 2237598 - protein, 19 aa, Cryptosporidium parvum
SEFYYYWSKFKYNIRRFSY

SEQ ID NO: 2237599 - protein, 27 aa, Cryptosporidium parvum
SEGQFCMGMVYTLFPFLDSLECITNSH

SEQ ID NO: 2237600 - protein, 22 aa, Cryptosporidium parvum
SEGSRILGYFFEDFVEFENKLS

SEQ ID NO: 2237601 - protein, 21 aa, Cryptosporidium parvum
SEGYSAGALKHGPFALIDKDS

SEQ ID NO: 2237602 - protein, 22 aa, Cryptosporidium parvum
SEHLALFVVFEFILKVLALFYW

SEQ ID NO: 2237603 - protein, 19 aa, Cryptosporidium parvum
SEICMPYTVLPAIMNEYRI

SEQ ID NO: 2237604 - protein, 19 aa, Cryptosporidium parvum
SEIFCDSLLLNITCVLGYV

SEQ ID NO: 2237605 - protein, 26 aa, Cryptosporidium parvum
SEIGVKTSDKWTRYLIDANVCNFELV

SEQ ID NO: 2237606 - protein, 21 aa, Cryptosporidium parvum
SEIKTLIRISNKIEYSFYNNI

SEQ ID NO: 2237607 - protein, 21 aa, Cryptosporidium parvum
SEILLFPSILILKLLSIQNYE

SEQ ID NO: 2237608 - protein, 21 aa, Cryptosporidium parvum
SEILPILGSFSISHYIRNEIL

SEQ ID NO: 2237609 - protein, 20 aa, Cryptosporidium parvum
SEINLVLILSTSMFDLPDFF

SEQ ID NO: 2237610 - protein, 23 aa, Cryptosporidium parvum
SEINLVYLDWAIKSSMISPENII

SEQ ID NO: 2237611 - protein, 19 aa, Cryptosporidium parvum
SEIRMLVSLSSYLETISKS

SEQ ID NO: 2237612 - protein, 17 aa, Cryptosporidium parvum
SEISIPLCEYLKEYKRR

SEQ ID NO: 2237613 - protein, 24 aa, Cryptosporidium parvum
SEISSLYLKLVFEIDYVSGSKNDH

SEQ ID NO: 2237614 - protein, 19 aa, Cryptosporidium parvum
SEISTWKVAWMIFSAFKSS

SEQ ID NO: 2237615 - protein, 26 aa, Cryptosporidium parvum
SEKDLPWLKPGLEYSGVSFQEFNFIM

SEQ ID NO: 2237616 - protein, 26 aa, Cryptosporidium parvum
SEKGKEIFSNYGFLIVERYKYFSRKY

SEQ ID NO: 2237617 - protein, 22 aa, Cryptosporidium parvum
SEKSENCYFVLGKYYKLRKSVG

SEQ ID NO: 2237618 - protein, 28 aa, Cryptosporidium parvum
SEKSTYWFKCIQSLCYYAKIEEIYLSIY

SEQ ID NO: 2237619 - protein, 21 aa, Cryptosporidium parvum
SELDFLGWFSVASFFTLATVI

SEQ ID NO: 2237620 - protein, 23 aa, Cryptosporidium parvum
SELFERKPGFSFFLEEKQTGIVF

SEQ ID NO: 2237621 - protein, 20 aa, Cryptosporidium parvum
SELLKVIVFGGLDGIITIFS

SEQ ID NO: 2237622 - protein, 21 aa, Cryptosporidium parvum
SELLPILVFTFINSCFSFFVL

SEQ ID NO: 2237623 - protein, 17 aa, Cryptosporidium parvum
SELNHAVIMIGYGINDN

SEQ ID NO: 2237624 - protein, 26 aa, Cryptosporidium parvum
SELPSLEICRVGGILIFFYLISNYWK

SEQ ID NO: 2237625 - protein, 22 aa, Cryptosporidium parvum
SELQSKCFLGSLYTLYSSNSGI

SEQ ID NO: 2237626 - protein, 24 aa, Cryptosporidium parvum
SELSEQVLEAWAMVSISAKNFVSD

SEQ ID NO: 2237627 - protein, 25 aa, Cryptosporidium parvum
SELTNPRLLAWSVIIKDGQPVYNND

SEQ ID NO: 2237628 - protein, 18 aa, Cryptosporidium parvum
SELVREIAWVIFDEIHYM

SEQ ID NO: 2237629 - protein, 19 aa, Cryptosporidium parvum
SEMIYSLLQPCTFINSQLS

SEQ ID NO: 2237630 - protein, 19 aa, Cryptosporidium parvum
SEMLKRCNATLVYKFSKFQ

SEQ ID NO: 2237631 - protein, 24 aa, Cryptosporidium parvum
SEMSRFSLYEGYTWDNLEVTSKIN

SEQ ID NO: 2237632 - protein, 19 aa, Cryptosporidium parvum
SEMVKYVRPVPGITEYGLS

SEQ ID NO: 2237633 - protein, 30 aa, Cryptosporidium parvum
SENEILFKRLVRILACLNSSITNQSVCLQK

SEQ ID NO: 2237634 - protein, 25 aa, Cryptosporidium parvum
SENEPFHCLYCLKRKQKGKRGRKRK

SEQ ID NO: 2237635 - protein, 23 aa, Cryptosporidium parvum
SENLVFYIFKLVPLFKYTRQAIE

SEQ ID NO: 2237636 - protein, 24 aa, Cryptosporidium parvum
SENSEVIEGFLFEEIMPEVKKRKR

SEQ ID NO: 2237637 - protein, 19 aa, Cryptosporidium parvum
SERIKLLSIELGKEAESIA

SEQ ID NO: 2237638 - protein, 27 aa, Cryptosporidium parvum
SESCCVVAEIPWDRNIGEFQRINNIFN

SEQ ID NO: 2237639 - protein, 24 aa, Cryptosporidium parvum
SESDYKLFFRFLKARQFNVEKSTE

SEQ ID NO: 2237640 - protein, 28 aa, Cryptosporidium parvum
SESFNVCSIKCIFAYIDLLIHLRSSNDI

SEQ ID NO: 2237641 - protein, 20 aa, Cryptosporidium parvum
SESFPWVIEEVVGRYFYMIL

SEQ ID NO: 2237642 - protein, 25 aa, Cryptosporidium parvum
SESYKLLEISLIFAGIVTGILIFVP

SEQ ID NO: 2237643 - protein, 17 aa, Cryptosporidium parvum
SETDYLCIIDFKIAIES

SEQ ID NO: 2237644 - protein, 28 aa, Cryptosporidium parvum
SETESVIKPDEWCWLEKNGECEAKGATY

SEQ ID NO: 2237645 - protein, 24 aa, Cryptosporidium parvum
SETIKEIYQFLSRNLNSIGGTVSP

SEQ ID NO: 2237646 - protein, 23 aa, Cryptosporidium parvum
SETWIYTVFRFFFPDSAPLSWLF

SEQ ID NO: 2237647 - protein, 19 aa, Cryptosporidium parvum
SEVAILVDVGFLYDPPKII

SEQ ID NO: 2237648 - protein, 21 aa, Cryptosporidium parvum
SEVIKTLLINIIFNSMISESN

SEQ ID NO: 2237649 - protein, 18 aa, Cryptosporidium parvum
SEVLRARWNELSNNKNDQ

SEQ ID NO: 2237650 - protein, 31 aa, Cryptosporidium parvum
SEWNYKVLFLFLRIIGLTLFVEHLLIHTIKI

SEQ ID NO: 2237651 - protein, 26 aa, Cryptosporidium parvum
SEWRFSENFIGVILLPLVGNAAEHIT

SEQ ID NO: 2237652 - protein, 27 aa, Cryptosporidium parvum
SEYKLDKSFLHIGSAFFSMAIAEILSD

SEQ ID NO: 2237653 - protein, 26 aa, Cryptosporidium parvum
SEYRSRWMIAMHPFRVTVSYNEKGKQ

SEQ ID NO: 2237654 - protein, 18 aa, Cryptosporidium parvum
SEYWSEFFKKYGGESNRA

SEQ ID NO: 2237655 - protein, 19 aa, Cryptosporidium parvum
SEYYILRVPFSRFVSLHTS

SEQ ID NO: 2237656 - protein, 27 aa, Cryptosporidium parvum
SFAGAYKYAVSNGIKTDNVYGLPVDEI

SEQ ID NO: 2237657 - protein, 25 aa, Cryptosporidium parvum
SFALFKIRGMRGIISEEDFEVLQQK

SEQ ID NO: 2237658 - protein, 32 aa, Cryptosporidium parvum
SFARFKDKVIRFTLCFFDIFGLAHGKNRVNVA

SEQ ID NO: 2237659 - protein, 24 aa, Cryptosporidium parvum
SFDALKYRFQRTFNNSSPVIILQQ

SEQ ID NO: 2237660 - protein, 18 aa, Cryptosporidium parvum
SFDLSSYLMRSRKLNSKV

SEQ ID NO: 2237661 - protein, 27 aa, Cryptosporidium parvum
SFEDWKRRVIFHANIVWSPKQIYMQSV

SEQ ID NO: 2237662 - protein, 18 aa, Cryptosporidium parvum
SFELFTFCIVEDSQNSID

SEQ ID NO: 2237663 - protein, 53 aa, Cryptosporidium parvum
SFESANKIILCFPHLRAICVHLGMKNDPIFNWELLKNIWLPFRLISKNEESLV

SEQ ID NO: 2237664 - protein, 22 aa, Cryptosporidium parvum
SFFEKRLDFLLSNIHEKKINFS

SEQ ID NO: 2237665 - protein, 19 aa, Cryptosporidium parvum
SFFNSIKFKRFKKRYAGVL

SEQ ID NO: 2237666 - protein, 18 aa, Cryptosporidium parvum
SFFPGRHYTPALDFGFMI

SEQ ID NO: 2237667 - protein, 19 aa, Cryptosporidium parvum
SFFSIKLLKRVFLLGNFIT

SEQ ID NO: 2237668 - protein, 19 aa, Cryptosporidium parvum
SFFTNFCVVLSCYISAIGP

SEQ ID NO: 2237669 - protein, 38 aa, Cryptosporidium parvum; identical to SEQ ID NO: 2127342

SEQ ID NO: 2237670 - protein, 19 aa, Cryptosporidium parvum
SFGELLGIVHCHIYYLNEI

SEQ ID NO: 2237671 - protein, 23 aa, Cryptosporidium parvum
SFGIFCGVLGYIGCTISNSRCVY

SEQ ID NO: 2237672 - protein, 20 aa, Cryptosporidium parvum
SFIEMCFRQTQTPAYQTGHI

SEQ ID NO: 2237673 - protein, 23 aa, Cryptosporidium parvum
SFIERFSQFYLLLVNLLIINFSK

SEQ ID NO: 2237674 - protein, 18 aa, Cryptosporidium parvum
SFILGNRMLYNFKSKKCL

SEQ ID NO: 2237675 - protein, 18 aa, Cryptosporidium parvum
SFIPMIITTLIFGLIVYI

SEQ ID NO: 2237676 - protein, 25 aa, Cryptosporidium parvum
SFIPYIIGLVLFVWLLIGDSFVPAY

SEQ ID NO: 2237677 - protein, 19 aa, Cryptosporidium parvum
SFISVLFVDLFGKDYLGNE

SEQ ID NO: 2237678 - protein, 27 aa, Cryptosporidium parvum
SFITTCLFCLLGIIVVLYYFKEYRFYP

SEQ ID NO: 2237679 - protein, 20 aa, Cryptosporidium parvum
SFKNDQCFNFSDILEEKSYF

SEQ ID NO: 2237680 - protein, 22 aa, Cryptosporidium parvum
SFLCSSKSFSVETCVESVEMNI

SEQ ID NO: 2237681 - protein, 26 aa, Cryptosporidium parvum
SFLNSFKMKFSVIIAFFQMTLGVILK

SEQ ID NO: 2237682 - protein, 22 aa, Cryptosporidium parvum
SFLTIFHKFFRKFNFSVKSNYG

SEQ ID NO: 2237683 - protein, 20 aa, Cryptosporidium parvum
SFLTSVCWFAIGADAFSNGN

SEQ ID NO: 2237684 - protein, 27 aa, Cryptosporidium parvum
SFLVLRDCIYIVFSLIYYSKSRDLDDF

SEQ ID NO: 2237685 - protein, 33 aa, Cryptosporidium parvum
SFNFPSIRMPLFLKWLRYSAFAVLYPIGIFSEV

SEQ ID NO: 2237686 - protein, 18 aa, Cryptosporidium parvum
SFNFSFFGSHWLNQNNSM

SEQ ID NO: 2237687 - protein, 23 aa, Cryptosporidium parvum
SFNLCNYCLNFGFNHNIEDIKLI

SEQ ID NO: 2237688 - protein, 21 aa, Cryptosporidium parvum
SFNLYCMFVQLITLITKLRDL

SEQ ID NO: 2237689 - protein, 25 aa, Cryptosporidium parvum
SFPEIGHILNLLRYYFKQVNPEKDQ

SEQ ID NO: 2237690 - protein, 27 aa, Cryptosporidium parvum
SFPIVCESLQIWGHLRLHDGSTANNHT

SEQ ID NO: 2237691 - protein, 24 aa, Cryptosporidium parvum
SFSANPLIHYSINGLSYYHSHHAQ

SEQ ID NO: 2237692 - protein, 25 aa, Cryptosporidium parvum
SFSCKCLIRVLFIESMESTRNLGIL

SEQ ID NO: 2237693 - protein, 18 aa, Cryptosporidium parvum
SFSEAYKINKKDAMENQQ

SEQ ID NO: 2237694 - protein, 18 aa, Cryptosporidium parvum
SFSILKLNFDMETDLEPS

SEQ ID NO: 2237695 - protein, 37 aa, Cryptosporidium parvum
SFSLMILFKWIHIFYIEIKYLFWIWKSNYLQNAPSTE

SEQ ID NO: 2237696 - protein, 18 aa, Cryptosporidium parvum
SFSSLKIPIAIEYIEPIL

SEQ ID NO: 2237697 - protein, 21 aa, Cryptosporidium parvum
SFSYMPCPNYIYLNIDAKAKQ

SEQ ID NO: 2237698 - protein, 26 aa, Cryptosporidium parvum
SFTTFKHPLLRITALELMSLLFELEF

SEQ ID NO: 2237699 - protein, 22 aa, Cryptosporidium parvum
SFVLLFCLFFYQLDKLHAEVIY

SEQ ID NO: 2237700 - protein, 25 aa, Cryptosporidium parvum
SFVNACTVISAFIKAFAFEISNYSF

SEQ ID NO: 2237701 - protein, 30 aa, Cryptosporidium parvum; identical to SEQ ID NO: 2127360

SEQ ID NO: 2237702 - protein, 18 aa, Cryptosporidium parvum
SFYEFILIIIQEIDFIKN

SEQ ID NO: 2237703 - protein, 18 aa, Cryptosporidium parvum
SFYKYEFSDHLLQIKYLI

SEQ ID NO: 2237704 - protein, 21 aa, Cryptosporidium parvum
SGAILSYIMCKGMNRDFVSVL

SEQ ID NO: 2237705 - protein, 18 aa, Cryptosporidium parvum
SGALGCPVSASIAYAQAM

SEQ ID NO: 2237706 - protein, 18 aa, Cryptosporidium parvum
SGDQKLLVHKDWDSIIKA

SEQ ID NO: 2237707 - protein, 27 aa, Cryptosporidium parvum
SGEESHHLRKSCSFLVDEFFRSELFER

SEQ ID NO: 2237708 - protein, 23 aa, Cryptosporidium parvum
SGEFFNIRYEKISKFSQNLISLR

SEQ ID NO: 2237709 - protein, 20 aa, Cryptosporidium parvum
SGELITWGAGYYGRLGTNST

SEQ ID NO: 2237710 - protein, 18 aa, Cryptosporidium parvum
SGERKGLFVRIYRDLSRL

SEQ ID NO: 2237711 - protein, 19 aa, Cryptosporidium parvum
SGFETCIRTWWKYTCKITG

SEQ ID NO: 2237712 - protein, 19 aa, Cryptosporidium parvum
SGGDAYRAETFLATLEKVK

SEQ ID NO: 2237713 - protein, 27 aa, Cryptosporidium parvum
SGGQRARICLARALYSLPDYLFYNQES

SEQ ID NO: 2237714 - protein, 19 aa, Cryptosporidium parvum
SGGQRARISLARALYSLPI

SEQ ID NO: 2237715 - protein, 25 aa, Cryptosporidium parvum
SGGRQSSLWNALNFLSSFSNKEEKS

SEQ ID NO: 2237716 - protein, 26 aa, Cryptosporidium parvum
SGGYGKMRIALCLNKIITSLQEKNQN

SEQ ID NO: 2237717 - protein, 17 aa, Cryptosporidium parvum
SGIKITPYYAGHVLGAS

SEQ ID NO: 2237718 - protein, 23 aa, Cryptosporidium parvum
SGILNFFLGIIIIWCIHTTSPIA

SEQ ID NO: 2237719 - protein, 19 aa, Cryptosporidium parvum
SGISSLPFFARAWIAALPL

SEQ ID NO: 2237720 - protein, 23 aa, Cryptosporidium parvum
SGIYPSFISLGWQRIESLMNTCR

SEQ ID NO: 2237721 - protein, 22 aa, Cryptosporidium parvum
SGKDPKVRWEEIRQGIMDLRML

SEQ ID NO: 2237722 - protein, 25 aa, Cryptosporidium parvum
SGKSYPKKLAFSFLDEIKRLFIEEL

SEQ ID NO: 2237723 - protein, 24 aa, Cryptosporidium parvum
SGKYASCFSKNHFSIFSLFNKHKL

SEQ ID NO: 2237724 - protein, 24 aa, Cryptosporidium parvum
SGKYFSGSIAGFISGKAGSQSKSS

SEQ ID NO: 2237725 - protein, 19 aa, Cryptosporidium parvum
SGLNSLFLPSIIRHKIDLV

SEQ ID NO: 2237726 - protein, 19 aa, Cryptosporidium parvum
SGLPGIFIVYDFQPFLLQK

SEQ ID NO: 2237727 - protein, 22 aa, Cryptosporidium parvum
SGLPSKRCESIWERILILDSNI

SEQ ID NO: 2237728 - protein, 24 aa, Cryptosporidium parvum
SGLTKEWDEFLTLYQHRNEEINND

SEQ ID NO: 2237729 - protein, 33 aa, Cryptosporidium parvum
SGNSSYRSLNWWRLKRKFSRAIQSRVQRGGGGI

SEQ ID NO: 2237730 - protein, 22 aa, Cryptosporidium parvum
SGQIFFAISILLSFPLMIFPVK

SEQ ID NO: 2237731 - protein, 23 aa, Cryptosporidium parvum
SGSETPFTLSLEVNPVYIQLIDI

SEQ ID NO: 2237732 - protein, 18 aa, Cryptosporidium parvum
SGSGFHWNLETELINFEN

SEQ ID NO: 2237733 - protein, 19 aa, Cryptosporidium parvum
SGSIGGFFIVFSLSIGIIH

SEQ ID NO: 2237734 - protein, 18 aa, Cryptosporidium parvum
SGSRCARGGSSKEPMLLN

SEQ ID NO: 2237735 - protein, 20 aa, Cryptosporidium parvum
SGSVTIKFTTRFERSTDTYS

SEQ ID NO: 2237736 - protein, 18 aa, Cryptosporidium parvum
SGTPLPISIIKSINTNIP

SEQ ID NO: 2237737 - protein, 17 aa, Cryptosporidium parvum
SGVKIIDLEVRYRRPNS

SEQ ID NO: 2237738 - protein, 18 aa, Cryptosporidium parvum
SGVMPPPIQSSVSMPHGV

SEQ ID NO: 2237739 - protein, 20 aa, Cryptosporidium parvum
SGVQCIYSIIGFPTYFKIFD

SEQ ID NO: 2237740 - protein, 26 aa, Cryptosporidium parvum
SGYFEMFEIIGVFLIITYLSIIFIYS

SEQ ID NO: 2237741 - protein, 23 aa, Cryptosporidium parvum
SGYMAAVCKYGCGEMGVTYPYYY

SEQ ID NO: 2237742 - protein, 29 aa, Cryptosporidium parvum
SGYSCSFLARRFGGFLGCEKLLKDLAQDS

SEQ ID NO: 2237743 - protein, 23 aa, Cryptosporidium parvum
SHCIDKLKFFIGYTQLQNEKEFQ

SEQ ID NO: 2237744 - protein, 20 aa, Cryptosporidium parvum
SHCMAFLVVCVIALNSSKYI

SEQ ID NO: 2237745 - protein, 25 aa, Cryptosporidium parvum
SHFDLQFIFTFIFWGKICVLTSISW

SEQ ID NO: 2237746 - protein, 31 aa, Cryptosporidium parvum
SHFKLVYLKLCLFCKSQILAILKSFFISLKF

SEQ ID NO: 2237747 - protein, 25 aa, Cryptosporidium parvum
SHHLRFCKSKIFSRIFHYNYNFEDY

SEQ ID NO: 2237748 - protein, 26 aa, Cryptosporidium parvum
SHHLSDLFVYFGISRFTLYYIKHNIT

SEQ ID NO: 2237749 - protein, 26 aa, Cryptosporidium parvum
SHIITFSGTFLISFLVFIPFLIVILI

SEQ ID NO: 2237750 - protein, 18 aa, Cryptosporidium parvum
SHIPYKCTKEQYQILKGK

SEQ ID NO: 2237751 - protein, 26 aa, Cryptosporidium parvum
SHISAHIGSLLAWLFQNMAQHVEQDR

SEQ ID NO: 2237752 - protein, 27 aa, Cryptosporidium parvum
SHKKSAYCWNYEISIQFSDLEVFCQSL

SEQ ID NO: 2237753 - protein, 28 aa, Cryptosporidium parvum
SHLDNELGWYWYHLGIYNLILIKIIYLN

SEQ ID NO: 2237754 - protein, 22 aa, Cryptosporidium parvum
SHNDTWIKGGMEFYLMLLQFIY

SEQ ID NO: 2237755 - protein, 25 aa, Cryptosporidium parvum
SHNILPCFLIGDLLFLKKGVTGVWN

SEQ ID NO: 2237756 - protein, 19 aa, Cryptosporidium parvum
SHNIPMYWLVPLLVSCLGS

SEQ ID NO: 2237757 - protein, 24 aa, Cryptosporidium parvum
SHQLWKFIIDSSILFSISCFSSTP

SEQ ID NO: 2237758 - protein, 26 aa, Cryptosporidium parvum
SHQNFLIPLVIKKLLDTLVIHRDLFL

SEQ ID NO: 2237759 - protein, 21 aa, Cryptosporidium parvum
SHVEKLLCCNIPSFLGISPNS

SEQ ID NO: 2237760 - protein, 24 aa, Cryptosporidium parvum
SHYKPPTLYTHQTFDMVDRQIAQE

SEQ ID NO: 2237761 - protein, 23 aa, Cryptosporidium parvum
SIAGIRSESCIVSELNFTSTTGF

SEQ ID NO: 2237762 - protein, 34 aa, Cryptosporidium parvum
SIAGLGLLGGLGYGLKRKRTRGGDLTGDSIGMRN

SEQ ID NO: 2237763 - protein, 21 aa, Cryptosporidium parvum
SIAHLAVPFGFNISEIENINE

SEQ ID NO: 2237764 - protein, 22 aa, Cryptosporidium parvum
SIAKENICWSHGHFVAIFYSLI

SEQ ID NO: 2237765 - protein, 18 aa, Cryptosporidium parvum
SIAPCDFVLLSGSITVNE

SEQ ID NO: 2237766 - protein, 24 aa, Cryptosporidium parvum
SIASNRLSYFYGIKGPSITIDTAC

SEQ ID NO: 2237767 - protein, 24 aa, Cryptosporidium parvum
SIDDEMILYLSLEHQLKINNETMV

SEQ ID NO: 2237768 - protein, 31 aa, Cryptosporidium parvum
SIDRKTMFRICNFVSIFLEILIRGGFIIFVF

SEQ ID NO: 2237769 - protein, 18 aa, Cryptosporidium parvum
SIDVDFWITNSFSNFSGI

SEQ ID NO: 2237770 - protein, 24 aa, Cryptosporidium parvum
SIDYFPFAIALTILAKNLFSVINS

SEQ ID NO: 2237771 - protein, 18 aa, Cryptosporidium parvum
SIEISKLLLKFGADPNEK

SEQ ID NO: 2237772 - protein, 18 aa, Cryptosporidium parvum
SIFCICIYLFGKVEASLT

SEQ ID NO: 2237773 - protein, 18 aa, Cryptosporidium parvum
SIFEAIERIVLPPSNDQY

SEQ ID NO: 2237774 - protein, 22 aa, Cryptosporidium parvum
SIFKPHAMSAIFIGKLNNSSLI

SEQ ID NO: 2237775 - protein, 23 aa, Cryptosporidium parvum
SIFRVSIGFCYSKEAENLKKLKV

SEQ ID NO: 2237776 - protein, 25 aa, Cryptosporidium parvum
SIFSHPLVIIFIFILVVCMFAGGSL

SEQ ID NO: 2237777 - protein, 30 aa, Cryptosporidium parvum
SIFSSPLFLCLSILLALVVLIDFIIRKNNA

SEQ ID NO: 2237778 - protein, 17 aa, Cryptosporidium parvum
SIFTRTSLIFLENINNG

SEQ ID NO: 2237779 - protein, 23 aa, Cryptosporidium parvum
SIFVNFPSVWGIKRSRPANKIKK

SEQ ID NO: 2237780 - protein, 21 aa, Cryptosporidium parvum
SIGCPCNLNPYSKLCGCYINP

SEQ ID NO: 2237781 - protein, 26 aa, Cryptosporidium parvum
SIGENGKILWKRKILEEGTFYPSRVF

SEQ ID NO: 2237782 - protein, 17 aa, Cryptosporidium parvum
SIIARLAKNRGHYITSI

SEQ ID NO: 2237783 - protein, 27 aa, Cryptosporidium parvum
SIIFTFKLKFFLGTMIFQNIRSYYSHQ

SEQ ID NO: 2237784 - protein, 19 aa, Cryptosporidium parvum
SIIICIVVSLISIVTQGKN

SEQ ID NO: 2237785 - protein, 18 aa, Cryptosporidium parvum
SIIIKCNLQQFILTINDD

SEQ ID NO: 2237786 - protein, 20 aa, Cryptosporidium parvum
SIIKKCKRIYHLSDGILKEI

SEQ ID NO: 2237787 - protein, 24 aa, Cryptosporidium parvum
SIILLPDTVRLVFLSATIPNHLEF

SEQ ID NO: 2237788 - protein, 20 aa, Cryptosporidium parvum
SIIRLIHFIFKRALRKFPSD

SEQ ID NO: 2237789 - protein, 27 aa, Cryptosporidium parvum
SIISQLYLKFSLIWKPYTDILIKLVKS

SEQ ID NO: 2237790 - protein, 36 aa, Cryptosporidium parvum
SIITSPPWWMVWQSQFYPRLSIEKNIKEQDINLLEN

SEQ ID NO: 2237791 - protein, 23 aa, Cryptosporidium parvum
SIKERRRIIGVLPQIPLLLKGWT

SEQ ID NO: 2237792 - protein, 32 aa, Cryptosporidium parvum
SIKMLLDILILKSFYILHIWKVKDHSLLGRPC

SEQ ID NO: 2237793 - protein, 23 aa, Cryptosporidium parvum
SIKSRLEVGVGYSMYQDVYILNS

SEQ ID NO: 2237794 - protein, 21 aa, Cryptosporidium parvum
SIKSVKLIYCEDDSDLFQDNR

SEQ ID NO: 2237795 - protein, 20 aa, Cryptosporidium parvum
SILCFPYIFHIPELELAAKR

SEQ ID NO: 2237796 - protein, 28 aa, Cryptosporidium parvum
SILDGQMSLRLGIVVNLLYGNQSVLVLK

SEQ ID NO: 2237797 - protein, 26 aa, Cryptosporidium parvum
SILECLRFSLFGEISIPVFRDIISRD

SEQ ID NO: 2237798 - protein, 17 aa, Cryptosporidium parvum
SILEFIEMLNIKKLIFE

SEQ ID NO: 2237799 - protein, 17 aa, Cryptosporidium parvum
SILFHMLLFIVGKTDEI

SEQ ID NO: 2237800 - protein, 20 aa, Cryptosporidium parvum
SILFKDSRIKIGIGSSSCFQ

SEQ ID NO: 2237801 - protein, 33 aa, Cryptosporidium parvum
SILGLDYTRLFSAFCHYHGLLVGSGPGAGAGVG

SEQ ID NO: 2237802 - protein, 20 aa, Cryptosporidium parvum
SILPLLSIIWLFKDISEKII

SEQ ID NO: 2237803 - protein, 18 aa, Cryptosporidium parvum
SILQEIYLLLNYNNEYFK

SEQ ID NO: 2237804 - protein, 17 aa, Cryptosporidium parvum
SILRIEILSGKTISIES

SEQ ID NO: 2237805 - protein, 21 aa, Cryptosporidium parvum
SILRYSLCELTVFSIGDWGEK

SEQ ID NO: 2237806 - protein, 30 aa, Cryptosporidium parvum
SILSCFCLHYLWKYFEKEFGIITSLLSISI

SEQ ID NO: 2237807 - protein, 18 aa, Cryptosporidium parvum
SILSELDVLEKCFTRIRL

SEQ ID NO: 2237808 - protein, 21 aa, Cryptosporidium parvum
SILSLLFKIIYLIRILNSLRC

SEQ ID NO: 2237809 - protein, 24 aa, Cryptosporidium parvum
SILSNLLLVLGMSFFAGGIFHHVQ

SEQ ID NO: 2237810 - protein, 25 aa, Cryptosporidium parvum
SILSRNGFCTVPIFINLTFEAIENI

SEQ ID NO: 2237811 - protein, 23 aa, Cryptosporidium parvum
SILYCPLRIFVLCLTTIVVITIL

SEQ ID NO: 2237812 - protein, 25 aa, Cryptosporidium parvum
SIMDTLRFLFALELFSLNFTSLLKA

SEQ ID NO: 2237813 - protein, 30 aa, Cryptosporidium parvum
SIMGTWMITCVIFAHKWIEILIVYMTLISK

SEQ ID NO: 2237814 - protein, 19 aa, Cryptosporidium parvum
SIMKLCIQDGNKLLKLQNE

SEQ ID NO: 2237815 - protein, 20 aa, Cryptosporidium parvum
SIMLCIIQNPLTGIFIGLVV

SEQ ID NO: 2237816 - protein, 25 aa, Cryptosporidium parvum
SINFNLRVTWKKNLYPSSSTRIIKI

SEQ ID NO: 2237817 - protein, 19 aa, Cryptosporidium parvum
SINIPRVLPLGINEERLPE

SEQ ID NO: 2237818 - protein, 24 aa, Cryptosporidium parvum
SINRRFLFPILLNYIKTNNIYSQH

SEQ ID NO: 2237819 - protein, 23 aa, Cryptosporidium parvum
SINTLIFFCIGKIMLVAIYNKKN

SEQ ID NO: 2237820 - protein, 31 aa, Cryptosporidium parvum
SIPDRIIIMIHHFPTFLNVFINSRMETTLVT

SEQ ID NO: 2237821 - protein, 23 aa, Cryptosporidium parvum
SIPIFKEFLLRKDIQDFDIVSAT

SEQ ID NO: 2237822 - protein, 25 aa, Cryptosporidium parvum
SIPTIPCIDLEIFLYNSVSALYFIL

SEQ ID NO: 2237823 - protein, 42 aa, Cryptosporidium parvum
SIPVLACASACGYKSGFINSGCICRFRKLLLIFNYEKNELKL

SEQ ID NO: 2237824 - protein, 23 aa, Cryptosporidium parvum
SIQKCNCLYCQTQRVRIFGNYLN

SEQ ID NO: 2237825 - protein, 23 aa, Cryptosporidium parvum
SIQSSVFPWAFIYNNSGKMIEKD

SEQ ID NO: 2237826 - protein, 18 aa, Cryptosporidium parvum
SIRIDIHELRDLKFNDGT

SEQ ID NO: 2237827 - protein, 20 aa, Cryptosporidium parvum
SIRMLISNYWNYLWDIFLDI

SEQ ID NO: 2237828 - protein, 21 aa, Cryptosporidium parvum
SISLSCLFSVLIFQLSLMLNS

SEQ ID NO: 2237829 - protein, 19 aa, Cryptosporidium parvum
SISPEVIYGLILESFSECN

SEQ ID NO: 2237830 - protein, 17 aa, Cryptosporidium parvum
SISPNFIKPYGIISSSY

SEQ ID NO: 2237831 - protein, 22 aa, Cryptosporidium parvum
SITECFGEKIFGISGTIVSKGN

SEQ ID NO: 2237832 - protein, 22 aa, Cryptosporidium parvum
SIVDILIYLGSFGKNLLGKDSS

SEQ ID NO: 2237833 - protein, 24 aa, Cryptosporidium parvum
SIVKICLIAISILTTGVNHFLAKN

SEQ ID NO: 2237834 - protein, 22 aa, Cryptosporidium parvum
SIVNETPCNIFIRQLNTSSWNH

SEQ ID NO: 2237835 - protein, 21 aa, Cryptosporidium parvum
SIVYFPKTIHLLGRIGDDSAV

SEQ ID NO: 2237836 - protein, 22 aa, Cryptosporidium parvum
SIYFEKEFTEYIIIEMSQTPLI

SEQ ID NO: 2237837 - protein, 23 aa, Cryptosporidium parvum
SIYIAVFGFIFSHFEWKNIPASM

SEQ ID NO: 2237838 - protein, 24 aa, Cryptosporidium parvum
SIYMKNFHWHVAEKITHYLIFLSS

SEQ ID NO: 2237839 - protein, 25 aa, Cryptosporidium parvum
SIYNISGRVISIFLVIFGFIQFLKF

SEQ ID NO: 2237840 - protein, 19 aa, Cryptosporidium parvum
SIYTEKLLRCESCGRNFHL

SEQ ID NO: 2237841 - protein, 19 aa, Cryptosporidium parvum
SKAIVFEDRIIKKWKAQNI

SEQ ID NO: 2237842 - protein, 26 aa, Cryptosporidium parvum
SKALFPSRNQFVWCLLWTTTEYTRTF

SEQ ID NO: 2237843 - protein, 23 aa, Cryptosporidium parvum
SKARVCIFFPIGELFNIMNIYWL

SEQ ID NO: 2237844 - protein, 18 aa, Cryptosporidium parvum
SKASFSWNTLQMGTLWKF

SEQ ID NO: 2237845 - protein, 23 aa, Cryptosporidium parvum
SKAWWICGIPLSVYSLLAEISLL

SEQ ID NO: 2237846 - protein, 17 aa, Cryptosporidium parvum
SKCIKPFLRNVSLILGD

SEQ ID NO: 2237847 - protein, 19 aa, Cryptosporidium parvum
SKCKLGGVKKRPLVKKTPR

SEQ ID NO: 2237848 - protein, 19 aa, Cryptosporidium parvum
SKCQNKCCKSCCRKIQQNL

SEQ ID NO: 2237849 - protein, 20 aa, Cryptosporidium parvum
SKDIFFGLILEFKKISVSIF

SEQ ID NO: 2237850 - protein, 19 aa, Cryptosporidium parvum
SKDILPMITNEKSYIMRIT

SEQ ID NO: 2237851 - protein, 24 aa, Cryptosporidium parvum
SKDKLCGICMSNLVVFGLDFSLKC

SEQ ID NO: 2237852 - protein, 24 aa, Cryptosporidium parvum
SKENIPVRLFNGLNHIISNRDFDN

SEQ ID NO: 2237853 - protein, 19 aa, Cryptosporidium parvum
SKERCKGIGNPNVVYCEPG

SEQ ID NO: 2237854 - protein, 21 aa, Cryptosporidium parvum
SKERCKVYFPYIDYLINLIQN

SEQ ID NO: 2237855 - protein, 17 aa, Cryptosporidium parvum
SKESFSISSQKEHISSN

SEQ ID NO: 2237856 - protein, 20 aa, Cryptosporidium parvum
SKETCIRLTLLGYINEANCA

SEQ ID NO: 2237857 - protein, 21 aa, Cryptosporidium parvum
SKEVKTMLNVFGKRMSSMKFS

SEQ ID NO: 2237858 - protein, 22 aa, Cryptosporidium parvum
SKFAVFVFYAFFILQNSIVNAI

SEQ ID NO: 2237859 - protein, 31 aa, Cryptosporidium parvum
SKFELLRRVLREMPHLIGFEDRLHFYYHYIA

SEQ ID NO: 2237860 - protein, 19 aa, Cryptosporidium parvum
SKFFDPFVFNFSIDVHQCI

SEQ ID NO: 2237861 - protein, 19 aa, Cryptosporidium parvum
SKFHTECFFTASDDCSVAI

SEQ ID NO: 2237862 - protein, 17 aa, Cryptosporidium parvum
SKFLDFEFGDLIIDPEA

SEQ ID NO: 2237863 - protein, 19 aa, Cryptosporidium parvum
SKFNKWKAKRMRKKGINLF

SEQ ID NO: 2237864 - protein, 19 aa, Cryptosporidium parvum
SKFPFPYNGFSSMVLTGAK

SEQ ID NO: 2237865 - protein, 24 aa, Cryptosporidium parvum
SKFTELRSKLSPIQILLKSLNGKQ

SEQ ID NO: 2237866 - protein, 27 aa, Cryptosporidium parvum
SKFWLKLRKEAIGWFIYTIEDPKYSVD

SEQ ID NO: 2237867 - protein, 23 aa, Cryptosporidium parvum
SKGGESFLPLSLNIQALNPSEPS

SEQ ID NO: 2237868 - protein, 20 aa, Cryptosporidium parvum
SKGLIPPKWCKVEKKERMTN

SEQ ID NO: 2237869 - protein, 18 aa, Cryptosporidium parvum
SKGLRPLINLSKVGSGQI

SEQ ID NO: 2237870 - protein, 20 aa, Cryptosporidium parvum
SKGRWSEQVDLLAREEDKSL

SEQ ID NO: 2237871 - protein, 25 aa, Cryptosporidium parvum
SKGYKYKPEFPFIRMVNPSPIKQEY

SEQ ID NO: 2237872 - protein, 27 aa, Cryptosporidium parvum
SKHDCPYISYKIPNSFIAFPTSINTII

SEQ ID NO: 2237873 - protein, 21 aa, Cryptosporidium parvum
SKIEPIWIHRNRVQCVRFHPW

SEQ ID NO: 2237874 - protein, 20 aa, Cryptosporidium parvum
SKIFSRLFGHKGFLNSPYSR

SEQ ID NO: 2237875 - protein, 19 aa, Cryptosporidium parvum
SKIGRFFFEDQIAILEFSI

SEQ ID NO: 2237876 - protein, 26 aa, Cryptosporidium parvum
SKINGMPVIEVWRASKVIVSKRSLGK

SEQ ID NO: 2237877 - protein, 22 aa, Cryptosporidium parvum
SKIPNLRPSSVIQATNLNPTNG

SEQ ID NO: 2237878 - protein, 19 aa, Cryptosporidium parvum
SKIPYKLKKLGGISELSSF

SEQ ID NO: 2237879 - protein, 25 aa, Cryptosporidium parvum
SKISGMPVINVWKAKQVVVSKRSLA

SEQ ID NO: 2237880 - protein, 18 aa, Cryptosporidium parvum
SKITLRNGRIWNLAADLE

SEQ ID NO: 2237881 - protein, 24 aa, Cryptosporidium parvum
SKIVWPGTFSHPFKDFNPTFSANR

SEQ ID NO: 2237882 - protein, 32 aa, Cryptosporidium parvum; identical to SEQ ID NO: 2127495

SEQ ID NO: 2237883 - protein, 25 aa, Cryptosporidium parvum
SKKIGRWDLLDIFNKNLLIIMDGVI

SEQ ID NO: 2237884 - protein, 19 aa, Cryptosporidium parvum
SKKIKILFQKGIQQRLEDI

SEQ ID NO: 2237885 - protein, 25 aa, Cryptosporidium parvum
SKKKWLCGLGVHYVSSSRDHKIFNK

SEQ ID NO: 2237886 - protein, 22 aa, Cryptosporidium parvum
SKKLYFKFVEKISRKNFNNIKY

SEQ ID NO: 2237887 - protein, 18 aa, Cryptosporidium parvum
SKKNFSFNFKNRSLNKEN

SEQ ID NO: 2237888 - protein, 17 aa, Cryptosporidium parvum
SKKSFKMFEEFDQINEF

SEQ ID NO: 2237889 - protein, 20 aa, Cryptosporidium parvum
SKLIEIVKMNFIKNEIPNQK

SEQ ID NO: 2237890 - protein, 19 aa, Cryptosporidium parvum
SKLIFGNSILYLNPKESHY

SEQ ID NO: 2237891 - protein, 28 aa, Cryptosporidium parvum
SKLKAYEWANCCWNYLGTITEINNLSSK

SEQ ID NO: 2237892 - protein, 20 aa, Cryptosporidium parvum
SKLLLFNYLKLNSMKTTLIH

SEQ ID NO: 2237893 - protein, 20 aa, Cryptosporidium parvum
SKLRNSKCKIFVQTNIPYLL

SEQ ID NO: 2237894 - protein, 21 aa, Cryptosporidium parvum
SKLSLIIWMFISSIFTISQPL

SEQ ID NO: 2237895 - protein, 38 aa, Cryptosporidium parvum
SKLSSEILYRCYMKFFRGILRYFLIYGSNHRWVDLNEL

SEQ ID NO: 2237896 - protein, 24 aa, Cryptosporidium parvum
SKLTKRLLLIPIPLLIQLLQAIFM

SEQ ID NO: 2237897 - protein, 21 aa, Cryptosporidium parvum
SKLWGKFKSIPYFVVLEICNE

SEQ ID NO: 2237898 - protein, 29 aa, Cryptosporidium parvum
SKMGFGPWFSFFYYWKFIPLTFYYNIIKS

SEQ ID NO: 2237899 - protein, 31 aa, Cryptosporidium parvum
SKNDMLKFIPLRAVINNVWLESVIRNKEERK

SEQ ID NO: 2237900 - protein, 24 aa, Cryptosporidium parvum
SKNIKASYFFLIWSVWLFTISFLF

SEQ ID NO: 2237901 - protein, 23 aa, Cryptosporidium parvum
SKNKYKFAILAIEFLDKLIKSNI

SEQ ID NO: 2237902 - protein, 21 aa, Cryptosporidium parvum
SKPISEFRIKTAFGGYLTILS

SEQ ID NO: 2237903 - protein, 17 aa, Cryptosporidium parvum
SKPKIFPVFGKRPIEGE

SEQ ID NO: 2237904 - protein, 19 aa, Cryptosporidium parvum
SKQEISMIVKFFQNKDATL

SEQ ID NO: 2237905 - protein, 23 aa, Cryptosporidium parvum
SKRCSNFYCSLEAHFHIAKRLHL

SEQ ID NO: 2237906 - protein, 17 aa, Cryptosporidium parvum
SKREFPDYFQVREAETP

SEQ ID NO: 2237907 - protein, 19 aa, Cryptosporidium parvum
SKRFPRTRNTAVSRSHSTK

SEQ ID NO: 2237908 - protein, 35 aa, Cryptosporidium parvum
SKRKFTFISNEWWKIHKLESVFKGVEIINEIKKRS

SEQ ID NO: 2237909 - protein, 31 aa, Cryptosporidium parvum; identical to SEQ ID NO: 2127507

SEQ ID NO: 2237910 - protein, 22 aa, Cryptosporidium parvum
SKRKSRRRAASNTKKISGVMPP

SEQ ID NO: 2237911 - protein, 18 aa, Cryptosporidium parvum
SKRNNWKITANNVMEAFH

SEQ ID NO: 2237912 - protein, 23 aa, Cryptosporidium parvum
SKRRVGIILIKLSQLFNQNKIYN

SEQ ID NO: 2237913 - protein, 24 aa, Cryptosporidium parvum
SKRVKNCLTYLLVAAFTTIALILI

SEQ ID NO: 2237914 - protein, 30 aa, Cryptosporidium parvum
SKSGDLPEERFCWNYNFLMPLYEGGSSTSK

SEQ ID NO: 2237915 - protein, 21 aa, Cryptosporidium parvum
SKSKLLLFILHTLRQLGIQYT

SEQ ID NO: 2237916 - protein, 20 aa, Cryptosporidium parvum
SKSKVSWTRILQKIRILNIP

SEQ ID NO: 2237917 - protein, 19 aa, Cryptosporidium parvum
SKSSLSIKDISNFNPLSVN

SEQ ID NO: 2237918 - protein, 22 aa, Cryptosporidium parvum
SKSTRFLLVMGELSDKRSFFGR

SEQ ID NO: 2237919 - protein, 25 aa, Cryptosporidium parvum
SKSYKKLPVSYAFHSVMFSEISNIL

SEQ ID NO: 2237920 - protein, 18 aa, Cryptosporidium parvum
SKTSLDFIPSGYKDIKND

SEQ ID NO: 2237921 - protein, 23 aa, Cryptosporidium parvum
SKTVISEAIWCKSIIREDHLREY

SEQ ID NO: 2237922 - protein, 22 aa, Cryptosporidium parvum
SKTWQILSKFWASYLEKNKKSP

SEQ ID NO: 2237923 - protein, 25 aa, Cryptosporidium parvum
SKVLLFRLFCLVFFCTIILYDIFTE

SEQ ID NO: 2237924 - protein, 17 aa, Cryptosporidium parvum
SKVLSWSEGVLRPKSVQ

SEQ ID NO: 2237925 - protein, 21 aa, Cryptosporidium parvum
SKWKSCSKWSNKNKFELENDR

SEQ ID NO: 2237926 - protein, 26 aa, Cryptosporidium parvum
SKWSIYRLVFIYSFLLIMYQFLDILL

SEQ ID NO: 2237927 - protein, 25 aa, Cryptosporidium parvum
SKYAKDAILSLCFSSEGGMISFGGY

SEQ ID NO: 2237928 - protein, 28 aa, Cryptosporidium parvum
SKYDLPDWYKHICIIYASLKEKNRILFE

SEQ ID NO: 2237929 - protein, 19 aa, Cryptosporidium parvum
SKYFIYPFLFQYNTRSNID

SEQ ID NO: 2237930 - protein, 24 aa, Cryptosporidium parvum
SKYGKFIRFKGIFKAKNSIESDHL

SEQ ID NO: 2237931 - protein, 26 aa, Cryptosporidium parvum
SKYIREWRIKAGFKEFNVMVIRNGTW

SEQ ID NO: 2237932 - protein, 21 aa, Cryptosporidium parvum
SKYLEKLNCIINDEFSIVGSF

SEQ ID NO: 2237933 - protein, 27 aa, Cryptosporidium parvum
SKYLWMDAFIFLIRLCGINLSTDRLPS

SEQ ID NO: 2237934 - protein, 26 aa, Cryptosporidium parvum
SKYQAFIVCPCIRNYNELLFYSHFRW

SEQ ID NO: 2237935 - protein, 21 aa, Cryptosporidium parvum
SKYSIKDLMAFPDDSLGRRYG

SEQ ID NO: 2237936 - protein, 25 aa, Cryptosporidium parvum
SLADKRFVLLVGHQRITIIDTWSRL

SEQ ID NO: 2237937 - protein, 25 aa, Cryptosporidium parvum
SLAELKSPINWLFWILDSDRISLLT

SEQ ID NO: 2237938 - protein, 17 aa, Cryptosporidium parvum
SLAIFNNIFKLFLLIIP

SEQ ID NO: 2237939 - protein, 18 aa, Cryptosporidium parvum
SLARTNLNFTLGVKSPLH

SEQ ID NO: 2237940 - protein, 23 aa, Cryptosporidium parvum
SLCNICLKISPGERIGIVGRTGA

SEQ ID NO: 2237941 - protein, 25 aa, Cryptosporidium parvum
SLCRMIGYRLPFPIMNSGEYYCSNL

SEQ ID NO: 2237942 - protein, 20 aa, Cryptosporidium parvum
SLDIFKYCCCCTSSTTKALY

SEQ ID NO: 2237943 - protein, 21 aa, Cryptosporidium parvum
SLDLLELILKYIDDLSLMYEA

SEQ ID NO: 2237944 - protein, 26 aa, Cryptosporidium parvum
SLEAWLKIRLQVGIIIPLTFFNVFSS

SEQ ID NO: 2237945 - protein, 21 aa, Cryptosporidium parvum
SLELVEKLYLISAGNILKTRH

SEQ ID NO: 2237946 - protein, 25 aa, Cryptosporidium parvum
SLENIWRKKSFRRMVNEHIQWEEDC

SEQ ID NO: 2237947 - protein, 31 aa, Cryptosporidium parvum; identical to SEQ ID NO: 2127537

SEQ ID NO: 2237948 - protein, 20 aa, Cryptosporidium parvum
SLEYKLSCDVSSFKHDNEFL

SEQ ID NO: 2237949 - protein, 20 aa, Cryptosporidium parvum
SLFWKRCLNEPIVSVKVESK

SEQ ID NO: 2237950 - protein, 29 aa, Cryptosporidium parvum
SLGPYPVFLVYSIICLKCSLQENSAIKLS

SEQ ID NO: 2237951 - protein, 18 aa, Cryptosporidium parvum
SLHNFSIAVINSATLNTI

SEQ ID NO: 2237952 - protein, 25 aa, Cryptosporidium parvum
SLHNFWKVVIGFIMSVLSGISIPLF

SEQ ID NO: 2237953 - protein, 19 aa, Cryptosporidium parvum
SLHTSIKIISSFMVLGIAL

SEQ ID NO: 2237954 - protein, 18 aa, Cryptosporidium parvum
SLIARAVAYSVIRKKRQI

SEQ ID NO: 2237955 - protein, 18 aa, Cryptosporidium parvum
SLIASSYVLYYGINDPSR

SEQ ID NO: 2237956 - protein, 20 aa, Cryptosporidium parvum
SLIEEWRLFCIKEKSIYATL

SEQ ID NO: 2237957 - protein, 17 aa, Cryptosporidium parvum
SLIELAIQVIRIMNINI

SEQ ID NO: 2237958 - protein, 22 aa, Cryptosporidium parvum
SLIHAGCKIIKVFGGDESNDSL

SEQ ID NO: 2237959 - protein, 29 aa, Cryptosporidium parvum
SLIKLKFELLRTGKIEIEYSFDFVKHEWI

SEQ ID NO: 2237960 - protein, 24 aa, Cryptosporidium parvum
SLILGFLSILAFAWITESNSEYSQ

SEQ ID NO: 2237961 - protein, 18 aa, Cryptosporidium parvum
SLILKRRFLIQDFRDPQI

SEQ ID NO: 2237962 - protein, 24 aa, Cryptosporidium parvum
SLILPISRYYLIGMLVLSSEINQN

SEQ ID NO: 2237963 - protein, 19 aa, Cryptosporidium parvum
SLIPMKTNILLIIWNITMN

SEQ ID NO: 2237964 - protein, 23 aa, Cryptosporidium parvum
SLIRIIHFLSVLTFFGLPNTNKG

SEQ ID NO: 2237965 - protein, 35 aa, Cryptosporidium parvum
SLIVKFYSTFVFSWSCSLVWFGNHLLKLFCNVDSI

SEQ ID NO: 2237966 - protein, 18 aa, Cryptosporidium parvum
SLIVTWKYQKEYIQNKEF

SEQ ID NO: 2237967 - protein, 25 aa, Cryptosporidium parvum
SLKLHELYIQFNIQSVIDRNDKDCY

SEQ ID NO: 2237968 - protein, 21 aa, Cryptosporidium parvum
SLKNDICCLFDSFEKEVDILN

SEQ ID NO: 2237969 - protein, 22 aa, Cryptosporidium parvum
SLKYYKYKGWYSFIISTLAGTV

SEQ ID NO: 2237970 - protein, 18 aa, Cryptosporidium parvum
SLLDGCFQLFALFIENHE

SEQ ID NO: 2237971 - protein, 23 aa, Cryptosporidium parvum
SLLDTFVAWLFKNNINRYINYIY

SEQ ID NO: 2237972 - protein, 20 aa, Cryptosporidium parvum
SLLILVLSLYFLILSLDLSF

SEQ ID NO: 2237973 - protein, 25 aa, Cryptosporidium parvum
SLLNFKAECVKFIMFRNSQISKGFL

SEQ ID NO: 2237974 - protein, 26 aa, Cryptosporidium parvum
SLLNSQLSHFGWFKLILNGGEKIQLE

SEQ ID NO: 2237975 - protein, 19 aa, Cryptosporidium parvum
SLLTCINKANLVISSNLLN

SEQ ID NO: 2237976 - protein, 23 aa, Cryptosporidium parvum
SLLTFAALIIFSGFICFILENDW

SEQ ID NO: 2237977 - protein, 22 aa, Cryptosporidium parvum
SLLTYLRLNSCISKEPNFIQVF

SEQ ID NO: 2237978 - protein, 17 aa, Cryptosporidium parvum
SLMAYCLSYLVLALAIL

SEQ ID NO: 2237979 - protein, 20 aa, Cryptosporidium parvum
SLMWFVRLYFTVNMKSILLD

SEQ ID NO: 2237980 - protein, 27 aa, Cryptosporidium parvum
SLNECYRYSVLFNLYFDLMEFQKDLLF

SEQ ID NO: 2237981 - protein, 20 aa, Cryptosporidium parvum
SLNEIFKVATFATSFDHSLF

SEQ ID NO: 2237982 - protein, 23 aa, Cryptosporidium parvum
SLNELRIVWELENDNIISEKNYG

SEQ ID NO: 2237983 - protein, 19 aa, Cryptosporidium parvum
SLNGAVCMFKAVLPLMKIR

SEQ ID NO: 2237984 - protein, 20 aa, Cryptosporidium parvum
SLNKKCFRRVALSEPIGSVT

SEQ ID NO: 2237985 - protein, 21 aa, Cryptosporidium parvum
SLNLFIWKFINTEYLKSNEEI

SEQ ID NO: 2237986 - protein, 18 aa, Cryptosporidium parvum
SLNLLALIDYKPSSILEL

SEQ ID NO: 2237987 - protein, 25 aa, Cryptosporidium parvum
SLNSLKIINEFLRYQIIIENMDDLF

SEQ ID NO: 2237988 - protein, 18 aa, Cryptosporidium parvum
SLPCGRNGLLKVSQATNM

SEQ ID NO: 2237989 - protein, 23 aa, Cryptosporidium parvum
SLPFNFLLLFTLLVFSIGVVSVK

SEQ ID NO: 2237990 - protein, 33 aa, Cryptosporidium parvum
SLPKLRYILIQRLKIWLTPLLLFHDLISSKNRM

SEQ ID NO: 2237991 - protein, 18 aa, Cryptosporidium parvum
SLQLQFTGFLFLKTICNT

SEQ ID NO: 2237992 - protein, 17 aa, Cryptosporidium parvum
SLQRNGFRPDLRLNGLP

SEQ ID NO: 2237993 - protein, 21 aa, Cryptosporidium parvum
SLRINKFPFLRKESSKVILPT

SEQ ID NO: 2237994 - protein, 19 aa, Cryptosporidium parvum
SLRSRVFFGTPIYNGQLFK

SEQ ID NO: 2237995 - protein, 18 aa, Cryptosporidium parvum
SLSGSVLLLSTRITSPWV

SEQ ID NO: 2237996 - protein, 18 aa, Cryptosporidium parvum
SLSLIFSFGGKFRERVTK

SEQ ID NO: 2237997 - protein, 26 aa, Cryptosporidium parvum
SLSLKWKTEFPSVISRQHLISPIKEK

SEQ ID NO: 2237998 - protein, 25 aa, Cryptosporidium parvum
SLSRSMGTYSFCKSIIYDSKNTRNL

SEQ ID NO: 2237999 - protein, 27 aa, Cryptosporidium parvum
SLSSSLRCPWVILRFLFIDIWIGLLLF

SEQ ID NO: 2238000 - protein, 24 aa, Cryptosporidium parvum
SLSTTRWFACFLLFVGVLLVQKTN

SEQ ID NO: 2238001 - protein, 18 aa, Cryptosporidium parvum
SLSYSERSIHLSGRTLPS

SEQ ID NO: 2238002 - protein, 22 aa, Cryptosporidium parvum
SLTGFACSDCINCGTHENKPFN

SEQ ID NO: 2238003 - protein, 22 aa, Cryptosporidium parvum
SLTGSFGFGWLSKGMMNIKCQE

SEQ ID NO: 2238004 - protein, 20 aa, Cryptosporidium parvum
SLTISDGWASIDLPNLQDSG

SEQ ID NO: 2238005 - protein, 24 aa, Cryptosporidium parvum
SLTIYCIMGSLFSFLIKIKSFSTS

SEQ ID NO: 2238006 - protein, 33 aa, Cryptosporidium parvum; identical to SEQ ID NO: 2181734

SEQ ID NO: 2238007 - protein, 21 aa, Cryptosporidium parvum
SLTYFPGILLIILFNHTILNW

SEQ ID NO: 2238008 - protein, 20 aa, Cryptosporidium parvum
SLVFRSIFLYFLIARVPTAV

SEQ ID NO: 2238009 - protein, 19 aa, Cryptosporidium parvum
SLVLTCVYSVLLLISLTYS

SEQ ID NO: 2238010 - protein, 24 aa, Cryptosporidium parvum
SLVREGECIMAIFCQTVLFVAFNK

SEQ ID NO: 2238011 - protein, 25 aa, Cryptosporidium parvum
SLWCDEEILELLLLATVHHNAGLLF

SEQ ID NO: 2238012 - protein, 19 aa, Cryptosporidium parvum
SLWHNRLRTARVWMDEFYQ

SEQ ID NO: 2238013 - protein, 22 aa, Cryptosporidium parvum
SLYHIMDLILFFLPNKVNKHNS

SEQ ID NO: 2238014 - protein, 19 aa, Cryptosporidium parvum
SLYMFSTVLFKSFFDCHSR

SEQ ID NO: 2238015 - protein, 27 aa, Cryptosporidium parvum
SLYNIPPRCELARCIDNGRFSKNFEIV

SEQ ID NO: 2238016 - protein, 24 aa, Cryptosporidium parvum
SLYSCFNFWGAFLILKAESNSHKF

SEQ ID NO: 2238017 - protein, 25 aa, Cryptosporidium parvum
SMDLLIPLYIGFWFINSILDAIVYI

SEQ ID NO: 2238018 - protein, 24 aa, Cryptosporidium parvum
SMEAWSDNILIAWTEKLGPREVKI

SEQ ID NO: 2238019 - protein, 20 aa, Cryptosporidium parvum
SMFSEFFKSPLFDENYVEKE

SEQ ID NO: 2238020 - protein, 18 aa, Cryptosporidium parvum
SMGTLDWIHCIQARIAIL

SEQ ID NO: 2238021 - protein, 27 aa, Cryptosporidium parvum
SMISTSYFLSCRILPYLWSFYESYPTY

SEQ ID NO: 2238022 - protein, 24 aa, Cryptosporidium parvum
SMKFENWPFIGIQNEWKHIEKEIN

SEQ ID NO: 2238023 - protein, 23 aa, Cryptosporidium parvum
SMKMGRYYQCEIVLENLSFNIIE

SEQ ID NO: 2238024 - protein, 18 aa, Cryptosporidium parvum
SMLFSFNARIRKNAIIPI

SEQ ID NO: 2238025 - protein, 18 aa, Cryptosporidium parvum
SMLGELRYGPNYLSSNAL

SEQ ID NO: 2238026 - protein, 24 aa, Cryptosporidium parvum
SMSIMKPILLEGAPGIGKTAIILT

SEQ ID NO: 2238027 - protein, 23 aa, Cryptosporidium parvum
SMVSRLGRCYLWLENKDLVTDQM

SEQ ID NO: 2238028 - protein, 22 aa, Cryptosporidium parvum
SMVVKCIDEFIKVCKTHYNNIN

SEQ ID NO: 2238029 - protein, 20 aa, Cryptosporidium parvum
SNAFEIYLGKDLVYSAIQNN

SEQ ID NO: 2238030 - protein, 19 aa, Cryptosporidium parvum
SNCLLRIGPNIQNSKDSDK

SEQ ID NO: 2238031 - protein, 24 aa, Cryptosporidium parvum
SNDSRKGTILSIFTRHVYKVRSEV

SEQ ID NO: 2238032 - protein, 21 aa, Cryptosporidium parvum
SNDYKSFFISNGIFIINGKLI

SEQ ID NO: 2238033 - protein, 18 aa, Cryptosporidium parvum
SNEFKRSLNTITEETNST

SEQ ID NO: 2238034 - protein, 20 aa, Cryptosporidium parvum
SNFFSAVIFVIFLNPYNVGD

SEQ ID NO: 2238035 - protein, 17 aa, Cryptosporidium parvum
SNFKRDIATSFIYMLND

SEQ ID NO: 2238036 - protein, 28 aa, Cryptosporidium parvum
SNFLQMLILLCFMGAFLSLMGPLTQSVI

SEQ ID NO: 2238037 - protein, 26 aa, Cryptosporidium parvum
SNFSGIGCRLGFKYSILEQATLTGPI

SEQ ID NO: 2238038 - protein, 20 aa, Cryptosporidium parvum
SNFWCGINAIQPGHSATVYM

SEQ ID NO: 2238039 - protein, 23 aa, Cryptosporidium parvum
SNGHCLKLYSIIHFLYNKYIINN

SEQ ID NO: 2238040 - protein, 19 aa, Cryptosporidium parvum
SNGISQFFLSFEVTNQQLK

SEQ ID NO: 2238041 - protein, 26 aa, Cryptosporidium parvum
SNHKLYEIIDKFMLNLQYYKELNKTI

SEQ ID NO: 2238042 - protein, 19 aa, Cryptosporidium parvum
SNIEFARSRFEDYISSLQF

SEQ ID NO: 2238043 - protein, 22 aa, Cryptosporidium parvum
SNIGKVLLGFALYNKAKYQSQS

SEQ ID NO: 2238044 - protein, 19 aa, Cryptosporidium parvum
SNIHLDYFHHLYLFIYFFF

SEQ ID NO: 2238045 - protein, 20 aa, Cryptosporidium parvum
SNIIKCYKMISGYDSEVHWQ

SEQ ID NO: 2238046 - protein, 23 aa, Cryptosporidium parvum
SNILESRFTGVSIYYPDPDQQVL

SEQ ID NO: 2238047 - protein, 19 aa, Cryptosporidium parvum
SNIPEIRALIMKREGLSEQ

SEQ ID NO: 2238048 - protein, 23 aa, Cryptosporidium parvum
SNIPIPIDCEGFDLSWIPSNPLD

SEQ ID NO: 2238049 - protein, 24 aa, Cryptosporidium parvum
SNIPSWSLQCILEMLSELVQNSDI

SEQ ID NO: 2238050 - protein, 20 aa, Cryptosporidium parvum
SNIPVSYSELMVKVFMELKR

SEQ ID NO: 2238051 - protein, 24 aa, Cryptosporidium parvum
SNISEYVLRYSLMMESMNFPGPVK

SEQ ID NO: 2238052 - protein, 18 aa, Cryptosporidium parvum
SNIYTRRLVDISREEKLI

SEQ ID NO: 2238053 - protein, 20 aa, Cryptosporidium parvum
SNKHWDILRKILLGETKDIN

SEQ ID NO: 2238054 - protein, 24 aa, Cryptosporidium parvum
SNKLPWYSGVSFRIVGKFNAENDK

SEQ ID NO: 2238055 - protein, 20 aa, Cryptosporidium parvum
SNKLVKDWYIHPNYLSYLVL

SEQ ID NO: 2238056 - protein, 19 aa, Cryptosporidium parvum
SNKQAKMILINRATQLTLE

SEQ ID NO: 2238057 - protein, 22 aa, Cryptosporidium parvum
SNKQIYCFICTSNIINALSEIQ

SEQ ID NO: 2238058 - protein, 21 aa, Cryptosporidium parvum
SNKSIKFHEMWIGDQCPEILN

SEQ ID NO: 2238059 - protein, 18 aa, Cryptosporidium parvum
SNLDYKEFHRFIIDTISK

SEQ ID NO: 2238060 - protein, 22 aa, Cryptosporidium parvum
SNLEIGVFIASYLSLPKFQDNS

SEQ ID NO: 2238061 - protein, 19 aa, Cryptosporidium parvum
SNLELCLKVYNIFKDTQNI

SEQ ID NO: 2238062 - protein, 22 aa, Cryptosporidium parvum
SNLETISIIFGYLFTISTGQPC

SEQ ID NO: 2238063 - protein, 22 aa, Cryptosporidium parvum
SNLHISSIMSFMINLSKEETLL

SEQ ID NO: 2238064 - protein, 24 aa, Cryptosporidium parvum
SNLIFKFLIELYSRYSNKNKNNNN

SEQ ID NO: 2238065 - protein, 20 aa, Cryptosporidium parvum
SNLIKCLREKIASIVRPLTT

SEQ ID NO: 2238066 - protein, 19 aa, Cryptosporidium parvum
SNLILLILCYIVEIEPYIP

SEQ ID NO: 2238067 - protein, 17 aa, Cryptosporidium parvum
SNLKATSILLEIDNQEV

SEQ ID NO: 2238068 - protein, 20 aa, Cryptosporidium parvum
SNLLKISIFILKIFSSNEVI

SEQ ID NO: 2238069 - protein, 23 aa, Cryptosporidium parvum
SNLLKKLFPLFNIKQDSDIFENS

SEQ ID NO: 2238070 - protein, 21 aa, Cryptosporidium parvum
SNLNANCQLLLYQNKETKSLK

SEQ ID NO: 2238071 - protein, 27 aa, Cryptosporidium parvum
SNLNIKCGLVILIEYILEFFISKGEVI

SEQ ID NO: 2238072 - protein, 25 aa, Cryptosporidium parvum
SNLNYWSSQLFKPVNFYSMIKNLEE

SEQ ID NO: 2238073 - protein, 26 aa, Cryptosporidium parvum
SNLRFFNRFYCGILMHKSLLKLIIES

SEQ ID NO: 2238074 - protein, 17 aa, Cryptosporidium parvum
SNLVCQLVFLLLLFSRV

SEQ ID NO: 2238075 - protein, 17 aa, Cryptosporidium parvum
SNLYRDLWVSVPNSMHN

SEQ ID NO: 2238076 - protein, 25 aa, Cryptosporidium parvum
SNMDGRFALASGMPLSRGRKPSRSL

SEQ ID NO: 2238077 - protein, 19 aa, Cryptosporidium parvum
SNMIYRVGVKSVFVNDLQW

SEQ ID NO: 2238078 - protein, 17 aa, Cryptosporidium parvum
SNMSLKLSKLVNYNKKR

SEQ ID NO: 2238079 - protein, 24 aa, Cryptosporidium parvum
SNNDIFPRFSFPNYFYHYVSHYTD

SEQ ID NO: 2238080 - protein, 19 aa, Cryptosporidium parvum
SNNLGEYGFRLNDEDRNLN

SEQ ID NO: 2238081 - protein, 23 aa, Cryptosporidium parvum
SNNPNFIWIYTFIVLFQGLLCAL

SEQ ID NO: 2238082 - protein, 17 aa, Cryptosporidium parvum
SNNRRFGIYASNNNDIN

SEQ ID NO: 2238083 - protein, 25 aa, Cryptosporidium parvum
SNNSFIYECHRIIKSHLCNPENSLN

SEQ ID NO: 2238084 - protein, 23 aa, Cryptosporidium parvum
SNPELKIHKLISFNNIKDYYNIN

SEQ ID NO: 2238085 - protein, 19 aa, Cryptosporidium parvum
SNQAGICRKAFTPRPYSSV

SEQ ID NO: 2238086 - protein, 20 aa, Cryptosporidium parvum
SNQEIWKGTDWQTSILYCSS

SEQ ID NO: 2238087 - protein, 20 aa, Cryptosporidium parvum
SNQGLSCLTLLVSNEEFEIL

SEQ ID NO: 2238088 - protein, 17 aa, Cryptosporidium parvum
SNRLFYVVFTILIGFIF

SEQ ID NO: 2238089 - protein, 25 aa, Cryptosporidium parvum
SNSIKYIKLRLSKLIEINLKVIPLN

SEQ ID NO: 2238090 - protein, 23 aa, Cryptosporidium parvum
SNSILRWFPLSFILNRLTNDQLH

SEQ ID NO: 2238091 - protein, 25 aa, Cryptosporidium parvum
SNSLPWFKRQIFKLLKLKQENLKEF

SEQ ID NO: 2238092 - protein, 19 aa, Cryptosporidium parvum
SNSTWVFRNNNGILKDSSV

SEQ ID NO: 2238093 - protein, 20 aa, Cryptosporidium parvum
SNSWLLPLLRVHINRTELSF

SEQ ID NO: 2238094 - protein, 22 aa, Cryptosporidium parvum
SNTEIICEITLFGLIEHIESIL

SEQ ID NO: 2238095 - protein, 17 aa, Cryptosporidium parvum
SNTELLTGLKFYETGRL

SEQ ID NO: 2238096 - protein, 23 aa, Cryptosporidium parvum
SNTFLSLLIVRFLNCNSENARES

SEQ ID NO: 2238097 - protein, 19 aa, Cryptosporidium parvum
SNTRISGVFPNQFQFQKIS

SEQ ID NO: 2238098 - protein, 18 aa, Cryptosporidium parvum
SNTVCWASLLSKHVINSH

SEQ ID NO: 2238099 - protein, 21 aa, Cryptosporidium parvum
SNVFECIPERLFSTLRPNKSK

SEQ ID NO: 2238100 - protein, 18 aa, Cryptosporidium parvum
SNVKWGAKLMTWLITAVV

SEQ ID NO: 2238101 - protein, 23 aa, Cryptosporidium parvum
SNVKYSVCLNRIYSEGVCINTSV

SEQ ID NO: 2238102 - protein, 32 aa, Cryptosporidium parvum; identical to SEQ ID NO: 2127633

SEQ ID NO: 2238103 - protein, 26 aa, Cryptosporidium parvum
SNVSQFLFGFIVGFYRGWKMALVMSA

SEQ ID NO: 2238104 - protein, 20 aa, Cryptosporidium parvum
SNYKLLALFHEYSIQQINLL

SEQ ID NO: 2238105 - protein, 19 aa, Cryptosporidium parvum
SNYKQFSFDFVWKERELIT

SEQ ID NO: 2238106 - protein, 21 aa, Cryptosporidium parvum
SPAPLRRRIASQGNNYLDDMM

SEQ ID NO: 2238107 - protein, 19 aa, Cryptosporidium parvum
SPDFPNWYTFKYKGLEELK

SEQ ID NO: 2238108 - protein, 24 aa, Cryptosporidium parvum
SPEQGSGVPITFEILFEVLERTER

SEQ ID NO: 2238109 - protein, 25 aa, Cryptosporidium parvum
SPETAKLFGAVSCYKSFGSFLSIAV

SEQ ID NO: 2238110 - protein, 19 aa, Cryptosporidium parvum
SPGEAVGCLAAQSIGEPAT

SEQ ID NO: 2238111 - protein, 24 aa, Cryptosporidium parvum
SPGMNIPCFCCIQSELDGASLFYR

SEQ ID NO: 2238112 - protein, 24 aa, Cryptosporidium parvum
SPHDFKLLICHIIDKILINYNILA

SEQ ID NO: 2238113 - protein, 22 aa, Cryptosporidium parvum
SPHFKICGWISSSQFKFVDLWK

SEQ ID NO: 2238114 - protein, 25 aa, Cryptosporidium parvum
SPISRRFALGVGFGAGLGWGVKSAN

SEQ ID NO: 2238115 - protein, 22 aa, Cryptosporidium parvum
SPKCRPWSIWGTLPYRNASALA

SEQ ID NO: 2238116 - protein, 20 aa, Cryptosporidium parvum
SPLEYCSYPLFTNTHETTDY

SEQ ID NO: 2238117 - protein, 19 aa, Cryptosporidium parvum
SPPSYYATNGIKTINPNQV

SEQ ID NO: 2238118 - protein, 18 aa, Cryptosporidium parvum
SPQIIRIISKFVSLQGAE

SEQ ID NO: 2238119 - protein, 17 aa, Cryptosporidium parvum
SPRACLCNGEKKSENFK

SEQ ID NO: 2238120 - protein, 21 aa, Cryptosporidium parvum
SPRISLECILELVSYSESTNW

SEQ ID NO: 2238121 - protein, 27 aa, Cryptosporidium parvum
SPRQWMWEIVTGFKWGSSSYGSSSKSK

SEQ ID NO: 2238122 - protein, 21 aa, Cryptosporidium parvum
SPRYLSFGFISPYMKLKDKEL

SEQ ID NO: 2238123 - protein, 20 aa, Cryptosporidium parvum
SPSFEILVSIFKLRSYSGRE

SEQ ID NO: 2238124 - protein, 17 aa, Cryptosporidium parvum
SPSNVFLNRSKKFKSKE

SEQ ID NO: 2238125 - protein, 19 aa, Cryptosporidium parvum
SPSSLRVCENIRKPIPTET

SEQ ID NO: 2238126 - protein, 25 aa, Cryptosporidium parvum
SPVLKLKNMFYIFILSASIYFFKKE

SEQ ID NO: 2238127 - protein, 20 aa, Cryptosporidium parvum
SPVRKGLEIWTNEIIGDISV

SEQ ID NO: 2238128 - protein, 18 aa, Cryptosporidium parvum
SPWSEWTMCLGGCDEKPY

SEQ ID NO: 2238129 - protein, 24 aa, Cryptosporidium parvum
SPYREIWLEISLTVPARLKSLLPY

SEQ ID NO: 2238130 - protein, 18 aa, Cryptosporidium parvum
SPYYCWGNLEPRDLSPNQ

SEQ ID NO: 2238131 - protein, 23 aa, Cryptosporidium parvum
SQAKCKRLIVISRFYSDSEEALK

SEQ ID NO: 2238132 - protein, 25 aa, Cryptosporidium parvum
SQDELRWKIIGVLFRCVTRKDLEIC

SEQ ID NO: 2238133 - protein, 17 aa, Cryptosporidium parvum
SQELLRMIIHQTEANLN

SEQ ID NO: 2238134 - protein, 18 aa, Cryptosporidium parvum
SQFCHLQPLVLIHGRLCY

SEQ ID NO: 2238135 - protein, 26 aa, Cryptosporidium parvum
SQFLFKCSWHPIKQNLEISAKLKAVS

SEQ ID NO: 2238136 - protein, 26 aa, Cryptosporidium parvum
SQHCSFLRLGAFLENDFDIELVRIVY

SEQ ID NO: 2238137 - protein, 19 aa, Cryptosporidium parvum
SQIFLCIVVWNVVCATSSE

SEQ ID NO: 2238138 - protein, 25 aa, Cryptosporidium parvum
SQIQNCVWLPSLLESKARFKLAKIM

SEQ ID NO: 2238139 - protein, 18 aa, Cryptosporidium parvum
SQKCSYFSNDICIITIIM

SEQ ID NO: 2238140 - protein, 17 aa, Cryptosporidium parvum
SQKIWKKVIYSFYSIFS

SEQ ID NO: 2238141 - protein, 17 aa, Cryptosporidium parvum
SQKNEWQVMGKNISKKD

SEQ ID NO: 2238142 - protein, 38 aa, Cryptosporidium parvum
SQLHSLFALSIIWYLSFNPKYIFSFVFLLGLIILFISF

SEQ ID NO: 2238143 - protein, 23 aa, Cryptosporidium parvum
SQLKHIFFPISFIISEPPPSNRA

SEQ ID NO: 2238144 - protein, 21 aa, Cryptosporidium parvum
SQLLSLSGYQCYLLKKIISSS

SEQ ID NO: 2238145 - protein, 24 aa, Cryptosporidium parvum
SQLNPLCLLLFALEITKLSGSHDI

SEQ ID NO: 2238146 - protein, 19 aa, Cryptosporidium parvum
SQLPLLVMISVSSILTSSH

SEQ ID NO: 2238147 - protein, 20 aa, Cryptosporidium parvum
SQLRHSWNLVKAVISAVKYI

SEQ ID NO: 2238148 - protein, 17 aa, Cryptosporidium parvum
SQLRIFGLTSICENGSS

SEQ ID NO: 2238149 - protein, 21 aa, Cryptosporidium parvum
SQLRVQLPFVKNIGGNYIMDE

SEQ ID NO: 2238150 - protein, 17 aa, Cryptosporidium parvum
SQLVFYTAIQIISVILA

SEQ ID NO: 2238151 - protein, 17 aa, Cryptosporidium parvum
SQMVLMRAASLVSAIIA

SEQ ID NO: 2238152 - protein, 26 aa, Cryptosporidium parvum
SQNICYECTMFLYKIISSLLSFNNQV

SEQ ID NO: 2238153 - protein, 25 aa, Cryptosporidium parvum
SQNKFRCRLCDFYIDLNGLRESINF

SEQ ID NO: 2238154 - protein, 20 aa, Cryptosporidium parvum
SQPAFGWHFHNDISLPTEHP

SEQ ID NO: 2238155 - protein, 24 aa, Cryptosporidium parvum
SQPLFPWGPLYSYQHPVVTVSQIR

SEQ ID NO: 2238156 - protein, 24 aa, Cryptosporidium parvum
SQPLKVGCHFIRTNGVFACLMYIS

SEQ ID NO: 2238157 - protein, 22 aa, Cryptosporidium parvum
SQPNFRSLASFHELNHNEINYR

SEQ ID NO: 2238158 - protein, 24 aa, Cryptosporidium parvum
SQPNLRPRSLFSINKMDSQDHSKD

SEQ ID NO: 2238159 - protein, 20 aa, Cryptosporidium parvum
SQPTIIHWLIILLSALFSCY

SEQ ID NO: 2238160 - protein, 24 aa, Cryptosporidium parvum
SQPTKVKWYDGLIQFSKKVTELSG

SEQ ID NO: 2238161 - protein, 20 aa, Cryptosporidium parvum
SQQSIAWSFLLVKKPSNILE

SEQ ID NO: 2238162 - protein, 21 aa, Cryptosporidium parvum
SQRLGCWNFILPKLISEDFVI

SEQ ID NO: 2238163 - protein, 18 aa, Cryptosporidium parvum
SQRLRPSTPTSYSSSSSS

SEQ ID NO: 2238164 - protein, 19 aa, Cryptosporidium parvum
SQRRPFHERGLGLSVESQV

SEQ ID NO: 2238165 - protein, 18 aa, Cryptosporidium parvum
SQSSLVIFNILYYGFSPE

SEQ ID NO: 2238166 - protein, 23 aa, Cryptosporidium parvum
SQTKGDWCLYNFGIVCEAVSLIM

SEQ ID NO: 2238167 - protein, 17 aa, Cryptosporidium parvum
SQVFLNLIFRKYLSLSF

SEQ ID NO: 2238168 - protein, 17 aa, Cryptosporidium parvum
SQVGLLLLNKVQRKSFK

SEQ ID NO: 2238169 - protein, 17 aa, Cryptosporidium parvum
SQVKCINLALSSMEHIH

SEQ ID NO: 2238170 - protein, 20 aa, Cryptosporidium parvum
SQVKMDWLFDLDAFNIHKIT

SEQ ID NO: 2238171 - protein, 17 aa, Cryptosporidium parvum
SQYFLWWFILFPLALRV

SEQ ID NO: 2238172 - protein, 23 aa, Cryptosporidium parvum
SQYKESFSMFIIILEYMASIESK

SEQ ID NO: 2238173 - protein, 22 aa, Cryptosporidium parvum
SQYKLWTSVYIFDGQNHIGKKL

SEQ ID NO: 2238174 - protein, 29 aa, Cryptosporidium parvum
SQYLKLSQSVLFFLVRLSFLVIQVRSFLA

SEQ ID NO: 2238175 - protein, 17 aa, Cryptosporidium parvum
SRAGGLITDRYLDGLHA

SEQ ID NO: 2238176 - protein, 23 aa, Cryptosporidium parvum
SRALRLFSTLLLILGTEKCPNTV

SEQ ID NO: 2238177 - protein, 23 aa, Cryptosporidium parvum
SRCGMRILGFAVGHINCPNEDPT

SEQ ID NO: 2238178 - protein, 24 aa, Cryptosporidium parvum
SRDLKSDFWSFALQIFKSLADENS

SEQ ID NO: 2238179 - protein, 24 aa, Cryptosporidium parvum
SREEKICNYYENFPRSYVKYSGID

SEQ ID NO: 2238180 - protein, 17 aa, Cryptosporidium parvum
SREIAIGILSPFIDILI

SEQ ID NO: 2238181 - protein, 18 aa, Cryptosporidium parvum
SRELQRMCLVLYSPLCGV

SEQ ID NO: 2238182 - protein, 26 aa, Cryptosporidium parvum
SRELWRISEIYFMGKILILTSKMTNF

SEQ ID NO: 2238183 - protein, 23 aa, Cryptosporidium parvum
SREVIRSWEFLVDFEMEDEVLSN

SEQ ID NO: 2238184 - protein, 22 aa, Cryptosporidium parvum
SRFHEIVDIIFFSYLSSQYLKL

SEQ ID NO: 2238185 - protein, 18 aa, Cryptosporidium parvum
SRFISVSTHLSFKNYDKL

SEQ ID NO: 2238186 - protein, 19 aa, Cryptosporidium parvum
SRFNKLFTDPFSKITHSTT

SEQ ID NO: 2238187 - protein, 22 aa, Cryptosporidium parvum
SRFQNIRFPINFNSFNAEEFGL

SEQ ID NO: 2238188 - protein, 22 aa, Cryptosporidium parvum
SRFYAAQVVLMFEYLHGKNIIY

SEQ ID NO: 2238189 - protein, 18 aa, Cryptosporidium parvum
SRGGTNCLKEIRNYVEEL

SEQ ID NO: 2238190 - protein, 23 aa, Cryptosporidium parvum
SRHRSGILNFIFMNRFANNVNSY

SEQ ID NO: 2238191 - protein, 17 aa, Cryptosporidium parvum
SRIFGMISESIGSLCKT

SEQ ID NO: 2238192 - protein, 32 aa, Cryptosporidium parvum
SRIFIGIACSILCLIAEVGLFMIYDIKRNMKV

SEQ ID NO: 2238193 - protein, 19 aa, Cryptosporidium parvum
SRIHQDFLTRINIEEQKRK

SEQ ID NO: 2238194 - protein, 19 aa, Cryptosporidium parvum
SRIICKFQDFVFSKLENTI

SEQ ID NO: 2238195 - protein, 18 aa, Cryptosporidium parvum
SRIIRIFTHPTFLSIKTV

SEQ ID NO: 2238196 - protein, 18 aa, Cryptosporidium parvum
SRILEYYLLVIILAKLFF

SEQ ID NO: 2238197 - protein, 17 aa, Cryptosporidium parvum
SRIPSEVKWLVDLSEIW

SEQ ID NO: 2238198 - protein, 25 aa, Cryptosporidium parvum
SRISLPEIYFVLTVDGTLWSIGENG

SEQ ID NO: 2238199 - protein, 19 aa, Cryptosporidium parvum
SRKGILMSPIKICRGMDNK

SEQ ID NO: 2238200 - protein, 24 aa, Cryptosporidium parvum
SRKSSKYRRILGLHDDSINVRIKT

SEQ ID NO: 2238201 - protein, 21 aa, Cryptosporidium parvum
SRKTVGMGWELQRKLTKLGYN

SEQ ID NO: 2238202 - protein, 23 aa, Cryptosporidium parvum
SRKVGFLAVFLLNIIFFDANIGL

SEQ ID NO: 2238203 - protein, 18 aa, Cryptosporidium parvum
SRLATELLCTNVFLDVLI

SEQ ID NO: 2238204 - protein, 24 aa, Cryptosporidium parvum
SRLATPWSGDIIFWQKVMAENAFA

SEQ ID NO: 2238205 - protein, 22 aa, Cryptosporidium parvum
SRLILLNSIEDFSGIPLFMIFV

SEQ ID NO: 2238206 - protein, 19 aa, Cryptosporidium parvum
SRLIQDYPIYDIMKEPENT

SEQ ID NO: 2238207 - protein, 24 aa, Cryptosporidium parvum
SRLIYNWMQQYFIYKLRKIPKFNY

SEQ ID NO: 2238208 - protein, 27 aa, Cryptosporidium parvum
SRLKFAAEVFLAFDIIKILTTAMSELS

SEQ ID NO: 2238209 - protein, 17 aa, Cryptosporidium parvum
SRLKYSSEFLGQLSEYI

SEQ ID NO: 2238210 - protein, 20 aa, Cryptosporidium parvum
SRLLESFGNFYVKEGLESPF

SEQ ID NO: 2238211 - protein, 18 aa, Cryptosporidium parvum
SRLLESFHIPNFNKPALD

SEQ ID NO: 2238212 - protein, 24 aa, Cryptosporidium parvum
SRLRRVYRREFAALIQFLNGKSVD

SEQ ID NO: 2238213 - protein, 31 aa, Cryptosporidium parvum
SRLSKVVTCIFAINCMFRNAANYNHSRIVQS

SEQ ID NO: 2238214 - protein, 29 aa, Cryptosporidium parvum
SRLWNRYKYIWPASFCFSSTIVLNNACLS

SEQ ID NO: 2238215 - protein, 17 aa, Cryptosporidium parvum
SRLYKYNLSIIYNYARS

SEQ ID NO: 2238216 - protein, 28 aa, Cryptosporidium parvum
SRNELNIALKCYMDSICYILYSKDVLEF

SEQ ID NO: 2238217 - protein, 24 aa, Cryptosporidium parvum
SRNKFKLIISCIHIITSVIPPEFP

SEQ ID NO: 2238218 - protein, 25 aa, Cryptosporidium parvum
SRNKKIKEILCMESFLDLQFSIIMD

SEQ ID NO: 2238219 - protein, 20 aa, Cryptosporidium parvum
SRNLPSALLLAGPGAILTMV

SEQ ID NO: 2238220 - protein, 24 aa, Cryptosporidium parvum
SRQHIRFATAPFKADIRLVGSVWL

SEQ ID NO: 2238221 - protein, 18 aa, Cryptosporidium parvum
SRRHAISMFISEELNSNF

SEQ ID NO: 2238222 - protein, 21 aa, Cryptosporidium parvum
SRRVINWKLVKEIIKIHLNTS

SEQ ID NO: 2238223 - protein, 18 aa, Cryptosporidium parvum
SRSASHFGKVYNGLYPVG

SEQ ID NO: 2238224 - protein, 26 aa, Cryptosporidium parvum
SRSFLDRYDIPLLFNLLYSEDANDHN

SEQ ID NO: 2238225 - protein, 20 aa, Cryptosporidium parvum
SRSGFKLVSYIEYWNQREFE

SEQ ID NO: 2238226 - protein, 25 aa, Cryptosporidium parvum
SRSLKICLSILILINLVCIEKNILM

SEQ ID NO: 2238227 - protein, 21 aa, Cryptosporidium parvum
SRSLRLEAIRLYNNEGDEANF

SEQ ID NO: 2238228 - protein, 21 aa, Cryptosporidium parvum
SRSRLDIFGFIPKYSTSEPDR

SEQ ID NO: 2238229 - protein, 22 aa, Cryptosporidium parvum
SRSRQYFCLALNIQKSNLRALW

SEQ ID NO: 2238230 - protein, 21 aa, Cryptosporidium parvum
SRTCVCRPCAMRDNRGSTDSS

SEQ ID NO: 2238231 - protein, 18 aa, Cryptosporidium parvum
SRTFDLSTGFAFAAFGMI

SEQ ID NO: 2238232 - protein, 18 aa, Cryptosporidium parvum
SRTYDFLISIGINPDGIR

SEQ ID NO: 2238233 - protein, 20 aa, Cryptosporidium parvum
SRVNYNMICVMLGQQELEGR

SEQ ID NO: 2238234 - protein, 36 aa, Cryptosporidium parvum
SRYAMAYSPIFRVVLGVLRWLRWESRVNPCKQNDIV

SEQ ID NO: 2238235 - protein, 19 aa, Cryptosporidium parvum
SRYRVVPISSQSTSSSVFT

SEQ ID NO: 2238236 - protein, 20 aa, Cryptosporidium parvum
SRYSPVLPLQKSGFIILNDN

SEQ ID NO: 2238237 - protein, 23 aa, Cryptosporidium parvum
SSADELFKFIGVTERFFSTFDDD

SEQ ID NO: 2238238 - protein, 17 aa, Cryptosporidium parvum
SSAFYWIRRGFYLPRSY

SEQ ID NO: 2238239 - protein, 17 aa, Cryptosporidium parvum
SSARRRSRSRSRSRRSS

SEQ ID NO: 2238240 - protein, 23 aa, Cryptosporidium parvum
SSCPKLKRIAMRSEIQERMPNYR

SEQ ID NO: 2238241 - protein, 23 aa, Cryptosporidium parvum
SSDGICIIYHIFLLLKSSFKRYF

SEQ ID NO: 2238242 - protein, 24 aa, Cryptosporidium parvum
SSEDLWEALRICCLSGTIRSLPGG

SEQ ID NO: 2238243 - protein, 22 aa, Cryptosporidium parvum
SSEEFKLEYILKILSTHQANLE

SEQ ID NO: 2238244 - protein, 26 aa, Cryptosporidium parvum
SSELIMELYEICWSIFTTILGYITMF

SEQ ID NO: 2238245 - protein, 19 aa, Cryptosporidium parvum
SSENCKICVLDFVREKALY

SEQ ID NO: 2238246 - protein, 33 aa, Cryptosporidium parvum; identical to SEQ ID NO: 2127706

SEQ ID NO: 2238247 - protein, 17 aa, Cryptosporidium parvum
SSFIFGTICKFIGLPLL

SEQ ID NO: 2238248 - protein, 26 aa, Cryptosporidium parvum
SSFLNVLRHLGYWLGQITIGINRPII

SEQ ID NO: 2238249 - protein, 26 aa, Cryptosporidium parvum
SSFNILDELWRWYSRLVNDQFVDFDN

SEQ ID NO: 2238250 - protein, 19 aa, Cryptosporidium parvum
SSFSSSLTICITKYILTFI

SEQ ID NO: 2238251 - protein, 21 aa, Cryptosporidium parvum
SSGCGPCYDASIINDLGAVNC

SEQ ID NO: 2238252 - protein, 20 aa, Cryptosporidium parvum
SSGFNAYFLVSLAFLQMLVS

SEQ ID NO: 2238253 - protein, 28 aa, Cryptosporidium parvum
SSGQLKSAISLPWGIIFENKNFLKWILK

SEQ ID NO: 2238254 - protein, 25 aa, Cryptosporidium parvum
SSGVKTDLIILEFIYKDLNYFEISN

SEQ ID NO: 2238255 - protein, 19 aa, Cryptosporidium parvum
SSHCVTSYSILIWLLLENI

SEQ ID NO: 2238256 - protein, 23 aa, Cryptosporidium parvum
SSHKICSPSLLADTFIQAADIAR

SEQ ID NO: 2238257 - protein, 31 aa, Cryptosporidium parvum
SSHKLQSYILWLLLCLNLNMGTVRPFVNASL

SEQ ID NO: 2238258 - protein, 26 aa, Cryptosporidium parvum
SSIEKLFVQMCCKCRTVVFARFAPSQ

SEQ ID NO: 2238259 - protein, 24 aa, Cryptosporidium parvum
SSIFPCKYRPYSYVILTIGAEKFS

SEQ ID NO: 2238260 - protein, 17 aa, Cryptosporidium parvum
SSIICFFESPVMLAKYL

SEQ ID NO: 2238261 - protein, 24 aa, Cryptosporidium parvum
SSIKLKMGLDLKVLAPPSSQVYKF

SEQ ID NO: 2238262 - protein, 27 aa, Cryptosporidium parvum
SSIKSCLYCGSVLNTIRYISFYCFLDN

SEQ ID NO: 2238263 - protein, 19 aa, Cryptosporidium parvum
SSILIDMLYAMAICNSTVP

SEQ ID NO: 2238264 - protein, 25 aa, Cryptosporidium parvum
SSILSNRISYIFGFQGPSFTIDSAC

SEQ ID NO: 2238265 - protein, 18 aa, Cryptosporidium parvum
SSILTVICFVSVIGINLG

SEQ ID NO: 2238266 - protein, 17 aa, Cryptosporidium parvum
SSIMTRVFFESCGIADL

SEQ ID NO: 2238267 - protein, 20 aa, Cryptosporidium parvum
SSINKLRFKIQVLTLVCPIS

SEQ ID NO: 2238268 - protein, 38 aa, Cryptosporidium parvum
SSIPRLFNILCEWCDYFGPNIMTIFWLLLVFFIISILI

SEQ ID NO: 2238269 - protein, 22 aa, Cryptosporidium parvum
SSISRSCCLILLLIAFVENNRN

SEQ ID NO: 2238270 - protein, 20 aa, Cryptosporidium parvum
SSKILLNFNRNGAFALFDPI

SEQ ID NO: 2238271 - protein, 20 aa, Cryptosporidium parvum
SSKLLPPEALYTWPTSSSNQ

SEQ ID NO: 2238272 - protein, 22 aa, Cryptosporidium parvum
SSKLRISISLYKNLFDKFTRSL

SEQ ID NO: 2238273 - protein, 44 aa, Cryptosporidium parvum; identical to SEQ ID NO: 2127725

SEQ ID NO: 2238274 - protein, 24 aa, Cryptosporidium parvum
SSKYRYYVVEGFTFQTIFRHFPLR

SEQ ID NO: 2238275 - protein, 26 aa, Cryptosporidium parvum
SSLFFERPELLLIHKKKVLRDMLNGN

SEQ ID NO: 2238276 - protein, 21 aa, Cryptosporidium parvum
SSLFIIIGWITSYTCSCVLPK

SEQ ID NO: 2238277 - protein, 19 aa, Cryptosporidium parvum
SSLFQCILGNYKLDSGFIS

SEQ ID NO: 2238278 - protein, 22 aa, Cryptosporidium parvum
SSLHRRIRKFLKVHESGNSQFG

SEQ ID NO: 2238279 - protein, 25 aa, Cryptosporidium parvum
SSLISNRVSYSFGLTGPSLTIDTAC

SEQ ID NO: 2238280 - protein, 35 aa, Cryptosporidium parvum
SSLKGLCCNFGHLVFPSNGLIQFFYRLLSKIFTKN

SEQ ID NO: 2238281 - protein, 27 aa, Cryptosporidium parvum
SSLKVRLLKPFYSWRATAAHGVCLYRK

SEQ ID NO: 2238282 - protein, 22 aa, Cryptosporidium parvum
SSLLRRAFCTESLMKIINFKIA

SEQ ID NO: 2238283 - protein, 18 aa, Cryptosporidium parvum
SSLPELIFGLLIQNDGSK

SEQ ID NO: 2238284 - protein, 17 aa, Cryptosporidium parvum
SSLPLRENFALPFIWIN

SEQ ID NO: 2238285 - protein, 18 aa, Cryptosporidium parvum
SSLPRSSIMMQVLSSKGL

SEQ ID NO: 2238286 - protein, 32 aa, Cryptosporidium parvum
SSLQALKFRLLCLRAHLIKCGPVLPKNIYNGS

SEQ ID NO: 2238287 - protein, 23 aa, Cryptosporidium parvum
SSLSPRFGRNSFFSAANSSSNSV

SEQ ID NO: 2238288 - protein, 23 aa, Cryptosporidium parvum
SSNILRDVWFSEISREILNYVNG

SEQ ID NO: 2238289 - protein, 26 aa, Cryptosporidium parvum
SSNITRKWSELMVKYYGVLNDSDKSD

SEQ ID NO: 2238290 - protein, 22 aa, Cryptosporidium parvum
SSNLILRKLLIDENGSKKIINS

SEQ ID NO: 2238291 - protein, 21 aa, Cryptosporidium parvum
SSNPDIVCWSLRTLTTTCSNW

SEQ ID NO: 2238292 - protein, 17 aa, Cryptosporidium parvum
SSNRKLIGVTRVIPEEI

SEQ ID NO: 2238293 - protein, 18 aa, Cryptosporidium parvum
SSNSKYWYSFAVTGINIT

SEQ ID NO: 2238294 - protein, 22 aa, Cryptosporidium parvum
SSPFCIAPWILDSAFQVLGGFL

SEQ ID NO: 2238295 - protein, 20 aa, Cryptosporidium parvum
SSPSPYLHWTLKEIYDQPHA

SEQ ID NO: 2238296 - protein, 19 aa, Cryptosporidium parvum
SSQAAFKIIFGEITALKSM

SEQ ID NO: 2238297 - protein, 23 aa, Cryptosporidium parvum
SSQIKNIICKESDLVFSNTETNV

SEQ ID NO: 2238298 - protein, 17 aa, Cryptosporidium parvum
SSQRPSIEVRRNCILVN

SEQ ID NO: 2238299 - protein, 19 aa, Cryptosporidium parvum
SSQSFKILRESSIQISSNF

SEQ ID NO: 2238300 - protein, 24 aa, Cryptosporidium parvum
SSRIWRITISLILFIFFCGISIIL

SEQ ID NO: 2238301 - protein, 26 aa, Cryptosporidium parvum
SSRKLKRFIPVHFHPILMEPLSSRLF

SEQ ID NO: 2238302 - protein, 21 aa, Cryptosporidium parvum
SSRPYGFSDVIYVNYRIFNEK

SEQ ID NO: 2238303 - protein, 34 aa, Cryptosporidium parvum; identical to SEQ ID NO: 2127750

SEQ ID NO: 2238304 - protein, 23 aa, Cryptosporidium parvum
SSSAFICIYYFLSIAESISSLIY

SEQ ID NO: 2238305 - protein, 28 aa, Cryptosporidium parvum
SSSEWSEFDFAIAAVVHFFSIILGVPIL

SEQ ID NO: 2238306 - protein, 19 aa, Cryptosporidium parvum
SSSGFLIGGGVGINSSGSG

SEQ ID NO: 2238307 - protein, 19 aa, Cryptosporidium parvum
SSSIFDININFPKGDKDTN

SEQ ID NO: 2238308 - protein, 20 aa, Cryptosporidium parvum
SSSIPIKAKSLFHLEALHGT

SEQ ID NO: 2238309 - protein, 22 aa, Cryptosporidium parvum
SSSIYNFVFIFSIIISTIYLLQ

SEQ ID NO: 2238310 - protein, 18 aa, Cryptosporidium parvum
SSSKRMGILLEFKGRYIY

SEQ ID NO: 2238311 - protein, 24 aa, Cryptosporidium parvum
SSSMKLFVALLIRPKSVEWFNGLF

SEQ ID NO: 2238312 - protein, 24 aa, Cryptosporidium parvum
SSSNFGLKLGYCVTTINNFSKSPN

SEQ ID NO: 2238313 - protein, 18 aa, Cryptosporidium parvum
SSSPPFVIIYWDSVSDSL

SEQ ID NO: 2238314 - protein, 20 aa, Cryptosporidium parvum
SSSVIFPFTFYVKSSDNNSD

SEQ ID NO: 2238315 - protein, 17 aa, Cryptosporidium parvum
SSTIIGVISIIFSILHI

SEQ ID NO: 2238316 - protein, 18 aa, Cryptosporidium parvum
SSTKTQLEFCLTAIQLRL

SEQ ID NO: 2238317 - protein, 21 aa, Cryptosporidium parvum
SSVALAHFWLHPALIHTSSHS

SEQ ID NO: 2238318 - protein, 18 aa, Cryptosporidium parvum
SSVLEVHDLHVWSVSVGV

SEQ ID NO: 2238319 - protein, 19 aa, Cryptosporidium parvum
SSVMIRLMLVFGPAACCLS

SEQ ID NO: 2238320 - protein, 23 aa, Cryptosporidium parvum
SSWFVSDPWIWLDLIETSFLPLI

SEQ ID NO: 2238321 - protein, 23 aa, Cryptosporidium parvum
STAWYFNPDFENILSNSCVITSP

SEQ ID NO: 2238322 - protein, 19 aa, Cryptosporidium parvum
STCEFLVDLFEGFLDLTQV

SEQ ID NO: 2238323 - protein, 22 aa, Cryptosporidium parvum
STCNKCKECSAGCPEWFKGNTV

SEQ ID NO: 2238324 - protein, 21 aa, Cryptosporidium parvum
STEAIATWEGLKCFEIEDYDL

SEQ ID NO: 2238325 - protein, 17 aa, Cryptosporidium parvum
STEFKIEIDYKLKNISC

SEQ ID NO: 2238326 - protein, 18 aa, Cryptosporidium parvum
STETINWTCIPTQAGTIP

SEQ ID NO: 2238327 - protein, 27 aa, Cryptosporidium parvum
STFFKFGSPLFRVKNIPLRLSCSRIED

SEQ ID NO: 2238328 - protein, 24 aa, Cryptosporidium parvum
STFLKIPLPLLLAVGAVLILETDY

SEQ ID NO: 2238329 - protein, 24 aa, Cryptosporidium parvum
STFWKVLLGNIFLIILCLSNVYST

SEQ ID NO: 2238330 - protein, 18 aa, Cryptosporidium parvum
STFWQSKKVWSFSSQSND

SEQ ID NO: 2238331 - protein, 25 aa, Cryptosporidium parvum
STGQRIRISFARSLYCKLIQSSVYR

SEQ ID NO: 2238332 - protein, 29 aa, Cryptosporidium parvum
STIEVGLLYKSWMCHKNLKKEILNRHIKQ

SEQ ID NO: 2238333 - protein, 17 aa, Cryptosporidium parvum
STIEYLPQVVLRFKEYI

SEQ ID NO: 2238334 - protein, 34 aa, Cryptosporidium parvum; identical to SEQ ID NO: 2127777

SEQ ID NO: 2238335 - protein, 17 aa, Cryptosporidium parvum
STIFSQVQFSRGQKVRL

SEQ ID NO: 2238336 - protein, 18 aa, Cryptosporidium parvum
STIPGIIISLIISVATLR

SEQ ID NO: 2238337 - protein, 41 aa, Cryptosporidium parvum
STKSGILKHVLLGSIIAVIFGCVSKYYFFDKIVLTEENLPN

SEQ ID NO: 2238338 - protein, 17 aa, Cryptosporidium parvum
STLDLISTLGYKYTSIV

SEQ ID NO: 2238339 - protein, 18 aa, Cryptosporidium parvum
STLEGSRTIFLLKNSEYF

SEQ ID NO: 2238340 - protein, 25 aa, Cryptosporidium parvum
STLLCGLCVIYITLSIVIIVNFFAF

SEQ ID NO: 2238341 - protein, 17 aa, Cryptosporidium parvum
STLLSAILRLYSIQEGS

SEQ ID NO: 2238342 - protein, 28 aa, Cryptosporidium parvum
STLQCARFILLFVCNDFFTLFSKLYNKK

SEQ ID NO: 2238343 - protein, 18 aa, Cryptosporidium parvum
STLSGPAIRITRSNTANK

SEQ ID NO: 2238344 - protein, 27 aa, Cryptosporidium parvum
STLSIKYRIWISFAFTIIILTLIALLR

SEQ ID NO: 2238345 - protein, 19 aa, Cryptosporidium parvum
STLSVELNDDFGYLVNMGS

SEQ ID NO: 2238346 - protein, 18 aa, Cryptosporidium parvum
STLTTVLLMYKLMGLNSI

SEQ ID NO: 2238347 - protein, 25 aa, Cryptosporidium parvum
STLVCFLAIISIRFLVKCCQGKETL

SEQ ID NO: 2238348 - protein, 18 aa, Cryptosporidium parvum
STLWSGSVTIKFTTRFER

SEQ ID NO: 2238349 - protein, 17 aa, Cryptosporidium parvum
STLYKFQNLHAWNTLLS

SEQ ID NO: 2238350 - protein, 19 aa, Cryptosporidium parvum
STNICKSIMPFFINMKQTN

SEQ ID NO: 2238351 - protein, 23 aa, Cryptosporidium parvum
STPLPHYRWIECSNRSNLEKLKN

SEQ ID NO: 2238352 - protein, 19 aa, Cryptosporidium parvum
STPPLLKICGFDITEKLSG

SEQ ID NO: 2238353 - protein, 17 aa, Cryptosporidium parvum
STPWITFIVLVRSSRTG

SEQ ID NO: 2238354 - protein, 25 aa, Cryptosporidium parvum
STSFIIKYFTSMWISIVSKLNNSRQ

SEQ ID NO: 2238355 - protein, 25 aa, Cryptosporidium parvum
STSIKRIVVITSLLSFILIPDSTSF

SEQ ID NO: 2238356 - protein, 30 aa, Cryptosporidium parvum
STSLMYIRSLLRLFFLFSSFKEDNGKQKMK

SEQ ID NO: 2238357 - protein, 17 aa, Cryptosporidium parvum
STSSGLLFNEILRSPST

SEQ ID NO: 2238358 - protein, 19 aa, Cryptosporidium parvum
STSWTQWAIGKIIGTGGSS

SEQ ID NO: 2238359 - protein, 24 aa, Cryptosporidium parvum
STVCFIICAFGVLVVHYLESKAAM

SEQ ID NO: 2238360 - protein, 26 aa, Cryptosporidium parvum
STYTESFRLFGIVVASSIVFIFMMYS

SEQ ID NO: 2238361 - protein, 25 aa, Cryptosporidium parvum
SVAAEAAKKYFAANVEGEGEGEEVP

SEQ ID NO: 2238362 - protein, 20 aa, Cryptosporidium parvum
SVACLFLFNENPISSNIGSK

SEQ ID NO: 2238363 - protein, 23 aa, Cryptosporidium parvum
SVACSFILEMIAKLKLGNKNLEK

SEQ ID NO: 2238364 - protein, 24 aa, Cryptosporidium parvum
SVAFRVYPIFKYFGFFFKFIQRLK

SEQ ID NO: 2238365 - protein, 18 aa, Cryptosporidium parvum
SVAIWKLSNNFEVILLQN

SEQ ID NO: 2238366 - protein, 25 aa, Cryptosporidium parvum
SVDFPRIPVHITKATHNWHVKHHRE

SEQ ID NO: 2238367 - protein, 18 aa, Cryptosporidium parvum
SVDNMSILFKILDYFLLT

SEQ ID NO: 2238368 - protein, 19 aa, Cryptosporidium parvum
SVEAGRCLDLLVNQLISSQ

SEQ ID NO: 2238369 - protein, 19 aa, Cryptosporidium parvum
SVFSDFFLSLSQIFITESN

SEQ ID NO: 2238370 - protein, 18 aa, Cryptosporidium parvum
SVFYCSQSSWIINGTVRS

SEQ ID NO: 2238371 - protein, 25 aa, Cryptosporidium parvum
SVGFVLVCALFFHSLFEGMVVGTSK

SEQ ID NO: 2238372 - protein, 21 aa, Cryptosporidium parvum
SVGIAPRLYAILEHCEDNCND

SEQ ID NO: 2238373 - protein, 28 aa, Cryptosporidium parvum
SVGLRLNRGALRFPIEINEENGFLMSNV

SEQ ID NO: 2238374 - protein, 24 aa, Cryptosporidium parvum
SVGSLRCWIQVLPPEIAIIRPIYP

SEQ ID NO: 2238375 - protein, 26 aa, Cryptosporidium parvum
SVHFKEPIGEPLLWNYIIQIVLALVH

SEQ ID NO: 2238376 - protein, 19 aa, Cryptosporidium parvum
SVHTCPRCLNKISRNRRIK

SEQ ID NO: 2238377 - protein, 21 aa, Cryptosporidium parvum
SVIFCLAIFMNFVLSYTYGKN

SEQ ID NO: 2238378 - protein, 25 aa, Cryptosporidium parvum
SVIPPEFPITLSVAVTMAVVQLTKK

SEQ ID NO: 2238379 - protein, 23 aa, Cryptosporidium parvum
SVISLPSITGFVFDHMEIGINNT

SEQ ID NO: 2238380 - protein, 20 aa, Cryptosporidium parvum
SVKKEWISLLIILKDNPAIS

SEQ ID NO: 2238381 - protein, 17 aa, Cryptosporidium parvum
SVLFKSKIHRFFSHQLM

SEQ ID NO: 2238382 - protein, 25 aa, Cryptosporidium parvum
SVLLTLICSIGFIPGIPKWVDSAEH

SEQ ID NO: 2238383 - protein, 20 aa, Cryptosporidium parvum
SVLNPRTWRVIFSEITAIII

SEQ ID NO: 2238384 - protein, 20 aa, Cryptosporidium parvum
SVLPHLKSLVQIISHGLSDE

SEQ ID NO: 2238385 - protein, 22 aa, Cryptosporidium parvum
SVLPILRIVILAVLDPRKLHSS

SEQ ID NO: 2238386 - protein, 31 aa, Cryptosporidium parvum; identical to SEQ ID NO: 2127808

SEQ ID NO: 2238387 - protein, 23 aa, Cryptosporidium parvum
SVLSRPAMFCIIFISLLITILEI

SEQ ID NO: 2238388 - protein, 18 aa, Cryptosporidium parvum
SVPLQLFPSMGIIEKYIF

SEQ ID NO: 2238389 - protein, 25 aa, Cryptosporidium parvum
SVRMLEFLSGIAYVPIKVDFPGNLK

SEQ ID NO: 2238390 - protein, 24 aa, Cryptosporidium parvum
SVSEKKNKCDIIYSFKVKNSINKL

SEQ ID NO: 2238391 - protein, 24 aa, Cryptosporidium parvum
SVSFPLIRINLIKDWDWKNKQLIG

SEQ ID NO: 2238392 - protein, 18 aa, Cryptosporidium parvum
SVSILELLCYQNFSFQEG

SEQ ID NO: 2238393 - protein, 25 aa, Cryptosporidium parvum
SVSLEVFSSICFVLCLRGLSTQETA

SEQ ID NO: 2238394 - protein, 26 aa, Cryptosporidium parvum
SVSRNSLKMALDLCIINYPEVAQKLG

SEQ ID NO: 2238395 - protein, 20 aa, Cryptosporidium parvum
SVTEVFRLSGASVIASFLTL

SEQ ID NO: 2238396 - protein, 20 aa, Cryptosporidium parvum
SVWGFFPVNLLPRFNPYNSG

SEQ ID NO: 2238397 - protein, 22 aa, Cryptosporidium parvum
SVYEIKELILLQDLDLKLLKEL

SEQ ID NO: 2238398 - protein, 19 aa, Cryptosporidium parvum
SWFFRLWSESTVLTSPVLY

SEQ ID NO: 2238399 - protein, 22 aa, Cryptosporidium parvum
SWFNCHPQTFVAGSCLLGTISI

SEQ ID NO: 2238400 - protein, 25 aa, Cryptosporidium parvum
SWFTHCLQKYFPLWFSDEDLDSFSY

SEQ ID NO: 2238401 - protein, 19 aa, Cryptosporidium parvum
SWFYGDLFCNYKMNQIIIT

SEQ ID NO: 2238402 - protein, 22 aa, Cryptosporidium parvum
SWGIPFNYCCFIYSIFTLLSCL

SEQ ID NO: 2238403 - protein, 26 aa, Cryptosporidium parvum
SWLWSELPIRFAIDLNGLTIRKMHSS

SEQ ID NO: 2238404 - protein, 19 aa, Cryptosporidium parvum
SWNPFSITRVKLFHASNSC

SEQ ID NO: 2238405 - protein, 22 aa, Cryptosporidium parvum
SWPCIEYIQLFWKVHGMTNTGL

SEQ ID NO: 2238406 - protein, 26 aa, Cryptosporidium parvum
SWSVQEISEIFILQKIRNRWSEPKKM

SEQ ID NO: 2238407 - protein, 18 aa, Cryptosporidium parvum
SWTKNALIPTEQVTYNTK

SEQ ID NO: 2238408 - protein, 24 aa, Cryptosporidium parvum
SWYLARLARESFMNMNLDLLLESL

SEQ ID NO: 2238409 - protein, 22 aa, Cryptosporidium parvum
SYFKQIISLFGINNLYISFEPF

SEQ ID NO: 2238410 - protein, 21 aa, Cryptosporidium parvum
SYFLHNSRVSINFSTNENILQ

SEQ ID NO: 2238411 - protein, 22 aa, Cryptosporidium parvum
SYFPQVLIYLSFIRIICFPITE

SEQ ID NO: 2238412 - protein, 26 aa, Cryptosporidium parvum
SYFSQLKFRIVLVGRKIRGLGKLYWY

SEQ ID NO: 2238413 - protein, 26 aa, Cryptosporidium parvum
SYGFMLMVCHWLLFDSIQCIITLLIG

SEQ ID NO: 2238414 - protein, 19 aa, Cryptosporidium parvum
SYGVLTYLWFYGIPNKNGK

SEQ ID NO: 2238415 - protein, 17 aa, Cryptosporidium parvum
SYGWEIVDIGRKFEPEM

SEQ ID NO: 2238416 - protein, 27 aa, Cryptosporidium parvum
SYHEFLETVEIWSAIAGEALIFTGNQI

SEQ ID NO: 2238417 - protein, 24 aa, Cryptosporidium parvum
SYIGLLYCNKYIFKDFEDTKLFNE

SEQ ID NO: 2238418 - protein, 23 aa, Cryptosporidium parvum
SYIKGAHLIIDWHNYGHTLLIAD

SEQ ID NO: 2238419 - protein, 19 aa, Cryptosporidium parvum
SYIRTILMLQANWRRNQNQ

SEQ ID NO: 2238420 - protein, 25 aa, Cryptosporidium parvum
SYISCYLHHLGLYYNIFQLCESLFN

SEQ ID NO: 2238421 - protein, 20 aa, Cryptosporidium parvum
SYISVPWIPGERTAIEELKV

SEQ ID NO: 2238422 - protein, 26 aa, Cryptosporidium parvum
SYIYIPANLLLLIGIYYLPLEEICNL

SEQ ID NO: 2238423 - protein, 40 aa, Cryptosporidium parvum
SYKFKEPRKLPGPLLPYGFSILILLSLFKIIPIWNKLSKI

SEQ ID NO: 2238424 - protein, 26 aa, Cryptosporidium parvum
SYKGMADCIITMFKREGIRSFYRSLP

SEQ ID NO: 2238425 - protein, 20 aa, Cryptosporidium parvum
SYLFGRQFLNPSLFKLKQKN

SEQ ID NO: 2238426 - protein, 22 aa, Cryptosporidium parvum
SYLKVFYIKNMINDWSKEKIKK

SEQ ID NO: 2238427 - protein, 22 aa, Cryptosporidium parvum
SYLMPDFPNWVPIDQKYDDNIG

SEQ ID NO: 2238428 - protein, 22 aa, Cryptosporidium parvum
SYLNDFPLIYIFINDEKSNFDL

SEQ ID NO: 2238429 - protein, 18 aa, Cryptosporidium parvum
SYLPSPFVRIVALDNALE

SEQ ID NO: 2238430 - protein, 19 aa, Cryptosporidium parvum
SYLSQEFFLDNSIQELLAL

SEQ ID NO: 2238431 - protein, 27 aa, Cryptosporidium parvum
SYNNCTNALFPESWIEFILMNNSRYEE

SEQ ID NO: 2238432 - protein, 28 aa, Cryptosporidium parvum
SYNPHVRYAAALTLGITCCGMESPKVTA

SEQ ID NO: 2238433 - protein, 18 aa, Cryptosporidium parvum
SYPSLILFKDFITSKVNF

SEQ ID NO: 2238434 - protein, 17 aa, Cryptosporidium parvum
SYQIISSLFERFPNLII

SEQ ID NO: 2238435 - protein, 29 aa, Cryptosporidium parvum
SYQLRVVIWRVRHIPIEPNTTISLYVSGI

SEQ ID NO: 2238436 - protein, 25 aa, Cryptosporidium parvum
SYQRNEYNIGISIQEEFESLKELIQ

SEQ ID NO: 2238437 - protein, 26 aa, Cryptosporidium parvum
SYRMSLFACFGRDLLLECLQGVKEKI

SEQ ID NO: 2238438 - protein, 22 aa, Cryptosporidium parvum
SYSELMVKVFMELKRHRSKSQM

SEQ ID NO: 2238439 - protein, 25 aa, Cryptosporidium parvum
SYSLECIRKIISLAISCSSYEGPDC

SEQ ID NO: 2238440 - protein, 26 aa, Cryptosporidium parvum
SYSLKPIHSFYFLRSYVRQYLEYIFK

SEQ ID NO: 2238441 - protein, 19 aa, Cryptosporidium parvum
SYSNAWRVGASHTMLQIQP

SEQ ID NO: 2238442 - protein, 19 aa, Cryptosporidium parvum
SYTEFLAACYEWRDSELGV

SEQ ID NO: 2238443 - protein, 20 aa, Cryptosporidium parvum
SYTGSLIWNIWNQKNIILNL

SEQ ID NO: 2238444 - protein, 18 aa, Cryptosporidium parvum
SYTRALLLFERFLLVKYT

SEQ ID NO: 2238445 - protein, 18 aa, Cryptosporidium parvum
SYTSKIIVPIKFRVDFNV

SEQ ID NO: 2238446 - protein, 17 aa, Cryptosporidium parvum
SYYTILLHFLHKKFIKI

SEQ ID NO: 2238447 - protein, 21 aa, Cryptosporidium parvum
SYYVGDGMCDLQCFNEACNWD

SEQ ID NO: 2238448 - protein, 24 aa, Cryptosporidium parvum
TAACKISGEIGYFFVSHLLSLGAS

SEQ ID NO: 2238449 - protein, 19 aa, Cryptosporidium parvum
TAALSWPITIMQYAATLDN

SEQ ID NO: 2238450 - protein, 21 aa, Cryptosporidium parvum
TAASCGMRLVLVNSQYVVVES

SEQ ID NO: 2238451 - protein, 20 aa, Cryptosporidium parvum
TACHLACFLSNAQGHPFTTP

SEQ ID NO: 2238452 - protein, 25 aa, Cryptosporidium parvum
TAELIKICRCLSIPIVVDADGLYVI

SEQ ID NO: 2238453 - protein, 18 aa, Cryptosporidium parvum
TAFFSKDFVQISLFLINI

SEQ ID NO: 2238454 - protein, 21 aa, Cryptosporidium parvum
TAGLWGLALVFVMSYAPLIND

SEQ ID NO: 2238455 - protein, 17 aa, Cryptosporidium parvum
TAIQLRLANNGDDHIDL

SEQ ID NO: 2238456 - protein, 25 aa, Cryptosporidium parvum
TAKKILKFNIYIYRIYTDKYKRKII

SEQ ID NO: 2238457 - protein, 18 aa, Cryptosporidium parvum
TALELMSLLFELEFPINE

SEQ ID NO: 2238458 - protein, 17 aa, Cryptosporidium parvum
TALFHAVLMEDDGMVES

SEQ ID NO: 2238459 - protein, 23 aa, Cryptosporidium parvum
TALHLAYMYGMMGLAEFLINNGF

SEQ ID NO: 2238460 - protein, 24 aa, Cryptosporidium parvum
TALIISMVSICFALLLEIRIGFRA

SEQ ID NO: 2238461 - protein, 17 aa, Cryptosporidium parvum
TALIVLTLVFSWLFNLR

SEQ ID NO: 2238462 - protein, 24 aa, Cryptosporidium parvum
TALRCLLHVILGRYDFSNNHIMDI

SEQ ID NO: 2238463 - protein, 21 aa, Cryptosporidium parvum
TANCYIPTLLSFYYFEINFSF

SEQ ID NO: 2238464 - protein, 22 aa, Cryptosporidium parvum
TAPELPWMNSIGFSYLNKDLPS

SEQ ID NO: 2238465 - protein, 22 aa, Cryptosporidium parvum
TAPVPWARWYVEDHTIPQCIWG

SEQ ID NO: 2238466 - protein, 24 aa, Cryptosporidium parvum
TAPYKFMRGLMCFLTVSLSMLYLI

SEQ ID NO: 2238467 - protein, 17 aa, Cryptosporidium parvum
TAQGIFVNFKRLYEYNG

SEQ ID NO: 2238468 - protein, 19 aa, Cryptosporidium parvum
TARGNLNLRGFRLKEKNYQ

SEQ ID NO: 2238469 - protein, 19 aa, Cryptosporidium parvum
TASFIAAVFCEMLRAYTVR

SEQ ID NO: 2238470 - protein, 22 aa, Cryptosporidium parvum
TASLLSCFAVKYVVGRSRTFGL

SEQ ID NO: 2238471 - protein, 21 aa, Cryptosporidium parvum
TATIFFRRYFVVFFIIPSYLK

SEQ ID NO: 2238472 - protein, 20 aa, Cryptosporidium parvum
TATLCSSVRIYYTHEFVSNY

SEQ ID NO: 2238473 - protein, 24 aa, Cryptosporidium parvum
TAVIPICLSLLMWNDQENIRRIIL

SEQ ID NO: 2238474 - protein, 17 aa, Cryptosporidium parvum
TAVLKCGENMAGYNIGV

SEQ ID NO: 2238475 - protein, 18 aa, Cryptosporidium parvum
TAYDISPLVRMTSVRILR

SEQ ID NO: 2238476 - protein, 18 aa, Cryptosporidium parvum
TCETCLVGSWSEWSDCST

SEQ ID NO: 2238477 - protein, 20 aa, Cryptosporidium parvum
TCGMSVSVALIWDILNIYSF

SEQ ID NO: 2238478 - protein, 23 aa, Cryptosporidium parvum
TCHEVIRPGCCVAFSIDIDGEEK

SEQ ID NO: 2238479 - protein, 22 aa, Cryptosporidium parvum
TCINCLKYVLFDTFEKDIQQMD

SEQ ID NO: 2238480 - protein, 17 aa, Cryptosporidium parvum
TCKIACCSKKCYCATKQ

SEQ ID NO: 2238481 - protein, 17 aa, Cryptosporidium parvum
TCKVLNCVEHLEFTSEL

SEQ ID NO: 2238482 - protein, 23 aa, Cryptosporidium parvum
TCLFAQRAVERWDKVFNDIGKAN

SEQ ID NO: 2238483 - protein, 30 aa, Cryptosporidium parvum
TCQQLIDWSELLSLLLDMFVIKASDLDSST

SEQ ID NO: 2238484 - protein, 17 aa, Cryptosporidium parvum
TCSILLLISAILGYFFP

SEQ ID NO: 2238485 - protein, 24 aa, Cryptosporidium parvum
TCSNIKGAINILGITGKIFMDVLF

SEQ ID NO: 2238486 - protein, 24 aa, Cryptosporidium parvum
TCVQCASTEWCYRVSPNSGGFWNV

SEQ ID NO: 2238487 - protein, 17 aa, Cryptosporidium parvum
TDCDIQSLFGIYDWYSD

SEQ ID NO: 2238488 - protein, 18 aa, Cryptosporidium parvum
TDCSLLSIEYIKKLQIVF

SEQ ID NO: 2238489 - protein, 25 aa, Cryptosporidium parvum
TDDEIIRLKSLIYLYKKMFNKYKED

SEQ ID NO: 2238490 - protein, 24 aa, Cryptosporidium parvum
TDECCYRNGAIYFLTLNCKQLINH

SEQ ID NO: 2238491 - protein, 25 aa, Cryptosporidium parvum
TDEEGRGAFWWSAYYGNIKQIQIIL

SEQ ID NO: 2238492 - protein, 25 aa, Cryptosporidium parvum
TDEFTLIEWCCKLLAQIKFLDFEKY

SEQ ID NO: 2238493 - protein, 25 aa, Cryptosporidium parvum
TDFFKENRSIFTFKENFKSMNYCLI

SEQ ID NO: 2238494 - protein, 25 aa, Cryptosporidium parvum
TDICPIKYICLMLSNSFYGLDPKSP

SEQ ID NO: 2238495 - protein, 21 aa, Cryptosporidium parvum
TDIPTHLGVYYNFINSEGPTT

SEQ ID NO: 2238496 - protein, 23 aa, Cryptosporidium parvum
TDIPWSVSTPYILSSLEKAQQVI

SEQ ID NO: 2238497 - protein, 18 aa, Cryptosporidium parvum
TDKILVLHLFSAKEWSDY

SEQ ID NO: 2238498 - protein, 25 aa, Cryptosporidium parvum
TDKYKRKIIKRVQGILRNLKIVNKS

SEQ ID NO: 2238499 - protein, 23 aa, Cryptosporidium parvum
TDLCLLCNSKLFFLENKKLSSKV

SEQ ID NO: 2238500 - protein, 18 aa, Cryptosporidium parvum
TDLFTFGAIISVSTTLLL

SEQ ID NO: 2238501 - protein, 20 aa, Cryptosporidium parvum
TDLKLMLEEIGIAFRIPFKW

SEQ ID NO: 2238502 - protein, 17 aa, Cryptosporidium parvum
TDLKSFWISIDSNYIKL

SEQ ID NO: 2238503 - protein, 25 aa, Cryptosporidium parvum
TDPMDCNYTYYKFMPCNPNQQGKLL

SEQ ID NO: 2238504 - protein, 26 aa, Cryptosporidium parvum
TDRLPISYMRFCPVSIRIHDYLQSGR

SEQ ID NO: 2238505 - protein, 36 aa, Cryptosporidium parvum; identical to SEQ ID NO: 2127890

SEQ ID NO: 2238506 - protein, 23 aa, Cryptosporidium parvum
TDVKFKIILISTILESLHVANFT

SEQ ID NO: 2238507 - protein, 19 aa, Cryptosporidium parvum
TDYLCIIDFKIAIESSNTA

SEQ ID NO: 2238508 - protein, 22 aa, Cryptosporidium parvum
TEESRCIASIDYLTHVVKKNNH

SEQ ID NO: 2238509 - protein, 26 aa, Cryptosporidium parvum
TEFSRILYRIHIFKIQNMLLLISSYY

SEQ ID NO: 2238510 - protein, 22 aa, Cryptosporidium parvum
TEGILEFWSDWFSPDSNKITEA

SEQ ID NO: 2238511 - protein, 20 aa, Cryptosporidium parvum
TEIRRIKCIINEGNQRGIED

SEQ ID NO: 2238512 - protein, 25 aa, Cryptosporidium parvum
TEKFSDMYFCHFYKTNVELEKLDKA

SEQ ID NO: 2238513 - protein, 24 aa, Cryptosporidium parvum
TEKKNCSFYSIWQEFTDQVNNMCT

SEQ ID NO: 2238514 - protein, 26 aa, Cryptosporidium parvum
TEKPITRWILPSGFEPQYFQMYAESL

SEQ ID NO: 2238515 - protein, 21 aa, Cryptosporidium parvum
TELELPLLYECDWNLVMRARN

SEQ ID NO: 2238516 - protein, 17 aa, Cryptosporidium parvum
TELQRLFGNNAKDKCLW

SEQ ID NO: 2238517 - protein, 25 aa, Cryptosporidium parvum
TEMLNKYFEWRGKKKVAELINTTQI

SEQ ID NO: 2238518 - protein, 19 aa, Cryptosporidium parvum
TENLYWCKLIGSRIDLYKW

SEQ ID NO: 2238519 - protein, 28 aa, Cryptosporidium parvum
TENNLFVIYIDWLHYLFTLYSTIESDIN

SEQ ID NO: 2238520 - protein, 20 aa, Cryptosporidium parvum
TENPFLFSLMKRVFNKQLLS

SEQ ID NO: 2238521 - protein, 22 aa, Cryptosporidium parvum
TEPRLFAKDIKQWVNTNILDHK

SEQ ID NO: 2238522 - protein, 18 aa, Cryptosporidium parvum
TERHRYYVDVNWKSNELK

SEQ ID NO: 2238523 - protein, 31 aa, Cryptosporidium parvum
TERILHSAFWISLYRLSFIPSKNNIHYLYTV

SEQ ID NO: 2238524 - protein, 24 aa, Cryptosporidium parvum
TESFKFLRCKARYSSDFRNLYEKE

SEQ ID NO: 2238525 - protein, 21 aa, Cryptosporidium parvum
TESLANFGVRSVHLLLVSKLV

SEQ ID NO: 2238526 - protein, 28 aa, Cryptosporidium parvum
TESRKKASLRIWIYRKLGKILNYIFKII

SEQ ID NO: 2238527 - protein, 26 aa, Cryptosporidium parvum
TETFFFPLKTLLGISLSPIIGLSWFN

SEQ ID NO: 2238528 - protein, 23 aa, Cryptosporidium parvum
TETKRLLERLAINLELPPIDDKM

SEQ ID NO: 2238529 - protein, 32 aa, Cryptosporidium parvum; identical to SEQ ID NO: 2127902

SEQ ID NO: 2238530 - protein, 22 aa, Cryptosporidium parvum
TETYFQPKIVIVSYILMIQLLP

SEQ ID NO: 2238531 - protein, 18 aa, Cryptosporidium parvum
TEWERCMSQNPTIIARKS

SEQ ID NO: 2238532 - protein, 17 aa, Cryptosporidium parvum
TEYLELLGIQFQLLYGL

SEQ ID NO: 2238533 - protein, 21 aa, Cryptosporidium parvum
TEYLLVVDICKIYDDVIFGEA

SEQ ID NO: 2238534 - protein, 32 aa, Cryptosporidium parvum
TEYSSLYLQNWLKYWSKKGSMIIYIFIGDINN

SEQ ID NO: 2238535 - protein, 18 aa, Cryptosporidium parvum
TFAASGIIGLIKLVLSLH

SEQ ID NO: 2238536 - protein, 25 aa, Cryptosporidium parvum
TFEEINFYFNQVFRELIPNGDAKLI

SEQ ID NO: 2238537 - protein, 25 aa, Cryptosporidium parvum
TFELFKGSIQFGRSLTPRHIMESLW

SEQ ID NO: 2238538 - protein, 20 aa, Cryptosporidium parvum
TFESLMAFNCQVECMDIPTS

SEQ ID NO: 2238539 - protein, 27 aa, Cryptosporidium parvum
TFFAETIPSIALIYGFWSSKNSFLGDT

SEQ ID NO: 2238540 - protein, 17 aa, Cryptosporidium parvum
TFFASSIIFVFIQELVI

SEQ ID NO: 2238541 - protein, 17 aa, Cryptosporidium parvum
TFFEVFDLPVFWPILLI

SEQ ID NO: 2238542 - protein, 23 aa, Cryptosporidium parvum
TFFIPLVLGKGIIKVFFQTLLLI

SEQ ID NO: 2238543 - protein, 30 aa, Cryptosporidium parvum; identical to SEQ ID NO: 2127907

SEQ ID NO: 2238544 - protein, 22 aa, Cryptosporidium parvum
TFFSRLRLPKEMGTLSRCSQIW

SEQ ID NO: 2238545 - protein, 22 aa, Cryptosporidium parvum
TFGQILCGIAFVSYGLGFLLLE

SEQ ID NO: 2238546 - protein, 19 aa, Cryptosporidium parvum
TFGYLRGYILLALPGVLDE

SEQ ID NO: 2238547 - protein, 20 aa, Cryptosporidium parvum
TFLATLEKVKLCLSDTTQLR

SEQ ID NO: 2238548 - protein, 19 aa, Cryptosporidium parvum
TFLECLFLRVKIESDPLTS

SEQ ID NO: 2238549 - protein, 26 aa, Cryptosporidium parvum
TFLLKSSVIGLALILTWIPGVLSTYT

SEQ ID NO: 2238550 - protein, 17 aa, Cryptosporidium parvum
TFLLSDTHLKYYIMRVR

SEQ ID NO: 2238551 - protein, 20 aa, Cryptosporidium parvum
TFLMCSIIRAFDLSNVFKPL

SEQ ID NO: 2238552 - protein, 19 aa, Cryptosporidium parvum
TFLNSRRVINWKLVKEIIK

SEQ ID NO: 2238553 - protein, 20 aa, Cryptosporidium parvum
TFLVIFGIFYAITLCSTIQY

SEQ ID NO: 2238554 - protein, 24 aa, Cryptosporidium parvum
TFMGSLRLTYGIAGIIGIVLYRII

SEQ ID NO: 2238555 - protein, 18 aa, Cryptosporidium parvum
TFPCVAYLGRLLVSASLS

SEQ ID NO: 2238556 - protein, 18 aa, Cryptosporidium parvum
TFPNFPGFLHSIVLLYNG

SEQ ID NO: 2238557 - protein, 33 aa, Cryptosporidium parvum
TFQRLERNFPVFIKRMVAQLIYLLQCEIKFFLK

SEQ ID NO: 2238558 - protein, 26 aa, Cryptosporidium parvum
TFRDWCWYFIFSWVIYCFNIWSDNSM

SEQ ID NO: 2238559 - protein, 17 aa, Cryptosporidium parvum
TFRKSWRKLSTSLEEID

SEQ ID NO: 2238560 - protein, 26 aa, Cryptosporidium parvum
TFRWPCYAFWKIIMGMNILYFMLLTF

SEQ ID NO: 2238561 - protein, 19 aa, Cryptosporidium parvum
TFSFIRLSNIISILYSCCI

SEQ ID NO: 2238562 - protein, 18 aa, Cryptosporidium parvum
TFSTCIRSAFAYFTKNNS

SEQ ID NO: 2238563 - protein, 20 aa, Cryptosporidium parvum
TFSTCISLYCKIIQDKENSN

SEQ ID NO: 2238564 - protein, 19 aa, Cryptosporidium parvum
TFVKFEICEPINKYQEVYL

SEQ ID NO: 2238565 - protein, 18 aa, Cryptosporidium parvum
TFVRCLIICLFVFSWPIS

SEQ ID NO: 2238566 - protein, 18 aa, Cryptosporidium parvum
TFWFNFIALIPLANLLGI

SEQ ID NO: 2238567 - protein, 17 aa, Cryptosporidium parvum
TGCLSFIGYNYKLSFVF

SEQ ID NO: 2238568 - protein, 25 aa, Cryptosporidium parvum
TGEDLYFRREMVIPPSVEISSLKEV

SEQ ID NO: 2238569 - protein, 21 aa, Cryptosporidium parvum
TGEPVFNWRLVYPHLVTPISG

SEQ ID NO: 2238570 - protein, 24 aa, Cryptosporidium parvum
TGGIKTYLFWALFIYFSISSSLLV

SEQ ID NO: 2238571 - protein, 21 aa, Cryptosporidium parvum
TGGKGPFFFCSSNPSIAMIDF

SEQ ID NO: 2238572 - protein, 24 aa, Cryptosporidium parvum
TGIPCVALSLFGLFMINESSGIFS

SEQ ID NO: 2238573 - protein, 25 aa, Cryptosporidium parvum
TGKGLIWRWRRNLRYYWIKLLVLFE

SEQ ID NO: 2238574 - protein, 17 aa, Cryptosporidium parvum
TGKLYVFLMVNSKGTRV

SEQ ID NO: 2238575 - protein, 18 aa, Cryptosporidium parvum
TGKTIPNTYAGVYRSNET

SEQ ID NO: 2238576 - protein, 31 aa, Cryptosporidium parvum
TGLPTDPYSNCPFNPVTGNLVSRSTGKTIPN

SEQ ID NO: 2238577 - protein, 18 aa, Cryptosporidium parvum
TGSFPIYNTLLLRSLYSI

SEQ ID NO: 2238578 - protein, 45 aa, Cryptosporidium parvum
TGTEFLLNILQWLSSMPFSNVPIEFKGVINESIFLDSEKCLVQIG

SEQ ID NO: 2238579 - protein, 18 aa, Cryptosporidium parvum
TGTKLDFFAFTQSPNRKE

SEQ ID NO: 2238580 - protein, 23 aa, Cryptosporidium parvum
TGTPLPSVCYIDFELKCNNPSEG

SEQ ID NO: 2238581 - protein, 17 aa, Cryptosporidium parvum
THFDHFEWETGRHMIPL

SEQ ID NO: 2238582 - protein, 21 aa, Cryptosporidium parvum
THFPWEFKYVYKADLLKVPIV

SEQ ID NO: 2238583 - protein, 40 aa, Cryptosporidium parvum
THIYHSCFKLIPSFKLFLFIFFLFRFRKSIIKSLRDEVKT

SEQ ID NO: 2238584 - protein, 18 aa, Cryptosporidium parvum
THPTICLFQVLFKVLAFL

SEQ ID NO: 2238585 - protein, 17 aa, Cryptosporidium parvum
THSELNHAVIMIGYGIN

SEQ ID NO: 2238586 - protein, 24 aa, Cryptosporidium parvum
THSMKICRSSSCPNLGPISSSRSN

SEQ ID NO: 2238587 - protein, 26 aa, Cryptosporidium parvum
TIADYLRWIALVLFPSFIYIRNTMNS

SEQ ID NO: 2238588 - protein, 20 aa, Cryptosporidium parvum
TIAFYRLVVNYGRMMSYVPF

SEQ ID NO: 2238589 - protein, 18 aa, Cryptosporidium parvum
TIAMLRKQEMLRSQASEN

SEQ ID NO: 2238590 - protein, 22 aa, Cryptosporidium parvum
TICFASIFIMEIVNLIYVYNLF

SEQ ID NO: 2238591 - protein, 19 aa, Cryptosporidium parvum
TICNGIICITGVIYILIGL

SEQ ID NO: 2238592 - protein, 31 aa, Cryptosporidium parvum
TIDKGWIYCHKFWKETMVYHFLYTVLVTSPF

SEQ ID NO: 2238593 - protein, 18 aa, Cryptosporidium parvum
TIDTVEWCWDNCTRETET

SEQ ID NO: 2238594 - protein, 18 aa, Cryptosporidium parvum
TIEEYKKNIDLFREYIEK

SEQ ID NO: 2238595 - protein, 18 aa, Cryptosporidium parvum
TIETRFVKSNSMAFAGEI

SEQ ID NO: 2238596 - protein, 17 aa, Cryptosporidium parvum
TIFFLEFFVQRLVFDKL

SEQ ID NO: 2238597 - protein, 18 aa, Cryptosporidium parvum
TIFGRKLPLCNFPLLDNN

SEQ ID NO: 2238598 - protein, 25 aa, Cryptosporidium parvum
TIFRHFPLRRSFVFELMDHVNTLHF

SEQ ID NO: 2238599 - protein, 19 aa, Cryptosporidium parvum
TIGDYSIIRLIHFIFKRAL

SEQ ID NO: 2238600 - protein, 24 aa, Cryptosporidium parvum
TIHMSLIKCCFDMNMWEDARKLLE

SEQ ID NO: 2238601 - protein, 25 aa, Cryptosporidium parvum
TIIDITGKETIVWYDAIAGNNIVIS

SEQ ID NO: 2238602 - protein, 25 aa, Cryptosporidium parvum
TIIDVIRFSVGFIIKSIVADLQKPM

SEQ ID NO: 2238603 - protein, 24 aa, Cryptosporidium parvum
TIIHPVSFCLTSNLQVLGAVVNLK

SEQ ID NO: 2238604 - protein, 24 aa, Cryptosporidium parvum
TIIKIMLGIPFFKYFEEKESMISS

SEQ ID NO: 2238605 - protein, 27 aa, Cryptosporidium parvum
TIKGKCIYKNPFFYSFFPINSICREFT

SEQ ID NO: 2238606 - protein, 23 aa, Cryptosporidium parvum
TIKYLMHIPLSFYNSLSLPMVMG

SEQ ID NO: 2238607 - protein, 26 aa, Cryptosporidium parvum
TILDCLRLPVCYSFTTLNTRQQLFFD

SEQ ID NO: 2238608 - protein, 25 aa, Cryptosporidium parvum
TILEICLAFFKWTYLVRRDERMNLM

SEQ ID NO: 2238609 - protein, 23 aa, Cryptosporidium parvum
TILEYLDRIPLIQMPLSIASTIR

SEQ ID NO: 2238610 - protein, 23 aa, Cryptosporidium parvum
TILKDEFLPLFIKKNIFTESLEI

SEQ ID NO: 2238611 - protein, 18 aa, Cryptosporidium parvum
TILRLLSVEFPKYKKILN

SEQ ID NO: 2238612 - protein, 29 aa, Cryptosporidium parvum
TILWWACKLHYPKLIFRLLEFYIQARKLP

SEQ ID NO: 2238613 - protein, 21 aa, Cryptosporidium parvum
TIPKARISIIMSDLSSISSKI

SEQ ID NO: 2238614 - protein, 24 aa, Cryptosporidium parvum
TIPYSYRNKYEFTIGYTNNEILDA

SEQ ID NO: 2238615 - protein, 23 aa, Cryptosporidium parvum
TIPYYCYNLILSVLKKEEMKCDN

SEQ ID NO: 2238616 - protein, 22 aa, Cryptosporidium parvum
TIRDLLVKRAQEFNIILDDVSL

SEQ ID NO: 2238617 - protein, 22 aa, Cryptosporidium parvum
TIRGVMRYSNYKGFGTDKFTFQ

SEQ ID NO: 2238618 - protein, 18 aa, Cryptosporidium parvum
TIRHPYYIILVLPICRAL

SEQ ID NO: 2238619 - protein, 24 aa, Cryptosporidium parvum
TIRTCKGLRTSTREHRIICNLSQS

SEQ ID NO: 2238620 - protein, 18 aa, Cryptosporidium parvum
TISGRLLLELKLIEKELI

SEQ ID NO: 2238621 - protein, 24 aa, Cryptosporidium parvum
TISSPFRLPLALFATHSPHNVVLF

SEQ ID NO: 2238622 - protein, 19 aa, Cryptosporidium parvum
TITMTSIMLYFFSLSSMRN

SEQ ID NO: 2238623 - protein, 27 aa, Cryptosporidium parvum
TITTFNFKRCCAKIMNSVTGYFDTFEY

SEQ ID NO: 2238624 - protein, 25 aa, Cryptosporidium parvum
TIVRGIEILVFFAFKKNYLSIFFFD

SEQ ID NO: 2238625 - protein, 19 aa, Cryptosporidium parvum
TIYSFLMKVLENILVIDLH

SEQ ID NO: 2238626 - protein, 20 aa, Cryptosporidium parvum
TKAFNKICLYDVEIILIYCK

SEQ ID NO: 2238627 - protein, 17 aa, Cryptosporidium parvum
TKCSGIIKKRFLLMRNY

SEQ ID NO: 2238628 - protein, 20 aa, Cryptosporidium parvum
TKEIKSSLVDTFNNTMSIDI

SEQ ID NO: 2238629 - protein, 23 aa, Cryptosporidium parvum
TKFEMEDWIQLFLESIVIKDFMN

SEQ ID NO: 2238630 - protein, 17 aa, Cryptosporidium parvum
TKFLLPIEIGNIPEDSG

SEQ ID NO: 2238631 - protein, 23 aa, Cryptosporidium parvum
TKGMLVKWGLVVLIFQLFFSLLV

SEQ ID NO: 2238632 - protein, 21 aa, Cryptosporidium parvum
TKICPPEGCTLRNIIDSIRIC

SEQ ID NO: 2238633 - protein, 25 aa, Cryptosporidium parvum
TKILLEAFTSWSLVLFSIIICAFLF

SEQ ID NO: 2238634 - protein, 17 aa, Cryptosporidium parvum
TKINIRFIPNLANPTKE

SEQ ID NO: 2238635 - protein, 17 aa, Cryptosporidium parvum
TKKLICHNTSTSNAITI

SEQ ID NO: 2238636 - protein, 19 aa, Cryptosporidium parvum
TKLDIIDCIASVPTKVQIT

SEQ ID NO: 2238637 - protein, 22 aa, Cryptosporidium parvum
TKLFWILIPIIICIISLSTNIF

SEQ ID NO: 2238638 - protein, 25 aa, Cryptosporidium parvum
TKLIGVGCLLCFKLSTIDKIIFSKF

SEQ ID NO: 2238639 - protein, 21 aa, Cryptosporidium parvum
TKLKLQTLLNRSASYIKLNDF

SEQ ID NO: 2238640 - protein, 17 aa, Cryptosporidium parvum
TKLRCWHIASNYLSNQI

SEQ ID NO: 2238641 - protein, 17 aa, Cryptosporidium parvum
TKMGLILVNNYKKIGSY

SEQ ID NO: 2238642 - protein, 18 aa, Cryptosporidium parvum
TKNLPNIIISWFNFAIEE

SEQ ID NO: 2238643 - protein, 17 aa, Cryptosporidium parvum
TKNWYKFNLWRYIEYEE

SEQ ID NO: 2238644 - protein, 26 aa, Cryptosporidium parvum
TKPFFSLKIFGIWSMNAVFHAAVSLF

SEQ ID NO: 2238645 - protein, 31 aa, Cryptosporidium parvum
TKPFRLSLFTNKLFVIQIFFIIISTIAITLV

SEQ ID NO: 2238646 - protein, 21 aa, Cryptosporidium parvum
TKPKPGIPVNGGGVVPDEEAK

SEQ ID NO: 2238647 - protein, 20 aa, Cryptosporidium parvum
TKRCCWSISIPRECIALSRI

SEQ ID NO: 2238648 - protein, 23 aa, Cryptosporidium parvum
TKRVFRESIIRGCCKQLELLLSI

SEQ ID NO: 2238649 - protein, 18 aa, Cryptosporidium parvum
TKSDIVFVILCFVTALTL

SEQ ID NO: 2238650 - protein, 17 aa, Cryptosporidium parvum
TKSLAIPLFSNSIENQY

SEQ ID NO: 2238651 - protein, 25 aa, Cryptosporidium parvum
TKTGLNLLILFGIAFMGFCVSGPDS

SEQ ID NO: 2238652 - protein, 19 aa, Cryptosporidium parvum
TKYDLNGLLFWNVSSDTYI

SEQ ID NO: 2238653 - protein, 26 aa, Cryptosporidium parvum
TKYEFGWPLLFNKSWFYGDLFCNYKM

SEQ ID NO: 2238654 - protein, 27 aa, Cryptosporidium parvum
TKYSFPIITGLLLYIGIYLPNGNESNS

SEQ ID NO: 2238655 - protein, 25 aa, Cryptosporidium parvum
TLAKEIMRGFSILIHHILVRSYNFH

SEQ ID NO: 2238656 - protein, 35 aa, Cryptosporidium parvum
TLDWIHCIQARIAILSGIIWGLGIVFAGKRNIELK

SEQ ID NO: 2238657 - protein, 26 aa, Cryptosporidium parvum
TLEAFRYAGIKIWLLTGDKLETALCI

SEQ ID NO: 2238658 - protein, 25 aa, Cryptosporidium parvum
TLEIPFRLKKDFISPLSSPVSSQAD

SEQ ID NO: 2238659 - protein, 23 aa, Cryptosporidium parvum
TLEKTGGVVPEFVNPKYLDSTKT

SEQ ID NO: 2238660 - protein, 23 aa, Cryptosporidium parvum
TLFMLGFLRYFRVLNPVPILTII

SEQ ID NO: 2238661 - protein, 25 aa, Cryptosporidium parvum
TLFPILTVNAVINFLIFYLINGTLI

SEQ ID NO: 2238662 - protein, 32 aa, Cryptosporidium parvum; identical to SEQ ID NO: 2128001

SEQ ID NO: 2238663 - protein, 27 aa, Cryptosporidium parvum
TLGKHVLRATLILTILLPFILEIYYLI

SEQ ID NO: 2238664 - protein, 24 aa, Cryptosporidium parvum
TLHFSKGVELFLSYYYERNERIIG

SEQ ID NO: 2238665 - protein, 18 aa, Cryptosporidium parvum
TLIGPIIRIWAFELAPCV

SEQ ID NO: 2238666 - protein, 18 aa, Cryptosporidium parvum
TLITLLGVSSVWFNDKSI

SEQ ID NO: 2238667 - protein, 24 aa, Cryptosporidium parvum
TLITRFPIRLMIESYNIMFLTGLT

SEQ ID NO: 2238668 - protein, 34 aa, Cryptosporidium parvum
TLKDSSMWEWNLRDIIRLLRFLQLNLIRNLNLRK

SEQ ID NO: 2238669 - protein, 25 aa, Cryptosporidium parvum
TLKEIKLKIPITISYYKIKNIFYND

SEQ ID NO: 2238670 - protein, 17 aa, Cryptosporidium parvum
TLLEKKTYISFLLQQNK

SEQ ID NO: 2238671 - protein, 20 aa, Cryptosporidium parvum
TLLITFGMLNPWYILFDWEY

SEQ ID NO: 2238672 - protein, 19 aa, Cryptosporidium parvum
TLLIYKKKLINYLIPQLFA

SEQ ID NO: 2238673 - protein, 22 aa, Cryptosporidium parvum
TLLKIGNVFVSFIFSSYLTSFM

SEQ ID NO: 2238674 - protein, 18 aa, Cryptosporidium parvum
TLLMKLKNSLNFEDPLLP

SEQ ID NO: 2238675 - protein, 17 aa, Cryptosporidium parvum
TLLQYRFHINDSMKCAF

SEQ ID NO: 2238676 - protein, 17 aa, Cryptosporidium parvum
TLLTYLFTYFKESDIDL

SEQ ID NO: 2238677 - protein, 25 aa, Cryptosporidium parvum
TLNFFAGSVLVIWSIFIYGLERAFP

SEQ ID NO: 2238678 - protein, 18 aa, Cryptosporidium parvum
TLNKMMVMLLNFGSKNPE

SEQ ID NO: 2238679 - protein, 17 aa, Cryptosporidium parvum
TLPELPKGVGTELHSDL

SEQ ID NO: 2238680 - protein, 18 aa, Cryptosporidium parvum
TLPWAFRQTGLFLGIIVL

SEQ ID NO: 2238681 - protein, 28 aa, Cryptosporidium parvum
TLRGYNFEFFKTISLDIFLPLSPLFDPR

SEQ ID NO: 2238682 - protein, 20 aa, Cryptosporidium parvum
TLSCSLYYRLKVVKISCKNT

SEQ ID NO: 2238683 - protein, 23 aa, Cryptosporidium parvum
TLSKFLVRIIHHFSGLYYSLLRS

SEQ ID NO: 2238684 - protein, 22 aa, Cryptosporidium parvum
TLSPSNCIKCPPNGHCKDGNLK

SEQ ID NO: 2238685 - protein, 23 aa, Cryptosporidium parvum
TLSSRINSVLSRFHSGEGNTKLK

SEQ ID NO: 2238686 - protein, 26 aa, Cryptosporidium parvum
TLVIIAHKWVEGIAVSAGIKKHTEIS

SEQ ID NO: 2238687 - protein, 18 aa, Cryptosporidium parvum
TLYSKWLMNNYFPYPITM

SEQ ID NO: 2238688 - protein, 23 aa, Cryptosporidium parvum
TMDSHILGLCWGFGQAIQNTAQS

SEQ ID NO: 2238689 - protein, 17 aa, Cryptosporidium parvum
TMEKCCMYLARCVSNQE

SEQ ID NO: 2238690 - protein, 18 aa, Cryptosporidium parvum
TMGLIPVNRGDFFSDTPP

SEQ ID NO: 2238691 - protein, 27 aa, Cryptosporidium parvum
TMIDWLAVLICSLPVILIDEVLKAFSR

SEQ ID NO: 2238692 - protein, 21 aa, Cryptosporidium parvum
TMRYCRLFEKFSIFVVQDLFK

SEQ ID NO: 2238693 - protein, 19 aa, Cryptosporidium parvum
TMSGLSVSYLAAKNLTVDT

SEQ ID NO: 2238694 - protein, 21 aa, Cryptosporidium parvum
TMSIKKAYRLMSLKYHPDKNP

SEQ ID NO: 2238695 - protein, 17 aa, Cryptosporidium parvum
TNARAAMATSYFIGLGS

SEQ ID NO: 2238696 - protein, 23 aa, Cryptosporidium parvum
TNASIKLIRAWNSHMILRSKRRK

SEQ ID NO: 2238697 - protein, 22 aa, Cryptosporidium parvum
TNCVPIKAFFLLLDKLSNTNWH

SEQ ID NO: 2238698 - protein, 20 aa, Cryptosporidium parvum
TNEILLFMGKWKYRQKDKNH

SEQ ID NO: 2238699 - protein, 17 aa, Cryptosporidium parvum
TNFIICWISRAGRSNHF

SEQ ID NO: 2238700 - protein, 17 aa, Cryptosporidium parvum
TNFPFPSQLVVIIMANV

SEQ ID NO: 2238701 - protein, 17 aa, Cryptosporidium parvum
TNICFASTAITNGTGKA

SEQ ID NO: 2238702 - protein, 26 aa, Cryptosporidium parvum
TNIFKNCLFPFILEEKLQRSALLGLT

SEQ ID NO: 2238703 - protein, 17 aa, Cryptosporidium parvum
TNIKSYELLTYFCQEVI

SEQ ID NO: 2238704 - protein, 24 aa, Cryptosporidium parvum
TNISFPMKFIISKLNFDIIKIITS

SEQ ID NO: 2238705 - protein, 17 aa, Cryptosporidium parvum
TNKLCVICMVNVSIFKD

SEQ ID NO: 2238706 - protein, 24 aa, Cryptosporidium parvum
TNKLNSCLLLLLSNITQNFSIEKY

SEQ ID NO: 2238707 - protein, 18 aa, Cryptosporidium parvum
TNKTARGNLNLRGFRLKE

SEQ ID NO: 2238708 - protein, 19 aa, Cryptosporidium parvum
TNLECIDMMNGPAICVGIR

SEQ ID NO: 2238709 - protein, 25 aa, Cryptosporidium parvum
TNLKKLSFRKEINFLCSFKNILNST

SEQ ID NO: 2238710 - protein, 20 aa, Cryptosporidium parvum
TNLLFYWIICGVIFMIESIV

SEQ ID NO: 2238711 - protein, 27 aa, Cryptosporidium parvum
TNLNIKLSFPIARSFERKLEASIYVSN

SEQ ID NO: 2238712 - protein, 24 aa, Cryptosporidium parvum
TNLNWLKVLIKYFKIFSHSLVPLL

SEQ ID NO: 2238713 - protein, 19 aa, Cryptosporidium parvum
TNLRCVRVNLLGNGQSETK

SEQ ID NO: 2238714 - protein, 24 aa, Cryptosporidium parvum
TNNEIPGLLSVVSIAKENICWSHG

SEQ ID NO: 2238715 - protein, 21 aa, Cryptosporidium parvum
TNNFEPINWFVIYYDSIWHSL

SEQ ID NO: 2238716 - protein, 18 aa, Cryptosporidium parvum
TNPLFFPLDESIPIVLAL

SEQ ID NO: 2238717 - protein, 24 aa, Cryptosporidium parvum
TNREYPIVLIIGWCEQIDMLVKLT

SEQ ID NO: 2238718 - protein, 21 aa, Cryptosporidium parvum
TNRFISLIGEHVFSQYYTTNG

SEQ ID NO: 2238719 - protein, 23 aa, Cryptosporidium parvum
TNSASLRLARFIFESKAPKKSKR

SEQ ID NO: 2238720 - protein, 18 aa, Cryptosporidium parvum
TNSLPFPIQIRLKMASGL

SEQ ID NO: 2238721 - protein, 23 aa, Cryptosporidium parvum
TNSRGIIKYILPFYSFQMFLKDT

SEQ ID NO: 2238722 - protein, 24 aa, Cryptosporidium parvum
TNTLKGTNFTGVVEDSILKNNLTQ

SEQ ID NO: 2238723 - protein, 26 aa, Cryptosporidium parvum
TNVEDILRISLFFGPEIKDFQKTLDQ

SEQ ID NO: 2238724 - protein, 18 aa, Cryptosporidium parvum
TNYHLSLFGPKNLSIEKL

SEQ ID NO: 2238725 - protein, 17 aa, Cryptosporidium parvum
TNYKWVQIISDILINKP

SEQ ID NO: 2238726 - protein, 17 aa, Cryptosporidium parvum
TNYPGLVIISAKKKNLT

SEQ ID NO: 2238727 - protein, 40 aa, Cryptosporidium parvum
TNYQIVCNFKFYTPCIKYLMQFLHDFVAHWSIEKSDQNLS

SEQ ID NO: 2238728 - protein, 25 aa, Cryptosporidium parvum
TNYSLFRHCLNFNKITASLIRDIPF

SEQ ID NO: 2238729 - protein, 23 aa, Cryptosporidium parvum
TPAEFLYMREIRFMNVDSVQLIT

SEQ ID NO: 2238730 - protein, 17 aa, Cryptosporidium parvum
TPDCRYYSYGAFLKGPG

SEQ ID NO: 2238731 - protein, 28 aa, Cryptosporidium parvum
TPDLYLFPRFLSFYKLAPIKLRQQMWLR

SEQ ID NO: 2238732 - protein, 32 aa, Cryptosporidium parvum
TPDPQSCVTCFRRNHFPELQAIFVTCGLKHQK

SEQ ID NO: 2238733 - protein, 23 aa, Cryptosporidium parvum
TPDSLGILIWMKYLIKLAPIESI

SEQ ID NO: 2238734 - protein, 27 aa, Cryptosporidium parvum
TPETLFSNWLRLMIAILIQDSYNLPLQ

SEQ ID NO: 2238735 - protein, 26 aa, Cryptosporidium parvum
TPFGELRLGLKIPYDNKVVSIFFDDQ

SEQ ID NO: 2238736 - protein, 24 aa, Cryptosporidium parvum
TPFMAFRVLLRETKLEVVLRDEFA

SEQ ID NO: 2238737 - protein, 25 aa, Cryptosporidium parvum
TPFSPEIEDGGIIPPEVAAANADKF

SEQ ID NO: 2238738 - protein, 26 aa, Cryptosporidium parvum
TPFTKKLKYAFAFILFLQFIVLLMRI

SEQ ID NO: 2238739 - protein, 17 aa, Cryptosporidium parvum
TPILVFCHKVDPRLEGA

SEQ ID NO: 2238740 - protein, 23 aa, Cryptosporidium parvum
TPKDRDLDCIYLTSTGMQTEIRV

SEQ ID NO: 2238741 - protein, 24 aa, Cryptosporidium parvum
TPLPSGIPAHLLAPGNLPSATSVE

SEQ ID NO: 2238742 - protein, 22 aa, Cryptosporidium parvum
TPLSIMDRLLWSSSNLFVPTLR

SEQ ID NO: 2238743 - protein, 18 aa, Cryptosporidium parvum
TPQTAYRIWIRSQFLRRD

SEQ ID NO: 2238744 - protein, 19 aa, Cryptosporidium parvum
TPRGILFAIVDFVSYSSLF

SEQ ID NO: 2238745 - protein, 17 aa, Cryptosporidium parvum
TPSCIWACIPSQRLQSL

SEQ ID NO: 2238746 - protein, 20 aa, Cryptosporidium parvum
TPSCNDFFKGCESISKQYFS

SEQ ID NO: 2238747 - protein, 18 aa, Cryptosporidium parvum
TPSEIKSMVLAIIHTILL

SEQ ID NO: 2238748 - protein, 19 aa, Cryptosporidium parvum
TPTCSDVIEKFEWNKDLIG

SEQ ID NO: 2238749 - protein, 22 aa, Cryptosporidium parvum
TPWCGHCKTFDPIYNEVANIVT

SEQ ID NO: 2238750 - protein, 19 aa, Cryptosporidium parvum
TPYSWMLILFRAGPIGGMI

SEQ ID NO: 2238751 - protein, 24 aa, Cryptosporidium parvum
TQERLQRVYLFQGFINSRIKAYSN

SEQ ID NO: 2238752 - protein, 17 aa, Cryptosporidium parvum
TQFKDLEPILNYFEITE

SEQ ID NO: 2238753 - protein, 20 aa, Cryptosporidium parvum
TQGKFSFARVRSTTIPVRWY

SEQ ID NO: 2238754 - protein, 18 aa, Cryptosporidium parvum
TQIIKTSIPLIGKNIDCF

SEQ ID NO: 2238755 - protein, 26 aa, Cryptosporidium parvum
TQKKMLWIILCIFILILVVLLPIIIG

SEQ ID NO: 2238756 - protein, 38 aa, Cryptosporidium parvum
TQLEELYYNLGIIMGFPYFAPRFSLGFHYSKWEYTSEN

SEQ ID NO: 2238757 - protein, 26 aa, Cryptosporidium parvum
TQSSDFCRIWLLTALVRLIHIPSGGL

SEQ ID NO: 2238758 - protein, 20 aa, Cryptosporidium parvum
TRCQIKFPEEISCKLTGVVG

SEQ ID NO: 2238759 - protein, 24 aa, Cryptosporidium parvum
TRESSKLFLDFCLDKIKYYSENES

SEQ ID NO: 2238760 - protein, 17 aa, Cryptosporidium parvum
TRFKKYRGLESLRTSNW

SEQ ID NO: 2238761 - protein, 29 aa, Cryptosporidium parvum
TRIADIYMLGIIMFWIWSDGGIWKYSDTR

SEQ ID NO: 2238762 - protein, 21 aa, Cryptosporidium parvum
TRILEKIYHLFLKGELPYSKL

SEQ ID NO: 2238763 - protein, 17 aa, Cryptosporidium parvum
TRLDLYLYNLFKHLFSI

SEQ ID NO: 2238764 - protein, 21 aa, Cryptosporidium parvum
TRLNILNSYFLWEAGKGSKHD

SEQ ID NO: 2238765 - protein, 20 aa, Cryptosporidium parvum
TRLQGSLFRKINEFLYTSDS

SEQ ID NO: 2238766 - protein, 18 aa, Cryptosporidium parvum
TRLYCSFQGKIFFGTSSE

SEQ ID NO: 2238767 - protein, 17 aa, Cryptosporidium parvum
TRMVKKAVIPKEIKEND

SEQ ID NO: 2238768 - protein, 17 aa, Cryptosporidium parvum
TRNGYLFSTMNSEELHL

SEQ ID NO: 2238769 - protein, 22 aa, Cryptosporidium parvum
TRPGNFRTRLLLTLKSLYDMIG

SEQ ID NO: 2238770 - protein, 21 aa, Cryptosporidium parvum
TRPSILVTLCKLLKPAPPIPL

SEQ ID NO: 2238771 - protein, 20 aa, Cryptosporidium parvum
TRRILKMNLKDSLKGRSKNV

SEQ ID NO: 2238772 - protein, 20 aa, Cryptosporidium parvum
TRRMVDPVSLMLFDNSTGVM

SEQ ID NO: 2238773 - protein, 19 aa, Cryptosporidium parvum
TRSIIIKWLSNNVNEANLV

SEQ ID NO: 2238774 - protein, 23 aa, Cryptosporidium parvum
TRSKLLLMLRIRYRILKLKNEDK

SEQ ID NO: 2238775 - protein, 23 aa, Cryptosporidium parvum
TRSTMKSILGYSILISVFLFIVF

SEQ ID NO: 2238776 - protein, 19 aa, Cryptosporidium parvum
TRTFARFRINPIKITVKDI

SEQ ID NO: 2238777 - protein, 27 aa, Cryptosporidium parvum
TRTWKIPHGYSLLSYIYTYLWQFQINP

SEQ ID NO: 2238778 - protein, 26 aa, Cryptosporidium parvum
TRVVNFLRLYLIKVLPKNILGTFKNF

SEQ ID NO: 2238779 - protein, 29 aa, Cryptosporidium parvum
TRYLIDANVCNFELVAFQRDTEFFKLVFE

SEQ ID NO: 2238780 - protein, 22 aa, Cryptosporidium parvum
TRYSRHLVCDYIYIHEKFPEAA

SEQ ID NO: 2238781 - protein, 18 aa, Cryptosporidium parvum
TSAIPLLYVLIQFISNSN

SEQ ID NO: 2238782 - protein, 18 aa, Cryptosporidium parvum
TSASKLLLFNYLKLNSMK

SEQ ID NO: 2238783 - protein, 18 aa, Cryptosporidium parvum
TSASSWYKKLFPNNILVS

SEQ ID NO: 2238784 - protein, 25 aa, Cryptosporidium parvum
TSCGLGSRLRARWLLSEPENEEALS

SEQ ID NO: 2238785 - protein, 20 aa, Cryptosporidium parvum
TSCGLQKWDVSTQYIHKAFE

SEQ ID NO: 2238786 - protein, 18 aa, Cryptosporidium parvum
TSDRFKCDLNNEIISKMC

SEQ ID NO: 2238787 - protein, 23 aa, Cryptosporidium parvum
TSDWVTLLAIELFSTAYSLDDEK

SEQ ID NO: 2238788 - protein, 19 aa, Cryptosporidium parvum
TSECHTIFTWELLSSNCKQ

SEQ ID NO: 2238789 - protein, 25 aa, Cryptosporidium parvum
TSEMCCVQFFVPRSFISIDKYTVEG

SEQ ID NO: 2238790 - protein, 19 aa, Cryptosporidium parvum
TSFNPTWFHCLVWKSLTER

SEQ ID NO: 2238791 - protein, 39 aa, Cryptosporidium parvum
TSGKWKKISWIGFKISFFIPRTSISWIHQNELVLVTHGS

SEQ ID NO: 2238792 - protein, 18 aa, Cryptosporidium parvum
TSGLDFKVSTIIKNISKI

SEQ ID NO: 2238793 - protein, 20 aa, Cryptosporidium parvum
TSGNIWKMFQPILNIKYHSS

SEQ ID NO: 2238794 - protein, 28 aa, Cryptosporidium parvum
TSHRICKYFWKPIDLFRDVLAIVTISFV

SEQ ID NO: 2238795 - protein, 23 aa, Cryptosporidium parvum
TSHTIRLLALRRFELKILFQKIL

SEQ ID NO: 2238796 - protein, 27 aa, Cryptosporidium parvum
TSIEYSSEFFPRFSWSKNDTFGAFTTG

SEQ ID NO: 2238797 - protein, 35 aa, Cryptosporidium parvum
TSIFLPLTIKVVSYFKIDSIMLFLRSISISKMVNS

SEQ ID NO: 2238798 - protein, 29 aa, Cryptosporidium parvum
TSIFSLPLLSSWFGLQWTKNQLWSKDILP

SEQ ID NO: 2238799 - protein, 24 aa, Cryptosporidium parvum
TSIHSRILFKIIMSIYNNENILLV

SEQ ID NO: 2238800 - protein, 19 aa, Cryptosporidium parvum
TSILLLLCLLFEKDESERN

SEQ ID NO: 2238801 - protein, 30 aa, Cryptosporidium parvum; identical to SEQ ID NO: 2182991

SEQ ID NO: 2238802 - protein, 22 aa, Cryptosporidium parvum
TSKDLKSRCSYVMQHEMTIPYL

SEQ ID NO: 2238803 - protein, 18 aa, Cryptosporidium parvum
TSKQFGFWMFPFLLSSLS

SEQ ID NO: 2238804 - protein, 21 aa, Cryptosporidium parvum
TSLKHAINIINLMNDIYFPLN

SEQ ID NO: 2238805 - protein, 25 aa, Cryptosporidium parvum
TSLLFQLAIPLNFIGMIYRESKLTL

SEQ ID NO: 2238806 - protein, 21 aa, Cryptosporidium parvum
TSLLLKEIILFYVDNFLLNQE

SEQ ID NO: 2238807 - protein, 20 aa, Cryptosporidium parvum
TSLLLSWFFNGLFHAGVYPM

SEQ ID NO: 2238808 - protein, 23 aa, Cryptosporidium parvum
TSLWKGVTAHIIFRITEDLIKNS

SEQ ID NO: 2238809 - protein, 20 aa, Cryptosporidium parvum
TSNIVLRNGFHTNILRLYIP

SEQ ID NO: 2238810 - protein, 21 aa, Cryptosporidium parvum
TSNKYPLFLKYLFPKLSEALS

SEQ ID NO: 2238811 - protein, 18 aa, Cryptosporidium parvum
TSNLNILIPLAIYGLNKP

SEQ ID NO: 2238812 - protein, 20 aa, Cryptosporidium parvum
TSNTWLKSNQNLFGQYGDLI

SEQ ID NO: 2238813 - protein, 21 aa, Cryptosporidium parvum
TSPARLRLQISNVIPPENSAW

SEQ ID NO: 2238814 - protein, 24 aa, Cryptosporidium parvum
TSQGCLMISSLSKFPADTIHPLTS

SEQ ID NO: 2238815 - protein, 18 aa, Cryptosporidium parvum
TSQGFGNDASIDFEDGDY

SEQ ID NO: 2238816 - protein, 17 aa, Cryptosporidium parvum
TSRENGILFALPTGNNG

SEQ ID NO: 2238817 - protein, 23 aa, Cryptosporidium parvum
TSRYLQHLFPLFVRSTNEFLSKL

SEQ ID NO: 2238818 - protein, 17 aa, Cryptosporidium parvum
TSSCICVDCFQNGNHEN

SEQ ID NO: 2238819 - protein, 19 aa, Cryptosporidium parvum
TSSEWQMRMYGYKKGMKEI

SEQ ID NO: 2238820 - protein, 25 aa, Cryptosporidium parvum
TSSHARIVLVIALFIIIFMLKQGMF

SEQ ID NO: 2238821 - protein, 29 aa, Cryptosporidium parvum
TSSTCRKPQLPEFLLQRSVINSGANSGIV

SEQ ID NO: 2238822 - protein, 24 aa, Cryptosporidium parvum
TSTEFFDFIKLIFKKENSSLFSNV

SEQ ID NO: 2238823 - protein, 18 aa, Cryptosporidium parvum
TSVIEVWRIRNLKYDNSD

SEQ ID NO: 2238824 - protein, 22 aa, Cryptosporidium parvum
TSVILLEFWQFSVFVISTQILS

SEQ ID NO: 2238825 - protein, 23 aa, Cryptosporidium parvum
TSVPKALKFLGIHYETLKEFCDS

SEQ ID NO: 2238826 - protein, 24 aa, Cryptosporidium parvum
TSYILKRLHRGILYYKQKNNYIDS

SEQ ID NO: 2238827 - protein, 23 aa, Cryptosporidium parvum
TTCENCPFIISFRLFNISQEPFF

SEQ ID NO: 2238828 - protein, 18 aa, Cryptosporidium parvum
TTCLFPYANMIIPGIINQ

SEQ ID NO: 2238829 - protein, 19 aa, Cryptosporidium parvum
TTEILRSMLYRGSELVREI

SEQ ID NO: 2238830 - protein, 17 aa, Cryptosporidium parvum
TTFKIFILQLLWIGFFI

SEQ ID NO: 2238831 - protein, 17 aa, Cryptosporidium parvum
TTFLKIVFETISKASRI

SEQ ID NO: 2238832 - protein, 19 aa, Cryptosporidium parvum
TTGCGVYLNAGREVAVAST

SEQ ID NO: 2238833 - protein, 18 aa, Cryptosporidium parvum
TTHLGLLSIFSYILGVND

SEQ ID NO: 2238834 - protein, 29 aa, Cryptosporidium parvum
TTLEQGLDYSIAFILCRIICELSQHGFLH

SEQ ID NO: 2238835 - protein, 17 aa, Cryptosporidium parvum
TTLKCFSPKINGIYEGV

SEQ ID NO: 2238836 - protein, 25 aa, Cryptosporidium parvum
TTLKVLFSLLGPCRNLSMYSFATIE

SEQ ID NO: 2238837 - protein, 17 aa, Cryptosporidium parvum
TTLRFLLEAVDSQTQFG

SEQ ID NO: 2238838 - protein, 18 aa, Cryptosporidium parvum
TTLSEFELLYATFCRTFG

SEQ ID NO: 2238839 - protein, 24 aa, Cryptosporidium parvum
TTLSYFPEHIFIQILNVINQRIAE

SEQ ID NO: 2238840 - protein, 24 aa, Cryptosporidium parvum
TTPYLRIPLLLQFFSDENRINSLS

SEQ ID NO: 2238841 - protein, 25 aa, Cryptosporidium parvum
TTRTRKLLSAAYFIESCIDTFQLKS

SEQ ID NO: 2238842 - protein, 21 aa, Cryptosporidium parvum
TTSGACYRRLVRFERNKVQNC

SEQ ID NO: 2238843 - protein, 22 aa, Cryptosporidium parvum
TVAIICVVMFLIFGVYTMLFSF

SEQ ID NO: 2238844 - protein, 23 aa, Cryptosporidium parvum
TVALFCYGMFLSYICESFSLGTL

SEQ ID NO: 2238845 - protein, 23 aa, Cryptosporidium parvum
TVDIPWKRSHSLITEEVLILPRN

SEQ ID NO: 2238846 - protein, 24 aa, Cryptosporidium parvum
TVFFKMMIMVVGFGIFHGAVVLPI

SEQ ID NO: 2238847 - protein, 25 aa, Cryptosporidium parvum
TVFGIFGAVVFKFPKDQWFILICVV

SEQ ID NO: 2238848 - protein, 19 aa, Cryptosporidium parvum
TVFPWCISLLLYSLLHFTY

SEQ ID NO: 2238849 - protein, 17 aa, Cryptosporidium parvum
TVHRPTGTIGFWDSNGR

SEQ ID NO: 2238850 - protein, 18 aa, Cryptosporidium parvum
TVIRFLFENIDIKSANRL

SEQ ID NO: 2238851 - protein, 18 aa, Cryptosporidium parvum
TVKLRGASHFSFKQTMKR

SEQ ID NO: 2238852 - protein, 20 aa, Cryptosporidium parvum
TVLIRGRAEPPFPRIWSRSP

SEQ ID NO: 2238853 - protein, 17 aa, Cryptosporidium parvum
TVLSYTTFDHFFLIRSY

SEQ ID NO: 2238854 - protein, 21 aa, Cryptosporidium parvum
TVNKVLKLVLWLLGWLSVTFI

SEQ ID NO: 2238855 - protein, 25 aa, Cryptosporidium parvum
TVPDYIKRDFLLFINHLKIFSTPSG

SEQ ID NO: 2238856 - protein, 24 aa, Cryptosporidium parvum
TVSSLRWFLLDKKVLFSSLRQDLH

SEQ ID NO: 2238857 - protein, 24 aa, Cryptosporidium parvum
TVSWCLLSDVVIRIVHIIGLLSRG

SEQ ID NO: 2238858 - protein, 26 aa, Cryptosporidium parvum
TVVFVIICRFLFFPVSTLRRIKMQIN

SEQ ID NO: 2238859 - protein, 25 aa, Cryptosporidium parvum
TVVKQPWYAPLKKIGINIISGKNTI

SEQ ID NO: 2238860 - protein, 18 aa, Cryptosporidium parvum
TVVLIIVLEYLYRKTAMT

SEQ ID NO: 2238861 - protein, 23 aa, Cryptosporidium parvum
TVYIIECIFTYWISNLIFEILKG

SEQ ID NO: 2238862 - protein, 21 aa, Cryptosporidium parvum
TWELQSRYGLGQSQKDIMMIK

SEQ ID NO: 2238863 - protein, 25 aa, Cryptosporidium parvum
TWFCNREFGAEFLLNSVIVNQIAAN

SEQ ID NO: 2238864 - protein, 20 aa, Cryptosporidium parvum
TWFYCFLLIILNVQYSKLHL

SEQ ID NO: 2238865 - protein, 21 aa, Cryptosporidium parvum
TWTFFKDHRLAISITGADTKN

SEQ ID NO: 2238866 - protein, 27 aa, Cryptosporidium parvum
TWVSWMHCIALVLGRTCDSCLYVRLIA

SEQ ID NO: 2238867 - protein, 17 aa, Cryptosporidium parvum
TYCGLIYNDFFAAGLDI

SEQ ID NO: 2238868 - protein, 18 aa, Cryptosporidium parvum
TYELLRGLPHSVLLENDD

SEQ ID NO: 2238869 - protein, 23 aa, Cryptosporidium parvum
TYFPRILREIWLRNSNNKTQAIL

SEQ ID NO: 2238870 - protein, 22 aa, Cryptosporidium parvum
TYGDFFFIILISTFLKEVSRIH

SEQ ID NO: 2238871 - protein, 19 aa, Cryptosporidium parvum
TYGPLCNKTECNIRGSSTI

SEQ ID NO: 2238872 - protein, 21 aa, Cryptosporidium parvum
TYIIGYFIMFNRLSSKPWFQS

SEQ ID NO: 2238873 - protein, 27 aa, Cryptosporidium parvum
TYIIIMCLRHIITLYTLSRFGEGRFFA

SEQ ID NO: 2238874 - protein, 22 aa, Cryptosporidium parvum
TYKFRMPSYLFSRIKMNHNTTK

SEQ ID NO: 2238875 - protein, 25 aa, Cryptosporidium parvum
TYLFPKVLLDFSILFSKENILSGIR

SEQ ID NO: 2238876 - protein, 20 aa, Cryptosporidium parvum
TYLRRCRHFDNETSRFYAAQ

SEQ ID NO: 2238877 - protein, 22 aa, Cryptosporidium parvum
TYNFDFKNIWTIQSSQTTNSSA

SEQ ID NO: 2238878 - protein, 18 aa, Cryptosporidium parvum
TYSLLNYSLVIQLLIPLV

SEQ ID NO: 2238879 - protein, 18 aa, Cryptosporidium parvum
TYSLRSKARYRFNIDSPF

SEQ ID NO: 2238880 - protein, 19 aa, Cryptosporidium parvum
VADCSDKSTKECIYEILSM

SEQ ID NO: 2238881 - protein, 20 aa, Cryptosporidium parvum
VADLKPSIIVNSPIHDSINS

SEQ ID NO: 2238882 - protein, 21 aa, Cryptosporidium parvum
VADLPLPLVCEMIYSDKFAGK

SEQ ID NO: 2238883 - protein, 20 aa, Cryptosporidium parvum
VAENELKPLLSPSEKVYGRL

SEQ ID NO: 2238884 - protein, 25 aa, Cryptosporidium parvum
VAGFELSSFLLLLVLERSKISILNS

SEQ ID NO: 2238885 - protein, 24 aa, Cryptosporidium parvum
VAGLTVFCCLIFFGDLADSYLLHD

SEQ ID NO: 2238886 - protein, 18 aa, Cryptosporidium parvum
VAGRVFGISCLLIILVGL

SEQ ID NO: 2238887 - protein, 22 aa, Cryptosporidium parvum
VAIQMSELIARWNPKKDSRLIQ

SEQ ID NO: 2238888 - protein, 20 aa, Cryptosporidium parvum
VAKEAILVIIHDWISFIRFL

SEQ ID NO: 2238889 - protein, 29 aa, Cryptosporidium parvum
VAKFFSVMIPMWLSMKISRYKKRCVQQIA

SEQ ID NO: 2238890 - protein, 17 aa, Cryptosporidium parvum
VALFQGWLAVGYATYYT

SEQ ID NO: 2238891 - protein, 17 aa, Cryptosporidium parvum
VALGFVMYSRGGEEADE

SEQ ID NO: 2238892 - protein, 17 aa, Cryptosporidium parvum
VALLRLNHVNSRAISKS

SEQ ID NO: 2238893 - protein, 18 aa, Cryptosporidium parvum
VALPGWLRYSIFTVGEFE

SEQ ID NO: 2238894 - protein, 17 aa, Cryptosporidium parvum
VALTCLSLLFLNGDIRR

SEQ ID NO: 2238895 - protein, 21 aa, Cryptosporidium parvum
VALTLCLYSQLGISALFGISV

SEQ ID NO: 2238896 - protein, 18 aa, Cryptosporidium parvum
VAQKLGMEVIVPPDLNLN

SEQ ID NO: 2238897 - protein, 29 aa, Cryptosporidium parvum
VASGVSWFIFRYFFDFIRYFIEENKCFVF

SEQ ID NO: 2238898 - protein, 24 aa, Cryptosporidium parvum
VASRLLGSLPPEFPNLDDLMAIPV

SEQ ID NO: 2238899 - protein, 19 aa, Cryptosporidium parvum
VATCQIFKYFKAISQKTLN

SEQ ID NO: 2238900 - protein, 23 aa, Cryptosporidium parvum
VATICTLAAVAIIDSREIYQIYN

SEQ ID NO: 2238901 - protein, 18 aa, Cryptosporidium parvum
VATIRYDLTTSILPKDYT

SEQ ID NO: 2238902 - protein, 26 aa, Cryptosporidium parvum
VCEQHSGLYLSWRNIFDYPLTYELLR

SEQ ID NO: 2238903 - protein, 20 aa, Cryptosporidium parvum
VCFILLCLLANITRTISIII

SEQ ID NO: 2238904 - protein, 21 aa, Cryptosporidium parvum
VCISGKFPKRSRVLLSSTVVM

SEQ ID NO: 2238905 - protein, 18 aa, Cryptosporidium parvum
VCLFGICAPSSAFLESFF

SEQ ID NO: 2238906 - protein, 18 aa, Cryptosporidium parvum
VCLLASGEVVSWGDPSRG

SEQ ID NO: 2238907 - protein, 34 aa, Cryptosporidium parvum; identical to SEQ ID NO: 2128167

SEQ ID NO: 2238908 - protein, 19 aa, Cryptosporidium parvum
VCMYPCMDLDLIIENNIIA

SEQ ID NO: 2238909 - protein, 19 aa, Cryptosporidium parvum
VCSKGELKSALIDYPEIEI

SEQ ID NO: 2238910 - protein, 24 aa, Cryptosporidium parvum
VCSKSCDPSPCLNGGICSELPKSN

SEQ ID NO: 2238911 - protein, 21 aa, Cryptosporidium parvum
VCVEVLKFSHDYFYDEIPEIS

SEQ ID NO: 2238912 - protein, 21 aa, Cryptosporidium parvum
VCVYIVLSLELVEKLYLISAG

SEQ ID NO: 2238913 - protein, 17 aa, Cryptosporidium parvum
VDADWGKLVSNIPPKTS

SEQ ID NO: 2238914 - protein, 18 aa, Cryptosporidium parvum
VDDEFTFDSDGHIIYKQG

SEQ ID NO: 2238915 - protein, 33 aa, Cryptosporidium parvum
VDEAHCVCEWGHSFRPSYYSSIGHLINNFKVER

SEQ ID NO: 2238916 - protein, 19 aa, Cryptosporidium parvum
VDEIFEYIDIFIGAMQSAG

SEQ ID NO: 2238917 - protein, 20 aa, Cryptosporidium parvum
VDFVFGRGPDIWNILTIYIL

SEQ ID NO: 2238918 - protein, 18 aa, Cryptosporidium parvum
VDIAEFFHFLVSSYSRQL

SEQ ID NO: 2238919 - protein, 27 aa, Cryptosporidium parvum
VDKHFPLFRSCFKIAYTGAPPRSLIDI

SEQ ID NO: 2238920 - protein, 28 aa, Cryptosporidium parvum
VDKLRPETRICFEMNILCDGFGVSFLSN

SEQ ID NO: 2238921 - protein, 20 aa, Cryptosporidium parvum
VDLIFKISIAILKILKNSLF

SEQ ID NO: 2238922 - protein, 19 aa, Cryptosporidium parvum
VDLTFHFVKKLMAVKTRPS

SEQ ID NO: 2238923 - protein, 17 aa, Cryptosporidium parvum
VDLYSEYGFTPLLLACK

SEQ ID NO: 2238924 - protein, 17 aa, Cryptosporidium parvum
VDNRLIHHFLRKNKIQV

SEQ ID NO: 2238925 - protein, 19 aa, Cryptosporidium parvum
VDPPRSQWFILRKLAINQF

SEQ ID NO: 2238926 - protein, 17 aa, Cryptosporidium parvum
VDQEFDKYLTFNATENL

SEQ ID NO: 2238927 - protein, 28 aa, Cryptosporidium parvum
VDRHRRAKILKMRRYMEKTGKKLTGNSF

SEQ ID NO: 2238928 - protein, 20 aa, Cryptosporidium parvum
VDRYGLWKSALVPTILLVVC

SEQ ID NO: 2238929 - protein, 27 aa, Cryptosporidium parvum
VDSNLRCSAKFLIGVSNDCLRMFSKCI

SEQ ID NO: 2238930 - protein, 18 aa, Cryptosporidium parvum
VDVPKYLLDLPYLYNSSR

SEQ ID NO: 2238931 - protein, 31 aa, Cryptosporidium parvum
VDYLMWRSSFYGQPLIMCFFVTDRIPATQME

SEQ ID NO: 2238932 - protein, 24 aa, Cryptosporidium parvum
VEACPIDETFCLALEHGLPPTGGW

SEQ ID NO: 2238933 - protein, 17 aa, Cryptosporidium parvum
VEAEFRKQLILGEEGIP

SEQ ID NO: 2238934 - protein, 25 aa, Cryptosporidium parvum
VEAETIKKLGFVGGKIKMISSHLSN

SEQ ID NO: 2238935 - protein, 29 aa, Cryptosporidium parvum
VECKRTVNIKRLWEFGRLYNELNKNSESS

SEQ ID NO: 2238936 - protein, 19 aa, Cryptosporidium parvum
VEDWFPRPIADFQNYLNIS

SEQ ID NO: 2238937 - protein, 32 aa, Cryptosporidium parvum
VEEVFKVAFMLLRKGCRMQLDAFLRERAKAHW

SEQ ID NO: 2238938 - protein, 19 aa, Cryptosporidium parvum
VEFRIAILKDFFKFIRNIK

SEQ ID NO: 2238939 - protein, 24 aa, Cryptosporidium parvum
VEHFSKFHLNICNLPRPAFSRPVL

SEQ ID NO: 2238940 - protein, 24 aa, Cryptosporidium parvum
VEIKQKLQIWLGFSQISLNIRQAC

SEQ ID NO: 2238941 - protein, 21 aa, Cryptosporidium parvum
VEILQKLFVTFPLLFSTSKES

SEQ ID NO: 2238942 - protein, 18 aa, Cryptosporidium parvum
VEIRIRAIGLNFRDVLNV

SEQ ID NO: 2238943 - protein, 17 aa, Cryptosporidium parvum
VEIVIRFNSAICHELKG

SEQ ID NO: 2238944 - protein, 32 aa, Cryptosporidium parvum; identical to SEQ ID NO: 2128195

SEQ ID NO: 2238945 - protein, 27 aa, Cryptosporidium parvum
VELFTKWYKHILILFGITLTIMGLSNL

SEQ ID NO: 2238946 - protein, 19 aa, Cryptosporidium parvum
VELGLDFYLCDCSTALLSA

SEQ ID NO: 2238947 - protein, 19 aa, Cryptosporidium parvum
VELMTCLSSAYLQVKDENK

SEQ ID NO: 2238948 - protein, 19 aa, Cryptosporidium parvum
VELNDDFGYLVNMGSNFEK

SEQ ID NO: 2238949 - protein, 23 aa, Cryptosporidium parvum
VELSIYVSLLLKLFALVNSVEIE

SEQ ID NO: 2238950 - protein, 17 aa, Cryptosporidium parvum
VELYILRVKEIWDSIKF

SEQ ID NO: 2238951 - protein, 23 aa, Cryptosporidium parvum
VENIKSRILEFVPKYFDQKYVQE

SEQ ID NO: 2238952 - protein, 26 aa, Cryptosporidium parvum
VEQYRKVLPLWAFLFMKVVEQSLRIF

SEQ ID NO: 2238953 - protein, 19 aa, Cryptosporidium parvum
VERLKSWGIKSVFTDEAAK

SEQ ID NO: 2238954 - protein, 19 aa, Cryptosporidium parvum
VERNRIWTSLFTYSIPYNV

SEQ ID NO: 2238955 - protein, 18 aa, Cryptosporidium parvum
VERSRLYLAASREAGTEY

SEQ ID NO: 2238956 - protein, 23 aa, Cryptosporidium parvum
VESICPRGGCLAQETFPPVLSCP

SEQ ID NO: 2238957 - protein, 25 aa, Cryptosporidium parvum
VESKLFLDKLWLWHSGKYVNKFKTS

SEQ ID NO: 2238958 - protein, 17 aa, Cryptosporidium parvum
VESLFFLLVSPYSICPT

SEQ ID NO: 2238959 - protein, 20 aa, Cryptosporidium parvum
VESLFRIPLNRPEFVYRIKI

SEQ ID NO: 2238960 - protein, 21 aa, Cryptosporidium parvum
VESNWRYLALLYSLLISDTTG

SEQ ID NO: 2238961 - protein, 22 aa, Cryptosporidium parvum
VESSLGRLWFKYAGNEYDTSRN

SEQ ID NO: 2238962 - protein, 19 aa, Cryptosporidium parvum
VETKLFLIFIIKTSLLGIQ

SEQ ID NO: 2238963 - protein, 18 aa, Cryptosporidium parvum
VEVRFSVFLFGLNQEESC

SEQ ID NO: 2238964 - protein, 20 aa, Cryptosporidium parvum
VEYEFSKWINMGDFYLPTGH

SEQ ID NO: 2238965 - protein, 17 aa, Cryptosporidium parvum
VEYLLEMAALYMLDGKE

SEQ ID NO: 2238966 - protein, 25 aa, Cryptosporidium parvum
VEYYRKMLEFCLSIFSFELREFDWS

SEQ ID NO: 2238967 - protein, 20 aa, Cryptosporidium parvum
VFAMEMFIDRFISFPQFLSA

SEQ ID NO: 2238968 - protein, 18 aa, Cryptosporidium parvum
VFCSQCLLNSFKPLTHIC

SEQ ID NO: 2238969 - protein, 30 aa, Cryptosporidium parvum
VFDCKDIKESTRFLFWIIRHFDLNYLSPTI

SEQ ID NO: 2238970 - protein, 24 aa, Cryptosporidium parvum
VFEAPVLIPHSWLSSQMIYNESRS

SEQ ID NO: 2238971 - protein, 19 aa, Cryptosporidium parvum
VFELIKFENQRFIPKNVNV

SEQ ID NO: 2238972 - protein, 23 aa, Cryptosporidium parvum
VFFFCLKRRVSSYLNKRREITHK

SEQ ID NO: 2238973 - protein, 18 aa, Cryptosporidium parvum
VFFGTPIYNGQLFKENIS

SEQ ID NO: 2238974 - protein, 25 aa, Cryptosporidium parvum
VFGDICSLITYLLFIILFLVLNPSR

SEQ ID NO: 2238975 - protein, 19 aa, Cryptosporidium parvum
VFHKKCLYNSINNKFGLPN

SEQ ID NO: 2238976 - protein, 24 aa, Cryptosporidium parvum
VFIKEIFETPFIIDKSFFYKVKRD

SEQ ID NO: 2238977 - protein, 19 aa, Cryptosporidium parvum
VFILLTFICSLGCFTASIS

SEQ ID NO: 2238978 - protein, 23 aa, Cryptosporidium parvum
VFILSCWPNLMFDLCGIICGHYL

SEQ ID NO: 2238979 - protein, 18 aa, Cryptosporidium parvum
VFITYFLIIYTVSATELD

SEQ ID NO: 2238980 - protein, 17 aa, Cryptosporidium parvum
VFLLGNFITWILFVSVV

SEQ ID NO: 2238981 - protein, 20 aa, Cryptosporidium parvum
VFLSGIYFLWKKYPANNYND

SEQ ID NO: 2238982 - protein, 18 aa, Cryptosporidium parvum
VFLSYSFSYVLSSFSTST

SEQ ID NO: 2238983 - protein, 27 aa, Cryptosporidium parvum
VFQKLLTCIKLAFNTKISKFYDQDIII

SEQ ID NO: 2238984 - protein, 35 aa, Cryptosporidium parvum; identical to SEQ ID NO: 2128222

SEQ ID NO: 2238985 - protein, 18 aa, Cryptosporidium parvum
VFRRRLARKKAFKERNIQ

SEQ ID NO: 2238986 - protein, 32 aa, Cryptosporidium parvum; identical to SEQ ID NO: 2128224

SEQ ID NO: 2238987 - protein, 20 aa, Cryptosporidium parvum
VFSIFQWQLIWMSRKLSFSS

SEQ ID NO: 2238988 - protein, 17 aa, Cryptosporidium parvum
VFSRHSWGKRFIGLCTC

SEQ ID NO: 2238989 - protein, 19 aa, Cryptosporidium parvum
VFTIVLKFSEIHFKEPGKK

SEQ ID NO: 2238990 - protein, 18 aa, Cryptosporidium parvum
VFTLIDLIISYLKQVIQI

SEQ ID NO: 2238991 - protein, 24 aa, Cryptosporidium parvum
VFVILCFVTALTLFSIYCNSNLSF

SEQ ID NO: 2238992 - protein, 17 aa, Cryptosporidium parvum
VFVSFGIGIVSLVIFSS

SEQ ID NO: 2238993 - protein, 17 aa, Cryptosporidium parvum
VFVSFIFSSYLTSFMKS

SEQ ID NO: 2238994 - protein, 34 aa, Cryptosporidium parvum
VFVTHFCLFLWKIIKPFIILSIFILISFIVKIII

SEQ ID NO: 2238995 - protein, 24 aa, Cryptosporidium parvum
VFWPGKSKFLYYLSSVVLRGPDLR

SEQ ID NO: 2238996 - protein, 20 aa, Cryptosporidium parvum
VFYGIYGVDVPKYLLDLPYL

SEQ ID NO: 2238997 - protein, 17 aa, Cryptosporidium parvum
VFYYLSFIFSLINPALP

SEQ ID NO: 2238998 - protein, 19 aa, Cryptosporidium parvum
VFYYSCFVASVIILHLWYF

SEQ ID NO: 2238999 - protein, 18 aa, Cryptosporidium parvum
VGAIGLTLLDIFRDLGRN

SEQ ID NO: 2239000 - protein, 20 aa, Cryptosporidium parvum
VGALCGFGNEVIRLSDRSYM

SEQ ID NO: 2239001 - protein, 23 aa, Cryptosporidium parvum
VGCNGFKCPGEPCIDRPEAQEVV

SEQ ID NO: 2239002 - protein, 34 aa, Cryptosporidium parvum
VGDYLRLPFQAIMFLIEGLFCFFLGMTSDLKSKK

SEQ ID NO: 2239003 - protein, 23 aa, Cryptosporidium parvum
VGEISKCYFYFLFENKSSDSGGR

SEQ ID NO: 2239004 - protein, 28 aa, Cryptosporidium parvum
VGFEHLWKKRVVYLLKMQSVNAVLFLEG

SEQ ID NO: 2239005 - protein, 19 aa, Cryptosporidium parvum
VGFLPKIIEAYVVSLFELC

SEQ ID NO: 2239006 - protein, 18 aa, Cryptosporidium parvum
VGFPRLDKFSDIQTMDDV

SEQ ID NO: 2239007 - protein, 20 aa, Cryptosporidium parvum
VGFQGWRFAFLLVGVLSAIL

SEQ ID NO: 2239008 - protein, 20 aa, Cryptosporidium parvum
VGFVSAIASIFGMNIQSGLE

SEQ ID NO: 2239009 - protein, 26 aa, Cryptosporidium parvum
VGFYRGWKMALVMSASLPIVAAAGFL

SEQ ID NO: 2239010 - protein, 17 aa, Cryptosporidium parvum
VGGIGVYIPIYIGYLNP

SEQ ID NO: 2239011 - protein, 24 aa, Cryptosporidium parvum
VGGSFFPLWAPIRYIPAFMAERHR

SEQ ID NO: 2239012 - protein, 26 aa, Cryptosporidium parvum
VGIATVGIFVWWYVWGIDPSDGNTLV

SEQ ID NO: 2239013 - protein, 17 aa, Cryptosporidium parvum
VGIFLYFELVIFNEMTF

SEQ ID NO: 2239014 - protein, 20 aa, Cryptosporidium parvum
VGIIRYVPYLIFGISNSELE

SEQ ID NO: 2239015 - protein, 24 aa, Cryptosporidium parvum
VGILGWCIAHTALTYFIPLATDTS

SEQ ID NO: 2239016 - protein, 17 aa, Cryptosporidium parvum
VGIPVFIYGFFTLWSGT

SEQ ID NO: 2239017 - protein, 18 aa, Cryptosporidium parvum
VGKLRSSISYVQQNPILF

SEQ ID NO: 2239018 - protein, 18 aa, Cryptosporidium parvum
VGLLKFAIGVNHSQPIGL

SEQ ID NO: 2239019 - protein, 21 aa, Cryptosporidium parvum
VGLTCAIVYISLNFKSGNLDS

SEQ ID NO: 2239020 - protein, 19 aa, Cryptosporidium parvum
VGRVKCWIPNQSIELPLRR

SEQ ID NO: 2239021 - protein, 24 aa, Cryptosporidium parvum
VGSFGCVRGKWEVIKRIHCYQKCK

SEQ ID NO: 2239022 - protein, 22 aa, Cryptosporidium parvum
VGSLKYTWYFDFDDITVNFLDG

SEQ ID NO: 2239023 - protein, 17 aa, Cryptosporidium parvum
VGTFSCSIREYKFGNDG

SEQ ID NO: 2239024 - protein, 19 aa, Cryptosporidium parvum
VGVTSFRYSHKVKGGLKKD

SEQ ID NO: 2239025 - protein, 17 aa, Cryptosporidium parvum
VGVVWLFVFGKSRNFLL

SEQ ID NO: 2239026 - protein, 20 aa, Cryptosporidium parvum
VHECIRPCGYVAPTDSKLRV

SEQ ID NO: 2239027 - protein, 24 aa, Cryptosporidium parvum
VHFIASWWKNIGIIYINISDEMLA

SEQ ID NO: 2239028 - protein, 28 aa, Cryptosporidium parvum
VHGMKLWFEILFGVWILRRISPFSKILI

SEQ ID NO: 2239029 - protein, 29 aa, Cryptosporidium parvum
VHKSNCFWSGIIDYSCRYILTSGNGINFV

SEQ ID NO: 2239030 - protein, 27 aa, Cryptosporidium parvum
VHKVPEYRVLLIIPDEFYLTIAEVEFL

SEQ ID NO: 2239031 - protein, 18 aa, Cryptosporidium parvum
VHMLWLEVTMSYIIIPLQ

SEQ ID NO: 2239032 - protein, 17 aa, Cryptosporidium parvum
VHNEFIAPIALLGSSIE

SEQ ID NO: 2239033 - protein, 23 aa, Cryptosporidium parvum
VHNRWPLCVLVDEKSILPKVAII

SEQ ID NO: 2239034 - protein, 24 aa, Cryptosporidium parvum
VHRPHPWGLLITFIELIKNPKYAF

SEQ ID NO: 2239035 - protein, 20 aa, Cryptosporidium parvum
VHSVLKICGIYKYVINTLNG

SEQ ID NO: 2239036 - protein, 26 aa, Cryptosporidium parvum
VHSVWPRILFIQSIIIGRFKFLDDYK

SEQ ID NO: 2239037 - protein, 20 aa, Cryptosporidium parvum
VHVRINVGILGWCIAHTALT

SEQ ID NO: 2239038 - protein, 19 aa, Cryptosporidium parvum
VIALARFVSALTMLVVIPM

SEQ ID NO: 2239039 - protein, 17 aa, Cryptosporidium parvum
VICIWKISEYLNEIEAS

SEQ ID NO: 2239040 - protein, 18 aa, Cryptosporidium parvum
VIDFVLRNHLVFRNLNTF

SEQ ID NO: 2239041 - protein, 24 aa, Cryptosporidium parvum
VIDSRLLYFKTLFVVLYIFPETGF

SEQ ID NO: 2239042 - protein, 36 aa, Cryptosporidium parvum
VIDTCASLLYWSLRVTRYFFPLTIALVLLSFTIFSL

SEQ ID NO: 2239043 - protein, 23 aa, Cryptosporidium parvum
VIEIPYLYFWIYPLSIHLDIDTI

SEQ ID NO: 2239044 - protein, 18 aa, Cryptosporidium parvum
VIEKFEWNKDLIGTSSQA

SEQ ID NO: 2239045 - protein, 20 aa, Cryptosporidium parvum
VIELKGYIRILLKLIDIKAS

SEQ ID NO: 2239046 - protein, 29 aa, Cryptosporidium parvum
VIELMYLEHLRIIFFSIFLNGLSRVILLC

SEQ ID NO: 2239047 - protein, 26 aa, Cryptosporidium parvum
VIEPSFGIGRIIYCLLEHSFKIREDL

SEQ ID NO: 2239048 - protein, 23 aa, Cryptosporidium parvum
VIFDIRARPRVVVSLTGSKDLQM

SEQ ID NO: 2239049 - protein, 17 aa, Cryptosporidium parvum
VIFTPSGYFNFKNVTIE

SEQ ID NO: 2239050 - protein, 19 aa, Cryptosporidium parvum
VIGDFGCGTAKIGQTFGHI

SEQ ID NO: 2239051 - protein, 26 aa, Cryptosporidium parvum
VIGKDGRIENGMAFTMIPNDDTHVRF

SEQ ID NO: 2239052 - protein, 27 aa, Cryptosporidium parvum
VIGNAKLWWRYAIGCIIRDRRADISSI

SEQ ID NO: 2239053 - protein, 27 aa, Cryptosporidium parvum
VIGSLLISCQWLYSRHILYKSYVREFK

SEQ ID NO: 2239054 - protein, 23 aa, Cryptosporidium parvum
VIGVSLLHSLKFIDIGIYLANYI

SEQ ID NO: 2239055 - protein, 17 aa, Cryptosporidium parvum
VIIKLFLMKKRFFNKVN

SEQ ID NO: 2239056 - protein, 17 aa, Cryptosporidium parvum
VIIKLNFENSGKNSQKN

SEQ ID NO: 2239057 - protein, 24 aa, Cryptosporidium parvum
VIISKEFFCFSSNGFPWWRGIISF

SEQ ID NO: 2239058 - protein, 17 aa, Cryptosporidium parvum
VIISKRSNIPVSYSELM

SEQ ID NO: 2239059 - protein, 23 aa, Cryptosporidium parvum
VIKACSLDMDFAMWKDKDLRQLD

SEQ ID NO: 2239060 - protein, 22 aa, Cryptosporidium parvum
VIKNLEIISVFNLDNLENEELN

SEQ ID NO: 2239061 - protein, 18 aa, Cryptosporidium parvum
VILFKILSKHSINILIPV

SEQ ID NO: 2239062 - protein, 25 aa, Cryptosporidium parvum
VILKSLRPSLDFGENTSHHIPIKSF

SEQ ID NO: 2239063 - protein, 22 aa, Cryptosporidium parvum
VILKTFRRFYGIYFLLFSINLA

SEQ ID NO: 2239064 - protein, 18 aa, Cryptosporidium parvum
VILMMLLFVLLYFTLNNS

SEQ ID NO: 2239065 - protein, 18 aa, Cryptosporidium parvum
VILQCSFNFPSIRMPLFL

SEQ ID NO: 2239066 - protein, 17 aa, Cryptosporidium parvum
VIMNPLFSLAFKSSNRL

SEQ ID NO: 2239067 - protein, 20 aa, Cryptosporidium parvum
VINNIERWIPFYTPHYLILI

SEQ ID NO: 2239068 - protein, 22 aa, Cryptosporidium parvum
VIPFEAGELFLVGISFLLDGKI

SEQ ID NO: 2239069 - protein, 23 aa, Cryptosporidium parvum
VIPIEGISIGDLVERCPFHSSLF

SEQ ID NO: 2239070 - protein, 32 aa, Cryptosporidium parvum
VIQCSDCEGFLKKGALFGGMSICTPIEFGGSF

SEQ ID NO: 2239071 - protein, 19 aa, Cryptosporidium parvum
VIQDPEWITSNGDYYIIEF

SEQ ID NO: 2239072 - protein, 23 aa, Cryptosporidium parvum
VIQRFEKEFQYFVLIKESNLAKQ

SEQ ID NO: 2239073 - protein, 18 aa, Cryptosporidium parvum
VIQSHGFLKEDHEDLRNR

SEQ ID NO: 2239074 - protein, 18 aa, Cryptosporidium parvum
VIQTEFGISWTLESCSTN

SEQ ID NO: 2239075 - protein, 23 aa, Cryptosporidium parvum
VIRGFCLCEGYNLESIRSALDKH

SEQ ID NO: 2239076 - protein, 23 aa, Cryptosporidium parvum
VISAAIWWGFFGTVITFIMESEL

SEQ ID NO: 2239077 - protein, 21 aa, Cryptosporidium parvum
VISCCGFGFSLSGSVLLLSTR

SEQ ID NO: 2239078 - protein, 17 aa, Cryptosporidium parvum
VISHLKSTFSLEFDEKR

SEQ ID NO: 2239079 - protein, 28 aa, Cryptosporidium parvum
VISITVTISLDWILKIYKRSLYPEISHL

SEQ ID NO: 2239080 - protein, 25 aa, Cryptosporidium parvum
VISRGVRYSWKIGKSLDGLYKRIPY

SEQ ID NO: 2239081 - protein, 20 aa, Cryptosporidium parvum
VITSRSYLSSILIRNPALFK

SEQ ID NO: 2239082 - protein, 20 aa, Cryptosporidium parvum
VIVIFKFQKYFLPLVYLGAK

SEQ ID NO: 2239083 - protein, 17 aa, Cryptosporidium parvum
VIVNYFFIFIILFSVLG

SEQ ID NO: 2239084 - protein, 24 aa, Cryptosporidium parvum
VIVVIIGVSIALYFQNKNKESQRI

SEQ ID NO: 2239085 - protein, 19 aa, Cryptosporidium parvum
VIVYSHMRLLFSYFSNYSK

SEQ ID NO: 2239086 - protein, 21 aa, Cryptosporidium parvum
VIYLIKFLYRPKFEILGKLPG

SEQ ID NO: 2239087 - protein, 21 aa, Cryptosporidium parvum
VIYQKLWLKYINIVIMNYNDE

SEQ ID NO: 2239088 - protein, 23 aa, Cryptosporidium parvum
VIYSKLWLNGSIAIYNIAKKRLM

SEQ ID NO: 2239089 - protein, 19 aa, Cryptosporidium parvum
VKALRLGWAPTLIGYSAQG

SEQ ID NO: 2239090 - protein, 20 aa, Cryptosporidium parvum
VKATPSFVLFRGRQEPERLD

SEQ ID NO: 2239091 - protein, 17 aa, Cryptosporidium parvum
VKCDSEFEKNKSEGSES

SEQ ID NO: 2239092 - protein, 25 aa, Cryptosporidium parvum
VKCRMKEALERCLLLIENGNDYIPL

SEQ ID NO: 2239093 - protein, 21 aa, Cryptosporidium parvum
VKDGLDLSLIFATNNFYLQQI

SEQ ID NO: 2239094 - protein, 17 aa, Cryptosporidium parvum
VKDSIIYYSIIYSKNKR

SEQ ID NO: 2239095 - protein, 22 aa, Cryptosporidium parvum
VKESQLGIGITLSWPEGSKPPV

SEQ ID NO: 2239096 - protein, 23 aa, Cryptosporidium parvum
VKEYTIRDIISWCQFICNNFQEI

SEQ ID NO: 2239097 - protein, 28 aa, Cryptosporidium parvum
VKFARSHPLWKFTCTSAQAIVQDKDLAI

SEQ ID NO: 2239098 - protein, 21 aa, Cryptosporidium parvum
VKFVSIYLMFLMRNFWDQVLL

SEQ ID NO: 2239099 - protein, 28 aa, Cryptosporidium parvum
VKGVGKHGCKAQHYWYFREKTSDNSHKL

SEQ ID NO: 2239100 - protein, 19 aa, Cryptosporidium parvum
VKIEFLRCKLSMIRQELMK

SEQ ID NO: 2239101 - protein, 18 aa, Cryptosporidium parvum
VKIFDIFGINIINSNCIR

SEQ ID NO: 2239102 - protein, 18 aa, Cryptosporidium parvum
VKIVSLYLYIFLSFPITV

SEQ ID NO: 2239103 - protein, 20 aa, Cryptosporidium parvum
VKIYLEDELVFFLKEDLMKI

SEQ ID NO: 2239104 - protein, 26 aa, Cryptosporidium parvum
VKKDFSIWRCLYWPQIAINPIYSGGY

SEQ ID NO: 2239105 - protein, 17 aa, Cryptosporidium parvum
VKKGADHFLDIVYPKLI

SEQ ID NO: 2239106 - protein, 21 aa, Cryptosporidium parvum
VKKLRKLGFRVLVESGAGTKS

SEQ ID NO: 2239107 - protein, 26 aa, Cryptosporidium parvum
VKKLYKILRKMLIKFYIEEFGIILTY

SEQ ID NO: 2239108 - protein, 17 aa, Cryptosporidium parvum
VKKRLRDLGKISNEEDE

SEQ ID NO: 2239109 - protein, 25 aa, Cryptosporidium parvum
VKKSWRCILEINLLQQPPVINPFSN

SEQ ID NO: 2239110 - protein, 27 aa, Cryptosporidium parvum
VKKYKFNFSHVCARVQGGSCRRPSGIL

SEQ ID NO: 2239111 - protein, 22 aa, Cryptosporidium parvum
VKLGESLLLIILREESIQLNWN

SEQ ID NO: 2239112 - protein, 19 aa, Cryptosporidium parvum
VKLISNMGFKEGENQSKLI

SEQ ID NO: 2239113 - protein, 37 aa, Cryptosporidium parvum
VKLIYCLIFRIVRSIHLTKLFPIIIFLSVYQKVILRN

SEQ ID NO: 2239114 - protein, 23 aa, Cryptosporidium parvum
VKLLRLLYSSIIDIFISMDHEDQ

SEQ ID NO: 2239115 - protein, 23 aa, Cryptosporidium parvum
VKLQSSFFVTIWTPIFILNMQPC

SEQ ID NO: 2239116 - protein, 21 aa, Cryptosporidium parvum
VKMTLEFFKSTKLLVDRLDKN

SEQ ID NO: 2239117 - protein, 20 aa, Cryptosporidium parvum
VKNIPLRLSCSRIEDSCNPF

SEQ ID NO: 2239118 - protein, 17 aa, Cryptosporidium parvum
  misc_feature (15)..(15): Xaa can be any naturally occurring amino acid
VKNKCKSIYQFNKFXPI

SEQ ID NO: 2239119 - protein, 26 aa, Cryptosporidium parvum
VKNVTGRILVGMRWWYEITKDGETVW

SEQ ID NO: 2239120 - protein, 20 aa, Cryptosporidium parvum
VKPFRPILVINQSGYDIQLI

SEQ ID NO: 2239121 - protein, 24 aa, Cryptosporidium parvum
VKPIFVRKLFQSVSMFVGAGCQLS

SEQ ID NO: 2239122 - protein, 25 aa, Cryptosporidium parvum
VKQLLTCLLGCFIFGNTVTDKLLLG

SEQ ID NO: 2239123 - protein, 23 aa, Cryptosporidium parvum
VKQRKRLCIVLVQHIPTQFKYSN

SEQ ID NO: 2239124 - protein, 18 aa, Cryptosporidium parvum
VKRKFLQVCNEINVNIIK

SEQ ID NO: 2239125 - protein, 30 aa, Cryptosporidium parvum
VKRNYFLKLFWKITRKITIALRNEISNMNI

SEQ ID NO: 2239126 - protein, 21 aa, Cryptosporidium parvum
VKSDGTFRFQVYTSSGEVGFY

SEQ ID NO: 2239127 - protein, 24 aa, Cryptosporidium parvum
VKSMSGFLSRFPLNDILQTSISLY

SEQ ID NO: 2239128 - protein, 17 aa, Cryptosporidium parvum
VKSNCPQIAHARRTSTS

SEQ ID NO: 2239129 - protein, 18 aa, Cryptosporidium parvum
VKSWSLFNIYLKLELCGG

SEQ ID NO: 2239130 - protein, 23 aa, Cryptosporidium parvum
VKSYCLESIMFNKYYKVITEVEN

SEQ ID NO: 2239131 - protein, 18 aa, Cryptosporidium parvum
VKTLKFNNLIKCAIKGDK

SEQ ID NO: 2239132 - protein, 18 aa, Cryptosporidium parvum
VKVALIFITISLIMVIGF

SEQ ID NO: 2239133 - protein, 17 aa, Cryptosporidium parvum
VKVKYCLIQDTFEDILY

SEQ ID NO: 2239134 - protein, 21 aa, Cryptosporidium parvum
VKYGPRFGYKVEDFLQLETWY

SEQ ID NO: 2239135 - protein, 30 aa, Cryptosporidium parvum
VKYLVNWIIPPFIRKILLGGIGSVTVSGSG

SEQ ID NO: 2239136 - protein, 19 aa, Cryptosporidium parvum
VLACIKRSTSRLAGYQKKL

SEQ ID NO: 2239137 - protein, 18 aa, Cryptosporidium parvum
VLASYRILVIIALLPMLT

SEQ ID NO: 2239138 - protein, 24 aa, Cryptosporidium parvum
VLAVDHLPAFLNRYMASSPSNVVY

SEQ ID NO: 2239139 - protein, 24 aa, Cryptosporidium parvum
VLAYWSLQCLQWISPMVVSTPSCI

SEQ ID NO: 2239140 - protein, 27 aa, Cryptosporidium parvum
VLCKDCIFKVVKILSLFLKIQSNQPQD

SEQ ID NO: 2239141 - protein, 18 aa, Cryptosporidium parvum
VLCSWFPFTSLLAAPGVC

SEQ ID NO: 2239142 - protein, 21 aa, Cryptosporidium parvum
VLCVISGIFLTLGPFSVNVSN

SEQ ID NO: 2239143 - protein, 25 aa, Cryptosporidium parvum
VLDSMCFNNKLNLVAGGIRDCCILF

SEQ ID NO: 2239144 - protein, 25 aa, Cryptosporidium parvum
VLEQFAHTFGLVFSSLIRSITTIED

SEQ ID NO: 2239145 - protein, 22 aa, Cryptosporidium parvum
VLERFPVIIFGLIEDIFKEGIE

SEQ ID NO: 2239146 - protein, 17 aa, Cryptosporidium parvum
VLEYLYRKTAMTVSQAS

SEQ ID NO: 2239147 - protein, 18 aa, Cryptosporidium parvum
VLFFLNLRKIKSLINLLI

SEQ ID NO: 2239148 - protein, 30 aa, Cryptosporidium parvum
VLFSCILNAILIIISLNFASAMIVTPFSGL

SEQ ID NO: 2239149 - protein, 24 aa, Cryptosporidium parvum
VLHALLSSRFVKLFSAEQLMESLN

SEQ ID NO: 2239150 - protein, 17 aa, Cryptosporidium parvum
VLHGSLFSPIPLSFSHL

SEQ ID NO: 2239151 - protein, 20 aa, Cryptosporidium parvum
VLHHIFRYLFCDQRNLLSFK

SEQ ID NO: 2239152 - protein, 29 aa, Cryptosporidium parvum
VLHKYEVPLMFACETKKLICHNTSTSNAI

SEQ ID NO: 2239153 - protein, 23 aa, Cryptosporidium parvum
VLILPCAIFWFVFYSEMVPQSSS

SEQ ID NO: 2239154 - protein, 26 aa, Cryptosporidium parvum
VLIMGLCIFVRLFAVVRYEAIIHEFD

SEQ ID NO: 2239155 - protein, 25 aa, Cryptosporidium parvum
VLIRFHLFTVLNIWNLYLKELQAKL

SEQ ID NO: 2239156 - protein, 23 aa, Cryptosporidium parvum
VLKKVCFGEVLWGKDQDQSTKEG

SEQ ID NO: 2239157 - protein, 24 aa, Cryptosporidium parvum
VLKLLRKVYKDCMNNEKYIKKRLS

SEQ ID NO: 2239158 - protein, 26 aa, Cryptosporidium parvum
VLKNLWVCLVSGIFKILKHKQRISTC

SEQ ID NO: 2239159 - protein, 23 aa, Cryptosporidium parvum
VLLACFTSGLAGVFVEKLLKDSK

SEQ ID NO: 2239160 - protein, 23 aa, Cryptosporidium parvum
VLLCVCPAVLTLLFNYFPLSSAF

SEQ ID NO: 2239161 - protein, 18 aa, Cryptosporidium parvum
VLLFSRLHSALCINHIII

SEQ ID NO: 2239162 - protein, 24 aa, Cryptosporidium parvum
VLLKLWKDEICSITILSHLSDILP

SEQ ID NO: 2239163 - protein, 17 aa, Cryptosporidium parvum
VLLLSILILVMFYTMWY

SEQ ID NO: 2239164 - protein, 26 aa, Cryptosporidium parvum
VLLNSFLLKRLLIFGKLEENQDDHGL

SEQ ID NO: 2239165 - protein, 18 aa, Cryptosporidium parvum
VLLPICLYESSSQLNYHI

SEQ ID NO: 2239166 - protein, 24 aa, Cryptosporidium parvum
VLNLKWRYKMVLPVFAALPTLVSY

SEQ ID NO: 2239167 - protein, 24 aa, Cryptosporidium parvum
VLNRAVLFREWLIRIWDISPAIGR

SEQ ID NO: 2239168 - protein, 18 aa, Cryptosporidium parvum
VLNRFGLNAVNLMNKYLP

SEQ ID NO: 2239169 - protein, 18 aa, Cryptosporidium parvum
VLNVMGLYPGDPGKPGSD

SEQ ID NO: 2239170 - protein, 22 aa, Cryptosporidium parvum
VLPDCKYSLCYVNLALNSQKIG

SEQ ID NO: 2239171 - protein, 22 aa, Cryptosporidium parvum
VLPFSLKLLWAPLVDSVYIEKM

SEQ ID NO: 2239172 - protein, 23 aa, Cryptosporidium parvum
VLPPPPLRQIPMPSISVESLVIT

SEQ ID NO: 2239173 - protein, 23 aa, Cryptosporidium parvum
VLQVIFSRLFLRGYKEILCRIMV

SEQ ID NO: 2239174 - protein, 25 aa, Cryptosporidium parvum
VLRELRPIIRATIIGARQTIFHITT

SEQ ID NO: 2239175 - protein, 27 aa, Cryptosporidium parvum
VLRFISFLYCIVIFISIGRVRHLLFTL

SEQ ID NO: 2239176 - protein, 26 aa, Cryptosporidium parvum
VLRIPKDFSEEFILDISVKVGKLITQ

SEQ ID NO: 2239177 - protein, 19 aa, Cryptosporidium parvum
VLRIYKANVIVILLNAILI

SEQ ID NO: 2239178 - protein, 20 aa, Cryptosporidium parvum
VLRSNFPCRFSPKELSNIAW

SEQ ID NO: 2239179 - protein, 23 aa, Cryptosporidium parvum
VLSGICNYAIIAMFYASDNLFRK

SEQ ID NO: 2239180 - protein, 24 aa, Cryptosporidium parvum
VLSIRINMRQVRLLEVYNIRILES

SEQ ID NO: 2239181 - protein, 18 aa, Cryptosporidium parvum
VLSKKLVPTTNWNLIALS

SEQ ID NO: 2239182 - protein, 18 aa, Cryptosporidium parvum
VLSLKMNLINSFTDLDEL

SEQ ID NO: 2239183 - protein, 21 aa, Cryptosporidium parvum
VLSLYFLILSLDLSFINGDNF

SEQ ID NO: 2239184 - protein, 22 aa, Cryptosporidium parvum
VLSNFFLTVILLNWRNYESKYL

SEQ ID NO: 2239185 - protein, 18 aa, Cryptosporidium parvum
VLSSCLTILVTVSSRIQF

SEQ ID NO: 2239186 - protein, 17 aa, Cryptosporidium parvum
VLTCGKIYGLVIYTGIE

SEQ ID NO: 2239187 - protein, 17 aa, Cryptosporidium parvum
VLTFSGIMAIGFSSVAK

SEQ ID NO: 2239188 - protein, 22 aa, Cryptosporidium parvum
VLTHRCVNAFWSKAPCVRDSKF

SEQ ID NO: 2239189 - protein, 24 aa, Cryptosporidium parvum
VMCEKALLSFRHYRDVVYKTDYDE

SEQ ID NO: 2239190 - protein, 22 aa, Cryptosporidium parvum
VMEHSCFFPLDTIKTCLQSGKV

SEQ ID NO: 2239191 - protein, 18 aa, Cryptosporidium parvum
VMIFPLLLLLLLLISIDF

SEQ ID NO: 2239192 - protein, 20 aa, Cryptosporidium parvum
VMISLFWAIITFGAFKANSF

SEQ ID NO: 2239193 - protein, 23 aa, Cryptosporidium parvum
VMKVKVLLAKIVPLVSIGLLNIE

SEQ ID NO: 2239194 - protein, 18 aa, Cryptosporidium parvum
VMLFRRFDLKTITKSKSY

SEQ ID NO: 2239195 - protein, 19 aa, Cryptosporidium parvum
VMNMLKFEIDKFLADNPLF

SEQ ID NO: 2239196 - protein, 18 aa, Cryptosporidium parvum
VMRFLCLRGYGLTSEESN

SEQ ID NO: 2239197 - protein, 28 aa, Cryptosporidium parvum
VMRRWGRLRLLADYGIHFIRHGLTPVEV

SEQ ID NO: 2239198 - protein, 19 aa, Cryptosporidium parvum
VMSEILKLLSSLLIVLYSN

SEQ ID NO: 2239199 - protein, 24 aa, Cryptosporidium parvum
VMVHICTVLSYILPHVGDLEVETI

SEQ ID NO: 2239200 - protein, 23 aa, Cryptosporidium parvum
VMYAIPVAFFFSFNISFNNICLT

SEQ ID NO: 2239201 - protein, 26 aa, Cryptosporidium parvum
VNDPLCVKVPILIRPSPINNKLDTTL

SEQ ID NO: 2239202 - protein, 17 aa, Cryptosporidium parvum
VNDPRPCITFYSQDQVN

SEQ ID NO: 2239203 - protein, 23 aa, Cryptosporidium parvum
VNDSLMCPGVEFLSKGFIEKLIV

SEQ ID NO: 2239204 - protein, 30 aa, Cryptosporidium parvum; identical to SEQ ID NO: 2128370

SEQ ID NO: 2239205 - protein, 18 aa, Cryptosporidium parvum
VNFFPGLASFLLLETYPN

SEQ ID NO: 2239206 - protein, 19 aa, Cryptosporidium parvum
VNFISKVELVRCLADVADA

SEQ ID NO: 2239207 - protein, 34 aa, Cryptosporidium parvum; identical to SEQ ID NO: 2128374

SEQ ID NO: 2239208 - protein, 17 aa, Cryptosporidium parvum
VNFNKYFLLVVTIIVYF

SEQ ID NO: 2239209 - protein, 26 aa, Cryptosporidium parvum
VNGKIFIPSCVWTFVKDRDDYSSSDI

SEQ ID NO: 2239210 - protein, 20 aa, Cryptosporidium parvum
VNGLEFLFTLLFNIYDSKID

SEQ ID NO: 2239211 - protein, 17 aa, Cryptosporidium parvum
VNICLSLFSIDKLNSEI

SEQ ID NO: 2239212 - protein, 19 aa, Cryptosporidium parvum
VNIFDEFTLASLPSMDYFD

SEQ ID NO: 2239213 - protein, 18 aa, Cryptosporidium parvum
VNINRISKVPILSICNEN

SEQ ID NO: 2239214 - protein, 29 aa, Cryptosporidium parvum
VNKFGYLTWEWEPCVSLRSIIHPLIFTIC

SEQ ID NO: 2239215 - protein, 21 aa, Cryptosporidium parvum
VNKTHTCYILGDKNNKLFDEL

SEQ ID NO: 2239216 - protein, 25 aa, Cryptosporidium parvum
VNLDIIGTVSFCLNNLRILNKSVSY

SEQ ID NO: 2239217 - protein, 19 aa, Cryptosporidium parvum
VNLELKFGLRKWSPLLEKF

SEQ ID NO: 2239218 - protein, 18 aa, Cryptosporidium parvum
VNLLRKALKLFLIREWSL

SEQ ID NO: 2239219 - protein, 18 aa, Cryptosporidium parvum
VNLTLKWEIKKHYIRLNI

SEQ ID NO: 2239220 - protein, 25 aa, Cryptosporidium parvum
VNNRFCGQFLFGGIKNSSDWWDSFR

SEQ ID NO: 2239221 - protein, 23 aa, Cryptosporidium parvum
VNQHLCSILISLAILSISVFYFL

SEQ ID NO: 2239222 - protein, 25 aa, Cryptosporidium parvum
VNQRTKILICLSLISILSIKNLLPR

SEQ ID NO: 2239223 - protein, 20 aa, Cryptosporidium parvum
VNRFPSEFFEDIYNLSLSAI

SEQ ID NO: 2239224 - protein, 19 aa, Cryptosporidium parvum
VNRPRLTVLKSFQNLKGYS

SEQ ID NO: 2239225 - protein, 23 aa, Cryptosporidium parvum
VNSFKQIKCYAWEKYYIKNINEI

SEQ ID NO: 2239226 - protein, 20 aa, Cryptosporidium parvum
VNSILSRISNIIGEKLWNTI

SEQ ID NO: 2239227 - protein, 17 aa, Cryptosporidium parvum
VNSLKHRLSCLRVFVQL

SEQ ID NO: 2239228 - protein, 17 aa, Cryptosporidium parvum
VNTRLFKSWDILRNLVL

SEQ ID NO: 2239229 - protein, 26 aa, Cryptosporidium parvum
VNVFNKFAIIFIHLIKSLNCLHDIEN

SEQ ID NO: 2239230 - protein, 22 aa, Cryptosporidium parvum
VNVFRAVFNVLRGTLFRILFGK

SEQ ID NO: 2239231 - protein, 18 aa, Cryptosporidium parvum
VNVILLFVLLSKRKHTAS

SEQ ID NO: 2239232 - protein, 19 aa, Cryptosporidium parvum
VNYGEICFIIGDHGSGKTT

SEQ ID NO: 2239233 - protein, 23 aa, Cryptosporidium parvum
VNYLLGNYLNWVIFNIKDCNIKK

SEQ ID NO: 2239234 - protein, 28 aa, Cryptosporidium parvum
VNYYDYNLCFIIKILIYLISNVKDGLDL

SEQ ID NO: 2239235 - protein, 17 aa, Cryptosporidium parvum
VPDVYDILPICSNLLNS

SEQ ID NO: 2239236 - protein, 24 aa, Cryptosporidium parvum
VPFAEFGLPFVIKLFPNMLPSTFA

SEQ ID NO: 2239237 - protein, 17 aa, Cryptosporidium parvum
VPFCLISMVLSVVYRNK

SEQ ID NO: 2239238 - protein, 23 aa, Cryptosporidium parvum
VPGDASSVFKFWKNMTSLVTCIS

SEQ ID NO: 2239239 - protein, 19 aa, Cryptosporidium parvum
VPGLEVLESIIYPFKIKYL

SEQ ID NO: 2239240 - protein, 22 aa, Cryptosporidium parvum
VPGPGMSECLLLAFNTKSNNSG

SEQ ID NO: 2239241 - protein, 17 aa, Cryptosporidium parvum
VPHERWNAYCFNEKKSI

SEQ ID NO: 2239242 - protein, 17 aa, Cryptosporidium parvum
VPICPITFLPINVFAIY

SEQ ID NO: 2239243 - protein, 24 aa, Cryptosporidium parvum
VPKSETNSLCNIFRNKIQRIDTPL

SEQ ID NO: 2239244 - protein, 19 aa, Cryptosporidium parvum
VPNAFYLEQVHCMYTGIKP

SEQ ID NO: 2239245 - protein, 27 aa, Cryptosporidium parvum
VPNDIWRIKLIISRLFKIDSTTHPNLF

SEQ ID NO: 2239246 - protein, 23 aa, Cryptosporidium parvum
VPNKAYCCGIIGYIGSGDAQKVL

SEQ ID NO: 2239247 - protein, 20 aa, Cryptosporidium parvum
VPNREFLGLPILNRNDQLIG

SEQ ID NO: 2239248 - protein, 23 aa, Cryptosporidium parvum
VPPWANPLLLIAILISVFVHLVI

SEQ ID NO: 2239249 - protein, 17 aa, Cryptosporidium parvum
VPQILPWFNESLLEPFL

SEQ ID NO: 2239250 - protein, 30 aa, Cryptosporidium parvum; identical to SEQ ID NO: 2128399

SEQ ID NO: 2239251 - protein, 17 aa, Cryptosporidium parvum
VPREVSRELQLGRQIVF

SEQ ID NO: 2239252 - protein, 31 aa, Cryptosporidium parvum; identical to SEQ ID NO: 2128402

SEQ ID NO: 2239253 - protein, 27 aa, Cryptosporidium parvum
VPSSFFLDKRLLCIFEDKKMIRNLNNL

SEQ ID NO: 2239254 - protein, 18 aa, Cryptosporidium parvum
VPTLGSLFIICFLVLNYL

SEQ ID NO: 2239255 - protein, 21 aa, Cryptosporidium parvum
VPVPFEMFFDKVFIYSNDMEQ

SEQ ID NO: 2239256 - protein, 21 aa, Cryptosporidium parvum
VPVVRFCTWIVLLANIIPIAL

SEQ ID NO: 2239257 - protein, 17 aa, Cryptosporidium parvum
VPYCIYVSLFLFLIPQI

SEQ ID NO: 2239258 - protein, 21 aa, Cryptosporidium parvum
VPYSLPIILMVTFMTYKIVCQ

SEQ ID NO: 2239259 - protein, 23 aa, Cryptosporidium parvum
VQECLKLKRFESLSIIQHTILVA

SEQ ID NO: 2239260 - protein, 25 aa, Cryptosporidium parvum
VQEHLRPSPPLPMSNSIKNFQKLDP

SEQ ID NO: 2239261 - protein, 25 aa, Cryptosporidium parvum
VQEHLRPSPPLPMSNSIRDFQKLDP

SEQ ID NO: 2239262 - protein, 18 aa, Cryptosporidium parvum
VQETLRMYYGMKLATVKD

SEQ ID NO: 2239263 - protein, 26 aa, Cryptosporidium parvum
VQGQIQYLGSMGYEQRGLQRTSESPF

SEQ ID NO: 2239264 - protein, 18 aa, Cryptosporidium parvum
VQIIFLRQIFILLSVKDF

SEQ ID NO: 2239265 - protein, 28 aa, Cryptosporidium parvum
VQIIKCSELILTAILAFFVLKRKVTVRE

SEQ ID NO: 2239266 - protein, 22 aa, Cryptosporidium parvum
VQIILLDYLVTWILINVSVFKV

SEQ ID NO: 2239267 - protein, 29 aa, Cryptosporidium parvum
VQIYSIRFLKLILLHPNWSEFLRSRSNSS

SEQ ID NO: 2239268 - protein, 21 aa, Cryptosporidium parvum
VQKNYLFSFLCRMAQNKYGAL

SEQ ID NO: 2239269 - protein, 33 aa, Cryptosporidium parvum
VQKPIWFIPHRKCLLEVKSLIIFNYLFIIKLLK

SEQ ID NO: 2239270 - protein, 23 aa, Cryptosporidium parvum
VQKRLIYAIFFCLVFTLIEVVVG

SEQ ID NO: 2239271 - protein, 17 aa, Cryptosporidium parvum
VQLKGRIACEISTSDEL

SEQ ID NO: 2239272 - protein, 22 aa, Cryptosporidium parvum
VQNSFHLLRVMFITNIDLGLTL

SEQ ID NO: 2239273 - protein, 22 aa, Cryptosporidium parvum
VQQRSAILFTILLIKSLTILSP

SEQ ID NO: 2239274 - protein, 19 aa, Cryptosporidium parvum
VQSLIQWIRITSINESWNI

SEQ ID NO: 2239275 - protein, 26 aa, Cryptosporidium parvum
VQSPELYKRFLVSTGVYALFGTIISG

SEQ ID NO: 2239276 - protein, 20 aa, Cryptosporidium parvum
VQVAEFLLRNGLKDIDAVVF

SEQ ID NO: 2239277 - protein, 17 aa, Cryptosporidium parvum
VQVLRYLSISPLIFVVL

SEQ ID NO: 2239278 - protein, 19 aa, Cryptosporidium parvum
VRDPICRNMIYPIKDLDDA

SEQ ID NO: 2239279 - protein, 30 aa, Cryptosporidium parvum
VREEIKGLFSPEFWDFIDSCLTKDPNQRKN

SEQ ID NO: 2239280 - protein, 26 aa, Cryptosporidium parvum
VREMPFVSILFFCFLVSNLIYQLLAG

SEQ ID NO: 2239281 - protein, 22 aa, Cryptosporidium parvum
VRFEYFPNLTVAISYLGSSNSF

SEQ ID NO: 2239282 - protein, 20 aa, Cryptosporidium parvum
VRGTNCLQYGMLNSGQVSII

SEQ ID NO: 2239283 - protein, 18 aa, Cryptosporidium parvum
VRIAQGFLYMGKGLVTVN

SEQ ID NO: 2239284 - protein, 20 aa, Cryptosporidium parvum
VRKKTSILLFNFLSKQNSIQ

SEQ ID NO: 2239285 - protein, 28 aa, Cryptosporidium parvum
VRLSKNWSCEVWFYVPFEITFHPYCLIS

SEQ ID NO: 2239286 - protein, 20 aa, Cryptosporidium parvum
VRNLLPAFVTFGFSQDSNIL

SEQ ID NO: 2239287 - protein, 19 aa, Cryptosporidium parvum
VRPILKFSTLITGVNYAIS

SEQ ID NO: 2239288 - protein, 21 aa, Cryptosporidium parvum
VRPVLGRLLAFSIERMDYPDV

SEQ ID NO: 2239289 - protein, 17 aa, Cryptosporidium parvum
VRREMFLPIKFSESETP

SEQ ID NO: 2239290 - protein, 29 aa, Cryptosporidium parvum
VRREVCKYLKCNIFRFKLSLSSFKIVLSR

SEQ ID NO: 2239291 - protein, 18 aa, Cryptosporidium parvum
VRRIKWDLKDAGTSISRL

SEQ ID NO: 2239292 - protein, 21 aa, Cryptosporidium parvum
VRRILFCRYVLPYILYIQHTA

SEQ ID NO: 2239293 - protein, 18 aa, Cryptosporidium parvum
VRRLYKLHFFSIIKNIVL

SEQ ID NO: 2239294 - protein, 17 aa, Cryptosporidium parvum
VRSAILLGREWNREKYE

SEQ ID NO: 2239295 - protein, 24 aa, Cryptosporidium parvum
VRTRSYISFFWGMIIILFFLTSTL

SEQ ID NO: 2239296 - protein, 17 aa, Cryptosporidium parvum
VRYGRSTLTTVLLMYKL

SEQ ID NO: 2239297 - protein, 19 aa, Cryptosporidium parvum
VRYLLLIKLIEHFKVKRIL

SEQ ID NO: 2239298 - protein, 19 aa, Cryptosporidium parvum
VRYSVALLILKISRIQGFD

SEQ ID NO: 2239299 - protein, 24 aa, Cryptosporidium parvum
VSAEPSVVFLFPMIGLGIYYAVAR

SEQ ID NO: 2239300 - protein, 25 aa, Cryptosporidium parvum
VSAYLETFSSLVLELGIRDNILSQS

SEQ ID NO: 2239301 - protein, 18 aa, Cryptosporidium parvum
VSCHSFRKSLAVIIKSGE

SEQ ID NO: 2239302 - protein, 17 aa, Cryptosporidium parvum
VSCPHYFSEIGIYISLF

SEQ ID NO: 2239303 - protein, 17 aa, Cryptosporidium parvum
VSDHHSFILFTLIAYAL

SEQ ID NO: 2239304 - protein, 25 aa, Cryptosporidium parvum
VSDPQICYNPAMIIVILNGYESIYG

SEQ ID NO: 2239305 - protein, 23 aa, Cryptosporidium parvum
VSDSCIFKFFMFVSVIILTLSVG

SEQ ID NO: 2239306 - protein, 17 aa, Cryptosporidium parvum
VSFARFMLLLSSIIPIS

SEQ ID NO: 2239307 - protein, 17 aa, Cryptosporidium parvum
VSFYKFQTNTGVLDFEL

SEQ ID NO: 2239308 - protein, 19 aa, Cryptosporidium parvum
VSGCFLKSLLLASIPIPSQ

SEQ ID NO: 2239309 - protein, 23 aa, Cryptosporidium parvum
VSGYSGTVLSVFNSYALVYITQN

SEQ ID NO: 2239310 - protein, 20 aa, Cryptosporidium parvum
VSHDLCKKVDQIFKKIEQLN

SEQ ID NO: 2239311 - protein, 18 aa, Cryptosporidium parvum
VSHELCFEKNKLIENATQ

SEQ ID NO: 2239312 - protein, 25 aa, Cryptosporidium parvum
VSIKNCKNCLIAVACRQIRIHDSDG

SEQ ID NO: 2239313 - protein, 20 aa, Cryptosporidium parvum
VSILCIYNIIMLARNKPFII

SEQ ID NO: 2239314 - protein, 23 aa, Cryptosporidium parvum
VSILHICVFTGPIISSLTALASY

SEQ ID NO: 2239315 - protein, 23 aa, Cryptosporidium parvum
VSILKRPNLIFLQQIPSNNQLKS

SEQ ID NO: 2239316 - protein, 24 aa, Cryptosporidium parvum
VSIMICLYLNFIPSIYKIPGVPNV

SEQ ID NO: 2239317 - protein, 25 aa, Cryptosporidium parvum
VSISLCILGIIKPWIFMAWLTTAVT

SEQ ID NO: 2239318 - protein, 17 aa, Cryptosporidium parvum
VSKEFYAPRSGDNSCTL

SEQ ID NO: 2239319 - protein, 21 aa, Cryptosporidium parvum
VSKGFRLSERYVAHIMRQIMA

SEQ ID NO: 2239320 - protein, 18 aa, Cryptosporidium parvum
VSKKTYYWYFSKLKWSWT

SEQ ID NO: 2239321 - protein, 26 aa, Cryptosporidium parvum
VSKRPIPGSIAGDLNPIMKTPTQTDS

SEQ ID NO: 2239322 - protein, 28 aa, Cryptosporidium parvum
VSLAFQEWVEGIGILFIVLINASLATYM

SEQ ID NO: 2239323 - protein, 19 aa, Cryptosporidium parvum
VSLGICFSAVLLIIVVPFF

SEQ ID NO: 2239324 - protein, 24 aa, Cryptosporidium parvum
VSLKHQRYLIAYPIALLYASFTIV

SEQ ID NO: 2239325 - protein, 20 aa, Cryptosporidium parvum
VSLLIFKLIKNISMKYLNLV

SEQ ID NO: 2239326 - protein, 22 aa, Cryptosporidium parvum
VSLLSLKLSQIVSIDDSSNSLS

SEQ ID NO: 2239327 - protein, 19 aa, Cryptosporidium parvum
VSLLSWLSNIIISPSKSAH

SEQ ID NO: 2239328 - protein, 22 aa, Cryptosporidium parvum
VSMLCVYFIGVLFLAGFQEFIA

SEQ ID NO: 2239329 - protein, 17 aa, Cryptosporidium parvum
VSNEKFVIPSLPSDLDP

SEQ ID NO: 2239330 - protein, 18 aa, Cryptosporidium parvum
VSNLLKECLIPFKDLLLK

SEQ ID NO: 2239331 - protein, 21 aa, Cryptosporidium parvum
VSNMHGHRWFPPLLDQIRHFL

SEQ ID NO: 2239332 - protein, 19 aa, Cryptosporidium parvum
VSNPFDWMDLISLQGKTNF

SEQ ID NO: 2239333 - protein, 17 aa, Cryptosporidium parvum
VSNVPVVRWDHKKYFSL

SEQ ID NO: 2239334 - protein, 18 aa, Cryptosporidium parvum
VSNWITGPCCWLDDKFKH

SEQ ID NO: 2239335 - protein, 24 aa, Cryptosporidium parvum
VSPRNCSLESFLQTNCLNKNQDPY

SEQ ID NO: 2239336 - protein, 25 aa, Cryptosporidium parvum
VSQSLIYYRRILKYYFGDNFDNYWK

SEQ ID NO: 2239337 - protein, 22 aa, Cryptosporidium parvum
VSSEIPRTGYLLPKENRLITIL

SEQ ID NO: 2239338 - protein, 22 aa, Cryptosporidium parvum
VSSFIPRFPIDYIDENNKILQE

SEQ ID NO: 2239339 - protein, 26 aa, Cryptosporidium parvum
VSSFVLSVINMVKFVEKIKIPICQHN

SEQ ID NO: 2239340 - protein, 20 aa, Cryptosporidium parvum
VSSLGDLWVWGKAENVLSEK

SEQ ID NO: 2239341 - protein, 18 aa, Cryptosporidium parvum
VSSLLFCGAMMLLDYPIS

SEQ ID NO: 2239342 - protein, 21 aa, Cryptosporidium parvum
VSSNLPLLITLSFLLEDKKKS

SEQ ID NO: 2239343 - protein, 28 aa, Cryptosporidium parvum
VSTLLRNVCKYMHLVFVLDLGSLLWFSE

SEQ ID NO: 2239344 - protein, 18 aa, Cryptosporidium parvum
VSTQGMWRTVNWGEPPVD

SEQ ID NO: 2239345 - protein, 24 aa, Cryptosporidium parvum
VSTRLLKQLFRYIGQNPQHETILI

SEQ ID NO: 2239346 - protein, 27 aa, Cryptosporidium parvum
VSVALIWDILNIYSFLLFFIYTIMAKL

SEQ ID NO: 2239347 - protein, 20 aa, Cryptosporidium parvum
VSWEACLYLNNSVIRGFIQY

SEQ ID NO: 2239348 - protein, 37 aa, Cryptosporidium parvum
VSYIYKFANCFISSFSGPFMLFYSVLRTIDGMAENIQ

SEQ ID NO: 2239349 - protein, 18 aa, Cryptosporidium parvum
VSYLYRIISFSALSYLFF

SEQ ID NO: 2239350 - protein, 26 aa, Cryptosporidium parvum
VTAIRRTGPYQVWKVPPFMIPTSTET

SEQ ID NO: 2239351 - protein, 23 aa, Cryptosporidium parvum
VTDCFTLSFAFVIFFIVFLFFIG

SEQ ID NO: 2239352 - protein, 23 aa, Cryptosporidium parvum
VTENCKKPFWVMVHERNQPHAAQ

SEQ ID NO: 2239353 - protein, 19 aa, Cryptosporidium parvum
VTFVINWLFVFYVIYPLMW

SEQ ID NO: 2239354 - protein, 22 aa, Cryptosporidium parvum
VTFYRFSFFKSPVVQNAIDQTK

SEQ ID NO: 2239355 - protein, 40 aa, Cryptosporidium parvum
VTGCDCDRFPEGVACPMVLSGEANIECIGYKVWNSARKGA

SEQ ID NO: 2239356 - protein, 23 aa, Cryptosporidium parvum
VTGFPREHAGAIAISQSGETADT

SEQ ID NO: 2239357 - protein, 18 aa, Cryptosporidium parvum
VTIFGAGSFGSAISCVVG

SEQ ID NO: 2239358 - protein, 20 aa, Cryptosporidium parvum
VTIMVFKQVVGLSILFIPSI

SEQ ID NO: 2239359 - protein, 18 aa, Cryptosporidium parvum
VTIVGVWGLLFFGSFLVP

SEQ ID NO: 2239360 - protein, 17 aa, Cryptosporidium parvum
VTLAFSIFQIFTAMSFP

SEQ ID NO: 2239361 - protein, 29 aa, Cryptosporidium parvum
VTRSNACIFEFIIPLVLEPIMIRLITVLA

SEQ ID NO: 2239362 - protein, 22 aa, Cryptosporidium parvum
VTSCLISEFWSLGKELFFEIYT

SEQ ID NO: 2239363 - protein, 24 aa, Cryptosporidium parvum
VTSLDLPNSLSFNKSIYRYLLVQY

SEQ ID NO: 2239364 - protein, 23 aa, Cryptosporidium parvum
VTVPRLELFYGYLNIPLRYISLL

SEQ ID NO: 2239365 - protein, 26 aa, Cryptosporidium parvum
VTWMICIPSAFLIRPIWILENSLDSN

SEQ ID NO: 2239366 - protein, 20 aa, Cryptosporidium parvum
VVATCSLFLIISFFVNFLNK

SEQ ID NO: 2239367 - protein, 26 aa, Cryptosporidium parvum
VVCSLAKCRYMLKIDKIRSFSTPSNI

SEQ ID NO: 2239368 - protein, 19 aa, Cryptosporidium parvum
VVDLCTLCTSMASKYQNNI

SEQ ID NO: 2239369 - protein, 19 aa, Cryptosporidium parvum
VVFFLECKKFTKIYRNSPE

SEQ ID NO: 2239370 - protein, 24 aa, Cryptosporidium parvum
VVGEFGGLLNPATGVMIPGSLGPS

SEQ ID NO: 2239371 - protein, 25 aa, Cryptosporidium parvum
VVGIHKLRFLPAIIYIESTKQFITS

SEQ ID NO: 2239372 - protein, 25 aa, Cryptosporidium parvum
VVGMLPLLRRGIGIHHGGLLPVVKE

SEQ ID NO: 2239373 - protein, 19 aa, Cryptosporidium parvum
VVGSVLYIPISLMRAIEYY

SEQ ID NO: 2239374 - protein, 25 aa, Cryptosporidium parvum
VVHTLCIAASFGPNIVRNHTINRIQ

SEQ ID NO: 2239375 - protein, 24 aa, Cryptosporidium parvum
VVICTLSTIVFFLWKSDGEVNTKK

SEQ ID NO: 2239376 - protein, 19 aa, Cryptosporidium parvum
VVIIMCLYLIYTFYHIIPL

SEQ ID NO: 2239377 - protein, 23 aa, Cryptosporidium parvum
VVKFTCIYVLLLGSFINTLQYIF

SEQ ID NO: 2239378 - protein, 22 aa, Cryptosporidium parvum
VVLPFISPIPFGSRIQPMNGQQ

SEQ ID NO: 2239379 - protein, 19 aa, Cryptosporidium parvum
VVLQSKWPQVPLEASLIEF

SEQ ID NO: 2239380 - protein, 17 aa, Cryptosporidium parvum
VVNEFLDCLGRNIIISG

SEQ ID NO: 2239381 - protein, 25 aa, Cryptosporidium parvum
VVNWKRIPTMYIKYLLDGNYKGILR

SEQ ID NO: 2239382 - protein, 19 aa, Cryptosporidium parvum
VVPGHYLILILNGTKNFVN

SEQ ID NO: 2239383 - protein, 25 aa, Cryptosporidium parvum
VVPTYLCWHEDLLVLVIGFENSFEV

SEQ ID NO: 2239384 - protein, 22 aa, Cryptosporidium parvum
VVRALSRYKGFREYLRTSEIQS

SEQ ID NO: 2239385 - protein, 23 aa, Cryptosporidium parvum
VVTLKDSFSLLWAENGDVISEHY

SEQ ID NO: 2239386 - protein, 22 aa, Cryptosporidium parvum
VVTPWFRHIFMDTLSLPVVLII

SEQ ID NO: 2239387 - protein, 27 aa, Cryptosporidium parvum
VVVQRVAFCKEYGLIAIIVGIPDNAKH

SEQ ID NO: 2239388 - protein, 18 aa, Cryptosporidium parvum
VVYCVALLVNIIAAYSRE

SEQ ID NO: 2239389 - protein, 26 aa, Cryptosporidium parvum
VVYIPFPLSYSFKGMLQRGIESNPNI

SEQ ID NO: 2239390 - protein, 22 aa, Cryptosporidium parvum
VVYLCGYTFHKKGIKSMLYLNP

SEQ ID NO: 2239391 - protein, 24 aa, Cryptosporidium parvum
VVYPSLFTLFPLFRQILIREKIDI

SEQ ID NO: 2239392 - protein, 25 aa, Cryptosporidium parvum
VWDSSNLYFTWLLATRIILSLTTYF

SEQ ID NO: 2239393 - protein, 19 aa, Cryptosporidium parvum
VWEDYFRPRDIFIHNDLNI

SEQ ID NO: 2239394 - protein, 22 aa, Cryptosporidium parvum
VWRYLKPNHKISFSRDEYGNSY

SEQ ID NO: 2239395 - protein, 31 aa, Cryptosporidium parvum; identical to SEQ ID NO: 2128497

SEQ ID NO: 2239396 - protein, 17 aa, Cryptosporidium parvum
VWVLIYFYIHYLLLNTI

SEQ ID NO: 2239397 - protein, 23 aa, Cryptosporidium parvum
VYDLRTATKWRVLQGHTQQVDAL

SEQ ID NO: 2239398 - protein, 18 aa, Cryptosporidium parvum
VYERLFRQLLCTLITLLG

SEQ ID NO: 2239399 - protein, 17 aa, Cryptosporidium parvum
VYFLDRFAEEMVEEVEE

SEQ ID NO: 2239400 - protein, 23 aa, Cryptosporidium parvum
VYFTLECIFIRESVYVKEQHFQE

SEQ ID NO: 2239401 - protein, 21 aa, Cryptosporidium parvum
VYHPGDFPVPLFIRDEIDYQI

SEQ ID NO: 2239402 - protein, 26 aa, Cryptosporidium parvum
VYHSDFTWRLNSIMQRNLSDSVTKDA

SEQ ID NO: 2239403 - protein, 17 aa, Cryptosporidium parvum
VYKRKVQSITIVSKIIL

SEQ ID NO: 2239404 - protein, 23 aa, Cryptosporidium parvum
VYLFFSALISFTFTGSLMYQHCD

SEQ ID NO: 2239405 - protein, 19 aa, Cryptosporidium parvum
VYLGYPNCHRLLFFLIHVI

SEQ ID NO: 2239406 - protein, 19 aa, Cryptosporidium parvum
VYLRNDIKVNYWSSPIHSV

SEQ ID NO: 2239407 - protein, 24 aa, Cryptosporidium parvum
VYNIPLVTGIMVFNTLKIKDEHDR

SEQ ID NO: 2239408 - protein, 21 aa, Cryptosporidium parvum
VYPGVIQRLSIQLINSIEKGS

SEQ ID NO: 2239409 - protein, 20 aa, Cryptosporidium parvum
VYPKEKWRSITWEVQMHGMG

SEQ ID NO: 2239410 - protein, 24 aa, Cryptosporidium parvum
VYRRIYPEPSLYIFFLNFPIERWC

SEQ ID NO: 2239411 - protein, 24 aa, Cryptosporidium parvum
VYTLRFPNSFFGYPIQIFTKYIYK

SEQ ID NO: 2239412 - protein, 27 aa, Cryptosporidium parvum
VYYSSPIVCDIMLKFSPLLKKINMLEK

SEQ ID NO: 2239413 - protein, 18 aa, Cryptosporidium parvum
WAAILGIKIWHKEQRTED

SEQ ID NO: 2239414 - protein, 19 aa, Cryptosporidium parvum
WALLWVVIIVFQFLSLKFQ

SEQ ID NO: 2239415 - protein, 21 aa, Cryptosporidium parvum
WALTRFFSFAIFDTTRNEACF

SEQ ID NO: 2239416 - protein, 22 aa, Cryptosporidium parvum
WANSCITMIWPLLVVGDYLRLP

SEQ ID NO: 2239417 - protein, 25 aa, Cryptosporidium parvum
WATKRGNYGIIQWLISHGANIGHRD

SEQ ID NO: 2239418 - protein, 24 aa, Cryptosporidium parvum
WATQCISSILLNCICDFDEFSRLE

SEQ ID NO: 2239419 - protein, 18 aa, Cryptosporidium parvum
WCILLKISIEDINRKISI

SEQ ID NO: 2239420 - protein, 28 aa, Cryptosporidium parvum
WDDSCAKSGDLARTIGFISPKSLKYLEL

SEQ ID NO: 2239421 - protein, 19 aa, Cryptosporidium parvum
WDEFRELYLNIGIIDPERY

SEQ ID NO: 2239422 - protein, 23 aa, Cryptosporidium parvum
WDLLLKCDPEWVTVVFEVSAVQR

SEQ ID NO: 2239423 - protein, 21 aa, Cryptosporidium parvum
WDLWGPCIILLVLSSCLYIKA

SEQ ID NO: 2239424 - protein, 20 aa, Cryptosporidium parvum
WDNKGCVRGGYRNINLPGAQ

SEQ ID NO: 2239425 - protein, 17 aa, Cryptosporidium parvum
WDSFRHINKNFKTSVPT

SEQ ID NO: 2239426 - protein, 29 aa, Cryptosporidium parvum
WDSMILWNDLFVWRNFVFSIIMNLISRSD

SEQ ID NO: 2239427 - protein, 18 aa, Cryptosporidium parvum
WEDTLTWRGVKHCIQKLW

SEQ ID NO: 2239428 - protein, 21 aa, Cryptosporidium parvum
WEMNRICSMLEVMNKKLIKTG

SEQ ID NO: 2239429 - protein, 24 aa, Cryptosporidium parvum
WEQFPRYINPWFYNTRVLLARSKV

SEQ ID NO: 2239430 - protein, 17 aa, Cryptosporidium parvum
WERYFIKNIDSHRENEI

SEQ ID NO: 2239431 - protein, 27 aa, Cryptosporidium parvum
WEYIFRKAQIWRFLTSFFFVGPFSIGW

SEQ ID NO: 2239432 - protein, 26 aa, Cryptosporidium parvum
WFAFTQIRGSIPLFWEQTGVNSCAIT

SEQ ID NO: 2239433 - protein, 22 aa, Cryptosporidium parvum
WFEFYKYILSNGTHDIIINNSC

SEQ ID NO: 2239434 - protein, 25 aa, Cryptosporidium parvum
WFFKKFSTKSSYIWLKSKEKYTKST

SEQ ID NO: 2239435 - protein, 26 aa, Cryptosporidium parvum
WFISQRWDFCPLVFKQLMQIKRSSSI

SEQ ID NO: 2239436 - protein, 28 aa, Cryptosporidium parvum
WFKHFLTPWLKFGTVFDHFSEFIDYNLS

SEQ ID NO: 2239437 - protein, 18 aa, Cryptosporidium parvum
WFLTGIREMQLVSTASHR

SEQ ID NO: 2239438 - protein, 17 aa, Cryptosporidium parvum
WFVFGETLIEFNDKVIF

SEQ ID NO: 2239439 - protein, 19 aa, Cryptosporidium parvum
WGFLTFTVIFSFLVFALFA

SEQ ID NO: 2239440 - protein, 17 aa, Cryptosporidium parvum
WGIKSGTIEPMFNRCAE

SEQ ID NO: 2239441 - protein, 19 aa, Cryptosporidium parvum
WGLGIDRLIMFLADKNNIK

SEQ ID NO: 2239442 - protein, 22 aa, Cryptosporidium parvum
WGSGISICIMEYYGVNYKYMIG

SEQ ID NO: 2239443 - protein, 22 aa, Cryptosporidium parvum
WGSLCNSLRISSSCSSYLEDLL

SEQ ID NO: 2239444 - protein, 17 aa, Cryptosporidium parvum
WHEALVFDAALPDDLSI

SEQ ID NO: 2239445 - protein, 19 aa, Cryptosporidium parvum
WHIFVVFTIPYILFRVNST

SEQ ID NO: 2239446 - protein, 17 aa, Cryptosporidium parvum
WHSKKGLTRRALSLLQP

SEQ ID NO: 2239447 - protein, 34 aa, Cryptosporidium parvum
WHSLLPLKFSIGWLTCPSILISRIVRKLKSILLN

SEQ ID NO: 2239448 - protein, 17 aa, Cryptosporidium parvum
WIAGDIFLLTSSGYDFL

SEQ ID NO: 2239449 - protein, 17 aa, Cryptosporidium parvum
WIAKYLLSLSWLFLGIG

SEQ ID NO: 2239450 - protein, 17 aa, Cryptosporidium parvum
WIAQGHELLFFYLTYYS

SEQ ID NO: 2239451 - protein, 18 aa, Cryptosporidium parvum
WIIIIAHFFCLNRNGASL

SEQ ID NO: 2239452 - protein, 19 aa, Cryptosporidium parvum
WILLLRITIFNGVGGSERN

SEQ ID NO: 2239453 - protein, 18 aa, Cryptosporidium parvum
WIMIKIHLQLGIDHQDEY

SEQ ID NO: 2239454 - protein, 26 aa, Cryptosporidium parvum
WINSNCLVSGWKLCNYSSQLHFYDIR

SEQ ID NO: 2239455 - protein, 20 aa, Cryptosporidium parvum
WINYKLPTISGNSWEIAFHL

SEQ ID NO: 2239456 - protein, 22 aa, Cryptosporidium parvum
WIPKLDFQQACFKSNNNKWKVS

SEQ ID NO: 2239457 - protein, 20 aa, Cryptosporidium parvum
WIPTRVNKLLLLDPFLLNSN

SEQ ID NO: 2239458 - protein, 23 aa, Cryptosporidium parvum
WIQQVCGMIFYLIAYATLSLFGI

SEQ ID NO: 2239459 - protein, 20 aa, Cryptosporidium parvum
WIRVLISQRVLNIYKKRELQ

SEQ ID NO: 2239460 - protein, 21 aa, Cryptosporidium parvum
WISFIRFLKIEFEKIDKNYSN

SEQ ID NO: 2239461 - protein, 17 aa, Cryptosporidium parvum
WISLDLLQISEKVLNLR

SEQ ID NO: 2239462 - protein, 17 aa, Cryptosporidium parvum
WISLLIILKDNPAISKT

SEQ ID NO: 2239463 - protein, 26 aa, Cryptosporidium parvum
WISSDSKFFCWKKVRSKSSHLLNPSN

SEQ ID NO: 2239464 - protein, 17 aa, Cryptosporidium parvum
WITFCFCGQPIAVLLYY

SEQ ID NO: 2239465 - protein, 25 aa, Cryptosporidium parvum
WITLIPEIICELVYIFHTIKSNFKN

SEQ ID NO: 2239466 - protein, 23 aa, Cryptosporidium parvum
WIVSEILWSFSIWLESVAILPQL

SEQ ID NO: 2239467 - protein, 18 aa, Cryptosporidium parvum
WIYKCIRNSKQLINIQYY

SEQ ID NO: 2239468 - protein, 20 aa, Cryptosporidium parvum
WKAECERFGKSKVFENKNGN

SEQ ID NO: 2239469 - protein, 30 aa, Cryptosporidium parvum; identical to SEQ ID NO: 2128545

SEQ ID NO: 2239470 - protein, 17 aa, Cryptosporidium parvum
WKEKRSFVKGKGMMDTF

SEQ ID NO: 2239471 - protein, 18 aa, Cryptosporidium parvum
WKGTDWQTSILYCSSTSK

SEQ ID NO: 2239472 - protein, 23 aa, Cryptosporidium parvum
WKILDSPFRARSFYTFDPTLDFF

SEQ ID NO: 2239473 - protein, 25 aa, Cryptosporidium parvum
WKILKKDSFMLLSFVPIPTTAITYV

SEQ ID NO: 2239474 - protein, 18 aa, Cryptosporidium parvum
WKILLKKPLGDKFQVKTE

SEQ ID NO: 2239475 - protein, 17 aa, Cryptosporidium parvum
WKKYTGMVLEKYLYLLD

SEQ ID NO: 2239476 - protein, 32 aa, Cryptosporidium parvum
WKLNKEFFELFLRWIFQISLTENFEIPLTSYL

SEQ ID NO: 2239477 - protein, 21 aa, Cryptosporidium parvum
WKMKAYYLLTHTLEYESALFC

SEQ ID NO: 2239478 - protein, 19 aa, Cryptosporidium parvum
WKNKFWIRHVSPVITNSDR

SEQ ID NO: 2239479 - protein, 24 aa, Cryptosporidium parvum
WKNNIQKFIPFRFIKDCFISCIPV

SEQ ID NO: 2239480 - protein, 19 aa, Cryptosporidium parvum
WKPLYYLLTFFTFNFILKA

SEQ ID NO: 2239481 - protein, 21 aa, Cryptosporidium parvum
WKRNDFKYLVPHATQSLASDP

SEQ ID NO: 2239482 - protein, 20 aa, Cryptosporidium parvum
WKSIIKLQITTLIIYGSQNL

SEQ ID NO: 2239483 - protein, 19 aa, Cryptosporidium parvum
WKSSFSNQIPKEFEDLQTL

SEQ ID NO: 2239484 - protein, 17 aa, Cryptosporidium parvum
WKVAWMIFSAFKSSYTI

SEQ ID NO: 2239485 - protein, 18 aa, Cryptosporidium parvum
WKVFKVTCSRGYEAKIEP

SEQ ID NO: 2239486 - protein, 17 aa, Cryptosporidium parvum
WKVLLALENKDNFNQVL

SEQ ID NO: 2239487 - protein, 17 aa, Cryptosporidium parvum
WKYKSHKVLDFSGQNFK

SEQ ID NO: 2239488 - protein, 24 aa, Cryptosporidium parvum
WLAKISRYQTWSMWDQQFLNETDV

SEQ ID NO: 2239489 - protein, 17 aa, Cryptosporidium parvum
WLALLKLVQCMNPHKSK

SEQ ID NO: 2239490 - protein, 26 aa, Cryptosporidium parvum
WLAMYSMHFICMFFIPTFFYGLQYLT

SEQ ID NO: 2239491 - protein, 19 aa, Cryptosporidium parvum
WLFKSDLYYIFLLASNIKL

SEQ ID NO: 2239492 - protein, 19 aa, Cryptosporidium parvum
WLHFACSLSASSTLIVTFT

SEQ ID NO: 2239493 - protein, 18 aa, Cryptosporidium parvum
WLIRDCFLSISLKRKKEI

SEQ ID NO: 2239494 - protein, 17 aa, Cryptosporidium parvum
WLLGVGLVSSSFEVQTK

SEQ ID NO: 2239495 - protein, 19 aa, Cryptosporidium parvum
WLNILPGLFLIILQLFSII

SEQ ID NO: 2239496 - protein, 33 aa, Cryptosporidium parvum; identical to SEQ ID NO: 2184014

SEQ ID NO: 2239497 - protein, 22 aa, Cryptosporidium parvum
WLNKNCDEFFSLLLKQYSIIPI

SEQ ID NO: 2239498 - protein, 19 aa, Cryptosporidium parvum
WLNPNLKKLRYTLNNFPYN

SEQ ID NO: 2239499 - protein, 29 aa, Cryptosporidium parvum
WLPLGIFPSKCLFKLFPIIMQSVGQVNLT

SEQ ID NO: 2239500 - protein, 19 aa, Cryptosporidium parvum
WLQMHFLNLGLAMGDATLV

SEQ ID NO: 2239501 - protein, 25 aa, Cryptosporidium parvum
WLRVIPILMIFLIYYRKVRVRRQSI

SEQ ID NO: 2239502 - protein, 18 aa, Cryptosporidium parvum
WLRYNAYLRKSRLEFTNS

SEQ ID NO: 2239503 - protein, 20 aa, Cryptosporidium parvum
WLTSIDYLNWISSAKTIKEL

SEQ ID NO: 2239504 - protein, 19 aa, Cryptosporidium parvum
WLYFNGLKNIILLSRSSNN

SEQ ID NO: 2239505 - protein, 19 aa, Cryptosporidium parvum
WLYPYRILPMMFKDINNSV

SEQ ID NO: 2239506 - protein, 25 aa, Cryptosporidium parvum
WMEHIPRFARFDLKIAVSFQTHSEK

SEQ ID NO: 2239507 - protein, 18 aa, Cryptosporidium parvum
WMISILLFYFITRESQKI

SEQ ID NO: 2239508 - protein, 17 aa, Cryptosporidium parvum
WMIVFTLGCVIKVIIDK

SEQ ID NO: 2239509 - protein, 18 aa, Cryptosporidium parvum
WNAYCFNEKKSISAIQKI

SEQ ID NO: 2239510 - protein, 17 aa, Cryptosporidium parvum
WNDAFILQLFKSKNPNG

SEQ ID NO: 2239511 - protein, 18 aa, Cryptosporidium parvum
WNDLGVVLQSKWPQVPLE

SEQ ID NO: 2239512 - protein, 26 aa, Cryptosporidium parvum
WNETLKFPVGIPCLDDRIVLELWDAY

SEQ ID NO: 2239513 - protein, 25 aa, Cryptosporidium parvum
WNFKRIPEIYYFFESTFLWMLSYDY

SEQ ID NO: 2239514 - protein, 26 aa, Cryptosporidium parvum
WNFYCNYFKCCLEKWSLTNIHASSEY

SEQ ID NO: 2239515 - protein, 18 aa, Cryptosporidium parvum
WNKDYKKLTPQPVPDPLS

SEQ ID NO: 2239516 - protein, 20 aa, Cryptosporidium parvum
WNKFVLKKFMVYTVNSLRNL

SEQ ID NO: 2239517 - protein, 20 aa, Cryptosporidium parvum
WNLKNNTLFFIGRYTDTSRL

SEQ ID NO: 2239518 - protein, 21 aa, Cryptosporidium parvum
WNLNKGVLFPTLIQFLMNQKQ

SEQ ID NO: 2239519 - protein, 20 aa, Cryptosporidium parvum
WNNYFFKYKLWLFVNQFLIE

SEQ ID NO: 2239520 - protein, 20 aa, Cryptosporidium parvum
WNNYWLVLKFLKSINQNLIS

SEQ ID NO: 2239521 - protein, 24 aa, Cryptosporidium parvum
WNPLKKWTTLYSFGIKNLSEMISM

SEQ ID NO: 2239522 - protein, 20 aa, Cryptosporidium parvum
WNPSNSFLVWNYNSSKDSYQ

SEQ ID NO: 2239523 - protein, 20 aa, Cryptosporidium parvum
WNQKFFSRRSHAILNPPFFL

SEQ ID NO: 2239524 - protein, 27 aa, Cryptosporidium parvum
WNRRRYSYRMGWYYSMLSIVSGIIILV

SEQ ID NO: 2239525 - protein, 21 aa, Cryptosporidium parvum
WNSSSPRTYRWLSYTASTSLS

SEQ ID NO: 2239526 - protein, 26 aa, Cryptosporidium parvum
WNWFDSRSWYPLGRIIGQTLFPGLML

SEQ ID NO: 2239527 - protein, 19 aa, Cryptosporidium parvum
WPCIHIVGNILRDGFSSNK

SEQ ID NO: 2239528 - protein, 18 aa, Cryptosporidium parvum
WPFPEVFVETAGFPFALI

SEQ ID NO: 2239529 - protein, 22 aa, Cryptosporidium parvum
WPIKLNLLLIDPEWVNSRKPDY

SEQ ID NO: 2239530 - protein, 24 aa, Cryptosporidium parvum
WPILWCICQLLALVFVSYLLEKYL

SEQ ID NO: 2239531 - protein, 21 aa, Cryptosporidium parvum
WPIVLAELIKIFRLKNHKRLK

SEQ ID NO: 2239532 - protein, 18 aa, Cryptosporidium parvum
WPLFFKITIFALFFLFIV

SEQ ID NO: 2239533 - protein, 21 aa, Cryptosporidium parvum
WPSFHNFDGFIGLVGKLIFFY

SEQ ID NO: 2239534 - protein, 19 aa, Cryptosporidium parvum
WPVVIDLWFKYFQFEMDML

SEQ ID NO: 2239535 - protein, 23 aa, Cryptosporidium parvum
WPYLPKKFLFSIIDQVLIFMKNG

SEQ ID NO: 2239536 - protein, 17 aa, Cryptosporidium parvum
WQHPWSFFHSNECFMLY

SEQ ID NO: 2239537 - protein, 17 aa, Cryptosporidium parvum
WQMRMYGYKKGMKEIES

SEQ ID NO: 2239538 - protein, 17 aa, Cryptosporidium parvum
WQQLDFLYYTLTILFNI

SEQ ID NO: 2239539 - protein, 18 aa, Cryptosporidium parvum
WRGLKKSGGLLVRKSIDK

SEQ ID NO: 2239540 - protein, 17 aa, Cryptosporidium parvum
WRLFCIKEKSIYATLNL

SEQ ID NO: 2239541 - protein, 26 aa, Cryptosporidium parvum
WRMNKLLPRREYKLFLFDLARCGRVS

SEQ ID NO: 2239542 - protein, 21 aa, Cryptosporidium parvum
WRSEYVNSYFLLNILQYLIVL

SEQ ID NO: 2239543 - protein, 26 aa, Cryptosporidium parvum
WRTKHECYQDMAINCIQSSWKMVESN

SEQ ID NO: 2239544 - protein, 31 aa, Cryptosporidium parvum; identical to SEQ ID NO: 2128596

SEQ ID NO: 2239545 - protein, 17 aa, Cryptosporidium parvum
WRTVNWGEPPVDIYTTG

SEQ ID NO: 2239546 - protein, 33 aa, Cryptosporidium parvum; identical to SEQ ID NO: 2128598

SEQ ID NO: 2239547 - protein, 22 aa, Cryptosporidium parvum
WSIIGLLGIILIFKVYKDNKKE

SEQ ID NO: 2239548 - protein, 20 aa, Cryptosporidium parvum
WSKCRNILIYVWQRSEVEAV

SEQ ID NO: 2239549 - protein, 19 aa, Cryptosporidium parvum
WSKQWEMHEIWDGDYVTDG

SEQ ID NO: 2239550 - protein, 19 aa, Cryptosporidium parvum
WSLCLQFLILGIKVKLTSL

SEQ ID NO: 2239551 - protein, 20 aa, Cryptosporidium parvum
WSNGIFNYWRIEKFDKFILI

SEQ ID NO: 2239552 - protein, 26 aa, Cryptosporidium parvum
WSNRLRMLMLTGKLNIIFISSIIFTF

SEQ ID NO: 2239553 - protein, 24 aa, Cryptosporidium parvum
WSRLNCGALKIASCPYSKRRINNR

SEQ ID NO: 2239554 - protein, 21 aa, Cryptosporidium parvum
WSSEEKQLWQVFNSLGHAWDC

SEQ ID NO: 2239555 - protein, 24 aa, Cryptosporidium parvum
WSSLLLRLSLWIRSFHTARDELYY

SEQ ID NO: 2239556 - protein, 18 aa, Cryptosporidium parvum
WSSSIKIRVFSLISDLYI

SEQ ID NO: 2239557 - protein, 24 aa, Cryptosporidium parvum
WSSSPDRFLLKNGIILDTSIFLPL

SEQ ID NO: 2239558 - protein, 27 aa, Cryptosporidium parvum
WSSYIRGSPYLKIRCFDEDFSKIKEKS

SEQ ID NO: 2239559 - protein, 18 aa, Cryptosporidium parvum
WSTQILVWISSLLRISDF

SEQ ID NO: 2239560 - protein, 17 aa, Cryptosporidium parvum
WSYSFLQVGHFLIGFKM

SEQ ID NO: 2239561 - protein, 17 aa, Cryptosporidium parvum
WTGCSKFLCEGTKSRYR

SEQ ID NO: 2239562 - protein, 36 aa, Cryptosporidium parvum
WTGLSVDFFGFITALRMVFAYVHLFDGVILGIYLCM

SEQ ID NO: 2239563 - protein, 17 aa, Cryptosporidium parvum
WTIPHVILDSLLSCDNP

SEQ ID NO: 2239564 - protein, 24 aa, Cryptosporidium parvum
WTKKRWMPWITMVFTSFFTVSGGS

SEQ ID NO: 2239565 - protein, 31 aa, Cryptosporidium parvum
WTLTPRKELFLAYIWKNYRINNPKLINCDFI

SEQ ID NO: 2239566 - protein, 19 aa, Cryptosporidium parvum
WTMMNCNYKNIKVFNSIQE

SEQ ID NO: 2239567 - protein, 25 aa, Cryptosporidium parvum
WTRSKRFPIAISFLSILISFFTKQK

SEQ ID NO: 2239568 - protein, 26 aa, Cryptosporidium parvum
WTYILPDILLSFLLNIKIMPALEGDT

SEQ ID NO: 2239569 - protein, 18 aa, Cryptosporidium parvum
WVKSSLYRLVTNLLKQCL

SEQ ID NO: 2239570 - protein, 17 aa, Cryptosporidium parvum
WVLLGGLGSKCNELLLN

SEQ ID NO: 2239571 - protein, 18 aa, Cryptosporidium parvum
WWDSFRASIFGNISQKDI

SEQ ID NO: 2239572 - protein, 17 aa, Cryptosporidium parvum
WWELYSFIYEAIISLIL

SEQ ID NO: 2239573 - protein, 22 aa, Cryptosporidium parvum
WYHLDDYIIFILIKSNHNDNKS

SEQ ID NO: 2239574 - protein, 18 aa, Cryptosporidium parvum
WYLPGYWWYEKVTFTSEV

SEQ ID NO: 2239575 - protein, 18 aa, Cryptosporidium parvum
WYMEIIIYLIKFIANNTQ

SEQ ID NO: 2239576 - protein, 25 aa, Cryptosporidium parvum
WYSKNEFFEVFSWIIDSEINSKQLA

SEQ ID NO: 2239577 - protein, 19 aa, Cryptosporidium parvum
WYTPVPCIVNFPFNAKISR

SEQ ID NO: 2239578 - protein, 18 aa, Cryptosporidium parvum
WYYFLVAFYNLIGRLTWA

SEQ ID NO: 2239579 - protein, 17 aa, Cryptosporidium parvum
YAIIPAFLDQKSISIKM

SEQ ID NO: 2239580 - protein, 18 aa, Cryptosporidium parvum
YAIMKRMHRRFTVASKPY

SEQ ID NO: 2239581 - protein, 17 aa, Cryptosporidium parvum
YAIRRFTIESLQVSIKS

SEQ ID NO: 2239582 - protein, 21 aa, Cryptosporidium parvum
YALDRLGLWKKFADGNHSDCM

SEQ ID NO: 2239583 - protein, 17 aa, Cryptosporidium parvum
YALREFNELGGVNKLIQ

SEQ ID NO: 2239584 - protein, 18 aa, Cryptosporidium parvum
YANFLIDLIKMSPCSVIR

SEQ ID NO: 2239585 - protein, 18 aa, Cryptosporidium parvum
YAVRCILKPQSWTFSVYK

SEQ ID NO: 2239586 - protein, 17 aa, Cryptosporidium parvum
YAVRIAQGFLYMGKGLV

SEQ ID NO: 2239587 - protein, 21 aa, Cryptosporidium parvum
YAYLLKIKYDFVLNQQYTFKF

SEQ ID NO: 2239588 - protein, 20 aa, Cryptosporidium parvum
YCAEKLCTIFGECGEPARVQ

SEQ ID NO: 2239589 - protein, 25 aa, Cryptosporidium parvum
YCEIANWLCSSFVYFLDLNYIWVLR

SEQ ID NO: 2239590 - protein, 17 aa, Cryptosporidium parvum
YCGPGGAGFAYFATQFS

SEQ ID NO: 2239591 - protein, 18 aa, Cryptosporidium parvum
YCICVCLVKDLVFEVNHI

SEQ ID NO: 2239592 - protein, 24 aa, Cryptosporidium parvum
YCIRSAAFLPDILKKEGFVPSSNT

SEQ ID NO: 2239593 - protein, 17 aa, Cryptosporidium parvum
YCLSIFSRIILDFFYQH

SEQ ID NO: 2239594 - protein, 17 aa, Cryptosporidium parvum
YCNTFSNIILPFKYFKN

SEQ ID NO: 2239595 - protein, 19 aa, Cryptosporidium parvum
YCQSMNFIAAILLINMKEE

SEQ ID NO: 2239596 - protein, 24 aa, Cryptosporidium parvum
YCSDSEWSNRLILILIINLVQYGA

SEQ ID NO: 2239597 - protein, 19 aa, Cryptosporidium parvum
YCSQSSWIINGTVRSNIIL

SEQ ID NO: 2239598 - protein, 25 aa, Cryptosporidium parvum
YCTTLKMLFLKYLVDNIIKLLFDCL

SEQ ID NO: 2239599 - protein, 25 aa, Cryptosporidium parvum
YCTVSIKLPVYMAVEKFTHRKGQKT

SEQ ID NO: 2239600 - protein, 20 aa, Cryptosporidium parvum
YDCIKECPTQLISIELFGSV

SEQ ID NO: 2239601 - protein, 19 aa, Cryptosporidium parvum
YDFDWKKNYIEYAEKLTYQ

SEQ ID NO: 2239602 - protein, 21 aa, Cryptosporidium parvum
YDIEIFKILIAIGNLLSNVFR

SEQ ID NO: 2239603 - protein, 22 aa, Cryptosporidium parvum
YDIESGRLIGQVSKRPIPGSIA

SEQ ID NO: 2239604 - protein, 25 aa, Cryptosporidium parvum
YDISWSKKTAACILIIELLNHIPPI

SEQ ID NO: 2239605 - protein, 17 aa, Cryptosporidium parvum
YDKIPLIRLDRLPLKNK

SEQ ID NO: 2239606 - protein, 23 aa, Cryptosporidium parvum
YDLCLPICEIHKICLNDHTSNNF

SEQ ID NO: 2239607 - protein, 22 aa, Cryptosporidium parvum
YDLSNGDGYICLARTLNNSLLG

SEQ ID NO: 2239608 - protein, 17 aa, Cryptosporidium parvum
YDRMIKYSIQSYRQNGI

SEQ ID NO: 2239609 - protein, 18 aa, Cryptosporidium parvum
YDTFNISKGLLFIFENTI

SEQ ID NO: 2239610 - protein, 22 aa, Cryptosporidium parvum
YDYELPELLSYVNRYLNVNKHN

SEQ ID NO: 2239611 - protein, 23 aa, Cryptosporidium parvum
YEDLKWHSSLLLCCDIQSTVDIL

SEQ ID NO: 2239612 - protein, 28 aa, Cryptosporidium parvum
YEEDLHMAIAMVCIFHLLPQGSDEFVSK

SEQ ID NO: 2239613 - protein, 23 aa, Cryptosporidium parvum
YEEHGFSVLKNVAFVLVAGGLGE

SEQ ID NO: 2239614 - protein, 20 aa, Cryptosporidium parvum
YEELYSFGFLLIGSCMTLLY

SEQ ID NO: 2239615 - protein, 18 aa, Cryptosporidium parvum
YEFCKLIIHIMEKMEMIF

SEQ ID NO: 2239616 - protein, 23 aa, Cryptosporidium parvum
YEFWKLLRDLSMNIALKCSPKEG

SEQ ID NO: 2239617 - protein, 25 aa, Cryptosporidium parvum
YEGWQCLICKRISHMHCIMQSDSEY

SEQ ID NO: 2239618 - protein, 18 aa, Cryptosporidium parvum
YEHEDGFDILRTNNKKRI

SEQ ID NO: 2239619 - protein, 21 aa, Cryptosporidium parvum
YEIFYFRVFVLLTRFQNVKTI

SEQ ID NO: 2239620 - protein, 30 aa, Cryptosporidium parvum
YEILNYFEAFSFICLALFIADIPNSSDLRV

SEQ ID NO: 2239621 - protein, 22 aa, Cryptosporidium parvum
YEIPGCPVFSVFIATVVGILWL

SEQ ID NO: 2239622 - protein, 18 aa, Cryptosporidium parvum
YEIYLLFFEDYRITKIMT

SEQ ID NO: 2239623 - protein, 33 aa, Cryptosporidium parvum
YEKEIKPLLIRWIIFVIRLHKFSGLSDELCELY

SEQ ID NO: 2239624 - protein, 17 aa, Cryptosporidium parvum
YEKKRLSSIISPNIHFN

SEQ ID NO: 2239625 - protein, 24 aa, Cryptosporidium parvum
YEKSIKLVSRMVGSLVTKKIPYSN

SEQ ID NO: 2239626 - protein, 27 aa, Cryptosporidium parvum
YELGKEEKAIWCFKLSIHFNPMNVNAY

SEQ ID NO: 2239627 - protein, 25 aa, Cryptosporidium parvum
YELIKRKLIPGQKFGFGAKRNFNKN

SEQ ID NO: 2239628 - protein, 20 aa, Cryptosporidium parvum
YELLHYPKIVYLEILLPSLL

SEQ ID NO: 2239629 - protein, 18 aa, Cryptosporidium parvum
YELRCYLYACRNLNETGK

SEQ ID NO: 2239630 - protein, 27 aa, Cryptosporidium parvum
YENIKTRFNWDLSLFQTEFGYVKNINL

SEQ ID NO: 2239631 - protein, 18 aa, Cryptosporidium parvum
YEQARYNFISSLAGYSIA

SEQ ID NO: 2239632 - protein, 20 aa, Cryptosporidium parvum
YERRIISMIYLIKLFIFRVN

SEQ ID NO: 2239633 - protein, 24 aa, Cryptosporidium parvum
YESFACRWVFERILEYRCWFPNCR

SEQ ID NO: 2239634 - protein, 17 aa, Cryptosporidium parvum
YESKMFINKVFKFNPQI

SEQ ID NO: 2239635 - protein, 24 aa, Cryptosporidium parvum
YESNELRTSLILNSKTRSIEKPAP

SEQ ID NO: 2239636 - protein, 17 aa, Cryptosporidium parvum
YEYDCIRKMASRESIVS

SEQ ID NO: 2239637 - protein, 28 aa, Cryptosporidium parvum
YEYSIKFANSFPIIFEKLIPEYCIAIDN

SEQ ID NO: 2239638 - protein, 17 aa, Cryptosporidium parvum
YFATYVFRPEGENRVQA

SEQ ID NO: 2239639 - protein, 25 aa, Cryptosporidium parvum
YFDILLVNIAMDFIFKLNEFNRKDD

SEQ ID NO: 2239640 - protein, 34 aa, Cryptosporidium parvum
YFDSNFWLFLKRVCTRILECLAIQNLNLEERKNI

SEQ ID NO: 2239641 - protein, 23 aa, Cryptosporidium parvum
YFEIFKKFISYILLFLNVSRTAS

SEQ ID NO: 2239642 - protein, 20 aa, Cryptosporidium parvum
YFERYLKFSHLIISNETINN

SEQ ID NO: 2239643 - protein, 20 aa, Cryptosporidium parvum
YFESIIYLFKCSNYKDYFQN

SEQ ID NO: 2239644 - protein, 17 aa, Cryptosporidium parvum
YFFLRRPVDFEDIPLSL

SEQ ID NO: 2239645 - protein, 23 aa, Cryptosporidium parvum
YFFQAVFIFVIFFGLALSENIDE

SEQ ID NO: 2239646 - protein, 21 aa, Cryptosporidium parvum
YFFTQWGWWFCIERATSEIDI

SEQ ID NO: 2239647 - protein, 17 aa, Cryptosporidium parvum
YFHHLYLFIYFFFTLNI

SEQ ID NO: 2239648 - protein, 18 aa, Cryptosporidium parvum
YFILRIITSFTRLFSKNN

SEQ ID NO: 2239649 - protein, 18 aa, Cryptosporidium parvum
YFIPGFLILYFIQPFSYY

SEQ ID NO: 2239650 - protein, 19 aa, Cryptosporidium parvum
YFIYKLRKIPKFNYEELRT

SEQ ID NO: 2239651 - protein, 19 aa, Cryptosporidium parvum
YFKEYRFYPRMADYITYKI

SEQ ID NO: 2239652 - protein, 24 aa, Cryptosporidium parvum
YFKNIEFYKAYLLLDSFYAIEKQL

SEQ ID NO: 2239653 - protein, 23 aa, Cryptosporidium parvum
YFKSAYFFFLVFFALHFFIVKGQ

SEQ ID NO: 2239654 - protein, 23 aa, Cryptosporidium parvum
YFKTPFKFRYVFITILIKYLPMF

SEQ ID NO: 2239655 - protein, 25 aa, Cryptosporidium parvum
YFLCSPSLFVLMFIYIKRIIDNNPS

SEQ ID NO: 2239656 - protein, 20 aa, Cryptosporidium parvum
YFLEVVKLLIQFLGISSNGV

SEQ ID NO: 2239657 - protein, 18 aa, Cryptosporidium parvum
YFLLCSCNDKNNLILETF

SEQ ID NO: 2239658 - protein, 23 aa, Cryptosporidium parvum
YFNCICILSIILVTGIILLMFPI

SEQ ID NO: 2239659 - protein, 17 aa, Cryptosporidium parvum
YFNLWLIYFFLKNYILG

SEQ ID NO: 2239660 - protein, 26 aa, Cryptosporidium parvum
YFNSLKCIRIFLLRLKADLMWNYTPN

SEQ ID NO: 2239661 - protein, 24 aa, Cryptosporidium parvum
YFNYLRISSILVEVTYRGSVSLNN

SEQ ID NO: 2239662 - protein, 20 aa, Cryptosporidium parvum
YFPWTARFHPFISTINNKDE

SEQ ID NO: 2239663 - protein, 17 aa, Cryptosporidium parvum
YFQGFRVDLAVKYQKVR

SEQ ID NO: 2239664 - protein, 19 aa, Cryptosporidium parvum
YFSEIGIYISLFFDAIFNS

SEQ ID NO: 2239665 - protein, 18 aa, Cryptosporidium parvum
YFSILSMSLIYWWISSNS

SEQ ID NO: 2239666 - protein, 21 aa, Cryptosporidium parvum
YFSNTFLYLYISFIQNLLTSN

SEQ ID NO: 2239667 - protein, 24 aa, Cryptosporidium parvum
YFTGNLWLEMLIALFSLDIICNKR

SEQ ID NO: 2239668 - protein, 25 aa, Cryptosporidium parvum
YFTKTCSSLDYVCLSPLKNLFSEYS

SEQ ID NO: 2239669 - protein, 18 aa, Cryptosporidium parvum
YFTNRLGFSPTFMGSLRL

SEQ ID NO: 2239670 - protein, 25 aa, Cryptosporidium parvum
YFVQLKFGPKCLIPKIFRPRPYNYF

SEQ ID NO: 2239671 - protein, 17 aa, Cryptosporidium parvum
YFWSELKNLSISIQKIS

SEQ ID NO: 2239672 - protein, 17 aa, Cryptosporidium parvum
YFYCYSRETEKTGNKNI

SEQ ID NO: 2239673 - protein, 22 aa, Cryptosporidium parvum
YGAILWGCWISYKVFMSRYLAG

SEQ ID NO: 2239674 - protein, 17 aa, Cryptosporidium parvum
YGCIETINISIPYSNIL

SEQ ID NO: 2239675 - protein, 20 aa, Cryptosporidium parvum
YGDKYFCLYKLRVYGEQVNN

SEQ ID NO: 2239676 - protein, 19 aa, Cryptosporidium parvum
YGDQVPFILWVIMIGIVSQ

SEQ ID NO: 2239677 - protein, 18 aa, Cryptosporidium parvum
YGGFIVVGVLKYSDSIMK

SEQ ID NO: 2239678 - protein, 18 aa, Cryptosporidium parvum
YGGLRGGVSMALAMVFEG

SEQ ID NO: 2239679 - protein, 17 aa, Cryptosporidium parvum
YGIGIPKQKIINFSKTQ

SEQ ID NO: 2239680 - protein, 19 aa, Cryptosporidium parvum
YGIKACFIPMRYSISDYKL

SEQ ID NO: 2239681 - protein, 22 aa, Cryptosporidium parvum
YGIPKLFPIYIFTSKYTDHKHS

SEQ ID NO: 2239682 - protein, 20 aa, Cryptosporidium parvum
YGLIRPGDMVSILAALSKEG

SEQ ID NO: 2239683 - protein, 17 aa, Cryptosporidium parvum
YGLQSLVIWISRFKYEI

SEQ ID NO: 2239684 - protein, 21 aa, Cryptosporidium parvum
YGNLPIGHLIYKINYQEELML

SEQ ID NO: 2239685 - protein, 19 aa, Cryptosporidium parvum
YGNSYPIVVRIRILNDAFD

SEQ ID NO: 2239686 - protein, 17 aa, Cryptosporidium parvum
YGSIVLTNVHLISGEQY

SEQ ID NO: 2239687 - protein, 17 aa, Cryptosporidium parvum
YGVCNKFIEKLLDELKN

SEQ ID NO: 2239688 - protein, 20 aa, Cryptosporidium parvum
YGYYFIKVNVGFPITQQQTL

SEQ ID NO: 2239689 - protein, 18 aa, Cryptosporidium parvum
YHDGVCLTLLLLLQNLTN

SEQ ID NO: 2239690 - protein, 24 aa, Cryptosporidium parvum
YHEEKFSSFWGYKPSPYKKDLRKS

SEQ ID NO: 2239691 - protein, 24 aa, Cryptosporidium parvum
YHGLRSPIGLTFLNGFAVSLACTP

SEQ ID NO: 2239692 - protein, 18 aa, Cryptosporidium parvum
YHIKEFRRAIFSWNPRIP

SEQ ID NO: 2239693 - protein, 17 aa, Cryptosporidium parvum
YHIKLLVIFLVIIIKIG

SEQ ID NO: 2239694 - protein, 33 aa, Cryptosporidium parvum
YHLDIAYIWLYLRLEVIGCMTLVVTGIFSVLLS

SEQ ID NO: 2239695 - protein, 21 aa, Cryptosporidium parvum
YHPAIAFSHNLNFLFILETEK

SEQ ID NO: 2239696 - protein, 23 aa, Cryptosporidium parvum
YHPELWQPAWGIRTMLDALHAFF

SEQ ID NO: 2239697 - protein, 25 aa, Cryptosporidium parvum
YICCIYSLLHYIRIIINIYIILNYS

SEQ ID NO: 2239698 - protein, 19 aa, Cryptosporidium parvum
YICDCFKSAGYMTSPINNK

SEQ ID NO: 2239699 - protein, 27 aa, Cryptosporidium parvum
YICDESFCIKSLFGIRTTESMITIENS

SEQ ID NO: 2239700 - protein, 24 aa, Cryptosporidium parvum
YIDPELKGQIAFYVAGTVLLTLLI

SEQ ID NO: 2239701 - protein, 22 aa, Cryptosporidium parvum
YIFFPQSFLNLSLKNNISKGSS

SEQ ID NO: 2239702 - protein, 18 aa, Cryptosporidium parvum
YIFGRIVNRYSEFVSKAD

SEQ ID NO: 2239703 - protein, 19 aa, Cryptosporidium parvum
YIFSYEKLTLFKLLIFVSL

SEQ ID NO: 2239704 - protein, 18 aa, Cryptosporidium parvum
YIFWLKKHEEVFIEIPSE

SEQ ID NO: 2239705 - protein, 18 aa, Cryptosporidium parvum
YIIFESTDYNYAIPIHNE

SEQ ID NO: 2239706 - protein, 22 aa, Cryptosporidium parvum
YIIFRRLGIIYILIQKPIILIF

SEQ ID NO: 2239707 - protein, 24 aa, Cryptosporidium parvum
YIILLGKMICCYFTTMLSNVDFWM

SEQ ID NO: 2239708 - protein, 21 aa, Cryptosporidium parvum
YIISPKYSHRFVGYLEEEAVS

SEQ ID NO: 2239709 - protein, 20 aa, Cryptosporidium parvum
YILDKCIRYGNYGIYLFRYY

SEQ ID NO: 2239710 - protein, 18 aa, Cryptosporidium parvum
YILDWNLNKGVLFPTLIQ

SEQ ID NO: 2239711 - protein, 25 aa, Cryptosporidium parvum
YILRVKEIWDSIKFNMISQYYLLGI

SEQ ID NO: 2239712 - protein, 18 aa, Cryptosporidium parvum
YILSALALVVPIDYSENI

SEQ ID NO: 2239713 - protein, 18 aa, Cryptosporidium parvum
YIMLPSYYLWGNIYSILG

SEQ ID NO: 2239714 - protein, 18 aa, Cryptosporidium parvum
YIMRVRARVIGAINGVSL

SEQ ID NO: 2239715 - protein, 17 aa, Cryptosporidium parvum
YINHNWPINMAYVNKSG

SEQ ID NO: 2239716 - protein, 18 aa, Cryptosporidium parvum
YIQEFSAVISRSIELTTS

SEQ ID NO: 2239717 - protein, 22 aa, Cryptosporidium parvum
YIQEILGLFLFDSKQVRIEVMR

SEQ ID NO: 2239718 - protein, 17 aa, Cryptosporidium parvum
YIRRVGVTRTAHVTLTE

SEQ ID NO: 2239719 - protein, 17 aa, Cryptosporidium parvum
YIRSLFKPTEFALVNSF

SEQ ID NO: 2239720 - protein, 19 aa, Cryptosporidium parvum
YIRSMVKYRDISIGSFESL

SEQ ID NO: 2239721 - protein, 29 aa, Cryptosporidium parvum
YISIGRPFFAFNLLCMRHAKFHNSLEYKQ

SEQ ID NO: 2239722 - protein, 24 aa, Cryptosporidium parvum
YISYRDIIELSEFFAKQGQVEGLF

SEQ ID NO: 2239723 - protein, 21 aa, Cryptosporidium parvum
YITFEIGRGYKRCLLLQTGEL

SEQ ID NO: 2239724 - protein, 18 aa, Cryptosporidium parvum
YITMEYLNPISLFKQHLS

SEQ ID NO: 2239725 - protein, 25 aa, Cryptosporidium parvum
YITYSCAYLLCIISICFFLYPSWSL

SEQ ID NO: 2239726 - protein, 18 aa, Cryptosporidium parvum
YIWDSLFEFFSRINNEII

SEQ ID NO: 2239727 - protein, 18 aa, Cryptosporidium parvum
YIWIPLYTLEHLICDFKE

SEQ ID NO: 2239728 - protein, 17 aa, Cryptosporidium parvum
YIYDLTRTPSWCDRVLV

SEQ ID NO: 2239729 - protein, 25 aa, Cryptosporidium parvum
YIYIPHHITILIAFIDFISTIRHPY

SEQ ID NO: 2239730 - protein, 32 aa, Cryptosporidium parvum; identical to SEQ ID NO: 2128712

SEQ ID NO: 2239731 - protein, 18 aa, Cryptosporidium parvum
YKCFKKCIPISESTVSSE

SEQ ID NO: 2239732 - protein, 20 aa, Cryptosporidium parvum
YKDLEVVASHCIDKLKFFIG

SEQ ID NO: 2239733 - protein, 23 aa, Cryptosporidium parvum
YKENSIEFSRLFNINSVINPIFA

SEQ ID NO: 2239734 - protein, 23 aa, Cryptosporidium parvum
YKEPIVIFEIFNFINSNIMKYVK

SEQ ID NO: 2239735 - protein, 20 aa, Cryptosporidium parvum
YKESYSLICELLLSLCNDKE

SEQ ID NO: 2239736 - protein, 23 aa, Cryptosporidium parvum
YKETFLQVCVTFFVGLVSSGLLE

SEQ ID NO: 2239737 - protein, 20 aa, Cryptosporidium parvum
YKEYIWKLLNWESQLHSLFA

SEQ ID NO: 2239738 - protein, 24 aa, Cryptosporidium parvum
YKFFFLRKFFFFFQIKKKMNEIVN

SEQ ID NO: 2239739 - protein, 21 aa, Cryptosporidium parvum
YKFQNLHAWNTLLSKIGPIEI

SEQ ID NO: 2239740 - protein, 24 aa, Cryptosporidium parvum
YKGNGETFISYFLFQYKNNIVDKN

SEQ ID NO: 2239741 - protein, 24 aa, Cryptosporidium parvum
YKHLSCNFCGKVIFVPTEMTNQAR

SEQ ID NO: 2239742 - protein, 20 aa, Cryptosporidium parvum
YKIVCQRYISTYIRAQKVAL

SEQ ID NO: 2239743 - protein, 18 aa, Cryptosporidium parvum
YKIVLRFLSYLDHLLNFM

SEQ ID NO: 2239744 - protein, 21 aa, Cryptosporidium parvum
YKKEMWESFKSWHSDYSVLAG

SEQ ID NO: 2239745 - protein, 18 aa, Cryptosporidium parvum
YKKLFKKLFVNDFNQNIP

SEQ ID NO: 2239746 - protein, 24 aa, Cryptosporidium parvum
YKKLLMNWIRLSSMKQLPLSLMLW

SEQ ID NO: 2239747 - protein, 17 aa, Cryptosporidium parvum
YKKLMKFFRPIEMNYFG

SEQ ID NO: 2239748 - protein, 22 aa, Cryptosporidium parvum
YKKNADIWLNMVSELIKAKEQN

SEQ ID NO: 2239749 - protein, 19 aa, Cryptosporidium parvum
YKKNIDLFREYIEKDIFEL

SEQ ID NO: 2239750 - protein, 23 aa, Cryptosporidium parvum
YKKTELLECYTIFIDEYNISLEL

SEQ ID NO: 2239751 - protein, 18 aa, Cryptosporidium parvum
YKLGEFSMLIFIPLALPI

SEQ ID NO: 2239752 - protein, 21 aa, Cryptosporidium parvum
YKLHSSYPLYTFPIIDRGVRF

SEQ ID NO: 2239753 - protein, 17 aa, Cryptosporidium parvum
YKLIPGISNFNCSNDAY

SEQ ID NO: 2239754 - protein, 25 aa, Cryptosporidium parvum
YKLSLQELLRLLIVMIESWDELVII

SEQ ID NO: 2239755 - protein, 19 aa, Cryptosporidium parvum
YKLVFSSVVSLGFCTLIYI

SEQ ID NO: 2239756 - protein, 26 aa, Cryptosporidium parvum
YKMITVYEIIDFINCYFILNDNNNSG

SEQ ID NO: 2239757 - protein, 24 aa, Cryptosporidium parvum
YKNAPKGLGVMFSFLDRNNKKNPS

SEQ ID NO: 2239758 - protein, 23 aa, Cryptosporidium parvum
YKNELDFFYSRQFLSGQFFVDNI

SEQ ID NO: 2239759 - protein, 18 aa, Cryptosporidium parvum
YKNEYSTVWFIRKDEKDT

SEQ ID NO: 2239760 - protein, 21 aa, Cryptosporidium parvum
YKNYLERSGIYFKTIFNPHLF

SEQ ID NO: 2239761 - protein, 17 aa, Cryptosporidium parvum
YKPEMPLVLNSISCNIH

SEQ ID NO: 2239762 - protein, 21 aa, Cryptosporidium parvum
YKPHLINWCGLNIREGTNKKN

SEQ ID NO: 2239763 - protein, 17 aa, Cryptosporidium parvum
YKSCENGKEYQWEISSE

SEQ ID NO: 2239764 - protein, 18 aa, Cryptosporidium parvum
YKSGSLITYSRNYSTNHL

SEQ ID NO: 2239765 - protein, 18 aa, Cryptosporidium parvum
YKSLKSCNRIWVLSGGVK

SEQ ID NO: 2239766 - protein, 26 aa, Cryptosporidium parvum
YKSTKIKSPICLKKQLRRILDLSVNG

SEQ ID NO: 2239767 - protein, 24 aa, Cryptosporidium parvum
YKSYELDAILPLNALLTITVFHKN

SEQ ID NO: 2239768 - protein, 17 aa, Cryptosporidium parvum
YKTLELNLDCSYKSGNI

SEQ ID NO: 2239769 - protein, 18 aa, Cryptosporidium parvum
YKTVHSFSNISQYSVSNV

SEQ ID NO: 2239770 - protein, 19 aa, Cryptosporidium parvum
YKYILKFKPFLTLISTLPL

SEQ ID NO: 2239771 - protein, 21 aa, Cryptosporidium parvum
YKYKSEVFALSSYFENLEERF

SEQ ID NO: 2239772 - protein, 17 aa, Cryptosporidium parvum
YKYSFNILVFLLIQIIQ

SEQ ID NO: 2239773 - protein, 24 aa, Cryptosporidium parvum
YLASCIFIYLEVMRKYRYRELTKL

SEQ ID NO: 2239774 - protein, 22 aa, Cryptosporidium parvum
YLDLRLTPRVHFYKSFKNSKFR

SEQ ID NO: 2239775 - protein, 36 aa, Cryptosporidium parvum
YLDMAHNNWLIFYPIRCLSSTFKIMLHIFDIQSDSF

SEQ ID NO: 2239776 - protein, 22 aa, Cryptosporidium parvum
YLEDCRRIKSVTSISAKKLSNN

SEQ ID NO: 2239777 - protein, 25 aa, Cryptosporidium parvum
YLEFSAHEFLNFIIINYGLFNTENF

SEQ ID NO: 2239778 - protein, 20 aa, Cryptosporidium parvum
YLEKYCYFTTPSVLDQQDNG

SEQ ID NO: 2239779 - protein, 20 aa, Cryptosporidium parvum
YLELLGIQFQLLYGLPVCPL

SEQ ID NO: 2239780 - protein, 26 aa, Cryptosporidium parvum
YLEQRCGFSMDRVCSSGVKTDLIILE

SEQ ID NO: 2239781 - protein, 17 aa, Cryptosporidium parvum
YLETCINCLKYVLFDTF

SEQ ID NO: 2239782 - protein, 18 aa, Cryptosporidium parvum
YLEYFKYIFNRRHNINSS

SEQ ID NO: 2239783 - protein, 18 aa, Cryptosporidium parvum
YLFEVLYINLGIPILHNV

SEQ ID NO: 2239784 - protein, 18 aa, Cryptosporidium parvum
YLFIPEEPKFVGSNNDQQ

SEQ ID NO: 2239785 - protein, 21 aa, Cryptosporidium parvum
YLFVFCFVCILAKRVNVSSSR

SEQ ID NO: 2239786 - protein, 22 aa, Cryptosporidium parvum
YLGEISRLLIINFLKNKTPEIF

SEQ ID NO: 2239787 - protein, 17 aa, Cryptosporidium parvum
YLHHYRKAKGIVNNDPK

SEQ ID NO: 2239788 - protein, 18 aa, Cryptosporidium parvum
YLHLTRYYLVMIDFHEEG

SEQ ID NO: 2239789 - protein, 19 aa, Cryptosporidium parvum
YLHPFTLKFRSEILEKKFE

SEQ ID NO: 2239790 - protein, 27 aa, Cryptosporidium parvum
YLIENLYLRMIVDWMKKALKELNISSL

SEQ ID NO: 2239791 - protein, 31 aa, Cryptosporidium parvum
YLIFEFNEYFIFNGFLLYILLCSFNELEDIE

SEQ ID NO: 2239792 - protein, 18 aa, Cryptosporidium parvum
YLIFFIISRYFAKKNFII

SEQ ID NO: 2239793 - protein, 18 aa, Cryptosporidium parvum
YLIINFPGVSSIDEKVQE

SEQ ID NO: 2239794 - protein, 22 aa, Cryptosporidium parvum
YLIKHFRRHPSLIIDMNEISSQ

SEQ ID NO: 2239795 - protein, 42 aa, Cryptosporidium parvum
YLIKNEILHPFFIFQVCAVCIWFKNSYVEYAIFIILITIVSL

SEQ ID NO: 2239796 - protein, 17 aa, Cryptosporidium parvum
YLIKYLKGFIKIPELSG

SEQ ID NO: 2239797 - protein, 25 aa, Cryptosporidium parvum
YLILLCYAFNIFLSLVFCQELTSIL

SEQ ID NO: 2239798 - protein, 19 aa, Cryptosporidium parvum
YLIMSSMLAKIFLKSRSEF

SEQ ID NO: 2239799 - protein, 18 aa, Cryptosporidium parvum
YLINEVFTLIDLIISYLK

SEQ ID NO: 2239800 - protein, 24 aa, Cryptosporidium parvum
YLINHCVLRYLYYFEQENKCNNFN

SEQ ID NO: 2239801 - protein, 24 aa, Cryptosporidium parvum
YLINKYFRHCIVIIIAHHMESIEF

SEQ ID NO: 2239802 - protein, 18 aa, Cryptosporidium parvum
YLITFGLIKFNPVDYENF

SEQ ID NO: 2239803 - protein, 18 aa, Cryptosporidium parvum
YLKAFPIRIKDFEKYIQL

SEQ ID NO: 2239804 - protein, 20 aa, Cryptosporidium parvum
YLKDSINWNPNWDGNYKHEN

SEQ ID NO: 2239805 - protein, 17 aa, Cryptosporidium parvum
YLKEVLKSIRTVSMLNI

SEQ ID NO: 2239806 - protein, 22 aa, Cryptosporidium parvum
YLKKREEIYIIHPLLKSISLLV

SEQ ID NO: 2239807 - protein, 18 aa, Cryptosporidium parvum
YLKLKYLVLRIIFNSNKT

SEQ ID NO: 2239808 - protein, 18 aa, Cryptosporidium parvum
YLKNGKFDIHFIKNGEQS

SEQ ID NO: 2239809 - protein, 18 aa, Cryptosporidium parvum
YLKSIGIKFVSSSRDYTK

SEQ ID NO: 2239810 - protein, 19 aa, Cryptosporidium parvum
YLKSSIQRMFGIWRENGFY

SEQ ID NO: 2239811 - protein, 17 aa, Cryptosporidium parvum
YLLHFFNYYILLTPLPQ

SEQ ID NO: 2239812 - protein, 26 aa, Cryptosporidium parvum
YLLVPCNKPMWFVIGFQEDIFLEYIA

SEQ ID NO: 2239813 - protein, 17 aa, Cryptosporidium parvum
YLMYGNSLLSMLLGIHL

SEQ ID NO: 2239814 - protein, 17 aa, Cryptosporidium parvum
YLNDEFLTNLSIFQYKR

SEQ ID NO: 2239815 - protein, 17 aa, Cryptosporidium parvum
YLNENIHLFYNKRDEVE

SEQ ID NO: 2239816 - protein, 28 aa, Cryptosporidium parvum
YLNHSLKFLSEWSFDVSIRVVIEKTHLQ

SEQ ID NO: 2239817 - protein, 29 aa, Cryptosporidium parvum
YLNIKIPIEIWWKIFDFLDNNSLSQVSIL

SEQ ID NO: 2239818 - protein, 17 aa, Cryptosporidium parvum
YLNNRWQIICIYDNEAF

SEQ ID NO: 2239819 - protein, 17 aa, Cryptosporidium parvum
YLPEEMPDLYVYHHQVN

SEQ ID NO: 2239820 - protein, 26 aa, Cryptosporidium parvum
YLPQVVLRFKEYISIIPSLLGLQINS

SEQ ID NO: 2239821 - protein, 20 aa, Cryptosporidium parvum
YLPTVRSFISSFVISSLIRN

SEQ ID NO: 2239822 - protein, 20 aa, Cryptosporidium parvum
YLPTWIRLIHVFTFCQINTL

SEQ ID NO: 2239823 - protein, 17 aa, Cryptosporidium parvum
YLRICPNTYPVYLRNDI

SEQ ID NO: 2239824 - protein, 18 aa, Cryptosporidium parvum
YLRLWALSLAHNMLALVA

SEQ ID NO: 2239825 - protein, 25 aa, Cryptosporidium parvum
YLRNIIKARISSHYVNDGEDLIRGN

SEQ ID NO: 2239826 - protein, 20 aa, Cryptosporidium parvum
YLRYLEGIANLYLLNVERPN

SEQ ID NO: 2239827 - protein, 24 aa, Cryptosporidium parvum
YLSDEDFSALILKKVKDDSAKSDK

SEQ ID NO: 2239828 - protein, 22 aa, Cryptosporidium parvum
YLSFDTCWVLVLFLSIHNRIIF

SEQ ID NO: 2239829 - protein, 17 aa, Cryptosporidium parvum
YLSFFAKTIEIFKKIII

SEQ ID NO: 2239830 - protein, 18 aa, Cryptosporidium parvum
YLSIISFLLVIVAILVCF

SEQ ID NO: 2239831 - protein, 17 aa, Cryptosporidium parvum
YLSIPLLNYVFFNIKSL

SEQ ID NO: 2239832 - protein, 25 aa, Cryptosporidium parvum
YLSLSLKEVLINLCLTITEDSKADG

SEQ ID NO: 2239833 - protein, 21 aa, Cryptosporidium parvum
YLSRLPGIDIQLKLIDYSLDR

SEQ ID NO: 2239834 - protein, 18 aa, Cryptosporidium parvum
YLSRPVFILLTFICSLGC

SEQ ID NO: 2239835 - protein, 27 aa, Cryptosporidium parvum
YLSSCGKRPKWGMIITILQIVQMIIGT

SEQ ID NO: 2239836 - protein, 18 aa, Cryptosporidium parvum
YLSSILIRNPALFKNIVI

SEQ ID NO: 2239837 - protein, 21 aa, Cryptosporidium parvum
YLSTFSSLIFKSIAFNKSNMD

SEQ ID NO: 2239838 - protein, 17 aa, Cryptosporidium parvum
YLSWKRNDFKYLVPHAT

SEQ ID NO: 2239839 - protein, 23 aa, Cryptosporidium parvum
YLTKKLWKSIEIDSSEDYQYTFS

SEQ ID NO: 2239840 - protein, 19 aa, Cryptosporidium parvum
YLVVVPLDIGWTGWVVLAF

SEQ ID NO: 2239841 - protein, 23 aa, Cryptosporidium parvum
YLYILVIFKVNYVISIRNNKSSN

SEQ ID NO: 2239842 - protein, 17 aa, Cryptosporidium parvum
YLYKKCIIKNEMQDETI

SEQ ID NO: 2239843 - protein, 33 aa, Cryptosporidium parvum; identical to SEQ ID NO: 2128765

SEQ ID NO: 2239844 - protein, 22 aa, Cryptosporidium parvum
YLYSHGWELVKIRVMNFQYYLN

SEQ ID NO: 2239845 - protein, 18 aa, Cryptosporidium parvum
YMEKTGKKLTGNSFESLS

SEQ ID NO: 2239846 - protein, 17 aa, Cryptosporidium parvum
YMEPLILLHEQNTDYLT

SEQ ID NO: 2239847 - protein, 24 aa, Cryptosporidium parvum
YMFIWDIYMDWGLMKERSSFLRSK

SEQ ID NO: 2239848 - protein, 24 aa, Cryptosporidium parvum
YMHKRKRVCSIIDKLKKLDKLKPV

SEQ ID NO: 2239849 - protein, 24 aa, Cryptosporidium parvum
YMHYCSIILLNFVVTIFLEIYIGL

SEQ ID NO: 2239850 - protein, 23 aa, Cryptosporidium parvum
YMIGVLLYFCLTGEYYSFESKND

SEQ ID NO: 2239851 - protein, 17 aa, Cryptosporidium parvum
YMISPGYHFWVAELVKR

SEQ ID NO: 2239852 - protein, 19 aa, Cryptosporidium parvum
YMKPKALYLPCSLFDENPQ

SEQ ID NO: 2239853 - protein, 24 aa, Cryptosporidium parvum
YMKTRIYIRVPFHYLPLLNPKYVR

SEQ ID NO: 2239854 - protein, 25 aa, Cryptosporidium parvum
YMLSFKSIFMLAINIPIIYLSLFIS

SEQ ID NO: 2239855 - protein, 17 aa, Cryptosporidium parvum
YMMLKVISTRSFSNQFS

SEQ ID NO: 2239856 - protein, 20 aa, Cryptosporidium parvum
YNDWLVFFLFLNKFFRIKEK

SEQ ID NO: 2239857 - protein, 19 aa, Cryptosporidium parvum
YNEILRYLLQNEYFVEENV

SEQ ID NO: 2239858 - protein, 26 aa, Cryptosporidium parvum
YNELLFYSHFRWLKGEYIKKKRFEIS

SEQ ID NO: 2239859 - protein, 22 aa, Cryptosporidium parvum
YNEVTWWIGVISYAFGAIIHII

SEQ ID NO: 2239860 - protein, 17 aa, Cryptosporidium parvum
YNFEKPIVCQNVTFYNK

SEQ ID NO: 2239861 - protein, 17 aa, Cryptosporidium parvum
YNFGDPLPAVFNDSYKS

SEQ ID NO: 2239862 - protein, 34 aa, Cryptosporidium parvum
YNFSIPICIFLSLYKCKIKIIYLSSIFNDGTLYI

SEQ ID NO: 2239863 - protein, 17 aa, Cryptosporidium parvum
YNIRLAVPRSVIGSIIG

SEQ ID NO: 2239864 - protein, 25 aa, Cryptosporidium parvum
YNIYLVLWIQLHVRKEFSLQFKDNL

SEQ ID NO: 2239865 - protein, 21 aa, Cryptosporidium parvum
YNLFNLKSFVFVAALHGGLKS

SEQ ID NO: 2239866 - protein, 24 aa, Cryptosporidium parvum
YNLIILCVEIGMIVTTSFWLLMTQ

SEQ ID NO: 2239867 - protein, 20 aa, Cryptosporidium parvum
YNLMVCLIYLITDEAASIEN

SEQ ID NO: 2239868 - protein, 21 aa, Cryptosporidium parvum
YNLPIEYLYEFLIPTISLVIM

SEQ ID NO: 2239869 - protein, 25 aa, Cryptosporidium parvum
YNLVENFPLLYFNRAFQTAQLPCLL

SEQ ID NO: 2239870 - protein, 24 aa, Cryptosporidium parvum
YNNKSLFGYKEWHQIFQYYSNFVG

SEQ ID NO: 2239871 - protein, 18 aa, Cryptosporidium parvum
YNQFWAWKDIGDKSGKIV

SEQ ID NO: 2239872 - protein, 18 aa, Cryptosporidium parvum
YNQIEVIISDLLLPYSIK

SEQ ID NO: 2239873 - protein, 23 aa, Cryptosporidium parvum
YNRDYQVGYSLRWTSSNKSSINS

SEQ ID NO: 2239874 - protein, 18 aa, Cryptosporidium parvum
YNRIRLSLRDQYHNNYYL

SEQ ID NO: 2239875 - protein, 28 aa, Cryptosporidium parvum
YNRRMDVHWPFTLFSLWGEPKSVSMNIW

SEQ ID NO: 2239876 - protein, 20 aa, Cryptosporidium parvum
YNSEGLKCLSSIFDIIEGRI

SEQ ID NO: 2239877 - protein, 17 aa, Cryptosporidium parvum
YNSFDGCSLFDDDGMKK

SEQ ID NO: 2239878 - protein, 17 aa, Cryptosporidium parvum
YNSIREFWKITSVSNII

SEQ ID NO: 2239879 - protein, 26 aa, Cryptosporidium parvum
YNSLSLPMVMGYYYLPPDTLYLGKFS

SEQ ID NO: 2239880 - protein, 18 aa, Cryptosporidium parvum
YNSTKFFAINTFSYEGEI

SEQ ID NO: 2239881 - protein, 27 aa, Cryptosporidium parvum
YNTCKIRLNVYAPFWINNRQHIPIYVL

SEQ ID NO: 2239882 - protein, 24 aa, Cryptosporidium parvum
YNTFWEMLDLLVLKNQDNKKSMKL

SEQ ID NO: 2239883 - protein, 22 aa, Cryptosporidium parvum
YNTNCIKWNPLNSYLIGALHEN

SEQ ID NO: 2239884 - protein, 21 aa, Cryptosporidium parvum
YNTWCSIIGVVSRFHEIVDII

SEQ ID NO: 2239885 - protein, 18 aa, Cryptosporidium parvum
YNYFSEWGVLNMIGILVC

SEQ ID NO: 2239886 - protein, 18 aa, Cryptosporidium parvum
YPCSDPAQRYGLIGDGIS

SEQ ID NO: 2239887 - protein, 17 aa, Cryptosporidium parvum
YPDRFVHRQGNLCKPDD

SEQ ID NO: 2239888 - protein, 18 aa, Cryptosporidium parvum
YPEFDGFNEFVLLHNGNF

SEQ ID NO: 2239889 - protein, 19 aa, Cryptosporidium parvum
YPEPQGSVRSQWDFLLQEM

SEQ ID NO: 2239890 - protein, 17 aa, Cryptosporidium parvum
YPFYHCHFLFQKSLIIS

SEQ ID NO: 2239891 - protein, 17 aa, Cryptosporidium parvum
YPGLVIISAKKKNLTKI

SEQ ID NO: 2239892 - protein, 19 aa, Cryptosporidium parvum
YPIRTLEIPFRLKKDFISP

SEQ ID NO: 2239893 - protein, 19 aa, Cryptosporidium parvum
YPISLAFDLYYTFVLEEKY

SEQ ID NO: 2239894 - protein, 24 aa, Cryptosporidium parvum
YPISSFKHTLVWVKKSMELYNHNF

SEQ ID NO: 2239895 - protein, 25 aa, Cryptosporidium parvum
YPKRIVIKELIPWIYKAEKKMRHNI

SEQ ID NO: 2239896 - protein, 19 aa, Cryptosporidium parvum
YPLAVIRKYIEFRGKRKGY

SEQ ID NO: 2239897 - protein, 17 aa, Cryptosporidium parvum
YPLFVYSIIWGRRKSFF

SEQ ID NO: 2239898 - protein, 18 aa, Cryptosporidium parvum
YPLGKKVKTQKALLQDVS

SEQ ID NO: 2239899 - protein, 17 aa, Cryptosporidium parvum
YPLMPISNGFRLFKTPK

SEQ ID NO: 2239900 - protein, 25 aa, Cryptosporidium parvum
YPLWWKTKLHFTRSSPYLNHYIPEI

SEQ ID NO: 2239901 - protein, 17 aa, Cryptosporidium parvum
YPLYPIWIIVNKNHYKC

SEQ ID NO: 2239902 - protein, 20 aa, Cryptosporidium parvum
YPMLHFPLTNGIKMNDYFLR

SEQ ID NO: 2239903 - protein, 20 aa, Cryptosporidium parvum
YPMVIHLTFNLNLLKSSINS

SEQ ID NO: 2239904 - protein, 24 aa, Cryptosporidium parvum
YPPFWTSCRHLLQLIGQLDPKTYI

SEQ ID NO: 2239905 - protein, 22 aa, Cryptosporidium parvum
YPQILHCILLIVLTNYSEYYSI

SEQ ID NO: 2239906 - protein, 26 aa, Cryptosporidium parvum
YPRGTWKAVSSRAFIRDPYALVLLSG

SEQ ID NO: 2239907 - protein, 21 aa, Cryptosporidium parvum
YPRKKSYRKLVNLIRQNVDSV

SEQ ID NO: 2239908 - protein, 20 aa, Cryptosporidium parvum
YPRYWGLLTVIGRRTQSHNE

SEQ ID NO: 2239909 - protein, 19 aa, Cryptosporidium parvum
YPSFIKLGGINGREGSSSG

SEQ ID NO: 2239910 - protein, 18 aa, Cryptosporidium parvum
YPSRYEMLALITMIESSI

SEQ ID NO: 2239911 - protein, 28 aa, Cryptosporidium parvum
YPTGRKIGGSSLIFGIIYYWSKKFPTSL

SEQ ID NO: 2239912 - protein, 17 aa, Cryptosporidium parvum
YPWYDYLAVIVITISLS

SEQ ID NO: 2239913 - protein, 22 aa, Cryptosporidium parvum
YPYFFSQKCGFAREFDYSTFKY

SEQ ID NO: 2239914 - protein, 19 aa, Cryptosporidium parvum
YPYLACKVLGLLNQEKKED

SEQ ID NO: 2239915 - protein, 20 aa, Cryptosporidium parvum
YQDLRMIAGFYKKKTTLPLL

SEQ ID NO: 2239916 - protein, 17 aa, Cryptosporidium parvum
YQEFLRLDFTVMNLNNS

SEQ ID NO: 2239917 - protein, 21 aa, Cryptosporidium parvum
YQFIGISAFIGYIIIVLSLFV

SEQ ID NO: 2239918 - protein, 23 aa, Cryptosporidium parvum
YQFLDILLKFSIIYLLIQMSFWP

SEQ ID NO: 2239919 - protein, 17 aa, Cryptosporidium parvum
YQHCILGSILVSNSSNM

SEQ ID NO: 2239920 - protein, 19 aa, Cryptosporidium parvum
YQIDDEWKREALYKKTLKL

SEQ ID NO: 2239921 - protein, 22 aa, Cryptosporidium parvum
YQIKRYFIRINYYDMLGEGGFI

SEQ ID NO: 2239922 - protein, 17 aa, Cryptosporidium parvum
YQILSISFINNGPTNAN

SEQ ID NO: 2239923 - protein, 23 aa, Cryptosporidium parvum
YQKDARFNLVYVDTIHVYLSVLK

SEQ ID NO: 2239924 - protein, 17 aa, Cryptosporidium parvum
YQLGYFSILGLLRLHAL

SEQ ID NO: 2239925 - protein, 24 aa, Cryptosporidium parvum
YQLIPEFIDGLGYGNHELYYSETR

SEQ ID NO: 2239926 - protein, 30 aa, Cryptosporidium parvum
YQLLRFQPLVIKAFLGRLVFPELLEYSEKQ

SEQ ID NO: 2239927 - protein, 17 aa, Cryptosporidium parvum
YQLSFLMLVKMGIIEPV

SEQ ID NO: 2239928 - protein, 22 aa, Cryptosporidium parvum
YQNLIKIIKFVIILKSYQKLDL

SEQ ID NO: 2239929 - protein, 23 aa, Cryptosporidium parvum
YQVFLKMWFTPLINYLNQFANSE

SEQ ID NO: 2239930 - protein, 19 aa, Cryptosporidium parvum
YQYCKRIYRERVIIKSEKI

SEQ ID NO: 2239931 - protein, 18 aa, Cryptosporidium parvum
YQYTFSCLIFQKKKSELL

SEQ ID NO: 2239932 - protein, 19 aa, Cryptosporidium parvum
YRAETFLATLEKVKLCLSD

SEQ ID NO: 2239933 - protein, 20 aa, Cryptosporidium parvum
YRAFSEFYIDSSIKNMRKHL

SEQ ID NO: 2239934 - protein, 17 aa, Cryptosporidium parvum
YRARYPLVENGPFEEQD

SEQ ID NO: 2239935 - protein, 20 aa, Cryptosporidium parvum
YRCSGSFLTTALLFKLPRGR

SEQ ID NO: 2239936 - protein, 19 aa, Cryptosporidium parvum
YRDCGNFLMAKNCFLVALE

SEQ ID NO: 2239937 - protein, 25 aa, Cryptosporidium parvum
YRELSCIRKIFSLPFIAFFIYMLFF

SEQ ID NO: 2239938 - protein, 24 aa, Cryptosporidium parvum
YRENCILSIFGVINYVISRVLYLS

SEQ ID NO: 2239939 - protein, 20 aa, Cryptosporidium parvum
YRFWEKKPKYVHKNINGSER

SEQ ID NO: 2239940 - protein, 17 aa, Cryptosporidium parvum
YRGIGGLIWSSSSDVRI

SEQ ID NO: 2239941 - protein, 19 aa, Cryptosporidium parvum
YRGYEVCPTYSMVNYHLGK

SEQ ID NO: 2239942 - protein, 22 aa, Cryptosporidium parvum
YRKKDPFKLIAVLRIIPTFNVD

SEQ ID NO: 2239943 - protein, 23 aa, Cryptosporidium parvum
YRKLWLIICLAILALTGITEKTL

SEQ ID NO: 2239944 - protein, 17 aa, Cryptosporidium parvum
YRLASFHPSIIFVLDQE

SEQ ID NO: 2239945 - protein, 24 aa, Cryptosporidium parvum
YRLDFKECYIHLFVELSKTSLVNQ

SEQ ID NO: 2239946 - protein, 19 aa, Cryptosporidium parvum
YRLFESCQLILHDVLKDYA

SEQ ID NO: 2239947 - protein, 17 aa, Cryptosporidium parvum
YRLPKTAYFDGILQVLS

SEQ ID NO: 2239948 - protein, 19 aa, Cryptosporidium parvum
YRLRCKKRPWYVIYEGEGG

SEQ ID NO: 2239949 - protein, 17 aa, Cryptosporidium parvum
YRLSYSMENRPISSSLR

SEQ ID NO: 2239950 - protein, 25 aa, Cryptosporidium parvum
YRNKFACKLLKPLIDDYINKKIHSL

SEQ ID NO: 2239951 - protein, 19 aa, Cryptosporidium parvum
YRPKFEILGKLPGTLIFKS

SEQ ID NO: 2239952 - protein, 18 aa, Cryptosporidium parvum
YRQHVWNDAQAVNIIAKC

SEQ ID NO: 2239953 - protein, 38 aa, Cryptosporidium parvum
YRREVHYLMCCLSLITLRGSSEFILLSISGWGSLCNSL

SEQ ID NO: 2239954 - protein, 26 aa, Cryptosporidium parvum
YRRLYELLCPPVFSLKVRAKFLKLLS

SEQ ID NO: 2239955 - protein, 25 aa, Cryptosporidium parvum
YRRSFLPLFLVFVFLALQFIGLSIM

SEQ ID NO: 2239956 - protein, 18 aa, Cryptosporidium parvum
YRSELLYRAQFLLETHTN

SEQ ID NO: 2239957 - protein, 21 aa, Cryptosporidium parvum
YRSETKFPFGSIKPLWYRQIP

SEQ ID NO: 2239958 - protein, 19 aa, Cryptosporidium parvum
YRSKIKYNKLIATQWDESH

SEQ ID NO: 2239959 - protein, 18 aa, Cryptosporidium parvum
YRSLPITLFMNIPQTGLF

SEQ ID NO: 2239960 - protein, 17 aa, Cryptosporidium parvum
YRTCFIGSFHHAIMDGL

SEQ ID NO: 2239961 - protein, 22 aa, Cryptosporidium parvum
YRTVPILKPVVWSGIKELLDVS

SEQ ID NO: 2239962 - protein, 22 aa, Cryptosporidium parvum
YRVEDLLFKKGLRDPFITVEFS

SEQ ID NO: 2239963 - protein, 26 aa, Cryptosporidium parvum
YRYLHQLGYLRSCGGMDLVYKQIYNH

SEQ ID NO: 2239964 - protein, 19 aa, Cryptosporidium parvum
YSCLRKVNLNIRVGDVIGI

SEQ ID NO: 2239965 - protein, 21 aa, Cryptosporidium parvum
YSDILTLKFVRIVSTSLFFTG

SEQ ID NO: 2239966 - protein, 26 aa, Cryptosporidium parvum
YSDKPICIPNLFFGIELPKIIYQNNY

SEQ ID NO: 2239967 - protein, 19 aa, Cryptosporidium parvum
YSDKYRYIIFESTDYNYAI

SEQ ID NO: 2239968 - protein, 27 aa, Cryptosporidium parvum
YSDLSNIILFCMKNLIYSRSVMMPNSE

SEQ ID NO: 2239969 - protein, 17 aa, Cryptosporidium parvum
YSECSIWGIDGLPNLRL

SEQ ID NO: 2239970 - protein, 24 aa, Cryptosporidium parvum
YSEIKHIFYFLSFFFFILSIFLFE

SEQ ID NO: 2239971 - protein, 22 aa, Cryptosporidium parvum
YSESTNWIWKLNKEFFELFLRW

SEQ ID NO: 2239972 - protein, 17 aa, Cryptosporidium parvum
YSFHSNIEFARSRFEDY

SEQ ID NO: 2239973 - protein, 25 aa, Cryptosporidium parvum
YSFSNWRFNVPWLLWADSAFIGIQN

SEQ ID NO: 2239974 - protein, 24 aa, Cryptosporidium parvum
YSHPILRERIEYFGRFQQDILDSN

SEQ ID NO: 2239975 - protein, 17 aa, Cryptosporidium parvum
YSIEIDGGLAFIPSLIF

SEQ ID NO: 2239976 - protein, 17 aa, Cryptosporidium parvum
YSIIKCVVFSISVAYLL

SEQ ID NO: 2239977 - protein, 25 aa, Cryptosporidium parvum
YSIIRILPSVKWFKNNGIFSMNRKD

SEQ ID NO: 2239978 - protein, 17 aa, Cryptosporidium parvum
YSIKLTPLLKVTNSLPF

SEQ ID NO: 2239979 - protein, 20 aa, Cryptosporidium parvum
YSILLFIMFLFRPFKSLKLF

SEQ ID NO: 2239980 - protein, 24 aa, Cryptosporidium parvum
YSILSIRILFIVPIIFSLILSLIW

SEQ ID NO: 2239981 - protein, 18 aa, Cryptosporidium parvum
YSILSYAIIPAFLDQKSI

SEQ ID NO: 2239982 - protein, 17 aa, Cryptosporidium parvum
YSIPSIVDREVWKEKLF

SEQ ID NO: 2239983 - protein, 19 aa, Cryptosporidium parvum
YSISEVISFVNILDFLNSK

SEQ ID NO: 2239984 - protein, 30 aa, Cryptosporidium parvum; identical to SEQ ID NO: 2128846

SEQ ID NO: 2239985 - protein, 25 aa, Cryptosporidium parvum
YSKLKKGDCVLIHVASGGVGLAAIQ

SEQ ID NO: 2239986 - protein, 20 aa, Cryptosporidium parvum
YSKNCIGFKLGPKEEMKRLP

SEQ ID NO: 2239987 - protein, 19 aa, Cryptosporidium parvum
YSLIFRESYPFNEDEVKDF

SEQ ID NO: 2239988 - protein, 19 aa, Cryptosporidium parvum
YSLLKSDPILFCSLIGIYL

SEQ ID NO: 2239989 - protein, 20 aa, Cryptosporidium parvum
YSLLQPCTFINSQLSSIILL

SEQ ID NO: 2239990 - protein, 24 aa, Cryptosporidium parvum
YSLLSLSAIVLFSGEESHHLRKSC

SEQ ID NO: 2239991 - protein, 25 aa, Cryptosporidium parvum
YSLRDIFFYLKFVITLNFENHPETL

SEQ ID NO: 2239992 - protein, 18 aa, Cryptosporidium parvum
YSMIFFNLTTLFKKLYEN

SEQ ID NO: 2239993 - protein, 22 aa, Cryptosporidium parvum
YSNDLKKLVLILLSKPALNKNN

SEQ ID NO: 2239994 - protein, 20 aa, Cryptosporidium parvum
YSNEFCKYMQYFFLIIILLP

SEQ ID NO: 2239995 - protein, 17 aa, Cryptosporidium parvum
YSNGNIFNKFDNNLTHL

SEQ ID NO: 2239996 - protein, 25 aa, Cryptosporidium parvum
YSNHIYGFIQFRLFLMSNLIIAYTL

SEQ ID NO: 2239997 - protein, 18 aa, Cryptosporidium parvum
YSNKVMCFKQFCKSSDGI

SEQ ID NO: 2239998 - protein, 23 aa, Cryptosporidium parvum
YSNLFSFESFCVLNYYNNSTRNN

SEQ ID NO: 2239999 - protein, 20 aa, Cryptosporidium parvum
YSNSYKWNWSSIPNNFVNFN

SEQ ID NO: 2240000 - protein, 18 aa, Cryptosporidium parvum
YSNVSFGFFVFISVLVSI

SEQ ID NO: 2240001 - protein, 28 aa, Cryptosporidium parvum
YSPQLKWVSNLWINYGLPTIMDSENFLV

SEQ ID NO: 2240002 - protein, 38 aa, Cryptosporidium parvum
YSQPKFVLYCFVNISFILICTYLSFFGLDGTEENKYKN

SEQ ID NO: 2240003 - protein, 24 aa, Cryptosporidium parvum
YSQSLCFQCSIGTYSEKEKSNSCE

SEQ ID NO: 2240004 - protein, 21 aa, Cryptosporidium parvum
YSQTCLKNLIFKENLQIKKTI

SEQ ID NO: 2240005 - protein, 37 aa, Cryptosporidium parvum
YSRNSLPKGAEWIVDIFEPWRAIFLGGVTTIYIDDGN

SEQ ID NO: 2240006 - protein, 25 aa, Cryptosporidium parvum
YSSDRPRWYPLLSAAHYGIMVGQDI

SEQ ID NO: 2240007 - protein, 25 aa, Cryptosporidium parvum
YSSKLYKATILWSKLFVIPSSRSKE

SEQ ID NO: 2240008 - protein, 19 aa, Cryptosporidium parvum
YSSSMLPEYITIDRKNKNP

SEQ ID NO: 2240009 - protein, 17 aa, Cryptosporidium parvum
YSSSSILSFYYDEYKLL

SEQ ID NO: 2240010 - protein, 29 aa, Cryptosporidium parvum
YSSTLDSIGMRWLIPWYLIEALLTKPNQI

SEQ ID NO: 2240011 - protein, 22 aa, Cryptosporidium parvum
YSSTRLENRFTILKDYVGFKSS

SEQ ID NO: 2240012 - protein, 20 aa, Cryptosporidium parvum
YSSTSQRGLRGYKEEIHPEL

SEQ ID NO: 2240013 - protein, 17 aa, Cryptosporidium parvum
YSTARLGIFRLLCDYYK

SEQ ID NO: 2240014 - protein, 24 aa, Cryptosporidium parvum
YSTFFPIDLCIKLLIFTISILLFF

SEQ ID NO: 2240015 - protein, 22 aa, Cryptosporidium parvum
YSTFKCTFFFQYLYVSANEIAF

SEQ ID NO: 2240016 - protein, 21 aa, Cryptosporidium parvum
YSTLYPSEFDMRMSGISSSTL

SEQ ID NO: 2240017 - protein, 25 aa, Cryptosporidium parvum
YSTPECSYCKSFPVIVDEKYNIINR

SEQ ID NO: 2240018 - protein, 21 aa, Cryptosporidium parvum
YSVIMPFNYIAGPLIVETQYK

SEQ ID NO: 2240019 - protein, 22 aa, Cryptosporidium parvum
YSVLRRIYEEFLSWYKFPKNEI

SEQ ID NO: 2240020 - protein, 21 aa, Cryptosporidium parvum
YSVTPWSSWGICSGCNGVITR

SEQ ID NO: 2240021 - protein, 26 aa, Cryptosporidium parvum
YSYLQYRGSIPIVWRQPPNLKKTPPV

SEQ ID NO: 2240022 - protein, 23 aa, Cryptosporidium parvum
YTDSIFSSVITWVVSVYLVEIIV

SEQ ID NO: 2240023 - protein, 18 aa, Cryptosporidium parvum
YTFFDYMIDYSILLFIMF

SEQ ID NO: 2240024 - protein, 25 aa, Cryptosporidium parvum
YTLDFGEFIIKFGPILISGILNFFL

SEQ ID NO: 2240025 - protein, 17 aa, Cryptosporidium parvum
YTLIGLFGDSIEFKNPK

SEQ ID NO: 2240026 - protein, 27 aa, Cryptosporidium parvum
YTLLAKYSFYGIPIIKPLFWLNQKDFN

SEQ ID NO: 2240027 - protein, 32 aa, Cryptosporidium parvum
YTLPETIDLLLYATFCFGFMMVILFFNSSGSV

SEQ ID NO: 2240028 - protein, 20 aa, Cryptosporidium parvum
YTLYAKIIFREDAEIELQEI

SEQ ID NO: 2240029 - protein, 18 aa, Cryptosporidium parvum
YTNWLSVICILYVVAVVF

SEQ ID NO: 2240030 - protein, 19 aa, Cryptosporidium parvum
YTPGIDFIYSFYGCLASGI

SEQ ID NO: 2240031 - protein, 18 aa, Cryptosporidium parvum
YTPLLAYIASINIIFKME

SEQ ID NO: 2240032 - protein, 24 aa, Cryptosporidium parvum
YTQWLQFYSCNTIEHSLHYILLSC

SEQ ID NO: 2240033 - protein, 23 aa, Cryptosporidium parvum
YTSIVLCDFALLSTGGIKTYLFW

SEQ ID NO: 2240034 - protein, 19 aa, Cryptosporidium parvum
YTTFDHFFLIRSYDFAPEE

SEQ ID NO: 2240035 - protein, 19 aa, Cryptosporidium parvum
YVASYMRWVAKQELKPVTL

SEQ ID NO: 2240036 - protein, 19 aa, Cryptosporidium parvum
YVEYDDIMEVYKFYWRRLK

SEQ ID NO: 2240037 - protein, 23 aa, Cryptosporidium parvum
YVFGFWPSLLFKQHYNNILRSKK

SEQ ID NO: 2240038 - protein, 18 aa, Cryptosporidium parvum
YVGLIGLDYFHLIISQLL

SEQ ID NO: 2240039 - protein, 19 aa, Cryptosporidium parvum
YVIASGRNGSFFSIKLTNK

SEQ ID NO: 2240040 - protein, 18 aa, Cryptosporidium parvum
YVIEHIINGLSIFPASGY

SEQ ID NO: 2240041 - protein, 18 aa, Cryptosporidium parvum
YVQFCLRNPSLSYFTCIG

SEQ ID NO: 2240042 - protein, 24 aa, Cryptosporidium parvum
YVRIARFEGPLTFINAERFVKNLE

SEQ ID NO: 2240043 - protein, 22 aa, Cryptosporidium parvum
YVRQYLEYIFKAFYNKDDQDYI

SEQ ID NO: 2240044 - protein, 20 aa, Cryptosporidium parvum
YVYRSFILKLVIKLNNYFLS

SEQ ID NO: 2240045 - protein, 25 aa, Cryptosporidium parvum
YWFFHSIWHIMAFLASTFIIHGCVP

SEQ ID NO: 2240046 - protein, 19 aa, Cryptosporidium parvum
YWIILCKSIDLMIVSVYLS

SEQ ID NO: 2240047 - protein, 23 aa, Cryptosporidium parvum
YWLKNLHFQFCIGFINNENFGQN

SEQ ID NO: 2240048 - protein, 34 aa, Cryptosporidium parvum
YWRKKAEVFLVEYVVALIICIGRKLFTQRIRLTL

SEQ ID NO: 2240049 - protein, 23 aa, Cryptosporidium parvum
YWSNHIVCPVLFYDAINHALNKF

SEQ ID NO: 2240050 - protein, 18 aa, Cryptosporidium parvum
YWVLKLINRGCYMRQIVK

SEQ ID NO: 2240051 - protein, 20 aa, Cryptosporidium parvum
YYCKCAEGFYGRNCTISSDN

SEQ ID NO: 2240052 - protein, 25 aa, Cryptosporidium parvum
YYDEYKLLMLRNGDPFYIQDIKLDL

SEQ ID NO: 2240053 - protein, 24 aa, Cryptosporidium parvum
YYEKLPLIFDRFFEEILRLDNSFI

SEQ ID NO: 2240054 - protein, 17 aa, Cryptosporidium parvum
YYEKLQFMINMRQFLIQ

SEQ ID NO: 2240055 - protein, 24 aa, Cryptosporidium parvum
YYELIVHRMSMSFQISTFKSNSII

SEQ ID NO: 2240056 - protein, 18 aa, Cryptosporidium parvum
YYERSSRSASHFGKVYNG

SEQ ID NO: 2240057 - protein, 19 aa, Cryptosporidium parvum
YYFSSLILWLFSKSNDSIV

SEQ ID NO: 2240058 - protein, 17 aa, Cryptosporidium parvum
YYGSITIQLTRRLQSGD

SEQ ID NO: 2240059 - protein, 24 aa, Cryptosporidium parvum
YYGWSALFLCLLLFSTFSFLILIP

SEQ ID NO: 2240060 - protein, 19 aa, Cryptosporidium parvum
YYIKEISPVLVREFGSQDD

SEQ ID NO: 2240061 - protein, 20 aa, Cryptosporidium parvum
YYISKTWVYHALIVSIVTII

SEQ ID NO: 2240062 - protein, 20 aa, Cryptosporidium parvum
YYKIASFFYTINFINIILDR

SEQ ID NO: 2240063 - protein, 18 aa, Cryptosporidium parvum
YYLASGFGKSVGLYDTNT

SEQ ID NO: 2240064 - protein, 17 aa, Cryptosporidium parvum
YYLFFIVIINILILSNG

SEQ ID NO: 2240065 - protein, 23 aa, Cryptosporidium parvum
YYLLYPSCRIFEPLDNLKDEAFV

SEQ ID NO: 2240066 - protein, 18 aa, Cryptosporidium parvum
YYLNWLREYEKALDDSIK

SEQ ID NO: 2240067 - protein, 17 aa, Cryptosporidium parvum
YYMKSRWPNPSVVENLI

SEQ ID NO: 2240068 - protein, 23 aa, Cryptosporidium parvum
YYNREELGYLPVLNFEISIPEWR

SEQ ID NO: 2240069 - protein, 20 aa, Cryptosporidium parvum
YYNSLGLTEDFLLVFMNFSL

SEQ ID NO: 2240070 - protein, 25 aa, Cryptosporidium parvum
YYNSLLCMKCFNFSLEPKFESPETK

SEQ ID NO: 2240071 - protein, 19 aa, Cryptosporidium parvum
YYSNGLYYLAIFKGRYNIQ

SEQ ID NO: 2240072 - protein, 17 aa, Cryptosporidium parvum
YYSPRIESIRTLERNQR

SEQ ID NO: 2240073 - protein, 24 aa, Cryptosporidium parvum
YYTNRLKSNIGFIPAQSFSDIISD

SEQ ID NO: 2240074 - protein, 30 aa, Cryptosporidium parvum
YYWYFSKLKWSWTIALFILCYSKTMFDKGT

SEQ ID NO: 2240075 - protein, 19 aa, Cryptosporidium parvum
YYYECRINTLILFCNNPME

SEQ ID NO: 2240076 - protein, 29 aa, Cryptosporidium parvum
YYYLFQQYCSFRFKFSASLKKISSTDSNN

SEQ ID NO: 2240077 - protein, 18 aa, Cryptosporidium parvum
YYYLSYFEVLSWIKITQE

SEQ ID NO: 2240078 - protein, 18 aa, Cryptosporidium parvum
YYYTILLDRFMKSNLDIK

SEQ ID NO: 2240079 - protein, 19 aa, Cryptosporidium parvum
ACTRISWQLFKELMLCSPL

SEQ ID NO: 2240080 - protein, 18 aa, Cryptosporidium parvum
ACWNEFLVIYAFEISENP

SEQ ID NO: 2240081 - protein, 18 aa, Cryptosporidium parvum
ADHLKPDFFYAFNSMPGW

SEQ ID NO: 2240082 - protein, 19 aa, Cryptosporidium parvum
ADYLRWIALVLFPSFIYIR

SEQ ID NO: 2240083 - protein, 17 aa, Cryptosporidium parvum
AELRSQYILRRIKENNC

SEQ ID NO: 2240084 - protein, 20 aa, Cryptosporidium parvum
AETIKKLGFVGGKIKMISSH

SEQ ID NO: 2240085 - protein, 21 aa, Cryptosporidium parvum
AETIPSIALIYGFWSSKNSFL

SEQ ID NO: 2240086 - protein, 18 aa, Cryptosporidium parvum
AFGLRYIVPSVFAIFAAL

SEQ ID NO: 2240087 - protein, 22 aa, Cryptosporidium parvum
AFQEWVEGIGILFIVLINASLA

SEQ ID NO: 2240088 - protein, 18 aa, Cryptosporidium parvum
AGAYKYAVSNGIKTDNVY

SEQ ID NO: 2240089 - protein, 18 aa, Cryptosporidium parvum
AIGLLGYMHALGIGTSPD

SEQ ID NO: 2240090 - protein, 17 aa, Cryptosporidium parvum
AKMMIEWNFAFHWYDDG

SEQ ID NO: 2240091 - protein, 18 aa, Cryptosporidium parvum
ALGILRDRIRVVSNDKFQ

SEQ ID NO: 2240092 - protein, 18 aa, Cryptosporidium parvum
ALIQSFWLGIADNVDPEL

SEQ ID NO: 2240093 - protein, 22 aa, Cryptosporidium parvum
ALPLICMLCFSAAQAAYEDWKR

SEQ ID NO: 2240094 - protein, 18 aa, Cryptosporidium parvum
ALSCPIWGLLADRYSRKY

SEQ ID NO: 2240095 - protein, 19 aa, Cryptosporidium parvum
ALSIFSIVCAVFFKQTMLY

SEQ ID NO: 2240096 - protein, 22 aa, Cryptosporidium parvum
ANAIRISMRILLLFLFALIFSI

SEQ ID NO: 2240097 - protein, 19 aa, Cryptosporidium parvum
ANILDRIYKIFSFSQKHNI

SEQ ID NO: 2240098 - protein, 18 aa, Cryptosporidium parvum
APGCPKWFIKNGYCDVNC

SEQ ID NO: 2240099 - protein, 18 aa, Cryptosporidium parvum
APILRYFREKEVRGFLLG

SEQ ID NO: 2240100 - protein, 18 aa, Cryptosporidium parvum
APKGLGVMFSFLDRNNKK

SEQ ID NO: 2240101 - protein, 17 aa, Cryptosporidium parvum
APLRGSVLFGHLQTIMP

SEQ ID NO: 2240102 - protein, 17 aa, Cryptosporidium parvum
APLSWLFFLACSSIAAY

SEQ ID NO: 2240103 - protein, 24 aa, Cryptosporidium parvum
ASCILPKLPEAFLFLSKKEDQVRK

SEQ ID NO: 2240104 - protein, 17 aa, Cryptosporidium parvum
ASFRLCKAIQDKLNPIN

SEQ ID NO: 2240105 - protein, 17 aa, Cryptosporidium parvum
ASIKAFAIFGILFVFEE

SEQ ID NO: 2240106 - protein, 17 aa, Cryptosporidium parvum
ATARAGVKIIYTPTILL

SEQ ID NO: 2240107 - protein, 18 aa, Cryptosporidium parvum
ATGGGRCEFELNQKVGCN

SEQ ID NO: 2240108 - protein, 19 aa, Cryptosporidium parvum
ATGSMGLRGSLLSGEILQQ

SEQ ID NO: 2240109 - protein, 17 aa, Cryptosporidium parvum
AWLKIRLQVGIIIPLTF

SEQ ID NO: 2240110 - protein, 17 aa, Cryptosporidium parvum
AWTLFSLLIICTLKGIS

SEQ ID NO: 2240111 - protein, 21 aa, Cryptosporidium parvum
AYEWANCCWNYLGTITEINNL

SEQ ID NO: 2240112 - protein, 18 aa, Cryptosporidium parvum
AYFYRPEEMDDFTTYSMY

SEQ ID NO: 2240113 - protein, 23 aa, Cryptosporidium parvum
AYMPPECWKIFWRLEENKIQFPL

SEQ ID NO: 2240114 - protein, 21 aa, Cryptosporidium parvum
AYSNFKWVFAIFILKPSILFL

SEQ ID NO: 2240115 - protein, 20 aa, Cryptosporidium parvum
CAEKAFNFFLIILISNLNLT

SEQ ID NO: 2240116 - protein, 18 aa, Cryptosporidium parvum
CCRTRPTLTPSLNTATYG

SEQ ID NO: 2240117 - protein, 17 aa, Cryptosporidium parvum
CCWPVWSGSIISFAAYM

SEQ ID NO: 2240118 - protein, 24 aa, Cryptosporidium parvum
CDIWIHPICLEWLIIARVQVFSLN

SEQ ID NO: 2240119 - protein, 30 aa, Cryptosporidium parvum
CDRFPEGVACPMVLSGEANIECIGYKVWNS

SEQ ID NO: 2240120 - protein, 17 aa, Cryptosporidium parvum
CEGCPKSNLEIMTDAMS

SEQ ID NO: 2240121 - protein, 20 aa, Cryptosporidium parvum
CFIFPLRLIIAYFVLKDSLG

SEQ ID NO: 2240122 - protein, 18 aa, Cryptosporidium parvum
CFIICAFGVLVVHYLESK

SEQ ID NO: 2240123 - protein, 17 aa, Cryptosporidium parvum
CFNDIYKIYGFIAVCCI

SEQ ID NO: 2240124 - protein, 19 aa, Cryptosporidium parvum
CGILSICLLIIIVLLVVLG

SEQ ID NO: 2240125 - protein, 18 aa, Cryptosporidium parvum
CGLCVIYITLSIVIIVNF

SEQ ID NO: 2240126 - protein, 17 aa, Cryptosporidium parvum
CGVLKLFLSLALSSSKK

SEQ ID NO: 2240127 - protein, 18 aa, Cryptosporidium parvum
CHGFEWLWFLALLIVISV

SEQ ID NO: 2240128 - protein, 17 aa, Cryptosporidium parvum
CHLPRKTLDIVFDVDLT

SEQ ID NO: 2240129 - protein, 19 aa, Cryptosporidium parvum
CHRSLRILIELPLALLHIF

SEQ ID NO: 2240130 - protein, 22 aa, Cryptosporidium parvum
CIALRLLFRCCGIKCGSSCTNK

SEQ ID NO: 2240131 - protein, 19 aa, Cryptosporidium parvum
CIFECFFEPLLYYKNKHNL

SEQ ID NO: 2240132 - protein, 19 aa, Cryptosporidium parvum
CILSFFLTFAIHLNFLEAN

SEQ ID NO: 2240133 - protein, 19 aa, Cryptosporidium parvum
CIQNSFEIFTILSMHNIFK

SEQ ID NO: 2240134 - protein, 21 aa, Cryptosporidium parvum
CIVSWVFPRARRMGLMPQNSS

SEQ ID NO: 2240135 - protein, 18 aa, Cryptosporidium parvum
CKAKEAINRIIIEASSRK

SEQ ID NO: 2240136 - protein, 18 aa, Cryptosporidium parvum
CKAQHYWYFREKTSDNSH

SEQ ID NO: 2240137 - protein, 17 aa, Cryptosporidium parvum
CKDCFREEISLLDRPSL

SEQ ID NO: 2240138 - protein, 18 aa, Cryptosporidium parvum
CKDLSLKAFHHFHNVSNL

SEQ ID NO: 2240139 - protein, 21 aa, Cryptosporidium parvum
CKGEELPLLWGQRATILHENM

SEQ ID NO: 2240140 - protein, 17 aa, Cryptosporidium parvum
CKLEPLVSLSFVVQESI

SEQ ID NO: 2240141 - protein, 17 aa, Cryptosporidium parvum
CKSVIYRRADFFRRKNH

SEQ ID NO: 2240142 - protein, 19 aa, Cryptosporidium parvum
CLFCIPLFLIVLSDLIPAL

SEQ ID NO: 2240143 - protein, 17 aa, Cryptosporidium parvum
CLFCKSQILAILKSFFI

SEQ ID NO: 2240144 - protein, 18 aa, Cryptosporidium parvum
CLICKRISHMHCIMQSDS

SEQ ID NO: 2240145 - protein, 19 aa, Cryptosporidium parvum
CLIVRLSAYIAFKKKFRSM

SEQ ID NO: 2240146 - protein, 18 aa, Cryptosporidium parvum
CLLLIWSRIIYKPWINTE

SEQ ID NO: 2240147 - protein, 20 aa, Cryptosporidium parvum
CLVCQICLVLSDLLSKTDSF

SEQ ID NO: 2240148 - protein, 31 aa, Cryptosporidium parvum
CNLNYRQEVIWNFRFASILGFTMNIKDFILD

SEQ ID NO: 2240149 - protein, 18 aa, Cryptosporidium parvum
CNNWYHWYCLGLHKDNIP

SEQ ID NO: 2240150 - protein, 21 aa, Cryptosporidium parvum
CPGRPFFEWSRLPGRKKNLEI

SEQ ID NO: 2240151 - protein, 20 aa, Cryptosporidium parvum
CPKFSIISGLLWKHNSVSWQ

SEQ ID NO: 2240152 - protein, 19 aa, Cryptosporidium parvum
CPKLKRIAMRSEIQERMPN

SEQ ID NO: 2240153 - protein, 19 aa, Cryptosporidium parvum
CPLRRVIYGFMTKIRLLLI

SEQ ID NO: 2240154 - protein, 18 aa, Cryptosporidium parvum
CPPGFNFAYDIWRKQKNK

SEQ ID NO: 2240155 - protein, 19 aa, Cryptosporidium parvum
CPYISYKIPNSFIAFPTSI

SEQ ID NO: 2240156 - protein, 17 aa, Cryptosporidium parvum
CSCPIGWYGNGYICIPK

SEQ ID NO: 2240157 - protein, 19 aa, Cryptosporidium parvum
CSGIFEWYTPLSLNSTIVE

SEQ ID NO: 2240158 - protein, 18 aa, Cryptosporidium parvum
CSIKCIFAYIDLLIHLRS

SEQ ID NO: 2240159 - protein, 24 aa, Cryptosporidium parvum
CSKCIKWKILMVLIVWYNLITTFK

SEQ ID NO: 2240160 - protein, 23 aa, Cryptosporidium parvum
CSKLYPALCFDLYGSPGFHNIYV

SEQ ID NO: 2240161 - protein, 20 aa, Cryptosporidium parvum
CSSLECSNCNEIIDMNISHN

SEQ ID NO: 2240162 - protein, 17 aa, Cryptosporidium parvum
CVGVYFLGVGVVGSVLY

SEQ ID NO: 2240163 - protein, 19 aa, Cryptosporidium parvum
CYAFWKIIMGMNILYFMLL

SEQ ID NO: 2240164 - protein, 21 aa, Cryptosporidium parvum
CYFFCDLCPIGMVGYFCSLKI

SEQ ID NO: 2240165 - protein, 17 aa, Cryptosporidium parvum
DCELKWALSDSELALIT

SEQ ID NO: 2240166 - protein, 20 aa, Cryptosporidium parvum
DCGWRRPRITIPPPVDSIDA

SEQ ID NO: 2240167 - protein, 17 aa, Cryptosporidium parvum
DCIITMFKREGIRSFYR

SEQ ID NO: 2240168 - protein, 29 aa, Cryptosporidium parvum
DCTFFGFEILKVLFPWKWISWLPTISQLL

SEQ ID NO: 2240169 - protein, 18 aa, Cryptosporidium parvum
DCYLLFQRWFLYFVNACK

SEQ ID NO: 2240170 - protein, 22 aa, Cryptosporidium parvum
DENLRLVPIFSFEDKPGTIDEG

SEQ ID NO: 2240171 - protein, 22 aa, Cryptosporidium parvum
DESYLRFEILREFIKNNAKSFQ

SEQ ID NO: 2240172 - protein, 22 aa, Cryptosporidium parvum
DFLRICIYLELFVQSILLSECV

SEQ ID NO: 2240173 - protein, 18 aa, Cryptosporidium parvum
DFSIWRCLYWPQIAINPI

SEQ ID NO: 2240174 - protein, 26 aa, Cryptosporidium parvum
DGGTVFKGEFPVGGPFSSPSDSSTFS

SEQ ID NO: 2240175 - protein, 20 aa, Cryptosporidium parvum
DGKWKLIAYRGITVSTISFW

SEQ ID NO: 2240176 - protein, 18 aa, Cryptosporidium parvum
DGLCSWWLNVKKINASPN

SEQ ID NO: 2240177 - protein, 22 aa, Cryptosporidium parvum
DIGPRFGVIMQIIFASSEKHRN

SEQ ID NO: 2240178 - protein, 18 aa, Cryptosporidium parvum
DIRLVGSVWLHFSVQLLD

SEQ ID NO: 2240179 - protein, 19 aa, Cryptosporidium parvum
DKLSLPILHYISIGRPFFA

SEQ ID NO: 2240180 - protein, 24 aa, Cryptosporidium parvum
DKMKRFSFRWEEQFMKYCEKVQRR

SEQ ID NO: 2240181 - protein, 24 aa, Cryptosporidium parvum
DKPGEFKWEYGILSLCLINGDWLL

SEQ ID NO: 2240182 - protein, 18 aa, Cryptosporidium parvum
DLLIPLYIGFWFINSILD

SEQ ID NO: 2240183 - protein, 22 aa, Cryptosporidium parvum
DLPEERFCWNYNFLMPLYEGGS

SEQ ID NO: 2240184 - protein, 20 aa, Cryptosporidium parvum
DLQLRISVCKMVDEDGLSNV

SEQ ID NO: 2240185 - protein, 24 aa, Cryptosporidium parvum
DLSSSKFLSCWAIFFLTTAFAAGL

SEQ ID NO: 2240186 - protein, 24 aa, Cryptosporidium parvum
DMRFYKFCLRLSCSRMLESQLAQY

SEQ ID NO: 2240187 - protein, 17 aa, Cryptosporidium parvum
DMYFCHFYKTNVELEKL

SEQ ID NO: 2240188 - protein, 19 aa, Cryptosporidium parvum
DNELGWYWYHLGIYNLILI

SEQ ID NO: 2240189 - protein, 18 aa, Cryptosporidium parvum
DPSLRYGPNVKRKTPRKR

SEQ ID NO: 2240190 - protein, 21 aa, Cryptosporidium parvum
DPTRIALRVGRILSVEKHPTA

SEQ ID NO: 2240191 - protein, 18 aa, Cryptosporidium parvum
DRIILCYTPGIDFIYSFY

SEQ ID NO: 2240192 - protein, 23 aa, Cryptosporidium parvum
DRNTLAMYMEWIWLNNHIQSVIE

SEQ ID NO: 2240193 - protein, 18 aa, Cryptosporidium parvum
DSIGMRWLIPWYLIEALL

SEQ ID NO: 2240194 - protein, 19 aa, Cryptosporidium parvum
DSKFFCWKKVRSKSSHLLN

SEQ ID NO: 2240195 - protein, 20 aa, Cryptosporidium parvum
DSLFCYLKLKKVPIPSLKKY

SEQ ID NO: 2240196 - protein, 18 aa, Cryptosporidium parvum
DSSTGFRVDSITGLPTDP

SEQ ID NO: 2240197 - protein, 21 aa, Cryptosporidium parvum
DSVYEIFKWIDSLALDKNNLI

SEQ ID NO: 2240198 - protein, 18 aa, Cryptosporidium parvum
DVHWPFTLFSLWGEPKSV

SEQ ID NO: 2240199 - protein, 19 aa, Cryptosporidium parvum
DVMNCLSWILKHYTKTSHH

SEQ ID NO: 2240200 - protein, 18 aa, Cryptosporidium parvum
DVRLFVIGVRMFRSLNSP

SEQ ID NO: 2240201 - protein, 19 aa, Cryptosporidium parvum
DYCLMCFLIRPLINSLAAR

SEQ ID NO: 2240202 - protein, 17 aa, Cryptosporidium parvum
DYLNSCLSFQCHRVREH

SEQ ID NO: 2240203 - protein, 23 aa, Cryptosporidium parvum
DYYHWWFLCIDIVFSGISISQNS

SEQ ID NO: 2240204 - protein, 18 aa, Cryptosporidium parvum
EADISYSRGRFVINVQSY

SEQ ID NO: 2240205 - protein, 23 aa, Cryptosporidium parvum
EAGLKKHRLVFCEKPESIPNMAR

SEQ ID NO: 2240206 - protein, 17 aa, Cryptosporidium parvum
ECDFSWLSNSWLNYYMN

SEQ ID NO: 2240207 - protein, 19 aa, Cryptosporidium parvum
ECFMLYKMLIGFYTATNNL

SEQ ID NO: 2240208 - protein, 18 aa, Cryptosporidium parvum
ECIDGWFKQNCVCPICRS

SEQ ID NO: 2240209 - protein, 19 aa, Cryptosporidium parvum
ECNGELAVGFFKFTMAIFD

SEQ ID NO: 2240210 - protein, 23 aa, Cryptosporidium parvum
EDCIRLSSFLTRFISDSIEIIFE

SEQ ID NO: 2240211 - protein, 22 aa, Cryptosporidium parvum
EDCLKLNFKGSLIFQNNESNKV

SEQ ID NO: 2240212 - protein, 23 aa, Cryptosporidium parvum
EDCSWSDLMVLNFFLTAFKGLAM

SEQ ID NO: 2240213 - protein, 23 aa, Cryptosporidium parvum
EDKRLPFFYTLRWYWLGVTLFST

SEQ ID NO: 2240214 - protein, 24 aa, Cryptosporidium parvum
EDLHMAIAMVCIFHLLPQGSDEFV

SEQ ID NO: 2240215 - protein, 17 aa, Cryptosporidium parvum
EDWWKRREQLFLSVDEL

SEQ ID NO: 2240216 - protein, 22 aa, Cryptosporidium parvum
EDYSAYCLRRIDGFPLSEFEAV

SEQ ID NO: 2240217 - protein, 20 aa, Cryptosporidium parvum
EECIRYIYRYGLYIYNGLIL

SEQ ID NO: 2240218 - protein, 17 aa, Cryptosporidium parvum
EEFPWSRLKYMYEKAIL

SEQ ID NO: 2240219 - protein, 19 aa, Cryptosporidium parvum
EEKAIWCFKLSIHFNPMNV

SEQ ID NO: 2240220 - protein, 21 aa, Cryptosporidium parvum
EFFFCLECIRSSKLIDTSWML

SEQ ID NO: 2240221 - protein, 18 aa, Cryptosporidium parvum
EFGWPLLFNKSWFYGDLF

SEQ ID NO: 2240222 - protein, 20 aa, Cryptosporidium parvum
EFLETVEIWSAIAGEALIFT

SEQ ID NO: 2240223 - protein, 18 aa, Cryptosporidium parvum
EFTEWKCHGGFFCAAAVY

SEQ ID NO: 2240224 - protein, 18 aa, Cryptosporidium parvum
EFVIKINLLYGLRNNVFG

SEQ ID NO: 2240225 - protein, 18 aa, Cryptosporidium parvum
EGFLKAVSKLVNIRKRVN

SEQ ID NO: 2240226 - protein, 18 aa, Cryptosporidium parvum
EGFLSKGGGFWGALNRNS

SEQ ID NO: 2240227 - protein, 19 aa, Cryptosporidium parvum
EGIIFPGWLIPGWSKLSKK

SEQ ID NO: 2240228 - protein, 19 aa, Cryptosporidium parvum
EHFGKLVVSHELCFEKNKL

SEQ ID NO: 2240229 - protein, 22 aa, Cryptosporidium parvum
EHLKRRRIDVILTIATLFGTSS

SEQ ID NO: 2240230 - protein, 18 aa, Cryptosporidium parvum
EIEDGGIIPPEVAAANAD

SEQ ID NO: 2240231 - protein, 25 aa, Cryptosporidium parvum
EIEISLICYREFIRSFVIYKQGGLK

SEQ ID NO: 2240232 - protein, 17 aa, Cryptosporidium parvum
EILKYYLGWSLSSALGS

SEQ ID NO: 2240233 - protein, 24 aa, Cryptosporidium parvum
EISIPEWRIEIIPIKTNHTIKDAN

SEQ ID NO: 2240234 - protein, 18 aa, Cryptosporidium parvum
EIWLKIIPILSIPSGNLF

SEQ ID NO: 2240235 - protein, 20 aa, Cryptosporidium parvum
EKKPTLPSSMPWAPNSSSFH

SEQ ID NO: 2240236 - protein, 23 aa, Cryptosporidium parvum
EKLSGFCLYIFTPLAILTFFKFT

SEQ ID NO: 2240237 - protein, 21 aa, Cryptosporidium parvum
EKSIKKKSSWRIHHSSENNYH

SEQ ID NO: 2240238 - protein, 21 aa, Cryptosporidium parvum
EKTFKCYRLLFIVQVICLIFS

SEQ ID NO: 2240239 - protein, 17 aa, Cryptosporidium parvum
ELFNEVYCDTCTAKYGA

SEQ ID NO: 2240240 - protein, 19 aa, Cryptosporidium parvum
ELFPSIVIVVSFWQKISPS

SEQ ID NO: 2240241 - protein, 18 aa, Cryptosporidium parvum
ELGIRECISITWREMMKS

SEQ ID NO: 2240242 - protein, 19 aa, Cryptosporidium parvum
ELHILFKRWDIRALNASNI

SEQ ID NO: 2240243 - protein, 23 aa, Cryptosporidium parvum
ELITFPFSLLFLFGISNMFVDAK

SEQ ID NO: 2240244 - protein, 24 aa, Cryptosporidium parvum
ELKHLFKIPMNYLPYIPKDTGESD

SEQ ID NO: 2240245 - protein, 18 aa, Cryptosporidium parvum
ELKPRLGTIQSNGSVFYC

SEQ ID NO: 2240246 - protein, 19 aa, Cryptosporidium parvum
ELLELLASVLCYIHPQSFG

SEQ ID NO: 2240247 - protein, 20 aa, Cryptosporidium parvum
ELLLMLSNVQLELCSAIFNS

SEQ ID NO: 2240248 - protein, 21 aa, Cryptosporidium parvum
ELLLNRISTIFSFENKHANNK

SEQ ID NO: 2240249 - protein, 23 aa, Cryptosporidium parvum
ELMYCFFCRIFIYLKKIKINNSI

SEQ ID NO: 2240250 - protein, 22 aa, Cryptosporidium parvum
ELPFWFERWLEAFNEKFNFLNH

SEQ ID NO: 2240251 - protein, 21 aa, Cryptosporidium parvum
ELSCIRKIFSLPFIAFFIYML

SEQ ID NO: 2240252 - protein, 19 aa, Cryptosporidium parvum
ELVNRITLFIDFDSDKYQF

SEQ ID NO: 2240253 - protein, 17 aa, Cryptosporidium parvum
EMLFFFKDYIENDVPLN

SEQ ID NO: 2240254 - protein, 25 aa, Cryptosporidium parvum
EMNISKFWLLIAIILIYITSLEKDV

SEQ ID NO: 2240255 - protein, 18 aa, Cryptosporidium parvum
ENIKNCWGLTWKKSNNIL

SEQ ID NO: 2240256 - protein, 20 aa, Cryptosporidium parvum
ENLYLRMIVDWMKKALKELN

SEQ ID NO: 2240257 - protein, 23 aa, Cryptosporidium parvum
ENNCFPCPIFKTGWMETNSKGDL

SEQ ID NO: 2240258 - protein, 19 aa, Cryptosporidium parvum
ENVVESFLGFASRLCTDVQ

SEQ ID NO: 2240259 - protein, 20 aa, Cryptosporidium parvum
EPFHCLYCLKRKQKGKRGRK

SEQ ID NO: 2240260 - protein, 21 aa, Cryptosporidium parvum
EPGRVPAKWGFRVGDESKRRR

SEQ ID NO: 2240261 - protein, 17 aa, Cryptosporidium parvum
EQLDLFFSYGLRKSSSN

SEQ ID NO: 2240262 - protein, 23 aa, Cryptosporidium parvum
EQSCIRYRISWFEFLIGKRDRSY

SEQ ID NO: 2240263 - protein, 18 aa, Cryptosporidium parvum
EQTIRWSIENMLSRGIIQ

SEQ ID NO: 2240264 - protein, 17 aa, Cryptosporidium parvum
ERFKIGIAIVINELENS

SEQ ID NO: 2240265 - protein, 23 aa, Cryptosporidium parvum
ERKSIKILYSWCETFEHIKEEYE

SEQ ID NO: 2240266 - protein, 17 aa, Cryptosporidium parvum
ERLRYLIFLAEVQMRRL

SEQ ID NO: 2240267 - protein, 18 aa, Cryptosporidium parvum
ERNFPVFIKRMVAQLIYL

SEQ ID NO: 2240268 - protein, 18 aa, Cryptosporidium parvum
ERRRIIGVLPQIPLLLKG

SEQ ID NO: 2240269 - protein, 22 aa, Cryptosporidium parvum
ERYAVTMLCEWNVVNTKLIPLW

SEQ ID NO: 2240270 - protein, 18 aa, Cryptosporidium parvum
ESFTRFRIIFSRERAKGL

SEQ ID NO: 2240271 - protein, 18 aa, Cryptosporidium parvum
ESIALNWNSWYFFPEQII

SEQ ID NO: 2240272 - protein, 22 aa, Cryptosporidium parvum
ESKNGLKYFCWDIQAVREIITA

SEQ ID NO: 2240273 - protein, 19 aa, Cryptosporidium parvum
ESKSDILECFIKWKNDHYY

SEQ ID NO: 2240274 - protein, 19 aa, Cryptosporidium parvum
ESSCCPLNLIRFCDNKQLL

SEQ ID NO: 2240275 - protein, 18 aa, Cryptosporidium parvum
ESYPEFLFCIPIKPASNI

SEQ ID NO: 2240276 - protein, 21 aa, Cryptosporidium parvum
ETLFSNWLRLMIAILIQDSYN

SEQ ID NO: 2240277 - protein, 17 aa, Cryptosporidium parvum
EVFKVAFMLLRKGCRMQ

SEQ ID NO: 2240278 - protein, 17 aa, Cryptosporidium parvum
EVIRPGCCVAFSIDIDG

SEQ ID NO: 2240279 - protein, 19 aa, Cryptosporidium parvum
EVMRICIVIIWTIACVVLG

SEQ ID NO: 2240280 - protein, 18 aa, Cryptosporidium parvum
FAGPRIDLQLAFDNSERF

SEQ ID NO: 2240281 - protein, 17 aa, Cryptosporidium parvum
FASLCFYFRDSVSMSCT

SEQ ID NO: 2240282 - protein, 21 aa, Cryptosporidium parvum
FAWLRLRLDFLLPVVLTSINV

SEQ ID NO: 2240283 - protein, 17 aa, Cryptosporidium parvum
FAYRFSFIVCCQLNQVI

SEQ ID NO: 2240284 - protein, 18 aa, Cryptosporidium parvum
FCCRITLVTLVFISVSLI

SEQ ID NO: 2240285 - protein, 18 aa, Cryptosporidium parvum
FCMPGFKPASLRDETCVQ

SEQ ID NO: 2240286 - protein, 22 aa, Cryptosporidium parvum
FCQEIYFPIGIIISVYCIYDSL

SEQ ID NO: 2240287 - protein, 17 aa, Cryptosporidium parvum
FDFAIAAVVHFFSIILG

SEQ ID NO: 2240288 - protein, 26 aa, Cryptosporidium parvum
FDKYGIPEYVFWIIVYTVPVLFVLLL

SEQ ID NO: 2240289 - protein, 17 aa, Cryptosporidium parvum
FDLPVFWPILLIYFIFL

SEQ ID NO: 2240290 - protein, 19 aa, Cryptosporidium parvum
FDLVLNCLSGEFIHESFKK

SEQ ID NO: 2240291 - protein, 17 aa, Cryptosporidium parvum
FDSRSWYPLGRIIGQTL

SEQ ID NO: 2240292 - protein, 22 aa, Cryptosporidium parvum
FEAFSFICLALFIADIPNSSDL

SEQ ID NO: 2240293 - protein, 18 aa, Cryptosporidium parvum
FECIKECMKRCIWTQKID

SEQ ID NO: 2240294 - protein, 18 aa, Cryptosporidium parvum
FEELRILIISPIFPEILL

SEQ ID NO: 2240295 - protein, 20 aa, Cryptosporidium parvum
FELFLSYFLEHIIKLLKIHK

SEQ ID NO: 2240296 - protein, 18 aa, Cryptosporidium parvum
FELPCMAIMSCFSPKDDL

SEQ ID NO: 2240297 - protein, 18 aa, Cryptosporidium parvum
FFEFCDFFRQLLMTPIMF

SEQ ID NO: 2240298 - protein, 24 aa, Cryptosporidium parvum
FFELFLRWIFQISLTENFEIPLTS

SEQ ID NO: 2240299 - protein, 17 aa, Cryptosporidium parvum
FFFPDSAPLSWLFFLAC

SEQ ID NO: 2240300 - protein, 22 aa, Cryptosporidium parvum
FFFRWITYYVEMEIAANYERII

SEQ ID NO: 2240301 - protein, 19 aa, Cryptosporidium parvum
FFIQEIFLSLGILIGNIEV

SEQ ID NO: 2240302 - protein, 17 aa, Cryptosporidium parvum
FFISSKCMEMFILNLQF

SEQ ID NO: 2240303 - protein, 19 aa, Cryptosporidium parvum
FFKCLKIIIDLLFNSNLFS

SEQ ID NO: 2240304 - protein, 17 aa, Cryptosporidium parvum
FFLSEVIFFELITRIQN

SEQ ID NO: 2240305 - protein, 19 aa, Cryptosporidium parvum
FFMSLPFPIPYLLILSVLH

SEQ ID NO: 2240306 - protein, 17 aa, Cryptosporidium parvum
FFSIFSVIVNYFFIFII

SEQ ID NO: 2240307 - protein, 17 aa, Cryptosporidium parvum
FFVRKGEVILRILENYY

SEQ ID NO: 2240308 - protein, 17 aa, Cryptosporidium parvum
FFYYWKFIPLTFYYNII

SEQ ID NO: 2240309 - protein, 18 aa, Cryptosporidium parvum
FGCVSKYYFFDKIVLTEE

SEQ ID NO: 2240310 - protein, 20 aa, Cryptosporidium parvum
FGGGEKVLWCIIYEVLNANI

SEQ ID NO: 2240311 - protein, 18 aa, Cryptosporidium parvum
FGLCCTRDSIILSGGGGG

SEQ ID NO: 2240312 - protein, 17 aa, Cryptosporidium parvum
FGLISINLLAIVISLYI

SEQ ID NO: 2240313 - protein, 19 aa, Cryptosporidium parvum
FGNEFLLSMGYKFDNTKLI

SEQ ID NO: 2240314 - protein, 18 aa, Cryptosporidium parvum
FGTICKFIGLPLLLGYII

SEQ ID NO: 2240315 - protein, 17 aa, Cryptosporidium parvum
FHLLKLIIGILFCQGQD

SEQ ID NO: 2240316 - protein, 17 aa, Cryptosporidium parvum
FHWRENFCRIIKEKGLS

SEQ ID NO: 2240317 - protein, 19 aa, Cryptosporidium parvum
FHYMKRFVIGLSIDKISSR

SEQ ID NO: 2240318 - protein, 25 aa, Cryptosporidium parvum
FIAIMSCYFLFIGLFEYNTRSVTFL

SEQ ID NO: 2240319 - protein, 22 aa, Cryptosporidium parvum
FIFSRNMFWLANWTGRKKLLDS

SEQ ID NO: 2240320 - protein, 20 aa, Cryptosporidium parvum
FIILCYWHTLNIFQFMYIFT

SEQ ID NO: 2240321 - protein, 17 aa, Cryptosporidium parvum
FIIPCLLIFLSDFLIPI

SEQ ID NO: 2240322 - protein, 17 aa, Cryptosporidium parvum
FILCAFNGLPLSSLSIK

SEQ ID NO: 2240323 - protein, 17 aa, Cryptosporidium parvum
FILHWSIAFIMFISTIF

SEQ ID NO: 2240324 - protein, 19 aa, Cryptosporidium parvum
FILICTYLSFFGLDGTEEN

SEQ ID NO: 2240325 - protein, 17 aa, Cryptosporidium parvum
FILKISLMLTMFFLAYS

SEQ ID NO: 2240326 - protein, 19 aa, Cryptosporidium parvum
FILNYCKKCFENIMNGESV

SEQ ID NO: 2240327 - protein, 19 aa, Cryptosporidium parvum
FIRNLKLCRLNLELEELVN

SEQ ID NO: 2240328 - protein, 17 aa, Cryptosporidium parvum
FITCLVCQICLVLSDLL

SEQ ID NO: 2240329 - protein, 25 aa, Cryptosporidium parvum
FITTCLFCLLGIIVVLYYFKEYRFY

SEQ ID NO: 2240330 - protein, 19 aa, Cryptosporidium parvum
FIYELGDFGGLIVMANDLK

SEQ ID NO: 2240331 - protein, 20 aa, Cryptosporidium parvum
FKANSFFFFSWIFMVILPLL

SEQ ID NO: 2240332 - protein, 17 aa, Cryptosporidium parvum
FKFMVHFIFSLIIFQIV

SEQ ID NO: 2240333 - protein, 25 aa, Cryptosporidium parvum
FKFPQLLYRRIISILPIMFHSSKPN

SEQ ID NO: 2240334 - protein, 20 aa, Cryptosporidium parvum
FKKEETALISFEFLGLAAMN

SEQ ID NO: 2240335 - protein, 21 aa, Cryptosporidium parvum
FKKISVIFLFIIVILLFLNFE

SEQ ID NO: 2240336 - protein, 21 aa, Cryptosporidium parvum
FKLFLFIFFLFRFRKSIIKSL

SEQ ID NO: 2240337 - protein, 17 aa, Cryptosporidium parvum
FKLFSRRLARVIFPSLH

SEQ ID NO: 2240338 - protein, 25 aa, Cryptosporidium parvum
FKLIFCILSSFLLLIKLQIFKFIGI

SEQ ID NO: 2240339 - protein, 19 aa, Cryptosporidium parvum
FKLIPSFKLFLFIFFLFRF

SEQ ID NO: 2240340 - protein, 19 aa, Cryptosporidium parvum
FKLKVVFIYDLKFQFGNNT

SEQ ID NO: 2240341 - protein, 18 aa, Cryptosporidium parvum
FKMKFSVIIAFFQMTLGV

SEQ ID NO: 2240342 - protein, 26 aa, Cryptosporidium parvum
FKRFKKRYAGVLGFAILICFLIGFYL

SEQ ID NO: 2240343 - protein, 25 aa, Cryptosporidium parvum
FKRGFLNTILFKWLSPIINSAEKGI

SEQ ID NO: 2240344 - protein, 20 aa, Cryptosporidium parvum
FKYICSWAKLLGLTISSFLF

SEQ ID NO: 2240345 - protein, 17 aa, Cryptosporidium parvum
FKYLSIWHYLRISDVSQ

SEQ ID NO: 2240346 - protein, 19 aa, Cryptosporidium parvum
FLAIISIRFLVKCCQGKET

SEQ ID NO: 2240347 - protein, 17 aa, Cryptosporidium parvum
FLDCLFCIPLFLIVLSD

SEQ ID NO: 2240348 - protein, 18 aa, Cryptosporidium parvum
FLDGILLKAIKEGHWLIL

SEQ ID NO: 2240349 - protein, 18 aa, Cryptosporidium parvum
FLFGFIVGFYRGWKMALV

SEQ ID NO: 2240350 - protein, 18 aa, Cryptosporidium parvum
FLFKCSWHPIKQNLEISA

SEQ ID NO: 2240351 - protein, 17 aa, Cryptosporidium parvum
FLFRFRKSIIKSLRDEV

SEQ ID NO: 2240352 - protein, 19 aa, Cryptosporidium parvum
FLFRNCLILIFLNDQNKIH

SEQ ID NO: 2240353 - protein, 17 aa, Cryptosporidium parvum
FLFSIFLYKSCIEHALQ

SEQ ID NO: 2240354 - protein, 17 aa, Cryptosporidium parvum
FLLSMGYKFDNTKLILD

SEQ ID NO: 2240355 - protein, 21 aa, Cryptosporidium parvum
FLPEMKRMIFGILIVITNWVC

SEQ ID NO: 2240356 - protein, 20 aa, Cryptosporidium parvum
FLQIFRYLLFYSLTLLSFSS

SEQ ID NO: 2240357 - protein, 20 aa, Cryptosporidium parvum
FLQNRLNLLASRNLLNHYVN

SEQ ID NO: 2240358 - protein, 17 aa, Cryptosporidium parvum
FLYCGYHALSIFSIVCA

SEQ ID NO: 2240359 - protein, 19 aa, Cryptosporidium parvum
FMQLFCGLFFQLSYFITFA

SEQ ID NO: 2240360 - protein, 25 aa, Cryptosporidium parvum
FNCGFCYTMMGLLFAWGYPPIINNT

SEQ ID NO: 2240361 - protein, 23 aa, Cryptosporidium parvum
FNECFRFPVVVPIVEDIIILKLW

SEQ ID NO: 2240362 - protein, 18 aa, Cryptosporidium parvum
FNIWRFLLSTAILLVSIF

SEQ ID NO: 2240363 - protein, 17 aa, Cryptosporidium parvum
FNNILAIVILSFAWYCL

SEQ ID NO: 2240364 - protein, 26 aa, Cryptosporidium parvum
FPGEIPGAALLRKRVYRRLNNIEDIV

SEQ ID NO: 2240365 - protein, 19 aa, Cryptosporidium parvum
FPIAIYRPGRIGGNSITGA

SEQ ID NO: 2240366 - protein, 19 aa, Cryptosporidium parvum
FPICKSLGWEAFFMFTVPV

SEQ ID NO: 2240367 - protein, 17 aa, Cryptosporidium parvum
FPIEIQVVNWKRIPTMY

SEQ ID NO: 2240368 - protein, 22 aa, Cryptosporidium parvum
FPIERWCIGDTWPINNPKISVG

SEQ ID NO: 2240369 - protein, 17 aa, Cryptosporidium parvum
FPILILITISNSSFKIR

SEQ ID NO: 2240370 - protein, 20 aa, Cryptosporidium parvum
FPITVLMQFLSCIAPIGYGM

SEQ ID NO: 2240371 - protein, 18 aa, Cryptosporidium parvum
FPNFYRWMNFKASTISEC

SEQ ID NO: 2240372 - protein, 18 aa, Cryptosporidium parvum
FPVGIPCLDDRIVLELWD

SEQ ID NO: 2240373 - protein, 17 aa, Cryptosporidium parvum
FPVSFGIPVITLQKLNV

SEQ ID NO: 2240374 - protein, 17 aa, Cryptosporidium parvum
FQFSRLYFKLARGDCRI

SEQ ID NO: 2240375 - protein, 17 aa, Cryptosporidium parvum
FRAFLSYFLPMVYGISL

SEQ ID NO: 2240376 - protein, 19 aa, Cryptosporidium parvum
FREKEVRGFLLGRQEMEGE

SEQ ID NO: 2240377 - protein, 17 aa, Cryptosporidium parvum
FRGVGILALICLLYFSL

SEQ ID NO: 2240378 - protein, 19 aa, Cryptosporidium parvum
FRHFPLRRSFVFELMDHVN

SEQ ID NO: 2240379 - protein, 17 aa, Cryptosporidium parvum
FRIACQFSLIKCTLANI

SEQ ID NO: 2240380 - protein, 19 aa, Cryptosporidium parvum
FRIILCSSILKIIDSHTLQ

SEQ ID NO: 2240381 - protein, 17 aa, Cryptosporidium parvum
FRIVLVGRKIRGLGKLY

SEQ ID NO: 2240382 - protein, 22 aa, Cryptosporidium parvum
FRKVGSCILGIFLFMIHNFVPD

SEQ ID NO: 2240383 - protein, 17 aa, Cryptosporidium parvum
FRLLSAIALSKLVPYCH

SEQ ID NO: 2240384 - protein, 19 aa, Cryptosporidium parvum
FRLPIVFNEASGIIVFGDK

SEQ ID NO: 2240385 - protein, 17 aa, Cryptosporidium parvum
FRMILVITMLTRTMGDS

SEQ ID NO: 2240386 - protein, 17 aa, Cryptosporidium parvum
FRPKSCFPCDKYLELKC

SEQ ID NO: 2240387 - protein, 17 aa, Cryptosporidium parvum
FRSIFCLCREGSANHGI

SEQ ID NO: 2240388 - protein, 19 aa, Cryptosporidium parvum
FSAFCHYHGLLVGSGPGAG

SEQ ID NO: 2240389 - protein, 19 aa, Cryptosporidium parvum
FSAHEFLNFIIINYGLFNT

SEQ ID NO: 2240390 - protein, 17 aa, Cryptosporidium parvum
FSFERLDYVLAHCKSNL

SEQ ID NO: 2240391 - protein, 17 aa, Cryptosporidium parvum
FSFIFLKFHSFWMERKP

SEQ ID NO: 2240392 - protein, 17 aa, Cryptosporidium parvum
FSFIFSLMNGFIMDKIG

SEQ ID NO: 2240393 - protein, 17 aa, Cryptosporidium parvum
FSFLIKFLFGYRYRDLK

SEQ ID NO: 2240394 - protein, 17 aa, Cryptosporidium parvum
FSKRLKYVYLYHRVEIK

SEQ ID NO: 2240395 - protein, 17 aa, Cryptosporidium parvum
FSLYEGYTWDNLEVTSK

SEQ ID NO: 2240396 - protein, 22 aa, Cryptosporidium parvum
FSRSDWVLAFFYRYMQWGFHVA

SEQ ID NO: 2240397 - protein, 17 aa, Cryptosporidium parvum
FSRYRLGSNEFKILPTN

SEQ ID NO: 2240398 - protein, 18 aa, Cryptosporidium parvum
FSSNLKCLFCFNKEDYNS

SEQ ID NO: 2240399 - protein, 19 aa, Cryptosporidium parvum
FTHEMLRRFLALAKITIPN

SEQ ID NO: 2240400 - protein, 18 aa, Cryptosporidium parvum
FTILLSRIIYWYSTTKLY

SEQ ID NO: 2240401 - protein, 17 aa, Cryptosporidium parvum
FTLEIFQNIILITSFHS

SEQ ID NO: 2240402 - protein, 22 aa, Cryptosporidium parvum
FTQIRGSIPLFWEQTGVNSCAI

SEQ ID NO: 2240403 - protein, 17 aa, Cryptosporidium parvum
FVWKIILFFIIWKSRND

SEQ ID NO: 2240404 - protein, 17 aa, Cryptosporidium parvum
FWFWFPLVHCISLSYVP

SEQ ID NO: 2240405 - protein, 17 aa, Cryptosporidium parvum
FWNEFIFCLALKALMVV

SEQ ID NO: 2240406 - protein, 29 aa, Cryptosporidium parvum
FYIRRISCLPIFWCSHDPWIPSGTIRSII

SEQ ID NO: 2240407 - protein, 18 aa, Cryptosporidium parvum
FYKYRLLIRLILNKERII

SEQ ID NO: 2240408 - protein, 17 aa, Cryptosporidium parvum
FYLLESIGHQMAPSVKI

SEQ ID NO: 2240409 - protein, 17 aa, Cryptosporidium parvum
FYLYARWTLYFNTQVIA

SEQ ID NO: 2240410 - protein, 18 aa, Cryptosporidium parvum
FYSHFRWLKGEYIKKKRF

SEQ ID NO: 2240411 - protein, 19 aa, Cryptosporidium parvum
FYSRIRIILRLSCAISPNW

SEQ ID NO: 2240412 - protein, 22 aa, Cryptosporidium parvum
FYYLQLCKRLSLGADFTMTSLI

SEQ ID NO: 2240413 - protein, 17 aa, Cryptosporidium parvum
GCLLCFKLSTIDKIIFS

SEQ ID NO: 2240414 - protein, 17 aa, Cryptosporidium parvum
GDFSIRFFSIFSVIVNY

SEQ ID NO: 2240415 - protein, 17 aa, Cryptosporidium parvum
GDHVWGFARGCFKSQLV

SEQ ID NO: 2240416 - protein, 21 aa, Cryptosporidium parvum
GDSPLHWAVRLELPKVVHRLV

SEQ ID NO: 2240417 - protein, 17 aa, Cryptosporidium parvum
GECPLRRVIYGFMTKIR

SEQ ID NO: 2240418 - protein, 23 aa, Cryptosporidium parvum
GEESHHLRKSCSFLVDEFFRSEL

SEQ ID NO: 2240419 - protein, 19 aa, Cryptosporidium parvum
GESSHVWGVLLARSLPAWD

SEQ ID NO: 2240420 - protein, 25 aa, Cryptosporidium parvum
GEVGLRLAAIYMYRFICQSNLVCGY

SEQ ID NO: 2240421 - protein, 24 aa, Cryptosporidium parvum
GFAILICFLIGFYLILFSAKHPTS

SEQ ID NO: 2240422 - protein, 18 aa, Cryptosporidium parvum
GFAVAFSLFSWICTLFVC

SEQ ID NO: 2240423 - protein, 25 aa, Cryptosporidium parvum
GFEHLWKKRVVYLLKMQSVNAVLFL

SEQ ID NO: 2240424 - protein, 20 aa, Cryptosporidium parvum
GFGPWFSFFYYWKFIPLTFY

SEQ ID NO: 2240425 - protein, 19 aa, Cryptosporidium parvum
GFVFESCIKIIWSLQLSIW

SEQ ID NO: 2240426 - protein, 25 aa, Cryptosporidium parvum
GHVFHLDCLKSWFIQQQTCPICRAP

SEQ ID NO: 2240427 - protein, 20 aa, Cryptosporidium parvum
GIFFKMNFLLGQSLILVGIY

SEQ ID NO: 2240428 - protein, 19 aa, Cryptosporidium parvum
GIFKICLLLNFLIISGVLS

SEQ ID NO: 2240429 - protein, 19 aa, Cryptosporidium parvum
GIHKLRFLPAIIYIESTKQ

SEQ ID NO: 2240430 - protein, 25 aa, Cryptosporidium parvum
GIHLKREWHRLWLVRSFLAFAWESY

SEQ ID NO: 2240431 - protein, 19 aa, Cryptosporidium parvum
GIPNFSLRTFSSCLSYIRT

SEQ ID NO: 2240432 - protein, 17 aa, Cryptosporidium parvum
GKETIVWYDAIAGNNIV

SEQ ID NO: 2240433 - protein, 17 aa, Cryptosporidium parvum
GKKEWKNICVASIKELE

SEQ ID NO: 2240434 - protein, 23 aa, Cryptosporidium parvum
GKPMILCPYRWTKLQNIIQKINI

SEQ ID NO: 2240435 - protein, 17 aa, Cryptosporidium parvum
GLCPWGWEYISGGKVNS

SEQ ID NO: 2240436 - protein, 22 aa, Cryptosporidium parvum
GLCSSAVEWERFLILVNKKDFL

SEQ ID NO: 2240437 - protein, 19 aa, Cryptosporidium parvum
GLGSRLRARWLLSEPENEE

SEQ ID NO: 2240438 - protein, 26 aa, Cryptosporidium parvum
GLLGGLGYGLKRKRTRGGDLTGDSIG

SEQ ID NO: 2240439 - protein, 24 aa, Cryptosporidium parvum
GLPVDPKTGFPIDPISYLPFAKNG

SEQ ID NO: 2240440 - protein, 20 aa, Cryptosporidium parvum
GLRIFWKGPIHTVPTINLTL

SEQ ID NO: 2240441 - protein, 19 aa, Cryptosporidium parvum
GNFGKIWLWLVKLLNKNSP

SEQ ID NO: 2240442 - protein, 24 aa, Cryptosporidium parvum
GNLHSGAICSICLTVCFSPFGLYG

SEQ ID NO: 2240443 - protein, 22 aa, Cryptosporidium parvum
GNLPLEVGFTFSFPIVQSKIAS

SEQ ID NO: 2240444 - protein, 17 aa, Cryptosporidium parvum
GNPRGSIDYIWYGAILQ

SEQ ID NO: 2240445 - protein, 18 aa, Cryptosporidium parvum
GPAILLRWFQASYFLQLI

SEQ ID NO: 2240446 - protein, 19 aa, Cryptosporidium parvum
GPIKFCIVCGENIQINSDF

SEQ ID NO: 2240447 - protein, 17 aa, Cryptosporidium parvum
GQFCMGMVYTLFPFLDS

SEQ ID NO: 2240448 - protein, 22 aa, Cryptosporidium parvum
GQMSLRLGIVVNLLYGNQSVLV

SEQ ID NO: 2240449 - protein, 19 aa, Cryptosporidium parvum
GRGAFWWSAYYGNIKQIQI

SEQ ID NO: 2240450 - protein, 20 aa, Cryptosporidium parvum
GRIPIPIKFGFGPLFDSVFQ

SEQ ID NO: 2240451 - protein, 20 aa, Cryptosporidium parvum
GRSSIPFGIIPDLNFHLRRY

SEQ ID NO: 2240452 - protein, 21 aa, Cryptosporidium parvum
GRTFNCFCGYGIGLVDLTAID

SEQ ID NO: 2240453 - protein, 19 aa, Cryptosporidium parvum
GSKVYIPYTKCVGVKHTTT

SEQ ID NO: 2240454 - protein, 17 aa, Cryptosporidium parvum
GSLGWGFYLLLLANSLL

SEQ ID NO: 2240455 - protein, 17 aa, Cryptosporidium parvum
GSLILWDSLFCYLKLKK

SEQ ID NO: 2240456 - protein, 23 aa, Cryptosporidium parvum
GSRINSLRRLRGLSEDNSQDVEE

SEQ ID NO: 2240457 - protein, 22 aa, Cryptosporidium parvum
GSTFRYKKLVGMLLESRGEIEK

SEQ ID NO: 2240458 - protein, 17 aa, Cryptosporidium parvum
GSVPYVSLYVKEKNIVT

SEQ ID NO: 2240459 - protein, 22 aa, Cryptosporidium parvum
GSWIQWLFKFHRISSVPLNSAD

SEQ ID NO: 2240460 - protein, 17 aa, Cryptosporidium parvum
GTILSIFTRHVYKVRSE

SEQ ID NO: 2240461 - protein, 19 aa, Cryptosporidium parvum
GVDFFKLLFENILKLFEDY

SEQ ID NO: 2240462 - protein, 21 aa, Cryptosporidium parvum
GVGKHGCKAQHYWYFREKTSD

SEQ ID NO: 2240463 - protein, 23 aa, Cryptosporidium parvum
GYGKMRIALCLNKIITSLQEKNQ

SEQ ID NO: 2240464 - protein, 17 aa, Cryptosporidium parvum
GYIKLRGSYLLRLLHSL

SEQ ID NO: 2240465 - protein, 24 aa, Cryptosporidium parvum
HEIEKRLGIVIARDEVMSMVYIML

SEQ ID NO: 2240466 - protein, 21 aa, Cryptosporidium parvum
HFYCIKFLWKFLPLTSTKDFL

SEQ ID NO: 2240467 - protein, 19 aa, Cryptosporidium parvum
HGKPVDWWTLGILIYEMVV

SEQ ID NO: 2240468 - protein, 17 aa, Cryptosporidium parvum
HHCPWLGVCIGEYNRCK

SEQ ID NO: 2240469 - protein, 17 aa, Cryptosporidium parvum
HIEEVLLIIAYEIFGME

SEQ ID NO: 2240470 - protein, 20 aa, Cryptosporidium parvum
HIPIRMSMEGAKLVRVHPEK

SEQ ID NO: 2240471 - protein, 26 aa, Cryptosporidium parvum
HKSTGLPIDPMVGLPFDPKSGNLVHP

SEQ ID NO: 2240472 - protein, 17 aa, Cryptosporidium parvum
HLFQFTRFYPLTVSFLH

SEQ ID NO: 2240473 - protein, 20 aa, Cryptosporidium parvum
HLPWRFLVYKALNTFIDDIF

SEQ ID NO: 2240474 - protein, 17 aa, Cryptosporidium parvum
HMIPLALCFIGMVSLSN

SEQ ID NO: 2240475 - protein, 20 aa, Cryptosporidium parvum
HPNIKFRLLSAIALSKLVPY

SEQ ID NO: 2240476 - protein, 17 aa, Cryptosporidium parvum
HSNWGYFRSIFITSDGI

SEQ ID NO: 2240477 - protein, 18 aa, Cryptosporidium parvum
HSRILFKIIMSIYNNENI

SEQ ID NO: 2240478 - protein, 24 aa, Cryptosporidium parvum
HSVWPRILFIQSIIIGRFKFLDDY

SEQ ID NO: 2240479 - protein, 19 aa, Cryptosporidium parvum
HVLSFPMSYIFFSTYGRKF

SEQ ID NO: 2240480 - protein, 18 aa, Cryptosporidium parvum
HWYCLGLHKDNIPSENEP

SEQ ID NO: 2240481 - protein, 17 aa, Cryptosporidium parvum
HYFEFLDGILLKAIKEG

SEQ ID NO: 2240482 - protein, 25 aa, Cryptosporidium parvum
IACSKIILWFVHFFRGFNGDEHISE

SEQ ID NO: 2240483 - protein, 19 aa, Cryptosporidium parvum
IAEFLIYYRFREVIRDKDD

SEQ ID NO: 2240484 - protein, 19 aa, Cryptosporidium parvum
IAFCYRISSVFLISKLNSL

SEQ ID NO: 2240485 - protein, 21 aa, Cryptosporidium parvum
IAIKHGFDLIPIYIAGAKDGT

SEQ ID NO: 2240486 - protein, 20 aa, Cryptosporidium parvum
IALIPRYAKRFGFKSRRDEV

SEQ ID NO: 2240487 - protein, 24 aa, Cryptosporidium parvum
IARYLKCVIMFKSIKEYSGNNNIC

SEQ ID NO: 2240488 - protein, 17 aa, Cryptosporidium parvum
IAVIFGCVSKYYFFDKI

SEQ ID NO: 2240489 - protein, 25 aa, Cryptosporidium parvum
ICDESFCIKSLFGIRTTESMITIEN

SEQ ID NO: 2240490 - protein, 23 aa, Cryptosporidium parvum
ICKYFWKPIDLFRDVLAIVTISF

SEQ ID NO: 2240491 - protein, 20 aa, Cryptosporidium parvum
ICLAFFKWTYLVRRDERMNL

SEQ ID NO: 2240492 - protein, 24 aa, Cryptosporidium parvum
ICLKLGWRSVFYIPSIFVFLFGII

SEQ ID NO: 2240493 - protein, 17 aa, Cryptosporidium parvum
ICRESCPAFLSLKEVFQ

SEQ ID NO: 2240494 - protein, 17 aa, Cryptosporidium parvum
IDILKLWSIGSESTVLS

SEQ ID NO: 2240495 - protein, 17 aa, Cryptosporidium parvum
IDITGKETIVWYDAIAG

SEQ ID NO: 2240496 - protein, 19 aa, Cryptosporidium parvum
IDLQLAFDNSERFILVYQH

SEQ ID NO: 2240497 - protein, 17 aa, Cryptosporidium parvum
IDPIFTCLVTVKLSNLI

SEQ ID NO: 2240498 - protein, 17 aa, Cryptosporidium parvum
IDPYSLWMLVDYRWGWP

SEQ ID NO: 2240499 - protein, 25 aa, Cryptosporidium parvum
IDSLFSLKHSFLWPHNNATLISAIS

SEQ ID NO: 2240500 - protein, 17 aa, Cryptosporidium parvum
IEDFEHWFISNKCPYFI

SEQ ID NO: 2240501 - protein, 21 aa, Cryptosporidium parvum
IEDFSKLLLCFEINVEDLFYN

SEQ ID NO: 2240502 - protein, 20 aa, Cryptosporidium parvum
IEEFEIFKSSFLGLGKKFLN

SEQ ID NO: 2240503 - protein, 18 aa, Cryptosporidium parvum
IEEVCNFIKIILAKITID

SEQ ID NO: 2240504 - protein, 23 aa, Cryptosporidium parvum
IEFWARDRPDLISAPSLGLDPDS

SEQ ID NO: 2240505 - protein, 17 aa, Cryptosporidium parvum
IELSGRFLLRLKEINYL

SEQ ID NO: 2240506 - protein, 19 aa, Cryptosporidium parvum
IENALRLSQAWDFVNSFRD

SEQ ID NO: 2240507 - protein, 17 aa, Cryptosporidium parvum
IEPFKGSLGWGFYLLLL

SEQ ID NO: 2240508 - protein, 24 aa, Cryptosporidium parvum
IEYSSEFFPRFSWSKNDTFGAFTT

SEQ ID NO: 2240509 - protein, 17 aa, Cryptosporidium parvum
IFCELFSFIFLKFHSFW

SEQ ID NO: 2240510 - protein, 17 aa, Cryptosporidium parvum
IFCVIVFFFLSDGDFSF

SEQ ID NO: 2240511 - protein, 22 aa, Cryptosporidium parvum
IFEAICVLSVLIISMYTSLGVF

SEQ ID NO: 2240512 - protein, 22 aa, Cryptosporidium parvum
IFEILKGLIILLFFVKQRKRLC

SEQ ID NO: 2240513 - protein, 17 aa, Cryptosporidium parvum
IFFAMAITLPCFLIIWC

SEQ ID NO: 2240514 - protein, 18 aa, Cryptosporidium parvum
IFFLNSMICFYRCSGSFL

SEQ ID NO: 2240515 - protein, 17 aa, Cryptosporidium parvum
IFFLVYFFIYGGFVYSF

SEQ ID NO: 2240516 - protein, 20 aa, Cryptosporidium parvum
IFKMQIFNPVKWYKKQEAIR

SEQ ID NO: 2240517 - protein, 21 aa, Cryptosporidium parvum
IFKSRINPLIKYFDIKPEISD

SEQ ID NO: 2240518 - protein, 25 aa, Cryptosporidium parvum
IFKYYCLRYPCLINYLFKLYSRIVD

SEQ ID NO: 2240519 - protein, 19 aa, Cryptosporidium parvum
IFLFSCSLCSIVFTQTVSN

SEQ ID NO: 2240520 - protein, 17 aa, Cryptosporidium parvum
IFLLRLIALYSEKNEQK

SEQ ID NO: 2240521 - protein, 21 aa, Cryptosporidium parvum
IFMPWKIAFNGVEWMESYTVE

SEQ ID NO: 2240522 - protein, 18 aa, Cryptosporidium parvum
IFNWELLKNIWLPFRLIS

SEQ ID NO: 2240523 - protein, 21 aa, Cryptosporidium parvum
IFPSKCLFKLFPIIMQSVGQV

SEQ ID NO: 2240524 - protein, 18 aa, Cryptosporidium parvum
IFQRKYWPVFIGTIPICD

SEQ ID NO: 2240525 - protein, 18 aa, Cryptosporidium parvum
IFSLEYFKQIGFKKDYEN

SEQ ID NO: 2240526 - protein, 17 aa, Cryptosporidium parvum
IFSYLSIIEKSELNINS

SEQ ID NO: 2240527 - protein, 20 aa, Cryptosporidium parvum
IFTFKLKFFLGTMIFQNIRS

SEQ ID NO: 2240528 - protein, 21 aa, Cryptosporidium parvum
IFVSRLSKIYIILTLTISSLS

SEQ ID NO: 2240529 - protein, 24 aa, Cryptosporidium parvum
IFYLLFKDCRGIVLSSFDHYKINK

SEQ ID NO: 2240530 - protein, 17 aa, Cryptosporidium parvum
IGDTWPINNPKISVGQI

SEQ ID NO: 2240531 - protein, 24 aa, Cryptosporidium parvum
IGIAFRIPFKWLPSASEKLSFLSK

SEQ ID NO: 2240532 - protein, 17 aa, Cryptosporidium parvum
IGIIVPEGFWVAEQRGT

SEQ ID NO: 2240533 - protein, 23 aa, Cryptosporidium parvum
IGLNRLGGFIGFMSLIVLVIIVI

SEQ ID NO: 2240534 - protein, 24 aa, Cryptosporidium parvum
IGNAKLWWRYAIGCIIRDRRADIS

SEQ ID NO: 2240535 - protein, 17 aa, Cryptosporidium parvum
IGVGCLLCFKLSTIDKI

SEQ ID NO: 2240536 - protein, 17 aa, Cryptosporidium parvum
IGVSGWIPMISHLSLGK

SEQ ID NO: 2240537 - protein, 23 aa, Cryptosporidium parvum
IGYRCFIEAGMLRSFVFSILPSN

SEQ ID NO: 2240538 - protein, 25 aa, Cryptosporidium parvum
IHCIQARIAILSGIIWGLGIVFAGK

SEQ ID NO: 2240539 - protein, 19 aa, Cryptosporidium parvum
IHVVYCLLCEAPLVEIFQQ

SEQ ID NO: 2240540 - protein, 17 aa, Cryptosporidium parvum
IHYLKRRINMLSTTKRY

SEQ ID NO: 2240541 - protein, 17 aa, Cryptosporidium parvum
IICCMIGFFLINSLGNF

SEQ ID NO: 2240542 - protein, 19 aa, Cryptosporidium parvum
IIDMPWMHRMACFRDDIIF

SEQ ID NO: 2240543 - protein, 19 aa, Cryptosporidium parvum
IIGGFCFCGATGANRNHGN

SEQ ID NO: 2240544 - protein, 17 aa, Cryptosporidium parvum
IIIIDFIFRRFGALTLF

SEQ ID NO: 2240545 - protein, 18 aa, Cryptosporidium parvum
IIIISSILPRLIHFLGAS

SEQ ID NO: 2240546 - protein, 24 aa, Cryptosporidium parvum
IIILKEIWIGMGIKNLLLINILRN

SEQ ID NO: 2240547 - protein, 18 aa, Cryptosporidium parvum
IIIMCLRHIITLYTLSRF

SEQ ID NO: 2240548 - protein, 19 aa, Cryptosporidium parvum
IILRLSCAISPNWLQVLYH

SEQ ID NO: 2240549 - protein, 17 aa, Cryptosporidium parvum
IILSWILNGCSPYLSLS

SEQ ID NO: 2240550 - protein, 18 aa, Cryptosporidium parvum
IIPFSWRIEFVIICLTTM

SEQ ID NO: 2240551 - protein, 22 aa, Cryptosporidium parvum
IIRELYRYRGLRTFWTGLLPTM

SEQ ID NO: 2240552 - protein, 20 aa, Cryptosporidium parvum
IISNRISYVFGLKGPSITID

SEQ ID NO: 2240553 - protein, 24 aa, Cryptosporidium parvum
IITSPPWWMVWQSQFYPRLSIEKN

SEQ ID NO: 2240554 - protein, 17 aa, Cryptosporidium parvum
IKDFILFPARITCDVPS

SEQ ID NO: 2240555 - protein, 21 aa, Cryptosporidium parvum
IKELPFMLAIEPPSTNCVPIK

SEQ ID NO: 2240556 - protein, 21 aa, Cryptosporidium parvum
IKFANSFPIIFEKLIPEYCIA

SEQ ID NO: 2240557 - protein, 17 aa, Cryptosporidium parvum
IKGFKMVKYRGKYGPGH

SEQ ID NO: 2240558 - protein, 17 aa, Cryptosporidium parvum
IKIVELKLGFLLQLAFF

SEQ ID NO: 2240559 - protein, 20 aa, Cryptosporidium parvum
IKPLLIRWIIFVIRLHKFSG

SEQ ID NO: 2240560 - protein, 19 aa, Cryptosporidium parvum
IKVELKLSAVWTIFDSIHG

SEQ ID NO: 2240561 - protein, 18 aa, Cryptosporidium parvum
IKYIKLRLSKLIEINLKV

SEQ ID NO: 2240562 - protein, 24 aa, Cryptosporidium parvum
ILAFSILCLVFWYNLMKVTNVEFS

SEQ ID NO: 2240563 - protein, 17 aa, Cryptosporidium parvum
ILARILLCLTTIPRLSF

SEQ ID NO: 2240564 - protein, 17 aa, Cryptosporidium parvum
ILFELFLSYFLEHIIKL

SEQ ID NO: 2240565 - protein, 24 aa, Cryptosporidium parvum
ILFKRLVRILACLNSSITNQSVCL

SEQ ID NO: 2240566 - protein, 17 aa, Cryptosporidium parvum
ILGCFSIDCLALKKNNL

SEQ ID NO: 2240567 - protein, 17 aa, Cryptosporidium parvum
ILGRLALMFKDSIREFS

SEQ ID NO: 2240568 - protein, 18 aa, Cryptosporidium parvum
ILHICVFTGPIISSLTAL

SEQ ID NO: 2240569 - protein, 17 aa, Cryptosporidium parvum
ILIDLGYFYYLYMLCLT

SEQ ID NO: 2240570 - protein, 19 aa, Cryptosporidium parvum
ILIELPLALLHIFQLYPHF

SEQ ID NO: 2240571 - protein, 17 aa, Cryptosporidium parvum
ILIGFIFIIGILGAFFY

SEQ ID NO: 2240572 - protein, 20 aa, Cryptosporidium parvum
ILKKDSFMLLSFVPIPTTAI

SEQ ID NO: 2240573 - protein, 25 aa, Cryptosporidium parvum
ILKPIPIQLFISWKLENHEFNNIKS

SEQ ID NO: 2240574 - protein, 21 aa, Cryptosporidium parvum
ILKSLRPSLDFGENTSHHIPI

SEQ ID NO: 2240575 - protein, 22 aa, Cryptosporidium parvum
ILLEAFTSWSLVLFSIIICAFL

SEQ ID NO: 2240576 - protein, 18 aa, Cryptosporidium parvum
ILLEKGLHEILKFNPNIE

SEQ ID NO: 2240577 - protein, 19 aa, Cryptosporidium parvum
ILLPLRKGYQIDFSGTKTR

SEQ ID NO: 2240578 - protein, 22 aa, Cryptosporidium parvum
ILNGAFCTRGFFIGSIINVHVI

SEQ ID NO: 2240579 - protein, 18 aa, Cryptosporidium parvum
ILPPLSLGCFEELSSPET

SEQ ID NO: 2240580 - protein, 17 aa, Cryptosporidium parvum
ILPRFYRYLGLYYSLIC

SEQ ID NO: 2240581 - protein, 18 aa, Cryptosporidium parvum
ILQEIKLFINYFKDVKDS

SEQ ID NO: 2240582 - protein, 22 aa, Cryptosporidium parvum
ILRYRPDFRIHLAEFFRVPINF

SEQ ID NO: 2240583 - protein, 18 aa, Cryptosporidium parvum
ILSLGWRGPFYIFGLIGV

SEQ ID NO: 2240584 - protein, 18 aa, Cryptosporidium parvum
ILSRDILIEFARKEKDTI

SEQ ID NO: 2240585 - protein, 21 aa, Cryptosporidium parvum
ILTWLIVLIVMKFSKKLQHYV

SEQ ID NO: 2240586 - protein, 22 aa, Cryptosporidium parvum
IMGLCIFVRLFAVVRYEAIIHE

SEQ ID NO: 2240587 - protein, 18 aa, Cryptosporidium parvum
IMRGFSILIHHILVRSYN

SEQ ID NO: 2240588 - protein, 17 aa, Cryptosporidium parvum
IMVGLHILVGTGIAVAS

SEQ ID NO: 2240589 - protein, 21 aa, Cryptosporidium parvum
INCIFSLKLSEMISNMSLFSK

SEQ ID NO: 2240590 - protein, 17 aa, Cryptosporidium parvum
INFILLWLRFGEIPLEG

SEQ ID NO: 2240591 - protein, 17 aa, Cryptosporidium parvum
INIIGIFNVWNFKKNSP

SEQ ID NO: 2240592 - protein, 22 aa, Cryptosporidium parvum
INIKTWFFWIVYSFLVFIIYFS

SEQ ID NO: 2240593 - protein, 17 aa, Cryptosporidium parvum
INLKKYFRFTAVELTDF

SEQ ID NO: 2240594 - protein, 20 aa, Cryptosporidium parvum
INMFSLCIVCKLYTEISICQ

SEQ ID NO: 2240595 - protein, 24 aa, Cryptosporidium parvum
INRFGIVAVPSFRFFRNGKMYTYT

SEQ ID NO: 2240596 - protein, 19 aa, Cryptosporidium parvum
INSCFSFFVLISFFIINYQ

SEQ ID NO: 2240597 - protein, 20 aa, Cryptosporidium parvum
IPAYCLRPLCQHILPSFHDA

SEQ ID NO: 2240598 - protein, 20 aa, Cryptosporidium parvum
IPCLEWTSTMSYTFTPYFFD

SEQ ID NO: 2240599 - protein, 17 aa, Cryptosporidium parvum
IPFRMILVITMLTRTMG

SEQ ID NO: 2240600 - protein, 21 aa, Cryptosporidium parvum
IPGSLPGSLNYPSFNTPQQTD

SEQ ID NO: 2240601 - protein, 20 aa, Cryptosporidium parvum
IPIEIWWKIFDFLDNNSLSQ

SEQ ID NO: 2240602 - protein, 17 aa, Cryptosporidium parvum
IPINFLWVIPLGTLPSP

SEQ ID NO: 2240603 - protein, 21 aa, Cryptosporidium parvum
IPLRWISFFLFKWRLELDESF

SEQ ID NO: 2240604 - protein, 27 aa, Cryptosporidium parvum
IPNPLLFLRCLCGWLLIQSIIKEFEQN

SEQ ID NO: 2240605 - protein, 22 aa, Cryptosporidium parvum
IPPICLFAWFWLFQYYRHASRE

SEQ ID NO: 2240606 - protein, 19 aa, Cryptosporidium parvum
IPRFARFDLKIAVSFQTHS

SEQ ID NO: 2240607 - protein, 17 aa, Cryptosporidium parvum
IPSGVTIFFIFVVFSFA

SEQ ID NO: 2240608 - protein, 17 aa, Cryptosporidium parvum
IPSRCILLIYIGLSSPV

SEQ ID NO: 2240609 - protein, 19 aa, Cryptosporidium parvum
IPVIIQFLLSIAIPSKNEF

SEQ ID NO: 2240610 - protein, 18 aa, Cryptosporidium parvum
IPVPDWMRPLLFTKSPNE

SEQ ID NO: 2240611 - protein, 18 aa, Cryptosporidium parvum
IQILESFLGYSLDYIISK

SEQ ID NO: 2240612 - protein, 18 aa, Cryptosporidium parvum
IRCSCRYCENCRKIQKIC

SEQ ID NO: 2240613 - protein, 21 aa, Cryptosporidium parvum
IRFPTIGSFFSWLGSFNSLYV

SEQ ID NO: 2240614 - protein, 17 aa, Cryptosporidium parvum
IRIGNCIGIDNFKYELT

SEQ ID NO: 2240615 - protein, 25 aa, Cryptosporidium parvum
IRIQRLEIFDGLYLFFNTNDQIIPR

SEQ ID NO: 2240616 - protein, 17 aa, Cryptosporidium parvum
IRKGRIESIGYFKPLKV

SEQ ID NO: 2240617 - protein, 21 aa, Cryptosporidium parvum
IRLNFKYSPKFIVEVFLNSLD

SEQ ID NO: 2240618 - protein, 17 aa, Cryptosporidium parvum
IRLSCSFGNKKNIELEL

SEQ ID NO: 2240619 - protein, 19 aa, Cryptosporidium parvum
IRLTLKMIYELSVFANHSS

SEQ ID NO: 2240620 - protein, 18 aa, Cryptosporidium parvum
IRNFCLFSAASIIFTYLY

SEQ ID NO: 2240621 - protein, 20 aa, Cryptosporidium parvum
IRYIISIIFYFIWGIELTPK

SEQ ID NO: 2240622 - protein, 22 aa, Cryptosporidium parvum
ISAHIGSLLAWLFQNMAQHVEQ

SEQ ID NO: 2240623 - protein, 20 aa, Cryptosporidium parvum
ISEIYLRYLYACRIILYSKN

SEQ ID NO: 2240624 - protein, 19 aa, Cryptosporidium parvum
ISHFIRISLLYSIDNQNNS

SEQ ID NO: 2240625 - protein, 17 aa, Cryptosporidium parvum
ISKKLRGIYAFPYIVSR

SEQ ID NO: 2240626 - protein, 19 aa, Cryptosporidium parvum
ISLIRRLRYISSLKLDIFR

SEQ ID NO: 2240627 - protein, 19 aa, Cryptosporidium parvum
ISLMLTMFFLAYSLKKFKE

SEQ ID NO: 2240628 - protein, 23 aa, Cryptosporidium parvum
ISLWKTIFPWIWNNLEHQQRNEL

SEQ ID NO: 2240629 - protein, 23 aa, Cryptosporidium parvum
ISLWLECFFLCFFYRSTKSSFEQ

SEQ ID NO: 2240630 - protein, 19 aa, Cryptosporidium parvum
ISNEWWKIHKLESVFKGVE

SEQ ID NO: 2240631 - protein, 17 aa, Cryptosporidium parvum
ISNVFSRIFLSYYNVCK

SEQ ID NO: 2240632 - protein, 21 aa, Cryptosporidium parvum
ISQLYLKFSLIWKPYTDILIK

SEQ ID NO: 2240633 - protein, 21 aa, Cryptosporidium parvum
ISRLEKILLFEVFSIGDEIRD

SEQ ID NO: 2240634 - protein, 25 aa, Cryptosporidium parvum
ISVRCRKGAGKLEFPDRSLDFTIPP

SEQ ID NO: 2240635 - protein, 26 aa, Cryptosporidium parvum
ISWIGFKISFFIPRTSISWIHQNELV

SEQ ID NO: 2240636 - protein, 18 aa, Cryptosporidium parvum
ITCSLLSLRSMEFLISIL

SEQ ID NO: 2240637 - protein, 17 aa, Cryptosporidium parvum
ITFPRYVLWELIFTSRW

SEQ ID NO: 2240638 - protein, 19 aa, Cryptosporidium parvum
ITMIKLRFKYIFDSINRKI

SEQ ID NO: 2240639 - protein, 21 aa, Cryptosporidium parvum
IVDIFEPWRAIFLGGVTTIYI

SEQ ID NO: 2240640 - protein, 18 aa, Cryptosporidium parvum
IVIQCYFRRYLCKKYLYF

SEQ ID NO: 2240641 - protein, 19 aa, Cryptosporidium parvum
IVSDLFSPIGMNWISTVSP

SEQ ID NO: 2240642 - protein, 19 aa, Cryptosporidium parvum
IVSMCLIELTNIYDILELE

SEQ ID NO: 2240643 - protein, 18 aa, Cryptosporidium parvum
IVYLLPLWFDLMRLPDKI

SEQ ID NO: 2240644 - protein, 17 aa, Cryptosporidium parvum
IWHYLRISDVSQIVNSQ

SEQ ID NO: 2240645 - protein, 19 aa, Cryptosporidium parvum
IYDEWRKLLYISFKYEDPT

SEQ ID NO: 2240646 - protein, 24 aa, Cryptosporidium parvum
IYIIFCFICALAVLIVINNEEAKY

SEQ ID NO: 2240647 - protein, 17 aa, Cryptosporidium parvum
IYKFKWVLIYLILLIFS

SEQ ID NO: 2240648 - protein, 18 aa, Cryptosporidium parvum
IYMLGIIMFWIWSDGGIW

SEQ ID NO: 2240649 - protein, 22 aa, Cryptosporidium parvum
IYRRKYDVFPFLKFKLNNKRSK

SEQ ID NO: 2240650 - protein, 19 aa, Cryptosporidium parvum
KARILCAFELVKIGDMMGN

SEQ ID NO: 2240651 - protein, 21 aa, Cryptosporidium parvum
KASISIRLYYFILRIVIIIGT

SEQ ID NO: 2240652 - protein, 22 aa, Cryptosporidium parvum
KCCCWHCCCIRLSKKVCNGYVK

SEQ ID NO: 2240653 - protein, 22 aa, Cryptosporidium parvum
KCHGGFFCAAAVYIAEDYIDSI

SEQ ID NO: 2240654 - protein, 17 aa, Cryptosporidium parvum
KCIYKNPFFYSFFPINS

SEQ ID NO: 2240655 - protein, 17 aa, Cryptosporidium parvum
KCKPFRWFLDNVAPETY

SEQ ID NO: 2240656 - protein, 20 aa, Cryptosporidium parvum
KCLPFSCLFILQILVALATI

SEQ ID NO: 2240657 - protein, 20 aa, Cryptosporidium parvum
KCQICNVIICSICNNMYQYG

SEQ ID NO: 2240658 - protein, 19 aa, Cryptosporidium parvum
KCTKFLLSMDTWLDESTIN

SEQ ID NO: 2240659 - protein, 23 aa, Cryptosporidium parvum
KDFLLKFVNICFTNVIGSSLFRR

SEQ ID NO: 2240660 - protein, 20 aa, Cryptosporidium parvum
KDGGLPCIVWLLLAIVHCSV

SEQ ID NO: 2240661 - protein, 19 aa, Cryptosporidium parvum
KDVYIKWIWNNDDSANNNC

SEQ ID NO: 2240662 - protein, 18 aa, Cryptosporidium parvum
KEALERCLLLIENGNDYI

SEQ ID NO: 2240663 - protein, 21 aa, Cryptosporidium parvum
KEARSAILLGLRVNKSSLILW

SEQ ID NO: 2240664 - protein, 19 aa, Cryptosporidium parvum
KEIFQLMIFIAQTCPYYYK

SEQ ID NO: 2240665 - protein, 29 aa, Cryptosporidium parvum
KEKECLRCKLPPVPDCSWIMKALYMNDLQ

SEQ ID NO: 2240666 - protein, 21 aa, Cryptosporidium parvum
KELLPRIACLIILRKLVRSEQ

SEQ ID NO: 2240667 - protein, 21 aa, Cryptosporidium parvum
KELRKPFFASFKYFKKKKNEL

SEQ ID NO: 2240668 - protein, 17 aa, Cryptosporidium parvum
KELRWNFYWCIMTLLCL

SEQ ID NO: 2240669 - protein, 20 aa, Cryptosporidium parvum
KEMLRISGIITVGVVRTIGN

SEQ ID NO: 2240670 - protein, 20 aa, Cryptosporidium parvum
KENFPLYLLGGIFELMLDDL

SEQ ID NO: 2240671 - protein, 17 aa, Cryptosporidium parvum
KERMKGILFKILISEQI

SEQ ID NO: 2240672 - protein, 19 aa, Cryptosporidium parvum
KFANCFISSFSGPFMLFYS

SEQ ID NO: 2240673 - protein, 18 aa, Cryptosporidium parvum
KFEFPLDGLCSWWLNVKK

SEQ ID NO: 2240674 - protein, 18 aa, Cryptosporidium parvum
KFIGLPLLLGYIIGGYVV

SEQ ID NO: 2240675 - protein, 22 aa, Cryptosporidium parvum
KFKPFCFIEIPLINAGNLFTSQ

SEQ ID NO: 2240676 - protein, 20 aa, Cryptosporidium parvum
KFQLSLNNLEIWFHRDNKKE

SEQ ID NO: 2240677 - protein, 18 aa, Cryptosporidium parvum
KFRIRAMFANRQLKRIFH

SEQ ID NO: 2240678 - protein, 22 aa, Cryptosporidium parvum
KFRPQIMPIILKWSKGESFASI

SEQ ID NO: 2240679 - protein, 34 aa, Cryptosporidium parvum
KGIKLASRCPIWFEYFCLILWRLLPIFEQSIPVS

SEQ ID NO: 2240680 - protein, 17 aa, Cryptosporidium parvum
KGILFKILISEQIKEIV

SEQ ID NO: 2240681 - protein, 17 aa, Cryptosporidium parvum
KGILRKYLKSIGISNPI

SEQ ID NO: 2240682 - protein, 22 aa, Cryptosporidium parvum
KGKEIFSNYGFLIVERYKYFSR

SEQ ID NO: 2240683 - protein, 17 aa, Cryptosporidium parvum
KGLFSPEFWDFIDSCLT

SEQ ID NO: 2240684 - protein, 18 aa, Cryptosporidium parvum
KGVIPIHLACKIQDFDIL

SEQ ID NO: 2240685 - protein, 20 aa, Cryptosporidium parvum
KHNVCITCSLLSLRSMEFLI

SEQ ID NO: 2240686 - protein, 21 aa, Cryptosporidium parvum
KIFSLIFFFFNILNLLNGEEI

SEQ ID NO: 2240687 - protein, 18 aa, Cryptosporidium parvum
KIFWLKNIQYYWNKRINM

SEQ ID NO: 2240688 - protein, 18 aa, Cryptosporidium parvum
KIGRWDLLDIFNKNLLII

SEQ ID NO: 2240689 - protein, 18 aa, Cryptosporidium parvum
KIIRLEVLLNSFLLKRLL

SEQ ID NO: 2240690 - protein, 19 aa, Cryptosporidium parvum
KIKEILCMESFLDLQFSII

SEQ ID NO: 2240691 - protein, 19 aa, Cryptosporidium parvum
KIKSPICLKKQLRRILDLS

SEQ ID NO: 2240692 - protein, 20 aa, Cryptosporidium parvum
KIKVVKLMPIWSIRNKSNFN

SEQ ID NO: 2240693 - protein, 19 aa, Cryptosporidium parvum
KILFKREKFSLLYSFTSGI

SEQ ID NO: 2240694 - protein, 17 aa, Cryptosporidium parvum
KILKIDPIFTCLVTVKL

SEQ ID NO: 2240695 - protein, 19 aa, Cryptosporidium parvum
KINTIWAIFRVQFLVLLLF

SEQ ID NO: 2240696 - protein, 22 aa, Cryptosporidium parvum
KIPRIYVIFIIFIIFFSNVECL

SEQ ID NO: 2240697 - protein, 18 aa, Cryptosporidium parvum
KISVFNWFTFIIFVIYIL

SEQ ID NO: 2240698 - protein, 19 aa, Cryptosporidium parvum
KIVTCYKVNLLVALLICFL

SEQ ID NO: 2240699 - protein, 17 aa, Cryptosporidium parvum
KIYASICGLLLGSVPST

SEQ ID NO: 2240700 - protein, 19 aa, Cryptosporidium parvum
KKARISFTFNTLDKLIISQ

SEQ ID NO: 2240701 - protein, 25 aa, Cryptosporidium parvum
KKGNFLLEWLREMKTFIPSNHFVFD

SEQ ID NO: 2240702 - protein, 17 aa, Cryptosporidium parvum
KKIEDFAPFAFFTTSKG

SEQ ID NO: 2240703 - protein, 20 aa, Cryptosporidium parvum
KKIRSGGTFIELGKRETLDY

SEQ ID NO: 2240704 - protein, 17 aa, Cryptosporidium parvum
KKLPVSYAFHSVMFSEI

SEQ ID NO: 2240705 - protein, 17 aa, Cryptosporidium parvum
KKLRGIYAFPYIVSRRI

SEQ ID NO: 2240706 - protein, 24 aa, Cryptosporidium parvum
KKMYRQMGNWGIFLGMFLAIVRII

SEQ ID NO: 2240707 - protein, 18 aa, Cryptosporidium parvum
KKREEIYIIHPLLKSISL

SEQ ID NO: 2240708 - protein, 23 aa, Cryptosporidium parvum
KKSFFKFEFKLEIENGIFGFTSH

SEQ ID NO: 2240709 - protein, 23 aa, Cryptosporidium parvum
KKSWRCILEINLLQQPPVINPFS

SEQ ID NO: 2240710 - protein, 20 aa, Cryptosporidium parvum
KKWLCGLGVHYVSSSRDHKI

SEQ ID NO: 2240711 - protein, 20 aa, Cryptosporidium parvum
KLELCGGCIEHFILAFQMIS

SEQ ID NO: 2240712 - protein, 18 aa, Cryptosporidium parvum
KLFLPDWSPLGGFLLVIV

SEQ ID NO: 2240713 - protein, 21 aa, Cryptosporidium parvum
KLGESWWKLGAIERSQSVYSK

SEQ ID NO: 2240714 - protein, 20 aa, Cryptosporidium parvum
KLGLNIQLFWFLRLNSLKFD

SEQ ID NO: 2240715 - protein, 17 aa, Cryptosporidium parvum
KLIGVGCLLCFKLSTID

SEQ ID NO: 2240716 - protein, 20 aa, Cryptosporidium parvum
KLIIILIEWILKNYLIHNEI

SEQ ID NO: 2240717 - protein, 18 aa, Cryptosporidium parvum
KLKKGDCVLIHVASGGVG

SEQ ID NO: 2240718 - protein, 22 aa, Cryptosporidium parvum
KLKRFFAEFIIRMEDFDVSVIP

SEQ ID NO: 2240719 - protein, 20 aa, Cryptosporidium parvum
KLKWSWTIALFILCYSKTMF

SEQ ID NO: 2240720 - protein, 18 aa, Cryptosporidium parvum
KLLACSDLGISMHYSSSG

SEQ ID NO: 2240721 - protein, 18 aa, Cryptosporidium parvum
KLLTCIKLAFNTKISKFY

SEQ ID NO: 2240722 - protein, 18 aa, Cryptosporidium parvum
KLPIKFPLAMHKINIENF

SEQ ID NO: 2240723 - protein, 24 aa, Cryptosporidium parvum
KLRSTMKWMACIEISLAVCSCCFA

SEQ ID NO: 2240724 - protein, 18 aa, Cryptosporidium parvum
KLSLFFFNSMGIRLFPNP

SEQ ID NO: 2240725 - protein, 24 aa, Cryptosporidium parvum
KLWITFILLCFFSVWISILESGIL

SEQ ID NO: 2240726 - protein, 17 aa, Cryptosporidium parvum
KLYKILRKMLIKFYIEE

SEQ ID NO: 2240727 - protein, 22 aa, Cryptosporidium parvum
KLYRISVEIERDWFQIYNVDME

SEQ ID NO: 2240728 - protein, 17 aa, Cryptosporidium parvum
KLYRVASFLSFLSLMTL

SEQ ID NO: 2240729 - protein, 18 aa, Cryptosporidium parvum
KLYWKLMLTCGVATICTL

SEQ ID NO: 2240730 - protein, 18 aa, Cryptosporidium parvum
KMIKGFVFESCIKIIWSL

SEQ ID NO: 2240731 - protein, 24 aa, Cryptosporidium parvum
KMIKRIGLKLGVEIGGPILILKNE

SEQ ID NO: 2240732 - protein, 19 aa, Cryptosporidium parvum
KMVKYRGKYGPGHFVSMDD

SEQ ID NO: 2240733 - protein, 17 aa, Cryptosporidium parvum
KNCSFYSIWQEFTDQVN

SEQ ID NO: 2240734 - protein, 24 aa, Cryptosporidium parvum
KNDMLKFIPLRAVINNVWLESVIR

SEQ ID NO: 2240735 - protein, 20 aa, Cryptosporidium parvum
KNFFLRISLRNQNTIQTLET

SEQ ID NO: 2240736 - protein, 23 aa, Cryptosporidium parvum
KNHYKCSFSFNFNECILTISQEF

SEQ ID NO: 2240737 - protein, 19 aa, Cryptosporidium parvum
KNNCELLIFTSFRFYVYIL

SEQ ID NO: 2240738 - protein, 22 aa, Cryptosporidium parvum
KNNEFRSSGILEYISPYSPLII

SEQ ID NO: 2240739 - protein, 18 aa, Cryptosporidium parvum
KNSISFNNLWFKDEEIIE

SEQ ID NO: 2240740 - protein, 20 aa, Cryptosporidium parvum
KNSKCLKSKMTINMNSSSHI

SEQ ID NO: 2240741 - protein, 20 aa, Cryptosporidium parvum
KPDFFYAFNSMPGWIQNRFI

SEQ ID NO: 2240742 - protein, 23 aa, Cryptosporidium parvum
KPFLKRVNSIYSMSALILLAPTP

SEQ ID NO: 2240743 - protein, 21 aa, Cryptosporidium parvum
KPICIPNLFFGIELPKIIYQN

SEQ ID NO: 2240744 - protein, 17 aa, Cryptosporidium parvum
KPITRWILPSGFEPQYF

SEQ ID NO: 2240745 - protein, 19 aa, Cryptosporidium parvum
KPLLCYPIWGRDKEDSTSL

SEQ ID NO: 2240746 - protein, 18 aa, Cryptosporidium parvum
KQIYCFICTSNIINALSE

SEQ ID NO: 2240747 - protein, 17 aa, Cryptosporidium parvum
KQRRFKNEISRCCEKFN

SEQ ID NO: 2240748 - protein, 20 aa, Cryptosporidium parvum
KRFSSLYIRNPWGYTLNNIL

SEQ ID NO: 2240749 - protein, 19 aa, Cryptosporidium parvum
KRGIRCFAWVCNNEKEMNI

SEQ ID NO: 2240750 - protein, 18 aa, Cryptosporidium parvum
KRGWKLILHRFIWEYKLS

SEQ ID NO: 2240751 - protein, 21 aa, Cryptosporidium parvum
KRGYCILFMRLLEIPGESVPI

SEQ ID NO: 2240752 - protein, 17 aa, Cryptosporidium parvum
KRIDIINSLFIELTKGF

SEQ ID NO: 2240753 - protein, 22 aa, Cryptosporidium parvum
KRINFTILICFLILSFLEALKS

SEQ ID NO: 2240754 - protein, 17 aa, Cryptosporidium parvum
KRIPSGVTIFFIFVVFS

SEQ ID NO: 2240755 - protein, 25 aa, Cryptosporidium parvum
KRKYMYWIWRRWRYLLSAKERMPIL

SEQ ID NO: 2240756 - protein, 33 aa, Cryptosporidium parvum; identical to SEQ ID NO: 2129334

SEQ ID NO: 2240757 - protein, 24 aa, Cryptosporidium parvum
KRRARKIMTKKGLSLLIKEFNTSK

SEQ ID NO: 2240758 - protein, 19 aa, Cryptosporidium parvum
KRRVIDLIMEFPRSKSSIL

SEQ ID NO: 2240759 - protein, 19 aa, Cryptosporidium parvum
KRTGYRPVPGVLIYPQNFR

SEQ ID NO: 2240760 - protein, 21 aa, Cryptosporidium parvum
KSELKFTWLGWLSFGRDQETG

SEQ ID NO: 2240761 - protein, 23 aa, Cryptosporidium parvum
KSEMSNVIMLYGFLETIEIKMNT

SEQ ID NO: 2240762 - protein, 24 aa, Cryptosporidium parvum
KSFIGRLFINICSFDDAKSYYSAM

SEQ ID NO: 2240763 - protein, 22 aa, Cryptosporidium parvum
KSGFIFFQWYFWYCLESRRYPS

SEQ ID NO: 2240764 - protein, 20 aa, Cryptosporidium parvum
KSIIFPKNWFNGIKSTENSL

SEQ ID NO: 2240765 - protein, 24 aa, Cryptosporidium parvum
KSILFKCFIVFAMNIFLKPYKHLL

SEQ ID NO: 2240766 - protein, 18 aa, Cryptosporidium parvum
KSKECPFCKNTIETLFFT

SEQ ID NO: 2240767 - protein, 17 aa, Cryptosporidium parvum
KSLSIEEFEIFKSSFLG

SEQ ID NO: 2240768 - protein, 24 aa, Cryptosporidium parvum
KSTFSWKIMSIFSFLKLKKPKYAP

SEQ ID NO: 2240769 - protein, 18 aa, Cryptosporidium parvum
KTNFCFLSELDLAFCVCI

SEQ ID NO: 2240770 - protein, 22 aa, Cryptosporidium parvum
KTPRKRIIPIFIKNRTPRKASN

SEQ ID NO: 2240771 - protein, 19 aa, Cryptosporidium parvum
KTRICIARTLYFFFSNMDS

SEQ ID NO: 2240772 - protein, 18 aa, Cryptosporidium parvum
KVIFPWSMGNRVPINSVS

SEQ ID NO: 2240773 - protein, 17 aa, Cryptosporidium parvum
KVLDCFKSIPLSDIIEN

SEQ ID NO: 2240774 - protein, 23 aa, Cryptosporidium parvum
KVPEYRVLLIIPDEFYLTIAEVE

SEQ ID NO: 2240775 - protein, 21 aa, Cryptosporidium parvum
KVPICQLCGYDAYCRSGGIMK

SEQ ID NO: 2240776 - protein, 17 aa, Cryptosporidium parvum
KVVTCIFAINCMFRNAA

SEQ ID NO: 2240777 - protein, 24 aa, Cryptosporidium parvum
KWSIYRLVFIYSFLLIMYQFLDIL

SEQ ID NO: 2240778 - protein, 20 aa, Cryptosporidium parvum
KWVSNLWINYGLPTIMDSEN

SEQ ID NO: 2240779 - protein, 17 aa, Cryptosporidium parvum
KYFSGSIAGFISGKAGS

SEQ ID NO: 2240780 - protein, 20 aa, Cryptosporidium parvum
KYICIFSFKVIMFRFFLLIS

SEQ ID NO: 2240781 - protein, 24 aa, Cryptosporidium parvum
KYKILCHLWIFRFIMSIAAISFPG

SEQ ID NO: 2240782 - protein, 20 aa, Cryptosporidium parvum
KYKKSMWLFFGIGIVQMTLS

SEQ ID NO: 2240783 - protein, 23 aa, Cryptosporidium parvum
KYLCYKYKFMLVPSMLILVIKNE

SEQ ID NO: 2240784 - protein, 21 aa, Cryptosporidium parvum
KYTSLPLDWIFKGLKNQSYDH

SEQ ID NO: 2240785 - protein, 17 aa, Cryptosporidium parvum
LAFNIGMRFIPNMKNKL

SEQ ID NO: 2240786 - protein, 22 aa, Cryptosporidium parvum
LAFSKSRFNGFSKWLQEDLASP

SEQ ID NO: 2240787 - protein, 23 aa, Cryptosporidium parvum
LAICLSRATGLWSHLDTVERLAS

SEQ ID NO: 2240788 - protein, 24 aa, Cryptosporidium parvum
LASIKPILARKGSKIVHMSQKSIS

SEQ ID NO: 2240789 - protein, 19 aa, Cryptosporidium parvum
LCEEWPSLLVIDFLEYYAS

SEQ ID NO: 2240790 - protein, 19 aa, Cryptosporidium parvum
LCGYDAYCRSGGIMKKTVD

SEQ ID NO: 2240791 - protein, 17 aa, Cryptosporidium parvum
LCIRVCLTSASLCFSGS

SEQ ID NO: 2240792 - protein, 18 aa, Cryptosporidium parvum
LCKVWLLSPFNALDVLLT

SEQ ID NO: 2240793 - protein, 18 aa, Cryptosporidium parvum
LCLWRLNIANLKEFLMND

SEQ ID NO: 2240794 - protein, 19 aa, Cryptosporidium parvum
LCTLPFPGNDNWLLRRAFL

SEQ ID NO: 2240795 - protein, 19 aa, Cryptosporidium parvum
LCYTVHLLALISHISAHIG

SEQ ID NO: 2240796 - protein, 21 aa, Cryptosporidium parvum
LDAWFKMRIKILLTIPITLIN

SEQ ID NO: 2240797 - protein, 23 aa, Cryptosporidium parvum
LDCLRLPVCYSFTTLNTRQQLFF

SEQ ID NO: 2240798 - protein, 18 aa, Cryptosporidium parvum
LDESIPIVLALPVTACLD

SEQ ID NO: 2240799 - protein, 17 aa, Cryptosporidium parvum
LDIRKALIHFFDRIKQY

SEQ ID NO: 2240800 - protein, 17 aa, Cryptosporidium parvum
LDKYTRMIYDYNSGLLL

SEQ ID NO: 2240801 - protein, 17 aa, Cryptosporidium parvum
LDLTTLPIRLWKSYRFE

SEQ ID NO: 2240802 - protein, 19 aa, Cryptosporidium parvum
LDMEGRFVLISAMTNFLGY

SEQ ID NO: 2240803 - protein, 18 aa, Cryptosporidium parvum
LDYGIKPWFLFSVSSVNS

SEQ ID NO: 2240804 - protein, 19 aa, Cryptosporidium parvum
LEFSNWLLTNWVFRTISNL

SEQ ID NO: 2240805 - protein, 17 aa, Cryptosporidium parvum
LEFYFKLKFIIHLIYSF

SEQ ID NO: 2240806 - protein, 18 aa, Cryptosporidium parvum
LEHLRIIFFSIFLNGLSR

SEQ ID NO: 2240807 - protein, 21 aa, Cryptosporidium parvum
LEIRTPFYLFILHTLRQHGVE

SEQ ID NO: 2240808 - protein, 22 aa, Cryptosporidium parvum
LEKLEPRASISLAKTRTKGTGW

SEQ ID NO: 2240809 - protein, 17 aa, Cryptosporidium parvum
LEPRIQLILSEQRQISQ

SEQ ID NO: 2240810 - protein, 23 aa, Cryptosporidium parvum
LEQRCGFSMDRVCSSGVKTDLII

SEQ ID NO: 2240811 - protein, 23 aa, Cryptosporidium parvum
LERLRTTFLISLNISKSVLEVDE

SEQ ID NO: 2240812 - protein, 25 aa, Cryptosporidium parvum
LFEIREMVFWFSPFMQISMPLSSDL

SEQ ID NO: 2240813 - protein, 17 aa, Cryptosporidium parvum
LFKEMKSPIVGVGDICF

SEQ ID NO: 2240814 - protein, 20 aa, Cryptosporidium parvum
LFNILCEWCDYFGPNIMTIF

SEQ ID NO: 2240815 - protein, 18 aa, Cryptosporidium parvum
LFNLKSFVFVAALHGGLK

SEQ ID NO: 2240816 - protein, 17 aa, Cryptosporidium parvum
LFNPCWTFTLSSKTDIF

SEQ ID NO: 2240817 - protein, 21 aa, Cryptosporidium parvum
LFPKRIIQLLNHIILSNQRQR

SEQ ID NO: 2240818 - protein, 18 aa, Cryptosporidium parvum
LFSLWLFVQKRLTTIQIA

SEQ ID NO: 2240819 - protein, 19 aa, Cryptosporidium parvum
LFSVCAIRFHAEWLDIVKF

SEQ ID NO: 2240820 - protein, 20 aa, Cryptosporidium parvum
LFTFRVRIFLAFSLFIAIVF

SEQ ID NO: 2240821 - protein, 17 aa, Cryptosporidium parvum
LGIWFPFYRIHNSMNSI

SEQ ID NO: 2240822 - protein, 17 aa, Cryptosporidium parvum
LGPEARLLLAWQSVVEA

SEQ ID NO: 2240823 - protein, 21 aa, Cryptosporidium parvum
LGRWFKFLNIKAINFNGFHQA

SEQ ID NO: 2240824 - protein, 21 aa, Cryptosporidium parvum
LHNFWKVVIGFIMSVLSGISI

SEQ ID NO: 2240825 - protein, 23 aa, Cryptosporidium parvum
LIDWKDLKKFGVIYILTENFKFQ

SEQ ID NO: 2240826 - protein, 17 aa, Cryptosporidium parvum
LIELSVNFILFLTSLLA

SEQ ID NO: 2240827 - protein, 17 aa, Cryptosporidium parvum
LIEPGGLICKPLVEDYY

SEQ ID NO: 2240828 - protein, 17 aa, Cryptosporidium parvum
LIFPFFLSWTVVGTVWL

SEQ ID NO: 2240829 - protein, 18 aa, Cryptosporidium parvum
LIIKLFLLLIAFIIFYVI

SEQ ID NO: 2240830 - protein, 17 aa, Cryptosporidium parvum
LIIRTGKLLSFSRNHPI

SEQ ID NO: 2240831 - protein, 19 aa, Cryptosporidium parvum
LILKSFYILHIWKVKDHSL

SEQ ID NO: 2240832 - protein, 25 aa, Cryptosporidium parvum
LILLILMFCCVFFLRRRSDDTESAQ

SEQ ID NO: 2240833 - protein, 18 aa, Cryptosporidium parvum
LILQELLCLFKRTTSPYI

SEQ ID NO: 2240834 - protein, 25 aa, Cryptosporidium parvum
LILTFKWELFIIFSLVVLADTCLLA

SEQ ID NO: 2240835 - protein, 24 aa, Cryptosporidium parvum
LINYWLGICPIELIIHEVFLIQNI

SEQ ID NO: 2240836 - protein, 23 aa, Cryptosporidium parvum
LIPELRTGPLFTYIAPLLLVLSI

SEQ ID NO: 2240837 - protein, 21 aa, Cryptosporidium parvum
LIQRLKIWLTPLLLFHDLISS

SEQ ID NO: 2240838 - protein, 19 aa, Cryptosporidium parvum
LIRISFWYEWIMIKIHLQL

SEQ ID NO: 2240839 - protein, 24 aa, Cryptosporidium parvum
LIRMRYPRCEGSTMRYFFVDTRSD

SEQ ID NO: 2240840 - protein, 21 aa, Cryptosporidium parvum
LIRRKAARIVNIFYGPSLNEL

SEQ ID NO: 2240841 - protein, 19 aa, Cryptosporidium parvum
LISKAVMFSSLFVRKLNES

SEQ ID NO: 2240842 - protein, 17 aa, Cryptosporidium parvum
LIVVFSIIIHSNRWLQD

SEQ ID NO: 2240843 - protein, 24 aa, Cryptosporidium parvum
LIYVYVCTYWGLFYFKIPKKYGIY

SEQ ID NO: 2240844 - protein, 31 aa, Cryptosporidium parvum
LKAYKPRAYFGFNCIIDFYYYLSHSWRSSAF

SEQ ID NO: 2240845 - protein, 17 aa, Cryptosporidium parvum
LKELSAMFWNNKYIGDF

SEQ ID NO: 2240846 - protein, 23 aa, Cryptosporidium parvum
LKFAAEVFLAFDIIKILTTAMSE

SEQ ID NO: 2240847 - protein, 20 aa, Cryptosporidium parvum
LKFFILFIFFVYLKTRHDLI

SEQ ID NO: 2240848 - protein, 18 aa, Cryptosporidium parvum
LKFSIGWLTCPSILISRI

SEQ ID NO: 2240849 - protein, 18 aa, Cryptosporidium parvum
LKIAVNIIREGKFDPYSS

SEQ ID NO: 2240850 - protein, 20 aa, Cryptosporidium parvum
LKIEILKLLILLVKNKYSLE

SEQ ID NO: 2240851 - protein, 17 aa, Cryptosporidium parvum
LKIILSILSKDISKDYK

SEQ ID NO: 2240852 - protein, 22 aa, Cryptosporidium parvum
LKISIFCWYFFEKLERWLSTFD

SEQ ID NO: 2240853 - protein, 17 aa, Cryptosporidium parvum
LKKGDRIILCYTPGIDF

SEQ ID NO: 2240854 - protein, 27 aa, Cryptosporidium parvum
LKLKKCFKMFLSVCGTSLSAIFGFFKT

SEQ ID NO: 2240855 - protein, 19 aa, Cryptosporidium parvum
LKLLFYFTVTALIYNKANA

SEQ ID NO: 2240856 - protein, 22 aa, Cryptosporidium parvum
LKLSCPTIFFKVCELMCSIEDY

SEQ ID NO: 2240857 - protein, 20 aa, Cryptosporidium parvum
LKQYRFFSIYALKCLKNQVN

SEQ ID NO: 2240858 - protein, 20 aa, Cryptosporidium parvum
LKSAISLPWGIIFENKNFLK

SEQ ID NO: 2240859 - protein, 17 aa, Cryptosporidium parvum
LKSELYVALGFGFYSHA

SEQ ID NO: 2240860 - protein, 20 aa, Cryptosporidium parvum
LKSKCIWKSVRMINIPKEAN

SEQ ID NO: 2240861 - protein, 20 aa, Cryptosporidium parvum
LKSSHFWKGGGYWLAGSGGL

SEQ ID NO: 2240862 - protein, 22 aa, Cryptosporidium parvum
LKVASLCPACFCRPLSGIQSFV

SEQ ID NO: 2240863 - protein, 20 aa, Cryptosporidium parvum
LKVRLLKPFYSWRATAAHGV

SEQ ID NO: 2240864 - protein, 18 aa, Cryptosporidium parvum
LKWKTEFPSVISRQHLIS

SEQ ID NO: 2240865 - protein, 18 aa, Cryptosporidium parvum
LKYAFAFILFLQFIVLLM

SEQ ID NO: 2240866 - protein, 21 aa, Cryptosporidium parvum
LKYVIGMLLGVFFGIWILSIC

SEQ ID NO: 2240867 - protein, 17 aa, Cryptosporidium parvum
LKYVYLYHRVEIKCILF

SEQ ID NO: 2240868 - protein, 17 aa, Cryptosporidium parvum
LLCALLFIGEAIGGVKA

SEQ ID NO: 2240869 - protein, 19 aa, Cryptosporidium parvum
LLCRLFFLYRGLRLTEERN

SEQ ID NO: 2240870 - protein, 18 aa, Cryptosporidium parvum
LLEASFCRLPIRMLIHSA

SEQ ID NO: 2240871 - protein, 22 aa, Cryptosporidium parvum
LLEIRIGFRAARYFHNSLLLGY

SEQ ID NO: 2240872 - protein, 22 aa, Cryptosporidium parvum
LLFKDLKRWLALLWTTIESFHL

SEQ ID NO: 2240873 - protein, 23 aa, Cryptosporidium parvum
LLIFPIRFLLTWILLKEHVGSVA

SEQ ID NO: 2240874 - protein, 18 aa, Cryptosporidium parvum
LLILRTYIWLHFPVFPGF

SEQ ID NO: 2240875 - protein, 23 aa, Cryptosporidium parvum
LLIRYFPDWEVALALSICLAIGR

SEQ ID NO: 2240876 - protein, 17 aa, Cryptosporidium parvum
LLKESYIILALMELLFG

SEQ ID NO: 2240877 - protein, 23 aa, Cryptosporidium parvum
LLKLLRLLLEFTKEYGYIKDIES

SEQ ID NO: 2240878 - protein, 18 aa, Cryptosporidium parvum
LLLCLNLNMGTVRPFVNA

SEQ ID NO: 2240879 - protein, 18 aa, Cryptosporidium parvum
LLLSFGLVAIQVYYIKSY

SEQ ID NO: 2240880 - protein, 18 aa, Cryptosporidium parvum
LLMNCIMYLLSHYYRKVS

SEQ ID NO: 2240881 - protein, 17 aa, Cryptosporidium parvum
LLMPRIYTLFIHILGLR

SEQ ID NO: 2240882 - protein, 20 aa, Cryptosporidium parvum
LLRNVCKYMHLVFVLDLGSL

SEQ ID NO: 2240883 - protein, 20 aa, Cryptosporidium parvum
LLSIGFKFKEKILIGNSDLE

SEQ ID NO: 2240884 - protein, 21 aa, Cryptosporidium parvum
LLTCLLGCFIFGNTVTDKLLL

SEQ ID NO: 2240885 - protein, 23 aa, Cryptosporidium parvum
LLTFKILFCIGTKQIFPIGCPLN

SEQ ID NO: 2240886 - protein, 18 aa, Cryptosporidium parvum
LLYFKTLFVVLYIFPETG

SEQ ID NO: 2240887 - protein, 24 aa, Cryptosporidium parvum
LMFSRLRFANWVLGIVVYAGTDTK

SEQ ID NO: 2240888 - protein, 28 aa, Cryptosporidium parvum
LMGIFRFKLCYVWKFSILNSYCLAIINN

SEQ ID NO: 2240889 - protein, 17 aa, Cryptosporidium parvum
LMVCHWLLFDSIQCIIT

SEQ ID NO: 2240890 - protein, 21 aa, Cryptosporidium parvum
LNDRLKVILIYKHANKNYFSF

SEQ ID NO: 2240891 - protein, 18 aa, Cryptosporidium parvum
LNEFPILILITISNSSFK

SEQ ID NO: 2240892 - protein, 17 aa, Cryptosporidium parvum
LNFTMMWLQYCGLSPLL

SEQ ID NO: 2240893 - protein, 22 aa, Cryptosporidium parvum
LNHIMLWFGLIIFWAITQIYGK

SEQ ID NO: 2240894 - protein, 24 aa, Cryptosporidium parvum
LNHSLKFLSEWSFDVSIRVVIEKT

SEQ ID NO: 2240895 - protein, 19 aa, Cryptosporidium parvum
LNIFYKLIVVFSIIIHSNR

SEQ ID NO: 2240896 - protein, 24 aa, Cryptosporidium parvum
LNISLHCNFTWSCIRNIFESNIRR

SEQ ID NO: 2240897 - protein, 18 aa, Cryptosporidium parvum
LNLGIILKFFSAMASQGY

SEQ ID NO: 2240898 - protein, 18 aa, Cryptosporidium parvum
LNYHNGWRYSLLAPCLLL

SEQ ID NO: 2240899 - protein, 17 aa, Cryptosporidium parvum
LPEYAVKGTESYADGFS

SEQ ID NO: 2240900 - protein, 25 aa, Cryptosporidium parvum
LPFYFACWFHFKYGKLIIGNSVSKT

SEQ ID NO: 2240901 - protein, 22 aa, Cryptosporidium parvum
LPGDDCIGGWLPPPVAIPCPSH

SEQ ID NO: 2240902 - protein, 21 aa, Cryptosporidium parvum
LPIKLIMSWYVLSKVLGSSSA

SEQ ID NO: 2240903 - protein, 19 aa, Cryptosporidium parvum
LPIRLWKSYRFEYSSIDEE

SEQ ID NO: 2240904 - protein, 22 aa, Cryptosporidium parvum
LPLCYSISMTIELIRLMVEQDI

SEQ ID NO: 2240905 - protein, 18 aa, Cryptosporidium parvum
LPLFLDRIIPSWVAVICS

SEQ ID NO: 2240906 - protein, 20 aa, Cryptosporidium parvum
LPMSICFVGLVAFGNICLKY

SEQ ID NO: 2240907 - protein, 17 aa, Cryptosporidium parvum
LPSSMPWAPNSSSFHIP

SEQ ID NO: 2240908 - protein, 25 aa, Cryptosporidium parvum
LPTDPYSNCPFNPVTGNLVSRSTGK

SEQ ID NO: 2240909 - protein, 18 aa, Cryptosporidium parvum
LPVSYAFHSVMFSEISNI

SEQ ID NO: 2240910 - protein, 24 aa, Cryptosporidium parvum
LQFLWIRFYGFRVIFRKFNDLLLT

SEQ ID NO: 2240911 - protein, 17 aa, Cryptosporidium parvum
LRFKLDYIMNQLEIKSE

SEQ ID NO: 2240912 - protein, 17 aa, Cryptosporidium parvum
LRFSLFGEISIPVFRDI

SEQ ID NO: 2240913 - protein, 28 aa, Cryptosporidium parvum
LRGRKCPSCFSGLGARIRRFFGRGERGI

SEQ ID NO: 2240914 - protein, 19 aa, Cryptosporidium parvum
LRKEPRLVYRECWRGDYFR

SEQ ID NO: 2240915 - protein, 19 aa, Cryptosporidium parvum
LRKGDLFDFLGCIRSFRSF

SEQ ID NO: 2240916 - protein, 19 aa, Cryptosporidium parvum
LRLDQELRDTIDLIFQLLF

SEQ ID NO: 2240917 - protein, 19 aa, Cryptosporidium parvum
LRLPIKVKYGCIETINISI

SEQ ID NO: 2240918 - protein, 21 aa, Cryptosporidium parvum
LRNLFGLYCHVVFSLCKFVSV

SEQ ID NO: 2240919 - protein, 25 aa, Cryptosporidium parvum
LRQGEMIRMFWAMWMHTGFIHIGFN

SEQ ID NO: 2240920 - protein, 19 aa, Cryptosporidium parvum
LRQQMWLRRPRWFVYEIIP

SEQ ID NO: 2240921 - protein, 30 aa, Cryptosporidium parvum; identical to SEQ ID NO: 2129434

SEQ ID NO: 2240922 - protein, 17 aa, Cryptosporidium parvum
LRSQYILRRIKENNCIK

SEQ ID NO: 2240923 - protein, 18 aa, Cryptosporidium parvum
LRVKEIWDSIKFNMISQY

SEQ ID NO: 2240924 - protein, 21 aa, Cryptosporidium parvum
LRWNFYWCIMTLLCLIHFCSY

SEQ ID NO: 2240925 - protein, 17 aa, Cryptosporidium parvum
LRYIFLNSLKISTIAQF

SEQ ID NO: 2240926 - protein, 17 aa, Cryptosporidium parvum
LRYLIFLAEVQMRRLIN

SEQ ID NO: 2240927 - protein, 20 aa, Cryptosporidium parvum
LRYVDSIAFIIAWNASDAFV

SEQ ID NO: 2240928 - protein, 17 aa, Cryptosporidium parvum
LSAKCQLALPIFIHISK

SEQ ID NO: 2240929 - protein, 24 aa, Cryptosporidium parvum
LSCAFFALYLICWIFAYVKDLSDW

SEQ ID NO: 2240930 - protein, 17 aa, Cryptosporidium parvum
LSFPITVLMQFLSCIAP

SEQ ID NO: 2240931 - protein, 19 aa, Cryptosporidium parvum
LSGELPKFFVINSYFNENL

SEQ ID NO: 2240932 - protein, 24 aa, Cryptosporidium parvum
LSIKYRIWISFAFTIIILTLIALL

SEQ ID NO: 2240933 - protein, 24 aa, Cryptosporidium parvum
LSKVIAVICLIVWVINFRNFQDPA

SEQ ID NO: 2240934 - protein, 22 aa, Cryptosporidium parvum
LSLIAFEWIKRNTLLFSEIKLV

SEQ ID NO: 2240935 - protein, 17 aa, Cryptosporidium parvum
LSLPIKLIMSWYVLSKV

SEQ ID NO: 2240936 - protein, 22 aa, Cryptosporidium parvum
LSLTRWFACFLLIFGVIMIPKK

SEQ ID NO: 2240937 - protein, 19 aa, Cryptosporidium parvum
LSMRIGLHYGGCIGGIVGS

SEQ ID NO: 2240938 - protein, 17 aa, Cryptosporidium parvum
LSQAWDFVNSFRDGLET

SEQ ID NO: 2240939 - protein, 17 aa, Cryptosporidium parvum
LSRFKLFSCIESLLDGK

SEQ ID NO: 2240940 - protein, 17 aa, Cryptosporidium parvum
LSSFLLLLVLERSKISI

SEQ ID NO: 2240941 - protein, 21 aa, Cryptosporidium parvum
LSSMFFICFSLVYGTKTESNV

SEQ ID NO: 2240942 - protein, 18 aa, Cryptosporidium parvum
LSSSLLICYGNILFILWL

SEQ ID NO: 2240943 - protein, 17 aa, Cryptosporidium parvum
LSVLRLIVYLIKSVFNI

SEQ ID NO: 2240944 - protein, 23 aa, Cryptosporidium parvum
LTELKGRIILLELFVELLYCIKL

SEQ ID NO: 2240945 - protein, 18 aa, Cryptosporidium parvum
LTICIPKLLLAASNYQIM

SEQ ID NO: 2240946 - protein, 20 aa, Cryptosporidium parvum
LTLICSIGFIPGIPKWVDSA

SEQ ID NO: 2240947 - protein, 19 aa, Cryptosporidium parvum
LTLWEIMKQFYLINNLFFI

SEQ ID NO: 2240948 - protein, 17 aa, Cryptosporidium parvum
LTMSFSYIFTSLAITCS

SEQ ID NO: 2240949 - protein, 25 aa, Cryptosporidium parvum
LTPRKELFLAYIWKNYRINNPKLIN

SEQ ID NO: 2240950 - protein, 22 aa, Cryptosporidium parvum
LVGFLLKYRFLRLINCNWTKLR

SEQ ID NO: 2240951 - protein, 17 aa, Cryptosporidium parvum
LVLHCILVLEFLIKNSI

SEQ ID NO: 2240952 - protein, 24 aa, Cryptosporidium parvum
LVLRDCIYIVFSLIYYSKSRDLDD

SEQ ID NO: 2240953 - protein, 18 aa, Cryptosporidium parvum
LVLVCIICYIITEFKNDN

SEQ ID NO: 2240954 - protein, 19 aa, Cryptosporidium parvum
LVNCLKETILILFKSNKLE

SEQ ID NO: 2240955 - protein, 22 aa, Cryptosporidium parvum
LYFELLNGLNLVKFDLFQYNIY

SEQ ID NO: 2240956 - protein, 19 aa, Cryptosporidium parvum
LYFTLGICKKLNKLLNCKY

SEQ ID NO: 2240957 - protein, 17 aa, Cryptosporidium parvum
LYGPFWLNITMAMLIGT

SEQ ID NO: 2240958 - protein, 20 aa, Cryptosporidium parvum
LYLKLCFELLLSFEKHSWAV

SEQ ID NO: 2240959 - protein, 22 aa, Cryptosporidium parvum
LYLPNCFLCYTLPKIQHPPISE

SEQ ID NO: 2240960 - protein, 18 aa, Cryptosporidium parvum
LYRWYLSKVGIVFFISVC

SEQ ID NO: 2240961 - protein, 17 aa, Cryptosporidium parvum
LYVALGFGFYSHALLNL

SEQ ID NO: 2240962 - protein, 18 aa, Cryptosporidium parvum
LYYNLGIIMGFPYFAPRF

SEQ ID NO: 2240963 - protein, 17 aa, Cryptosporidium parvum
MAEYLGSIESCFEDEMF

SEQ ID NO: 2240964 - protein, 19 aa, Cryptosporidium parvum
MAGPILLIACLGFFLLLAG

SEQ ID NO: 2240965 - protein, 19 aa, Cryptosporidium parvum
MDFWEFIKRNALIKNGKFL

SEQ ID NO: 2240966 - protein, 20 aa, Cryptosporidium parvum
MDIRYIFKYGYGEFFEIDFR

SEQ ID NO: 2240967 - protein, 19 aa, Cryptosporidium parvum
MELYEICWSIFTTILGYIT

SEQ ID NO: 2240968 - protein, 21 aa, Cryptosporidium parvum
MERLIEIFYIYLIIPNFQENN

SEQ ID NO: 2240969 - protein, 19 aa, Cryptosporidium parvum
MFRICNFVSIFLEILIRGG

SEQ ID NO: 2240970 - protein, 21 aa, Cryptosporidium parvum
MGCMFCATGSMGLRGSLLSGE

SEQ ID NO: 2240971 - protein, 17 aa, Cryptosporidium parvum
MGIVINGVYLRICPNTY

SEQ ID NO: 2240972 - protein, 27 aa, Cryptosporidium parvum
MHIKKVNPWFAVILCISLLNGISIWDR

SEQ ID NO: 2240973 - protein, 19 aa, Cryptosporidium parvum
MIEKRVCLLDIALIQKHLL

SEQ ID NO: 2240974 - protein, 18 aa, Cryptosporidium parvum
MIIIRLGVYSSIFYYKMV

SEQ ID NO: 2240975 - protein, 18 aa, Cryptosporidium parvum
MIKDRHFLGAYTIFGSLL

SEQ ID NO: 2240976 - protein, 17 aa, Cryptosporidium parvum
MKDPLIIGGEIRTISSR

SEQ ID NO: 2240977 - protein, 18 aa, Cryptosporidium parvum
MKPACFVSSIFSLIRISF

SEQ ID NO: 2240978 - protein, 19 aa, Cryptosporidium parvum
MKSPIVGVGDICFGNNCNY

SEQ ID NO: 2240979 - protein, 20 aa, Cryptosporidium parvum
MLIERWKWVLAIFAIHNIIG

SEQ ID NO: 2240980 - protein, 19 aa, Cryptosporidium parvum
MLILLCFMGAFLSLMGPLT

SEQ ID NO: 2240981 - protein, 17 aa, Cryptosporidium parvum
MLKEDVQLELDEGFAAK

SEQ ID NO: 2240982 - protein, 18 aa, Cryptosporidium parvum
MLLIMGFPNNWFEGVNID

SEQ ID NO: 2240983 - protein, 17 aa, Cryptosporidium parvum
MLRMLLHLYSGMRTRTQ

SEQ ID NO: 2240984 - protein, 20 aa, Cryptosporidium parvum
MNKLLPRREYKLFLFDLARC

SEQ ID NO: 2240985 - protein, 17 aa, Cryptosporidium parvum
MNVRMRQIWGLYLEEEN

SEQ ID NO: 2240986 - protein, 18 aa, Cryptosporidium parvum
MRILPGFPIRIKEETLIQ

SEQ ID NO: 2240987 - protein, 19 aa, Cryptosporidium parvum
MSIIYLYIYWHIQFRAKNE

SEQ ID NO: 2240988 - protein, 19 aa, Cryptosporidium parvum
MSWLMLFCQLLSYGNSSNF

SEQ ID NO: 2240989 - protein, 24 aa, Cryptosporidium parvum
MTICGNILRLGRIVAYISYCIGNY

SEQ ID NO: 2240990 - protein, 17 aa, Cryptosporidium parvum
MWLFFGIGIVQMTLSLF

SEQ ID NO: 2240991 - protein, 26 aa, Cryptosporidium parvum
MWLRRPRWFVYEIIPLVILFTKIFSS

SEQ ID NO: 2240992 - protein, 23 aa, Cryptosporidium parvum
MYFLSILVLFSWISIVIGGEGNL

SEQ ID NO: 2240993 - protein, 18 aa, Cryptosporidium parvum
MYPELPLSTTFMIESSKK

SEQ ID NO: 2240994 - protein, 19 aa, Cryptosporidium parvum
NACIFEFIIPLVLEPIMIR

SEQ ID NO: 2240995 - protein, 20 aa, Cryptosporidium parvum
NALVCAWTLFSLLIICTLKG

SEQ ID NO: 2240996 - protein, 20 aa, Cryptosporidium parvum
NASDAFVFSGITCWSHVNNQ

SEQ ID NO: 2240997 - protein, 24 aa, Cryptosporidium parvum
NCILDCIRLALPVSPNFLKKIKFK

SEQ ID NO: 2240998 - protein, 20 aa, Cryptosporidium parvum
NCVFGGVLICHGNFGDQARE

SEQ ID NO: 2240999 - protein, 19 aa, Cryptosporidium parvum
NCYRRWKWKKRVKRRKMKK

SEQ ID NO: 2241000 - protein, 23 aa, Cryptosporidium parvum
NDIWRIKLIISRLFKIDSTTHPN

SEQ ID NO: 2241001 - protein, 23 aa, Cryptosporidium parvum
NDIYKIYGFIAVCCIELKEKKTL

SEQ ID NO: 2241002 - protein, 22 aa, Cryptosporidium parvum
NECYRYSVLFNLYFDLMEFQKD

SEQ ID NO: 2241003 - protein, 18 aa, Cryptosporidium parvum
NEDLELWNLLGYKNAPKG

SEQ ID NO: 2241004 - protein, 23 aa, Cryptosporidium parvum
NEIFIQWNILRAGLKYILHQIKN

SEQ ID NO: 2241005 - protein, 19 aa, Cryptosporidium parvum
NEILHPFFIFQVCAVCIWF

SEQ ID NO: 2241006 - protein, 17 aa, Cryptosporidium parvum
NEIRLSSKFSFEEMTKC

SEQ ID NO: 2241007 - protein, 21 aa, Cryptosporidium parvum
NELLIRLIIYFKIIIEEKLDI

SEQ ID NO: 2241008 - protein, 18 aa, Cryptosporidium parvum
NEVVHRFLPWDSLNELMD

SEQ ID NO: 2241009 - protein, 19 aa, Cryptosporidium parvum
NFCTFEFMLSPTLIGVPNT

SEQ ID NO: 2241010 - protein, 17 aa, Cryptosporidium parvum
NFHWHVAEKITHYLIFL

SEQ ID NO: 2241011 - protein, 19 aa, Cryptosporidium parvum
NFNDHWRKGAGILPLNMLY

SEQ ID NO: 2241012 - protein, 24 aa, Cryptosporidium parvum
NFNSRFSWIVGMSIFTSSIFGLSY

SEQ ID NO: 2241013 - protein, 23 aa, Cryptosporidium parvum
NFPFKSLYLMNAIIILKFGLVCI

SEQ ID NO: 2241014 - protein, 18 aa, Cryptosporidium parvum
NFRIPRSRFDRVMISLFW

SEQ ID NO: 2241015 - protein, 23 aa, Cryptosporidium parvum
NIDFPATLIFDFPTLRLLIEHID

SEQ ID NO: 2241016 - protein, 19 aa, Cryptosporidium parvum
NIKLRLFIKIDLSKVNNND

SEQ ID NO: 2241017 - protein, 20 aa, Cryptosporidium parvum
NIKLSFPIARSFERKLEASI

SEQ ID NO: 2241018 - protein, 23 aa, Cryptosporidium parvum
NIKTRFNWDLSLFQTEFGYVKNI

SEQ ID NO: 2241019 - protein, 19 aa, Cryptosporidium parvum
NILFCYYCEQPLCQAYFEQ

SEQ ID NO: 2241020 - protein, 17 aa, Cryptosporidium parvum
NILKFILHWSIAFIMFI

SEQ ID NO: 2241021 - protein, 22 aa, Cryptosporidium parvum
NIRKELFDDLSFPISLSDGIVG

SEQ ID NO: 2241022 - protein, 18 aa, Cryptosporidium parvum
NIWITWKLLSKQVGLIAA

SEQ ID NO: 2241023 - protein, 20 aa, Cryptosporidium parvum
NKDAIKWVDFDFCYNRVDLN

SEQ ID NO: 2241024 - protein, 21 aa, Cryptosporidium parvum
NKELNCGLVLDSLEVRSIPNL

SEQ ID NO: 2241025 - protein, 24 aa, Cryptosporidium parvum
NKEMPRIPLLILIRANIGVIEDES

SEQ ID NO: 2241026 - protein, 20 aa, Cryptosporidium parvum
NKFLLRLTCEFYMKAMREIQ

SEQ ID NO: 2241027 - protein, 18 aa, Cryptosporidium parvum
NKLSINIIHEFYLSLEID

SEQ ID NO: 2241028 - protein, 22 aa, Cryptosporidium parvum
NKWKVSNIWVIFTLENNSRVYP

SEQ ID NO: 2241029 - protein, 18 aa, Cryptosporidium parvum
NLIFRKYLSLSFGDIQTV

SEQ ID NO: 2241030 - protein, 24 aa, Cryptosporidium parvum
NLLFQFYCEWSWTLLQLLDIVSLY

SEQ ID NO: 2241031 - protein, 21 aa, Cryptosporidium parvum
NLLKRRFFIAPSFEIYGGVAG

SEQ ID NO: 2241032 - protein, 21 aa, Cryptosporidium parvum
NLMIFKIWFSRNLKINNNQLI

SEQ ID NO: 2241033 - protein, 18 aa, Cryptosporidium parvum
NLNCWRKLLPCTTLDFSS

SEQ ID NO: 2241034 - protein, 18 aa, Cryptosporidium parvum
NLRCSAKFLIGVSNDCLR

SEQ ID NO: 2241035 - protein, 22 aa, Cryptosporidium parvum
NLRFTALSAFNWYLISMGFEFS

SEQ ID NO: 2241036 - protein, 23 aa, Cryptosporidium parvum
NLSFCFPEIDLSIAILTNDYVKG

SEQ ID NO: 2241037 - protein, 23 aa, Cryptosporidium parvum
NLWKSIRIISHFLLNELSLKKGD

SEQ ID NO: 2241038 - protein, 18 aa, Cryptosporidium parvum
NLWVCLVSGIFKILKHKQ

SEQ ID NO: 2241039 - protein, 18 aa, Cryptosporidium parvum
NMIALLIGFRGIYIYQIV

SEQ ID NO: 2241040 - protein, 23 aa, Cryptosporidium parvum
NMLPYKLRFFIGFSSISSLFGSF

SEQ ID NO: 2241041 - protein, 17 aa, Cryptosporidium parvum
NNFMAIWLDAQRIIIKT

SEQ ID NO: 2241042 - protein, 22 aa, Cryptosporidium parvum
NNHIGRLLTLFGISLNHQLQFL

SEQ ID NO: 2241043 - protein, 23 aa, Cryptosporidium parvum
NNINELWPFFYLHYNYIQKKLII

SEQ ID NO: 2241044 - protein, 19 aa, Cryptosporidium parvum
NPQCVPLTILENGCPMKQV

SEQ ID NO: 2241045 - protein, 22 aa, Cryptosporidium parvum
NQHGRLGYFKSIFRITKELKLF

SEQ ID NO: 2241046 - protein, 19 aa, Cryptosporidium parvum
NRAFEWYGDFEVLRDLLIQ

SEQ ID NO: 2241047 - protein, 21 aa, Cryptosporidium parvum
NRVFKEWKEIIIPLLPLILTY

SEQ ID NO: 2241048 - protein, 19 aa, Cryptosporidium parvum
NRYFWIISCLFTILFKTNN

SEQ ID NO: 2241049 - protein, 17 aa, Cryptosporidium parvum
NSIVYKLYWKLMLTCGV

SEQ ID NO: 2241050 - protein, 19 aa, Cryptosporidium parvum
NSLFLTMFCCIGGDSSVAR

SEQ ID NO: 2241051 - protein, 17 aa, Cryptosporidium parvum
NSPEFFRLWTLLILCGL

SEQ ID NO: 2241052 - protein, 17 aa, Cryptosporidium parvum
NTCKIFFYQDGFLSSLW

SEQ ID NO: 2241053 - protein, 19 aa, Cryptosporidium parvum
NVCLLRYSPLYLGAIKANI

SEQ ID NO: 2241054 - protein, 21 aa, Cryptosporidium parvum
NVFNWKLKILINFKRIFLETY

SEQ ID NO: 2241055 - protein, 21 aa, Cryptosporidium parvum
NVGVFKLCFKRRIINEEDSND

SEQ ID NO: 2241056 - protein, 17 aa, Cryptosporidium parvum
NVIKELIEPGGLICKPL

SEQ ID NO: 2241057 - protein, 19 aa, Cryptosporidium parvum
NVLFLKLIFLFSCSLCSIV

SEQ ID NO: 2241058 - protein, 18 aa, Cryptosporidium parvum
NVQLELCSAIFNSFNSNL

SEQ ID NO: 2241059 - protein, 17 aa, Cryptosporidium parvum
NWPFIGIQNEWKHIEKE

SEQ ID NO: 2241060 - protein, 19 aa, Cryptosporidium parvum
NYYWKLLLFIIIRRHSLIF

SEQ ID NO: 2241061 - protein, 19 aa, Cryptosporidium parvum
PALFWFITWGLILLCAAGA

SEQ ID NO: 2241062 - protein, 21 aa, Cryptosporidium parvum
PCMIFHYSVLFSYLVFILKTT

SEQ ID NO: 2241063 - protein, 21 aa, Cryptosporidium parvum
PDIQALFLLKICKTSYEINNR

SEQ ID NO: 2241064 - protein, 19 aa, Cryptosporidium parvum
PDYIVLLFAHWEIMIYRYS

SEQ ID NO: 2241065 - protein, 20 aa, Cryptosporidium parvum
PEFFRLWTLLILCGLLSMLL

SEQ ID NO: 2241066 - protein, 23 aa, Cryptosporidium parvum
PELSGKLWLLWYVSFKQKDCQMR

SEQ ID NO: 2241067 - protein, 20 aa, Cryptosporidium parvum
PELYKRFLVSTGVYALFGTI

SEQ ID NO: 2241068 - protein, 23 aa, Cryptosporidium parvum
PFFSLKIFGIWSMNAVFHAAVSL

SEQ ID NO: 2241069 - protein, 24 aa, Cryptosporidium parvum
PFGELRLGLKIPYDNKVVSIFFDD

SEQ ID NO: 2241070 - protein, 19 aa, Cryptosporidium parvum
PFSFCLSNFDFRDITSNIY

SEQ ID NO: 2241071 - protein, 21 aa, Cryptosporidium parvum
PFSGLHIFWSIIFSKYILNEE

SEQ ID NO: 2241072 - protein, 20 aa, Cryptosporidium parvum
PGFRILWTVRIIYISSVFLS

SEQ ID NO: 2241073 - protein, 17 aa, Cryptosporidium parvum
PGLKRINPIFVDRFILY

SEQ ID NO: 2241074 - protein, 23 aa, Cryptosporidium parvum
PGVLRLLVRLNMMYYYECRINTL

SEQ ID NO: 2241075 - protein, 22 aa, Cryptosporidium parvum
PHPKIKLGFLKWFNEKLPKDLF

SEQ ID NO: 2241076 - protein, 21 aa, Cryptosporidium parvum
PICQHNWRPIFITSLILSDKL

SEQ ID NO: 2241077 - protein, 17 aa, Cryptosporidium parvum
PIFITSLILSDKLWDDS

SEQ ID NO: 2241078 - protein, 19 aa, Cryptosporidium parvum
PIICIFGIILPSYVYALFC

SEQ ID NO: 2241079 - protein, 18 aa, Cryptosporidium parvum
PIIDLWRILALHPQSSDI

SEQ ID NO: 2241080 - protein, 18 aa, Cryptosporidium parvum
PIIFPWINDWIFPEISQD

SEQ ID NO: 2241081 - protein, 24 aa, Cryptosporidium parvum
PIIRWRCDRLYKRIHLDRLNELSD

SEQ ID NO: 2241082 - protein, 21 aa, Cryptosporidium parvum
PIKCLEFLPKIFLSSKDEKLV

SEQ ID NO: 2241083 - protein, 18 aa, Cryptosporidium parvum
PILRFDFLVSQLMSSSSQ

SEQ ID NO: 2241084 - protein, 18 aa, Cryptosporidium parvum
PIWILGVLFSCILNAILI

SEQ ID NO: 2241085 - protein, 17 aa, Cryptosporidium parvum
PLFKNIFIIGRRGWIQN

SEQ ID NO: 2241086 - protein, 19 aa, Cryptosporidium parvum
PLFRSCFKIAYTGAPPRSL

SEQ ID NO: 2241087 - protein, 17 aa, Cryptosporidium parvum
PLLSSWFGLQWTKNQLW

SEQ ID NO: 2241088 - protein, 19 aa, Cryptosporidium parvum
PLPCLGFLTSVFEGEVSPE

SEQ ID NO: 2241089 - protein, 18 aa, Cryptosporidium parvum
PLVIKAFLGRLVFPELLE

SEQ ID NO: 2241090 - protein, 19 aa, Cryptosporidium parvum
PNIIWKLILGESVSLNDLK

SEQ ID NO: 2241091 - protein, 21 aa, Cryptosporidium parvum
PNRLRVAFRIIFLDEQGDIEP

SEQ ID NO: 2241092 - protein, 23 aa, Cryptosporidium parvum
PPRIKYNLCRWICRAYIFQAIRL

SEQ ID NO: 2241093 - protein, 17 aa, Cryptosporidium parvum
PPSAFKCMLNLINSFDF

SEQ ID NO: 2241094 - protein, 17 aa, Cryptosporidium parvum
PQMFLEFSIYNENVDSI

SEQ ID NO: 2241095 - protein, 21 aa, Cryptosporidium parvum
PRFLEFYNLIGVNIFAVSYRG

SEQ ID NO: 2241096 - protein, 22 aa, Cryptosporidium parvum
PRIPLDIACTAMWFISQRWDFC

SEQ ID NO: 2241097 - protein, 19 aa, Cryptosporidium parvum
PRKLPGPLLPYGFSILILL

SEQ ID NO: 2241098 - protein, 20 aa, Cryptosporidium parvum
PRSRFDRVMISLFWAIITFG

SEQ ID NO: 2241099 - protein, 23 aa, Cryptosporidium parvum
PRWIPKFFFLLNFRIPRSRFDRV

SEQ ID NO: 2241100 - protein, 17 aa, Cryptosporidium parvum
PSHSYGLFEEDYDINNY

SEQ ID NO: 2241101 - protein, 25 aa, Cryptosporidium parvum
PSNRASMYWYRVFRSLSLLLYFSRK

SEQ ID NO: 2241102 - protein, 17 aa, Cryptosporidium parvum
PSPPLPMSNSIRDFQKL

SEQ ID NO: 2241103 - protein, 20 aa, Cryptosporidium parvum
PTCTCKKCKQAGSPSSGTEE

SEQ ID NO: 2241104 - protein, 21 aa, Cryptosporidium parvum
PTERCVLLMLGILQRMVYIPS

SEQ ID NO: 2241105 - protein, 20 aa, Cryptosporidium parvum
PTFQPRSGFVVGMGSGAGTG

SEQ ID NO: 2241106 - protein, 18 aa, Cryptosporidium parvum
PTYHIRRLLDIFTVLQLK

SEQ ID NO: 2241107 - protein, 18 aa, Cryptosporidium parvum
PTYLCWHEDLLVLVIGFE

SEQ ID NO: 2241108 - protein, 23 aa, Cryptosporidium parvum
PVFICIPCLIWVWCSDHCLQILK

SEQ ID NO: 2241109 - protein, 19 aa, Cryptosporidium parvum
PVFLSHIFDLLAFDQSIQE

SEQ ID NO: 2241110 - protein, 18 aa, Cryptosporidium parvum
PVFLVYSIICLKCSLQEN

SEQ ID NO: 2241111 - protein, 19 aa, Cryptosporidium parvum
PVYECIKLIITKFLLLILV

SEQ ID NO: 2241112 - protein, 17 aa, Cryptosporidium parvum
PWSILSLDISFKEKKKN

SEQ ID NO: 2241113 - protein, 19 aa, Cryptosporidium parvum
QAICSRYGLYIGGFFSPFI

SEQ ID NO: 2241114 - protein, 32 aa, Cryptosporidium parvum
QATISGSRSCGWKQGYSIDSSTGFRVDSITGL

SEQ ID NO: 2241115 - protein, 22 aa, Cryptosporidium parvum
QCARFILLFVCNDFFTLFSKLY

SEQ ID NO: 2241116 - protein, 20 aa, Cryptosporidium parvum
QCIILAFGIFVFISLLYYLL

SEQ ID NO: 2241117 - protein, 18 aa, Cryptosporidium parvum
QDLEAITAMLDRLCVNNI

SEQ ID NO: 2241118 - protein, 20 aa, Cryptosporidium parvum
QEGFWKKHFIYIGMNPPQIV

SEQ ID NO: 2241119 - protein, 17 aa, Cryptosporidium parvum
QELKIEYIVAILSSLLY

SEQ ID NO: 2241120 - protein, 17 aa, Cryptosporidium parvum
QEYRLVTNLGRYSKCLV

SEQ ID NO: 2241121 - protein, 25 aa, Cryptosporidium parvum
QFFFSMCFWGLFSAVLGPLSQKIAS

SEQ ID NO: 2241122 - protein, 19 aa, Cryptosporidium parvum
QGGPRTHLMMLIFFGGNIL

SEQ ID NO: 2241123 - protein, 23 aa, Cryptosporidium parvum
QGGWKFGILVIQSFLIIVIDSII

SEQ ID NO: 2241124 - protein, 24 aa, Cryptosporidium parvum
QGIFLRFYIWAVLWAIMIIFTTFK

SEQ ID NO: 2241125 - protein, 21 aa, Cryptosporidium parvum
QGVVYMCGFKSYTVEKDLIEL

SEQ ID NO: 2241126 - protein, 18 aa, Cryptosporidium parvum
QIFFAISILLSFPLMIFP

SEQ ID NO: 2241127 - protein, 23 aa, Cryptosporidium parvum
QINMNMTWVWGFMRSLRMELSSK

SEQ ID NO: 2241128 - protein, 18 aa, Cryptosporidium parvum
QKSFRIVVIAPWMEHIPR

SEQ ID NO: 2241129 - protein, 24 aa, Cryptosporidium parvum
QKVVYCLYSLLGIAFILFKLGTMG

SEQ ID NO: 2241130 - protein, 19 aa, Cryptosporidium parvum
QKYSPIWWLYVSNIDILRR

SEQ ID NO: 2241131 - protein, 21 aa, Cryptosporidium parvum
QLAEILFKICKPFEIKNIEEI

SEQ ID NO: 2241132 - protein, 21 aa, Cryptosporidium parvum
QLRVVIWRVRHIPIEPNTTIS

SEQ ID NO: 2241133 - protein, 17 aa, Cryptosporidium parvum
QLSEIWKIITLDSGKCP

SEQ ID NO: 2241134 - protein, 24 aa, Cryptosporidium parvum
QNICYECTMFLYKIISSLLSFNNQ

SEQ ID NO: 2241135 - protein, 23 aa, Cryptosporidium parvum
QPSLRPLVPLALDRSIREILQVV

SEQ ID NO: 2241136 - protein, 23 aa, Cryptosporidium parvum
QQELPRLIKIIIEVILFGMKPNN

SEQ ID NO: 2241137 - protein, 25 aa, Cryptosporidium parvum
QQLIDWSELLSLLLDMFVIKASDLD

SEQ ID NO: 2241138 - protein, 17 aa, Cryptosporidium parvum
QRFPPVILVFDIVEQGR

SEQ ID NO: 2241139 - protein, 22 aa, Cryptosporidium parvum
QRGFRSGYYWNICNSELRRVNQ

SEQ ID NO: 2241140 - protein, 18 aa, Cryptosporidium parvum
QSIFKFYLLESIGHQMAP

SEQ ID NO: 2241141 - protein, 17 aa, Cryptosporidium parvum
QSNPLLLNWKAFFPNII

SEQ ID NO: 2241142 - protein, 19 aa, Cryptosporidium parvum
QSYILWLLLCLNLNMGTVR

SEQ ID NO: 2241143 - protein, 18 aa, Cryptosporidium parvum
QVEYRWNFLINILEFVNK

SEQ ID NO: 2241144 - protein, 23 aa, Cryptosporidium parvum
QVFHLYFKFELIKCIQSTREAIS

SEQ ID NO: 2241145 - protein, 21 aa, Cryptosporidium parvum
QWFILICVVGFFLSMFGTFLI

SEQ ID NO: 2241146 - protein, 24 aa, Cryptosporidium parvum
QWSRKEFILEFAVRVCKKHFSWKD

SEQ ID NO: 2241147 - protein, 25 aa, Cryptosporidium parvum
QYALIWMTWCLWLLGSFLFSFGRVM

SEQ ID NO: 2241148 - protein, 19 aa, Cryptosporidium parvum
QYCSFRFKFSASLKKISST

SEQ ID NO: 2241149 - protein, 18 aa, Cryptosporidium parvum
QYIRIGLTIKFLHLTLKL

SEQ ID NO: 2241150 - protein, 19 aa, Cryptosporidium parvum
QYLPSCIMISVGCPSKHYI

SEQ ID NO: 2241151 - protein, 18 aa, Cryptosporidium parvum
RAGMICWIECFFVLFQGG

SEQ ID NO: 2241152 - protein, 18 aa, Cryptosporidium parvum
RATLILTILLPFILEIYY

SEQ ID NO: 2241153 - protein, 21 aa, Cryptosporidium parvum
RAVFFLHWWLITWPKIPFYAN

SEQ ID NO: 2241154 - protein, 18 aa, Cryptosporidium parvum
RCKFWWLSLVQFPECIWI

SEQ ID NO: 2241155 - protein, 21 aa, Cryptosporidium parvum
RDIISQIAFCYRISSVFLISK

SEQ ID NO: 2241156 - protein, 17 aa, Cryptosporidium parvum
RDILIEFARKEKDTIKS

SEQ ID NO: 2241157 - protein, 17 aa, Cryptosporidium parvum
REFPVSFGIPVITLQKL

SEQ ID NO: 2241158 - protein, 21 aa, Cryptosporidium parvum
REVLEVVPLLLIKDISVMIDK

SEQ ID NO: 2241159 - protein, 18 aa, Cryptosporidium parvum
REWKASKLIFLPSSDKHL

SEQ ID NO: 2241160 - protein, 19 aa, Cryptosporidium parvum
RFFECIKLILRKEATRIVK

SEQ ID NO: 2241161 - protein, 17 aa, Cryptosporidium parvum
RFREFTLDYALREINKL

SEQ ID NO: 2241162 - protein, 18 aa, Cryptosporidium parvum
RFVFNIPVPCHFPILRLQ

SEQ ID NO: 2241163 - protein, 17 aa, Cryptosporidium parvum
RFYSWDIVERWKYQWIF

SEQ ID NO: 2241164 - protein, 21 aa, Cryptosporidium parvum
RGFIPFILCGDLSPINNIDPS

SEQ ID NO: 2241165 - protein, 23 aa, Cryptosporidium parvum
RGFLLIKFIRWVIMKDPFNNVQL

SEQ ID NO: 2241166 - protein, 17 aa, Cryptosporidium parvum
RGIEILVFFAFKKNYLS

SEQ ID NO: 2241167 - protein, 19 aa, Cryptosporidium parvum
RGTWKAVSSRAFIRDPYAL

SEQ ID NO: 2241168 - protein, 22 aa, Cryptosporidium parvum
RGYKEILCRIMVGWSNNIDKSL

SEQ ID NO: 2241169 - protein, 29 aa, Cryptosporidium parvum
RHFPELISTILLRCCSTLGYINMGALESS

SEQ ID NO: 2241170 - protein, 17 aa, Cryptosporidium parvum
RHYKGTGLVIFGLLFII

SEQ ID NO: 2241171 - protein, 18 aa, Cryptosporidium parvum
RICYVFKFGCVVGWDLTR

SEQ ID NO: 2241172 - protein, 19 aa, Cryptosporidium parvum
RILPPYWYMNWVEQTSTRS

SEQ ID NO: 2241173 - protein, 18 aa, Cryptosporidium parvum
RINPIFVDRFILYSFISI

SEQ ID NO: 2241174 - protein, 21 aa, Cryptosporidium parvum
RIRLKHIFLIFIFTVLYVSCF

SEQ ID NO: 2241175 - protein, 17 aa, Cryptosporidium parvum
RIYELWKGTPMDIRQIL

SEQ ID NO: 2241176 - protein, 19 aa, Cryptosporidium parvum
RIYTLFIHILGLRCMVPVS

SEQ ID NO: 2241177 - protein, 17 aa, Cryptosporidium parvum
RKCKELLQLIAAIRQDV

SEQ ID NO: 2241178 - protein, 20 aa, Cryptosporidium parvum
RKESISFIDWINRLVSSKFS

SEQ ID NO: 2241179 - protein, 17 aa, Cryptosporidium parvum
RKFFPSLVKVFREAFLK

SEQ ID NO: 2241180 - protein, 19 aa, Cryptosporidium parvum
RKFTFISNEWWKIHKLESV

SEQ ID NO: 2241181 - protein, 20 aa, Cryptosporidium parvum
RKGLPQSFLNRFVRINVGKL

SEQ ID NO: 2241182 - protein, 21 aa, Cryptosporidium parvum
RKKAEVFLVEYVVALIICIGR

SEQ ID NO: 2241183 - protein, 20 aa, Cryptosporidium parvum
RKKLRLLIYIEDFYNEIKPK

SEQ ID NO: 2241184 - protein, 18 aa, Cryptosporidium parvum
RKLLPCTTLDFSSKIGSY

SEQ ID NO: 2241185 - protein, 20 aa, Cryptosporidium parvum
RKMLEFCLSIFSFELREFDW

SEQ ID NO: 2241186 - protein, 19 aa, Cryptosporidium parvum
RKRGFPIAIYRPGRIGGNS

SEQ ID NO: 2241187 - protein, 17 aa, Cryptosporidium parvum
RKRVCSIIDKLKKLDKL

SEQ ID NO: 2241188 - protein, 21 aa, Cryptosporidium parvum
RKSLRDCIVSWVFPRARRMGL

SEQ ID NO: 2241189 - protein, 25 aa, Cryptosporidium parvum
RKSTWRSSKFRSWKAILSLIYTTKE

SEQ ID NO: 2241190 - protein, 21 aa, Cryptosporidium parvum
RKVLPLWAFLFMKVVEQSLRI

SEQ ID NO: 2241191 - protein, 18 aa, Cryptosporidium parvum
RKWIILLIIIEFVIKINL

SEQ ID NO: 2241192 - protein, 18 aa, Cryptosporidium parvum
RKYWPVFIGTIPICDLEP

SEQ ID NO: 2241193 - protein, 19 aa, Cryptosporidium parvum
RLAAYLLLCFVIGNGLGPL

SEQ ID NO: 2241194 - protein, 20 aa, Cryptosporidium parvum
RLAYRRICKLALYMFYKNLT

SEQ ID NO: 2241195 - protein, 23 aa, Cryptosporidium parvum
RLCYRRTSILVLYNLYKCFTLNI

SEQ ID NO: 2241196 - protein, 20 aa, Cryptosporidium parvum
RLEKFCKLFFPALWLSCNDL

SEQ ID NO: 2241197 - protein, 22 aa, Cryptosporidium parvum
RLFKIRLNTIIGEFYSPLLNGT

SEQ ID NO: 2241198 - protein, 21 aa, Cryptosporidium parvum
RLGVYSSIFYYKMVLFKSKID

SEQ ID NO: 2241199 - protein, 19 aa, Cryptosporidium parvum
RLKPELIKDLLLIQINSFW

SEQ ID NO: 2241200 - protein, 18 aa, Cryptosporidium parvum
RLKYIWNCIKEFEPIDLS

SEQ ID NO: 2241201 - protein, 20 aa, Cryptosporidium parvum
RLNSQLSLHCRIRRVNYIPQ

SEQ ID NO: 2241202 - protein, 17 aa, Cryptosporidium parvum
RLSSKFSFEEMTKCLFV

SEQ ID NO: 2241203 - protein, 18 aa, Cryptosporidium parvum
RLWEFGRLYNELNKNSES

SEQ ID NO: 2241204 - protein, 20 aa, Cryptosporidium parvum
RLYDPLIWRYISVANWKVRL

SEQ ID NO: 2241205 - protein, 19 aa, Cryptosporidium parvum
RLYYFILRIVIIIGTISVL

SEQ ID NO: 2241206 - protein, 17 aa, Cryptosporidium parvum
RMKEALERCLLLIENGN

SEQ ID NO: 2241207 - protein, 17 aa, Cryptosporidium parvum
RNHRLILVFKRLIRQLI

SEQ ID NO: 2241208 - protein, 18 aa, Cryptosporidium parvum
RNIDIALRYALKGATKFN

SEQ ID NO: 2241209 - protein, 21 aa, Cryptosporidium parvum
RNSLKMALDLCIINYPEVAQK

SEQ ID NO: 2241210 - protein, 20 aa, Cryptosporidium parvum
RNTYCLGFDSDKSFLVLGAS

SEQ ID NO: 2241211 - protein, 19 aa, Cryptosporidium parvum
RPFFAFNLLCMRHAKFHNS

SEQ ID NO: 2241212 - protein, 24 aa, Cryptosporidium parvum
RPIWLKIRIVYVIFAILLFFIIGA

SEQ ID NO: 2241213 - protein, 21 aa, Cryptosporidium parvum
RPVILRPIWILGVLFSCILNA

SEQ ID NO: 2241214 - protein, 19 aa, Cryptosporidium parvum
RQWMWEIVTGFKWGSSSYG

SEQ ID NO: 2241215 - protein, 17 aa, Cryptosporidium parvum
RRFLFPILLNYIKTNNI

SEQ ID NO: 2241216 - protein, 19 aa, Cryptosporidium parvum
RRLINHLKHFGALNDDDIA

SEQ ID NO: 2241217 - protein, 19 aa, Cryptosporidium parvum
RRLSQMLYHYVRVTLKEPR

SEQ ID NO: 2241218 - protein, 20 aa, Cryptosporidium parvum
RRSAWLLGCIFEFSSPNMAL

SEQ ID NO: 2241219 - protein, 19 aa, Cryptosporidium parvum
RRSICWTAFDFTELVPCVL

SEQ ID NO: 2241220 - protein, 19 aa, Cryptosporidium parvum
RRTFRCWTNIISKLVSYDS

SEQ ID NO: 2241221 - protein, 18 aa, Cryptosporidium parvum
RRTLMWFSISIIIVLLNI

SEQ ID NO: 2241222 - protein, 17 aa, Cryptosporidium parvum
RRVIFHANIVWSPKQIY

SEQ ID NO: 2241223 - protein, 24 aa, Cryptosporidium parvum
RRVLREMPHLIGFEDRLHFYYHYI

SEQ ID NO: 2241224 - protein, 17 aa, Cryptosporidium parvum
RSFLPLFLVFVFLALQF

SEQ ID NO: 2241225 - protein, 19 aa, Cryptosporidium parvum
RSFNIFDMFFFYKVLNFYY

SEQ ID NO: 2241226 - protein, 19 aa, Cryptosporidium parvum
RSLLRLFFLFSSFKEDNGK

SEQ ID NO: 2241227 - protein, 18 aa, Cryptosporidium parvum
RSLYSLEWEFEWLNNNSE

SEQ ID NO: 2241228 - protein, 17 aa, Cryptosporidium parvum
RSVLIPIYLPDTSVRGK

SEQ ID NO: 2241229 - protein, 23 aa, Cryptosporidium parvum
RTHHCRVCRTCVLKMDHHCPWIS

SEQ ID NO: 2241230 - protein, 25 aa, Cryptosporidium parvum
RTNGIKGFHWFKVNEYWDWSRNYLS

SEQ ID NO: 2241231 - protein, 21 aa, Cryptosporidium parvum
RTVNIKRLWEFGRLYNELNKN

SEQ ID NO: 2241232 - protein, 22 aa, Cryptosporidium parvum
RVMSTKTFFCWVWKSLYQGTVI

SEQ ID NO: 2241233 - protein, 25 aa, Cryptosporidium parvum
RYHISILMKAIFVFMFFDVSREFYI

SEQ ID NO: 2241234 - protein, 19 aa, Cryptosporidium parvum
RYKLVPIKWSWSVQEISEI

SEQ ID NO: 2241235 - protein, 17 aa, Cryptosporidium parvum
SAALWKAYFYRPEEMDD

SEQ ID NO: 2241236 - protein, 18 aa, Cryptosporidium parvum
SCAVVLTRRYVITIFLIF

SEQ ID NO: 2241237 - protein, 20 aa, Cryptosporidium parvum
SCFLLGIIVYYSFKDVEILN

SEQ ID NO: 2241238 - protein, 20 aa, Cryptosporidium parvum
SCLYCGSVLNTIRYISFYCF

SEQ ID NO: 2241239 - protein, 21 aa, Cryptosporidium parvum
SDCEGFLKKGALFGGMSICTP

SEQ ID NO: 2241240 - protein, 21 aa, Cryptosporidium parvum
SDFCRIWLLTALVRLIHIPSG

SEQ ID NO: 2241241 - protein, 18 aa, Cryptosporidium parvum
SDFTWRLNSIMQRNLSDS

SEQ ID NO: 2241242 - protein, 23 aa, Cryptosporidium parvum
SDHLPCAVWLPWIPQLIAGIDRI

SEQ ID NO: 2241243 - protein, 25 aa, Cryptosporidium parvum
SDPSTGLPFIPGFNVLVDPQTGEQI

SEQ ID NO: 2241244 - protein, 17 aa, Cryptosporidium parvum
SDYKLFFRFLKARQFNV

SEQ ID NO: 2241245 - protein, 17 aa, Cryptosporidium parvum
SEGFKFKFLDYLDGMSN

SEQ ID NO: 2241246 - protein, 17 aa, Cryptosporidium parvum
SEIPSWFVGILTLPTLK

SEQ ID NO: 2241247 - protein, 21 aa, Cryptosporidium parvum
SEKKNKCDIIYSFKVKNSINK

SEQ ID NO: 2241248 - protein, 17 aa, Cryptosporidium parvum
SELFSVCAIRFHAEWLD

SEQ ID NO: 2241249 - protein, 20 aa, Cryptosporidium parvum
SELKRQNCILIFSKLNGVFL

SEQ ID NO: 2241250 - protein, 20 aa, Cryptosporidium parvum
SEVESFWRRHFVLAEDMLEI

SEQ ID NO: 2241251 - protein, 23 aa, Cryptosporidium parvum
SEVKWLVDLSEIWNEHPVEILLI

SEQ ID NO: 2241252 - protein, 20 aa, Cryptosporidium parvum
SEVYIELSVGSWTYWVIPNF

SEQ ID NO: 2241253 - protein, 20 aa, Cryptosporidium parvum
SFELSYKWCFQVFSYDNRYC

SEQ ID NO: 2241254 - protein, 23 aa, Cryptosporidium parvum
SFIGKVCSIEFYLYNPLSFPIVC

SEQ ID NO: 2241255 - protein, 25 aa, Cryptosporidium parvum
SFNTGGICSFLWIMAKFPDYVYCDK

SEQ ID NO: 2241256 - protein, 19 aa, Cryptosporidium parvum
SFRLFGIVVASSIVFIFMM

SEQ ID NO: 2241257 - protein, 19 aa, Cryptosporidium parvum
SFWSFKLPLIIKNIIFFIY

SEQ ID NO: 2241258 - protein, 25 aa, Cryptosporidium parvum
SGNNEFRGSLFLICIRFLCNMFHNS

SEQ ID NO: 2241259 - protein, 22 aa, Cryptosporidium parvum
SGYRGCAIYDLINSRWRLFCDL

SEQ ID NO: 2241260 - protein, 17 aa, Cryptosporidium parvum
SHARIVLVIALFIIIFM

SEQ ID NO: 2241261 - protein, 21 aa, Cryptosporidium parvum
SHGRIGMMQGIPPHMGGAGQG

SEQ ID NO: 2241262 - protein, 22 aa, Cryptosporidium parvum
SIIWKLCLIFLLGATDSQLSFM

SEQ ID NO: 2241263 - protein, 22 aa, Cryptosporidium parvum
SIKIHPRFRLFSCMNPVIVPIE

SEQ ID NO: 2241264 - protein, 27 aa, Cryptosporidium parvum
SIKSLFLKTVFLFRILRYWNNDITSSS

SEQ ID NO: 2241265 - protein, 18 aa, Cryptosporidium parvum
SILAILGIHFSKKRKLSF

SEQ ID NO: 2241266 - protein, 23 aa, Cryptosporidium parvum
SILSNRISYIFGFQGPSFTIDSA

SEQ ID NO: 2241267 - protein, 20 aa, Cryptosporidium parvum
SIMSICIWLSLLVFEGSYLF

SEQ ID NO: 2241268 - protein, 25 aa, Cryptosporidium parvum
SIRFKSNIITFIWKPLYYLLTFFTF

SEQ ID NO: 2241269 - protein, 18 aa, Cryptosporidium parvum
SIRFLKLILLHPNWSEFL

SEQ ID NO: 2241270 - protein, 19 aa, Cryptosporidium parvum
SISISFAFLAKYYFQNTRK

SEQ ID NO: 2241271 - protein, 17 aa, Cryptosporidium parvum
SKFAVFVFYAFFILQNS

SEQ ID NO: 2241272 - protein, 17 aa, Cryptosporidium parvum
SKFFAHFSINAELTKVW

SEQ ID NO: 2241273 - protein, 18 aa, Cryptosporidium parvum
SKIKYKFFRNFQLSPFLP

SEQ ID NO: 2241274 - protein, 17 aa, Cryptosporidium parvum
SLECIRKIISLAISCSS

SEQ ID NO: 2241275 - protein, 18 aa, Cryptosporidium parvum
SLFALSIIWYLSFNPKYI

SEQ ID NO: 2241276 - protein, 23 aa, Cryptosporidium parvum
SLFLKEGILIWILSKEIFAPVSN

SEQ ID NO: 2241277 - protein, 17 aa, Cryptosporidium parvum
SLITLRGSSEFILLSIS

SEQ ID NO: 2241278 - protein, 21 aa, Cryptosporidium parvum
SLKCFHAICWCCTLRLRYLLK

SEQ ID NO: 2241279 - protein, 22 aa, Cryptosporidium parvum
SLKGLCCNFGHLVFPSNGLIQF

SEQ ID NO: 2241280 - protein, 20 aa, Cryptosporidium parvum
SLLLFCIFVGIAIKTFEGMR

SEQ ID NO: 2241281 - protein, 18 aa, Cryptosporidium parvum
SLLPLKFSIGWLTCPSIL

SEQ ID NO: 2241282 - protein, 25 aa, Cryptosporidium parvum
SLLYWSLRVTRYFFPLTIALVLLSF

SEQ ID NO: 2241283 - protein, 20 aa, Cryptosporidium parvum
SLMILFKWIHIFYIEIKYLF

SEQ ID NO: 2241284 - protein, 20 aa, Cryptosporidium parvum
SLNILPFKGFEILDKYFNNS

SEQ ID NO: 2241285 - protein, 21 aa, Cryptosporidium parvum
SLPFNFLLLFTLLVFSIGVVS

SEQ ID NO: 2241286 - protein, 20 aa, Cryptosporidium parvum
SLWPDYFFKVLFSEWLKVDD

SEQ ID NO: 2241287 - protein, 22 aa, Cryptosporidium parvum
SMKCAFDFLFRGIRRVQRLVEL

SEQ ID NO: 2241288 - protein, 18 aa, Cryptosporidium parvum
SMLFWLPYYLIRELNYGP

SEQ ID NO: 2241289 - protein, 18 aa, Cryptosporidium parvum
SNELWKLDIAYFSFQKFG

SEQ ID NO: 2241290 - protein, 18 aa, Cryptosporidium parvum
SNIKFCWFDFHSECSKMR

SEQ ID NO: 2241291 - protein, 23 aa, Cryptosporidium parvum
SNIKSCPVHTAFSYRYQDENFDI

SEQ ID NO: 2241292 - protein, 19 aa, Cryptosporidium parvum
SNILAAIQFLLSDSFGNTL

SEQ ID NO: 2241293 - protein, 19 aa, Cryptosporidium parvum
SNLYFTWLLATRIILSLTT

SEQ ID NO: 2241294 - protein, 24 aa, Cryptosporidium parvum
SNSPFGCLMFRLARTTLEQGLDYS

SEQ ID NO: 2241295 - protein, 18 aa, Cryptosporidium parvum
SPESILFSPFCNISDANE

SEQ ID NO: 2241296 - protein, 17 aa, Cryptosporidium parvum
SPFRIACQFSLIKCTLA

SEQ ID NO: 2241297 - protein, 17 aa, Cryptosporidium parvum
SPIGLTFLNGFAVSLAC

SEQ ID NO: 2241298 - protein, 17 aa, Cryptosporidium parvum
SPIPGPIRFCREVKYLT

SEQ ID NO: 2241299 - protein, 19 aa, Cryptosporidium parvum
SPKRPCWRIILLDDVIWNG

SEQ ID NO: 2241300 - protein, 19 aa, Cryptosporidium parvum
SPLFLCLSILLALVVLIDF

SEQ ID NO: 2241301 - protein, 22 aa, Cryptosporidium parvum
SQFMLSKSFLFKILLLVLNLIP

SEQ ID NO: 2241302 - protein, 18 aa, Cryptosporidium parvum
SQFYPRLSIEKNIKEQDI

SEQ ID NO: 2241303 - protein, 18 aa, Cryptosporidium parvum
SQILRYVDSIAFIIAWNA

SEQ ID NO: 2241304 - protein, 17 aa, Cryptosporidium parvum
SQLGIGITLSWPEGSKP

SEQ ID NO: 2241305 - protein, 19 aa, Cryptosporidium parvum
SQLSHFGWFKLILNGGEKI

SEQ ID NO: 2241306 - protein, 18 aa, Cryptosporidium parvum
SRALYCFGKNIAPFLNNP

SEQ ID NO: 2241307 - protein, 18 aa, Cryptosporidium parvum
SREGLKWVCMDIEKDFGD

SEQ ID NO: 2241308 - protein, 19 aa, Cryptosporidium parvum
SRFKLAYSVLRERGFQNSK

SEQ ID NO: 2241309 - protein, 17 aa, Cryptosporidium parvum
SRISFDFKVFDQERKCY

SEQ ID NO: 2241310 - protein, 17 aa, Cryptosporidium parvum
SRLGRCYLWLENKDLVT

SEQ ID NO: 2241311 - protein, 22 aa, Cryptosporidium parvum
SSCKASACNGCLTISKYNVFTG

SEQ ID NO: 2241312 - protein, 19 aa, Cryptosporidium parvum
SSFFLDKRLLCIFEDKKMI

SEQ ID NO: 2241313 - protein, 20 aa, Cryptosporidium parvum
SSFYGQPLIMCFFVTDRIPA

SEQ ID NO: 2241314 - protein, 17 aa, Cryptosporidium parvum
SSLRFKLDYIMNQLEIK

SEQ ID NO: 2241315 - protein, 22 aa, Cryptosporidium parvum
SSSENWLALQFIKQYNVSIYID

SEQ ID NO: 2241316 - protein, 21 aa, Cryptosporidium parvum
STALRICYNIGLTFGRSPVFL

SEQ ID NO: 2241317 - protein, 26 aa, Cryptosporidium parvum
STFVFSWSCSLVWFGNHLLKLFCNVD

SEQ ID NO: 2241318 - protein, 24 aa, Cryptosporidium parvum
STTGFTTDTSMNWPVSITSGELKD

SEQ ID NO: 2241319 - protein, 19 aa, Cryptosporidium parvum
STVFCFFNYIFTDLSRAHD

SEQ ID NO: 2241320 - protein, 25 aa, Cryptosporidium parvum
STYQSICYIWLWDLFVEYFGGSEQI

SEQ ID NO: 2241321 - protein, 19 aa, Cryptosporidium parvum
SWFIFRYFFDFIRYFIEEN

SEQ ID NO: 2241322 - protein, 20 aa, Cryptosporidium parvum
SYTLPIIWLLKSMNLSDSIS

SEQ ID NO: 2241323 - protein, 19 aa, Cryptosporidium parvum
TAIFNWRFVFNIPVPCHFP

SEQ ID NO: 2241324 - protein, 24 aa, Cryptosporidium parvum
TCDSCLYVRLIAFECIKECMKRCI

SEQ ID NO: 2241325 - protein, 20 aa, Cryptosporidium parvum
TCINKLNIVSAIFKILDQKN

SEQ ID NO: 2241326 - protein, 24 aa, Cryptosporidium parvum
TCKIRLNVYAPFWINNRQHIPIYV

SEQ ID NO: 2241327 - protein, 26 aa, Cryptosporidium parvum
TDEEIKCGFCFSKCCCWPVWSGSIIS

SEQ ID NO: 2241328 - protein, 17 aa, Cryptosporidium parvum
TEGRSSIPFGIIPDLNF

SEQ ID NO: 2241329 - protein, 25 aa, Cryptosporidium parvum
TESVIKPDEWCWLEKNGECEAKGAT

SEQ ID NO: 2241330 - protein, 18 aa, Cryptosporidium parvum
TFCIFRLVLNTVQSLIQW

SEQ ID NO: 2241331 - protein, 23 aa, Cryptosporidium parvum
TFKIPEVWGVYKFVINHKRIGYN

SEQ ID NO: 2241332 - protein, 21 aa, Cryptosporidium parvum
TFQLKSCHGVSCASDCIVTEW

SEQ ID NO: 2241333 - protein, 18 aa, Cryptosporidium parvum
TFSSLVLELGIRDNILSQ

SEQ ID NO: 2241334 - protein, 20 aa, Cryptosporidium parvum
TFSSRFGWRRVEEIIKSNTS

SEQ ID NO: 2241335 - protein, 20 aa, Cryptosporidium parvum
TGIFNWRFVFDIKIPTQYPI

SEQ ID NO: 2241336 - protein, 25 aa, Cryptosporidium parvum
THFCLFLWKIIKPFIILSIFILISF

SEQ ID NO: 2241337 - protein, 18 aa, Cryptosporidium parvum
THHCSVCKRCIFKMDHHC

SEQ ID NO: 2241338 - protein, 24 aa, Cryptosporidium parvum
TILPPRLRSIFSINYVKVDDSPES

SEQ ID NO: 2241339 - protein, 23 aa, Cryptosporidium parvum
TILVCIFKKKWLVAFLAFIAGLI

SEQ ID NO: 2241340 - protein, 18 aa, Cryptosporidium parvum
TKGLCVIAFLPHIADSSD

SEQ ID NO: 2241341 - protein, 17 aa, Cryptosporidium parvum
TKNCPKCNDGIKNGDET

SEQ ID NO: 2241342 - protein, 17 aa, Cryptosporidium parvum
TLECLKLLILNKSLFCN

SEQ ID NO: 2241343 - protein, 17 aa, Cryptosporidium parvum
TLKIFYLYARWTLYFNT

SEQ ID NO: 2241344 - protein, 20 aa, Cryptosporidium parvum
TLLILCGLLSMLLNYFTFLV

SEQ ID NO: 2241345 - protein, 17 aa, Cryptosporidium parvum
TLQGMQCCVPQKSAKGW

SEQ ID NO: 2241346 - protein, 17 aa, Cryptosporidium parvum
TNFTGVVEDSILKNNLT

SEQ ID NO: 2241347 - protein, 19 aa, Cryptosporidium parvum
TNIYLKWSRLVYEELENQK

SEQ ID NO: 2241348 - protein, 18 aa, Cryptosporidium parvum
TNLLKSWFSKAFKQGLSL

SEQ ID NO: 2241349 - protein, 19 aa, Cryptosporidium parvum
TNVLKLCRFCIEFLICQRE

SEQ ID NO: 2241350 - protein, 21 aa, Cryptosporidium parvum
TPECSYCKSFPVIVDEKYNII

SEQ ID NO: 2241351 - protein, 23 aa, Cryptosporidium parvum
TQDFGIRCPYFLTSILRSGKVGH

SEQ ID NO: 2241352 - protein, 23 aa, Cryptosporidium parvum
TQQFPFNGSLLLNGKVANITTFD

SEQ ID NO: 2241353 - protein, 17 aa, Cryptosporidium parvum
TRLLKQLFRYIGQNPQH

SEQ ID NO: 2241354 - protein, 19 aa, Cryptosporidium parvum
TRQECLSCTSMAYCSQCPG

SEQ ID NO: 2241355 - protein, 23 aa, Cryptosporidium parvum
TRSKRFPIAISFLSILISFFTKQ

SEQ ID NO: 2241356 - protein, 19 aa, Cryptosporidium parvum
TSFSIPINFLWVIPLGTLP

SEQ ID NO: 2241357 - protein, 23 aa, Cryptosporidium parvum
TTFNFKRCCAKIMNSVTGYFDTF

SEQ ID NO: 2241358 - protein, 24 aa, Cryptosporidium parvum
TTIFECLRIKLLIIPEQKSLIMNI

SEQ ID NO: 2241359 - protein, 20 aa, Cryptosporidium parvum
TTKYEEWWIFAVTKGSNPQI

SEQ ID NO: 2241360 - protein, 18 aa, Cryptosporidium parvum
TVYVWPRNALGLFKSLFD

SEQ ID NO: 2241361 - protein, 21 aa, Cryptosporidium parvum
TWKIPHGYSLLSYIYTYLWQF

SEQ ID NO: 2241362 - protein, 24 aa, Cryptosporidium parvum
TWMICIPSAFLIRPIWILENSLDS

SEQ ID NO: 2241363 - protein, 17 aa, Cryptosporidium parvum
TYFYFPLITDMRIMSSI

SEQ ID NO: 2241364 - protein, 18 aa, Cryptosporidium parvum
VASFLSFLSLMTLFLTAS

SEQ ID NO: 2241365 - protein, 20 aa, Cryptosporidium parvum
VAYYPFKLVVAFLLVIGNVS

SEQ ID NO: 2241366 - protein, 17 aa, Cryptosporidium parvum
VCELKCIIRDLQNRVQW

SEQ ID NO: 2241367 - protein, 17 aa, Cryptosporidium parvum
VCGLIKLIRIIFSIFTY

SEQ ID NO: 2241368 - protein, 17 aa, Cryptosporidium parvum
VCNFKFYTPCIKYLMQF

SEQ ID NO: 2241369 - protein, 17 aa, Cryptosporidium parvum
VCSCCFALVQAVVLPFI

SEQ ID NO: 2241370 - protein, 17 aa, Cryptosporidium parvum
VCTLQGMQCCVPQKSAK

SEQ ID NO: 2241371 - protein, 19 aa, Cryptosporidium parvum
VFIGIKWRNHRLILVFKRL

SEQ ID NO: 2241372 - protein, 19 aa, Cryptosporidium parvum
VFMMTNFIAIMSCYFLFIG

SEQ ID NO: 2241373 - protein, 18 aa, Cryptosporidium parvum
VFVAFCFCMNISLNNMCL

SEQ ID NO: 2241374 - protein, 20 aa, Cryptosporidium parvum
VGFFEVWLLLSLWKRYPARI

SEQ ID NO: 2241375 - protein, 25 aa, Cryptosporidium parvum
VGLIHFFRYFLGGAFQTASVIFNFG

SEQ ID NO: 2241376 - protein, 25 aa, Cryptosporidium parvum
VGLKICFSSKVFKDLILFFGTKVPT

SEQ ID NO: 2241377 - protein, 17 aa, Cryptosporidium parvum
VGPALFWFITWGLILLC

SEQ ID NO: 2241378 - protein, 23 aa, Cryptosporidium parvum
VGTIRPKISFGIFDTISLCLDSC

SEQ ID NO: 2241379 - protein, 18 aa, Cryptosporidium parvum
VHNRWPLCVLVDEKSILP

SEQ ID NO: 2241380 - protein, 21 aa, Cryptosporidium parvum
VHYLMCCLSLITLRGSSEFIL

SEQ ID NO: 2241381 - protein, 19 aa, Cryptosporidium parvum
VIASNFCWDCVKSSKGKVS

SEQ ID NO: 2241382 - protein, 17 aa, Cryptosporidium parvum
VIEGFLFEEIMPEVKKR

SEQ ID NO: 2241383 - protein, 19 aa, Cryptosporidium parvum
VIFRYALEIQYIFYNKKRN

SEQ ID NO: 2241384 - protein, 18 aa, Cryptosporidium parvum
VIIAHKWVEGIAVSAGIK

SEQ ID NO: 2241385 - protein, 18 aa, Cryptosporidium parvum
VIKAFIWNKDYKKLTPQP

SEQ ID NO: 2241386 - protein, 22 aa, Cryptosporidium parvum
VIRFTLCFFDIFGLAHGKNRVN

SEQ ID NO: 2241387 - protein, 18 aa, Cryptosporidium parvum
VIRSWEFLVDFEMEDEVL

SEQ ID NO: 2241388 - protein, 18 aa, Cryptosporidium parvum
VISSLGIFCISAKGFVSV

SEQ ID NO: 2241389 - protein, 17 aa, Cryptosporidium parvum
VKAIICGEAIQLRNPRV

SEQ ID NO: 2241390 - protein, 19 aa, Cryptosporidium parvum
VKFFWKLAYLVLFILCWVV

SEQ ID NO: 2241391 - protein, 17 aa, Cryptosporidium parvum
VLIPHSWLSSQMIYNES

SEQ ID NO: 2241392 - protein, 22 aa, Cryptosporidium parvum
VLLACWSVCIILSILDLYYLNN

SEQ ID NO: 2241393 - protein, 17 aa, Cryptosporidium parvum
VLLGSIIAVIFGCVSKY

SEQ ID NO: 2241394 - protein, 18 aa, Cryptosporidium parvum
VMFLRYFSPLIIYVLDKA

SEQ ID NO: 2241395 - protein, 17 aa, Cryptosporidium parvum
VNLPIFFAMAITLPCFL

SEQ ID NO: 2241396 - protein, 18 aa, Cryptosporidium parvum
VNRAVYWAGMLQRYINKG

SEQ ID NO: 2241397 - protein, 19 aa, Cryptosporidium parvum
VNSLICWNKLIPNFLLCYS

SEQ ID NO: 2241398 - protein, 23 aa, Cryptosporidium parvum
VPARLKSLLPYMGQLISPMLNAL

SEQ ID NO: 2241399 - protein, 17 aa, Cryptosporidium parvum
VPDRPTNTWWNKISGQT

SEQ ID NO: 2241400 - protein, 17 aa, Cryptosporidium parvum
VPPELKLQIPPGSQNSD

SEQ ID NO: 2241401 - protein, 24 aa, Cryptosporidium parvum
VQVFRRMISIFSWFFTGIVILLMV

SEQ ID NO: 2241402 - protein, 19 aa, Cryptosporidium parvum
VRLSFKILACFPFCSSSKR

SEQ ID NO: 2241403 - protein, 25 aa, Cryptosporidium parvum
VRLYRLGKIFKVWRLIKKNNKSIKI

SEQ ID NO: 2241404 - protein, 17 aa, Cryptosporidium parvum
VRPCLRIMVTLIKSFIG

SEQ ID NO: 2241405 - protein, 22 aa, Cryptosporidium parvum
VRYLNEIVHAFVLIQKGFYRSA

SEQ ID NO: 2241406 - protein, 18 aa, Cryptosporidium parvum
VRYYCIHAGFGILYLFIF

SEQ ID NO: 2241407 - protein, 18 aa, Cryptosporidium parvum
VSELNFTSTTGFTTDTSM

SEQ ID NO: 2241408 - protein, 18 aa, Cryptosporidium parvum
VSKRWCIKPALPKYTGLT

SEQ ID NO: 2241409 - protein, 22 aa, Cryptosporidium parvum
VSLEVFSSICFVLCLRGLSTQE

SEQ ID NO: 2241410 - protein, 18 aa, Cryptosporidium parvum
VSQLPFPIVIHRFTNSKE

SEQ ID NO: 2241411 - protein, 17 aa, Cryptosporidium parvum
VSSDTYIYWGYQNKTGT

SEQ ID NO: 2241412 - protein, 20 aa, Cryptosporidium parvum
VSSLCLWWKHPVNYPLSVVL

SEQ ID NO: 2241413 - protein, 26 aa, Cryptosporidium parvum
VSTCLLGSALLEWILSVVFVRQPPTT

SEQ ID NO: 2241414 - protein, 17 aa, Cryptosporidium parvum
VSWMPLMLENCSPALSD

SEQ ID NO: 2241415 - protein, 19 aa, Cryptosporidium parvum
VSWQLLFRYMEYIDRILDI

SEQ ID NO: 2241416 - protein, 19 aa, Cryptosporidium parvum
VTCIFAINCMFRNAANYNH

SEQ ID NO: 2241417 - protein, 18 aa, Cryptosporidium parvum
VTGMKKCVSALIHSNTEL

SEQ ID NO: 2241418 - protein, 19 aa, Cryptosporidium parvum
VTISLDWILKIYKRSLYPE

SEQ ID NO: 2241419 - protein, 17 aa, Cryptosporidium parvum
VTIYIGYFIYLDYRFII

SEQ ID NO: 2241420 - protein, 18 aa, Cryptosporidium parvum
VVFLNFLGLQTFFNTRNV

SEQ ID NO: 2241421 - protein, 17 aa, Cryptosporidium parvum
VVIGFIMSVLSGISIPL

SEQ ID NO: 2241422 - protein, 19 aa, Cryptosporidium parvum
VVIITFVFIIWIRRTNQQV

SEQ ID NO: 2241423 - protein, 19 aa, Cryptosporidium parvum
VVNFLRLYLIKVLPKNILG

SEQ ID NO: 2241424 - protein, 23 aa, Cryptosporidium parvum
VVTICLSIGCSEMCRRKANIRKL

SEQ ID NO: 2241425 - protein, 22 aa, Cryptosporidium parvum
WACKLHYPKLIFRLLEFYIQAR

SEQ ID NO: 2241426 - protein, 17 aa, Cryptosporidium parvum
WAGQISLLWKLQLTLNK

SEQ ID NO: 2241427 - protein, 18 aa, Cryptosporidium parvum
WDAEVLTSYGWIECAGHA

SEQ ID NO: 2241428 - protein, 19 aa, Cryptosporidium parvum
WDIVERWKYQWIFQDAIPF

SEQ ID NO: 2241429 - protein, 17 aa, Cryptosporidium parvum
WELLKNIWLPFRLISKN

SEQ ID NO: 2241430 - protein, 22 aa, Cryptosporidium parvum
WGRLRLLADYGIHFIRHGLTPV

SEQ ID NO: 2241431 - protein, 27 aa, Cryptosporidium parvum
WHPKKRICVFHLLRLCLEHGLQDQTSI

SEQ ID NO: 2241432 - protein, 17 aa, Cryptosporidium parvum
WIALVLFPSFIYIRNTM

SEQ ID NO: 2241433 - protein, 18 aa, Cryptosporidium parvum
WIHGGRLIWYKTGKNSSN

SEQ ID NO: 2241434 - protein, 17 aa, Cryptosporidium parvum
WILLALRCIGGLVFLST

SEQ ID NO: 2241435 - protein, 17 aa, Cryptosporidium parvum
WILPSGFEPQYFQMYAE

SEQ ID NO: 2241436 - protein, 19 aa, Cryptosporidium parvum
WIYCHKFWKETMVYHFLYT

SEQ ID NO: 2241437 - protein, 18 aa, Cryptosporidium parvum
WIYYRIFHGIPFELFEIC

SEQ ID NO: 2241438 - protein, 20 aa, Cryptosporidium parvum
WKIILFFIIWKSRNDFIKFQ

SEQ ID NO: 2241439 - protein, 23 aa, Cryptosporidium parvum
WKLAYLVLFILCWVVFPILLEYE

SEQ ID NO: 2241440 - protein, 19 aa, Cryptosporidium parvum
WKSQCYVDILPLDFCDVNH

SEQ ID NO: 2241441 - protein, 20 aa, Cryptosporidium parvum
WLFVRLEIMGCIAVFTAGTL

SEQ ID NO: 2241442 - protein, 19 aa, Cryptosporidium parvum
WLQNRICYVFKFGCVVGWD

SEQ ID NO: 2241443 - protein, 19 aa, Cryptosporidium parvum
WLRNFCKNGSLQLLVNSLS

SEQ ID NO: 2241444 - protein, 22 aa, Cryptosporidium parvum
WLWSELPIRFAIDLNGLTIRKM

SEQ ID NO: 2241445 - protein, 18 aa, Cryptosporidium parvum
WMDAFIFLIRLCGINLST

SEQ ID NO: 2241446 - protein, 20 aa, Cryptosporidium parvum
WMHRMACFRDDIIFIIYIYQ

SEQ ID NO: 2241447 - protein, 23 aa, Cryptosporidium parvum
WMLVDYRWGWPLVNSYFQLQEPL

SEQ ID NO: 2241448 - protein, 20 aa, Cryptosporidium parvum
WPHQLPIRSWRVWGPSDENI

SEQ ID NO: 2241449 - protein, 23 aa, Cryptosporidium parvum
WPSDLTFKIGLTYCLERLVYSEM

SEQ ID NO: 2241450 - protein, 24 aa, Cryptosporidium parvum
WRCYCLIQRWLGIHIDILGACVIS

SEQ ID NO: 2241451 - protein, 18 aa, Cryptosporidium parvum
WRFWFCPDSNMLETGEDL

SEQ ID NO: 2241452 - protein, 19 aa, Cryptosporidium parvum
WSCEVWFYVPFEITFHPYC

SEQ ID NO: 2241453 - protein, 19 aa, Cryptosporidium parvum
WSIAEAFVLGGISVFGVAI

SEQ ID NO: 2241454 - protein, 19 aa, Cryptosporidium parvum
WSRLKYMYEKAILRKSNLD

SEQ ID NO: 2241455 - protein, 17 aa, Cryptosporidium parvum
WTSCRHLLQLIGQLDPK

SEQ ID NO: 2241456 - protein, 20 aa, Cryptosporidium parvum
WVICCHIFLLYLCISSPNAL

SEQ ID NO: 2241457 - protein, 17 aa, Cryptosporidium parvum
WYIAWTWFVDLILSIST

SEQ ID NO: 2241458 - protein, 18 aa, Cryptosporidium parvum
WYLPQMFLEFSIYNENVD

SEQ ID NO: 2241459 - protein, 18 aa, Cryptosporidium parvum
YAKRFGFKSRRDEVPIEQ

SEQ ID NO: 2241460 - protein, 18 aa, Cryptosporidium parvum
YAVSNGIKTDNVYGLPVD

SEQ ID NO: 2241461 - protein, 17 aa, Cryptosporidium parvum
YCIHAGFGILYLFIFHW

SEQ ID NO: 2241462 - protein, 18 aa, Cryptosporidium parvum
YCLWAGQISLLWKLQLTL

SEQ ID NO: 2241463 - protein, 19 aa, Cryptosporidium parvum
YDFVLRYIFLNSLKISTIA

SEQ ID NO: 2241464 - protein, 25 aa, Cryptosporidium parvum
YDLPDWYKHICIIYASLKEKNRILF

SEQ ID NO: 2241465 - protein, 24 aa, Cryptosporidium parvum
YDYNLCFIIKILIYLISNVKDGLD

SEQ ID NO: 2241466 - protein, 17 aa, Cryptosporidium parvum
YEKKARISFTFNTLDKL

SEQ ID NO: 2241467 - protein, 21 aa, Cryptosporidium parvum
YELIFRLVFHLKYINYLLNNI

SEQ ID NO: 2241468 - protein, 22 aa, Cryptosporidium parvum
YEPRSKFGYRFFLVCNRVQNIG

SEQ ID NO: 2241469 - protein, 24 aa, Cryptosporidium parvum
YFEFPIQILFWFGYENTRLVAYKI

SEQ ID NO: 2241470 - protein, 17 aa, Cryptosporidium parvum
YFFPEQIIDLSLVKIQD

SEQ ID NO: 2241471 - protein, 20 aa, Cryptosporidium parvum
YFRINFAYRFSFIVCCQLNQ

SEQ ID NO: 2241472 - protein, 17 aa, Cryptosporidium parvum
YFSKLKWSWTIALFILC

SEQ ID NO: 2241473 - protein, 18 aa, Cryptosporidium parvum
YFYRELKFTLQRLISNWN

SEQ ID NO: 2241474 - protein, 17 aa, Cryptosporidium parvum
YGCFDQRIQVLNFEISP

SEQ ID NO: 2241475 - protein, 19 aa, Cryptosporidium parvum
YGGPRKWSLGFQILECKKL

SEQ ID NO: 2241476 - protein, 19 aa, Cryptosporidium parvum
YGLCLGLLFLGKREACETT

SEQ ID NO: 2241477 - protein, 19 aa, Cryptosporidium parvum
YGLLSLRKGDLFDFLGCIR

SEQ ID NO: 2241478 - protein, 17 aa, Cryptosporidium parvum
YGLPGFLLLILALILTL

SEQ ID NO: 2241479 - protein, 17 aa, Cryptosporidium parvum
YGLYIGGFFSPFIRLIQ

SEQ ID NO: 2241480 - protein, 24 aa, Cryptosporidium parvum
YILSCWKLLWCLSINELIGEGLRN

SEQ ID NO: 2241481 - protein, 18 aa, Cryptosporidium parvum
YIPPFICNHFIRKDSDSE

SEQ ID NO: 2241482 - protein, 17 aa, Cryptosporidium parvum
YISFFWGMIIILFFLTS

SEQ ID NO: 2241483 - protein, 17 aa, Cryptosporidium parvum
YIVKCILEGSSIRKEDY

SEQ ID NO: 2241484 - protein, 17 aa, Cryptosporidium parvum
YIYRYGLYIYNGLILDF

SEQ ID NO: 2241485 - protein, 25 aa, Cryptosporidium parvum
YKKKRFRFNFGIIILHFILANIKNG

SEQ ID NO: 2241486 - protein, 21 aa, Cryptosporidium parvum
YKKLYLRPWWHSEFVSQIDLE

SEQ ID NO: 2241487 - protein, 23 aa, Cryptosporidium parvum
YKKTLKLAFKILRICMINTNILQ

SEQ ID NO: 2241488 - protein, 18 aa, Cryptosporidium parvum
YKKYRNTYCLGFDSDKSF

SEQ ID NO: 2241489 - protein, 18 aa, Cryptosporidium parvum
YKLLEISLIFAGIVTGIL

SEQ ID NO: 2241490 - protein, 20 aa, Cryptosporidium parvum
YKPPTLYTHQTFDMVDRQIA

SEQ ID NO: 2241491 - protein, 20 aa, Cryptosporidium parvum
YKVNLLVALLICFLLCNTVL

SEQ ID NO: 2241492 - protein, 19 aa, Cryptosporidium parvum
YKVPICLKSIVNHYVRILK

SEQ ID NO: 2241493 - protein, 20 aa, Cryptosporidium parvum
YKWGIEYDKPYLIALPHIFK

SEQ ID NO: 2241494 - protein, 17 aa, Cryptosporidium parvum
YKYAVFVAFCFCMNISL

SEQ ID NO: 2241495 - protein, 21 aa, Cryptosporidium parvum
YKYGLKLYWIRKVSKTLKFLK

SEQ ID NO: 2241496 - protein, 18 aa, Cryptosporidium parvum
YLELIFCEELDWKITFKL

SEQ ID NO: 2241497 - protein, 17 aa, Cryptosporidium parvum
YLKLCLFCKSQILAILK

SEQ ID NO: 2241498 - protein, 18 aa, Cryptosporidium parvum
YLLNFSMLLCFDTILYDL

SEQ ID NO: 2241499 - protein, 22 aa, Cryptosporidium parvum
YLQYRGSIPIVWRQPPNLKKTP

SEQ ID NO: 2241500 - protein, 20 aa, Cryptosporidium parvum
YLYRFCFNATLAVLIESIIS

SEQ ID NO: 2241501 - protein, 20 aa, Cryptosporidium parvum
YMFCKGLQYPTSGWLRLNHL

SEQ ID NO: 2241502 - protein, 23 aa, Cryptosporidium parvum
YNDFLFEFIIKFILKQESCQPLL

SEQ ID NO: 2241503 - protein, 17 aa, Cryptosporidium parvum
YNEIKLCIDYYIQIITM

SEQ ID NO: 2241504 - protein, 24 aa, Cryptosporidium parvum
YNRMAALPLFRLFMKQDKEWINRQ

SEQ ID NO: 2241505 - protein, 19 aa, Cryptosporidium parvum
YNRRFRLMFIPPNEVQHNS

SEQ ID NO: 2241506 - protein, 24 aa, Cryptosporidium parvum
YPYYYRPFFGYGFPLLGTEPYFQS

SEQ ID NO: 2241507 - protein, 17 aa, Cryptosporidium parvum
YRFLRLINCNWTKLRPH

SEQ ID NO: 2241508 - protein, 17 aa, Cryptosporidium parvum
YRIGIIVPEGFWVAEQR

SEQ ID NO: 2241509 - protein, 18 aa, Cryptosporidium parvum
YRKLWLIICLAILALTGI

SEQ ID NO: 2241510 - protein, 19 aa, Cryptosporidium parvum
YRLEYETINLLNLFLQGEF

SEQ ID NO: 2241511 - protein, 19 aa, Cryptosporidium parvum
YRSRWMIAMHPFRVTVSYN

SEQ ID NO: 2241512 - protein, 19 aa, Cryptosporidium parvum
YRVKLGFGLHYGWAIEGAI

SEQ ID NO: 2241513 - protein, 17 aa, Cryptosporidium parvum
YRWLFVRLEIMGCIAVF

SEQ ID NO: 2241514 - protein, 18 aa, Cryptosporidium parvum
YSCLKRGGKVLIPVFAIG

SEQ ID NO: 2241515 - protein, 17 aa, Cryptosporidium parvum
YSFPFSFCLSNFDFRDI

SEQ ID NO: 2241516 - protein, 18 aa, Cryptosporidium parvum
YSKNEFFEVFSWIIDSEI

SEQ ID NO: 2241517 - protein, 19 aa, Cryptosporidium parvum
YSLHCLIELCKFGIIDYDK

SEQ ID NO: 2241518 - protein, 20 aa, Cryptosporidium parvum
YSNTRFGDILTFPTKDYPNG

SEQ ID NO: 2241519 - protein, 23 aa, Cryptosporidium parvum
YSPIFRVVLGVLRWLRWESRVNP

SEQ ID NO: 2241520 - protein, 17 aa, Cryptosporidium parvum
YSREEFYVYQAIFNYSI

SEQ ID NO: 2241521 - protein, 17 aa, Cryptosporidium parvum
YSTELGIILGLESSFTI

SEQ ID NO: 2241522 - protein, 24 aa, Cryptosporidium parvum
YTRMIYDYNSGLLLDSNDEPIPGS

SEQ ID NO: 2241523 - protein, 19 aa, Cryptosporidium parvum
YTVRTWDWFTKPLFNNPWL

SEQ ID NO: 2241524 - protein, 24 aa, Cryptosporidium parvum
YVWIACSFLSFLLVNYYITKWIWG

SEQ ID NO: 2241525 - protein, 18 aa, Cryptosporidium parvum
YWHTLNIFQFMYIFTPAI

SEQ ID NO: 2241526 - protein, 21 aa, Cryptosporidium parvum
YWRRMQIRFPIFFGGSMTEKA

SEQ ID NO: 2241527 - protein, 24 aa, Cryptosporidium parvum
YYEERRWKIYAARRLSQMVQNYWR

SEQ ID NO: 2241528 - protein, 18 aa, Cryptosporidium parvum
YYFKHPWFLKSWKFVNIE

SEQ ID NO: 2241529 - protein, 19 aa, Cryptosporidium parvum
YYLNCVFIAYGIYSAYEAK

SEQ ID NO: 2241530 - protein, 20 aa, Cryptosporidium parvum
YYYLSHSWRSSAFSKLVVSE

SEQ ID NO: 2241531 - protein, 23 aa, Cryptosporidium parvum
FIKFSEFYLNNYKLEGFILGNLN

SEQ ID NO: 2241532 - protein, 28 aa, Cryptosporidium parvum
VSPKSIIQFRFIFPLDKITDNFSEFSTD

SEQ ID NO: 2241533 - protein, 29 aa, Cryptosporidium parvum
AAFHIMGWIFCFFLDKTWFYFPYIGICLW

SEQ ID NO: 2241534 - protein, 25 aa, Cryptosporidium parvum
AAGVGIYFGWKLFKKGKVCSMIKEI

SEQ ID NO: 2241535 - protein, 35 aa, Cryptosporidium parvum; identical to SEQ ID NO: 2129837

SEQ ID NO: 2241536 - protein, 25 aa, Cryptosporidium parvum
AAIYYLVILVVNIKVLLMADHIHYL

SEQ ID NO: 2241537 - protein, 27 aa, Cryptosporidium parvum
AALPGIITFLFFFISSFGFQVLGTVYK

SEQ ID NO: 2241538 - protein, 17 aa, Cryptosporidium parvum
AALSWPITIMQYAATLD

SEQ ID NO: 2241539 - protein, 28 aa, Cryptosporidium parvum
AALVETIIRLLFFFNYFVRMSTEMNNQS

SEQ ID NO: 2241540 - protein, 25 aa, Cryptosporidium parvum
AAMLLLFEILFVTILLNMFTTIIMN

SEQ ID NO: 2241541 - protein, 28 aa, Cryptosporidium parvum
AATLYEIFYFRVFVLLTRFQNVKTILVS

SEQ ID NO: 2241542 - protein, 21 aa, Cryptosporidium parvum
AAVSLFIPYFILGGNNPISND

SEQ ID NO: 2241543 - protein, 24 aa, Cryptosporidium parvum
ACDKIYKRDWQQVCLDWIYCDLCN

SEQ ID NO: 2241544 - protein, 24 aa, Cryptosporidium parvum
ACIASLLMLFRIFQIFSSLFSQVN

SEQ ID NO: 2241545 - protein, 21 aa, Cryptosporidium parvum
ACKFKLLSYFLTPSEFVFEIL

SEQ ID NO: 2241546 - protein, 17 aa, Cryptosporidium parvum
ADEYFYFELDEANPYIL

SEQ ID NO: 2241547 - protein, 23 aa, Cryptosporidium parvum
ADLNTILPFFILLEFNSNGQKHL

SEQ ID NO: 2241548 - protein, 24 aa, Cryptosporidium parvum
ADPSVAQILKLLELDIDLKTNEEA

SEQ ID NO: 2241549 - protein, 32 aa, Cryptosporidium parvum
AEEDKRLPFFYTLRWYWLGVTLFSTGKLWWVP

SEQ ID NO: 2241550 - protein, 24 aa, Cryptosporidium parvum
AEESYQLSFLMLVKMGIIEPVYNI

SEQ ID NO: 2241551 - protein, 24 aa, Cryptosporidium parvum
AEFLMVLGILLHKVGSEVALITLA

SEQ ID NO: 2241552 - protein, 17 aa, Cryptosporidium parvum
AEGIYLPIIYPSDFWCI

SEQ ID NO: 2241553 - protein, 30 aa, Cryptosporidium parvum
AEKLTYQYFLDWFKQIYDNSVLFMFAIQSP

SEQ ID NO: 2241554 - protein, 20 aa, Cryptosporidium parvum
AELIKSLIFSWKIFSERMDI

SEQ ID NO: 2241555 - protein, 28 aa, Cryptosporidium parvum
AELKSPINWLFWILDSDRISLLTMHELN

SEQ ID NO: 2241556 - protein, 29 aa, Cryptosporidium parvum
AEMIFEFHYLLEISLKYLLCNRYDSSELK

SEQ ID NO: 2241557 - protein, 20 aa, Cryptosporidium parvum
AEMIILRNIIKNLHDWYYIV

SEQ ID NO: 2241558 - protein, 23 aa, Cryptosporidium parvum
AENTLIISGLKKKSKLFPKVLTL

SEQ ID NO: 2241559 - protein, 25 aa, Cryptosporidium parvum
AERIDPLLLFYLLTNYFDEMVKIIE

SEQ ID NO: 2241560 - protein, 32 aa, Cryptosporidium parvum
AEWIVMVSTIQWPSFGLLLRWNQRQKRRDNEK

SEQ ID NO: 2241561 - protein, 19 aa, Cryptosporidium parvum
AEYDNLMLPLNKVYVLLLK

SEQ ID NO: 2241562 - protein, 25 aa, Cryptosporidium parvum
AFAAFGMIWIVLLPLWSVCALPSDI

SEQ ID NO: 2241563 - protein, 19 aa, Cryptosporidium parvum
AFCEFINMFSLCIVCKLYT

SEQ ID NO: 2241564 - protein, 25 aa, Cryptosporidium parvum
AFDELVPKPLYRRIVERRRIRAKLL

SEQ ID NO: 2241565 - protein, 18 aa, Cryptosporidium parvum
AFFDILYVITEVLRIFIY

SEQ ID NO: 2241566 - protein, 18 aa, Cryptosporidium parvum
AFGNFPSYIKPMVFSWPS

SEQ ID NO: 2241567 - protein, 18 aa, Cryptosporidium parvum
AFGTYYQHLVLYSIIRNT

SEQ ID NO: 2241568 - protein, 23 aa, Cryptosporidium parvum
AFHVYVCAAFLLHWEKKLRNMEF

SEQ ID NO: 2241569 - protein, 20 aa, Cryptosporidium parvum
AFICIYYFLSIAESISSLIY

SEQ ID NO: 2241570 - protein, 40 aa, Cryptosporidium parvum
AFIRDPYALVLLSGGLLMPRIYTLFIHILGLRCMVPVSHS

SEQ ID NO: 2241571 - protein, 18 aa, Cryptosporidium parvum
AFLNFGQNFIFTGGLLSA

SEQ ID NO: 2241572 - protein, 17 aa, Cryptosporidium parvum
AFLRERAKAHWIICLVD

SEQ ID NO: 2241573 - protein, 24 aa, Cryptosporidium parvum
AFPCSEYLLKLKLILKRNSRNKII

SEQ ID NO: 2241574 - protein, 19 aa, Cryptosporidium parvum
AFQYLMIDFNKKTWKKIIL

SEQ ID NO: 2241575 - protein, 20 aa, Cryptosporidium parvum
AFSFAAFLICSLTLCLYAFL

SEQ ID NO: 2241576 - protein, 22 aa, Cryptosporidium parvum
AFSIEAFLLRLSYSRLFYSYNS

SEQ ID NO: 2241577 - protein, 24 aa, Cryptosporidium parvum
AFYAKRLLPLRTNGNFLLVTLLFG

SEQ ID NO: 2241578 - protein, 24 aa, Cryptosporidium parvum
AGASVGLFWHLLKENKDFVIEAPI

SEQ ID NO: 2241579 - protein, 19 aa, Cryptosporidium parvum
AGELFLVGISFLLDGKIPI

SEQ ID NO: 2241580 - protein, 20 aa, Cryptosporidium parvum
AGFASFLTLFYGVSSGVVQS

SEQ ID NO: 2241581 - protein, 21 aa, Cryptosporidium parvum
AGGVPILVGFVSTCLLGSALL

SEQ ID NO: 2241582 - protein, 23 aa, Cryptosporidium parvum
AGIITIISYLKWGQLCILFDENQ

SEQ ID NO: 2241583 - protein, 26 aa, Cryptosporidium parvum
AGIVGFIRLLVVLSFGAVPALLNYKN

SEQ ID NO: 2241584 - protein, 21 aa, Cryptosporidium parvum
AGLIKLLLSLRNGISPPNLHL

SEQ ID NO: 2241585 - protein, 25 aa, Cryptosporidium parvum
AGMTLFACLIGFILPNLFTPKYTHY

SEQ ID NO: 2241586 - protein, 25 aa, Cryptosporidium parvum
AGNYKLFMLFISTLFLLELAMLLGS

SEQ ID NO: 2241587 - protein, 19 aa, Cryptosporidium parvum
AGQISLLWKLQLTLNKEEN

SEQ ID NO: 2241588 - protein, 23 aa, Cryptosporidium parvum
AGRISPVLLFLSVVLIMGLCIFV

SEQ ID NO: 2241589 - protein, 23 aa, Cryptosporidium parvum
AGRPFYPHKFKISMSLPAYALKY

SEQ ID NO: 2241590 - protein, 20 aa, Cryptosporidium parvum
AHIFWSFSLAELKSPINWLF

SEQ ID NO: 2241591 - protein, 21 aa, Cryptosporidium parvum
AHIGGFVVGILYTFATMKACK

SEQ ID NO: 2241592 - protein, 17 aa, Cryptosporidium parvum
AHLDTPFTSIFAASLRF

SEQ ID NO: 2241593 - protein, 24 aa, Cryptosporidium parvum
AHTLKRFLLLYSLSTGLSLTFGGL

SEQ ID NO: 2241594 - protein, 24 aa, Cryptosporidium parvum
AIAEWLIEVVGMKNILLLSRNPHM

SEQ ID NO: 2241595 - protein, 22 aa, Cryptosporidium parvum
AIFFTLVIFFTTSSILYLTIIL

SEQ ID NO: 2241596 - protein, 17 aa, Cryptosporidium parvum
AIFTLMIYSSMEILSKK

SEQ ID NO: 2241597 - protein, 17 aa, Cryptosporidium parvum
AIFYLKFSRLISTDGNV

SEQ ID NO: 2241598 - protein, 17 aa, Cryptosporidium parvum
AIGFFFCNFGLLISYLF

SEQ ID NO: 2241599 - protein, 17 aa, Cryptosporidium parvum
AIGKLLCYLFIHNPDIT

SEQ ID NO: 2241600 - protein, 20 aa, Cryptosporidium parvum
AIIAYLVFNKTINGSKLLIS

SEQ ID NO: 2241601 - protein, 22 aa, Cryptosporidium parvum
AIICVVMFLIFGVYTMLFSFYT

SEQ ID NO: 2241602 - protein, 23 aa, Cryptosporidium parvum
AIILLTIAYIVVFFLECKKFTKI

SEQ ID NO: 2241603 - protein, 17 aa, Cryptosporidium parvum
AIISLFISTLFKKPFIA

SEQ ID NO: 2241604 - protein, 25 aa, Cryptosporidium parvum
AIKHGFDLIPIYIAGAKDGTYLTLN

SEQ ID NO: 2241605 - protein, 29 aa, Cryptosporidium parvum
AIKNNKHFDLYFPTKIDLLNISSIDFTRN

SEQ ID NO: 2241606 - protein, 29 aa, Cryptosporidium parvum
AIKSFIMGNLIIILFEDSTIKVLKILKSN

SEQ ID NO: 2241607 - protein, 21 aa, Cryptosporidium parvum
AIKSNSWLLPLLRVHINRTEL

SEQ ID NO: 2241608 - protein, 21 aa, Cryptosporidium parvum
AILAFFVLKRKVTVREVIAFS

SEQ ID NO: 2241609 - protein, 23 aa, Cryptosporidium parvum
AILAYIFVLLGICKFISFGKCLS

SEQ ID NO: 2241610 - protein, 17 aa, Cryptosporidium parvum
AILLLFISVICTLIGKN

SEQ ID NO: 2241611 - protein, 20 aa, Cryptosporidium parvum
AILTFTMILIGVISNFFASF

SEQ ID NO: 2241612 - protein, 25 aa, Cryptosporidium parvum
AILVIIHDWISFIRFLKIEFEKIDK

SEQ ID NO: 2241613 - protein, 18 aa, Cryptosporidium parvum
AIPKNRPTALPKSVCKYF

SEQ ID NO: 2241614 - protein, 24 aa, Cryptosporidium parvum
AIQLYNLVIFLLERKKDISPNIRI

SEQ ID NO: 2241615 - protein, 26 aa, Cryptosporidium parvum
AIRIPIMCILFLVIPKESSSFYYFMV

SEQ ID NO: 2241616 - protein, 20 aa, Cryptosporidium parvum
AISFLSILISFFTKQKNQYF

SEQ ID NO: 2241617 - protein, 27 aa, Cryptosporidium parvum
AISILQPILNLLFRAATIYLTTGVSQE

SEQ ID NO: 2241618 - protein, 27 aa, Cryptosporidium parvum
AISYSIRIFIFPIKIASTFAIAIKTFD

SEQ ID NO: 2241619 - protein, 20 aa, Cryptosporidium parvum
AIVISLYIISISSVVLIIEV

SEQ ID NO: 2241620 - protein, 24 aa, Cryptosporidium parvum
AIWAYLGSVLILSLAIFECFFDTH

SEQ ID NO: 2241621 - protein, 24 aa, Cryptosporidium parvum
AKCIQNFWRNIYLKNINIEREILT

SEQ ID NO: 2241622 - protein, 27 aa, Cryptosporidium parvum
AKDGGLPCIVWLLLAIVHCSVNGNKSS

SEQ ID NO: 2241623 - protein, 25 aa, Cryptosporidium parvum
AKDTRLELFPMLPKIFEALSVRLET

SEQ ID NO: 2241624 - protein, 27 aa, Cryptosporidium parvum
AKFDKNYRVIYQKLWLKYINIVIMNYN

SEQ ID NO: 2241625 - protein, 30 aa, Cryptosporidium parvum
AKILCKKACKPFNLLSFSLPDLGQSNLDDK

SEQ ID NO: 2241626 - protein, 26 aa, Cryptosporidium parvum
AKRLREFILLIKRLIHRNGESFLSKV

SEQ ID NO: 2241627 - protein, 24 aa, Cryptosporidium parvum
AKSILFHMLLFIVGKTDEIWILLN

SEQ ID NO: 2241628 - protein, 32 aa, Cryptosporidium parvum; identical to SEQ ID NO: 2129900

SEQ ID NO: 2241629 - protein, 36 aa, Cryptosporidium parvum; identical to SEQ ID NO: 2129901

SEQ ID NO: 2241630 - protein, 20 aa, Cryptosporidium parvum
AKVIPKILLKFFPDLENINL

SEQ ID NO: 2241631 - protein, 35 aa, Cryptosporidium parvum
AKYSFWLTVINLLILNIIYFLFIKNRNLPGKKRSR

SEQ ID NO: 2241632 - protein, 30 aa, Cryptosporidium parvum; identical to SEQ ID NO: 2129902

SEQ ID NO: 2241633 - protein, 24 aa, Cryptosporidium parvum
ALCKNYLISNYLFSSSIPESAEYV

SEQ ID NO: 2241634 - protein, 23 aa, Cryptosporidium parvum
ALDTNGLVWVWGQNNLKQLTGIP

SEQ ID NO: 2241635 - protein, 25 aa, Cryptosporidium parvum
ALEHGLPPTGGWGLGIDRLIMFLAD

SEQ ID NO: 2241636 - protein, 25 aa, Cryptosporidium parvum
ALFAFEIIEYLRFKADMKDPLIIGG

SEQ ID NO: 2241637 - protein, 21 aa, Cryptosporidium parvum
ALFFSIIAFNINFEYDLSLNL

SEQ ID NO: 2241638 - protein, 17 aa, Cryptosporidium parvum
ALILSKIVLNLSSLIGP

SEQ ID NO: 2241639 - protein, 32 aa, Cryptosporidium parvum; identical to SEQ ID NO: 2129909

SEQ ID NO: 2241640 - protein, 18 aa, Cryptosporidium parvum
ALIPTRIILAGKLRIMCF

SEQ ID NO: 2241641 - protein, 21 aa, Cryptosporidium parvum
ALIRLSLFLPFVPSNCLLGLT

SEQ ID NO: 2241642 - protein, 17 aa, Cryptosporidium parvum
ALISLILIIILLTNLIT

SEQ ID NO: 2241643 - protein, 20 aa, Cryptosporidium parvum
ALISSLLFFFLYNYSNLLQN

SEQ ID NO: 2241644 - protein, 23 aa, Cryptosporidium parvum
ALITFLQLIIYIPLVSARKIQSL

SEQ ID NO: 2241645 - protein, 33 aa, Cryptosporidium parvum
ALLHIFQLYPHFIERYFAIFAPNLVSCLNIVSL

SEQ ID NO: 2241646 - protein, 17 aa, Cryptosporidium parvum
ALLLFERFLLVKYTNED

SEQ ID NO: 2241647 - protein, 20 aa, Cryptosporidium parvum
ALLMNPFRRNIKRNSFNINT

SEQ ID NO: 2241648 - protein, 24 aa, Cryptosporidium parvum
ALLYACYFVILLQPLFEIYYIGAS

SEQ ID NO: 2241649 - protein, 31 aa, Cryptosporidium parvum; identical to SEQ ID NO: 2129915

SEQ ID NO: 2241650 - protein, 26 aa, Cryptosporidium parvum
ALNGILRSLILTKLELLEKLSRFKIQ

SEQ ID NO: 2241651 - protein, 20 aa, Cryptosporidium parvum
ALPCCGLLDPLKPVQGYFYV

SEQ ID NO: 2241652 - protein, 20 aa, Cryptosporidium parvum
ALPSDWFLAALQQLSQMNAE

SEQ ID NO: 2241653 - protein, 28 aa, Cryptosporidium parvum
ALRSRTILFGNYHYLLLSIVPAITPRHV

SEQ ID NO: 2241654 - protein, 27 aa, Cryptosporidium parvum
ALTYILLFFLLIPLKDYSIIWKLCLIF

SEQ ID NO: 2241655 - protein, 20 aa, Cryptosporidium parvum
ALVLFNTGLLPYFLESLNKE

SEQ ID NO: 2241656 - protein, 18 aa, Cryptosporidium parvum
ALYLFKHLAKMKKLMILI

SEQ ID NO: 2241657 - protein, 20 aa, Cryptosporidium parvum
ALYSLPIRYSAFSKNKFYID

SEQ ID NO: 2241658 - protein, 18 aa, Cryptosporidium parvum
AMKPWKINSILIKAIKYL

SEQ ID NO: 2241659 - protein, 17 aa, Cryptosporidium parvum
AMTIRFLWSEGGSQFDF

SEQ ID NO: 2241660 - protein, 17 aa, Cryptosporidium parvum
AMYLGEFYFNLLYELFP

SEQ ID NO: 2241661 - protein, 29 aa, Cryptosporidium parvum
AMYSMHFICMFFIPTFFYGLQYLTSNLSD

SEQ ID NO: 2241662 - protein, 32 aa, Cryptosporidium parvum; identical to SEQ ID NO: 2129924

SEQ ID NO: 2241663 - protein, 25 aa, Cryptosporidium parvum
ANCYIPTLLSFYYFEINFSFSDEMP

SEQ ID NO: 2241664 - protein, 24 aa, Cryptosporidium parvum
ANDTERLIYYRSNLRRILTESKLC

SEQ ID NO: 2241665 - protein, 26 aa, Cryptosporidium parvum
ANEENWRAYFNIYLTACIVLPIVCTV

SEQ ID NO: 2241666 - protein, 45 aa, Cryptosporidium parvum; identical to SEQ ID NO: 2129925

SEQ ID NO: 2241667 - protein, 32 aa, Cryptosporidium parvum
ANFVFNQVFLSWFKHFLTPWLKFGTVFDHFSE

SEQ ID NO: 2241668 - protein, 23 aa, Cryptosporidium parvum
ANIEHFRFYTIRNITGNITDVIS

SEQ ID NO: 2241669 - protein, 21 aa, Cryptosporidium parvum
ANLDLNIRIYLPYSSELHVEY

SEQ ID NO: 2241670 - protein, 23 aa, Cryptosporidium parvum
ANQSNLFLYNPFEKKVNDLREIC

SEQ ID NO: 2241671 - protein, 31 aa, Cryptosporidium parvum; identical to SEQ ID NO: 2129932

SEQ ID NO: 2241672 - protein, 27 aa, Cryptosporidium parvum
ANSRSLYLFMIMYGFTIVICKNILLYS

SEQ ID NO: 2241673 - protein, 28 aa, Cryptosporidium parvum
ANTIERILGLRAPFYRLAMNTTTFPEDS

SEQ ID NO: 2241674 - protein, 25 aa, Cryptosporidium parvum
ANYGLPGFLLLILALILTLYFLHVI

SEQ ID NO: 2241675 - protein, 17 aa, Cryptosporidium parvum
APAIPALAAYPIIQNNS

SEQ ID NO: 2241676 - protein, 22 aa, Cryptosporidium parvum
APCSVSFWLFPINLDKYQDKFS

SEQ ID NO: 2241677 - protein, 24 aa, Cryptosporidium parvum
APISHLILHLWVNNIPCSYRGILW

SEQ ID NO: 2241678 - protein, 22 aa, Cryptosporidium parvum
APNGRYILITLGQEYVAKALTM

SEQ ID NO: 2241679 - protein, 17 aa, Cryptosporidium parvum
APTLNILLVPSKTVKRK

SEQ ID NO: 2241680 - protein, 20 aa, Cryptosporidium parvum
AQITFLWGFGLVAIPLKIKN

SEQ ID NO: 2241681 - protein, 26 aa, Cryptosporidium parvum
AQKKKLYLLILLHSVDISNPLMNTNI

SEQ ID NO: 2241682 - protein, 27 aa, Cryptosporidium parvum
AQLIISFVFILLCRFNYKVEISLLFAQ

SEQ ID NO: 2241683 - protein, 18 aa, Cryptosporidium parvum
AQTCPYYYKYGVCNKFIE

SEQ ID NO: 2241684 - protein, 31 aa, Cryptosporidium parvum
AQVSKQLIDWVWIISSLPELIFGLLIQNDGS

SEQ ID NO: 2241685 - protein, 35 aa, Cryptosporidium parvum
ARCLIKKLYMELWYNGWLALLKLVQCMNPHKSKAI

SEQ ID NO: 2241686 - protein, 24 aa, Cryptosporidium parvum
ARILIDLGYFYYLYMLCLTVFCTN

SEQ ID NO: 2241687 - protein, 34 aa, Cryptosporidium parvum
ARIRQYALIWMTWCLWLLGSFLFSFGRVMLGLYH

SEQ ID NO: 2241688 - protein, 23 aa, Cryptosporidium parvum
ARKLRHLLLNYGAIEKIPWGLGD

SEQ ID NO: 2241689 - protein, 20 aa, Cryptosporidium parvum
ARLYSILEEQVWALLPGFFD

SEQ ID NO: 2241690 - protein, 26 aa, Cryptosporidium parvum
ARRFGGFLGCEKLLKDLAQDSLPPGI

SEQ ID NO: 2241691 - protein, 25 aa, Cryptosporidium parvum
ARRSDLLIKILKQVLEIINIENLGQ

SEQ ID NO: 2241692 - protein, 19 aa, Cryptosporidium parvum
ARTFRSIFCLCREGSANHG

SEQ ID NO: 2241693 - protein, 18 aa, Cryptosporidium parvum
ARTYIVGVNWIRNQLPFP

SEQ ID NO: 2241694 - protein, 24 aa, Cryptosporidium parvum
ASAVLRYIEIFLFSGMNGSSPLIT

SEQ ID NO: 2241695 - protein, 19 aa, Cryptosporidium parvum
ASCVLFFIFGLKSLYEGLF

SEQ ID NO: 2241696 - protein, 27 aa, Cryptosporidium parvum
ASESPFYSIIRILPSVKWFKNNGIFSM

SEQ ID NO: 2241697 - protein, 39 aa, Cryptosporidium parvum; identical to SEQ ID NO: 2129955

SEQ ID NO: 2241698 - protein, 24 aa, Cryptosporidium parvum
ASFLVILILALIYRSYRAKSAAKK

SEQ ID NO: 2241699 - protein, 37 aa, Cryptosporidium parvum
ASFRIQFFSGPLVIFLYLAYLLYCILFQTKSSGIFNL

SEQ ID NO: 2241700 - protein, 20 aa, Cryptosporidium parvum
ASFYYPYFFSQKCGFAREFD

SEQ ID NO: 2241701 - protein, 28 aa, Cryptosporidium parvum
ASGIYKEFLVILPWFLDTTIKMQKETKS

SEQ ID NO: 2241702 - protein, 23 aa, Cryptosporidium parvum
ASIFFIIISNCIINFILINCINS

SEQ ID NO: 2241703 - protein, 30 aa, Cryptosporidium parvum; identical to SEQ ID NO: 2129959

SEQ ID NO: 2241704 - protein, 28 aa, Cryptosporidium parvum
ASIKAFAIFGILFVFEEPYLLVSTSRDI

SEQ ID NO: 2241705 - protein, 17 aa, Cryptosporidium parvum
ASIVTIAILYYLQKNNS

SEQ ID NO: 2241706 - protein, 25 aa, Cryptosporidium parvum
ASLARDFIIMVYLQPIYKNNGEEEY

SEQ ID NO: 2241707 - protein, 28 aa, Cryptosporidium parvum
ASLNGFIISQLIFNPLRLKMIKEKYQED

SEQ ID NO: 2241708 - protein, 21 aa, Cryptosporidium parvum
ASNITFFQLYTNYIREYQRRL

SEQ ID NO: 2241709 - protein, 33 aa, Cryptosporidium parvum
ASRKYLSFIFNYYKPILLWIFRIKYNKNKAINP

SEQ ID NO: 2241710 - protein, 32 aa, Cryptosporidium parvum
ASSPIVHWIIIFLCILHMAIFLAIFMNKTQNS

SEQ ID NO: 2241711 - protein, 28 aa, Cryptosporidium parvum
ASTSLSHFLIFYLLSSIPRINKVENGIL

SEQ ID NO: 2241712 - protein, 21 aa, Cryptosporidium parvum
ASYRILVIIALLPMLTVFYGI

SEQ ID NO: 2241713 - protein, 24 aa, Cryptosporidium parvum
ATARAGVKIIYTPTILLSSSESLN

SEQ ID NO: 2241714 - protein, 28 aa, Cryptosporidium parvum
ATCSLFLIISFFVNFLNKHLEVIFTSTT

SEQ ID NO: 2241715 - protein, 36 aa, Cryptosporidium parvum; identical to SEQ ID NO: 2129964

SEQ ID NO: 2241716 - protein, 32 aa, Cryptosporidium parvum
ATFLAPTFTMNWIMFIVPFALAIIIGIPISHC

SEQ ID NO: 2241717 - protein, 29 aa, Cryptosporidium parvum
ATFLGVDFFKLLFENILKLFEDYTKKCAQ

SEQ ID NO: 2241718 - protein, 28 aa, Cryptosporidium parvum
ATGIDEIFYPFIPQLFLMMGREQVISNL

SEQ ID NO: 2241719 - protein, 17 aa, Cryptosporidium parvum
ATIVGFCGFFADCFGMN

SEQ ID NO: 2241720 - protein, 25 aa, Cryptosporidium parvum
ATIYQILIYVFVLASIYNSFVLYFR

SEQ ID NO: 2241721 - protein, 19 aa, Cryptosporidium parvum
ATLVTSLVYVLMGNKLDPA

SEQ ID NO: 2241722 - protein, 22 aa, Cryptosporidium parvum
ATNNFYLQQIYGYGLDDSNSLS

SEQ ID NO: 2241723 - protein, 28 aa, Cryptosporidium parvum
ATQLIVFIIFYLFIGTSLNLPAALASIH

SEQ ID NO: 2241724 - protein, 28 aa, Cryptosporidium parvum
ATRNFISEWFLLVTFYSFFSFIHICFLV

SEQ ID NO: 2241725 - protein, 25 aa, Cryptosporidium parvum
ATSAALWKAYFYRPEEMDDFTTYSM

SEQ ID NO: 2241726 - protein, 27 aa, Cryptosporidium parvum
ATSKILSFVFWLFSYRELAPEHGKNVP

SEQ ID NO: 2241727 - protein, 24 aa, Cryptosporidium parvum
ATVLVFLIVIYFQGFRVDLAVKYQ

SEQ ID NO: 2241728 - protein, 22 aa, Cryptosporidium parvum
ATYFSYYYSVISSLLMIFNYNS

SEQ ID NO: 2241729 - protein, 23 aa, Cryptosporidium parvum
AVEAFFLLICIMALIVCYIVSRV

SEQ ID NO: 2241730 - protein, 25 aa, Cryptosporidium parvum
AVEWERFLILVNKKDFLPNTKWIIP

SEQ ID NO: 2241731 - protein, 19 aa, Cryptosporidium parvum
AVIALFHLLFTKPDKISAL

SEQ ID NO: 2241732 - protein, 20 aa, Cryptosporidium parvum
AVIDLRRRPIKELPDRSMEK

SEQ ID NO: 2241733 - protein, 41 aa, Cryptosporidium parvum
AVISYLMGIYLRPDKYSILLSRVLWLLPHDSPDGKYLSLAF

SEQ ID NO: 2241734 - protein, 27 aa, Cryptosporidium parvum
AVKSMSGFLSRFPLNDILQTSISLYNS

SEQ ID NO: 2241735 - protein, 23 aa, Cryptosporidium parvum
AVLLASLILMPSISSVIIVIIIL

SEQ ID NO: 2241736 - protein, 18 aa, Cryptosporidium parvum
AVLLYYYLWALSKGQIDQ

SEQ ID NO: 2241737 - protein, 20 aa, Cryptosporidium parvum
AVLPLMKIRWKTLNLINTSK

SEQ ID NO: 2241738 - protein, 21 aa, Cryptosporidium parvum
AVLYLFNPCWTFTLSSKTDIF

SEQ ID NO: 2241739 - protein, 20 aa, Cryptosporidium parvum
AVNLHTFGDLWTIPWNCCKD

SEQ ID NO: 2241740 - protein, 22 aa, Cryptosporidium parvum
AVNNKLFSLLFTQSNNISKEVI

SEQ ID NO: 2241741 - protein, 18 aa, Cryptosporidium parvum
AVVRCDLTYRFTGESIFE

SEQ ID NO: 2241742 - protein, 20 aa, Cryptosporidium parvum
AVVSILFSILALLGVSFCSV

SEQ ID NO: 2241743 - protein, 25 aa, Cryptosporidium parvum
AWKLWKTKIFILSGRFPFFSIKDDS

SEQ ID NO: 2241744 - protein, 21 aa, Cryptosporidium parvum
AWLKIRLQVGIIIPLTFFNVF

SEQ ID NO: 2241745 - protein, 18 aa, Cryptosporidium parvum
AWMDNPKLLIKTGQKSHT

SEQ ID NO: 2241746 - protein, 25 aa, Cryptosporidium parvum
AYAVPVYFILLRSFTQDLVTHAVFS

SEQ ID NO: 2241747 - protein, 26 aa, Cryptosporidium parvum
AYLTLFGLTIILFFEKALFSPQDVAQ

SEQ ID NO: 2241748 - protein, 23 aa, Cryptosporidium parvum
AYNNALGFLFLSAGHFSFSNKDK

SEQ ID NO: 2241749 - protein, 25 aa, Cryptosporidium parvum
AYRPPILQMYIFISALGTLFCTIYF

SEQ ID NO: 2241750 - protein, 25 aa, Cryptosporidium parvum
AYRRICKLALYMFYKNLTVGIPVFI

SEQ ID NO: 2241751 - protein, 19 aa, Cryptosporidium parvum
AYSVKRSIRHSWQERIATD

SEQ ID NO: 2241752 - protein, 26 aa, Cryptosporidium parvum
CAEKAFNFFLIILISNLNLTMYEKSI

SEQ ID NO: 2241753 - protein, 29 aa, Cryptosporidium parvum
CALGGPLLGFLFGWGVHLFLKVAQATNDV

SEQ ID NO: 2241754 - protein, 20 aa, Cryptosporidium parvum
CALWMDFQILPDGDQTLIGE

SEQ ID NO: 2241755 - protein, 28 aa, Cryptosporidium parvum
CASAWPWWIYLCLVLLSLVILGMTLIIL

SEQ ID NO: 2241756 - protein, 31 aa, Cryptosporidium parvum; identical to SEQ ID NO: 2129995

SEQ ID NO: 2241757 - protein, 17 aa, Cryptosporidium parvum
CCPISEIAVLFLLSLVS

SEQ ID NO: 2241758 - protein, 24 aa, Cryptosporidium parvum
CDCDRFPEGVACPMVLSGEANIEC

SEQ ID NO: 2241759 - protein, 36 aa, Cryptosporidium parvum; identical to SEQ ID NO: 2129997

SEQ ID NO: 2241760 - protein, 17 aa, Cryptosporidium parvum
CDVAILICVPPELKLQI

SEQ ID NO: 2241761 - protein, 31 aa, Cryptosporidium parvum
CDVLILFDCLFIIPCLLIFLSDFLIPINILV

SEQ ID NO: 2241762 - protein, 24 aa, Cryptosporidium parvum
CEDCNLMIFVIPSQFIRSVASQIR

SEQ ID NO: 2241763 - protein, 28 aa, Cryptosporidium parvum
CEHKKYSWWVYFVFCIATQIIIGAIVKS

SEQ ID NO: 2241764 - protein, 38 aa, Cryptosporidium parvum; identical to SEQ ID NO: 2130000

SEQ ID NO: 2241765 - protein, 22 aa, Cryptosporidium parvum
CENKIYLDPISRCPKGFVEAGN

SEQ ID NO: 2241766 - protein, 32 aa, Cryptosporidium parvum
CEQHSGLYLSWRNIFDYPLTYELLRGLPHSVL

SEQ ID NO: 2241767 - protein, 25 aa, Cryptosporidium parvum
CFDTHFIYILTMFIDQIKEISRSIG

SEQ ID NO: 2241768 - protein, 17 aa, Cryptosporidium parvum
CFFLGLYDDMVPADLLI

SEQ ID NO: 2241769 - protein, 25 aa, Cryptosporidium parvum
CFFLIVCGWVINVFWPFVEGIGIRD

SEQ ID NO: 2241770 - protein, 35 aa, Cryptosporidium parvum
CFFVTIFFSISSLFFLLCLVIRRIYMRRLNNYATT

SEQ ID NO: 2241771 - protein, 26 aa, Cryptosporidium parvum
CFHIPQIKLVLSWISRIYGSNLTLLY

SEQ ID NO: 2241772 - protein, 26 aa, Cryptosporidium parvum
CFHPKEMLLIMGFPNNWFEGVNIDLK

SEQ ID NO: 2241773 - protein, 20 aa, Cryptosporidium parvum
CFKRHILISPQYSTFLVKNL

SEQ ID NO: 2241774 - protein, 23 aa, Cryptosporidium parvum
CFLGCIIFILTYVASRALRANLK

SEQ ID NO: 2241775 - protein, 20 aa, Cryptosporidium parvum
CFMLYKMLIGFYTATNNLEN

SEQ ID NO: 2241776 - protein, 25 aa, Cryptosporidium parvum
CFRDDIIFIIYIYQRWIYRSKKEYQ

SEQ ID NO: 2241777 - protein, 24 aa, Cryptosporidium parvum
CFSIIECLLPFIPLSWTKFFPETN

SEQ ID NO: 2241778 - protein, 24 aa, Cryptosporidium parvum
CFSKCCCWPVWSGSIISFAAYMVM

SEQ ID NO: 2241779 - protein, 23 aa, Cryptosporidium parvum
CFTILLSRIIYWYSTTKLYSEKI

SEQ ID NO: 2241780 - protein, 18 aa, Cryptosporidium parvum
CFVIGLLAVLVSGGSLGS

SEQ ID NO: 2241781 - protein, 18 aa, Cryptosporidium parvum
CGCSGFWSRLLNLFGSCF

SEQ ID NO: 2241782 - protein, 24 aa, Cryptosporidium parvum
CGKTSIFQLLSTLYKKQLYIVNCH

SEQ ID NO: 2241783 - protein, 21 aa, Cryptosporidium parvum
CGSNPIPFFKAGIDSYKVFKG

SEQ ID NO: 2241784 - protein, 28 aa, Cryptosporidium parvum
CGTSLSAIFGFFKTLFCVPNLNNRAQDN

SEQ ID NO: 2241785 - protein, 22 aa, Cryptosporidium parvum
CGVLKLFLSLALSSSKKKFIKQ

SEQ ID NO: 2241786 - protein, 23 aa, Cryptosporidium parvum
CHGWTQFGFVTWMPIYFTDVCKV

SEQ ID NO: 2241787 - protein, 23 aa, Cryptosporidium parvum
CHPSQFLFKCSWHPIKQNLEISA

SEQ ID NO: 2241788 - protein, 21 aa, Cryptosporidium parvum
CHRLLFFLIHVIRRLYEEVFI

SEQ ID NO: 2241789 - protein, 23 aa, Cryptosporidium parvum
CIASVLPFICKILENVKGGYYYP

SEQ ID NO: 2241790 - protein, 24 aa, Cryptosporidium parvum
CICIHVVYCLLCEAPLVEIFQQSQ

SEQ ID NO: 2241791 - protein, 26 aa, Cryptosporidium parvum
CICRFRKLLLIFNYEKNELKLILCEL

SEQ ID NO: 2241792 - protein, 29 aa, Cryptosporidium parvum
CIDNLFDFFVYSILLYNVNFKLFISAIIY

SEQ ID NO: 2241793 - protein, 24 aa, Cryptosporidium parvum
CIEKRKTMLLPEHYLYGVKDLSRH

SEQ ID NO: 2241794 - protein, 22 aa, Cryptosporidium parvum
CIISILIYFASFFLLESHFDLQ

SEQ ID NO: 2241795 - protein, 28 aa, Cryptosporidium parvum
CIKIIWSLQLSIWYKYNVIYRKHIFVLD

SEQ ID NO: 2241796 - protein, 29 aa, Cryptosporidium parvum
CIKLIITKFLLLILVSIVGGSFFPLWAPI

SEQ ID NO: 2241797 - protein, 20 aa, Cryptosporidium parvum
CILPLFDLLINHVNRLQLSD

SEQ ID NO: 2241798 - protein, 26 aa, Cryptosporidium parvum
CILSFFLTFAIHLNFLEANPGGEIFA

SEQ ID NO: 2241799 - protein, 18 aa, Cryptosporidium parvum
CILSWYLGDYSITLNFFA

SEQ ID NO: 2241800 - protein, 34 aa, Cryptosporidium parvum; identical to SEQ ID NO: 2130023

SEQ ID NO: 2241801 - protein, 29 aa, Cryptosporidium parvum
CIPVWNIFLFLFALIGPIINFLKRIFLGK

SEQ ID NO: 2241802 - protein, 18 aa, Cryptosporidium parvum
CIRQFERSLYECEKLNEL

SEQ ID NO: 2241803 - protein, 32 aa, Cryptosporidium parvum
CISLFVSKILVLTFFLVIFTSDFEIQNRLAHF

SEQ ID NO: 2241804 - protein, 26 aa, Cryptosporidium parvum
CISLRMKFFIKALYKKLGKFKKFDMN

SEQ ID NO: 2241805 - protein, 22 aa, Cryptosporidium parvum
CIVPFIIYSEILRDGSLKLKPE

SEQ ID NO: 2241806 - protein, 27 aa, Cryptosporidium parvum
CIYKNPFFYSFFPINSICREFTGLPIT

SEQ ID NO: 2241807 - protein, 21 aa, Cryptosporidium parvum
CIYVSLFLFLIPQILNDLLAN

SEQ ID NO: 2241808 - protein, 17 aa, Cryptosporidium parvum
CKEYGLIAIIVGIPDNA

SEQ ID NO: 2241809 - protein, 28 aa, Cryptosporidium parvum
CKFDEKPFFWCEYLRYLNLSRNKFEELP

SEQ ID NO: 2241810 - protein, 23 aa, Cryptosporidium parvum
CKGFAYIFAMTTLIIAYAVLRQQ

SEQ ID NO: 2241811 - protein, 20 aa, Cryptosporidium parvum
CKIASLWKGYKTRKFMDSII

SEQ ID NO: 2241812 - protein, 29 aa, Cryptosporidium parvum
CKIEIEAFYKWIQVLYYKVLNNNITSNNE

SEQ ID NO: 2241813 - protein, 21 aa, Cryptosporidium parvum
CKLVRLLVERELPPGFYQGVF

SEQ ID NO: 2241814 - protein, 28 aa, Cryptosporidium parvum
CKQDKKNRLFYWLRILLPETRTNQKDKL

SEQ ID NO: 2241815 - protein, 18 aa, Cryptosporidium parvum
CLEKSWSYVLWSEKVNYS

SEQ ID NO: 2241816 - protein, 23 aa, Cryptosporidium parvum
CLGVFTCILTCIIISYIQDNHAR

SEQ ID NO: 2241817 - protein, 27 aa, Cryptosporidium parvum
CLIEFNKFRLFLLLDNEEREFFGTQKE

SEQ ID NO: 2241818 - protein, 18 aa, Cryptosporidium parvum
CLIEVCKQLWDSYYIIDD

SEQ ID NO: 2241819 - protein, 35 aa, Cryptosporidium parvum
CLIHVLLIFIDSLPFWCIYLYFCAFSALRSFIFGS

SEQ ID NO: 2241820 - protein, 17 aa, Cryptosporidium parvum
CLILKKDSKLNSIIREI

SEQ ID NO: 2241821 - protein, 17 aa, Cryptosporidium parvum
CLLFSHENIRTYNQWDV

SEQ ID NO: 2241822 - protein, 17 aa, Cryptosporidium parvum
CLMDILVELLYSLRIND

SEQ ID NO: 2241823 - protein, 26 aa, Cryptosporidium parvum
CLRIVEFIYKLFFRSIEDWHYPITKK

SEQ ID NO: 2241824 - protein, 28 aa, Cryptosporidium parvum
CLSITIWNYLLNPFYVCHISFINSLVIN

SEQ ID NO: 2241825 - protein, 23 aa, Cryptosporidium parvum
CLSPYALLCLWHPHSKSCSMYYS

SEQ ID NO: 2241826 - protein, 24 aa, Cryptosporidium parvum
CLTYLLVAAFTTIALILIFVIFDK

SEQ ID NO: 2241827 - protein, 19 aa, Cryptosporidium parvum
CLVSLIFIIAFANLFNTIF

SEQ ID NO: 2241828 - protein, 18 aa, Cryptosporidium parvum
CLYIVILCIYIPGSIFMY

SEQ ID NO: 2241829 - protein, 24 aa, Cryptosporidium parvum
CMEALPLFLDRIIPSWVAVICSVT

SEQ ID NO: 2241830 - protein, 17 aa, Cryptosporidium parvum
CMIFTSFLSYLGIAGFI

SEQ ID NO: 2241831 - protein, 18 aa, Cryptosporidium parvum
CMNTNILEIAWIILTEFN

SEQ ID NO: 2241832 - protein, 17 aa, Cryptosporidium parvum
CMPGFKPASLRDETCVQ

SEQ ID NO: 2241833 - protein, 28 aa, Cryptosporidium parvum
CNEIKVIYLISLIFRLFSKPRIKIYYNS

SEQ ID NO: 2241834 - protein, 25 aa, Cryptosporidium parvum
CNIIKKIIYLTKLQKNIVFLALNSI

SEQ ID NO: 2241835 - protein, 18 aa, Cryptosporidium parvum
CNIKEFMKIFSASNKKKL

SEQ ID NO: 2241836 - protein, 21 aa, Cryptosporidium parvum
CNKRGNFKNQFLIELLKASNI

SEQ ID NO: 2241837 - protein, 26 aa, Cryptosporidium parvum
CNQKLLNSFFQIILKLSSTCIGFYSF

SEQ ID NO: 2241838 - protein, 24 aa, Cryptosporidium parvum
CNRSNFMFLSKDKLVKILNLIIVL

SEQ ID NO: 2241839 - protein, 18 aa, Cryptosporidium parvum
CNSINHMLVFISSKYTEI

SEQ ID NO: 2241840 - protein, 28 aa, Cryptosporidium parvum
CNVPNDIWRIKLIISRLFKIDSTTHPNL

SEQ ID NO: 2241841 - protein, 22 aa, Cryptosporidium parvum
CPLRRVIYGFMTKIRLLLIESI

SEQ ID NO: 2241842 - protein, 22 aa, Cryptosporidium parvum
CPTFELLLRKCIIEWEKQIDYI

SEQ ID NO: 2241843 - protein, 19 aa, Cryptosporidium parvum
CPTSLICNLLLILEDYLMN

SEQ ID NO: 2241844 - protein, 26 aa, Cryptosporidium parvum
CQYLSTKLISAIIYLAILGLTDHCIL

SEQ ID NO: 2241845 - protein, 28 aa, Cryptosporidium parvum
CRKLQVSDMWYQWILDIINKSDLLGLML

SEQ ID NO: 2241846 - protein, 27 aa, Cryptosporidium parvum
CRRVRGWNLPFLRTIPQMNAITQIRHE

SEQ ID NO: 2241847 - protein, 33 aa, Cryptosporidium parvum
CSEIYNLIIYFISSLIFIYYGIDFELLDEFNLI

SEQ ID NO: 2241848 - protein, 26 aa, Cryptosporidium parvum
CSIDKFLLLFEMLGIILSIPDSSLSN

SEQ ID NO: 2241849 - protein, 17 aa, Cryptosporidium parvum
CSILISLAILSISVFYF

SEQ ID NO: 2241850 - protein, 24 aa, Cryptosporidium parvum
CSISFWREIVTLYKKLKEVIQSHG

SEQ ID NO: 2241851 - protein, 24 aa, Cryptosporidium parvum
CSKLYPALCFDLYGSPGFHNIYVG

SEQ ID NO: 2241852 - protein, 17 aa, Cryptosporidium parvum
CSLLSIEYIKKLQIVFE

SEQ ID NO: 2241853 - protein, 24 aa, Cryptosporidium parvum
CSSIQLMSFWKLYNDVFDLVESEF

SEQ ID NO: 2241854 - protein, 20 aa, Cryptosporidium parvum
CSWMLLLLSYFFGAGYLFSG

SEQ ID NO: 2241855 - protein, 24 aa, Cryptosporidium parvum
CTAPPIVQIFGSILAILGIHFSKK

SEQ ID NO: 2241856 - protein, 22 aa, Cryptosporidium parvum
CTGIFIIFRLSSAMYRYSVLSC

SEQ ID NO: 2241857 - protein, 30 aa, Cryptosporidium parvum
CTLPFPGNDNWLLRRAFLPEVVVQRVAFCK

SEQ ID NO: 2241858 - protein, 27 aa, Cryptosporidium parvum
CTSQYFLWWFILFPLALRVYLTNNIAQ

SEQ ID NO: 2241859 - protein, 24 aa, Cryptosporidium parvum
CTVGFFLMGFIGYSVKLVFIPINN

SEQ ID NO: 2241860 - protein, 24 aa, Cryptosporidium parvum
CVAGIYFFFIFYGIVQERIHTLGD

SEQ ID NO: 2241861 - protein, 17 aa, Cryptosporidium parvum
CVFPYKEYIWKLLNWES

SEQ ID NO: 2241862 - protein, 18 aa, Cryptosporidium parvum
CVGGGLLGYINRAKKLLK

SEQ ID NO: 2241863 - protein, 19 aa, Cryptosporidium parvum
CVGVYFLGVGVVGSVLYIP

SEQ ID NO: 2241864 - protein, 26 aa, Cryptosporidium parvum
CVIRGIMVFILSPLLTRIGYGLTIKE

SEQ ID NO: 2241865 - protein, 19 aa, Cryptosporidium parvum
CVNPKQPFRYNSTRMLNVL

SEQ ID NO: 2241866 - protein, 18 aa, Cryptosporidium parvum
CVQSLENIWRKKSFRRMV

SEQ ID NO: 2241867 - protein, 17 aa, Cryptosporidium parvum
CVRPWWGEPIKNGNLGN

SEQ ID NO: 2241868 - protein, 25 aa, Cryptosporidium parvum
CVTSYSILIWLLLENINALGFVSGF

SEQ ID NO: 2241869 - protein, 30 aa, Cryptosporidium parvum
CWLSIISTCILSLILSLIWIAHPPSSIILD

SEQ ID NO: 2241870 - protein, 17 aa, Cryptosporidium parvum
CYIWNIKGHNALGEIQD

SEQ ID NO: 2241871 - protein, 29 aa, Cryptosporidium parvum
CYKVNLLVALLICFLLCNTVLTSNSTLHF

SEQ ID NO: 2241872 - protein, 19 aa, Cryptosporidium parvum
CYMDSICYILYSKDVLEFV

SEQ ID NO: 2241873 - protein, 29 aa, Cryptosporidium parvum
CYNGWTITVWFHYPLLTNYSYTINNSSNQ

SEQ ID NO: 2241874 - protein, 25 aa, Cryptosporidium parvum
CYNNKHIIVIILEDLLLLLKENIME

SEQ ID NO: 2241875 - protein, 23 aa, Cryptosporidium parvum
CYRYSVLFNLYFDLMEFQKDLLF

SEQ ID NO: 2241876 - protein, 18 aa, Cryptosporidium parvum
CYSGYFQQFYYKDANFIY

SEQ ID NO: 2241877 - protein, 25 aa, Cryptosporidium parvum
DAEIYGEIWIIVLSLVLVSIIVSDE

SEQ ID NO: 2241878 - protein, 25 aa, Cryptosporidium parvum
DAFMAFQILQLLIKLAKTGRTIICT

SEQ ID NO: 2241879 - protein, 38 aa, Cryptosporidium parvum
DAGTKGMLVKWGLVVLIFQLFFSLLVKAGDLDLPSRNS

SEQ ID NO: 2241880 - protein, 25 aa, Cryptosporidium parvum
DAITTKFYILHNWVFFGNNVVNTSQ

SEQ ID NO: 2241881 - protein, 18 aa, Cryptosporidium parvum
DALYFILNPGYTECIHFH

SEQ ID NO: 2241882 - protein, 24 aa, Cryptosporidium parvum
DARKIAIDLLLRPDIYNIPSDIVS

SEQ ID NO: 2241883 - protein, 31 aa, Cryptosporidium parvum
DARNELYFVTIFYGLQFALNRIFQGIISKNM

SEQ ID NO: 2241884 - protein, 33 aa, Cryptosporidium parvum; identical to SEQ ID NO: 2130074

SEQ ID NO: 2241885 - protein, 27 aa, Cryptosporidium parvum
DASPLAIFISVYLQAMSIVQSNLMQIQ

SEQ ID NO: 2241886 - protein, 22 aa, Cryptosporidium parvum
DASSVFKFWKNMTSLVTCISEI

SEQ ID NO: 2241887 - protein, 34 aa, Cryptosporidium parvum
DATLAIAVGLPVGILGLCIIAGSLFLIGGRSGDQ

SEQ ID NO: 2241888 - protein, 26 aa, Cryptosporidium parvum
DATRSTLIFTFLTEKTNKFFDCFLNT

SEQ ID NO: 2241889 - protein, 27 aa, Cryptosporidium parvum
DAVVIFRRIIRLFPSTNLSITSATSLL

SEQ ID NO: 2241890 - protein, 27 aa, Cryptosporidium parvum
DCLERLLKFSIISILWILSANYCNLFK

SEQ ID NO: 2241891 - protein, 31 aa, Cryptosporidium parvum
DDAPDNDFLFKIFPFLSIFNEGSKRIMDEFE

SEQ ID NO: 2241892 - protein, 22 aa, Cryptosporidium parvum
DDDTIILIFNICKNIIISNNNN

SEQ ID NO: 2241893 - protein, 28 aa, Cryptosporidium parvum
DDFHNDIPLLWLLTLSVASVVITVQCLI

SEQ ID NO: 2241894 - protein, 18 aa, Cryptosporidium parvum
DDFYYYHYFGFDQSKQQD

SEQ ID NO: 2241895 - protein, 17 aa, Cryptosporidium parvum
DDILISNKLLYGHKMII

SEQ ID NO: 2241896 - protein, 28 aa, Cryptosporidium parvum
DDITVNFLDGFKLLVNKLSLYRCNEYGN

SEQ ID NO: 2241897 - protein, 36 aa, Cryptosporidium parvum; identical to SEQ ID NO: 2130082

SEQ ID NO: 2241898 - protein, 22 aa, Cryptosporidium parvum
DDKSYNHYCGCKKGYRISSLNQ

SEQ ID NO: 2241899 - protein, 24 aa, Cryptosporidium parvum
DDKVFVYMGMLFSGGLDSTVLLYL

SEQ ID NO: 2241900 - protein, 28 aa, Cryptosporidium parvum
DDLMAIPVTLLVRIIILSNGIEGEIREI

SEQ ID NO: 2241901 - protein, 23 aa, Cryptosporidium parvum
DDMNGFYIMPVKEYYRFLDMESI

SEQ ID NO: 2241902 - protein, 18 aa, Cryptosporidium parvum
DDMVPADLLIPKLKKMMP

SEQ ID NO: 2241903 - protein, 25 aa, Cryptosporidium parvum
DDTIKYLMHIPLSFYNSLSLPMVMG

SEQ ID NO: 2241904 - protein, 19 aa, Cryptosporidium parvum
DDYIIWMFSVVVAPLIIMV

SEQ ID NO: 2241905 - protein, 25 aa, Cryptosporidium parvum
DEALRYLLSSYRLFDPLENSSFSES

SEQ ID NO: 2241906 - protein, 23 aa, Cryptosporidium parvum
DEEPSVAQILKLLQLDVDPKTNE

SEQ ID NO: 2241907 - protein, 23 aa, Cryptosporidium parvum
DEGNLFWVIRSYSLSTGSDVNVD

SEQ ID NO: 2241908 - protein, 23 aa, Cryptosporidium parvum
DEGVILIRQWIIKTSLKFMELFI

SEQ ID NO: 2241909 - protein, 26 aa, Cryptosporidium parvum
DEHLSIIKIILLLLLSTISKVHSKNE

SEQ ID NO: 2241910 - protein, 27 aa, Cryptosporidium parvum
DEIGHLFFEIFPFLSGIENMILKQIIM

SEQ ID NO: 2241911 - protein, 26 aa, Cryptosporidium parvum
DEIIRLKSLIYLYKKMFNKYKEDRNI

SEQ ID NO: 2241912 - protein, 32 aa, Cryptosporidium parvum; identical to SEQ ID NO: 2130091

SEQ ID NO: 2241913 - protein, 22 aa, Cryptosporidium parvum
DEKELMYKYKIKYNSILKEKDM

SEQ ID NO: 2241914 - protein, 35 aa, Cryptosporidium parvum
DEKENPVILLFKDLKRWLALLWTTIESFHLYIELL

SEQ ID NO: 2241915 - protein, 18 aa, Cryptosporidium parvum
DEKHLPYYFLNEFPICKE

SEQ ID NO: 2241916 - protein, 24 aa, Cryptosporidium parvum
DEKLIIILIEWILKNYLIHNEISL

SEQ ID NO: 2241917 - protein, 27 aa, Cryptosporidium parvum
DELFPSWEYGLSLPLPVPFNHPDLLLN

SEQ ID NO: 2241918 - protein, 25 aa, Cryptosporidium parvum
DENCLCIWDIWTNLSYNLPIISRPD

SEQ ID NO: 2241919 - protein, 25 aa, Cryptosporidium parvum
DENIVIIIDLFYLKSMKIWKIDHEL

SEQ ID NO: 2241920 - protein, 26 aa, Cryptosporidium parvum
DENIYIRELLKYFLQNYYDLNPNIIE

SEQ ID NO: 2241921 - protein, 26 aa, Cryptosporidium parvum
DENQLILEWFIVLVTKFLISYLNSNN

SEQ ID NO: 2241922 - protein, 30 aa, Cryptosporidium parvum
DENTLFNGFFINLGILVIAILICVEKGYIS

SEQ ID NO: 2241923 - protein, 17 aa, Cryptosporidium parvum
DENYRICNLSKVKLPNL

SEQ ID NO: 2241924 - protein, 25 aa, Cryptosporidium parvum
DEPQFKTVLVLTLNKPLIGKTFKQE

SEQ ID NO: 2241925 - protein, 17 aa, Cryptosporidium parvum
DERIKLRERLRCNSFKW

SEQ ID NO: 2241926 - protein, 25 aa, Cryptosporidium parvum
DERQFLKYWFVFGETLIEFNDKVIF

SEQ ID NO: 2241927 - protein, 23 aa, Cryptosporidium parvum
DESAIFSLEYFKQIGFKKDYENH

SEQ ID NO: 2241928 - protein, 24 aa, Cryptosporidium parvum
DESFILYYINLVSSLIRYTQNHLL

SEQ ID NO: 2241929 - protein, 37 aa, Cryptosporidium parvum
DETYGLPIDTLTGYPLDPVSLIPFNPETGELFDPISD

SEQ ID NO: 2241930 - protein, 21 aa, Cryptosporidium parvum
DEWRKLLYISFKYEDPTSTFD

SEQ ID NO: 2241931 - protein, 25 aa, Cryptosporidium parvum
DEYIVNDIIPLYPLGSIFESKNEQT

SEQ ID NO: 2241932 - protein, 26 aa, Cryptosporidium parvum
DEYNKFFLAYLSYLVLYSTRKPFSVV

SEQ ID NO: 2241933 - protein, 17 aa, Cryptosporidium parvum
DFCPLVFKQLMQIKRSS

SEQ ID NO: 2241934 - protein, 20 aa, Cryptosporidium parvum
DFFEKIGSIFYLLLLKRYET

SEQ ID NO: 2241935 - protein, 17 aa, Cryptosporidium parvum
DFFIILNDLYDIWFLKF

SEQ ID NO: 2241936 - protein, 24 aa, Cryptosporidium parvum
DFGIRCPYFLTSILRSGKVGHSLK

SEQ ID NO: 2241937 - protein, 25 aa, Cryptosporidium parvum
DFGTLKYIILPPNSFVFELHSLEKS

SEQ ID NO: 2241938 - protein, 23 aa, Cryptosporidium parvum
DFLDKFLDIPLKEAMFIEGAKEK

SEQ ID NO: 2241939 - protein, 19 aa, Cryptosporidium parvum
DFLLKFVNICFTNVIGSSL

SEQ ID NO: 2241940 - protein, 24 aa, Cryptosporidium parvum
DFNTLQFFLLSISNPLKTILNFEL

SEQ ID NO: 2241941 - protein, 29 aa, Cryptosporidium parvum
DFPATLIFDFPTLRLLIEHIDLLKNGNKE

SEQ ID NO: 2241942 - protein, 30 aa, Cryptosporidium parvum; identical to SEQ ID NO: 2130104

SEQ ID NO: 2241943 - protein, 19 aa, Cryptosporidium parvum
DFSRFLVLLLSIYIFSRLD

SEQ ID NO: 2241944 - protein, 19 aa, Cryptosporidium parvum
DFTFRLYALYAQHSYIFFL

SEQ ID NO: 2241945 - protein, 18 aa, Cryptosporidium parvum
DFTKIGVFGYNPPGTSEE

SEQ ID NO: 2241946 - protein, 32 aa, Cryptosporidium parvum
DGDFFILVPATAKPVLIPPIGLSGGTGGVEGK

SEQ ID NO: 2241947 - protein, 22 aa, Cryptosporidium parvum
DGFEVLFGLFLPQLVHDHVGLS

SEQ ID NO: 2241948 - protein, 18 aa, Cryptosporidium parvum
DGGYLVPIIYYLKVDTRR

SEQ ID NO: 2241949 - protein, 27 aa, Cryptosporidium parvum
DGICIIYHIFLLLKSSFKRYFNNNQIT

SEQ ID NO: 2241950 - protein, 32 aa, Cryptosporidium parvum
DGIVNHDLLIRWFQLGIWFPFYRIHNSMNSIS

SEQ ID NO: 2241951 - protein, 35 aa, Cryptosporidium parvum
DGKAIYGDNLLYFKKKIIPKMTILDLIEKSNNVRS

SEQ ID NO: 2241952 - protein, 17 aa, Cryptosporidium parvum
DGLFLLYFQKRANKLKN

SEQ ID NO: 2241953 - protein, 26 aa, Cryptosporidium parvum
DGMVAFYDSLLIKGLPKNSVEYSKML

SEQ ID NO: 2241954 - protein, 24 aa, Cryptosporidium parvum
DGSLDFPCDDLTGMYAFCVGSINN

SEQ ID NO: 2241955 - protein, 44 aa, Cryptosporidium parvum
DGVYTLIHKLTYQLLIMILITGSIQWAFWNTALSKYQAIFVVPI

SEQ ID NO: 2241956 - protein, 25 aa, Cryptosporidium parvum
DGYGIVFKIPLIQNFLLEKISKLEK

SEQ ID NO: 2241957 - protein, 24 aa, Cryptosporidium parvum
DHHKLSFLYLPHNETRLYFSMDGT

SEQ ID NO: 2241958 - protein, 37 aa, Cryptosporidium parvum
DHHSRKLFYQVYRPSILIFGIFLYLFVSNSNQANDYI

SEQ ID NO: 2241959 - protein, 25 aa, Cryptosporidium parvum
DHLKPDFFYAFNSMPGWIQNRFIFA

SEQ ID NO: 2241960 - protein, 32 aa, Cryptosporidium parvum
DHNIPNLLNKYRFLSLLKLPKSHFEKIRQLIF

SEQ ID NO: 2241961 - protein, 23 aa, Cryptosporidium parvum
DHSMKLLIFSLSTLFAGAIISLF

SEQ ID NO: 2241962 - protein, 22 aa, Cryptosporidium parvum
DIALRYFLSRFFLPGESQMVYR

SEQ ID NO: 2241963 - protein, 36 aa, Cryptosporidium parvum
DIEITPIPIEKMLDKYTRMIYDYNSGLLLDSNDEPI

SEQ ID NO: 2241964 - protein, 19 aa, Cryptosporidium parvum
DIESFLSFDSEFEKNEMEE

SEQ ID NO: 2241965 - protein, 33 aa, Cryptosporidium parvum
DIFEKIHIYMIGVLLYFCLTGEYYSFESKNDNL

SEQ ID NO: 2241966 - protein, 23 aa, Cryptosporidium parvum
DIFEPWRAIFLGGVTTIYIDDGN

SEQ ID NO: 2241967 - protein, 27 aa, Cryptosporidium parvum
DIFIKEEILFLINYFKNNGFLEIEKIK

SEQ ID NO: 2241968 - protein, 27 aa, Cryptosporidium parvum
DIFLNDPILGYIFSVYLLLSEKSEARQ

SEQ ID NO: 2241969 - protein, 27 aa, Cryptosporidium parvum
DIFSKLLDTFFILIKVFVQKNVSKLIC

SEQ ID NO: 2241970 - protein, 23 aa, Cryptosporidium parvum
DIGLFGFMYYWNVKLNMVSMINL

SEQ ID NO: 2241971 - protein, 31 aa, Cryptosporidium parvum
DIHSLAYKVFDAQVALLIPIFGRRNVLTFGN

SEQ ID NO: 2241972 - protein, 21 aa, Cryptosporidium parvum
DIIEIYYCFIIGIQKGIEKTE

SEQ ID NO: 2241973 - protein, 19 aa, Cryptosporidium parvum
DIIGKIVSILLIIREKLLP

SEQ ID NO: 2241974 - protein, 26 aa, Cryptosporidium parvum
DIIQMCRPWQIHGVLYWIGDPNGSKI

SEQ ID NO: 2241975 - protein, 25 aa, Cryptosporidium parvum
DIISALLKGPLLYWRDKRLAKLHEV

SEQ ID NO: 2241976 - protein, 28 aa, Cryptosporidium parvum
DIISFLTIIFLIFIYKVFGYVERPERKL

SEQ ID NO: 2241977 - protein, 24 aa, Cryptosporidium parvum
DIKASDIIIRLSLRYINFELNMGE

SEQ ID NO: 2241978 - protein, 29 aa, Cryptosporidium parvum
DIKESTRFLFWIIRHFDLNYLSPTIAFSI

SEQ ID NO: 2241979 - protein, 23 aa, Cryptosporidium parvum
DILTLKFVRIVSTSLFFTGVKPT

SEQ ID NO: 2241980 - protein, 28 aa, Cryptosporidium parvum
DIMALYDPRFLVFEFAYSILLRKDQVEL

SEQ ID NO: 2241981 - protein, 18 aa, Cryptosporidium parvum
DIMEYIYSELLYCYIQTM

SEQ ID NO: 2241982 - protein, 31 aa, Cryptosporidium parvum; identical to SEQ ID NO: 2209184

SEQ ID NO: 2241983 - protein, 24 aa, Cryptosporidium parvum
DINIEILRLIYYELIVHRMSMSFQ

SEQ ID NO: 2241984 - protein, 21 aa, Cryptosporidium parvum
DINKLIQIFRFTLKISSNGIE

SEQ ID NO: 2241985 - protein, 20 aa, Cryptosporidium parvum
DINLPLINFLFTIINVKFDS

SEQ ID NO: 2241986 - protein, 31 aa, Cryptosporidium parvum
DINNDCLILIFALILYLIISIIDIGSDKMTE

SEQ ID NO: 2241987 - protein, 30 aa, Cryptosporidium parvum
DINQGIFKICLLLNFLIISGVLSILINFST

SEQ ID NO: 2241988 - protein, 31 aa, Cryptosporidium parvum; identical to SEQ ID NO: 2130133

SEQ ID NO: 2241989 - protein, 27 aa, Cryptosporidium parvum
DIPEFHLYQWIFVIDFFNTKDTTETDD

SEQ ID NO: 2241990 - protein, 26 aa, Cryptosporidium parvum
DIQQKSMLILLVSLIQFTFKNMYLPT

SEQ ID NO: 2241991 - protein, 17 aa, Cryptosporidium parvum
DIRGEVWCYLLGSDRML

SEQ ID NO: 2241992 - protein, 24 aa, Cryptosporidium parvum
DIRKIPLMFPFLEGEDTKNIIWAP

SEQ ID NO: 2241993 - protein, 18 aa, Cryptosporidium parvum
DIRNGLLFYKGVELLTRN

SEQ ID NO: 2241994 - protein, 26 aa, Cryptosporidium parvum
DISDNFFRIPRSIPISLRLKLNRGTG

SEQ ID NO: 2241995 - protein, 32 aa, Cryptosporidium parvum
DISPEFYSLRDIFFYLKFVITLNFENHPETLN

SEQ ID NO: 2241996 - protein, 21 aa, Cryptosporidium parvum
DISPIIMREYLLKVLINDSCG

SEQ ID NO: 2241997 - protein, 24 aa, Cryptosporidium parvum
DISPWKPVFIDSSDLRFWTIFFED

SEQ ID NO: 2241998 - protein, 18 aa, Cryptosporidium parvum
DISTLNPYTPFDLSLRPS

SEQ ID NO: 2241999 - protein, 21 aa, Cryptosporidium parvum
DISVIPPKTRIPYIPKNWDCE

SEQ ID NO: 2242000 - protein, 17 aa, Cryptosporidium parvum
DIYLIQSLNLVGSYLER

SEQ ID NO: 2242001 - protein, 28 aa, Cryptosporidium parvum
DIYSAALILLELLCPRFTTAMERIHVLD

SEQ ID NO: 2242002 - protein, 19 aa, Cryptosporidium parvum
DKCFIKEDPKFPWPNCSQV

SEQ ID NO: 2242003 - protein, 23 aa, Cryptosporidium parvum
DKCISFEWLLKQSTLFINLNINN

SEQ ID NO: 2242004 - protein, 33 aa, Cryptosporidium parvum
DKDYTKKVLKLVYELSYFALPKDTLNIRKFEAS

SEQ ID NO: 2242005 - protein, 32 aa, Cryptosporidium parvum
DKEEKYFYQVFLKMWFTPLINYLNQFANSEVE

SEQ ID NO: 2242006 - protein, 23 aa, Cryptosporidium parvum
DKHIPLQHFILYILVCNATQLIL

SEQ ID NO: 2242007 - protein, 22 aa, Cryptosporidium parvum
DKIINWFWDVLSELTVLQQQMF

SEQ ID NO: 2242008 - protein, 19 aa, Cryptosporidium parvum
DKITFSISKINLVLSWILN

SEQ ID NO: 2242009 - protein, 23 aa, Cryptosporidium parvum
DKKDPFYKLVKMIDMFVVGNERK

SEQ ID NO: 2242010 - protein, 25 aa, Cryptosporidium parvum
DKKNLYFNFLRYPEKWIRFSESTII

SEQ ID NO: 2242011 - protein, 21 aa, Cryptosporidium parvum
DKLMIISDQIYPFVSYKAIVQ

SEQ ID NO: 2242012 - protein, 19 aa, Cryptosporidium parvum
DKLSLLFRLSILESTEILL

SEQ ID NO: 2242013 - protein, 19 aa, Cryptosporidium parvum
DKLSYLQKNPPITGSIFPD

SEQ ID NO: 2242014 - protein, 19 aa, Cryptosporidium parvum
DKLVWMKTSVLFKSKIHRF

SEQ ID NO: 2242015 - protein, 29 aa, Cryptosporidium parvum
DKMSYNLFIPIWNDKIIPLLLETIKQNNY

SEQ ID NO: 2242016 - protein, 23 aa, Cryptosporidium parvum
DKNLFRFKIFVVTLLYISRSIIE

SEQ ID NO: 2242017 - protein, 19 aa, Cryptosporidium parvum
DKNMDLIILLLMINSSNNN

SEQ ID NO: 2242018 - protein, 24 aa, Cryptosporidium parvum
DKNNRIYMVLKESLDLLYSYLGFN

SEQ ID NO: 2242019 - protein, 28 aa, Cryptosporidium parvum
DKNPFTYPFFILLLDVFTYIIIMCLRHI

SEQ ID NO: 2242020 - protein, 27 aa, Cryptosporidium parvum
DKQYKIWIQTIPYYCYNLILSVLKKEE

SEQ ID NO: 2242021 - protein, 32 aa, Cryptosporidium parvum; identical to SEQ ID NO: 2130150

SEQ ID NO: 2242022 - protein, 25 aa, Cryptosporidium parvum
DKSPIPYISKILFYDVIIQQINNSN

SEQ ID NO: 2242023 - protein, 25 aa, Cryptosporidium parvum
DKVAPFPVFATWVQQIVGVFCFGIL

SEQ ID NO: 2242024 - protein, 26 aa, Cryptosporidium parvum
DKYKGIDYGALLNCKYKYPEQTYSKM

SEQ ID NO: 2242025 - protein, 19 aa, Cryptosporidium parvum
DKYSKFRNWILNSLSSVRE

SEQ ID NO: 2242026 - protein, 30 aa, Cryptosporidium parvum
DLAYFIGMIFSKILLQIFNIKLVNFDRVIS

SEQ ID NO: 2242027 - protein, 22 aa, Cryptosporidium parvum
DLDAILQVVPHLRSLSANIFLE

SEQ ID NO: 2242028 - protein, 24 aa, Cryptosporidium parvum
DLDEYEDLYYYGFENDYGSNHSKN

SEQ ID NO: 2242029 - protein, 19 aa, Cryptosporidium parvum
DLDMWRLNELTKGNCLSVA

SEQ ID NO: 2242030 - protein, 25 aa, Cryptosporidium parvum
DLDSKVAILMAPINETLSILQETTN

SEQ ID NO: 2242031 - protein, 25 aa, Cryptosporidium parvum
DLDSQPLFPWGPLYSYQHPVVTVSQ

SEQ ID NO: 2242032 - protein, 20 aa, Cryptosporidium parvum
DLEIITIVDILFKSSLEKSQ

SEQ ID NO: 2242033 - protein, 26 aa, Cryptosporidium parvum
DLESAKKFLKLLYIQKLWGSNVSKDK

SEQ ID NO: 2242034 - protein, 26 aa, Cryptosporidium parvum
DLETGLPRDPVSGLPQLPNGTLVDPS

SEQ ID NO: 2242035 - protein, 31 aa, Cryptosporidium parvum
DLFDFLGCIRSFRSFFFYNRPKKDVYTASIY

SEQ ID NO: 2242036 - protein, 17 aa, Cryptosporidium parvum
DLFDFYISDGINNKIIV

SEQ ID NO: 2242037 - protein, 27 aa, Cryptosporidium parvum
DLFEIREMVFWFSPFMQISMPLSSDLE

SEQ ID NO: 2242038 - protein, 20 aa, Cryptosporidium parvum
DLFFNFFSKFTEKKIASLKL

SEQ ID NO: 2242039 - protein, 18 aa, Cryptosporidium parvum
DLFFVIDYRFNSFGKKKI

SEQ ID NO: 2242040 - protein, 23 aa, Cryptosporidium parvum
DLIGMINVFYKFDSFLLIFDQNI

SEQ ID NO: 2242041 - protein, 25 aa, Cryptosporidium parvum
DLINNHLIPFILYSINFGILQNDDI

SEQ ID NO: 2242042 - protein, 20 aa, Cryptosporidium parvum
DLIYILERFIYISDNIINII

SEQ ID NO: 2242043 - protein, 19 aa, Cryptosporidium parvum
DLKNWCHGFWFKANKIDIS

SEQ ID NO: 2242044 - protein, 28 aa, Cryptosporidium parvum
DLLKNNSLIYYLIYSSNIIGLLKNGSKS

SEQ ID NO: 2242045 - protein, 23 aa, Cryptosporidium parvum
DLLLGLYRYIGYDEFQFLSMDAP

SEQ ID NO: 2242046 - protein, 18 aa, Cryptosporidium parvum
DLLNINKISLFSAMEVFS

SEQ ID NO: 2242047 - protein, 23 aa, Cryptosporidium parvum
DLNGREFKLIDSLGLFVNLSDVK

SEQ ID NO: 2242048 - protein, 25 aa, Cryptosporidium parvum
DLNHAVEQIFLKSSLYSNDLKKLVL

SEQ ID NO: 2242049 - protein, 24 aa, Cryptosporidium parvum
DLQYKDTLYPVLFQRLPSSSSRTL

SEQ ID NO: 2242050 - protein, 26 aa, Cryptosporidium parvum
DLSAKCQLALPIFIHISKLTLSKWTE

SEQ ID NO: 2242051 - protein, 20 aa, Cryptosporidium parvum
DLSFEPLFKGLPNGLESIVY

SEQ ID NO: 2242052 - protein, 26 aa, Cryptosporidium parvum
DLSLLLLWLVLLMNICIIPIFSIDIF

SEQ ID NO: 2242053 - protein, 23 aa, Cryptosporidium parvum
DLSPLFYSVISKNLRMTHFLLKC

SEQ ID NO: 2242054 - protein, 25 aa, Cryptosporidium parvum
DLSSNLFIGVLYLFSDVYQNNSGSD

SEQ ID NO: 2242055 - protein, 19 aa, Cryptosporidium parvum
DLSSYLFELLRKGGNPTVY

SEQ ID NO: 2242056 - protein, 32 aa, Cryptosporidium parvum; identical to SEQ ID NO: 2130169

SEQ ID NO: 2242057 - protein, 18 aa, Cryptosporidium parvum
DLTFIFGNINSCRKLYQF

SEQ ID NO: 2242058 - protein, 26 aa, Cryptosporidium parvum
DLYLQIYNVFSFSKPILLITISFLEN

SEQ ID NO: 2242059 - protein, 25 aa, Cryptosporidium parvum
DMAHNNWLIFYPIRCLSSTFKIMLH

SEQ ID NO: 2242060 - protein, 19 aa, Cryptosporidium parvum
DMALGRWFKFLNIKAINFN

SEQ ID NO: 2242061 - protein, 18 aa, Cryptosporidium parvum
DMGDMLELLRSYLSQEFF

SEQ ID NO: 2242062 - protein, 23 aa, Cryptosporidium parvum
DMGSKVYIPYTKCVGVKHTTTTT

SEQ ID NO: 2242063 - protein, 31 aa, Cryptosporidium parvum
DMNITSQKMYLLLDILILIKQNWEKMKPSLG

SEQ ID NO: 2242064 - protein, 27 aa, Cryptosporidium parvum
DMTSKKILLYYLSISNSIIKLPENHQG

SEQ ID NO: 2242065 - protein, 26 aa, Cryptosporidium parvum
DNHCSGFWYIKFYIKNLGNVISTSDE

SEQ ID NO: 2242066 - protein, 23 aa, Cryptosporidium parvum
DNIFTFPHVLPYDKSILTLSGPA

SEQ ID NO: 2242067 - protein, 22 aa, Cryptosporidium parvum
DNISTILWFKTFEAKISIILEG

SEQ ID NO: 2242068 - protein, 17 aa, Cryptosporidium parvum
DNKIHLWDLRKSAILDS

SEQ ID NO: 2242069 - protein, 24 aa, Cryptosporidium parvum
DNKNPLLITIQIIPAILGNTASGS

SEQ ID NO: 2242070 - protein, 19 aa, Cryptosporidium parvum
DNKPILYKIKQPIGWMLYD

SEQ ID NO: 2242071 - protein, 28 aa, Cryptosporidium parvum
DNLIKDELKWAYLDHLITTPIGASAVLR

SEQ ID NO: 2242072 - protein, 31 aa, Cryptosporidium parvum
DNLISAWVFVRFLIIGLYVGIATVGIFVWWY

SEQ ID NO: 2242073 - protein, 19 aa, Cryptosporidium parvum
DNLKVILYLYTLSIIRVEK

SEQ ID NO: 2242074 - protein, 25 aa, Cryptosporidium parvum
DNSSGVLLFIPMFLSINKGGNYKVS

SEQ ID NO: 2242075 - protein, 24 aa, Cryptosporidium parvum
DNVKLYCWFIIHKKFDRYSHGQSS

SEQ ID NO: 2242076 - protein, 17 aa, Cryptosporidium parvum
DNWAHIGGFVAGLLWSF

SEQ ID NO: 2242077 - protein, 18 aa, Cryptosporidium parvum
DNYKLLFFSFIQTFVTLF

SEQ ID NO: 2242078 - protein, 27 aa, Cryptosporidium parvum
DPERHFIKYVLAFFAASDGIVMENLAV

SEQ ID NO: 2242079 - protein, 19 aa, Cryptosporidium parvum
DPEWITSNGDYYIIEFTEQ

SEQ ID NO: 2242080 - protein, 17 aa, Cryptosporidium parvum
DPFLPTLKIGNLPEMKL

SEQ ID NO: 2242081 - protein, 24 aa, Cryptosporidium parvum
DPINIVFIKLVSLFSKAFGVFMTG

SEQ ID NO: 2242082 - protein, 26 aa, Cryptosporidium parvum
DPLCTILFSFFVLATTIKILKDSANV

SEQ ID NO: 2242083 - protein, 21 aa, Cryptosporidium parvum
DPLCVKVPILIRPSPINNKLD

SEQ ID NO: 2242084 - protein, 17 aa, Cryptosporidium parvum
DPLILDPWVLVHIVYNM

SEQ ID NO: 2242085 - protein, 26 aa, Cryptosporidium parvum
DPLKIEILKLLILLVKNKYSLETISN

SEQ ID NO: 2242086 - protein, 33 aa, Cryptosporidium parvum; identical to SEQ ID NO: 2188272

SEQ ID NO: 2242087 - protein, 24 aa, Cryptosporidium parvum
DPNLKFEIDFIKKYLSKFSNKNCS

SEQ ID NO: 2242088 - protein, 23 aa, Cryptosporidium parvum
DPNNLFFYNLFSKKQTISSNSNF

SEQ ID NO: 2242089 - protein, 24 aa, Cryptosporidium parvum
DPPRSQWFILRKLAINQFDEILRL

SEQ ID NO: 2242090 - protein, 19 aa, Cryptosporidium parvum
DPRILRIRNLSLEMLHAIY

SEQ ID NO: 2242091 - protein, 22 aa, Cryptosporidium parvum
DQFNLWTTDIWLNIIVAICLGL

SEQ ID NO: 2242092 - protein, 24 aa, Cryptosporidium parvum
DQGIELHILFKRWDIRALNASNIM

SEQ ID NO: 2242093 - protein, 27 aa, Cryptosporidium parvum
DQHKLNLYSKWIKLTLKCRDISYTRKI

SEQ ID NO: 2242094 - protein, 27 aa, Cryptosporidium parvum
DQIDKTKLFILLKKLYLEIKNNYDARI

SEQ ID NO: 2242095 - protein, 21 aa, Cryptosporidium parvum
DQIRKHWFFNAHPGLLELCDT

SEQ ID NO: 2242096 - protein, 24 aa, Cryptosporidium parvum
DQKKLIDIGIFPLALNNLTNIIKI

SEQ ID NO: 2242097 - protein, 26 aa, Cryptosporidium parvum
DQLESIVDILIYLGSFGKNLLGKDSS

SEQ ID NO: 2242098 - protein, 31 aa, Cryptosporidium parvum; identical to SEQ ID NO: 2229706

SEQ ID NO: 2242099 - protein, 22 aa, Cryptosporidium parvum
DQPIFTLNGYRILKSIWYGSRL

SEQ ID NO: 2242100 - protein, 27 aa, Cryptosporidium parvum
DQSFTDPIIFPWINDWIFPEISQDDDS

SEQ ID NO: 2242101 - protein, 23 aa, Cryptosporidium parvum
DQSTFLRAPSLLLGKKIPNYPLN

SEQ ID NO: 2242102 - protein, 23 aa, Cryptosporidium parvum
DQYRWSVANLIKKQSISTQFIVT

SEQ ID NO: 2242103 - protein, 22 aa, Cryptosporidium parvum
DRDLDCIYLTSTGMQTEIRVAD

SEQ ID NO: 2242104 - protein, 23 aa, Cryptosporidium parvum
DRFLLKNGIILDTSIFLPLTIKV

SEQ ID NO: 2242105 - protein, 20 aa, Cryptosporidium parvum
DRHLGPALIPKLLPSLLISE

SEQ ID NO: 2242106 - protein, 28 aa, Cryptosporidium parvum
DRHLLRTLTFIFLFICTTVTYFVSDLGL

SEQ ID NO: 2242107 - protein, 27 aa, Cryptosporidium parvum
DRLERNLRYFLLNYIVIILGMTMLSLI

SEQ ID NO: 2242108 - protein, 19 aa, Cryptosporidium parvum
DRNGLTPFYFLLKDGMSTN

SEQ ID NO: 2242109 - protein, 21 aa, Cryptosporidium parvum
DRPTNTWWNKISGQTYQVDGK

SEQ ID NO: 2242110 - protein, 26 aa, Cryptosporidium parvum
DRRRRNLEFLLNEYEWEEASKGEQEY

SEQ ID NO: 2242111 - protein, 26 aa, Cryptosporidium parvum
DRVRRILFCRYVLPYILYIQHTAFVL

SEQ ID NO: 2242112 - protein, 20 aa, Cryptosporidium parvum
DRYGIYPLNLIIKKAQRIPK

SEQ ID NO: 2242113 - protein, 18 aa, Cryptosporidium parvum
DRYLYIMMEFVIGGEFFT

SEQ ID NO: 2242114 - protein, 24 aa, Cryptosporidium parvum
DRYSSPIFFPIYNSLLDTKCDNFA

SEQ ID NO: 2242115 - protein, 24 aa, Cryptosporidium parvum
DSAIPWWAVILGIVPERFSSSIAC

SEQ ID NO: 2242116 - protein, 19 aa, Cryptosporidium parvum
DSARHTLFKLLYSCIFHTS

SEQ ID NO: 2242117 - protein, 20 aa, Cryptosporidium parvum
DSDLSDIKFLKTGDLGFINN

SEQ ID NO: 2242118 - protein, 18 aa, Cryptosporidium parvum
DSDYILFQRYRCSIHSNH

SEQ ID NO: 2242119 - protein, 20 aa, Cryptosporidium parvum
DSFYIRLIDISTSGIWSLVN

SEQ ID NO: 2242120 - protein, 24 aa, Cryptosporidium parvum
DSIEDILVPVTKPIFSDYSSIGRN

SEQ ID NO: 2242121 - protein, 18 aa, Cryptosporidium parvum
DSINNRIPCMAFDIIMHT

SEQ ID NO: 2242122 - protein, 26 aa, Cryptosporidium parvum
DSIVKGIILWGLPFYVQEKSILNHVQ

SEQ ID NO: 2242123 - protein, 17 aa, Cryptosporidium parvum
DSKLSFFGLSMNSPNTS

SEQ ID NO: 2242124 - protein, 22 aa, Cryptosporidium parvum
DSKMFFFAEKLIFNLKFLIREF

SEQ ID NO: 2242125 - protein, 41 aa, Cryptosporidium parvum
DSKRYLNIYQLWSGLWITILRDVPFTAVYWTLTEKLRSRIV

SEQ ID NO: 2242126 - protein, 19 aa, Cryptosporidium parvum
DSLINYRRKFKESSILDLS

SEQ ID NO: 2242127 - protein, 20 aa, Cryptosporidium parvum
DSLLERLSYSYALSQSVKLS

SEQ ID NO: 2242128 - protein, 21 aa, Cryptosporidium parvum
DSLYLTYITLLGYGKEMELGL

SEQ ID NO: 2242129 - protein, 26 aa, Cryptosporidium parvum
DSNNDIFPRFSFPNYFYHYVSHYTDT

SEQ ID NO: 2242130 - protein, 23 aa, Cryptosporidium parvum
DSNYDHLILPLIDKLISLKEKDQ

SEQ ID NO: 2242131 - protein, 22 aa, Cryptosporidium parvum
DSRKFSLLLYTIISQVLTEINS

SEQ ID NO: 2242132 - protein, 23 aa, Cryptosporidium parvum
DSRNLIILYVCKFIPLTRCDEFA

SEQ ID NO: 2242133 - protein, 18 aa, Cryptosporidium parvum
DSRSWYPLGRIIGQTLFP

SEQ ID NO: 2242134 - protein, 36 aa, Cryptosporidium parvum
DSSLNYYYYYYYYYIILMPILMDKLNNPLYCCLNNY

SEQ ID NO: 2242135 - protein, 26 aa, Cryptosporidium parvum
DSTPLYYILPNFAFGIPLALYIKHTK

SEQ ID NO: 2242136 - protein, 25 aa, Cryptosporidium parvum
DSVLLALSLIFTSPWYIYKDNSLKE

SEQ ID NO: 2242137 - protein, 23 aa, Cryptosporidium parvum
DSVPGYFHPLKQTIYEIGVIPYD

SEQ ID NO: 2242138 - protein, 25 aa, Cryptosporidium parvum
DSWCEKFLQIIFKKLFNPHETLIIR

SEQ ID NO: 2242139 - protein, 27 aa, Cryptosporidium parvum
DSYGVLTYLWFYGIPNKNGKLEFPYGW

SEQ ID NO: 2242140 - protein, 23 aa, Cryptosporidium parvum
DSYVLQTFYKMMTLVVCIGICYG

SEQ ID NO: 2242141 - protein, 33 aa, Cryptosporidium parvum; identical to SEQ ID NO: 2130207

SEQ ID NO: 2242142 - protein, 32 aa, Cryptosporidium parvum
DTFVLNFSLLSKAYFFLRRPVDFEDIPLSLQQ

SEQ ID NO: 2242143 - protein, 20 aa, Cryptosporidium parvum
DTILNPRYIALPTPIKPPPD

SEQ ID NO: 2242144 - protein, 33 aa, Cryptosporidium parvum
DTKIPGVLRLLVRLNMMYYYECRINTLILFCNN

SEQ ID NO: 2242145 - protein, 23 aa, Cryptosporidium parvum
DTKRICEIILRLASQYGPNKKAV

SEQ ID NO: 2242146 - protein, 25 aa, Cryptosporidium parvum
DTKSLNHLIIYLRNIIKARISSHYV

SEQ ID NO: 2242147 - protein, 21 aa, Cryptosporidium parvum
DTLELLIWNYYQGIAFRMVKL

SEQ ID NO: 2242148 - protein, 20 aa, Cryptosporidium parvum
DTLFPKFWVENTFGALLPDI

SEQ ID NO: 2242149 - protein, 23 aa, Cryptosporidium parvum
DTLFSNLPLVLYPGEQRINIREN

SEQ ID NO: 2242150 - protein, 18 aa, Cryptosporidium parvum
DTLNFTNIQKWKLSLRFE

SEQ ID NO: 2242151 - protein, 37 aa, Cryptosporidium parvum; identical to SEQ ID NO: 2130213

SEQ ID NO: 2242152 - protein, 18 aa, Cryptosporidium parvum
DTMLPSFIVERLLIDQKN

SEQ ID NO: 2242153 - protein, 24 aa, Cryptosporidium parvum
DTNIFERIWIFNFDLESEADEYII

SEQ ID NO: 2242154 - protein, 25 aa, Cryptosporidium parvum
DTNTLLFPTMIWINVIRSFILPKDY

SEQ ID NO: 2242155 - protein, 17 aa, Cryptosporidium parvum
DTRQKDIVLKEIKLPFL

SEQ ID NO: 2242156 - protein, 51 aa, Cryptosporidium parvum
DTTFFIRPKSVRIIFIVIISKEFFCFSSNGFPWWRGIISFFKEYLTSNKQS

SEQ ID NO: 2242157 - protein, 24 aa, Cryptosporidium parvum
DTVSDLIFPPKRKSRFPISAYPRA

SEQ ID NO: 2242158 - protein, 24 aa, Cryptosporidium parvum
DTVSLYYLSIVLISFLVLGQFVLT

SEQ ID NO: 2242159 - protein, 25 aa, Cryptosporidium parvum
DTVYIRCDKGKRFRKYTAIPYFKYQ

SEQ ID NO: 2242160 - protein, 27 aa, Cryptosporidium parvum
DTYGLPSLILFIRALNELNPQKNAELV

SEQ ID NO: 2242161 - protein, 29 aa, Cryptosporidium parvum
DVATIADYLRWIALVLFPSFIYIRNTMNS

SEQ ID NO: 2242162 - protein, 25 aa, Cryptosporidium parvum
DVFRRLYSLLIKFAPLDLKDLISIE

SEQ ID NO: 2242163 - protein, 23 aa, Cryptosporidium parvum
DVGHGFIVFLIGLVLVLNYGKLK

SEQ ID NO: 2242164 - protein, 27 aa, Cryptosporidium parvum
DVHPSFPMSYVPKILNFIDRGGNLMIF

SEQ ID NO: 2242165 - protein, 18 aa, Cryptosporidium parvum
DVIFPADIARILVGVTSF

SEQ ID NO: 2242166 - protein, 26 aa, Cryptosporidium parvum
DVKQKDYFIIWGCNYLSQISTYLSIP

SEQ ID NO: 2242167 - protein, 17 aa, Cryptosporidium parvum
DVLFFRFIKLFQSIKQV

SEQ ID NO: 2242168 - protein, 32 aa, Cryptosporidium parvum; identical to SEQ ID NO: 2130221

SEQ ID NO: 2242169 - protein, 24 aa, Cryptosporidium parvum
DVPKYLLDLPYLYNSSRSGYYSHW

SEQ ID NO: 2242170 - protein, 25 aa, Cryptosporidium parvum
DVPLTLEAFRYAGIKIWLLTGDKLE

SEQ ID NO: 2242171 - protein, 20 aa, Cryptosporidium parvum
DVRLSLYSYYKIIFENEMIQ

SEQ ID NO: 2242172 - protein, 24 aa, Cryptosporidium parvum
DVSKRWCIKPALPKYTGLTFSTET

SEQ ID NO: 2242173 - protein, 27 aa, Cryptosporidium parvum
DWINKIFLKSIFGLLHTYPKVYNRFDN

SEQ ID NO: 2242174 - protein, 22 aa, Cryptosporidium parvum
DWKFYNFGNFPLDLEIFEKFVP

SEQ ID NO: 2242175 - protein, 23 aa, Cryptosporidium parvum
DWKGHTLVVKRYASLYFVACIDK

SEQ ID NO: 2242176 - protein, 35 aa, Cryptosporidium parvum; identical to SEQ ID NO: 2130229

SEQ ID NO: 2242177 - protein, 20 aa, Cryptosporidium parvum
DYDYFIWDTLDKLSTRLYEK

SEQ ID NO: 2242178 - protein, 19 aa, Cryptosporidium parvum
DYFQCSINFFLANNFQFDE

SEQ ID NO: 2242179 - protein, 18 aa, Cryptosporidium parvum
DYFYRWKNENLFQKFNTC

SEQ ID NO: 2242180 - protein, 24 aa, Cryptosporidium parvum
DYIKLYFAGLITLINNILLQMIPQ

SEQ ID NO: 2242181 - protein, 20 aa, Cryptosporidium parvum
DYIVFFVTNYQIVCNFKFYT

SEQ ID NO: 2242182 - protein, 24 aa, Cryptosporidium parvum
DYIVWFDLDIVITNKFFSIERILD

SEQ ID NO: 2242183 - protein, 26 aa, Cryptosporidium parvum
DYKFSKINTLQLLEKSLKGLKFEDIS

SEQ ID NO: 2242184 - protein, 26 aa, Cryptosporidium parvum
DYLHYIGHSLPFPVVIYLLSNQFSSE

SEQ ID NO: 2242185 - protein, 24 aa, Cryptosporidium parvum
DYQYTFSCLIFQKKKSELLLLEGK

SEQ ID NO: 2242186 - protein, 23 aa, Cryptosporidium parvum
DYYRKLCSQVIFPTPLVSTDKVV

SEQ ID NO: 2242187 - protein, 23 aa, Cryptosporidium parvum
EAAATVDLFAFTLDGGKRIEVAV

SEQ ID NO: 2242188 - protein, 23 aa, Cryptosporidium parvum
EAALSMFSEFFKSPLFDENYVEK

SEQ ID NO: 2242189 - protein, 36 aa, Cryptosporidium parvum
EAERDLNILYIVWKLLLYITLGVSIMLCIIQNPLTG

SEQ ID NO: 2242190 - protein, 39 aa, Cryptosporidium parvum
EAFALFFDWRFCIDLTGYLIKLLRLFPQRKTYIIKAICS

SEQ ID NO: 2242191 - protein, 24 aa, Cryptosporidium parvum
EAFFSSIFPCKYRPYSYVILTIGA

SEQ ID NO: 2242192 - protein, 17 aa, Cryptosporidium parvum
EAFGEDIVIPLLIMTSD

SEQ ID NO: 2242193 - protein, 22 aa, Cryptosporidium parvum
EAHIIFMFRQYYKLYNTLLKDG

SEQ ID NO: 2242194 - protein, 25 aa, Cryptosporidium parvum
EAKGTIPWLQPLIGSYLLSTFNIWS

SEQ ID NO: 2242195 - protein, 25 aa, Cryptosporidium parvum
EALIQSICMIFFQSSPESKYRVIQY

SEQ ID NO: 2242196 - protein, 19 aa, Cryptosporidium parvum
EAMLQSFWCIHALQHALIT

SEQ ID NO: 2242197 - protein, 20 aa, Cryptosporidium parvum
EANVIRFWNRILAKELKNVA

SEQ ID NO: 2242198 - protein, 17 aa, Cryptosporidium parvum
EARIILSKFINSLNLGN

SEQ ID NO: 2242199 - protein, 26 aa, Cryptosporidium parvum
ECGTSFVMWFGEGTPAATLKCGAYTI

SEQ ID NO: 2242200 - protein, 27 aa, Cryptosporidium parvum
ECPNQYLLLVAFIGMIMLVLLISYGIA

SEQ ID NO: 2242201 - protein, 23 aa, Cryptosporidium parvum
ECRINTLILFCNNPMELWVDYIK

SEQ ID NO: 2242202 - protein, 25 aa, Cryptosporidium parvum
ECVFILYCSFALPSLLFSSFSLMIL

SEQ ID NO: 2242203 - protein, 24 aa, Cryptosporidium parvum
EDCVENIKYLPLKLAQVGASSVIE

SEQ ID NO: 2242204 - protein, 33 aa, Cryptosporidium parvum
EDDFQDLLWHLIIYSIAPFIVYIYNRRMKFVYD

SEQ ID NO: 2242205 - protein, 31 aa, Cryptosporidium parvum; identical to SEQ ID NO: 2130256

SEQ ID NO: 2242206 - protein, 27 aa, Cryptosporidium parvum
EDFLDIPEIFWHNYKFHSVWRNLQEYL

SEQ ID NO: 2242207 - protein, 24 aa, Cryptosporidium parvum
EDFLNNNFFIPPTSNKPILVSKYN

SEQ ID NO: 2242208 - protein, 27 aa, Cryptosporidium parvum
EDFSGIPLFMIFVQSNNLILSSRSYLI

SEQ ID NO: 2242209 - protein, 30 aa, Cryptosporidium parvum
EDGIPGFRILWTVRIIYISSVFLSWLVLFS

SEQ ID NO: 2242210 - protein, 23 aa, Cryptosporidium parvum
EDHLIKSQWFSIIDVLRCEYEIE

SEQ ID NO: 2242211 - protein, 21 aa, Cryptosporidium parvum
EDILTLKMYWKDLKQKCLVKL

SEQ ID NO: 2242212 - protein, 21 aa, Cryptosporidium parvum
EDIPFISGFLYGISLSGFFKA

SEQ ID NO: 2242213 - protein, 25 aa, Cryptosporidium parvum
EDIVYWKFIPNTPIQWIIGLSECLK

SEQ ID NO: 2242214 - protein, 24 aa, Cryptosporidium parvum
EDLASPWVLYINVLGNREYPRGTW

SEQ ID NO: 2242215 - protein, 20 aa, Cryptosporidium parvum
EDLVSRFLGWFNPVNWQVLK

SEQ ID NO: 2242216 - protein, 36 aa, Cryptosporidium parvum
EDMSNFDYLKIFKIPLILFILSFISVLFVDLFGKDY

SEQ ID NO: 2242217 - protein, 25 aa, Cryptosporidium parvum
EDNLIYGYKNPQCVPLTILENGCPM

SEQ ID NO: 2242218 - protein, 30 aa, Cryptosporidium parvum; identical to SEQ ID NO: 2130263

SEQ ID NO: 2242219 - protein, 22 aa, Cryptosporidium parvum
EDPRYTLECLKLLILNKSLFCN

SEQ ID NO: 2242220 - protein, 24 aa, Cryptosporidium parvum
EDRNKLIGILPQVPLILKGWTVRN

SEQ ID NO: 2242221 - protein, 26 aa, Cryptosporidium parvum
EDSEKFYVRVLLNKKRFPKLVYDKIV

SEQ ID NO: 2242222 - protein, 34 aa, Cryptosporidium parvum
EDSLKRWTYILPDILLSFLLNIKIMPALEGDTET

SEQ ID NO: 2242223 - protein, 28 aa, Cryptosporidium parvum
EDTIDYVPIHQLLRQYFPHCTVFVVAHH

SEQ ID NO: 2242224 - protein, 18 aa, Cryptosporidium parvum
EDVISIVFMIFCIINLFC

SEQ ID NO: 2242225 - protein, 30 aa, Cryptosporidium parvum
EEAKNLGRIIFYLGLRFIKNEKVRAELTLG

SEQ ID NO: 2242226 - protein, 23 aa, Cryptosporidium parvum
EECAPGCPKWFIKNGYCDVNCQN

SEQ ID NO: 2242227 - protein, 38 aa, Cryptosporidium parvum
EECIRYIYRYGLYIYNGLILDFKILYKVYQKSFMDSGF

SEQ ID NO: 2242228 - protein, 17 aa, Cryptosporidium parvum
EEDIMEYIYSELLYCYI

SEQ ID NO: 2242229 - protein, 24 aa, Cryptosporidium parvum
EEFLNEDLDPKYRARYPLVENGPF

SEQ ID NO: 2242230 - protein, 21 aa, Cryptosporidium parvum
EEFPWSRLKYMYEKAILRKSN

SEQ ID NO: 2242231 - protein, 25 aa, Cryptosporidium parvum
EEFYSLLIQIFWKKTKFLNNTNSEA

SEQ ID NO: 2242232 - protein, 26 aa, Cryptosporidium parvum
EEGFGNHYFVFFLATIVSGAVGVYIA

SEQ ID NO: 2242233 - protein, 25 aa, Cryptosporidium parvum
EEHSLWVSIISLLIVFEIRSCQHTV

SEQ ID NO: 2242234 - protein, 23 aa, Cryptosporidium parvum
EEKESIDFIFNSALATLAEEDRN

SEQ ID NO: 2242235 - protein, 25 aa, Cryptosporidium parvum
EEKIMRRVPLIKKIYNWSISETNYI

SEQ ID NO: 2242236 - protein, 35 aa, Cryptosporidium parvum; identical to SEQ ID NO: 2130272

SEQ ID NO: 2242237 - protein, 25 aa, Cryptosporidium parvum
EEKLTYYIHPLYLIADFLETDMSSR

SEQ ID NO: 2242238 - protein, 24 aa, Cryptosporidium parvum
EEKRLAIMLFEGGICTYLMIILLN

SEQ ID NO: 2242239 - protein, 40 aa, Cryptosporidium parvum
EEKRPYNYFRNNPIMRLFFFIFVLAMFSPANISNGFQKAQ

SEQ ID NO: 2242240 - protein, 25 aa, Cryptosporidium parvum
EELTIIGVFLRTLLIYKKKLINYLI

SEQ ID NO: 2242241 - protein, 30 aa, Cryptosporidium parvum
EEQSKTIDLLLLLSVYSPYELLLFLEEQKE

SEQ ID NO: 2242242 - protein, 26 aa, Cryptosporidium parvum
EERCLPLKQFFVSFLLNSTFERRNNM

SEQ ID NO: 2242243 - protein, 28 aa, Cryptosporidium parvum
EERWARSYAYFPFPYKPKLMDLDLVVEK

SEQ ID NO: 2242244 - protein, 24 aa, Cryptosporidium parvum
EETISFPRLVIIRPKGLNNLKDVN

SEQ ID NO: 2242245 - protein, 24 aa, Cryptosporidium parvum
EETMRLFYPLVKKDNPRSFEEFPI

SEQ ID NO: 2242246 - protein, 18 aa, Cryptosporidium parvum
EEYIGIRLQCYVNLMITL

SEQ ID NO: 2242247 - protein, 21 aa, Cryptosporidium parvum
EFAALIQFLNGKSVDYIIQSQ

SEQ ID NO: 2242248 - protein, 38 aa, Cryptosporidium parvum
EFCKYMQYFFLIIILLPSTYFLPQIKGIIRIIKSYKKF

SEQ ID NO: 2242249 - protein, 19 aa, Cryptosporidium parvum
EFDLVLFTNILLEIPEIPS

SEQ ID NO: 2242250 - protein, 27 aa, Cryptosporidium parvum
EFEEGIIEILLFPIIRNFCCDEQECVR

SEQ ID NO: 2242251 - protein, 20 aa, Cryptosporidium parvum
EFFHFLVSSYSRQLKRRVLP

SEQ ID NO: 2242252 - protein, 24 aa, Cryptosporidium parvum
EFFSLLLKQYSIIPITYKIGEVLR

SEQ ID NO: 2242253 - protein, 22 aa, Cryptosporidium parvum
EFGLNFCLILLELHILNENKLS

SEQ ID NO: 2242254 - protein, 25 aa, Cryptosporidium parvum
EFIKLFQIIVLLETISKRFINLKNF

SEQ ID NO: 2242255 - protein, 25 aa, Cryptosporidium parvum
EFILKVLALFYWISMPLFRMPHESR

SEQ ID NO: 2242256 - protein, 20 aa, Cryptosporidium parvum
EFISIRKLVCPLFQDWVLEL

SEQ ID NO: 2242257 - protein, 28 aa, Cryptosporidium parvum
EFKDTIMYYIIFLKYVIIVTKLQNCLNE

SEQ ID NO: 2242258 - protein, 17 aa, Cryptosporidium parvum
EFKHREILLYNLKEVFI

SEQ ID NO: 2242259 - protein, 24 aa, Cryptosporidium parvum
EFLQTLRYGLLRENLFLELRGIKE

SEQ ID NO: 2242260 - protein, 17 aa, Cryptosporidium parvum
EFLYLKNENFMNNYISM

SEQ ID NO: 2242261 - protein, 23 aa, Cryptosporidium parvum
EFMDLFLQLFNRIYEYLEPPLYN

SEQ ID NO: 2242262 - protein, 23 aa, Cryptosporidium parvum
EFMDSPIFIIWCANHIRSRLGNE

SEQ ID NO: 2242263 - protein, 20 aa, Cryptosporidium parvum
EFMIIYLIIIAIEVSKRIPS

SEQ ID NO: 2242264 - protein, 20 aa, Cryptosporidium parvum
EFMNLILEYNFQEFFELILW

SEQ ID NO: 2242265 - protein, 18 aa, Cryptosporidium parvum
EFNDKVIFFDLNKKKLFI

SEQ ID NO: 2242266 - protein, 25 aa, Cryptosporidium parvum
EFNEYFIFNGFLLYILLCSFNELED

SEQ ID NO: 2242267 - protein, 32 aa, Cryptosporidium parvum; identical to SEQ ID NO: 2130286

SEQ ID NO: 2242268 - protein, 25 aa, Cryptosporidium parvum
EFNSLNKILLYMHKRKRVCSIIDKL

SEQ ID NO: 2242269 - protein, 22 aa, Cryptosporidium parvum
EFQPFIFNLFSLLCENSNKNHT

SEQ ID NO: 2242270 - protein, 17 aa, Cryptosporidium parvum
EFRVLENPSNKLRYIYN

SEQ ID NO: 2242271 - protein, 18 aa, Cryptosporidium parvum
EFSKILNIPLTLIIIIRG

SEQ ID NO: 2242272 - protein, 23 aa, Cryptosporidium parvum
EFSKYIVILIVLFSLNNQLSNTG

SEQ ID NO: 2242273 - protein, 18 aa, Cryptosporidium parvum
EFSLRIFSYFRSIGVYNT

SEQ ID NO: 2242274 - protein, 28 aa, Cryptosporidium parvum
EFSLYHIMDLILFFLPNKVNKHNSSFYM

SEQ ID NO: 2242275 - protein, 24 aa, Cryptosporidium parvum
EFVDEIVDLLWLGPSSPAISSLLA

SEQ ID NO: 2242276 - protein, 28 aa, Cryptosporidium parvum
EFVHSKIINLPYLSALFNVPNSITHENK

SEQ ID NO: 2242277 - protein, 17 aa, Cryptosporidium parvum
EFYNLIGVNIFAVSYRG

SEQ ID NO: 2242278 - protein, 18 aa, Cryptosporidium parvum
EFYSRIRIILRLSCAISP

SEQ ID NO: 2242279 - protein, 22 aa, Cryptosporidium parvum
EGDSFYIEFIELLFLSQGESYD

SEQ ID NO: 2242280 - protein, 25 aa, Cryptosporidium parvum
EGFTFQTIFRHFPLRRSFVFELMDH

SEQ ID NO: 2242281 - protein, 32 aa, Cryptosporidium parvum
EGFVQGFRVGLIHFFRYFLGGAFQTASVIFNF

SEQ ID NO: 2242282 - protein, 26 aa, Cryptosporidium parvum
EGGICTYLMIILLNQELRNCNIEIDN

SEQ ID NO: 2242283 - protein, 32 aa, Cryptosporidium parvum
EGGLSLFFHVLRTSFFILYESYGGAISDLNQV

SEQ ID NO: 2242284 - protein, 20 aa, Cryptosporidium parvum
EGGSFFALGLINAGYMDQKS

SEQ ID NO: 2242285 - protein, 30 aa, Cryptosporidium parvum
EGISAFIEPIVILFILVLNAFVGVWQESNA

SEQ ID NO: 2242286 - protein, 17 aa, Cryptosporidium parvum
EGLEMYCKTVWKCIVDC

SEQ ID NO: 2242287 - protein, 29 aa, Cryptosporidium parvum
EGLHADFACLIYKALKFKLPAPRVQQIIS

SEQ ID NO: 2242288 - protein, 23 aa, Cryptosporidium parvum
EGQFCMGMVYTLFPFLDSLECIT

SEQ ID NO: 2242289 - protein, 27 aa, Cryptosporidium parvum
EGRLATIILITLTLVLLPHEFQRLKEA

SEQ ID NO: 2242290 - protein, 24 aa, Cryptosporidium parvum
EGRNLLWWMAHLGDEDLIRILVSF

SEQ ID NO: 2242291 - protein, 21 aa, Cryptosporidium parvum
EGSISLLLTYLSKAKENNEKI

SEQ ID NO: 2242292 - protein, 24 aa, Cryptosporidium parvum
EGSLFVLRLKYLNNLFSDLVLNKL

SEQ ID NO: 2242293 - protein, 25 aa, Cryptosporidium parvum
EGVEMMIHRFLISQSTWSSIGKLKD

SEQ ID NO: 2242294 - protein, 21 aa, Cryptosporidium parvum
EGYVIYLILGPYSTNIRDELI

SEQ ID NO: 2242295 - protein, 27 aa, Cryptosporidium parvum
EHDLYLKLCFELLLSFEKHSWAVSIAL

SEQ ID NO: 2242296 - protein, 27 aa, Cryptosporidium parvum
EHDSINRRFLFPILLNYIKTNNIYSQH

SEQ ID NO: 2242297 - protein, 26 aa, Cryptosporidium parvum
EHEYGHFYYNYYLLNNLPIGYVSQIP

SEQ ID NO: 2242298 - protein, 17 aa, Cryptosporidium parvum
EHFSYMITQIISLLLCC

SEQ ID NO: 2242299 - protein, 18 aa, Cryptosporidium parvum
EHFTAIFDVLLQDKAPKL

SEQ ID NO: 2242300 - protein, 42 aa, Cryptosporidium parvum
EHGMLETLYVSRYLYLVVSLLDLPYFVDSFSLFWCKEQERKK

SEQ ID NO: 2242301 - protein, 17 aa, Cryptosporidium parvum
EHIPRFARFDLKIAVSF

SEQ ID NO: 2242302 - protein, 28 aa, Cryptosporidium parvum
EHIYNDFLFEFIIKFILKQESCQPLLNV

SEQ ID NO: 2242303 - protein, 17 aa, Cryptosporidium parvum
EHNQLYRYLIREMNKTS

SEQ ID NO: 2242304 - protein, 22 aa, Cryptosporidium parvum
EHRNYIELLWDFNSIQLEIDVI

SEQ ID NO: 2242305 - protein, 18 aa, Cryptosporidium parvum
EHYAHRFKRFPETLFIYF

SEQ ID NO: 2242306 - protein, 19 aa, Cryptosporidium parvum
EHYTKFVCIIWSIISSMDP

SEQ ID NO: 2242307 - protein, 32 aa, Cryptosporidium parvum
EIAVMFLRYFSPLIIYVLDKALAYYSSSNSQN

SEQ ID NO: 2242308 - protein, 18 aa, Cryptosporidium parvum
EICLDLWYEILDKNISNR

SEQ ID NO: 2242309 - protein, 22 aa, Cryptosporidium parvum
EIDDLLGLLKLLTTIRNSLELG

SEQ ID NO: 2242310 - protein, 19 aa, Cryptosporidium parvum
EIDLLIISNSRRKAFSLIH

SEQ ID NO: 2242311 - protein, 30 aa, Cryptosporidium parvum
EIEDNSQNYIFFPQSFLNLSLKNNISKGSS

SEQ ID NO: 2242312 - protein, 25 aa, Cryptosporidium parvum
EIEEIWLKIIPILSIPSGNLFKTRF

SEQ ID NO: 2242313 - protein, 24 aa, Cryptosporidium parvum
EIEIQWIIPAFYSSLSSSNSKPLK

SEQ ID NO: 2242314 - protein, 24 aa, Cryptosporidium parvum
EIEKLYLFTSDSLNFYWMNLSSTV

SEQ ID NO: 2242315 - protein, 26 aa, Cryptosporidium parvum
EIENLINSLFSLSYYYFKSSFNDICG

SEQ ID NO: 2242316 - protein, 30 aa, Cryptosporidium parvum
EIFSTRFRAFLSYFLPMVYGISLFSVAWLK

SEQ ID NO: 2242317 - protein, 33 aa, Cryptosporidium parvum
EIHDWLTLIVKPINSLLLFSWNSPLTLNGNHKD

SEQ ID NO: 2242318 - protein, 30 aa, Cryptosporidium parvum
EIHLKGFHDVLPKFLRIFAKHLSHPNKYFT

SEQ ID NO: 2242319 - protein, 24 aa, Cryptosporidium parvum
EIIDKFMLNLQYYKELNKTIKYLF

SEQ ID NO: 2242320 - protein, 31 aa, Cryptosporidium parvum; identical to SEQ ID NO: 2130322

SEQ ID NO: 2242321 - protein, 29 aa, Cryptosporidium parvum
EIISLLETLYYKFYYYISSAIRPLKNDKK

SEQ ID NO: 2242322 - protein, 17 aa, Cryptosporidium parvum
EIISTLLNLFLQNVKQP

SEQ ID NO: 2242323 - protein, 24 aa, Cryptosporidium parvum
EIKFEAKFFSLHNFWKVVIGFIMS

SEQ ID NO: 2242324 - protein, 20 aa, Cryptosporidium parvum
EIKGLFSPEFWDFIDSCLTK

SEQ ID NO: 2242325 - protein, 17 aa, Cryptosporidium parvum
EILCMESFLDLQFSIIM

SEQ ID NO: 2242326 - protein, 31 aa, Cryptosporidium parvum
EILGALLSILLIWFMTIMLVYEAIQRMLYPV

SEQ ID NO: 2242327 - protein, 18 aa, Cryptosporidium parvum
EILLFTIKSLSYLWNFEV

SEQ ID NO: 2242328 - protein, 18 aa, Cryptosporidium parvum
EILQLLINILLVITNNMF

SEQ ID NO: 2242329 - protein, 17 aa, Cryptosporidium parvum
EILYGWRALLGYEKGRA

SEQ ID NO: 2242330 - protein, 26 aa, Cryptosporidium parvum
EILYPKRIVIKELIPWIYKAEKKMRH

SEQ ID NO: 2242331 - protein, 29 aa, Cryptosporidium parvum
EINEKYIVYLIFWVVVKFFESIKIVESDR

SEQ ID NO: 2242332 - protein, 21 aa, Cryptosporidium parvum
EINGVYLTWLRPSIISKNAES

SEQ ID NO: 2242333 - protein, 19 aa, Cryptosporidium parvum
EIPSSLPITLLDDKNYKLI

SEQ ID NO: 2242334 - protein, 19 aa, Cryptosporidium parvum
EIPVSSLCLWWKHPVNYPL

SEQ ID NO: 2242335 - protein, 29 aa, Cryptosporidium parvum
EIRELLRKSFSTILPYKPIKDLSERFDNN

SEQ ID NO: 2242336 - protein, 18 aa, Cryptosporidium parvum
EIRQKFKNKFVFGCNIIE

SEQ ID NO: 2242337 - protein, 26 aa, Cryptosporidium parvum
EISGKPYYWLQYFVNNVSVIPIKLNE

SEQ ID NO: 2242338 - protein, 26 aa, Cryptosporidium parvum
EISHQNFLIPLVIKKLLDTLVIHRDL

SEQ ID NO: 2242339 - protein, 25 aa, Cryptosporidium parvum
EISLIFAGIVTGILIFVPTSLIFPK

SEQ ID NO: 2242340 - protein, 26 aa, Cryptosporidium parvum
EISLLFAQIIVLVLLTLLTSRLVTTV

SEQ ID NO: 2242341 - protein, 68 aa, Cryptosporidium parvum
EITGKGLIWRWRRNLRYYWIKLLVLFEEIGMFVTLFSMFLTLLAISMFLLWFLLGSLINSDNILPYVV

SEQ ID NO: 2242342 - protein, 33 aa, Cryptosporidium parvum; identical to SEQ ID NO: 2188875

SEQ ID NO: 2242343 - protein, 59 aa, Cryptosporidium parvum
EITTPDLYLFPRFLSFYKLAPIKLRQQMWLRRPRWFVYEIIPLVILFTKIFSSVDYYSI

SEQ ID NO: 2242344 - protein, 36 aa, Cryptosporidium parvum
EIVYRDLSYWLIPSEYLLYLIFRISSESYSDSLIVL

SEQ ID NO: 2242345 - protein, 18 aa, Cryptosporidium parvum
EIYNSIYLLSINTLNILL

SEQ ID NO: 2242346 - protein, 22 aa, Cryptosporidium parvum
EIYPFVHFFFQNLDISNLNWKV

SEQ ID NO: 2242347 - protein, 32 aa, Cryptosporidium parvum; identical to SEQ ID NO: 2130337

SEQ ID NO: 2242348 - protein, 23 aa, Cryptosporidium parvum
EKALWTILFIILVSTLTLYGYLV

SEQ ID NO: 2242349 - protein, 22 aa, Cryptosporidium parvum
EKDKILIYYNLFPKMNTSEIEF

SEQ ID NO: 2242350 - protein, 25 aa, Cryptosporidium parvum
EKDQKILVLIIFSKLIQYKTDKVSV

SEQ ID NO: 2242351 - protein, 32 aa, Cryptosporidium parvum
EKEDLRSKLKLWIKNWYIIDLILKVVKTQGEE

SEQ ID NO: 2242352 - protein, 35 aa, Cryptosporidium parvum; identical to SEQ ID NO: 2130340

SEQ ID NO: 2242353 - protein, 21 aa, Cryptosporidium parvum
EKFIHIHRPFLFSSKMVHTDF

SEQ ID NO: 2242354 - protein, 24 aa, Cryptosporidium parvum
EKFNQTIINFPWISSKYSYKWNVI

SEQ ID NO: 2242355 - protein, 25 aa, Cryptosporidium parvum
EKGFIYFITCLVCQICLVLSDLLSK

SEQ ID NO: 2242356 - protein, 23 aa, Cryptosporidium parvum
EKGLYYIVGYIKYTLCIIQQPDS

SEQ ID NO: 2242357 - protein, 17 aa, Cryptosporidium parvum
EKGVYYAIDMGGTNLRC

SEQ ID NO: 2242358 - protein, 25 aa, Cryptosporidium parvum
EKIDLFMDFWEFIKRNALIKNGKFL

SEQ ID NO: 2242359 - protein, 19 aa, Cryptosporidium parvum
EKIWNKTFWMTVLSSIIFS

SEQ ID NO: 2242360 - protein, 41 aa, Cryptosporidium parvum
EKKGIGYLFFFFKNYKFFFLRKFFFFFQIKKKMNEIVNKHG

SEQ ID NO: 2242361 - protein, 26 aa, Cryptosporidium parvum
EKLAAETIFFFLRDFIRNPIEILKSK

SEQ ID NO: 2242362 - protein, 21 aa, Cryptosporidium parvum
EKLLDALYKYSIQNADLILKN

SEQ ID NO: 2242363 - protein, 19 aa, Cryptosporidium parvum
EKLLLYLVGISMGGLMTLC

SEQ ID NO: 2242364 - protein, 18 aa, Cryptosporidium parvum
EKLLSRLRYTKLSFFEST

SEQ ID NO: 2242365 - protein, 24 aa, Cryptosporidium parvum
EKLNFENKIPLLLNQEYAFLKEEW

SEQ ID NO: 2242366 - protein, 23 aa, Cryptosporidium parvum
EKLPFFTINIFSQLFIEHYRNLD

SEQ ID NO: 2242367 - protein, 27 aa, Cryptosporidium parvum
EKLPKDLFGRLRYLFTTSNFDVLAERF

SEQ ID NO: 2242368 - protein, 22 aa, Cryptosporidium parvum
EKLTIWIGSWNLGGQPLNIDLD

SEQ ID NO: 2242369 - protein, 24 aa, Cryptosporidium parvum
EKLVNFTLALILYLRERQYDINYI

SEQ ID NO: 2242370 - protein, 24 aa, Cryptosporidium parvum
EKMEMIFILPYGKFCIEKCLGDKE

SEQ ID NO: 2242371 - protein, 19 aa, Cryptosporidium parvum
EKNHFTGHFLYYNNKYEIE

SEQ ID NO: 2242372 - protein, 24 aa, Cryptosporidium parvum
EKNIGYILLSFFSAIKFASNNEFS

SEQ ID NO: 2242373 - protein, 25 aa, Cryptosporidium parvum
EKNIGYILLSFFSVIKFASNNEFSK

SEQ ID NO: 2242374 - protein, 33 aa, Cryptosporidium parvum
EKNIVFEELFESYLKFWWIIGSCEYYNNHPAGN

SEQ ID NO: 2242375 - protein, 23 aa, Cryptosporidium parvum
EKNPLKKFLEKIKKKRNLGLTNE

SEQ ID NO: 2242376 - protein, 26 aa, Cryptosporidium parvum
EKNYRHFFLLLFFVTMLLIMIIIATI

SEQ ID NO: 2242377 - protein, 31 aa, Cryptosporidium parvum
EKQIRIMPNLNKRYIISSTLLKHLKEFSKSL

SEQ ID NO: 2242378 - protein, 17 aa, Cryptosporidium parvum
EKQSLRLFLSLNGMPLA

SEQ ID NO: 2242379 - protein, 19 aa, Cryptosporidium parvum
EKVFVRIIGIKPKHVKMVI

SEQ ID NO: 2242380 - protein, 24 aa, Cryptosporidium parvum
EKVRREMFLPIKFSESETPRGILF

SEQ ID NO: 2242381 - protein, 20 aa, Cryptosporidium parvum
EKYFVLIIEILYTFTMTNSM

SEQ ID NO: 2242382 - protein, 33 aa, Cryptosporidium parvum
EKYIYIFGLLFSWVLFVLSIPMLYHLLFYHLPQ

SEQ ID NO: 2242383 - protein, 23 aa, Cryptosporidium parvum
EKYTILKSSLFNLLLNPINNQEQ

SEQ ID NO: 2242384 - protein, 19 aa, Cryptosporidium parvum
ELALITKELIYWTCTNRSK

SEQ ID NO: 2242385 - protein, 23 aa, Cryptosporidium parvum
ELDHYFGWLDILKPRPVLVYNMS

SEQ ID NO: 2242386 - protein, 21 aa, Cryptosporidium parvum
ELDISLIYNRLMELGIQYGKK

SEQ ID NO: 2242387 - protein, 19 aa, Cryptosporidium parvum
ELELPLLYECDWNLVMRAR

SEQ ID NO: 2242388 - protein, 25 aa, Cryptosporidium parvum
ELETQLYMRIAPELYLKQLIVGGLD

SEQ ID NO: 2242389 - protein, 36 aa, Cryptosporidium parvum
ELFDNLAFNFPFKSLYLMNAIIILKFGLVCIFNGEV

SEQ ID NO: 2242390 - protein, 19 aa, Cryptosporidium parvum
ELFHYFSVLLAISKLNVIK

SEQ ID NO: 2242391 - protein, 25 aa, Cryptosporidium parvum
ELFRKNYIPITQFEKVLLSVTSCVE

SEQ ID NO: 2242392 - protein, 24 aa, Cryptosporidium parvum
ELGPTWLHFYGQTTGLRGSAIDIK

SEQ ID NO: 2242393 - protein, 23 aa, Cryptosporidium parvum
ELGYVIYFYITFTETLNLIFIKI

SEQ ID NO: 2242394 - protein, 18 aa, Cryptosporidium parvum
ELIIKKSRFLIENFVSHF

SEQ ID NO: 2242395 - protein, 28 aa, Cryptosporidium parvum
ELIIVELSIYVSLLLKLFALVNSVEIEE

SEQ ID NO: 2242396 - protein, 17 aa, Cryptosporidium parvum
ELILYTLPCLINQLSLN

SEQ ID NO: 2242397 - protein, 26 aa, Cryptosporidium parvum
ELIQIFNLICYFLDLKEEIILDKNQD

SEQ ID NO: 2242398 - protein, 26 aa, Cryptosporidium parvum
ELITFPFSLLFLFGISNMFVDAKSIY

SEQ ID NO: 2242399 - protein, 39 aa, Cryptosporidium parvum
ELKCITTKLLLLFYKYIILLLRFISIFDLSDAKDSIFKF

SEQ ID NO: 2242400 - protein, 32 aa, Cryptosporidium parvum; identical to SEQ ID NO: 2130365

SEQ ID NO: 2242401 - protein, 27 aa, Cryptosporidium parvum
ELKKFVSIVFPHPKKFKPIFKGSLLIP

SEQ ID NO: 2242402 - protein, 29 aa, Cryptosporidium parvum
ELKLGFLLQLAFFRLWSVNLAALIVSLEG

SEQ ID NO: 2242403 - protein, 21 aa, Cryptosporidium parvum
ELKRQNCILIFSKLNGVFLTV

SEQ ID NO: 2242404 - protein, 30 aa, Cryptosporidium parvum
ELKSIRMLISNYWNYLWDIFLDIDKSNNTS

SEQ ID NO: 2242405 - protein, 22 aa, Cryptosporidium parvum
ELKSNFLYLLDTFTIIKEKLNN

SEQ ID NO: 2242406 - protein, 18 aa, Cryptosporidium parvum
ELLFPRLSKISIPINGPL

SEQ ID NO: 2242407 - protein, 26 aa, Cryptosporidium parvum
ELLIPILDFLVFSISLLNLAQILHVL

SEQ ID NO: 2242408 - protein, 25 aa, Cryptosporidium parvum
ELLPILVFTFINSCFSFFVLISFFI

SEQ ID NO: 2242409 - protein, 25 aa, Cryptosporidium parvum
ELLPRIACLIILRKLVRSEQISYDY

SEQ ID NO: 2242410 - protein, 26 aa, Cryptosporidium parvum
ELLQMRRSFFQFVISFCVVAVSLFGV

SEQ ID NO: 2242411 - protein, 20 aa, Cryptosporidium parvum
ELLTGLKFYETGRLDWKFYN

SEQ ID NO: 2242412 - protein, 18 aa, Cryptosporidium parvum
ELLTLENLVYFAENYRNI

SEQ ID NO: 2242413 - protein, 22 aa, Cryptosporidium parvum
ELNGIKLFRNINHKIFSSVKFA

SEQ ID NO: 2242414 - protein, 26 aa, Cryptosporidium parvum
ELNIVLPITTLFDYPTINSLSDFILN

SEQ ID NO: 2242415 - protein, 24 aa, Cryptosporidium parvum
ELNKEILVPLKLNNGYKLMPNNDI

SEQ ID NO: 2242416 - protein, 26 aa, Cryptosporidium parvum
ELNKTIKYLFLRLYSNVVQLVEGKIQ

SEQ ID NO: 2242417 - protein, 28 aa, Cryptosporidium parvum
ELNLVFVPLFILFEYLFPGLWNLDIPLY

SEQ ID NO: 2242418 - protein, 24 aa, Cryptosporidium parvum
ELNPGYIYINHLLPYILTSEINKN

SEQ ID NO: 2242419 - protein, 23 aa, Cryptosporidium parvum
ELNWYHFLTIYIVKIKNSLYQET

SEQ ID NO: 2242420 - protein, 20 aa, Cryptosporidium parvum
ELNYYLIINGYFETSHRLTQ

SEQ ID NO: 2242421 - protein, 25 aa, Cryptosporidium parvum
ELPFSYVEFYEKLGVFVIDVRSSIK

SEQ ID NO: 2242422 - protein, 23 aa, Cryptosporidium parvum
ELPIYLMPCIYLGADVFYKGKLI

SEQ ID NO: 2242423 - protein, 30 aa, Cryptosporidium parvum
ELPRIDFKRKKFPWITPAHPYIGPKISGSD

SEQ ID NO: 2242424 - protein, 19 aa, Cryptosporidium parvum
ELRKPFFASFKYFKKKKNE

SEQ ID NO: 2242425 - protein, 23 aa, Cryptosporidium parvum
ELSSVFLVIYILASKELVNLFMH

SEQ ID NO: 2242426 - protein, 24 aa, Cryptosporidium parvum
ELTNLLFYWIICGVIFMIESIVGI

SEQ ID NO: 2242427 - protein, 22 aa, Cryptosporidium parvum
ELTSGWLAFTVSTILIMIFGEI

SEQ ID NO: 2242428 - protein, 18 aa, Cryptosporidium parvum
ELVHYVLGIMFKSNIVAE

SEQ ID NO: 2242429 - protein, 21 aa, Cryptosporidium parvum
ELVISGIIWYLTESQEIFLLP

SEQ ID NO: 2242430 - protein, 20 aa, Cryptosporidium parvum
ELVKLFNTILTIIITNGQET

SEQ ID NO: 2242431 - protein, 25 aa, Cryptosporidium parvum
ELVLKLALKIYFPSSIITGMSIASQ

SEQ ID NO: 2242432 - protein, 19 aa, Cryptosporidium parvum
ELVLLALRSLDLWIDNLHH

SEQ ID NO: 2242433 - protein, 25 aa, Cryptosporidium parvum
ELVTLYEGIVIALCLELGIVLDIED

SEQ ID NO: 2242434 - protein, 18 aa, Cryptosporidium parvum
EMDYVIAAVYYYFIRWQG

SEQ ID NO: 2242435 - protein, 32 aa, Cryptosporidium parvum; identical to SEQ ID NO: 2130383

SEQ ID NO: 2242436 - protein, 23 aa, Cryptosporidium parvum
EMIHLILTTLYFYGSEGLIKEFF

SEQ ID NO: 2242437 - protein, 20 aa, Cryptosporidium parvum
EMIKLHFWNNSFKSLVLTCV

SEQ ID NO: 2242438 - protein, 18 aa, Cryptosporidium parvum
EMLSKKFHFIRAPVINVG

SEQ ID NO: 2242439 - protein, 27 aa, Cryptosporidium parvum
EMNVQKLKYIFTFATRNLRTPDIDTAL

SEQ ID NO: 2242440 - protein, 17 aa, Cryptosporidium parvum
EMNYFYLEEPNISLIYC

SEQ ID NO: 2242441 - protein, 18 aa, Cryptosporidium parvum
EMPPYYHIYNSRSKLEES

SEQ ID NO: 2242442 - protein, 20 aa, Cryptosporidium parvum
EMRKVLLLVLHANVSRIEDL

SEQ ID NO: 2242443 - protein, 17 aa, Cryptosporidium parvum
EMRNKIFRQIKIVYPDA

SEQ ID NO: 2242444 - protein, 25 aa, Cryptosporidium parvum
EMSYRLWSIVYFIMTGIRISEYKYK

SEQ ID NO: 2242445 - protein, 24 aa, Cryptosporidium parvum
EMYKFVIKDLRKLFANLNIPLIKI

SEQ ID NO: 2242446 - protein, 19 aa, Cryptosporidium parvum
ENDFDIELVRIVYSSLFAS

SEQ ID NO: 2242447 - protein, 30 aa, Cryptosporidium parvum
ENDLTFSILGPLWTHILNYIRRLINNKDSS

SEQ ID NO: 2242448 - protein, 27 aa, Cryptosporidium parvum
ENEIGWIFYAFPKLYQAFVLIDLYICF

SEQ ID NO: 2242449 - protein, 25 aa, Cryptosporidium parvum
ENETGIINFYNPFKTDFLSSQYWIS

SEQ ID NO: 2242450 - protein, 30 aa, Cryptosporidium parvum
ENFQIISSILKPIPIQLFISWKLENHEFNN

SEQ ID NO: 2242451 - protein, 18 aa, Cryptosporidium parvum
ENGIILWNDLKKCILNLV

SEQ ID NO: 2242452 - protein, 20 aa, Cryptosporidium parvum
ENIDLKSVLIYLYCNKRGNF

SEQ ID NO: 2242453 - protein, 25 aa, Cryptosporidium parvum
ENILKRFFECIKLILRKEATRIVKI

SEQ ID NO: 2242454 - protein, 26 aa, Cryptosporidium parvum
ENIMIWQILFPKLIYEFFFCFSFSIY

SEQ ID NO: 2242455 - protein, 26 aa, Cryptosporidium parvum
ENIRKLNILPPIRIYELWKGTPMDIR

SEQ ID NO: 2242456 - protein, 27 aa, Cryptosporidium parvum
ENKIVYIKLLTHYKLITSIKLQAEAFL

SEQ ID NO: 2242457 - protein, 23 aa, Cryptosporidium parvum
ENKKKIKFISTLKGRLINYSELM

SEQ ID NO: 2242458 - protein, 29 aa, Cryptosporidium parvum
ENKLLKSSFLKNIKLFFNSAGIFISNLYS

SEQ ID NO: 2242459 - protein, 19 aa, Cryptosporidium parvum
ENKVIFLQLKLLNYKREFL

SEQ ID NO: 2242460 - protein, 24 aa, Cryptosporidium parvum
ENLIPITLGYLFDLLCQESYGSKN

SEQ ID NO: 2242461 - protein, 19 aa, Cryptosporidium parvum
ENLLFHYMKRFVIGLSIDK

SEQ ID NO: 2242462 - protein, 21 aa, Cryptosporidium parvum
ENMLYKWIIAQTVTTSAGIIC

SEQ ID NO: 2242463 - protein, 20 aa, Cryptosporidium parvum
ENNFFIFSQVRELDPRILRI

SEQ ID NO: 2242464 - protein, 35 aa, Cryptosporidium parvum
ENNFKRLCWNLLKILYLFTLLLFILSDSEFISNYS

SEQ ID NO: 2242465 - protein, 25 aa, Cryptosporidium parvum
ENNPLLLMYINLYNNKNLRDISRNE

SEQ ID NO: 2242466 - protein, 21 aa, Cryptosporidium parvum
ENNPLLLMYYDDYCLMCFLIR

SEQ ID NO: 2242467 - protein, 26 aa, Cryptosporidium parvum
ENNRKIFEFIFPICKSLGWEAFFMFT

SEQ ID NO: 2242468 - protein, 24 aa, Cryptosporidium parvum
ENQIFFDYNKLFIFCFNNFTKCIS

SEQ ID NO: 2242469 - protein, 23 aa, Cryptosporidium parvum
ENQNLFIMIFLHPITIRIVSFLL

SEQ ID NO: 2242470 - protein, 26 aa, Cryptosporidium parvum
ENRKQKFILFLLGILLVSIINIIQHK

SEQ ID NO: 2242471 - protein, 33 aa, Cryptosporidium parvum
ENRSRLIYNWMQQYFIYKLRKIPKFNYEELRTL

SEQ ID NO: 2242472 - protein, 24 aa, Cryptosporidium parvum
ENSDIFIPLFTLISHENLSFSQDL

SEQ ID NO: 2242473 - protein, 28 aa, Cryptosporidium parvum
ENSGTKFLLLIPVLMNLINVLIKHSTGS

SEQ ID NO: 2242474 - protein, 17 aa, Cryptosporidium parvum
ENSLFFLLPSNTISKRS

SEQ ID NO: 2242475 - protein, 23 aa, Cryptosporidium parvum
ENSPIMPIKLSPIALKDSEPVVL

SEQ ID NO: 2242476 - protein, 17 aa, Cryptosporidium parvum
ENSPLWRIRMMRLGKCG

SEQ ID NO: 2242477 - protein, 17 aa, Cryptosporidium parvum
ENTEIDLLIISNSRRKA

SEQ ID NO: 2242478 - protein, 23 aa, Cryptosporidium parvum
ENVSLLIFKLIKNISMKYLNLVN

SEQ ID NO: 2242479 - protein, 20 aa, Cryptosporidium parvum
ENWADTVQVLLQGPGIINTR

SEQ ID NO: 2242480 - protein, 17 aa, Cryptosporidium parvum
ENYLVRILLIYCNLTSS

SEQ ID NO: 2242481 - protein, 21 aa, Cryptosporidium parvum
ENYRNIFKVILKESQRFSSSE

SEQ ID NO: 2242482 - protein, 21 aa, Cryptosporidium parvum
EPEFSFIPLKAGPLLPNKAKE

SEQ ID NO: 2242483 - protein, 18 aa, Cryptosporidium parvum
EPFRIPFAGKLRICAFDK

SEQ ID NO: 2242484 - protein, 21 aa, Cryptosporidium parvum
EPILDGLLIFLRDGSETFRIQ

SEQ ID NO: 2242485 - protein, 25 aa, Cryptosporidium parvum
EPREYIYPGIFFELEPPFPCSWERV

SEQ ID NO: 2242486 - protein, 33 aa, Cryptosporidium parvum; identical to SEQ ID NO: 2130408

SEQ ID NO: 2242487 - protein, 17 aa, Cryptosporidium parvum
EPSANTNFLLVDPKINA

SEQ ID NO: 2242488 - protein, 26 aa, Cryptosporidium parvum
EPSGINMGLFYSIDRFMNVHPMILES

SEQ ID NO: 2242489 - protein, 25 aa, Cryptosporidium parvum
EPSVVFLFPMIGLGIYYAVARYFSR

SEQ ID NO: 2242490 - protein, 25 aa, Cryptosporidium parvum
EQDKTLFPPRIKIKSLPKIINDVKS

SEQ ID NO: 2242491 - protein, 26 aa, Cryptosporidium parvum
EQDLELFLYDEFLYNNIIILDIDNSD

SEQ ID NO: 2242492 - protein, 20 aa, Cryptosporidium parvum
EQFLPYKQKLDKALSDLKLL

SEQ ID NO: 2242493 - protein, 34 aa, Cryptosporidium parvum; identical to SEQ ID NO: 2130413

SEQ ID NO: 2242494 - protein, 20 aa, Cryptosporidium parvum
EQIIFVKLLISDKAANRILS

SEQ ID NO: 2242495 - protein, 17 aa, Cryptosporidium parvum
EQLFIIIEPFTLNKSSF

SEQ ID NO: 2242496 - protein, 19 aa, Cryptosporidium parvum
EQLILIQKLVPRFPEVVVI

SEQ ID NO: 2242497 - protein, 31 aa, Cryptosporidium parvum
EQLLHYNILNIFYKLIVVFSIIIHSNRWLQD

SEQ ID NO: 2242498 - protein, 17 aa, Cryptosporidium parvum
EQMERIVLYLQQLSQYA

SEQ ID NO: 2242499 - protein, 17 aa, Cryptosporidium parvum
EQNIIIYGFIKGSAVNQ

SEQ ID NO: 2242500 - protein, 23 aa, Cryptosporidium parvum
EQNLMKILRILSGSRNPILIEGE

SEQ ID NO: 2242501 - protein, 24 aa, Cryptosporidium parvum
EQSFYNITLFIFAAVTFISTIETI

SEQ ID NO: 2242502 - protein, 33 aa, Cryptosporidium parvum
EQSHPNFYLVLLYFHFVLESKFSLLPRKSYQST

SEQ ID NO: 2242503 - protein, 23 aa, Cryptosporidium parvum
EQSLRIFITIMKIPNLSGIVLQA

SEQ ID NO: 2242504 - protein, 27 aa, Cryptosporidium parvum
EQSPSSFLIIILSLLRLHAIDGILNSR

SEQ ID NO: 2242505 - protein, 24 aa, Cryptosporidium parvum
EQVEYRWNFLINILEFVNKNEGNK

SEQ ID NO: 2242506 - protein, 23 aa, Cryptosporidium parvum
EQYAYWMLTLFTLAGISELMMLF

SEQ ID NO: 2242507 - protein, 36 aa, Cryptosporidium parvum
EQYGSPLLHFLKTVAYYPFKLVVAFLLVIGNVSPVQ

SEQ ID NO: 2242508 - protein, 22 aa, Cryptosporidium parvum
EQYPNCIIILTFLVIRNTMISS

SEQ ID NO: 2242509 - protein, 18 aa, Cryptosporidium parvum
ERAPLFQTWTKRSKYAKD

SEQ ID NO: 2242510 - protein, 36 aa, Cryptosporidium parvum
EREPSLMRALLRAYYPFILICIFSLTIIDVIRFSVG

SEQ ID NO: 2242511 - protein, 19 aa, Cryptosporidium parvum
ERFLSKWLSLNTSNFSFFV

SEQ ID NO: 2242512 - protein, 24 aa, Cryptosporidium parvum
ERGTYYAIKFLRLGIGANDDITRI

SEQ ID NO: 2242513 - protein, 32 aa, Cryptosporidium parvum; identical to SEQ ID NO: 2130422

SEQ ID NO: 2242514 - protein, 26 aa, Cryptosporidium parvum
ERIKKFLFTYGYPVELLKPLSNIWPG

SEQ ID NO: 2242515 - protein, 23 aa, Cryptosporidium parvum
ERNFPVFIKRMVAQLIYLLQCEI

SEQ ID NO: 2242516 - protein, 22 aa, Cryptosporidium parvum
ERNRIWTSLFTYSIPYNVLSDC

SEQ ID NO: 2242517 - protein, 34 aa, Cryptosporidium parvum
ERQGLIIMATSASLLLFCIFVGIAIKTFEGMRNE

SEQ ID NO: 2242518 - protein, 21 aa, Cryptosporidium parvum
ERQKHYFEFLDGILLKAIKEG

SEQ ID NO: 2242519 - protein, 18 aa, Cryptosporidium parvum
ERSYLPIIVFSFSKKDCE

SEQ ID NO: 2242520 - protein, 33 aa, Cryptosporidium parvum
ERVFQYLTTPYLRIPLLLQFFSDENRINSLSSV

SEQ ID NO: 2242521 - protein, 41 aa, Cryptosporidium parvum
ERVSYKLIMNIKIFFFFILKLYQFIRFPLNVLNLKKKCIIG

SEQ ID NO: 2242522 - protein, 19 aa, Cryptosporidium parvum
ERYYSLLLSKRRGPALIEL

SEQ ID NO: 2242523 - protein, 18 aa, Cryptosporidium parvum
ESDFLQILALITKSIINF

SEQ ID NO: 2242524 - protein, 25 aa, Cryptosporidium parvum
ESDKSLFSLIPSPPKLFIKDKTPET

SEQ ID NO: 2242525 - protein, 25 aa, Cryptosporidium parvum
ESDYIISLVQWDKLFYSLKLDNVEY

SEQ ID NO: 2242526 - protein, 34 aa, Cryptosporidium parvum
ESFLGYSLDYIISKEITFFWTTLLLLGETDTSDS

SEQ ID NO: 2242527 - protein, 29 aa, Cryptosporidium parvum
ESFPPSLAPLYMWVLKPYHIRKRLGHQYL

SEQ ID NO: 2242528 - protein, 34 aa, Cryptosporidium parvum
ESGDDFDYYLYYNNSYLTFLFKHKDGKYYEVGSL

SEQ ID NO: 2242529 - protein, 25 aa, Cryptosporidium parvum
ESIFQRKYWPVFIGTIPICDLEPSN

SEQ ID NO: 2242530 - protein, 26 aa, Cryptosporidium parvum
ESIKGFIYAIYFWSDAINAKVYSPIN

SEQ ID NO: 2242531 - protein, 20 aa, Cryptosporidium parvum
ESILNPYYLFQNNSLLNNNK

SEQ ID NO: 2242532 - protein, 19 aa, Cryptosporidium parvum
ESIVYFPKTIHLLGRIGDD

SEQ ID NO: 2242533 - protein, 28 aa, Cryptosporidium parvum
ESKHLVFLMWIVLSLIFTLYSKWLMNNY

SEQ ID NO: 2242534 - protein, 25 aa, Cryptosporidium parvum
ESKIYKEPLLLDKYQPDFTGESFPE

SEQ ID NO: 2242535 - protein, 26 aa, Cryptosporidium parvum
ESKVRSWFFRLWSESTVLTSPVLYIE

SEQ ID NO: 2242536 - protein, 19 aa, Cryptosporidium parvum
ESLDLLELILKYIDDLSLM

SEQ ID NO: 2242537 - protein, 36 aa, Cryptosporidium parvum
ESLKMLLEHYPRWIPKFFFLLNFRIPRSRFDRVMIS

SEQ ID NO: 2242538 - protein, 22 aa, Cryptosporidium parvum
ESLSILLERNPIKSKTLLLNPC

SEQ ID NO: 2242539 - protein, 28 aa, Cryptosporidium parvum
ESLSYYQLYILLVFLIESSDWFIHHGYF

SEQ ID NO: 2242540 - protein, 30 aa, Cryptosporidium parvum; identical to SEQ ID NO: 2130441

SEQ ID NO: 2242541 - protein, 17 aa, Cryptosporidium parvum
ESMLNMEKLLRLKYMKT

SEQ ID NO: 2242542 - protein, 17 aa, Cryptosporidium parvum
ESNLLKISIFILKIFSS

SEQ ID NO: 2242543 - protein, 25 aa, Cryptosporidium parvum
ESNTDMFSLFPYGSPLHISFKGGPT

SEQ ID NO: 2242544 - protein, 19 aa, Cryptosporidium parvum
ESNWRYLALLYSLLISDTT

SEQ ID NO: 2242545 - protein, 22 aa, Cryptosporidium parvum
ESQKWSFILGNRMLYNFKSKKC

SEQ ID NO: 2242546 - protein, 49 aa, Cryptosporidium parvum
ESQLHSLFALSIIWYLSFNPKYIFSFVFLLGLIILFISFDKRNLALNLE

SEQ ID NO: 2242547 - protein, 28 aa, Cryptosporidium parvum
ESQQKLPTYYKFPFIPNNSFSNCYKSFN

SEQ ID NO: 2242548 - protein, 26 aa, Cryptosporidium parvum
ESRDLLNYFFSVALISPFVVVSDSTT

SEQ ID NO: 2242549 - protein, 25 aa, Cryptosporidium parvum
ESRYYVICFTISLILTIMVLLYNFL

SEQ ID NO: 2242550 - protein, 20 aa, Cryptosporidium parvum
ESSCCPLNLIRFCDNKQLLN

SEQ ID NO: 2242551 - protein, 27 aa, Cryptosporidium parvum
ESSHVWGVLLARSLPAWDWKSPSILVS

SEQ ID NO: 2242552 - protein, 28 aa, Cryptosporidium parvum
ESSIYIKLKLPFFNLSVESIFCIHPAIF

SEQ ID NO: 2242553 - protein, 33 aa, Cryptosporidium parvum; identical to SEQ ID NO: 2130446

SEQ ID NO: 2242554 - protein, 18 aa, Cryptosporidium parvum
ESSWFTYITSVALFLIIG

SEQ ID NO: 2242555 - protein, 31 aa, Cryptosporidium parvum
ESTSLMYIRSLLRLFFLFSSFKEDNGKQKMK

SEQ ID NO: 2242556 - protein, 23 aa, Cryptosporidium parvum
ESTTSIFQIYYSEVFDLFFTEWN

SEQ ID NO: 2242557 - protein, 36 aa, Cryptosporidium parvum; identical to SEQ ID NO: 2130451

SEQ ID NO: 2242558 - protein, 23 aa, Cryptosporidium parvum
ESVIPITLLCKTFLSLEKEKKDP

SEQ ID NO: 2242559 - protein, 25 aa, Cryptosporidium parvum
ESWDELVIIYYYYNTIEILRIKRSH

SEQ ID NO: 2242560 - protein, 27 aa, Cryptosporidium parvum
ESYFRYCTMIILQILNINFYEIIIENN

SEQ ID NO: 2242561 - protein, 22 aa, Cryptosporidium parvum
ETDLLFDLKKISPGQALLIADL

SEQ ID NO: 2242562 - protein, 20 aa, Cryptosporidium parvum
ETGKVIPGSLPGSLNYPSFN

SEQ ID NO: 2242563 - protein, 21 aa, Cryptosporidium parvum
ETHFRIIMYFVRKTINSKEIR

SEQ ID NO: 2242564 - protein, 23 aa, Cryptosporidium parvum
ETHQVYIAFRILATIVPLVIQFT

SEQ ID NO: 2242565 - protein, 25 aa, Cryptosporidium parvum
ETIAVSLHYSILSGFKLFLDRCHCI

SEQ ID NO: 2242566 - protein, 24 aa, Cryptosporidium parvum
ETIKTIFRILLKRSIHVDKFWSSV

SEQ ID NO: 2242567 - protein, 20 aa, Cryptosporidium parvum
ETIYLSSIILLYTQLKGGNH

SEQ ID NO: 2242568 - protein, 22 aa, Cryptosporidium parvum
ETKRLLERLAINLELPPIDDKM

SEQ ID NO: 2242569 - protein, 20 aa, Cryptosporidium parvum
ETLFIGAPKCRCPNGFQGDG

SEQ ID NO: 2242570 - protein, 23 aa, Cryptosporidium parvum
ETLLESVFILSNQIYMAKSFCQM

SEQ ID NO: 2242571 - protein, 27 aa, Cryptosporidium parvum
ETMNKIYYLNKFYFTYIEGGLVNDHEI

SEQ ID NO: 2242572 - protein, 31 aa, Cryptosporidium parvum
ETNYFMENIIKFLVKYLSLIVNFSAIFDDRN

SEQ ID NO: 2242573 - protein, 30 aa, Cryptosporidium parvum
ETPDSLGILIWMKYLIKLAPIESIEIFIDQ

SEQ ID NO: 2242574 - protein, 32 aa, Cryptosporidium parvum; identical to SEQ ID NO: 2130456

SEQ ID NO: 2242575 - protein, 46 aa, Cryptosporidium parvum
ETPSIAYIYPYYWKYILEPIRYIISIIFYFIWGIELTPKKEFDNKD

SEQ ID NO: 2242576 - protein, 46 aa, Cryptosporidium parvum
ETSLICEAKLFIQKWVIILIGIIFIFLPLYFRIRTRRRKAELIRKI

SEQ ID NO: 2242577 - protein, 33 aa, Cryptosporidium parvum; identical to SEQ ID NO: 2130459

SEQ ID NO: 2242578 - protein, 18 aa, Cryptosporidium parvum
ETTISFHPGCNCIVGLNG

SEQ ID NO: 2242579 - protein, 24 aa, Cryptosporidium parvum
ETVIRFLFENIDIKSANRLSTMFI

SEQ ID NO: 2242580 - protein, 36 aa, Cryptosporidium parvum; identical to SEQ ID NO: 2130460

SEQ ID NO: 2242581 - protein, 22 aa, Cryptosporidium parvum
ETWWNPLLPLRNVPYLIVIGKP

SEQ ID NO: 2242582 - protein, 25 aa, Cryptosporidium parvum
ETYEIFLFLSAISLLYFILSGYDGS

SEQ ID NO: 2242583 - protein, 26 aa, Cryptosporidium parvum
ETYFKNYHVLGYLPISYTKGLSERLS

SEQ ID NO: 2242584 - protein, 18 aa, Cryptosporidium parvum
EVDNKYLIGIDDYNYFGL

SEQ ID NO: 2242585 - protein, 27 aa, Cryptosporidium parvum
EVDQLRRSAWLLGCIFEFSSPNMALAI

SEQ ID NO: 2242586 - protein, 18 aa, Cryptosporidium parvum
EVETPMLNMIYGGAAARP

SEQ ID NO: 2242587 - protein, 22 aa, Cryptosporidium parvum
EVFKVAFMLLRKGCRMQLDAFL

SEQ ID NO: 2242588 - protein, 24 aa, Cryptosporidium parvum
EVIKRIHCYQKCKPYPISSSSSQN

SEQ ID NO: 2242589 - protein, 18 aa, Cryptosporidium parvum
EVILYYCLLRDLYSSRRS

SEQ ID NO: 2242590 - protein, 21 aa, Cryptosporidium parvum
EVIVFLDCYLTYLDTISSKNI

SEQ ID NO: 2242591 - protein, 28 aa, Cryptosporidium parvum
EVKIPFSKYYLPIPLQHSQPKPIKMGDF

SEQ ID NO: 2242592 - protein, 26 aa, Cryptosporidium parvum
EVLYKYVIFISFLLQWIASATRSCYL

SEQ ID NO: 2242593 - protein, 24 aa, Cryptosporidium parvum
EVNERLVLTLLLKIKNGAPILRRK

SEQ ID NO: 2242594 - protein, 24 aa, Cryptosporidium parvum
EVRMTLIGLISRLIERHRLILINY

SEQ ID NO: 2242595 - protein, 24 aa, Cryptosporidium parvum
EVSLITYWILQICALLFGVGCGIF

SEQ ID NO: 2242596 - protein, 18 aa, Cryptosporidium parvum
EVSNRLIKLFSKLGGETL

SEQ ID NO: 2242597 - protein, 27 aa, Cryptosporidium parvum
EVTKVPNFILLCALIPQIPGCPCDPLL

SEQ ID NO: 2242598 - protein, 27 aa, Cryptosporidium parvum
EVVGRYFYMILVEKLSFNTGGICSFLW

SEQ ID NO: 2242599 - protein, 20 aa, Cryptosporidium parvum
EVVLLSVFMNTNKQLKCHIF

SEQ ID NO: 2242600 - protein, 18 aa, Cryptosporidium parvum
EVYTNYYLRLNNINKLLS

SEQ ID NO: 2242601 - protein, 45 aa, Cryptosporidium parvum
EWKCRWRGLHFKVYTLRFPNSFFGYPIQIFTKYIYKHLGIFLIGV

SEQ ID NO: 2242602 - protein, 30 aa, Cryptosporidium parvum
EWLPIKRIIMLFLAGTFILSIYIILAFNCG

SEQ ID NO: 2242603 - protein, 18 aa, Cryptosporidium parvum
EWSEPYPFNLMFRTKIGP

SEQ ID NO: 2242604 - protein, 18 aa, Cryptosporidium parvum
EWSSWSPCSVTCGCGTTT

SEQ ID NO: 2242605 - protein, 29 aa, Cryptosporidium parvum
EYARYHGYSYFLFDGSFYDSIPKPVITDW

SEQ ID NO: 2242606 - protein, 26 aa, Cryptosporidium parvum
EYDSSPFCIAPWILDSAFQVLGGFLI

SEQ ID NO: 2242607 - protein, 29 aa, Cryptosporidium parvum
EYGKHLDLLYPYILGPIFKACRQYTNPKL

SEQ ID NO: 2242608 - protein, 26 aa, Cryptosporidium parvum
EYHDGVCLTLLLLLQNLTNLSVTNDN

SEQ ID NO: 2242609 - protein, 27 aa, Cryptosporidium parvum
EYIQVFKLFCLVFSRLDMNQITLIEMT

SEQ ID NO: 2242610 - protein, 24 aa, Cryptosporidium parvum
EYKKLLMNWIRLSSMKQLPLSLML

SEQ ID NO: 2242611 - protein, 17 aa, Cryptosporidium parvum
EYKLHQYIIWGSSINFI

SEQ ID NO: 2242612 - protein, 29 aa, Cryptosporidium parvum
EYKRLTSEFPWFTSAWLRRACLALERNDY

SEQ ID NO: 2242613 - protein, 17 aa, Cryptosporidium parvum
EYKYKMFPFIMKKSQSD

SEQ ID NO: 2242614 - protein, 34 aa, Cryptosporidium parvum
EYNFQEFFELILWDKYFIPIYYSEIIQILSGKAY

SEQ ID NO: 2242615 - protein, 27 aa, Cryptosporidium parvum
EYNKKLYYYIIFNSWNTLSLLVEENDI

SEQ ID NO: 2242616 - protein, 22 aa, Cryptosporidium parvum
EYPGYTIQILHSLTSAFDCQLQ

SEQ ID NO: 2242617 - protein, 22 aa, Cryptosporidium parvum
EYSPWIMYRIYFSNQVKNSRLI

SEQ ID NO: 2242618 - protein, 28 aa, Cryptosporidium parvum
EYSSLYLQNWLKYWSKKGSMIIYIFIGD

SEQ ID NO: 2242619 - protein, 32 aa, Cryptosporidium parvum
FAAERVMLYWVRKTIYISTFVILLISKTKKNI

SEQ ID NO: 2242620 - protein, 26 aa, Cryptosporidium parvum
FAAFVTPPMILSLGWRGPFYIFGLIG

SEQ ID NO: 2242621 - protein, 20 aa, Cryptosporidium parvum
FAEFGLPFVIKLFPNMLPST

SEQ ID NO: 2242622 - protein, 31 aa, Cryptosporidium parvum
FAEKLTYQYFLNWFKKIYKNSNLFMLAVQST

SEQ ID NO: 2242623 - protein, 75 aa, Cryptosporidium parvum
FAEKRNLILVFAILVNIILISMANIIIPIVYSIKNTLFPILTVNAVINFLIFYLINGTLIYIFTRKMNSFNKSIL

SEQ ID NO: 2242624 - protein, 18 aa, Cryptosporidium parvum
FAELPFDGLVGLGFPDKN

SEQ ID NO: 2242625 - protein, 19 aa, Cryptosporidium parvum
FAFITFKAKFINLFFFFFF

SEQ ID NO: 2242626 - protein, 24 aa, Cryptosporidium parvum
FAFVIFFIVFLFFIGFSEFIFFII

SEQ ID NO: 2242627 - protein, 17 aa, Cryptosporidium parvum
FAFVSAPLSALWLWVLM

SEQ ID NO: 2242628 - protein, 24 aa, Cryptosporidium parvum
FAIEICMIPSIWYLEIIHCMHMGM

SEQ ID NO: 2242629 - protein, 25 aa, Cryptosporidium parvum
FAIFLVVFLNFLGLQTFFNTRNVES

SEQ ID NO: 2242630 - protein, 29 aa, Cryptosporidium parvum
FAIIGSLVVILLIYGWTVGYGSNIYTSRA

SEQ ID NO: 2242631 - protein, 18 aa, Cryptosporidium parvum
FAITVIQYYFYFGASLDR

SEQ ID NO: 2242632 - protein, 26 aa, Cryptosporidium parvum
FAIVGGVNLLLSPQPFLACCAANMLS

SEQ ID NO: 2242633 - protein, 19 aa, Cryptosporidium parvum
FAKLAFITVRMKSNLILVP

SEQ ID NO: 2242634 - protein, 31 aa, Cryptosporidium parvum; identical to SEQ ID NO: 2130492

SEQ ID NO: 2242635 - protein, 25 aa, Cryptosporidium parvum
FALNKLYFIIIYYSVYLSTNFVMEL

SEQ ID NO: 2242636 - protein, 17 aa, Cryptosporidium parvum
FALPFLTFIIEHLGFEI

SEQ ID NO: 2242637 - protein, 29 aa, Cryptosporidium parvum
FALTSFSTALLWALLFEPSINEFSPAFGE

SEQ ID NO: 2242638 - protein, 26 aa, Cryptosporidium parvum
FANERTLLQWMNMSVLLATISVSLLS

SEQ ID NO: 2242639 - protein, 25 aa, Cryptosporidium parvum
FANLEIFKMQIFNPVKWYKKQEAIR

SEQ ID NO: 2242640 - protein, 18 aa, Cryptosporidium parvum
FANRHLCAFILKQSLKIT

SEQ ID NO: 2242641 - protein, 26 aa, Cryptosporidium parvum
FAQICLDAWFKMRIKILLTIPITLIN

SEQ ID NO: 2242642 - protein, 17 aa, Cryptosporidium parvum
FATFIGFAISIVIGIIW

SEQ ID NO: 2242643 - protein, 24 aa, Cryptosporidium parvum
FAVGTFIQLLPLWAPSCIQFSLNK

SEQ ID NO: 2242644 - protein, 32 aa, Cryptosporidium parvum
FAYGYLKFIILYFLSLVLWGLYRHHLHLKVEA

SEQ ID NO: 2242645 - protein, 22 aa, Cryptosporidium parvum
FCCSILSLKIFLLLINNIDWES

SEQ ID NO: 2242646 - protein, 25 aa, Cryptosporidium parvum
FCHLQPLVLIHGRLCYRRTSILVLY

SEQ ID NO: 2242647 - protein, 18 aa, Cryptosporidium parvum
FCILITIVLSVLTILQSA

SEQ ID NO: 2242648 - protein, 18 aa, Cryptosporidium parvum
FCMLICILFIIPVLVRLW

SEQ ID NO: 2242649 - protein, 18 aa, Cryptosporidium parvum
FCNFGLLISYLFLENYFL

SEQ ID NO: 2242650 - protein, 26 aa, Cryptosporidium parvum
FCVPISIILPALFHLTLFKQRISLPA

SEQ ID NO: 2242651 - protein, 17 aa, Cryptosporidium parvum
FDCFLNTIKNQSYLENS

SEQ ID NO: 2242652 - protein, 23 aa, Cryptosporidium parvum
FDDIKQCCIFISQIILNSPISLS

SEQ ID NO: 2242653 - protein, 23 aa, Cryptosporidium parvum
FDDVALKCLPLYSSKTQLNNGEI

SEQ ID NO: 2242654 - protein, 30 aa, Cryptosporidium parvum; identical to SEQ ID NO: 2189509

SEQ ID NO: 2242655 - protein, 23 aa, Cryptosporidium parvum
FDEFRHFFPKISLIDGKDISKLE

SEQ ID NO: 2242656 - protein, 25 aa, Cryptosporidium parvum
FDEKRKLLLDLFKKLVIQGDLFSDL

SEQ ID NO: 2242657 - protein, 25 aa, Cryptosporidium parvum
FDFTELVPCVLKLYRLDFSAKNEIQ

SEQ ID NO: 2242658 - protein, 18 aa, Cryptosporidium parvum
FDILAYADTWDTSEDIIL

SEQ ID NO: 2242659 - protein, 22 aa, Cryptosporidium parvum
FDINRLWIRNLGRDCRLALFNN

SEQ ID NO: 2242660 - protein, 25 aa, Cryptosporidium parvum
FDKNNLDYYYLLTSYISGLSISYIH

SEQ ID NO: 2242661 - protein, 37 aa, Cryptosporidium parvum
FDKYGIPEYVFWIIVYTVPVLFVLLLCLTSYCCCCRR

SEQ ID NO: 2242662 - protein, 31 aa, Cryptosporidium parvum
FDQFSNFFNFFYLIVALFQLIPELRTGPLFT

SEQ ID NO: 2242663 - protein, 25 aa, Cryptosporidium parvum
FDSCVINLKNPYLLILHLICLTVET

SEQ ID NO: 2242664 - protein, 26 aa, Cryptosporidium parvum
FDSLEELLEYILRSPPPQKTVREEIK

SEQ ID NO: 2242665 - protein, 29 aa, Cryptosporidium parvum
FDVKYLVNWIIPPFIRKILLGGIGSVTVS

SEQ ID NO: 2242666 - protein, 21 aa, Cryptosporidium parvum
FEAFSFICLALFIADIPNSSD

SEQ ID NO: 2242667 - protein, 22 aa, Cryptosporidium parvum
FEANFLLILPALTASSYPSLIL

SEQ ID NO: 2242668 - protein, 29 aa, Cryptosporidium parvum
FECITISPYIPLYTLLNPLWDQSSRKKNR

SEQ ID NO: 2242669 - protein, 23 aa, Cryptosporidium parvum
FEDIITFLSLYSFGGFVGKYSKN

SEQ ID NO: 2242670 - protein, 19 aa, Cryptosporidium parvum
FEDILYDYIQYKRFIFQNN

SEQ ID NO: 2242671 - protein, 26 aa, Cryptosporidium parvum
FEDRLHFYYHYIAELRFNHYQPELFH

SEQ ID NO: 2242672 - protein, 19 aa, Cryptosporidium parvum
FEEFDVIFPADIARILVGV

SEQ ID NO: 2242673 - protein, 18 aa, Cryptosporidium parvum
FEELILLNELKILYNQKI

SEQ ID NO: 2242674 - protein, 17 aa, Cryptosporidium parvum
FEESNSIRIFFQAPTIG

SEQ ID NO: 2242675 - protein, 25 aa, Cryptosporidium parvum
FEGFTFIMTIIFSFGIIITTSFVIV

SEQ ID NO: 2242676 - protein, 17 aa, Cryptosporidium parvum
FEIIAKIFPSHPALVLY

SEQ ID NO: 2242677 - protein, 48 aa, Cryptosporidium parvum
FEIKDKLIMIPRFSISSIPILPILTKSKDIFFGLILEFKKISVSIFNN

SEQ ID NO: 2242678 - protein, 18 aa, Cryptosporidium parvum
FEILDEKLVYFPSYFRNN

SEQ ID NO: 2242679 - protein, 20 aa, Cryptosporidium parvum
FEILTFLFNVFKRKNKEQLF

SEQ ID NO: 2242680 - protein, 29 aa, Cryptosporidium parvum
FEITNPLFFPLDESIPIVLALPVTACLDD

SEQ ID NO: 2242681 - protein, 22 aa, Cryptosporidium parvum
  misc_feature (22)..(22): Xaa can be any naturally occurring amino acid
FEKIMSLFHFSMSTYWMVLGKX

SEQ ID NO: 2242682 - protein, 23 aa, Cryptosporidium parvum
FEKIPNIFFISSLELFNQIIVNT

SEQ ID NO: 2242683 - protein, 36 aa, Cryptosporidium parvum; identical to SEQ ID NO: 2130522

SEQ ID NO: 2242684 - protein, 21 aa, Cryptosporidium parvum
FEKQSILPPPGVGSPHVVCTL

SEQ ID NO: 2242685 - protein, 31 aa, Cryptosporidium parvum
FEKTILMIELILFSFPFNIPNLPLPKNLEIF

SEQ ID NO: 2242686 - protein, 33 aa, Cryptosporidium parvum
FEKYPNLVYYQAQLLYWLLQIAFELDGNQEQFV

SEQ ID NO: 2242687 - protein, 18 aa, Cryptosporidium parvum
FEMIKYLRIYQSGLTELI

SEQ ID NO: 2242688 - protein, 17 aa, Cryptosporidium parvum
FEMLISTLWISASKNDI

SEQ ID NO: 2242689 - protein, 24 aa, Cryptosporidium parvum
FENKHVDIILWFIKKWPISKFFDK

SEQ ID NO: 2242690 - protein, 18 aa, Cryptosporidium parvum
FENPKSRNILIPFIDSIF

SEQ ID NO: 2242691 - protein, 31 aa, Cryptosporidium parvum
FEQFCRPVNFYFLVISLLQIFPSISSTNGIP

SEQ ID NO: 2242692 - protein, 19 aa, Cryptosporidium parvum
FEQFFYYPCDLKDADFVSI

SEQ ID NO: 2242693 - protein, 25 aa, Cryptosporidium parvum
FESRYIWIPLYTLEHLICDFKEARD

SEQ ID NO: 2242694 - protein, 17 aa, Cryptosporidium parvum
FETKFLLSKISILNLVG

SEQ ID NO: 2242695 - protein, 31 aa, Cryptosporidium parvum
FEVCYFIMSLLLIIIKLINLLCIIFTSLNNI

SEQ ID NO: 2242696 - protein, 18 aa, Cryptosporidium parvum
FFAIFDPLCEISSDNLSF

SEQ ID NO: 2242697 - protein, 20 aa, Cryptosporidium parvum
FFAMAITLPCFLIIWCSCIE

SEQ ID NO: 2242698 - protein, 28 aa, Cryptosporidium parvum
FFENDLIFCGFLALYCPIKKHSKSVIQE

SEQ ID NO: 2242699 - protein, 19 aa, Cryptosporidium parvum
FFETFFYLRETLDKCAYVK

SEQ ID NO: 2242700 - protein, 19 aa, Cryptosporidium parvum
FFFRINKLNVKIWESAEFD

SEQ ID NO: 2242701 - protein, 18 aa, Cryptosporidium parvum
FFHYYDTTNTQYSYLNII

SEQ ID NO: 2242702 - protein, 20 aa, Cryptosporidium parvum
FFIATLVLSIAGFFSAIYSL

SEQ ID NO: 2242703 - protein, 18 aa, Cryptosporidium parvum
FFIFGLKSLYEGLFLIES

SEQ ID NO: 2242704 - protein, 21 aa, Cryptosporidium parvum
FFKCLKIIIDLLFNSNLFSKE

SEQ ID NO: 2242705 - protein, 18 aa, Cryptosporidium parvum
FFLIVCMMSLLISSVFNS

SEQ ID NO: 2242706 - protein, 19 aa, Cryptosporidium parvum
FFLLAYLIMLFFSPFVAIS

SEQ ID NO: 2242707 - protein, 22 aa, Cryptosporidium parvum
FFLWALFLFIINFDNSNETKFK

SEQ ID NO: 2242708 - protein, 47 aa, Cryptosporidium parvum
FFNKSWKTLRGYNFEFFKTISLDIFLPLSPLFDPRLTIRIFEGLVDD

SEQ ID NO: 2242709 - protein, 21 aa, Cryptosporidium parvum
FFNSFLTWLLIGSLDIQYICL

SEQ ID NO: 2242710 - protein, 25 aa, Cryptosporidium parvum
FFNTFFLFLVYYFTGFTMAFTDSLL

SEQ ID NO: 2242711 - protein, 19 aa, Cryptosporidium parvum
FFNVFLYYFNFVIRRLNKS

SEQ ID NO: 2242712 - protein, 42 aa, Cryptosporidium parvum
FFPIDLCIKLLIFTISILLFFYIANLIIWRRYDKHTYKHQSF

SEQ ID NO: 2242713 - protein, 18 aa, Cryptosporidium parvum
FFQVYLGIIVSALNIRER

SEQ ID NO: 2242714 - protein, 18 aa, Cryptosporidium parvum
FFRAIEYLDKFTNTFQSI

SEQ ID NO: 2242715 - protein, 45 aa, Cryptosporidium parvum
FFRFNILHEEYFSIKSILFKCFIVFAMNIFLKPYKHLLTNSSSDI

SEQ ID NO: 2242716 - protein, 29 aa, Cryptosporidium parvum
FFRQLLMTPIMFILYLTVPSPSLRRSVQI

SEQ ID NO: 2242717 - protein, 17 aa, Cryptosporidium parvum
FFRSKFFNKRYFGLIEN

SEQ ID NO: 2242718 - protein, 27 aa, Cryptosporidium parvum
FFSTYFGLLFVIIGGLIFWKVYVTIIP

SEQ ID NO: 2242719 - protein, 20 aa, Cryptosporidium parvum
FFTNKLNSCLLLLLSNITQN

SEQ ID NO: 2242720 - protein, 26 aa, Cryptosporidium parvum
FFTVISGLIIPILLNNIQKFSAYKEQ

SEQ ID NO: 2242721 - protein, 21 aa, Cryptosporidium parvum
FFVIIVHFISFSIGEQQPSPN

SEQ ID NO: 2242722 - protein, 25 aa, Cryptosporidium parvum
FFVRKGEVILRILENYYPPIFESNL

SEQ ID NO: 2242723 - protein, 21 aa, Cryptosporidium parvum
FFVSIVKICLIAISILTTGVN

SEQ ID NO: 2242724 - protein, 26 aa, Cryptosporidium parvum
FFYFILFYLFHFIFEEKKTIETIFFS

SEQ ID NO: 2242725 - protein, 20 aa, Cryptosporidium parvum
FFYLRTYLATYNKLVSNQCI

SEQ ID NO: 2242726 - protein, 37 aa, Cryptosporidium parvum; identical to SEQ ID NO: 2130551

SEQ ID NO: 2242727 - protein, 38 aa, Cryptosporidium parvum
FGAINLHYAIKNMLPYKLRFFIGFSSISSLFGSFGQYS

SEQ ID NO: 2242728 - protein, 18 aa, Cryptosporidium parvum
FGCRANINTILIPGNKQT

SEQ ID NO: 2242729 - protein, 25 aa, Cryptosporidium parvum
FGESKYLWFLPLRNIIRPNFNEELY

SEQ ID NO: 2242730 - protein, 17 aa, Cryptosporidium parvum
FGFDYIWDSLFEFFSRI

SEQ ID NO: 2242731 - protein, 17 aa, Cryptosporidium parvum
FGFLPRKDLVKNYFEQE

SEQ ID NO: 2242732 - protein, 24 aa, Cryptosporidium parvum
FGGTRWPHQLPIRSWRVWGPSDEN

SEQ ID NO: 2242733 - protein, 31 aa, Cryptosporidium parvum
FGHNIRGFSWLPMYHDMGLVGFIVSTVIIGS

SEQ ID NO: 2242734 - protein, 18 aa, Cryptosporidium parvum
FGICLFTSNPYLDLGFRD

SEQ ID NO: 2242735 - protein, 25 aa, Cryptosporidium parvum
FGIEFELFLQLLLLWISIDSSHKFR

SEQ ID NO: 2242736 - protein, 20 aa, Cryptosporidium parvum
FGIFVFISLLYYLLSNGDEC

SEQ ID NO: 2242737 - protein, 18 aa, Cryptosporidium parvum
FGIKNYYLNWLREYEKAL

SEQ ID NO: 2242738 - protein, 26 aa, Cryptosporidium parvum
FGIQHLCLPFIIYPILLCTSVGQMAD

SEQ ID NO: 2242739 - protein, 28 aa, Cryptosporidium parvum
FGISLKHYLTILLHMDRFSYKHIHRYLK

SEQ ID NO: 2242740 - protein, 27 aa, Cryptosporidium parvum
FGISLSHTILFDYPTISSLSTYINQKF

SEQ ID NO: 2242741 - protein, 26 aa, Cryptosporidium parvum
FGKDFNIFFFPIIVVLVYAINVFDLQ

SEQ ID NO: 2242742 - protein, 19 aa, Cryptosporidium parvum
FGKTYHKYLLGYLFGIHRW

SEQ ID NO: 2242743 - protein, 18 aa, Cryptosporidium parvum
FGLAYFGITIFDDVTKPI

SEQ ID NO: 2242744 - protein, 32 aa, Cryptosporidium parvum
FGLNIIKYTLLTIFIIMFITTFINYSIEIGVN

SEQ ID NO: 2242745 - protein, 31 aa, Cryptosporidium parvum
FGLSQIYIFNYWFAIYLLYSTRYINSCIHFI

SEQ ID NO: 2242746 - protein, 21 aa, Cryptosporidium parvum
FGNLGCDGGFYSNGWSYLLEQ

SEQ ID NO: 2242747 - protein, 24 aa, Cryptosporidium parvum
FGNLSKFSIFLRGINLLKTPEMKK

SEQ ID NO: 2242748 - protein, 36 aa, Cryptosporidium parvum
FGQGKYQFYKYILKFKPFLTLISTLPLDLEYRFFAF

SEQ ID NO: 2242749 - protein, 18 aa, Cryptosporidium parvum
FGQNRIIKPLFNRYFKLI

SEQ ID NO: 2242750 - protein, 24 aa, Cryptosporidium parvum
FGSDKIPFLFSPLENIQKFVHKGT

SEQ ID NO: 2242751 - protein, 20 aa, Cryptosporidium parvum
FGTCYFIYRGVNKDLIELFD

SEQ ID NO: 2242752 - protein, 45 aa, Cryptosporidium parvum
FGTFFYNLITIGFFIFAILSYFICFFLFIYNWIYLEKQNSNRRII

SEQ ID NO: 2242753 - protein, 17 aa, Cryptosporidium parvum
FGTFLIDVKSPFSGFTN

SEQ ID NO: 2242754 - protein, 27 aa, Cryptosporidium parvum
FHEFEAHLIIQYFIEYLQSTLKLYNQD

SEQ ID NO: 2242755 - protein, 17 aa, Cryptosporidium parvum
FHELPVTGLQFFNSNEY

SEQ ID NO: 2242756 - protein, 21 aa, Cryptosporidium parvum
FHFLSKLIQIEWLYIIIMCKS

SEQ ID NO: 2242757 - protein, 19 aa, Cryptosporidium parvum
FHGAVVLPILLSLVGRMPC

SEQ ID NO: 2242758 - protein, 28 aa, Cryptosporidium parvum
FHHFSKALLIVIMLSTFFISYKINLHVN

SEQ ID NO: 2242759 - protein, 28 aa, Cryptosporidium parvum
FHKDDSVYEIFKWIDSLALDKNNLISDK

SEQ ID NO: 2242760 - protein, 20 aa, Cryptosporidium parvum
FHKKGIKSMLYLNPNMYSLI

SEQ ID NO: 2242761 - protein, 21 aa, Cryptosporidium parvum
FHLVFALFLISFYQCTNTEPG

SEQ ID NO: 2242762 - protein, 17 aa, Cryptosporidium parvum
FHNRVHIFPFCLDSKQL

SEQ ID NO: 2242763 - protein, 17 aa, Cryptosporidium parvum
FHSNLSFIRVRTKSIFD

SEQ ID NO: 2242764 - protein, 17 aa, Cryptosporidium parvum
FHTKALIFFINKDFKRS

SEQ ID NO: 2242765 - protein, 30 aa, Cryptosporidium parvum; identical to SEQ ID NO: 2130572

SEQ ID NO: 2242766 - protein, 25 aa, Cryptosporidium parvum
FIAIVYALIIYFNPKRAQIIIIKNR

SEQ ID NO: 2242767 - protein, 23 aa, Cryptosporidium parvum
FIAPKILIPIFMYSRELTIKVPE

SEQ ID NO: 2242768 - protein, 37 aa, Cryptosporidium parvum
FIDIILFWMPFYYLFKLCFLFWLFLPQTTGAVTLYNN

SEQ ID NO: 2242769 - protein, 24 aa, Cryptosporidium parvum
FIDTFIIILYPLYIYTNIWMHRMP

SEQ ID NO: 2242770 - protein, 26 aa, Cryptosporidium parvum
FIENQAILILFLSSLVILRYDILAQL

SEQ ID NO: 2242771 - protein, 29 aa, Cryptosporidium parvum
FIERFSQFYLLLVNLLIINFSKLHSIKET

SEQ ID NO: 2242772 - protein, 19 aa, Cryptosporidium parvum
FIFAMKYLCKIINVCLLFI

SEQ ID NO: 2242773 - protein, 26 aa, Cryptosporidium parvum
FIFGNKIVELFPFIEKYKKINFLKNE

SEQ ID NO: 2242774 - protein, 26 aa, Cryptosporidium parvum
FIFIIYFFALFFNNISQIKAAEAPDD

SEQ ID NO: 2242775 - protein, 17 aa, Cryptosporidium parvum
FIFLEGVEMMYVSSLNR

SEQ ID NO: 2242776 - protein, 18 aa, Cryptosporidium parvum
FIFLMFRTRRRLGLITSL

SEQ ID NO: 2242777 - protein, 19 aa, Cryptosporidium parvum
FIFQFLNENTLNRLFLQIS

SEQ ID NO: 2242778 - protein, 20 aa, Cryptosporidium parvum
FIFSFFLYYNSRKRIFINNL

SEQ ID NO: 2242779 - protein, 18 aa, Cryptosporidium parvum
FIFSIIYPIIIVPIFNKL

SEQ ID NO: 2242780 - protein, 26 aa, Cryptosporidium parvum
FIFVYLFVILQIYIKFEFAGANSVGK

SEQ ID NO: 2242781 - protein, 27 aa, Cryptosporidium parvum
FIGKVCSIEFYLYNPLSFPIVCESLQI

SEQ ID NO: 2242782 - protein, 27 aa, Cryptosporidium parvum
FIGLVGKLIFFYYLEWETGSRLSYLKL

SEQ ID NO: 2242783 - protein, 18 aa, Cryptosporidium parvum
FIHEIGLIELEILFNSVY

SEQ ID NO: 2242784 - protein, 18 aa, Cryptosporidium parvum
FIHFIPASNLYTLYSIAD

SEQ ID NO: 2242785 - protein, 19 aa, Cryptosporidium parvum
FIHHGYFQHINLLKILRQV

SEQ ID NO: 2242786 - protein, 21 aa, Cryptosporidium parvum
FIIDKSFFYKVKRDCINKFKN

SEQ ID NO: 2242787 - protein, 17 aa, Cryptosporidium parvum
FIILNDLYDIWFLKFTE

SEQ ID NO: 2242788 - protein, 27 aa, Cryptosporidium parvum
FIINSRIIHRFLNPGRLVYIRLPYLEQ

SEQ ID NO: 2242789 - protein, 23 aa, Cryptosporidium parvum
FIINSYLSIISFLLVIVAILVCF

SEQ ID NO: 2242790 - protein, 29 aa, Cryptosporidium parvum
FIIWILQWYFFVLLVILMAGRIYGESSRE

SEQ ID NO: 2242791 - protein, 32 aa, Cryptosporidium parvum
FIKEKLKIMYLIRLYTLFLDFQGKFLLLSTYI

SEQ ID NO: 2242792 - protein, 24 aa, Cryptosporidium parvum
FIKKIKKIVTFYFLYRGEYKRDYG

SEQ ID NO: 2242793 - protein, 20 aa, Cryptosporidium parvum
FIKPFLKRVNSIYSMSALIL

SEQ ID NO: 2242794 - protein, 24 aa, Cryptosporidium parvum
FIKQFPYNDLISSSLLYSGGKQFE

SEQ ID NO: 2242795 - protein, 27 aa, Cryptosporidium parvum
FIKSFTKFNPLIGRLQWNSSSPRTYRW

SEQ ID NO: 2242796 - protein, 22 aa, Cryptosporidium parvum
FIKYWNSFLRWREQQSPRIMTI

SEQ ID NO: 2242797 - protein, 24 aa, Cryptosporidium parvum
FILENDWFLGMTPIIRVPIYTILG

SEQ ID NO: 2242798 - protein, 25 aa, Cryptosporidium parvum
FIMTLASDFYVYLFELMSDNERMKN

SEQ ID NO: 2242799 - protein, 17 aa, Cryptosporidium parvum
FINQLDILSLLEHIWII

SEQ ID NO: 2242800 - protein, 19 aa, Cryptosporidium parvum
FIPKYLFEQFCRPVNFYFL

SEQ ID NO: 2242801 - protein, 23 aa, Cryptosporidium parvum
FIPSGMRHFPIKKLIALIQSHSD

SEQ ID NO: 2242802 - protein, 25 aa, Cryptosporidium parvum
FIQGFIQVLLFCPPYCLHQRREILV

SEQ ID NO: 2242803 - protein, 17 aa, Cryptosporidium parvum
FIQKPYNIPPFLHFIFG

SEQ ID NO: 2242804 - protein, 20 aa, Cryptosporidium parvum
FISLAISLFIILCYWHTLNI

SEQ ID NO: 2242805 - protein, 25 aa, Cryptosporidium parvum
FISNIKYLIVNMKKKVRFKDESSSS

SEQ ID NO: 2242806 - protein, 18 aa, Cryptosporidium parvum
FISTLFKKPFIAHREKRI

SEQ ID NO: 2242807 - protein, 31 aa, Cryptosporidium parvum; identical to SEQ ID NO: 2130597

SEQ ID NO: 2242808 - protein, 24 aa, Cryptosporidium parvum
FITAELIKICRCLSIPIVVDADGL

SEQ ID NO: 2242809 - protein, 18 aa, Cryptosporidium parvum
FITDFFKAVLNFIESFSI

SEQ ID NO: 2242810 - protein, 22 aa, Cryptosporidium parvum
FITIPVMFYLDYLFYKKFTIPM

SEQ ID NO: 2242811 - protein, 28 aa, Cryptosporidium parvum
FITLCNMFIMYRLLLDVIPYPIGVTFSQ

SEQ ID NO: 2242812 - protein, 17 aa, Cryptosporidium parvum
FITPFLSTRDFYCDRNG

SEQ ID NO: 2242813 - protein, 24 aa, Cryptosporidium parvum
FIVSTIIYIIPFWSTSSMSLYFNN

SEQ ID NO: 2242814 - protein, 17 aa, Cryptosporidium parvum
FIVYIYNRRMKFVYDPS

SEQ ID NO: 2242815 - protein, 22 aa, Cryptosporidium parvum
FIWNRNISLPVLISGVDPRWIT

SEQ ID NO: 2242816 - protein, 19 aa, Cryptosporidium parvum
FIYKKLQLYTTPKFHRMFF

SEQ ID NO: 2242817 - protein, 26 aa, Cryptosporidium parvum
FIYNSWSFYLLVYTIGVIYSIFLFNK

SEQ ID NO: 2242818 - protein, 21 aa, Cryptosporidium parvum
FIYYCNFFTFTIITLIMMHIL

SEQ ID NO: 2242819 - protein, 27 aa, Cryptosporidium parvum
FKALNYVELVILLGTTLILDYNRKLGE

SEQ ID NO: 2242820 - protein, 27 aa, Cryptosporidium parvum
FKCHGFEWLWFLALLIVISVVMFPFMK

SEQ ID NO: 2242821 - protein, 19 aa, Cryptosporidium parvum
FKCIQSLCYYAKIEEIYLS

SEQ ID NO: 2242822 - protein, 19 aa, Cryptosporidium parvum
FKELILLKILAFVEINKRS

SEQ ID NO: 2242823 - protein, 19 aa, Cryptosporidium parvum
FKEYRFYPRMADYITYKIE

SEQ ID NO: 2242824 - protein, 30 aa, Cryptosporidium parvum
FKHDNEFLQFIIFPFQTFFSFNLESKVKTE

SEQ ID NO: 2242825 - protein, 24 aa, Cryptosporidium parvum
FKHLNWYHLYPRTSEMVKYVRPVP

SEQ ID NO: 2242826 - protein, 36 aa, Cryptosporidium parvum
FKKEEEMNISKFWLLIAIILIYITSLEKDVEEKGLV

SEQ ID NO: 2242827 - protein, 34 aa, Cryptosporidium parvum
FKKISVIFLFIIVILLFLNFELLYASDAKESESN

SEQ ID NO: 2242828 - protein, 32 aa, Cryptosporidium parvum
FKKNYLSIFFFDLVAYIFLILSAVLFDSSEHS

SEQ ID NO: 2242829 - protein, 34 aa, Cryptosporidium parvum
FKLKEFLINYYAKIIWSPVIFILTTNKTASSSTN

SEQ ID NO: 2242830 - protein, 17 aa, Cryptosporidium parvum
FKNDGWIADAVKYLFFI

SEQ ID NO: 2242831 - protein, 26 aa, Cryptosporidium parvum
FKNLPNKIELFSNLFFTFIEGTDFPF

SEQ ID NO: 2242832 - protein, 18 aa, Cryptosporidium parvum
FKQKKLMKIRKLSLILTL

SEQ ID NO: 2242833 - protein, 34 aa, Cryptosporidium parvum
FKRIPEIYYFFESTFLWMLSYDYVIGIFAGAITI

SEQ ID NO: 2242834 - protein, 30 aa, Cryptosporidium parvum; identical to SEQ ID NO: 2130614

SEQ ID NO: 2242835 - protein, 26 aa, Cryptosporidium parvum
FKTRKALLLPYLALLNTLLSSNIGSV

SEQ ID NO: 2242836 - protein, 17 aa, Cryptosporidium parvum
FKVILKESQRFSSSEKI

SEQ ID NO: 2242837 - protein, 19 aa, Cryptosporidium parvum
FKVLAFLSFIFGPFFFRFF

SEQ ID NO: 2242838 - protein, 33 aa, Cryptosporidium parvum; identical to SEQ ID NO: 2130619

SEQ ID NO: 2242839 - protein, 25 aa, Cryptosporidium parvum
FKVVAYNYMMLFYESDLSILTECFS

SEQ ID NO: 2242840 - protein, 20 aa, Cryptosporidium parvum
FLCIVLLKLAQNGMLATDVV

SEQ ID NO: 2242841 - protein, 27 aa, Cryptosporidium parvum
FLDNHVFMVIPMFRKISDLLKKNLDII

SEQ ID NO: 2242842 - protein, 36 aa, Cryptosporidium parvum; identical to SEQ ID NO: 2130622

SEQ ID NO: 2242843 - protein, 21 aa, Cryptosporidium parvum
FLFGLVYLLSLNFNYYNSENC

SEQ ID NO: 2242844 - protein, 19 aa, Cryptosporidium parvum
FLFVNKVIELFIFTTIFEC

SEQ ID NO: 2242845 - protein, 26 aa, Cryptosporidium parvum
FLGGYSNSYWVFQKLLTCIKLAFNTK

SEQ ID NO: 2242846 - protein, 25 aa, Cryptosporidium parvum
FLGHFLIAFVFFAISFLYTSGTFFI

SEQ ID NO: 2242847 - protein, 46 aa, Cryptosporidium parvum; identical to SEQ ID NO: 2130627

SEQ ID NO: 2242848 - protein, 17 aa, Cryptosporidium parvum
FLHIASCISQQFIHRSK

SEQ ID NO: 2242849 - protein, 22 aa, Cryptosporidium parvum
FLIGCLLTGLFLPVLKSKVLLI

SEQ ID NO: 2242850 - protein, 28 aa, Cryptosporidium parvum
FLIHKNLTYFFLFQINFGKSGLKISIFA

SEQ ID NO: 2242851 - protein, 21 aa, Cryptosporidium parvum
FLIINIFFYFSYSANLYILYT

SEQ ID NO: 2242852 - protein, 19 aa, Cryptosporidium parvum
FLIKPDYLFIDIKNKDLKL

SEQ ID NO: 2242853 - protein, 18 aa, Cryptosporidium parvum
FLITSILGIFPHLNILFS

SEQ ID NO: 2242854 - protein, 18 aa, Cryptosporidium parvum
FLKHLNYLKYLSDPILQS

SEQ ID NO: 2242855 - protein, 21 aa, Cryptosporidium parvum
FLKNIEFIFTIPETHIIIKSD

SEQ ID NO: 2242856 - protein, 18 aa, Cryptosporidium parvum
FLKWILKELNCETSTFVD

SEQ ID NO: 2242857 - protein, 25 aa, Cryptosporidium parvum
FLLELPNFLSTFFFVAGGLSFIRFF

SEQ ID NO: 2242858 - protein, 23 aa, Cryptosporidium parvum
FLLIGSCMTLLYKKDIFPEGISK

SEQ ID NO: 2242859 - protein, 20 aa, Cryptosporidium parvum
FLLLIKLQIFKFIGISYRNK

SEQ ID NO: 2242860 - protein, 19 aa, Cryptosporidium parvum
FLLQIQLVLCIVKADPSCF

SEQ ID NO: 2242861 - protein, 25 aa, Cryptosporidium parvum
FLLSNIDIWYVPFVNPDGYAAIERT

SEQ ID NO: 2242862 - protein, 26 aa, Cryptosporidium parvum
FLLTFKILFCIGTKQIFPIGCPLNSI

SEQ ID NO: 2242863 - protein, 18 aa, Cryptosporidium parvum
FLMIIFLIGDISGHWLYM

SEQ ID NO: 2242864 - protein, 29 aa, Cryptosporidium parvum
FLNREEYFHLLYTSLSFIFDKKSSALSTS

SEQ ID NO: 2242865 - protein, 25 aa, Cryptosporidium parvum
FLNSLIDCILLPVNIWITWKLLSKQ

SEQ ID NO: 2242866 - protein, 17 aa, Cryptosporidium parvum
FLNYNWEKRPDAFGTLL

SEQ ID NO: 2242867 - protein, 19 aa, Cryptosporidium parvum
FLRLDFTVMNLNNSLLKSQ

SEQ ID NO: 2242868 - protein, 19 aa, Cryptosporidium parvum
FLRNNLEWLGKATHWSRFS

SEQ ID NO: 2242869 - protein, 27 aa, Cryptosporidium parvum
FLRQIEIFFLIFYPFVFHVSVVAIMFY

SEQ ID NO: 2242870 - protein, 23 aa, Cryptosporidium parvum
FLSDILIPIIPVRKKGFDGKMKT

SEQ ID NO: 2242871 - protein, 17 aa, Cryptosporidium parvum
FLSEFIMDYPISSEFFN

SEQ ID NO: 2242872 - protein, 17 aa, Cryptosporidium parvum
FLSIYDLRVLKSTGIIS

SEQ ID NO: 2242873 - protein, 35 aa, Cryptosporidium parvum
FLSNNKLLLILFSSFINFFPFTIEFFPLTVELILN

SEQ ID NO: 2242874 - protein, 27 aa, Cryptosporidium parvum
FLSSNTFYLVLGFGALLVLAVLCFLLI

SEQ ID NO: 2242875 - protein, 26 aa, Cryptosporidium parvum
FLSTPYNFYFFFVNSLLGIGMGVLCG

SEQ ID NO: 2242876 - protein, 21 aa, Cryptosporidium parvum
FLTCFIYILPVYLMVISVKSL

SEQ ID NO: 2242877 - protein, 17 aa, Cryptosporidium parvum
FLTNPIIIPFSIAHIVF

SEQ ID NO: 2242878 - protein, 19 aa, Cryptosporidium parvum
FLTPEDLFRMFFGGMPAEV

SEQ ID NO: 2242879 - protein, 27 aa, Cryptosporidium parvum
FLTRNLFFSQFVKIACIIRGLHISAGT

SEQ ID NO: 2242880 - protein, 20 aa, Cryptosporidium parvum
FLVHLIFSTTFLTTFALLIL

SEQ ID NO: 2242881 - protein, 18 aa, Cryptosporidium parvum
FLVRLSFLVIQVRSFLAA

SEQ ID NO: 2242882 - protein, 28 aa, Cryptosporidium parvum
FLVTIKFIFDIQPISSFLYLPENYVNVD

SEQ ID NO: 2242883 - protein, 19 aa, Cryptosporidium parvum
FLYSVFSLSFPWTRMTSQV

SEQ ID NO: 2242884 - protein, 28 aa, Cryptosporidium parvum
FMAGITFPFIFYYLEFIESFNLPHIMNG

SEQ ID NO: 2242885 - protein, 27 aa, Cryptosporidium parvum
FMEMDHFIYFLHILIGWNKFVLKKFMV

SEQ ID NO: 2242886 - protein, 31 aa, Cryptosporidium parvum
FMKIRRILYFILIHILIFNILEINSLPPSFS

SEQ ID NO: 2242887 - protein, 43 aa, Cryptosporidium parvum
FMTSDPWFALIMFNSIMNIPWMIFVLYLFIRHVKSIMSNVTFY

SEQ ID NO: 2242888 - protein, 19 aa, Cryptosporidium parvum
FNALLFITNFNLIINSRII

SEQ ID NO: 2242889 - protein, 19 aa, Cryptosporidium parvum
FNAYALLGIWRYDKGITKC

SEQ ID NO: 2242890 - protein, 20 aa, Cryptosporidium parvum
FNEKIVGSIFYLLFKDCRGI

SEQ ID NO: 2242891 - protein, 47 aa, Cryptosporidium parvum
FNEYFNLGNKKFSSILRFLVILAAFISLLVLIKLPVKNRIELRKEML

SEQ ID NO: 2242892 - protein, 22 aa, Cryptosporidium parvum
FNFQSMIVVVLLSICTCSYLRP

SEQ ID NO: 2242893 - protein, 21 aa, Cryptosporidium parvum
FNFSFLILISDIMSYLLLKTS

SEQ ID NO: 2242894 - protein, 31 aa, Cryptosporidium parvum
FNFVTGFIIKFRLPIDPHILSYYLKEVILNL

SEQ ID NO: 2242895 - protein, 19 aa, Cryptosporidium parvum
FNILANLGIMLVAGGSILA

SEQ ID NO: 2242896 - protein, 17 aa, Cryptosporidium parvum
FNKHKLQLISSLSNFSN

SEQ ID NO: 2242897 - protein, 24 aa, Cryptosporidium parvum
FNKNFYLNGLLDNVLLRTSEILVE

SEQ ID NO: 2242898 - protein, 28 aa, Cryptosporidium parvum
FNKRSFEFHLFIKPWSYLDDIIENNTSQ

SEQ ID NO: 2242899 - protein, 27 aa, Cryptosporidium parvum
FNLKTFTLFQRLGMNGILYIIGAIKKS

SEQ ID NO: 2242900 - protein, 24 aa, Cryptosporidium parvum
FNLNTIRRFFYDLNVIISDIFYKS

SEQ ID NO: 2242901 - protein, 23 aa, Cryptosporidium parvum
FNLSTFILYIQLKPFIFTKRDSS

SEQ ID NO: 2242902 - protein, 25 aa, Cryptosporidium parvum
FNMAREFWMIPLNISSRALYCFGKN

SEQ ID NO: 2242903 - protein, 24 aa, Cryptosporidium parvum
FNNKYGKIILWKRNIDNINNEHNP

SEQ ID NO: 2242904 - protein, 17 aa, Cryptosporidium parvum
FNNLYFKNYVDFFMEFI

SEQ ID NO: 2242905 - protein, 25 aa, Cryptosporidium parvum
FNNRIACFIFFATSIIFLSFSISKF

SEQ ID NO: 2242906 - protein, 26 aa, Cryptosporidium parvum
FNNVYELRYYLLFPHLETFENSCNDI

SEQ ID NO: 2242907 - protein, 18 aa, Cryptosporidium parvum
FNRYLNLNFYFNQIQNDE

SEQ ID NO: 2242908 - protein, 18 aa, Cryptosporidium parvum
FNRYLRFLESIISKIVCE

SEQ ID NO: 2242909 - protein, 25 aa, Cryptosporidium parvum
FNSELPFWFERWLEAFNEKFNFLNH

SEQ ID NO: 2242910 - protein, 28 aa, Cryptosporidium parvum
FNSLKCIRIFLLRLKADLMWNYTPNIIS

SEQ ID NO: 2242911 - protein, 24 aa, Cryptosporidium parvum
FNSSSFFFLAALTLGLHQYNVQKE

SEQ ID NO: 2242912 - protein, 17 aa, Cryptosporidium parvum
FNTDALYFILNPGYTEC

SEQ ID NO: 2242913 - protein, 43 aa, Cryptosporidium parvum; identical to SEQ ID NO: 2130655

SEQ ID NO: 2242914 - protein, 17 aa, Cryptosporidium parvum
FNTYYYFLNAMGFSPGI

SEQ ID NO: 2242915 - protein, 28 aa, Cryptosporidium parvum
FNVLYILMGLLHLLFSYFWVHYGSSLFT

SEQ ID NO: 2242916 - protein, 17 aa, Cryptosporidium parvum
FNYAIYCFYSHLICIQA

SEQ ID NO: 2242917 - protein, 19 aa, Cryptosporidium parvum
FNYSLFLVFCFCLVNTVVS

SEQ ID NO: 2242918 - protein, 30 aa, Cryptosporidium parvum
FPCSILLGNLISLILFPLRVILASYAITII

SEQ ID NO: 2242919 - protein, 18 aa, Cryptosporidium parvum
FPFAILEVKLQSEQPIWV

SEQ ID NO: 2242920 - protein, 17 aa, Cryptosporidium parvum
FPFALIPARVLPTTKHI

SEQ ID NO: 2242921 - protein, 30 aa, Cryptosporidium parvum; identical to SEQ ID NO: 2130666

SEQ ID NO: 2242922 - protein, 28 aa, Cryptosporidium parvum
FPKLTSKIFFFFFLNIYFQIYNLEHILI

SEQ ID NO: 2242923 - protein, 24 aa, Cryptosporidium parvum
FPMSKFWMMGFFDAFSSILTLLAS

SEQ ID NO: 2242924 - protein, 18 aa, Cryptosporidium parvum
FPRPIADFQNYLNISPPP

SEQ ID NO: 2242925 - protein, 26 aa, Cryptosporidium parvum
FPSHPNLWAHLFIPEYGSEKTKEIPK

SEQ ID NO: 2242926 - protein, 26 aa, Cryptosporidium parvum
FPSNNILNIPFLPEMKRMIFGILIVI

SEQ ID NO: 2242927 - protein, 29 aa, Cryptosporidium parvum
FPTERCVLLMLGILQRMVYIPSVSALENC

SEQ ID NO: 2242928 - protein, 31 aa, Cryptosporidium parvum; identical to SEQ ID NO: 2130671

SEQ ID NO: 2242929 - protein, 22 aa, Cryptosporidium parvum
FPYKEYIWKLLNWESQLHSLFA

SEQ ID NO: 2242930 - protein, 26 aa, Cryptosporidium parvum
FQDNRYLFLQYLIKKSLNFEKKCQLF

SEQ ID NO: 2242931 - protein, 17 aa, Cryptosporidium parvum
FQDYWALAYPDYPEINR

SEQ ID NO: 2242932 - protein, 27 aa, Cryptosporidium parvum
FQEDIFLEYIALFSLEYFSSSFREIEI

SEQ ID NO: 2242933 - protein, 19 aa, Cryptosporidium parvum
FQFIPLTINSLKLSWNTPK

SEQ ID NO: 2242934 - protein, 27 aa, Cryptosporidium parvum
FQFKKALSLILYGLVSVALVFLNKRIF

SEQ ID NO: 2242935 - protein, 35 aa, Cryptosporidium parvum
FQKSYFSWVFSLFIVSFFCYFSMSIKNIYSIISCT

SEQ ID NO: 2242936 - protein, 40 aa, Cryptosporidium parvum; identical to SEQ ID NO: 2130674

SEQ ID NO: 2242937 - protein, 23 aa, Cryptosporidium parvum
FQNRSRELLVPSLGRKCELATEE

SEQ ID NO: 2242938 - protein, 32 aa, Cryptosporidium parvum; identical to SEQ ID NO: 2130676

SEQ ID NO: 2242939 - protein, 18 aa, Cryptosporidium parvum
FQTWTKRSKYAKDAILSL

SEQ ID NO: 2242940 - protein, 18 aa, Cryptosporidium parvum
FQYKRFFDHYIYQIILYS

SEQ ID NO: 2242941 - protein, 31 aa, Cryptosporidium parvum
FRESTTDWIFFSIILFLTIVRGIEILVFFAF

SEQ ID NO: 2242942 - protein, 19 aa, Cryptosporidium parvum
FRFWNALLVIWTNPFWTVK

SEQ ID NO: 2242943 - protein, 26 aa, Cryptosporidium parvum
FRKFTKLFKLFPKYKALLIKQIIAKE

SEQ ID NO: 2242944 - protein, 25 aa, Cryptosporidium parvum
FRLKKEILELPPSLWYVVLPQLLSR

SEQ ID NO: 2242945 - protein, 23 aa, Cryptosporidium parvum
FRLLSLLVILSLVFLLGLTEIEG

SEQ ID NO: 2242946 - protein, 26 aa, Cryptosporidium parvum
FRNPFFKNPFILVPVTINALVYGTLI

SEQ ID NO: 2242947 - protein, 25 aa, Cryptosporidium parvum
FRQEMSPILRIKWLRLIIDEGHNIG

SEQ ID NO: 2242948 - protein, 27 aa, Cryptosporidium parvum
FRRMISIFSWFFTGIVILLMVGINVNT

SEQ ID NO: 2242949 - protein, 41 aa, Cryptosporidium parvum
FSAFKSSYTILFILKISLMLTMFFLAYSLKKFKESFGIGSE

SEQ ID NO: 2242950 - protein, 21 aa, Cryptosporidium parvum
FSAHEFLNFIIINYGLFNTEN

SEQ ID NO: 2242951 - protein, 21 aa, Cryptosporidium parvum
FSEINLVYLDWAIKSSMISPE

SEQ ID NO: 2242952 - protein, 26 aa, Cryptosporidium parvum
FSERLFVNMLLFGYIWRKSAGYLNSE

SEQ ID NO: 2242953 - protein, 33 aa, Cryptosporidium parvum
FSFAHSYIQFTWVTKWIYLGSRRPLPAKDLPDL

SEQ ID NO: 2242954 - protein, 19 aa, Cryptosporidium parvum
FSFEFKFDILGFDACLMMQ

SEQ ID NO: 2242955 - protein, 19 aa, Cryptosporidium parvum
FSFLKAQIQTFLKLYLEQA

SEQ ID NO: 2242956 - protein, 19 aa, Cryptosporidium parvum
FSFLPKILEFQVKDGIFQA

SEQ ID NO: 2242957 - protein, 19 aa, Cryptosporidium parvum
FSGALLFTSLAVSLILVCI

SEQ ID NO: 2242958 - protein, 20 aa, Cryptosporidium parvum
FSGIHFLHAALLCRKTREWR

SEQ ID NO: 2242959 - protein, 25 aa, Cryptosporidium parvum
FSGLHIFWSIIFSKYILNEEIKSRH

SEQ ID NO: 2242960 - protein, 28 aa, Cryptosporidium parvum
FSHIKNIFMFLPYKFLTKMKKSIDLIFK

SEQ ID NO: 2242961 - protein, 25 aa, Cryptosporidium parvum
FSIDNRIPRKLYYIAKANIYSRIPE

SEQ ID NO: 2242962 - protein, 25 aa, Cryptosporidium parvum
FSIEHPNRFFYSKKLLIGLVNVPEF

SEQ ID NO: 2242963 - protein, 27 aa, Cryptosporidium parvum
FSIENYINKIPLFTNLFSEIINSKLNG

SEQ ID NO: 2242964 - protein, 18 aa, Cryptosporidium parvum
FSIPRLFDFLVFLDCLFC

SEQ ID NO: 2242965 - protein, 29 aa, Cryptosporidium parvum
FSIYIIFYIIFFYIQVVYSLYSNLSKGAN

SEQ ID NO: 2242966 - protein, 24 aa, Cryptosporidium parvum
FSKDWYMEIIIYLIKFIANNTQSV

SEQ ID NO: 2242967 - protein, 26 aa, Cryptosporidium parvum
FSKEIEFISLIYPKGWLLYSEDATTS

SEQ ID NO: 2242968 - protein, 24 aa, Cryptosporidium parvum
FSKEIYLRTIPYARYTPLFIEVRS

SEQ ID NO: 2242969 - protein, 27 aa, Cryptosporidium parvum
FSKIWNNYWLVLKFLKSINQNLISIFS

SEQ ID NO: 2242970 - protein, 38 aa, Cryptosporidium parvum
FSKKSILSLLFKIIYLIRILNSLRCLVLLLYSRSNETI

SEQ ID NO: 2242971 - protein, 24 aa, Cryptosporidium parvum
FSKNHFSIFSLFNKHKLQLISSLS

SEQ ID NO: 2242972 - protein, 24 aa, Cryptosporidium parvum
FSLIRRIYQQILVNSYKILEFSLG

SEQ ID NO: 2242973 - protein, 24 aa, Cryptosporidium parvum
FSLIYLYSYLFFDQNTGYLIEVNL

SEQ ID NO: 2242974 - protein, 26 aa, Cryptosporidium parvum
FSLKKMNLKLIIYLSNVFEYRNNQQS

SEQ ID NO: 2242975 - protein, 28 aa, Cryptosporidium parvum
FSLKRWKMFLDILPFSDILPLLHMIERI

SEQ ID NO: 2242976 - protein, 21 aa, Cryptosporidium parvum
FSLLTTILIIILKTGVISDTP

SEQ ID NO: 2242977 - protein, 26 aa, Cryptosporidium parvum
FSLNYLNLFHSVFPYYRGEVPKLTVS

SEQ ID NO: 2242978 - protein, 17 aa, Cryptosporidium parvum
FSMLIFIPLALPIITFS

SEQ ID NO: 2242979 - protein, 35 aa, Cryptosporidium parvum
FSNDGISHIYLLLVIILLVNLGIGLFFCGRNLNKQ

SEQ ID NO: 2242980 - protein, 22 aa, Cryptosporidium parvum
FSNLGLLIWISSAFLLLPLFFL

SEQ ID NO: 2242981 - protein, 25 aa, Cryptosporidium parvum
FSNSPFLCIWLLIHGSLQMLQGIFR

SEQ ID NO: 2242982 - protein, 19 aa, Cryptosporidium parvum
FSPAIWYCSINNTLLFFGI

SEQ ID NO: 2242983 - protein, 17 aa, Cryptosporidium parvum
FSPVFHILFERLSVNIQ

SEQ ID NO: 2242984 - protein, 20 aa, Cryptosporidium parvum
FSQKYLYWLKNLHFQFCIGF

SEQ ID NO: 2242985 - protein, 30 aa, Cryptosporidium parvum
FSRCYVFILTIFFGFFFLYLERIKTERVLY

SEQ ID NO: 2242986 - protein, 18 aa, Cryptosporidium parvum
FSSFFDDCYCEIANWLCS

SEQ ID NO: 2242987 - protein, 25 aa, Cryptosporidium parvum
FSSFSLMILFKWIHIFYIEIKYLFW

SEQ ID NO: 2242988 - protein, 19 aa, Cryptosporidium parvum
FSSFWGYKPSPYKKDLRKS

SEQ ID NO: 2242989 - protein, 18 aa, Cryptosporidium parvum
FSSLAFLKLVGSPIVHAY

SEQ ID NO: 2242990 - protein, 21 aa, Cryptosporidium parvum
FSSVMIRLMLVFGPAACCLSA

SEQ ID NO: 2242991 - protein, 23 aa, Cryptosporidium parvum
FSVMIPMWLSMKISRYKKRCVQQ

SEQ ID NO: 2242992 - protein, 19 aa, Cryptosporidium parvum
FSVTPYMSALFWITAVLST

SEQ ID NO: 2242993 - protein, 28 aa, Cryptosporidium parvum
FSYDISLIRIIHFLSVLTFFGLPNTNKG

SEQ ID NO: 2242994 - protein, 20 aa, Cryptosporidium parvum
FSYIPICSLLFFSNNLIAMS

SEQ ID NO: 2242995 - protein, 20 aa, Cryptosporidium parvum
FSYLLSFPKIDCNIIKKIIY

SEQ ID NO: 2242996 - protein, 28 aa, Cryptosporidium parvum
FSYNIIYNIILIVINIIIKDLQIFDKSN

SEQ ID NO: 2242997 - protein, 26 aa, Cryptosporidium parvum
FTCFDALLIFYILYILVKNENSEEID

SEQ ID NO: 2242998 - protein, 26 aa, Cryptosporidium parvum
FTDFQQTLIIFYLKIIRNCCLASEKA

SEQ ID NO: 2242999 - protein, 17 aa, Cryptosporidium parvum
FTFMALFIYNFWRCSIL

SEQ ID NO: 2243000 - protein, 17 aa, Cryptosporidium parvum
FTFNFSNINPKSIHKNV

SEQ ID NO: 2243001 - protein, 33 aa, Cryptosporidium parvum
FTGSKLFFELLFQLYNFLYTSVPPIIFATFDSD

SEQ ID NO: 2243002 - protein, 18 aa, Cryptosporidium parvum
FTICYIIINFFKKIVKFF

SEQ ID NO: 2243003 - protein, 31 aa, Cryptosporidium parvum
FTIGIEPIIIILRSFDLFTIVAPPALPATIA

SEQ ID NO: 2243004 - protein, 20 aa, Cryptosporidium parvum
FTIWVIFGIQHLCLPFIIYP

SEQ ID NO: 2243005 - protein, 26 aa, Cryptosporidium parvum
FTKHFFIVLAPIWFIFLLNSCIQRSE

SEQ ID NO: 2243006 - protein, 25 aa, Cryptosporidium parvum
FTKLNILFLFVPFGVLSYYLEWGAL

SEQ ID NO: 2243007 - protein, 17 aa, Cryptosporidium parvum
FTLLTVFASYSITLIVI

SEQ ID NO: 2243008 - protein, 39 aa, Cryptosporidium parvum
FTMAEWKFYKLVSVLRFISFLYCIVIFISIGRVRHLLFT

SEQ ID NO: 2243009 - protein, 36 aa, Cryptosporidium parvum; identical to SEQ ID NO: 2130725

SEQ ID NO: 2243010 - protein, 41 aa, Cryptosporidium parvum
FTRVTIYIGYFIYLDYRFIIVFLPISYFFNKFRIRAMFANR

SEQ ID NO: 2243011 - protein, 28 aa, Cryptosporidium parvum
FTSIAIIYYNHWLFDKVAPFPVFATWVQ

SEQ ID NO: 2243012 - protein, 39 aa, Cryptosporidium parvum
FTSKKYFHRALFDPTFLQYIYMILGISYHLLDNTKEACN

SEQ ID NO: 2243013 - protein, 26 aa, Cryptosporidium parvum
FTTIALILIFVIFDKNGRNPIQVYFQ

SEQ ID NO: 2243014 - protein, 18 aa, Cryptosporidium parvum
FTVLDKLELLPMDSYKLI

SEQ ID NO: 2243015 - protein, 19 aa, Cryptosporidium parvum
FTWRSTIYDIIIFDKIDDR

SEQ ID NO: 2243016 - protein, 21 aa, Cryptosporidium parvum
FTYKHFVVYIVFYVIGTILNL

SEQ ID NO: 2243017 - protein, 21 aa, Cryptosporidium parvum
FTYLLVRISSLFYILGLGSHL

SEQ ID NO: 2243018 - protein, 19 aa, Cryptosporidium parvum
FTYRRRLTALHLRFKQKKL

SEQ ID NO: 2243019 - protein, 20 aa, Cryptosporidium parvum
FVCLPLFQELCYVDVEGDVR

SEQ ID NO: 2243020 - protein, 35 aa, Cryptosporidium parvum
FVCRNKLLYLVLVIILLWALSFTIVHQLVISSTGN

SEQ ID NO: 2243021 - protein, 24 aa, Cryptosporidium parvum
FVDAAMLIAIFPRQIRFLIAEASF

SEQ ID NO: 2243022 - protein, 25 aa, Cryptosporidium parvum
FVEFSLIFENFYIHLLVNSDKIYKS

SEQ ID NO: 2243023 - protein, 26 aa, Cryptosporidium parvum
FVEKYPFPEKILFSMLVALTRLYGVS

SEQ ID NO: 2243024 - protein, 29 aa, Cryptosporidium parvum
FVFGSFIKMRPYKPIYKLCIVGAGPSGCY

SEQ ID NO: 2243025 - protein, 21 aa, Cryptosporidium parvum
FVGLLFGYITCLTILLGVLCI

SEQ ID NO: 2243026 - protein, 24 aa, Cryptosporidium parvum
FVINWLFVFYVIYPLMWEIIYTRI

SEQ ID NO: 2243027 - protein, 18 aa, Cryptosporidium parvum
FVIPIINSRFKLAYSVLR

SEQ ID NO: 2243028 - protein, 18 aa, Cryptosporidium parvum
FVLIVAFLSYNSDSSNLN

SEQ ID NO: 2243029 - protein, 23 aa, Cryptosporidium parvum
FVLSVINMVKFVEKIKIPICQHN

SEQ ID NO: 2243030 - protein, 24 aa, Cryptosporidium parvum
FVMELIGIYILVMQLYPPPNSIVT

SEQ ID NO: 2243031 - protein, 43 aa, Cryptosporidium parvum
FVNCEYMESFFKYFYQYIYITYYQLFHPPLIIRTGKLLSFSRN

SEQ ID NO: 2243032 - protein, 24 aa, Cryptosporidium parvum
FVNKYYFERYLKFSHLIISNETIN

SEQ ID NO: 2243033 - protein, 36 aa, Cryptosporidium parvum
FVNSLPKLRYILIQRLKIWLTPLLLFHDLISSKNRM

SEQ ID NO: 2243034 - protein, 26 aa, Cryptosporidium parvum
FVPHSIQLFWGVDYFAAKELLIEERK

SEQ ID NO: 2243035 - protein, 22 aa, Cryptosporidium parvum
FVPHVNLLVYYLKSLNSIVNHP

SEQ ID NO: 2243036 - protein, 29 aa, Cryptosporidium parvum
FVQISLFLINIIWAFLWALDSNYLTRESI

SEQ ID NO: 2243037 - protein, 21 aa, Cryptosporidium parvum
FVSIFSFIEIVSPRPSIFKYS

SEQ ID NO: 2243038 - protein, 29 aa, Cryptosporidium parvum
FVSRLICIILIIFTIIYVPNQISKLVQLA

SEQ ID NO: 2243039 - protein, 24 aa, Cryptosporidium parvum
FVSVLKLNLLLLWAPKENSKKYLS

SEQ ID NO: 2243040 - protein, 23 aa, Cryptosporidium parvum
FVTPLLLALFPFSRLHIGFIVRN

SEQ ID NO: 2243041 - protein, 17 aa, Cryptosporidium parvum
FVVLVFNSILNIYKFRN

SEQ ID NO: 2243042 - protein, 17 aa, Cryptosporidium parvum
FVYPAPNFLNLLIKRIR

SEQ ID NO: 2243043 - protein, 22 aa, Cryptosporidium parvum
FWESLMLGKCGVNLIPYSRWNC

SEQ ID NO: 2243044 - protein, 18 aa, Cryptosporidium parvum
FWNEFIFCLALKALMVVL

SEQ ID NO: 2243045 - protein, 24 aa, Cryptosporidium parvum
FYAGVILATLFFTVLGLTMTTIQI

SEQ ID NO: 2243046 - protein, 18 aa, Cryptosporidium parvum
FYFYHIIMHITITKASTM

SEQ ID NO: 2243047 - protein, 19 aa, Cryptosporidium parvum
FYGNIYHKKVISWIIQQIS

SEQ ID NO: 2243048 - protein, 24 aa, Cryptosporidium parvum
FYGQPLIMCFFVTDRIPATQMEKH

SEQ ID NO: 2243049 - protein, 27 aa, Cryptosporidium parvum
FYGRLPQVFHLYFKFELIKCIQSTREA

SEQ ID NO: 2243050 - protein, 19 aa, Cryptosporidium parvum
FYGYSLLSLSAIVLFSGEE

SEQ ID NO: 2243051 - protein, 17 aa, Cryptosporidium parvum
FYIFNWIYRFYAQHYVN

SEQ ID NO: 2243052 - protein, 27 aa, Cryptosporidium parvum
FYKLIYCLLMVLLYDSLLDFLNNMEPK

SEQ ID NO: 2243053 - protein, 24 aa, Cryptosporidium parvum
FYKVAPWIPVYLETKNKFLIEVSG

SEQ ID NO: 2243054 - protein, 24 aa, Cryptosporidium parvum
FYLLLLFIFGFIVKIQAAEGGEGS

SEQ ID NO: 2243055 - protein, 37 aa, Cryptosporidium parvum
FYLSINILRGNFGKIWLWLVKLLNKNSPHRLFVFVVL

SEQ ID NO: 2243056 - protein, 17 aa, Cryptosporidium parvum
FYLTLWVNSQCSGNVYF

SEQ ID NO: 2243057 - protein, 17 aa, Cryptosporidium parvum
FYMITVLVIIQLTLSIF

SEQ ID NO: 2243058 - protein, 25 aa, Cryptosporidium parvum
FYNRKFFIQLLIYAQLSLLFLFVQG

SEQ ID NO: 2243059 - protein, 17 aa, Cryptosporidium parvum
FYQILSISFINNGPTNA

SEQ ID NO: 2243060 - protein, 30 aa, Cryptosporidium parvum
FYRRLYVFLFGIVLFFILLFGICNSSIVFS

SEQ ID NO: 2243061 - protein, 36 aa, Cryptosporidium parvum; identical to SEQ ID NO: 2130755

SEQ ID NO: 2243062 - protein, 27 aa, Cryptosporidium parvum
FYSQNQLIVPIWDIRKLCNSNRATEFY

SEQ ID NO: 2243063 - protein, 26 aa, Cryptosporidium parvum
FYSRLTKTLIIYQYPSQLLSLSGYQC

SEQ ID NO: 2243064 - protein, 19 aa, Cryptosporidium parvum
FYTASFLSLLISLLGFFVI

SEQ ID NO: 2243065 - protein, 18 aa, Cryptosporidium parvum
FYVFCKLSINVISEHPRI

SEQ ID NO: 2243066 - protein, 25 aa, Cryptosporidium parvum
FYVKSIIFLLMLDFPNDRMDKTLIS

SEQ ID NO: 2243067 - protein, 18 aa, Cryptosporidium parvum
FYYDLKIMVLLWLILPVF

SEQ ID NO: 2243068 - protein, 31 aa, Cryptosporidium parvum; identical to SEQ ID NO: 2130761

SEQ ID NO: 2243069 - protein, 31 aa, Cryptosporidium parvum
GAEYFHHAVAFFILAPIKFLIKNFSKNSTRD

SEQ ID NO: 2243070 - protein, 45 aa, Cryptosporidium parvum
GAFSSFSYMPCPNYIYLNIDAKAKQLLFFPILKKDSNSELLEKSD

SEQ ID NO: 2243071 - protein, 20 aa, Cryptosporidium parvum
GAGYWLLHDLTDKIFFAKVK

SEQ ID NO: 2243072 - protein, 26 aa, Cryptosporidium parvum
GAIVLIKIYVLISKLYLLMRNINAKD

SEQ ID NO: 2243073 - protein, 27 aa, Cryptosporidium parvum
GALATFWFNFIALIPLANLLGIFTEEL

SEQ ID NO: 2243074 - protein, 27 aa, Cryptosporidium parvum
GALCELLFDILPINIQWSFIILQVPKL

SEQ ID NO: 2243075 - protein, 19 aa, Cryptosporidium parvum
GALTLFLMNLMLKNKRLNK

SEQ ID NO: 2243076 - protein, 24 aa, Cryptosporidium parvum
GARLKFIDFIAPIIIQTSLKWVSA

SEQ ID NO: 2243077 - protein, 21 aa, Cryptosporidium parvum
GATFPLMGYLIGKFVTSGVLP

SEQ ID NO: 2243078 - protein, 32 aa, Cryptosporidium parvum; identical to SEQ ID NO: 2130763

SEQ ID NO: 2243079 - protein, 21 aa, Cryptosporidium parvum
GCAIYDLINSRWRLFCDLNHE

SEQ ID NO: 2243080 - protein, 19 aa, Cryptosporidium parvum
GCFLLIKQPSTEKSLIFVT

SEQ ID NO: 2243081 - protein, 20 aa, Cryptosporidium parvum
GCGTSFHAALFAQLLMEHIS

SEQ ID NO: 2243082 - protein, 17 aa, Cryptosporidium parvum
GCILPIEVILCKSSITV

SEQ ID NO: 2243083 - protein, 28 aa, Cryptosporidium parvum
GCNDALIHLLNFLWPNVFENSPHLVQAV

SEQ ID NO: 2243084 - protein, 20 aa, Cryptosporidium parvum
GDFSLWIMNPRHGYFEPIIE

SEQ ID NO: 2243085 - protein, 19 aa, Cryptosporidium parvum
GDISVFRRYFHQNQKNNKL

SEQ ID NO: 2243086 - protein, 17 aa, Cryptosporidium parvum
GDIYKIIKNWWIKNRRD

SEQ ID NO: 2243087 - protein, 29 aa, Cryptosporidium parvum
GDKSNLFWFLVIPYWIIYFIQSGNNFHKW

SEQ ID NO: 2243088 - protein, 24 aa, Cryptosporidium parvum
GDLFTLTFFNIKRFGFEKSKMISS

SEQ ID NO: 2243089 - protein, 23 aa, Cryptosporidium parvum
GDLKKINLLFNKLLMDGDSKVKW

SEQ ID NO: 2243090 - protein, 18 aa, Cryptosporidium parvum
GDNIFLKINWKNNIQKFI

SEQ ID NO: 2243091 - protein, 30 aa, Cryptosporidium parvum
GDPQRIIFRSLLIYLLIIVLNNELGQTILS

SEQ ID NO: 2243092 - protein, 23 aa, Cryptosporidium parvum
GDPVLELLISFITDFFKAVLNFI

SEQ ID NO: 2243093 - protein, 26 aa, Cryptosporidium parvum
GDSKTPYIFIPLLKDINSKKDKSSKF

SEQ ID NO: 2243094 - protein, 25 aa, Cryptosporidium parvum
GDYSIKLSLFFFNSMGIRLFPNPNY

SEQ ID NO: 2243095 - protein, 29 aa, Cryptosporidium parvum
GEDLIRGNNFCFLTLWKKIEELTQQKASE

SEQ ID NO: 2243096 - protein, 18 aa, Cryptosporidium parvum
GEEYPPIPGYLQDKNRFP

SEQ ID NO: 2243097 - protein, 25 aa, Cryptosporidium parvum
GEFVISLVSFLPWIPDVDSAHEWIS

SEQ ID NO: 2243098 - protein, 28 aa, Cryptosporidium parvum
GEGTHFMLPWIERPVIFDIRARPRVVVS

SEQ ID NO: 2243099 - protein, 19 aa, Cryptosporidium parvum
GEILFYKYSFNILVFLLIQ

SEQ ID NO: 2243100 - protein, 22 aa, Cryptosporidium parvum
GEISMLIFFLTERHRYYVDVNW

SEQ ID NO: 2243101 - protein, 21 aa, Cryptosporidium parvum
GELFDVPFRLEASFLLENSNV

SEQ ID NO: 2243102 - protein, 20 aa, Cryptosporidium parvum
GELFINRFYINLQTDILDTP

SEQ ID NO: 2243103 - protein, 34 aa, Cryptosporidium parvum
GELWEYIKGLLSRIIDFIKTLWDLVRGEKKKRML

SEQ ID NO: 2243104 - protein, 30 aa, Cryptosporidium parvum
GENHRRRLNILWSQRYKNIKLRLFIKIDLS

SEQ ID NO: 2243105 - protein, 24 aa, Cryptosporidium parvum
GETIIEVPLILYSKFHKLIEIICV

SEQ ID NO: 2243106 - protein, 19 aa, Cryptosporidium parvum
GFCGLKNFEYLSYRSVLIS

SEQ ID NO: 2243107 - protein, 27 aa, Cryptosporidium parvum
GFEHLWKKRVVYLLKMQSVNAVLFLEG

SEQ ID NO: 2243108 - protein, 17 aa, Cryptosporidium parvum
GFFIWKYSQINLKQNDV

SEQ ID NO: 2243109 - protein, 31 aa, Cryptosporidium parvum
GFHNIYVGLLVIISGIWLVSRLAKIVEFYEM

SEQ ID NO: 2243110 - protein, 23 aa, Cryptosporidium parvum
GFIKVYCKILSKFSLKNKNSKKS

SEQ ID NO: 2243111 - protein, 19 aa, Cryptosporidium parvum
GFKIRRFLRVFKEVADFST

SEQ ID NO: 2243112 - protein, 25 aa, Cryptosporidium parvum
GFKKYIMLFLLLKVLSTLKYLQGVQ

SEQ ID NO: 2243113 - protein, 26 aa, Cryptosporidium parvum
GFKMAFIITMIWIVTLIVNIISITIF

SEQ ID NO: 2243114 - protein, 19 aa, Cryptosporidium parvum
GFLLLALIRLSLFLPFVPS

SEQ ID NO: 2243115 - protein, 29 aa, Cryptosporidium parvum
GFLNREEFLYWVINLHYDRFLFNGLNTKY

SEQ ID NO: 2243116 - protein, 20 aa, Cryptosporidium parvum
GFNLFTIIQLHYYICNFNYN

SEQ ID NO: 2243117 - protein, 23 aa, Cryptosporidium parvum
GFNPWIMKNILFIPLQIVRLNQC

SEQ ID NO: 2243118 - protein, 24 aa, Cryptosporidium parvum
GFPGAMMFGAIRLDGETGLPLEAE

SEQ ID NO: 2243119 - protein, 34 aa, Cryptosporidium parvum; identical to SEQ ID NO: 2130792

SEQ ID NO: 2243120 - protein, 27 aa, Cryptosporidium parvum
GFSEKLTLIFYPFTYKIKYKQTLKHVS

SEQ ID NO: 2243121 - protein, 17 aa, Cryptosporidium parvum
GFSFFLEEKQTGIVFEN

SEQ ID NO: 2243122 - protein, 33 aa, Cryptosporidium parvum
GFSSHKLQSYILWLLLCLNLNMGTVRPFVNASL

SEQ ID NO: 2243123 - protein, 26 aa, Cryptosporidium parvum
GFTIPPSLLWILTTSRLAFIPLYAAI

SEQ ID NO: 2243124 - protein, 24 aa, Cryptosporidium parvum
GFTLIFIPCLLCFYSYYPKFEFII

SEQ ID NO: 2243125 - protein, 17 aa, Cryptosporidium parvum
GFTSLLAHIILYWTGLS

SEQ ID NO: 2243126 - protein, 24 aa, Cryptosporidium parvum
GFVEKLIILLKIPNILNIAISYYF

SEQ ID NO: 2243127 - protein, 19 aa, Cryptosporidium parvum
GFVIIMANLIVLSLDFIQG

SEQ ID NO: 2243128 - protein, 37 aa, Cryptosporidium parvum
GFVRNQIFMIVRYLLYSLIFTIITFITLFKNNSKLVL

SEQ ID NO: 2243129 - protein, 27 aa, Cryptosporidium parvum
GFWILSSMFFICFSLVYGTKTESNVKN

SEQ ID NO: 2243130 - protein, 24 aa, Cryptosporidium parvum
GGASMLMLTILWQFTMVDNSISLW

SEQ ID NO: 2243131 - protein, 34 aa, Cryptosporidium parvum
GGETCDQFEFPWWFYNIIIVLAVLAVGIFYKSQI

SEQ ID NO: 2243132 - protein, 25 aa, Cryptosporidium parvum
GGILASILRKFYSKPKLHISAVEID

SEQ ID NO: 2243133 - protein, 23 aa, Cryptosporidium parvum
GGIMVNFLINNPVLYLNPIENTI

SEQ ID NO: 2243134 - protein, 25 aa, Cryptosporidium parvum
GGKGVLFFGVMFWSLCMIFTSFLSY

SEQ ID NO: 2243135 - protein, 27 aa, Cryptosporidium parvum
GGKNPYFGILYIISGILFILLSIYYII

SEQ ID NO: 2243136 - protein, 28 aa, Cryptosporidium parvum
GGLDSTVLLYLLLEWLFSNLEHLESNIF

SEQ ID NO: 2243137 - protein, 26 aa, Cryptosporidium parvum
GGNIIARVIFQIVELIYVVIPMSSEE

SEQ ID NO: 2243138 - protein, 27 aa, Cryptosporidium parvum
GGPRTHLMMLIFFGGNILRGLFTNSNA

SEQ ID NO: 2243139 - protein, 21 aa, Cryptosporidium parvum
GGPSYFIPFAIFGYYKTRADV

SEQ ID NO: 2243140 - protein, 25 aa, Cryptosporidium parvum
GGQPLNIDLDYWIKKDLPKNTSIVC

SEQ ID NO: 2243141 - protein, 28 aa, Cryptosporidium parvum
GGSGSWIQWLFKFHRISSVPLNSADDVF

SEQ ID NO: 2243142 - protein, 17 aa, Cryptosporidium parvum
GGSPLILGALWDVTDQD

SEQ ID NO: 2243143 - protein, 23 aa, Cryptosporidium parvum
GGSSLIFGIIYYWSKKFPTSLVS

SEQ ID NO: 2243144 - protein, 31 aa, Cryptosporidium parvum; identical to SEQ ID NO: 2130808

SEQ ID NO: 2243145 - protein, 17 aa, Cryptosporidium parvum
GGYFRIYDTFTWENIQI

SEQ ID NO: 2243146 - protein, 41 aa, Cryptosporidium parvum
GHFVAIFYSLIGLVFWHILIPIVYLLCIYFDTKNDKIQRRR

SEQ ID NO: 2243147 - protein, 18 aa, Cryptosporidium parvum
GHLASYWQFFKINTLYEN

SEQ ID NO: 2243148 - protein, 22 aa, Cryptosporidium parvum
GHSKIPYLLKCQICNVIICSIC

SEQ ID NO: 2243149 - protein, 24 aa, Cryptosporidium parvum
GICNYAIIAMFYASDNLFRKMIVE

SEQ ID NO: 2243150 - protein, 22 aa, Cryptosporidium parvum
GIFLINLIKYLLYLYVDLRQKK

SEQ ID NO: 2243151 - protein, 23 aa, Cryptosporidium parvum
GIFSLIGTIWEGGYFRIYDTFTW

SEQ ID NO: 2243152 - protein, 21 aa, Cryptosporidium parvum
GIFTYTFDTRLMLGKTAVTMS

SEQ ID NO: 2243153 - protein, 22 aa, Cryptosporidium parvum
GIFVRLKISLWAPLFEDVTDQK

SEQ ID NO: 2243154 - protein, 27 aa, Cryptosporidium parvum
GIGNPWLVFVPLFKKYDVWTSYILLYL

SEQ ID NO: 2243155 - protein, 31 aa, Cryptosporidium parvum
GIGVYIPIYIGYLNPILLQYINVFAGGTLLS

SEQ ID NO: 2243156 - protein, 43 aa, Cryptosporidium parvum
GIIDIFSRYFVPSIILLSLLAFVVWFLLAYYDKVDPARMFNID

SEQ ID NO: 2243157 - protein, 18 aa, Cryptosporidium parvum
GIIDLLWELDPKDPLVFA

SEQ ID NO: 2243158 - protein, 22 aa, Cryptosporidium parvum
GIIDNFIPLRLNLEIPKFEGEE

SEQ ID NO: 2243159 - protein, 25 aa, Cryptosporidium parvum
GIIFMSKFYYLIKQQLFSSIDTSLF

SEQ ID NO: 2243160 - protein, 23 aa, Cryptosporidium parvum
GIIKKRFLLMRNYEGWQCLICKR

SEQ ID NO: 2243161 - protein, 23 aa, Cryptosporidium parvum
GIILIGLLFFLRFDNISSQIADF

SEQ ID NO: 2243162 - protein, 21 aa, Cryptosporidium parvum
GIINIIPAYNLIPGDIVLLRT

SEQ ID NO: 2243163 - protein, 24 aa, Cryptosporidium parvum
GIISAILCIIVFTLGWKVTAINPG

SEQ ID NO: 2243164 - protein, 28 aa, Cryptosporidium parvum
GIIYERPWYFIFGSVLLTLICSIGFIPG

SEQ ID NO: 2243165 - protein, 23 aa, Cryptosporidium parvum
GIKACFIPMRYSISDYKLMENKN

SEQ ID NO: 2243166 - protein, 28 aa, Cryptosporidium parvum
GIKFPYTNLYFIPPIKMKVGYVRILTIT

SEQ ID NO: 2243167 - protein, 18 aa, Cryptosporidium parvum
GIKIIVYSISWIMVLIWD

SEQ ID NO: 2243168 - protein, 17 aa, Cryptosporidium parvum
GILGFLLVLEPESGTSP

SEQ ID NO: 2243169 - protein, 37 aa, Cryptosporidium parvum
GILIFVPTSLIFPKIGQFFYGKRLYSLLSGNELDSSR

SEQ ID NO: 2243170 - protein, 25 aa, Cryptosporidium parvum
GINITVILIMYITGLIFDIVAFMVL

SEQ ID NO: 2243171 - protein, 25 aa, Cryptosporidium parvum
GINPLAYIIILSFGSPLGAMIGAIV

SEQ ID NO: 2243172 - protein, 28 aa, Cryptosporidium parvum
GINTIFDEWILLLRITIFNGVGGSERNN

SEQ ID NO: 2243173 - protein, 17 aa, Cryptosporidium parvum
GIPEILSYFPDLYVDSS

SEQ ID NO: 2243174 - protein, 17 aa, Cryptosporidium parvum
GIPFFKYFEEKESMISS

SEQ ID NO: 2243175 - protein, 17 aa, Cryptosporidium parvum
GIPMDFRILILNSLTSA

SEQ ID NO: 2243176 - protein, 36 aa, Cryptosporidium parvum; identical to SEQ ID NO: 2130826

SEQ ID NO: 2243177 - protein, 29 aa, Cryptosporidium parvum
GIQNTFFAAFPIFFLSKIIYDVRKPLLKF

SEQ ID NO: 2243178 - protein, 17 aa, Cryptosporidium parvum
GIQRYFVWSIVQLGEFP

SEQ ID NO: 2243179 - protein, 18 aa, Cryptosporidium parvum
GIRRFLMLIILATAIEAI

SEQ ID NO: 2243180 - protein, 31 aa, Cryptosporidium parvum; identical to SEQ ID NO: 2130827

SEQ ID NO: 2243181 - protein, 24 aa, Cryptosporidium parvum
GISAFIGYIIIVLSLFVNGLLINL

SEQ ID NO: 2243182 - protein, 22 aa, Cryptosporidium parvum
GISEFGLFIRYFEIPDKRRAIE

SEQ ID NO: 2243183 - protein, 23 aa, Cryptosporidium parvum
GISIAILIGFLQVLFVILTTQVG

SEQ ID NO: 2243184 - protein, 22 aa, Cryptosporidium parvum
GISLFSVAWLKVSSPIFIAVCL

SEQ ID NO: 2243185 - protein, 35 aa, Cryptosporidium parvum
GISLQLIYMERLIEIFYIYLIIPNFQENNIIIGKL

SEQ ID NO: 2243186 - protein, 29 aa, Cryptosporidium parvum
GISSLPFFARAWIAALPLTFISFFTHYSA

SEQ ID NO: 2243187 - protein, 25 aa, Cryptosporidium parvum
GISTGVVFLALLYNSISVVPRQIDA

SEQ ID NO: 2243188 - protein, 24 aa, Cryptosporidium parvum
GITGKIFMDVLFQLVNAFDLDNRE

SEQ ID NO: 2243189 - protein, 21 aa, Cryptosporidium parvum
GITLFDRFIRLNNKHGLINCD

SEQ ID NO: 2243190 - protein, 18 aa, Cryptosporidium parvum
GITWIPRTLNIVHPINGF

SEQ ID NO: 2243191 - protein, 32 aa, Cryptosporidium parvum
GIVGMFMDTFITPWILLYREPIDNFKKTNKKS

SEQ ID NO: 2243192 - protein, 23 aa, Cryptosporidium parvum
GIYLILKIINFLPPKIRQLLTFY

SEQ ID NO: 2243193 - protein, 22 aa, Cryptosporidium parvum
GIYQKILAGKIFFPKYFDKNCK

SEQ ID NO: 2243194 - protein, 28 aa, Cryptosporidium parvum
GKEAFFKYIMRFYIFEKLSQFLVNPMDA

SEQ ID NO: 2243195 - protein, 18 aa, Cryptosporidium parvum
GKEPILRFDFLVSQLMSS

SEQ ID NO: 2243196 - protein, 26 aa, Cryptosporidium parvum
GKEPYLFISRFPSTPYYILALSLTGT

SEQ ID NO: 2243197 - protein, 23 aa, Cryptosporidium parvum
GKEVFCFNVFQLDIWNDEINSSI

SEQ ID NO: 2243198 - protein, 23 aa, Cryptosporidium parvum
GKFAMLRRNLVSVISAWGETAYN

SEQ ID NO: 2243199 - protein, 26 aa, Cryptosporidium parvum
GKFIDQLFILSFNLKKKLNLAWDACL

SEQ ID NO: 2243200 - protein, 23 aa, Cryptosporidium parvum
GKFQLCLLQFYQDPNISGGEGAR

SEQ ID NO: 2243201 - protein, 24 aa, Cryptosporidium parvum
GKILIMEICILYYDPKSFLDQEFV

SEQ ID NO: 2243202 - protein, 25 aa, Cryptosporidium parvum
GKINEIWNLFLKFGPPKISSYLENN

SEQ ID NO: 2243203 - protein, 28 aa, Cryptosporidium parvum
GKINLYRALLYSSFTKKPLLLTISEYDP

SEQ ID NO: 2243204 - protein, 17 aa, Cryptosporidium parvum
GKLINWIDGILLYAMKN

SEQ ID NO: 2243205 - protein, 52 aa, Cryptosporidium parvum; identical to SEQ ID NO: 2130841

SEQ ID NO: 2243206 - protein, 34 aa, Cryptosporidium parvum
GKNSSRRTLMWFSISIIIVLLNIFIGEYNKSVIE

SEQ ID NO: 2243207 - protein, 27 aa, Cryptosporidium parvum
GKPIDPTTGLPFNPPTGHLINPTNNNT

SEQ ID NO: 2243208 - protein, 29 aa, Cryptosporidium parvum
GKRLEKFCKLFFPALWLSCNDLKPDVSKS

SEQ ID NO: 2243209 - protein, 35 aa, Cryptosporidium parvum
GKRNTLEIYWWYFSLVGRAWCIVLLISCILKSVFD

SEQ ID NO: 2243210 - protein, 29 aa, Cryptosporidium parvum
GKSGLGSLYILFDVGFFLSSSRGRESSFE

SEQ ID NO: 2243211 - protein, 23 aa, Cryptosporidium parvum
GKSNILAAIQFLLSDSFGNTLVE

SEQ ID NO: 2243212 - protein, 24 aa, Cryptosporidium parvum
GKSNLLKKLFPLFNIKQDSDIFEN

SEQ ID NO: 2243213 - protein, 33 aa, Cryptosporidium parvum; identical to SEQ ID NO: 2130843

SEQ ID NO: 2243214 - protein, 20 aa, Cryptosporidium parvum
GKYEKPFFMLKKIFEMFVEL

SEQ ID NO: 2243215 - protein, 35 aa, Cryptosporidium parvum
GKYPKYHSFFKRGFLNTILFKWLSPIINSAEKGII

SEQ ID NO: 2243216 - protein, 18 aa, Cryptosporidium parvum
GLAHYLEHLLFINTEKYP

SEQ ID NO: 2243217 - protein, 22 aa, Cryptosporidium parvum
GLAHYLEHLLFINTEKYPELDG

SEQ ID NO: 2243218 - protein, 35 aa, Cryptosporidium parvum; identical to SEQ ID NO: 2130845

SEQ ID NO: 2243219 - protein, 21 aa, Cryptosporidium parvum
GLDMYLSILKAFKEDYCRYVI

SEQ ID NO: 2243220 - protein, 23 aa, Cryptosporidium parvum
GLDNQIIIWNYLENAWIQELHLL

SEQ ID NO: 2243221 - protein, 35 aa, Cryptosporidium parvum
GLEKNVDIFWFMAYTMITLCVFAGIVVILMFRRLQ

SEQ ID NO: 2243222 - protein, 26 aa, Cryptosporidium parvum
GLEKSIRYFISPLLLNCLQQMVLFDI

SEQ ID NO: 2243223 - protein, 40 aa, Cryptosporidium parvum; identical to SEQ ID NO: 2130848

SEQ ID NO: 2243224 - protein, 17 aa, Cryptosporidium parvum
GLFPGSFFHNRTPGLDF

SEQ ID NO: 2243225 - protein, 24 aa, Cryptosporidium parvum
GLGNEFLFNLLFLNDYNIKEIVIN

SEQ ID NO: 2243226 - protein, 29 aa, Cryptosporidium parvum
GLGSIIIQPLIAKILRKLPRQAAWSFVSM

SEQ ID NO: 2243227 - protein, 23 aa, Cryptosporidium parvum
GLGSPILLYLTGAGIGVIGVVDH

SEQ ID NO: 2243228 - protein, 19 aa, Cryptosporidium parvum
GLGVLYRLPKTAYFDGILQ

SEQ ID NO: 2243229 - protein, 18 aa, Cryptosporidium parvum
GLIFLIESKYLLISDFLD

SEQ ID NO: 2243230 - protein, 20 aa, Cryptosporidium parvum
GLIGVVIGGVWYITKNNKKE

SEQ ID NO: 2243231 - protein, 26 aa, Cryptosporidium parvum
GLIKAFCFSYINYYLKKIIATNSKPL

SEQ ID NO: 2243232 - protein, 20 aa, Cryptosporidium parvum
GLIMSIIFSLNYLNLFHSVF

SEQ ID NO: 2243233 - protein, 20 aa, Cryptosporidium parvum
GLISRIIWDILYYINDHKDR

SEQ ID NO: 2243234 - protein, 31 aa, Cryptosporidium parvum
GLITQILLWIFLFPYLLYNEKFKIIIMGQAF

SEQ ID NO: 2243235 - protein, 17 aa, Cryptosporidium parvum
GLKDKFFLIFYSSQVAS

SEQ ID NO: 2243236 - protein, 22 aa, Cryptosporidium parvum
GLKSQLFGMFKRKNKGGKHGKT

SEQ ID NO: 2243237 - protein, 26 aa, Cryptosporidium parvum
GLLDGFFEFCDFFRQLLMTPIMFILY

SEQ ID NO: 2243238 - protein, 26 aa, Cryptosporidium parvum
GLLGLLTLIDYWISTLSYQASMHLNQ

SEQ ID NO: 2243239 - protein, 22 aa, Cryptosporidium parvum
GLLLFIGYIFNVLFIGVASVLI

SEQ ID NO: 2243240 - protein, 18 aa, Cryptosporidium parvum
GLLLFQYSDDWPTRIDGS

SEQ ID NO: 2243241 - protein, 20 aa, Cryptosporidium parvum
GLLTLYFLGKVILNMFVGRL

SEQ ID NO: 2243242 - protein, 23 aa, Cryptosporidium parvum
GLLVFSVVLLVIFALNGVDARLQ

SEQ ID NO: 2243243 - protein, 39 aa, Cryptosporidium parvum
GLNGIKSFYIGSFLRALWLTIGGIIYFGCYQLCNSALEK

SEQ ID NO: 2243244 - protein, 26 aa, Cryptosporidium parvum
GLPLKPIFLSFFLFIVGSFFFYIGLA

SEQ ID NO: 2243245 - protein, 27 aa, Cryptosporidium parvum
GLPMYITRTPWDQLKIGKPLYIRTLKI

SEQ ID NO: 2243246 - protein, 24 aa, Cryptosporidium parvum
GLPRSLTLLHELARRGEWVAFLQE

SEQ ID NO: 2243247 - protein, 31 aa, Cryptosporidium parvum
GLPVDGKLFSSLFGLVIIFYKYEIVSSEHKK

SEQ ID NO: 2243248 - protein, 26 aa, Cryptosporidium parvum
GLRLAAIYMYRFICQSNLVCGYILGC

SEQ ID NO: 2243249 - protein, 26 aa, Cryptosporidium parvum
GLSGFFKGYLTYYFRIAPHAMITLLC

SEQ ID NO: 2243250 - protein, 27 aa, Cryptosporidium parvum
GLSGISWKYLINLILVTVVVYLCGYTF

SEQ ID NO: 2243251 - protein, 34 aa, Cryptosporidium parvum
GLSIDPYSLWMLVDYRWGWPLVNSYFQLQEPLVQ

SEQ ID NO: 2243252 - protein, 21 aa, Cryptosporidium parvum
GLSILLLTLKNIEVAIRGCPA

SEQ ID NO: 2243253 - protein, 21 aa, Cryptosporidium parvum
GLTILAYRYNGLRRNDIYHLL

SEQ ID NO: 2243254 - protein, 21 aa, Cryptosporidium parvum
GLTILWWACKLHYPKLIFRLL

SEQ ID NO: 2243255 - protein, 25 aa, Cryptosporidium parvum
GLVASIFIFILKATFLLSDTHLKYY

SEQ ID NO: 2243256 - protein, 20 aa, Cryptosporidium parvum
GLYRLFYIFNWIYRFYAQHY

SEQ ID NO: 2243257 - protein, 21 aa, Cryptosporidium parvum
GMEFYLMLLQFIYNAIDYSKP

SEQ ID NO: 2243258 - protein, 18 aa, Cryptosporidium parvum
GMIFGVPISPLTPLFIHM

SEQ ID NO: 2243259 - protein, 27 aa, Cryptosporidium parvum
GMITIWLNDYPWLKYALVGMMGITVLL

SEQ ID NO: 2243260 - protein, 26 aa, Cryptosporidium parvum
GMKNDPIFNWELLKNIWLPFRLISKN

SEQ ID NO: 2243261 - protein, 26 aa, Cryptosporidium parvum
GMLNPWYILFDWEYIFRKAQIWRFLT

SEQ ID NO: 2243262 - protein, 26 aa, Cryptosporidium parvum
GMNSLSFKLIYIHKILQSRILEILKD

SEQ ID NO: 2243263 - protein, 25 aa, Cryptosporidium parvum
GMYHGRIILPHSYPFSPPSLMMLTG

SEQ ID NO: 2243264 - protein, 19 aa, Cryptosporidium parvum
GMYSLLGLLLREISSHESS

SEQ ID NO: 2243265 - protein, 32 aa, Cryptosporidium parvum
GNEFTDLFLFRNKIPINLLINGNLTIDTFSEM

SEQ ID NO: 2243266 - protein, 24 aa, Cryptosporidium parvum
GNFRTRLLLTLKSLYDMIGLLPLV

SEQ ID NO: 2243267 - protein, 25 aa, Cryptosporidium parvum
GNGLLIFLLFEIHYLKRRINMLSTT

SEQ ID NO: 2243268 - protein, 37 aa, Cryptosporidium parvum
GNGNNFEIPNPLLFLRCLCGWLLIQSIIKEFEQNQLL

SEQ ID NO: 2243269 - protein, 21 aa, Cryptosporidium parvum
GNINRPLLFHFLRQLISENRN

SEQ ID NO: 2243270 - protein, 19 aa, Cryptosporidium parvum
GNIYISNYLGTRFALSLLN

SEQ ID NO: 2243271 - protein, 25 aa, Cryptosporidium parvum
GNLACMLLDIIYIPSKLFFHYYDTT

SEQ ID NO: 2243272 - protein, 26 aa, Cryptosporidium parvum
GNNKEHLYLFKKLQKWKKYTGMVLEK

SEQ ID NO: 2243273 - protein, 22 aa, Cryptosporidium parvum
GNNYILGLFSYEDFMDWHSKKG

SEQ ID NO: 2243274 - protein, 24 aa, Cryptosporidium parvum
GNPRLTLINLYNNTGGAGGAGGTG

SEQ ID NO: 2243275 - protein, 30 aa, Cryptosporidium parvum
GNRSFNIFDMFFFYKVLNFYYNDLNGADYN

SEQ ID NO: 2243276 - protein, 22 aa, Cryptosporidium parvum
GNTALHLAYMYGMMGLAEFLIN

SEQ ID NO: 2243277 - protein, 28 aa, Cryptosporidium parvum
GNTLWSKLFFTWLSPWMSKFLGPGVNTD

SEQ ID NO: 2243278 - protein, 21 aa, Cryptosporidium parvum
GNVIFIFKSLQRNGFRPDLRL

SEQ ID NO: 2243279 - protein, 24 aa, Cryptosporidium parvum
GPFDLKHGLRRFYKKHFRKSNSLP

SEQ ID NO: 2243280 - protein, 34 aa, Cryptosporidium parvum; identical to SEQ ID NO: 2130885

SEQ ID NO: 2243281 - protein, 37 aa, Cryptosporidium parvum
GPIWQKIAGIIQILPVLLMLFLAIMGNFMPTLFPEDK

SEQ ID NO: 2243282 - protein, 18 aa, Cryptosporidium parvum
GPLLDDFFEKIGSIFYLL

SEQ ID NO: 2243283 - protein, 24 aa, Cryptosporidium parvum
GPNKLFGSPIKYFTKTLLMCLSNP

SEQ ID NO: 2243284 - protein, 27 aa, Cryptosporidium parvum
GPPRRLPQLLVLSIIGGLTVLGFGALV

SEQ ID NO: 2243285 - protein, 25 aa, Cryptosporidium parvum
GPSQPLFFENFLVNNLKLGFGSMLL

SEQ ID NO: 2243286 - protein, 21 aa, Cryptosporidium parvum
GPTFVYLTPNLFYKSFFGNKN

SEQ ID NO: 2243287 - protein, 34 aa, Cryptosporidium parvum
GPTYQLFVGIGYIFYLIIFMIVITKVIQPNEEYS

SEQ ID NO: 2243288 - protein, 35 aa, Cryptosporidium parvum
GPVILFTDFQVYSFLLFLAMLLSSINIIGGFYVTT

SEQ ID NO: 2243289 - protein, 23 aa, Cryptosporidium parvum
GQGLLKLYFIFNMLEIFEKLFRS

SEQ ID NO: 2243290 - protein, 24 aa, Cryptosporidium parvum
GQGYIKLRGSYLLRLLHSLVDRDH

SEQ ID NO: 2243291 - protein, 30 aa, Cryptosporidium parvum; identical to SEQ ID NO: 2130889

SEQ ID NO: 2243292 - protein, 34 aa, Cryptosporidium parvum
GQKQLSLDRRYFPNIFFYCTHLEIPLMQNNNVKK

SEQ ID NO: 2243293 - protein, 29 aa, Cryptosporidium parvum
GQKQTWQSILACIVVCAGFLIGSLDRSTL

SEQ ID NO: 2243294 - protein, 25 aa, Cryptosporidium parvum
GQLARLFWSFWLHTGFIHLFINLSC

SEQ ID NO: 2243295 - protein, 21 aa, Cryptosporidium parvum
GQLILTSWELLLKRISESEDK

SEQ ID NO: 2243296 - protein, 18 aa, Cryptosporidium parvum
GQMILPNNQMIKMKKREI

SEQ ID NO: 2243297 - protein, 17 aa, Cryptosporidium parvum
GQNIWQFIVSRSKLLYN

SEQ ID NO: 2243298 - protein, 25 aa, Cryptosporidium parvum
GQNSSKIFFPPYNNTYISSLLYSNP

SEQ ID NO: 2243299 - protein, 21 aa, Cryptosporidium parvum
GQSCGPLLFAGASFALEASLS

SEQ ID NO: 2243300 - protein, 19 aa, Cryptosporidium parvum
GQSFLIIQPISVLAYESVG

SEQ ID NO: 2243301 - protein, 22 aa, Cryptosporidium parvum
GQTVLLHRWFESYIKDTHILKL

SEQ ID NO: 2243302 - protein, 18 aa, Cryptosporidium parvum
GQVPQWIILLFPSFIVNL

SEQ ID NO: 2243303 - protein, 18 aa, Cryptosporidium parvum
GQWDDAVVIFRRIIRLFP

SEQ ID NO: 2243304 - protein, 22 aa, Cryptosporidium parvum
GRGLSGCKLVIPTNLFTIYLVT

SEQ ID NO: 2243305 - protein, 30 aa, Cryptosporidium parvum
GRKIRGLGKLYWYLTILGLLSYSVIMPFNY

SEQ ID NO: 2243306 - protein, 33 aa, Cryptosporidium parvum; identical to SEQ ID NO: 2130895

SEQ ID NO: 2243307 - protein, 28 aa, Cryptosporidium parvum
GRKSRRFVIKYYATFLTMTSTRVIILIL

SEQ ID NO: 2243308 - protein, 18 aa, Cryptosporidium parvum
GRLCIIIVSIIWGIQIVI

SEQ ID NO: 2243309 - protein, 24 aa, Cryptosporidium parvum
GRLDNFKINWIAKGLPFCCRTRPT

SEQ ID NO: 2243310 - protein, 27 aa, Cryptosporidium parvum
GRLGKVLFPAGIYPSIKMILGRSGRRR

SEQ ID NO: 2243311 - protein, 21 aa, Cryptosporidium parvum
GRMESILNFLKLRCKGIGLDL

SEQ ID NO: 2243312 - protein, 21 aa, Cryptosporidium parvum
GRPFFAFNLLCMRHAKFHNSL

SEQ ID NO: 2243313 - protein, 22 aa, Cryptosporidium parvum
GRPRKTPLLSLTTLNKSSFKYF

SEQ ID NO: 2243314 - protein, 25 aa, Cryptosporidium parvum
GRQSSLWNALNFLSSFSNKEEKSRS

SEQ ID NO: 2243315 - protein, 21 aa, Cryptosporidium parvum
GRVFGISCLLIILVGLTQYVA

SEQ ID NO: 2243316 - protein, 17 aa, Cryptosporidium parvum
GSAFSVSSSIYNFVFIF

SEQ ID NO: 2243317 - protein, 28 aa, Cryptosporidium parvum
GSETFLLSPFSFIKNPHIWLKVISKYRI

SEQ ID NO: 2243318 - protein, 22 aa, Cryptosporidium parvum
GSEYFGFYPPQSEIFPIAKKYY

SEQ ID NO: 2243319 - protein, 25 aa, Cryptosporidium parvum
GSFFTSLIYISFPKEIIFAVQDDIS

SEQ ID NO: 2243320 - protein, 20 aa, Cryptosporidium parvum
GSFLTIVQLLLASVTGILIC

SEQ ID NO: 2243321 - protein, 24 aa, Cryptosporidium parvum
GSFLTTALLFKLPRGRYLLESGVE

SEQ ID NO: 2243322 - protein, 24 aa, Cryptosporidium parvum
GSGKTSLLFLIAKSLKHKGKISHP

SEQ ID NO: 2243323 - protein, 41 aa, Cryptosporidium parvum
GSHILLKAYKPRAYFGFNCIIDFYYYLSHSWRSSAFSKLVV

SEQ ID NO: 2243324 - protein, 25 aa, Cryptosporidium parvum
GSIASFRFALAFLTPITTYIIGYFI

SEQ ID NO: 2243325 - protein, 18 aa, Cryptosporidium parvum
GSIFYLLFKDCRGIVLSS

SEQ ID NO: 2243326 - protein, 23 aa, Cryptosporidium parvum
GSIIYPNFVLNKNKSWKILLKKP

SEQ ID NO: 2243327 - protein, 17 aa, Cryptosporidium parvum
GSIKYYVNGRFIGSIRK

SEQ ID NO: 2243328 - protein, 26 aa, Cryptosporidium parvum
GSKDKLIPFHIFLQTSIFMSTELEIQ

SEQ ID NO: 2243329 - protein, 21 aa, Cryptosporidium parvum
GSKYYITFFVDGSDLHVYFHS

SEQ ID NO: 2243330 - protein, 29 aa, Cryptosporidium parvum
GSLGKFTTKWLYFNGLKNIILLSRSSNNY

SEQ ID NO: 2243331 - protein, 25 aa, Cryptosporidium parvum
GSLNSYPWIWLKSILEICKDTKQVE

SEQ ID NO: 2243332 - protein, 26 aa, Cryptosporidium parvum
GSMICIYFTIYFSILLNIFGYENIGE

SEQ ID NO: 2243333 - protein, 31 aa, Cryptosporidium parvum
GSNGVIEIPYLYFWIYPLSIHLDIDTIKEMV

SEQ ID NO: 2243334 - protein, 21 aa, Cryptosporidium parvum
GSPIVHAYFNLAKRAIIVLTA

SEQ ID NO: 2243335 - protein, 25 aa, Cryptosporidium parvum
GSQDSLVPFFPPIPQIGNRNFDINE

SEQ ID NO: 2243336 - protein, 19 aa, Cryptosporidium parvum
GSRRIYLAFLFGGLIQRCL

SEQ ID NO: 2243337 - protein, 24 aa, Cryptosporidium parvum
GSSLIHNVFNWKLKILINFKRIFL

SEQ ID NO: 2243338 - protein, 33 aa, Cryptosporidium parvum
GSSNFVVPILVYITQILLSGTLYRVSSKLLPPE

SEQ ID NO: 2243339 - protein, 23 aa, Cryptosporidium parvum
GSSNYILIISFTLNIVISIFTMN

SEQ ID NO: 2243340 - protein, 24 aa, Cryptosporidium parvum
GSSSKFPFPYNGFSSMVLTGAKGS

SEQ ID NO: 2243341 - protein, 42 aa, Cryptosporidium parvum; identical to SEQ ID NO: 2130914

SEQ ID NO: 2243342 - protein, 33 aa, Cryptosporidium parvum
GSVTTLFMLGFLRYFRVLNPVPILTIILSWSSE

SEQ ID NO: 2243343 - protein, 17 aa, Cryptosporidium parvum
GSVWLHFSVQLLDGYDA

SEQ ID NO: 2243344 - protein, 40 aa, Cryptosporidium parvum
GTAIFNWRFVFNIPVPCHFPILRLQVWNRGLLVFGDAISE

SEQ ID NO: 2243345 - protein, 22 aa, Cryptosporidium parvum
GTCFSFYYIVMTRLLNSPWMIP

SEQ ID NO: 2243346 - protein, 28 aa, Cryptosporidium parvum
GTGIFNWRFVFDIKIPTQYPILKLQLWS

SEQ ID NO: 2243347 - protein, 29 aa, Cryptosporidium parvum
GTISAIKSLLFLSLVILNSFNYKKRSQDH

SEQ ID NO: 2243348 - protein, 25 aa, Cryptosporidium parvum
GTKNLVPIAYWRLSQGMTPSITVST

SEQ ID NO: 2243349 - protein, 27 aa, Cryptosporidium parvum
GTKYSFPIITGLLLYIGIYLPNGNESN

SEQ ID NO: 2243350 - protein, 21 aa, Cryptosporidium parvum
GTLSYFLYLKDYWSSKAYNFV

SEQ ID NO: 2243351 - protein, 28 aa, Cryptosporidium parvum
GTNKEQLDLFFSYGLRKSSSNYNMMADI

SEQ ID NO: 2243352 - protein, 23 aa, Cryptosporidium parvum
GTNTCYLYSLYMMIYIAIISSKG

SEQ ID NO: 2243353 - protein, 30 aa, Cryptosporidium parvum; identical to SEQ ID NO: 2130924

SEQ ID NO: 2243354 - protein, 25 aa, Cryptosporidium parvum
GTQIACIQLILIPLLEYEFNRNNEK

SEQ ID NO: 2243355 - protein, 22 aa, Cryptosporidium parvum
GTTFMALVSFFTSLWNRSSLTC

SEQ ID NO: 2243356 - protein, 17 aa, Cryptosporidium parvum
GTYMAHIPLMFTRKYIQ

SEQ ID NO: 2243357 - protein, 17 aa, Cryptosporidium parvum
GVAEHILPLLNPSLIRP

SEQ ID NO: 2243358 - protein, 18 aa, Cryptosporidium parvum
GVDKFFNILKNYYEIVIW

SEQ ID NO: 2243359 - protein, 21 aa, Cryptosporidium parvum
GVFLAGLFLNTLLGCASVSAS

SEQ ID NO: 2243360 - protein, 18 aa, Cryptosporidium parvum
GVFSFFDLAFDTFSGKDE

SEQ ID NO: 2243361 - protein, 25 aa, Cryptosporidium parvum
GVFSLPTFHFWILDNNSYILVDKLE

SEQ ID NO: 2243362 - protein, 35 aa, Cryptosporidium parvum; identical to SEQ ID NO: 2130930

SEQ ID NO: 2243363 - protein, 23 aa, Cryptosporidium parvum
GVFSSRDWVFYYNSHPMFKKMLY

SEQ ID NO: 2243364 - protein, 25 aa, Cryptosporidium parvum
GVFVYIMVNFFPYIYLRVDELDVIN

SEQ ID NO: 2243365 - protein, 26 aa, Cryptosporidium parvum
GVGILALICLLYFSLAHPLESKLIHR

SEQ ID NO: 2243366 - protein, 18 aa, Cryptosporidium parvum
GVGVVGSVLYIPISLMRA

SEQ ID NO: 2243367 - protein, 24 aa, Cryptosporidium parvum
GVILNYLLQGLFHPAKKVRSVYWR

SEQ ID NO: 2243368 - protein, 28 aa, Cryptosporidium parvum
GVKNPIAYSPLFIFYESDVSILPQTLYN

SEQ ID NO: 2243369 - protein, 26 aa, Cryptosporidium parvum
GVRIQYLRFVFSFFDISFIESSKFHD

SEQ ID NO: 2243370 - protein, 24 aa, Cryptosporidium parvum
GVSAGLISLLLYILSLIKERNENE

SEQ ID NO: 2243371 - protein, 24 aa, Cryptosporidium parvum
GVSDIKLHKWFYNYDFNSLISRKV

SEQ ID NO: 2243372 - protein, 28 aa, Cryptosporidium parvum
GVSFVPTVLVTPFLIMGAAVNYLFVIVN

SEQ ID NO: 2243373 - protein, 31 aa, Cryptosporidium parvum
GVSLFINSLLNLMFMELLIKLKLATNDNWVL

SEQ ID NO: 2243374 - protein, 21 aa, Cryptosporidium parvum
GVSNINEGFWKQIILSQSEKS

SEQ ID NO: 2243375 - protein, 17 aa, Cryptosporidium parvum
GVTTWKILALNIPTNKL

SEQ ID NO: 2243376 - protein, 36 aa, Cryptosporidium parvum
GVVALTLLIIYLLNKILFWFIVISIFAFCISVATRS

SEQ ID NO: 2243377 - protein, 24 aa, Cryptosporidium parvum
GVVFGFLISVWLRAAQALGGVQVI

SEQ ID NO: 2243378 - protein, 33 aa, Cryptosporidium parvum
GVVYSFRLSVLYTAITFLLFILRTTISDSENST

SEQ ID NO: 2243379 - protein, 23 aa, Cryptosporidium parvum
GWQPPPCYWSLMKHPAVVNSIQK

SEQ ID NO: 2243380 - protein, 22 aa, Cryptosporidium parvum
GWSYKFFIFLSIVQFKMFSFIW

SEQ ID NO: 2243381 - protein, 19 aa, Cryptosporidium parvum
GWVRDKILRFIYLNSAKNK

SEQ ID NO: 2243382 - protein, 21 aa, Cryptosporidium parvum
GYFCYGIISIYVWYNHFDTYK

SEQ ID NO: 2243383 - protein, 18 aa, Cryptosporidium parvum
GYIPTVVSFGLFSSIYFV

SEQ ID NO: 2243384 - protein, 30 aa, Cryptosporidium parvum
GYKSIKSFVLLAYFLNVFGVKDAMDVIISI

SEQ ID NO: 2243385 - protein, 29 aa, Cryptosporidium parvum
GYLEGMSIIYLYIYWHIQFRAKNERKTPE

SEQ ID NO: 2243386 - protein, 33 aa, Cryptosporidium parvum; identical to SEQ ID NO: 2130949

SEQ ID NO: 2243387 - protein, 30 aa, Cryptosporidium parvum; identical to SEQ ID NO: 2130950

SEQ ID NO: 2243388 - protein, 17 aa, Cryptosporidium parvum
GYPRNLPTLVLGLRGLI

SEQ ID NO: 2243389 - protein, 22 aa, Cryptosporidium parvum
GYSCSFLARRFGGFLGCEKLLK

SEQ ID NO: 2243390 - protein, 25 aa, Cryptosporidium parvum
GYVMFSFLQLLIFYMGGDQVILSVL

SEQ ID NO: 2243391 - protein, 22 aa, Cryptosporidium parvum
GYWGLYRGFIPMTLHSYFTRIL

SEQ ID NO: 2243392 - protein, 18 aa, Cryptosporidium parvum
GYYKFMLNLFLSSLLFDL

SEQ ID NO: 2243393 - protein, 19 aa, Cryptosporidium parvum
HAALFAQLLMEHISGFNTV

SEQ ID NO: 2243394 - protein, 26 aa, Cryptosporidium parvum
HACRLKIWLYCLRHFSASLLLKSRNK

SEQ ID NO: 2243395 - protein, 26 aa, Cryptosporidium parvum
HAGALNIPFWMTFTHKLDSINNRIPC

SEQ ID NO: 2243396 - protein, 17 aa, Cryptosporidium parvum
HAILTWINNLSLYLDGV

SEQ ID NO: 2243397 - protein, 32 aa, Cryptosporidium parvum; identical to SEQ ID NO: 2130958

SEQ ID NO: 2243398 - protein, 23 aa, Cryptosporidium parvum
HANKLLLNPISLVSIITTLHLAL

SEQ ID NO: 2243399 - protein, 29 aa, Cryptosporidium parvum
HAVLKNKLRTLYLWMDEFGDLAWRVMGRP

SEQ ID NO: 2243400 - protein, 30 aa, Cryptosporidium parvum
HCKYAKLLFQFLIFFIDNVCTLVLCGKRSQ

SEQ ID NO: 2243401 - protein, 32 aa, Cryptosporidium parvum; identical to SEQ ID NO: 2130962

SEQ ID NO: 2243402 - protein, 25 aa, Cryptosporidium parvum
HDEDLYLLDIFVYPCSDPAQRYGLI

SEQ ID NO: 2243403 - protein, 22 aa, Cryptosporidium parvum
HDIVIIMMIIIRLGVYSSIFYY

SEQ ID NO: 2243404 - protein, 37 aa, Cryptosporidium parvum
HDSELMVQIILILEALLQLHPIIFSLHSERIIAVFQI

SEQ ID NO: 2243405 - protein, 31 aa, Cryptosporidium parvum
HDSKYLLQCIDLIYFIFLNKCTEMIQEELSC

SEQ ID NO: 2243406 - protein, 20 aa, Cryptosporidium parvum
HDWDIYRYLTGPYKPHSYSN

SEQ ID NO: 2243407 - protein, 20 aa, Cryptosporidium parvum
HDYIALIHPINIGASYLNIR

SEQ ID NO: 2243408 - protein, 18 aa, Cryptosporidium parvum
HEFADLRPLFLWHGRHAY

SEQ ID NO: 2243409 - protein, 17 aa, Cryptosporidium parvum
HEGTILFLLCFNHNYWY

SEQ ID NO: 2243410 - protein, 32 aa, Cryptosporidium parvum
HEIFLNKIVYAPFWFFYINSVGKILSRFSSDM

SEQ ID NO: 2243411 - protein, 46 aa, Cryptosporidium parvum
HEIKTFGLIWPRELLCKYELIFRLVFHLKYINYLLNNIWILHQTSN

SEQ ID NO: 2243412 - protein, 32 aa, Cryptosporidium parvum
HELLLCKPNLPFGWINEWVFFLSVDSSLLLNT

SEQ ID NO: 2243413 - protein, 18 aa, Cryptosporidium parvum
HENMIKGFKMVKYRGKYG

SEQ ID NO: 2243414 - protein, 17 aa, Cryptosporidium parvum
HEQILNSLLLNLTTKRS

SEQ ID NO: 2243415 - protein, 19 aa, Cryptosporidium parvum
HEYLVVVPLDIGWTGWVVL

SEQ ID NO: 2243416 - protein, 17 aa, Cryptosporidium parvum
HFIIFRKEIGIKLIIID

SEQ ID NO: 2243417 - protein, 20 aa, Cryptosporidium parvum
HFITTRFKFRKNMGIAVIEE

SEQ ID NO: 2243418 - protein, 17 aa, Cryptosporidium parvum
HFIVWMKLSAFSTFNKI

SEQ ID NO: 2243419 - protein, 24 aa, Cryptosporidium parvum
HFKRFRWILNDFSLPSVIFCGETW

SEQ ID NO: 2243420 - protein, 40 aa, Cryptosporidium parvum
HFNCSWIIPQWFLIYLRLSVFLYLLIMLGLDVSNYYKLGY

SEQ ID NO: 2243421 - protein, 21 aa, Cryptosporidium parvum
HFRAIILHQKVLLIASGYSRS

SEQ ID NO: 2243422 - protein, 27 aa, Cryptosporidium parvum
HFSKFHLNICNLPRPAFSRPVLRRNQQ

SEQ ID NO: 2243423 - protein, 27 aa, Cryptosporidium parvum
HFSKTLLLFFLPQILNFIISIPQLFGI

SEQ ID NO: 2243424 - protein, 21 aa, Cryptosporidium parvum
HFVSLLRVKPLINVSGWTLSL

SEQ ID NO: 2243425 - protein, 17 aa, Cryptosporidium parvum
HFYKGYIPTVVSFGLFS

SEQ ID NO: 2243426 - protein, 37 aa, Cryptosporidium parvum
HFYSKYIYYFEYIGRIYFLIFLLVCILKIGVTKSMDI

SEQ ID NO: 2243427 - protein, 26 aa, Cryptosporidium parvum
HGLLNIILLFLTISVLFSIPISLLGS

SEQ ID NO: 2243428 - protein, 22 aa, Cryptosporidium parvum
HGYRRHIIDILYLNLDDYQVTF

SEQ ID NO: 2243429 - protein, 35 aa, Cryptosporidium parvum; identical to SEQ ID NO: 2130982

SEQ ID NO: 2243430 - protein, 27 aa, Cryptosporidium parvum
HHFHPALPIHLFPKRIIQLLNHIILSN

SEQ ID NO: 2243431 - protein, 25 aa, Cryptosporidium parvum
HHLIKIWLVYFFTVVFYELILSFIL

SEQ ID NO: 2243432 - protein, 23 aa, Cryptosporidium parvum
HHLKLCWVFIFCLSLFGMLDIIT

SEQ ID NO: 2243433 - protein, 33 aa, Cryptosporidium parvum
HHLMNIYNFIIKKYINWFLIPAADIFGLGNSIK

SEQ ID NO: 2243434 - protein, 28 aa, Cryptosporidium parvum
HHLSDLFVYFGISRFTLYYIKHNITLIF

SEQ ID NO: 2243435 - protein, 18 aa, Cryptosporidium parvum
HHSILDVALLSDSIIFIT

SEQ ID NO: 2243436 - protein, 19 aa, Cryptosporidium parvum
HIAFLPLEIYFPKNGNIRD

SEQ ID NO: 2243437 - protein, 24 aa, Cryptosporidium parvum
HIELLPYVRILYNKELLFQSCIVK

SEQ ID NO: 2243438 - protein, 18 aa, Cryptosporidium parvum
HIGLFLYEYLGEEYPEVL

SEQ ID NO: 2243439 - protein, 24 aa, Cryptosporidium parvum
HIKHYGMLLGSFILRKNDPEKQFE

SEQ ID NO: 2243440 - protein, 24 aa, Cryptosporidium parvum
HIKYNYLFDFIIQILGNINFSNLE

SEQ ID NO: 2243441 - protein, 24 aa, Cryptosporidium parvum
HILEWDLMQLTKKLLIFSLTVIKG

SEQ ID NO: 2243442 - protein, 18 aa, Cryptosporidium parvum
HILNLLRYYFKQVNPEKD

SEQ ID NO: 2243443 - protein, 20 aa, Cryptosporidium parvum
HILTIEFWQWVPDVYDILPI

SEQ ID NO: 2243444 - protein, 27 aa, Cryptosporidium parvum
HIMKLGDITLFLLRLIRFRSEEFSLYH

SEQ ID NO: 2243445 - protein, 25 aa, Cryptosporidium parvum
HINHKYLFSLSQLRLISLLRVYLNS

SEQ ID NO: 2243446 - protein, 18 aa, Cryptosporidium parvum
HINMFWVSRFPIMGKYTC

SEQ ID NO: 2243447 - protein, 25 aa, Cryptosporidium parvum
HINTMLINFLFDAIINMLNPWISLF

SEQ ID NO: 2243448 - protein, 19 aa, Cryptosporidium parvum
HIPIEYRPLYRDCTSNVNY

SEQ ID NO: 2243449 - protein, 24 aa, Cryptosporidium parvum
HIPPIWAQTYFQKLSDALFFISKD

SEQ ID NO: 2243450 - protein, 17 aa, Cryptosporidium parvum
HIQLYPRSSKRLKLIAV

SEQ ID NO: 2243451 - protein, 23 aa, Cryptosporidium parvum
HISPRDLWYYEKSLVGKILYNGI

SEQ ID NO: 2243452 - protein, 24 aa, Cryptosporidium parvum
HITETGLIPSLLTILSCEYSIHSQ

SEQ ID NO: 2243453 - protein, 28 aa, Cryptosporidium parvum
HITLSFNPPICILYAKLYWKENKSPVST

SEQ ID NO: 2243454 - protein, 18 aa, Cryptosporidium parvum
HIVYPYWSHSLAFSNYHK

SEQ ID NO: 2243455 - protein, 30 aa, Cryptosporidium parvum
HKCLNDQLLPYPTGFFPLNHSTLIPPVKQL

SEQ ID NO: 2243456 - protein, 32 aa, Cryptosporidium parvum
HKLEKLIFSILKIHIIYILELSILLSEMSEIK

SEQ ID NO: 2243457 - protein, 19 aa, Cryptosporidium parvum
HKNLRPIYIYFNSFKDRIN

SEQ ID NO: 2243458 - protein, 26 aa, Cryptosporidium parvum
HKRICPPGLILKKNHCLRFAQAKFRC

SEQ ID NO: 2243459 - protein, 25 aa, Cryptosporidium parvum
HKVPEYRVLLIIPDEFYLTIAEVEF

SEQ ID NO: 2243460 - protein, 23 aa, Cryptosporidium parvum
HKWIEILIVYMTLISKGINPLAY

SEQ ID NO: 2243461 - protein, 33 aa, Cryptosporidium parvum
HKYFLLLHIDTFPFRIFPDYLSGIRKPVIEALN

SEQ ID NO: 2243462 - protein, 18 aa, Cryptosporidium parvum
HLATLAIYYLLKDDLRLS

SEQ ID NO: 2243463 - protein, 17 aa, Cryptosporidium parvum
HLCTELVGPLIGGKLLS

SEQ ID NO: 2243464 - protein, 19 aa, Cryptosporidium parvum
HLDAYYDPFKSITKREVPC

SEQ ID NO: 2243465 - protein, 36 aa, Cryptosporidium parvum
HLDNELGWYWYHLGIYNLILIKIIYLNLSVQNEESK

SEQ ID NO: 2243466 - protein, 26 aa, Cryptosporidium parvum
HLGILNYLLFDEFGFTLLTVFASYSI

SEQ ID NO: 2243467 - protein, 19 aa, Cryptosporidium parvum
HLIIELFMSSFPYGIVEFL

SEQ ID NO: 2243468 - protein, 24 aa, Cryptosporidium parvum
HLIISQLLVIYFLTSHLFSLSIML

SEQ ID NO: 2243469 - protein, 33 aa, Cryptosporidium parvum; identical to SEQ ID NO: 2131006

SEQ ID NO: 2243470 - protein, 18 aa, Cryptosporidium parvum
HLNILFSLVTLQSKYYQS

SEQ ID NO: 2243471 - protein, 20 aa, Cryptosporidium parvum
HLQMRLSTLCYLPIHTRSSN

SEQ ID NO: 2243472 - protein, 31 aa, Cryptosporidium parvum; identical to SEQ ID NO: 2190743

SEQ ID NO: 2243473 - protein, 34 aa, Cryptosporidium parvum
HLRYFDAVTQLHTAWGYPLPSSPLKKSDFFTGSN

SEQ ID NO: 2243474 - protein, 18 aa, Cryptosporidium parvum
HLWDLRKSAILDSLELST

SEQ ID NO: 2243475 - protein, 25 aa, Cryptosporidium parvum
HLYNYIHILIVKFVGFFTLRLLGVL

SEQ ID NO: 2243476 - protein, 17 aa, Cryptosporidium parvum
HLYTSEVFMLMACKEIS

SEQ ID NO: 2243477 - protein, 20 aa, Cryptosporidium parvum
HMDPAPPILFKEMKSPIVGV

SEQ ID NO: 2243478 - protein, 18 aa, Cryptosporidium parvum
HMGMAPFFTGMLMSYSLQ

SEQ ID NO: 2243479 - protein, 18 aa, Cryptosporidium parvum
HMPSWAGLTHLLEGLLGL

SEQ ID NO: 2243480 - protein, 17 aa, Cryptosporidium parvum
HMQFLGLLITTNVVRFE

SEQ ID NO: 2243481 - protein, 17 aa, Cryptosporidium parvum
HMRIKLQQKIRDLVYTK

SEQ ID NO: 2243482 - protein, 36 aa, Cryptosporidium parvum; identical to SEQ ID NO: 2131012

SEQ ID NO: 2243483 - protein, 24 aa, Cryptosporidium parvum
HNEYQWCRRIIFLETVAGVPGMVG

SEQ ID NO: 2243484 - protein, 25 aa, Cryptosporidium parvum
HNFQFYYINLVLKSLHKLGESWWKL

SEQ ID NO: 2243485 - protein, 20 aa, Cryptosporidium parvum
HNRILFEMIISPLTFFDSQD

SEQ ID NO: 2243486 - protein, 18 aa, Cryptosporidium parvum
HNSNIFLGNRYGSGVGSS

SEQ ID NO: 2243487 - protein, 38 aa, Cryptosporidium parvum
HNVYKIIEFYIFRTSIKYYRFLLKDWLILTNQILLSQT

SEQ ID NO: 2243488 - protein, 27 aa, Cryptosporidium parvum
HPLSLVFINVLFNEKIWMTLTPHNIHN

SEQ ID NO: 2243489 - protein, 24 aa, Cryptosporidium parvum
HPNHFSLVFKSRYPNYVKDEVAKT

SEQ ID NO: 2243490 - protein, 17 aa, Cryptosporidium parvum
HPQIFSTASFDSSCKLW

SEQ ID NO: 2243491 - protein, 25 aa, Cryptosporidium parvum
HPVNYPLSVVLADKLPFIKNSNISE

SEQ ID NO: 2243492 - protein, 23 aa, Cryptosporidium parvum
HQGPKNWFFVDLINFQEITDFGI

SEQ ID NO: 2243493 - protein, 37 aa, Cryptosporidium parvum; identical to SEQ ID NO: 2131016

SEQ ID NO: 2243494 - protein, 17 aa, Cryptosporidium parvum
HQLLSQRIVYYFTNNRI

SEQ ID NO: 2243495 - protein, 19 aa, Cryptosporidium parvum
HQSLPCWMTLRSNTRESSS

SEQ ID NO: 2243496 - protein, 25 aa, Cryptosporidium parvum
HQVFDLLVLSLLPYNYTYNLEYGNA

SEQ ID NO: 2243497 - protein, 18 aa, Cryptosporidium parvum
HQWKDPHLLAFSKSRFNG

SEQ ID NO: 2243498 - protein, 31 aa, Cryptosporidium parvum
HQYLNIKIPIEIWWKIFDFLDNNSLSQVSIL

SEQ ID NO: 2243499 - protein, 27 aa, Cryptosporidium parvum
HRAIPLSLYRWYLSKVGIVFFISVCLL

SEQ ID NO: 2243500 - protein, 29 aa, Cryptosporidium parvum
HRFKRFPETLFIYFTPPKNAKKGELFDVP

SEQ ID NO: 2243501 - protein, 27 aa, Cryptosporidium parvum
HRLILVFKRLIRQLILYWKSIINYFMP

SEQ ID NO: 2243502 - protein, 31 aa, Cryptosporidium parvum; identical to SEQ ID NO: 2131019

SEQ ID NO: 2243503 - protein, 28 aa, Cryptosporidium parvum
HRVREHKSWYRFWEKKPKYVHKNINGSE

SEQ ID NO: 2243504 - protein, 28 aa, Cryptosporidium parvum
HRYCTTLKMLFLKYLVDNIIKLLFDCLT

SEQ ID NO: 2243505 - protein, 17 aa, Cryptosporidium parvum
HSELVKFLLFESSQRDL

SEQ ID NO: 2243506 - protein, 17 aa, Cryptosporidium parvum
HSFWMERKPKNILEFPI

SEQ ID NO: 2243507 - protein, 23 aa, Cryptosporidium parvum
HSGEGHWLFENPIRYLTSSEDIF

SEQ ID NO: 2243508 - protein, 22 aa, Cryptosporidium parvum
HSGTFMPVPGKPQGENGGIMTP

SEQ ID NO: 2243509 - protein, 31 aa, Cryptosporidium parvum
HSGTISWVIGLILGLLLGLVVGFSPIARSLK

SEQ ID NO: 2243510 - protein, 19 aa, Cryptosporidium parvum
HSIKIKVVKLMPIWSIRNK

SEQ ID NO: 2243511 - protein, 27 aa, Cryptosporidium parvum
HSISLVGLFCVIFVRRSFHHFVKSVES

SEQ ID NO: 2243512 - protein, 23 aa, Cryptosporidium parvum
HSKDLSILRFVFSYHKFFNPQNE

SEQ ID NO: 2243513 - protein, 17 aa, Cryptosporidium parvum
HSKIYTFFTVISGLIIP

SEQ ID NO: 2243514 - protein, 18 aa, Cryptosporidium parvum
HSLNFTMMWLQYCGLSPL

SEQ ID NO: 2243515 - protein, 26 aa, Cryptosporidium parvum
HSMGTRLFIQSFPKLLSENLLERCEQ

SEQ ID NO: 2243516 - protein, 24 aa, Cryptosporidium parvum
HSQDQYLRRLISSYDLVLEELKAK

SEQ ID NO: 2243517 - protein, 24 aa, Cryptosporidium parvum
HSSLLIISVLISKGKILKSKGITF

SEQ ID NO: 2243518 - protein, 25 aa, Cryptosporidium parvum
HSSVQFWLILYLTLIIFQIKDIINK

SEQ ID NO: 2243519 - protein, 17 aa, Cryptosporidium parvum
HSTLIPPVKQLVIRFNE

SEQ ID NO: 2243520 - protein, 19 aa, Cryptosporidium parvum
HSVSPFPLDLTLYSEYKST

SEQ ID NO: 2243521 - protein, 21 aa, Cryptosporidium parvum
HSYSFLEIITSKLPVLQDSKN

SEQ ID NO: 2243522 - protein, 27 aa, Cryptosporidium parvum
HTEKSSLLFIRPLRNLTSKEVMLYWKF

SEQ ID NO: 2243523 - protein, 37 aa, Cryptosporidium parvum
HTLNIFQFMYIFTPAICIFFVLLKLSLRNFNYPSFGN

SEQ ID NO: 2243524 - protein, 34 aa, Cryptosporidium parvum
HTWKKLYLRSPSDAMWYLFKQIIPIRGDLTVFGL

SEQ ID NO: 2243525 - protein, 28 aa, Cryptosporidium parvum
HVEQKKLLIRFIPFHLFSITGMTLDVFN

SEQ ID NO: 2243526 - protein, 35 aa, Cryptosporidium parvum; identical to SEQ ID NO: 2131034

SEQ ID NO: 2243527 - protein, 26 aa, Cryptosporidium parvum
HVVTFFFMLFLIFILIGLLSSFVAEN

SEQ ID NO: 2243528 - protein, 27 aa, Cryptosporidium parvum
HWEQFPRYINPWFYNTRVLLARSKVIK

SEQ ID NO: 2243529 - protein, 29 aa, Cryptosporidium parvum
HYENPFIVYLHVLYLKFSLGNFSGPISCT

SEQ ID NO: 2243530 - protein, 32 aa, Cryptosporidium parvum
HYFDFTWALLTFSFLSFLFSIFLYKSCIEHAL

SEQ ID NO: 2243531 - protein, 18 aa, Cryptosporidium parvum
HYFPLSETFLYNYLESFP

SEQ ID NO: 2243532 - protein, 25 aa, Cryptosporidium parvum
HYLMNFWTFFIPLVLGKGIIKVFFQ

SEQ ID NO: 2243533 - protein, 24 aa, Cryptosporidium parvum
HYRIWMHGAWLPSFKMVWGQIPHG

SEQ ID NO: 2243534 - protein, 17 aa, Cryptosporidium parvum
HYWFIFGASVGYYTFHP

SEQ ID NO: 2243535 - protein, 17 aa, Cryptosporidium parvum
HYYEAEGRLLMFKVKQL

SEQ ID NO: 2243536 - protein, 22 aa, Cryptosporidium parvum
IAAHGLFYKGYNLIILCVEIGM

SEQ ID NO: 2243537 - protein, 32 aa, Cryptosporidium parvum; identical to SEQ ID NO: 2131043

SEQ ID NO: 2243538 - protein, 25 aa, Cryptosporidium parvum
IAAVVHFFSIILGVPILYGQYVSKV

SEQ ID NO: 2243539 - protein, 22 aa, Cryptosporidium parvum
IACIFVYILNILGLVIINPKPE

SEQ ID NO: 2243540 - protein, 17 aa, Cryptosporidium parvum
IADQILILIMKNKKNKL

SEQ ID NO: 2243541 - protein, 17 aa, Cryptosporidium parvum
IAEFLIYYRFREVIRDK

SEQ ID NO: 2243542 - protein, 24 aa, Cryptosporidium parvum
IAENMILSIFRRGGFYFSTNPNVD

SEQ ID NO: 2243543 - protein, 21 aa, Cryptosporidium parvum
IAFALLYPLMKLFSKTSFSGA

SEQ ID NO: 2243544 - protein, 26 aa, Cryptosporidium parvum
IAFCNYLILINLFGWNTLKTVFQVYD

SEQ ID NO: 2243545 - protein, 19 aa, Cryptosporidium parvum
IAFFLILAIVLFVVISRTT

SEQ ID NO: 2243546 - protein, 26 aa, Cryptosporidium parvum
IAFLIVAGLTVFCCLIFFGDLADSYL

SEQ ID NO: 2243547 - protein, 29 aa, Cryptosporidium parvum
IAFMQCVFSALFYFIPVALFQGWLAVGYA

SEQ ID NO: 2243548 - protein, 27 aa, Cryptosporidium parvum
IAGLIKLILVLNYKVAVPIPNLRKVNP

SEQ ID NO: 2243549 - protein, 32 aa, Cryptosporidium parvum; identical to SEQ ID NO: 2131047

SEQ ID NO: 2243550 - protein, 24 aa, Cryptosporidium parvum
IAKKRLMFFSPFISAVPSIMGNVL

SEQ ID NO: 2243551 - protein, 32 aa, Cryptosporidium parvum; identical to SEQ ID NO: 2131051

SEQ ID NO: 2243552 - protein, 25 aa, Cryptosporidium parvum
IALDLIKRHHLLLVTLLLANSICME

SEQ ID NO: 2243553 - protein, 33 aa, Cryptosporidium parvum
IALFGHFISIYWLNYKNPVFNFTFYSKKITPYL

SEQ ID NO: 2243554 - protein, 20 aa, Cryptosporidium parvum
IALKNLLHRPLKYALKNAIE

SEQ ID NO: 2243555 - protein, 27 aa, Cryptosporidium parvum
IALNWNSWYFFPEQIIDLSLVKIQDFL

SEQ ID NO: 2243556 - protein, 41 aa, Cryptosporidium parvum
IALVLLSFTIFSLTWILYLGFYWYWIPPKSISFPINFDFQN

SEQ ID NO: 2243557 - protein, 35 aa, Cryptosporidium parvum
IANWLCSSFVYFLDLNYIWVLRLGFDPFRSKCKLG

SEQ ID NO: 2243558 - protein, 22 aa, Cryptosporidium parvum
IAPILIMELPTLSSLGLQILKV

SEQ ID NO: 2243559 - protein, 19 aa, Cryptosporidium parvum
IARVLIGHLILFPQKMVVN

SEQ ID NO: 2243560 - protein, 23 aa, Cryptosporidium parvum
IARYLKCVIMFKSIKEYSGNNNI

SEQ ID NO: 2243561 - protein, 32 aa, Cryptosporidium parvum; identical to SEQ ID NO: 2131059

SEQ ID NO: 2243562 - protein, 29 aa, Cryptosporidium parvum
IASLEPLLYSKYYYTILLDRFMKSNLDIK

SEQ ID NO: 2243563 - protein, 19 aa, Cryptosporidium parvum
IASNRLSYFYGIKGPSITI

SEQ ID NO: 2243564 - protein, 28 aa, Cryptosporidium parvum
IATLFPVYWTFLLGLVLLVFGGISVIAN

SEQ ID NO: 2243565 - protein, 25 aa, Cryptosporidium parvum
IATSPSSFKIFFSPIPEPITIFEDT

SEQ ID NO: 2243566 - protein, 26 aa, Cryptosporidium parvum
IAVDVYLPRIRFGYKTLPTVVDITRY

SEQ ID NO: 2243567 - protein, 25 aa, Cryptosporidium parvum
IAVLLRAMFYNYKFGKDIYLCSIIY

SEQ ID NO: 2243568 - protein, 19 aa, Cryptosporidium parvum
ICDQPFDYHLWNLVINICQ

SEQ ID NO: 2243569 - protein, 20 aa, Cryptosporidium parvum
ICEITTDIISYIWKNQYFNT

SEQ ID NO: 2243570 - protein, 18 aa, Cryptosporidium parvum
ICEITYLGYLLYYENIEK

SEQ ID NO: 2243571 - protein, 19 aa, Cryptosporidium parvum
ICERVDTRLFFNLELGICE

SEQ ID NO: 2243572 - protein, 24 aa, Cryptosporidium parvum
ICFLWLTILVELFWFNKESRKNVD

SEQ ID NO: 2243573 - protein, 18 aa, Cryptosporidium parvum
ICHDLLRVIINIYNRINN

SEQ ID NO: 2243574 - protein, 19 aa, Cryptosporidium parvum
ICIFMFLIVSCLGINIFTN

SEQ ID NO: 2243575 - protein, 27 aa, Cryptosporidium parvum
ICIFPILYYTFYFYYFWVFDSIKNSNR

SEQ ID NO: 2243576 - protein, 22 aa, Cryptosporidium parvum
ICITSIIYFILPSSLKKVAGNE

SEQ ID NO: 2243577 - protein, 29 aa, Cryptosporidium parvum
ICKKSLFCGIWLLFHSWSISLLKGVQQQG

SEQ ID NO: 2243578 - protein, 26 aa, Cryptosporidium parvum
ICKSLGWEAFFMFTVPVSANKFRPLG

SEQ ID NO: 2243579 - protein, 19 aa, Cryptosporidium parvum
ICKWIIIIAHFFCLNRNGA

SEQ ID NO: 2243580 - protein, 18 aa, Cryptosporidium parvum
ICLILTTDDYFKSLSKSF

SEQ ID NO: 2243581 - protein, 36 aa, Cryptosporidium parvum
ICLKLGWRSVFYIPSIFVFLFGIIVLKYLKKPKNLY

SEQ ID NO: 2243582 - protein, 23 aa, Cryptosporidium parvum
ICLTLAGSVWYGFAKSLNCNSGG

SEQ ID NO: 2243583 - protein, 33 aa, Cryptosporidium parvum
ICMKSVKKIFLSWTGFIFVLREIIEKAIFSIKN

SEQ ID NO: 2243584 - protein, 19 aa, Cryptosporidium parvum
ICNLIQIHYFPLSETFLYN

SEQ ID NO: 2243585 - protein, 26 aa, Cryptosporidium parvum
ICNTKNWYKFNLWRYIEYEEYIRKNS

SEQ ID NO: 2243586 - protein, 24 aa, Cryptosporidium parvum
ICSAEGQCIWTLAKRLKELSAMFW

SEQ ID NO: 2243587 - protein, 25 aa, Cryptosporidium parvum
ICSGGLLIIGLCPWGWEYISGGKVN

SEQ ID NO: 2243588 - protein, 29 aa, Cryptosporidium parvum
ICSLITYLLFIILFLVLNPSRIPLYIMGD

SEQ ID NO: 2243589 - protein, 19 aa, Cryptosporidium parvum
ICSYFISLLGIHLSKRKAT

SEQ ID NO: 2243590 - protein, 25 aa, Cryptosporidium parvum
ICVLSSLGTIPIIRCSNKQFSPSQM

SEQ ID NO: 2243591 - protein, 31 aa, Cryptosporidium parvum; identical to SEQ ID NO: 2131081

SEQ ID NO: 2243592 - protein, 25 aa, Cryptosporidium parvum
IDATFIWDNYWTIGYVCLFISIIKF

SEQ ID NO: 2243593 - protein, 23 aa, Cryptosporidium parvum
IDDEFNLCKYSKSTRFLLVMGEL

SEQ ID NO: 2243594 - protein, 19 aa, Cryptosporidium parvum
IDFDPLNPLKFYKTCYRTY

SEQ ID NO: 2243595 - protein, 17 aa, Cryptosporidium parvum
IDFTRLLISKAVMFSSL

SEQ ID NO: 2243596 - protein, 22 aa, Cryptosporidium parvum
IDGGIELKFFYLDDLKNSISPE

SEQ ID NO: 2243597 - protein, 18 aa, Cryptosporidium parvum
IDIALRYALKGATKFNCG

SEQ ID NO: 2243598 - protein, 22 aa, Cryptosporidium parvum
IDIKLLQDLLWSGVPRGSPPEL

SEQ ID NO: 2243599 - protein, 28 aa, Cryptosporidium parvum
IDISYQFLFLIYRKILISKTKYLVISHL

SEQ ID NO: 2243600 - protein, 18 aa, Cryptosporidium parvum
IDIYILVKEGLLASKYHF

SEQ ID NO: 2243601 - protein, 25 aa, Cryptosporidium parvum
IDKPSNFIFILQGDIVFVYDKDSHL

SEQ ID NO: 2243602 - protein, 30 aa, Cryptosporidium parvum
IDLLLYATFCFGFMMVILFFNSSGSVKHSI

SEQ ID NO: 2243603 - protein, 33 aa, Cryptosporidium parvum
IDLYTTMSILGYSLLPIVILAGISVVFSLRSKV

SEQ ID NO: 2243604 - protein, 20 aa, Cryptosporidium parvum
IDNGGTILLLIFSGNSENYI

SEQ ID NO: 2243605 - protein, 24 aa, Cryptosporidium parvum
IDNLHHDFLYPILTNSLHQPHRFQ

SEQ ID NO: 2243606 - protein, 28 aa, Cryptosporidium parvum
IDNNDYFKLFLYYIVISNLVHSINSIID

SEQ ID NO: 2243607 - protein, 18 aa, Cryptosporidium parvum
IDNPLFFMKNVEMIFGNA

SEQ ID NO: 2243608 - protein, 25 aa, Cryptosporidium parvum
IDPSTLTIFLKSVIILIYKVISIQK

SEQ ID NO: 2243609 - protein, 23 aa, Cryptosporidium parvum
IDPYVFIPLHTFHAVSTPLLVNI

SEQ ID NO: 2243610 - protein, 24 aa, Cryptosporidium parvum
IDQFFWIIIAIFFIHEMLLFLVQK

SEQ ID NO: 2243611 - protein, 24 aa, Cryptosporidium parvum
IDQVFIWQSPFISLPIIITAMVKL

SEQ ID NO: 2243612 - protein, 24 aa, Cryptosporidium parvum
IDQVSIFFFTPVLLIKKITGSHKV

SEQ ID NO: 2243613 - protein, 33 aa, Cryptosporidium parvum
IDQYISIFSSPLFLCLSILLALVVLIDFIIRKN

SEQ ID NO: 2243614 - protein, 19 aa, Cryptosporidium parvum
IDRFWEFQIFGYNILKITG

SEQ ID NO: 2243615 - protein, 62 aa, Cryptosporidium parvum; identical to SEQ ID NO: 2131087

SEQ ID NO: 2243616 - protein, 18 aa, Cryptosporidium parvum
IDRSYKLIKPLNSFLDPK

SEQ ID NO: 2243617 - protein, 26 aa, Cryptosporidium parvum
IDSFSKYFLVIIYLIIHCTIHMIRGL

SEQ ID NO: 2243618 - protein, 23 aa, Cryptosporidium parvum
IDSLIPFLVPILDNNPINKSFIN

SEQ ID NO: 2243619 - protein, 24 aa, Cryptosporidium parvum
IDSSIRLKFWEYLFEELIPVIQSL

SEQ ID NO: 2243620 - protein, 18 aa, Cryptosporidium parvum
IDSVRRLLPKKLMTGLWP

SEQ ID NO: 2243621 - protein, 30 aa, Cryptosporidium parvum
IDVADPLMRFHCFIFGAIYLESAHAILQIA

SEQ ID NO: 2243622 - protein, 26 aa, Cryptosporidium parvum
IDVIINYIPIIIPRYYSICNTKNWYK

SEQ ID NO: 2243623 - protein, 20 aa, Cryptosporidium parvum
IDVIWRKIFTQEFVKITLDD

SEQ ID NO: 2243624 - protein, 19 aa, Cryptosporidium parvum
IDWSLYLLNERSCNSAYIG

SEQ ID NO: 2243625 - protein, 29 aa, Cryptosporidium parvum
IECEIYSFMIVFYLLMFNINHFNFKSYYK

SEQ ID NO: 2243626 - protein, 22 aa, Cryptosporidium parvum
IECLIILELTPSGILIACWNAP

SEQ ID NO: 2243627 - protein, 37 aa, Cryptosporidium parvum
IEDAWEIYYLITFIQLSFREIFIIFSQNNKNIEYKYL

SEQ ID NO: 2243628 - protein, 20 aa, Cryptosporidium parvum
IEDFVLPFKFSIIDNRYPAI

SEQ ID NO: 2243629 - protein, 24 aa, Cryptosporidium parvum
IEDLPIFPPLVLPELYKYVTEKKG

SEQ ID NO: 2243630 - protein, 23 aa, Cryptosporidium parvum
IEDRNIILCLILGAAFHVYSCLF

SEQ ID NO: 2243631 - protein, 25 aa, Cryptosporidium parvum
IEDTIQCIDGIWTTPRLECRKSCTN

SEQ ID NO: 2243632 - protein, 20 aa, Cryptosporidium parvum
IEFGILLIITVINIIGLITL

SEQ ID NO: 2243633 - protein, 25 aa, Cryptosporidium parvum
IEFKVYIYSAYYDWRIDRIRINSLI

SEQ ID NO: 2243634 - protein, 18 aa, Cryptosporidium parvum
IEFNKYKVLIVIFSALLA

SEQ ID NO: 2243635 - protein, 20 aa, Cryptosporidium parvum
IEFPIFVSWFQQLVGLAIFQ

SEQ ID NO: 2243636 - protein, 19 aa, Cryptosporidium parvum
IEFQISYSVPFLITNEYYG

SEQ ID NO: 2243637 - protein, 27 aa, Cryptosporidium parvum
IEFVADRLLFALDIPKIYNVSNPFDWM

SEQ ID NO: 2243638 - protein, 17 aa, Cryptosporidium parvum
IEIFFGVFVDLLSLPIK

SEQ ID NO: 2243639 - protein, 25 aa, Cryptosporidium parvum
IEIFKKIIIFLKDLIINIFNEKIVG

SEQ ID NO: 2243640 - protein, 25 aa, Cryptosporidium parvum
IEIGPTSLLTPLLKASSKGILNNAK

SEQ ID NO: 2243641 - protein, 33 aa, Cryptosporidium parvum
IEISFSNLLFLFRNCLILIFLNDQNKIHNINKN

SEQ ID NO: 2243642 - protein, 34 aa, Cryptosporidium parvum
IEITKFFNSRLITIYILFFNIYLNKFPEKNPLYN

SEQ ID NO: 2243643 - protein, 52 aa, Cryptosporidium parvum
IEITMTHIFSIKTLIACIVIVSTIFIIIIGIWLAWIFRYKRQTEIYDMDHLE

SEQ ID NO: 2243644 - protein, 24 aa, Cryptosporidium parvum
IEKESIFLNPVNILGLLGPECIEI

SEQ ID NO: 2243645 - protein, 33 aa, Cryptosporidium parvum
IEKFIDLKVIYYQYLIILWHYEQSPKEISMCFL

SEQ ID NO: 2243646 - protein, 17 aa, Cryptosporidium parvum
IEKFWLDCELETSVELS

SEQ ID NO: 2243647 - protein, 23 aa, Cryptosporidium parvum
IEKGLLMLPIITARTMFELLETV

SEQ ID NO: 2243648 - protein, 26 aa, Cryptosporidium parvum
IEKIKDIFSVGYFDALIVGNIGYEKS

SEQ ID NO: 2243649 - protein, 21 aa, Cryptosporidium parvum
IEKLIFNCLSFIDGFYNFGAS

SEQ ID NO: 2243650 - protein, 23 aa, Cryptosporidium parvum
IELIIHEVFLIQNIIPDIINLIS

SEQ ID NO: 2243651 - protein, 25 aa, Cryptosporidium parvum
IELITLMLIPELMSGLFVIILMACI

SEQ ID NO: 2243652 - protein, 26 aa, Cryptosporidium parvum
IELPPAPLNSMLLLKAASGMPYSTSS

SEQ ID NO: 2243653 - protein, 28 aa, Cryptosporidium parvum
IELTFWCVFFLMLNVIISIALRTVIFKF

SEQ ID NO: 2243654 - protein, 30 aa, Cryptosporidium parvum
IEMDSYMHIYVYLLLRLIQSICIPNGIVSS

SEQ ID NO: 2243655 - protein, 18 aa, Cryptosporidium parvum
IEMFLRQLIPNINSERLI

SEQ ID NO: 2243656 - protein, 34 aa, Cryptosporidium parvum
IEMNQLWITLIPEIICELVYIFHTIKSNFKNLNK

SEQ ID NO: 2243657 - protein, 20 aa, Cryptosporidium parvum
IENCLFVYDFITIYDSLMMF

SEQ ID NO: 2243658 - protein, 24 aa, Cryptosporidium parvum
IENGEFNFPMKVNFFSALEVFQVS

SEQ ID NO: 2243659 - protein, 18 aa, Cryptosporidium parvum
IENIILLYLLSLNNFYNL

SEQ ID NO: 2243660 - protein, 26 aa, Cryptosporidium parvum
IENKPLPPIWIPLKQTRDGWIDMIDN

SEQ ID NO: 2243661 - protein, 32 aa, Cryptosporidium parvum
IENMILKQIIMQMIILFKNLVSVLIAKDRKRS

SEQ ID NO: 2243662 - protein, 23 aa, Cryptosporidium parvum
IENRKIWSKLWNIMIIDHKNKRG

SEQ ID NO: 2243663 - protein, 29 aa, Cryptosporidium parvum
IEQEYIKHKIKLFELYNTTYTILDHLEND

SEQ ID NO: 2243664 - protein, 17 aa, Cryptosporidium parvum
IEQLIRMHLRTDCLGFL

SEQ ID NO: 2243665 - protein, 17 aa, Cryptosporidium parvum
IERFLGSSAFALFSFFD

SEQ ID NO: 2243666 - protein, 25 aa, Cryptosporidium parvum
IERHRLILINYYSYLGRYLSPNNKN

SEQ ID NO: 2243667 - protein, 25 aa, Cryptosporidium parvum
IERINSFQLLLKLINDLMPNIVEEL

SEQ ID NO: 2243668 - protein, 26 aa, Cryptosporidium parvum
IESGRLIGQVSKRPIPGSIAGDLNPI

SEQ ID NO: 2243669 - protein, 26 aa, Cryptosporidium parvum
IESLKWVFSMLFFTSIGLVIDATFIW

SEQ ID NO: 2243670 - protein, 25 aa, Cryptosporidium parvum
IESSTPFEYLVLETILVESCNIINR

SEQ ID NO: 2243671 - protein, 26 aa, Cryptosporidium parvum
IEVDKLMIRMIYGSLPSLGCEQLQIS

SEQ ID NO: 2243672 - protein, 40 aa, Cryptosporidium parvum
IEWDMAGPILLIACLGFFLLLAGKIHFGYIYGIGILSCIG

SEQ ID NO: 2243673 - protein, 19 aa, Cryptosporidium parvum
IEYIVHITHLFLLTKRNSG

SEQ ID NO: 2243674 - protein, 29 aa, Cryptosporidium parvum
IEYTNINMYWIYYRIFHGIPFELFEICQI

SEQ ID NO: 2243675 - protein, 27 aa, Cryptosporidium parvum
IFAFSGMIDIFFFKFLSSVNKYRQKNN

SEQ ID NO: 2243676 - protein, 20 aa, Cryptosporidium parvum
IFCIHPAIFTLMIYSSMEIL

SEQ ID NO: 2243677 - protein, 17 aa, Cryptosporidium parvum
IFCSFVISLACCAVGNF

SEQ ID NO: 2243678 - protein, 22 aa, Cryptosporidium parvum
IFDRYYIFCKGSFDVLTKFSPN

SEQ ID NO: 2243679 - protein, 26 aa, Cryptosporidium parvum
IFEDAKIFVILFKILSKHSINILIPV

SEQ ID NO: 2243680 - protein, 32 aa, Cryptosporidium parvum
IFEEEVILMMLLFVLLYFTLNNSLSIIKDYFI

SEQ ID NO: 2243681 - protein, 32 aa, Cryptosporidium parvum
IFEELRILIISPIFPEILLDKILSFKSGKVVF

SEQ ID NO: 2243682 - protein, 39 aa, Cryptosporidium parvum
IFEKKYLDLYYYYLVNISKLINYWLGICPIELIIHEVFL

SEQ ID NO: 2243683 - protein, 21 aa, Cryptosporidium parvum
IFELMLSINILSIKRLIDSIN

SEQ ID NO: 2243684 - protein, 18 aa, Cryptosporidium parvum
IFESLQLTLVLLPTGISS

SEQ ID NO: 2243685 - protein, 20 aa, Cryptosporidium parvum
IFEYYLWPEKMEDPKYSIID

SEQ ID NO: 2243686 - protein, 18 aa, Cryptosporidium parvum
IFFDYLLSIEDFKLYIQH

SEQ ID NO: 2243687 - protein, 29 aa, Cryptosporidium parvum
IFFGVFVDLLSLPIKLIMSWYVLSKVLGS

SEQ ID NO: 2243688 - protein, 17 aa, Cryptosporidium parvum
IFFIFREGIQVIVSMIL

SEQ ID NO: 2243689 - protein, 19 aa, Cryptosporidium parvum
IFFLEFFVQRLVFDKLQLV

SEQ ID NO: 2243690 - protein, 25 aa, Cryptosporidium parvum
IFFLFINFLFLFENVTDNFLFKKDV

SEQ ID NO: 2243691 - protein, 21 aa, Cryptosporidium parvum
IFFLVFAISALNVNSQELILT

SEQ ID NO: 2243692 - protein, 24 aa, Cryptosporidium parvum
IFGYTLMFLLHFSSYAYYFAGICF

SEQ ID NO: 2243693 - protein, 26 aa, Cryptosporidium parvum
IFHIEKLLLLRIYFLPQFIQRDNSKN

SEQ ID NO: 2243694 - protein, 17 aa, Cryptosporidium parvum
IFHVLKALYSKLSSFRR

SEQ ID NO: 2243695 - protein, 28 aa, Cryptosporidium parvum
IFIIHYSVLLIVKLILECFTFISEALLS

SEQ ID NO: 2243696 - protein, 17 aa, Cryptosporidium parvum
IFIPGTFLILFSIIIDT

SEQ ID NO: 2243697 - protein, 26 aa, Cryptosporidium parvum
IFISFLVLYISYFYSFEESNEFKDAL

SEQ ID NO: 2243698 - protein, 18 aa, Cryptosporidium parvum
IFKFLGLSELLVLELKIF

SEQ ID NO: 2243699 - protein, 27 aa, Cryptosporidium parvum
IFLFLFALRFYFWVRGRFSFNVGSNEK

SEQ ID NO: 2243700 - protein, 20 aa, Cryptosporidium parvum
IFLICIYTLNLDVAEGFYSA

SEQ ID NO: 2243701 - protein, 18 aa, Cryptosporidium parvum
IFLQLKLLNYKREFLHVP

SEQ ID NO: 2243702 - protein, 20 aa, Cryptosporidium parvum
IFLSIPPLHFAYLGVVLCIV

SEQ ID NO: 2243703 - protein, 32 aa, Cryptosporidium parvum
IFLSIVLGILTLYLLLIPLSTATIMFIYNEVE

SEQ ID NO: 2243704 - protein, 18 aa, Cryptosporidium parvum
IFLSRLIQELFKAYISTM

SEQ ID NO: 2243705 - protein, 17 aa, Cryptosporidium parvum
IFMIIRYYLNMNQDSQS

SEQ ID NO: 2243706 - protein, 18 aa, Cryptosporidium parvum
IFMLAINIPIIYLSLFIS

SEQ ID NO: 2243707 - protein, 17 aa, Cryptosporidium parvum
IFNLIKEITILFPEISH

SEQ ID NO: 2243708 - protein, 18 aa, Cryptosporidium parvum
IFNPVKWYKKQEAIRRAN

SEQ ID NO: 2243709 - protein, 19 aa, Cryptosporidium parvum
IFNQVQFILIRTLKVDYSA

SEQ ID NO: 2243710 - protein, 21 aa, Cryptosporidium parvum
IFNVIQDPEWITSNGDYYIIE

SEQ ID NO: 2243711 - protein, 21 aa, Cryptosporidium parvum
IFPDEPKIILRRKKPNLFAEA

SEQ ID NO: 2243712 - protein, 17 aa, Cryptosporidium parvum
IFPSHPALVLYASNAEF

SEQ ID NO: 2243713 - protein, 26 aa, Cryptosporidium parvum
IFPVSIDVFLSNRLIWDLFGECTLED

SEQ ID NO: 2243714 - protein, 19 aa, Cryptosporidium parvum
IFQKISFFWVTPYFCERIL

SEQ ID NO: 2243715 - protein, 19 aa, Cryptosporidium parvum
IFRIYSSLATNILWRGLKK

SEQ ID NO: 2243716 - protein, 19 aa, Cryptosporidium parvum
IFRRDIQLPLIKPTTKFEN

SEQ ID NO: 2243717 - protein, 26 aa, Cryptosporidium parvum
IFSLFTILPVLFFLNLRKIKSLINLL

SEQ ID NO: 2243718 - protein, 27 aa, Cryptosporidium parvum
IFSNEYLSKFYLFLAKELEVLEPKTPE

SEQ ID NO: 2243719 - protein, 26 aa, Cryptosporidium parvum
IFTLYSKWLMNNYFPYPITMSLIHMI

SEQ ID NO: 2243720 - protein, 29 aa, Cryptosporidium parvum
IFTRKIFHLFLIALFFPQILSFNIMPTKE

SEQ ID NO: 2243721 - protein, 27 aa, Cryptosporidium parvum
IFVCCGLLIWLLLTNIFEVLWIAKYLL

SEQ ID NO: 2243722 - protein, 31 aa, Cryptosporidium parvum; identical to SEQ ID NO: 2131141

SEQ ID NO: 2243723 - protein, 20 aa, Cryptosporidium parvum
IFVFLFPALIHHRVIYNKKE

SEQ ID NO: 2243724 - protein, 31 aa, Cryptosporidium parvum
IFVLSGVVSMRIFRPYWSDGRMWINLVLVYI

SEQ ID NO: 2243725 - protein, 19 aa, Cryptosporidium parvum
IFVNLYRKKIQVYTKIIKA

SEQ ID NO: 2243726 - protein, 25 aa, Cryptosporidium parvum
IFVTYLHYLFILITTPIGFSILRVV

SEQ ID NO: 2243727 - protein, 18 aa, Cryptosporidium parvum
IFYKLKYYNNQHLNKTIL

SEQ ID NO: 2243728 - protein, 17 aa, Cryptosporidium parvum
IFYLIKNNTVEFLYNED

SEQ ID NO: 2243729 - protein, 21 aa, Cryptosporidium parvum
IFYLLILYTIQGLPMGISYSI

SEQ ID NO: 2243730 - protein, 17 aa, Cryptosporidium parvum
IFYRPKVLSTSILLLLC

SEQ ID NO: 2243731 - protein, 23 aa, Cryptosporidium parvum
IGAFMGLFITPILKVRPKEIFEN

SEQ ID NO: 2243732 - protein, 20 aa, Cryptosporidium parvum
IGDLPLAPPLSALSASPIQY

SEQ ID NO: 2243733 - protein, 31 aa, Cryptosporidium parvum; identical to SEQ ID NO: 2131145

SEQ ID NO: 2243734 - protein, 22 aa, Cryptosporidium parvum
IGFACFTILFSLSLLIFHLYIG

SEQ ID NO: 2243735 - protein, 27 aa, Cryptosporidium parvum
IGFAISIVIGIIWLISLRYESRIADSI

SEQ ID NO: 2243736 - protein, 23 aa, Cryptosporidium parvum
IGFSLYILIILIKYIISIGIIEE

SEQ ID NO: 2243737 - protein, 19 aa, Cryptosporidium parvum
IGGYCICVCLVKDLVFEVN

SEQ ID NO: 2243738 - protein, 29 aa, Cryptosporidium parvum
IGHIELELPVFHPLFLGNLVRILKCCCWH

SEQ ID NO: 2243739 - protein, 19 aa, Cryptosporidium parvum
IGIACSILCLIAEVGLFMI

SEQ ID NO: 2243740 - protein, 37 aa, Cryptosporidium parvum; identical to SEQ ID NO: 2131149

SEQ ID NO: 2243741 - protein, 31 aa, Cryptosporidium parvum
IGIQCFIFLIFLILVIYNFYRKRLLRKRLMN

SEQ ID NO: 2243742 - protein, 26 aa, Cryptosporidium parvum
IGIRLQCYVNLMITLRRLQLKLLDYD

SEQ ID NO: 2243743 - protein, 25 aa, Cryptosporidium parvum
IGISFVTLILLTILMILVHCVLEKH

SEQ ID NO: 2243744 - protein, 28 aa, Cryptosporidium parvum
IGISVWIRNLIINLIIILICLAVLAYIS

SEQ ID NO: 2243745 - protein, 34 aa, Cryptosporidium parvum
IGKRLTFPSNLPIKQFFFCFFIEESLKANIKEIE

SEQ ID NO: 2243746 - protein, 18 aa, Cryptosporidium parvum
IGKVLLGFALYNKAKYQS

SEQ ID NO: 2243747 - protein, 29 aa, Cryptosporidium parvum
IGLGSFIGFIILIALIRIIYFAAKKRNSR

SEQ ID NO: 2243748 - protein, 19 aa, Cryptosporidium parvum
IGLKVYYLPYKSIYDNVVY

SEQ ID NO: 2243749 - protein, 23 aa, Cryptosporidium parvum
IGLLFSLYYRRFLDPCVGSLSIL

SEQ ID NO: 2243750 - protein, 20 aa, Cryptosporidium parvum
IGLQTFKIFLDSHTNFLIAK

SEQ ID NO: 2243751 - protein, 19 aa, Cryptosporidium parvum
IGMLTMLELNLALGCFETN

SEQ ID NO: 2243752 - protein, 22 aa, Cryptosporidium parvum
IGNFISYLRYLEGIANLYLLNV

SEQ ID NO: 2243753 - protein, 26 aa, Cryptosporidium parvum
IGNISKFNIFFRELNIRYLNNKYHNE

SEQ ID NO: 2243754 - protein, 27 aa, Cryptosporidium parvum
IGPLTISVIVIILIISCIIGGFCFCGA

SEQ ID NO: 2243755 - protein, 25 aa, Cryptosporidium parvum
IGPQLFISFILFYSEIESIDTQAIE

SEQ ID NO: 2243756 - protein, 25 aa, Cryptosporidium parvum
IGRGYKRCLLLQTGELLRLVHSYNK

SEQ ID NO: 2243757 - protein, 20 aa, Cryptosporidium parvum
IGRKIFRFPTIKLYKKREKA

SEQ ID NO: 2243758 - protein, 22 aa, Cryptosporidium parvum
IGRLFDPIRLLVARVGLEGEMV

SEQ ID NO: 2243759 - protein, 20 aa, Cryptosporidium parvum
IGSCLLLLNCRFGIAPVSMN

SEQ ID NO: 2243760 - protein, 37 aa, Cryptosporidium parvum
IGSDVYTIWIPLYNNVLLWITLISGLSISLWPDYFFK

SEQ ID NO: 2243761 - protein, 26 aa, Cryptosporidium parvum
IGSFGLMLFIIIMGTFLTYVLEAVAC

SEQ ID NO: 2243762 - protein, 30 aa, Cryptosporidium parvum
IGSIFFILGTLLQLLPIWAPAFVQSCINSS

SEQ ID NO: 2243763 - protein, 25 aa, Cryptosporidium parvum
IGSISNLYYYLLKKVWNFKENSNNI

SEQ ID NO: 2243764 - protein, 17 aa, Cryptosporidium parvum
IGSLVIFFQMGEPNLYS

SEQ ID NO: 2243765 - protein, 24 aa, Cryptosporidium parvum
IGSSIYYFFIRYFINGCRSLRSCY

SEQ ID NO: 2243766 - protein, 24 aa, Cryptosporidium parvum
IGTLKIFYLYARWTLYFNTQVIAG

SEQ ID NO: 2243767 - protein, 17 aa, Cryptosporidium parvum
IGTWVWLELFRITGTQL

SEQ ID NO: 2243768 - protein, 21 aa, Cryptosporidium parvum
IGVCLILFTLGLEFSLKRVLS

SEQ ID NO: 2243769 - protein, 17 aa, Cryptosporidium parvum
IGVHRKFQFRPATIHIG

SEQ ID NO: 2243770 - protein, 19 aa, Cryptosporidium parvum
IGVMIAGLLILYNPAWTIA

SEQ ID NO: 2243771 - protein, 31 aa, Cryptosporidium parvum; identical to SEQ ID NO: 2131168

SEQ ID NO: 2243772 - protein, 39 aa, Cryptosporidium parvum
IGYIGIGYVFGFWPSLLFKQHYNNILRSKKHKLFIMGDS

SEQ ID NO: 2243773 - protein, 27 aa, Cryptosporidium parvum
IGYQEILFIILITTVLVYFGIISVLYD

SEQ ID NO: 2243774 - protein, 31 aa, Cryptosporidium parvum
IHDEIDLYLQFFIFKRPYLSAFSLVFSKSQM

SEQ ID NO: 2243775 - protein, 54 aa, Cryptosporidium parvum
IHEIWYSFQFSILPVILNIMIYGFQISILSIFPVTCIILTLVYNYLSTLSISNP

SEQ ID NO: 2243776 - protein, 23 aa, Cryptosporidium parvum
IHGMGACIMTAIWLVQDLKSNLG

SEQ ID NO: 2243777 - protein, 18 aa, Cryptosporidium parvum
IHIMALRGIILSIGIIFP

SEQ ID NO: 2243778 - protein, 23 aa, Cryptosporidium parvum
IHITSFTYLLLLDIHFLANQESV

SEQ ID NO: 2243779 - protein, 23 aa, Cryptosporidium parvum
IHIYYLIILLLQLTSSIIPILTK

SEQ ID NO: 2243780 - protein, 17 aa, Cryptosporidium parvum
IHKKYLIQYIYLSGNNI

SEQ ID NO: 2243781 - protein, 39 aa, Cryptosporidium parvum
IHKTKPFRLSLFTNKLFVIQIFFIIISTIAITLVPTSLL

SEQ ID NO: 2243782 - protein, 22 aa, Cryptosporidium parvum
IHLFLFFVLFSEFKYGEINHYQ

SEQ ID NO: 2243783 - protein, 17 aa, Cryptosporidium parvum
IHPLIFTICYIIINFFK

SEQ ID NO: 2243784 - protein, 28 aa, Cryptosporidium parvum
IHPSFNLYCMFVQLITLITKLRDLGTLN

SEQ ID NO: 2243785 - protein, 26 aa, Cryptosporidium parvum
IHQGSIIIISLLFESLISILNKKHNL

SEQ ID NO: 2243786 - protein, 20 aa, Cryptosporidium parvum
IHSLVLVCIICYIITEFKND

SEQ ID NO: 2243787 - protein, 18 aa, Cryptosporidium parvum
IHSRISLLYLSKKPVMNL

SEQ ID NO: 2243788 - protein, 25 aa, Cryptosporidium parvum
IHTTLLDELIWLVFCSIEQEKEYVP

SEQ ID NO: 2243789 - protein, 25 aa, Cryptosporidium parvum
IHTYTLKWFDNILPSLKIPKVPWDL

SEQ ID NO: 2243790 - protein, 23 aa, Cryptosporidium parvum
IIAFFVNLPIFFAMAITLPCFLI

SEQ ID NO: 2243791 - protein, 18 aa, Cryptosporidium parvum
IIAIVVVAIIIIAGIIHC

SEQ ID NO: 2243792 - protein, 18 aa, Cryptosporidium parvum
IICNISLIMLYFHEVIKH

SEQ ID NO: 2243793 - protein, 33 aa, Cryptosporidium parvum; identical to SEQ ID NO: 2131188

SEQ ID NO: 2243794 - protein, 18 aa, Cryptosporidium parvum
IIDWHNYGHTLLIADKRE

SEQ ID NO: 2243795 - protein, 23 aa, Cryptosporidium parvum
IIEELFWRSFVYKELIISLGVRN

SEQ ID NO: 2243796 - protein, 43 aa, Cryptosporidium parvum
IIELYKYLNSFRLFMKMPSFISTIYILIGLLMKIEISYSKFEF

SEQ ID NO: 2243797 - protein, 28 aa, Cryptosporidium parvum
IIFEIADLPFIIIYSNIRKVKVFLKTDQ

SEQ ID NO: 2243798 - protein, 24 aa, Cryptosporidium parvum
IIFGISIFTFIAVSLGFVLCRVMN

SEQ ID NO: 2243799 - protein, 22 aa, Cryptosporidium parvum
IIFKESISLLKSGKLVWMVPLI

SEQ ID NO: 2243800 - protein, 27 aa, Cryptosporidium parvum
IIFNIDRFFLTLNLYNKFKLPNHILYA

SEQ ID NO: 2243801 - protein, 18 aa, Cryptosporidium parvum
IIFSCNNIFDFSITKMNL

SEQ ID NO: 2243802 - protein, 45 aa, Cryptosporidium parvum
IIFSLSKKDYVWIACSFLSFLLVNYYITKWIWGSNLTSSQNEGST

SEQ ID NO: 2243803 - protein, 18 aa, Cryptosporidium parvum
IIGGLLFVLFADERQISL

SEQ ID NO: 2243804 - protein, 30 aa, Cryptosporidium parvum
IIGVDILYFTYFVCIFLAILSVIASGILEV

SEQ ID NO: 2243805 - protein, 18 aa, Cryptosporidium parvum
IIHKYLNPRQLLIDSYSR

SEQ ID NO: 2243806 - protein, 17 aa, Cryptosporidium parvum
IIHLLVLKFLTIKFDQA

SEQ ID NO: 2243807 - protein, 30 aa, Cryptosporidium parvum; identical to SEQ ID NO: 2131196

SEQ ID NO: 2243808 - protein, 17 aa, Cryptosporidium parvum
IIIKELPFMLAIEPPST

SEQ ID NO: 2243809 - protein, 23 aa, Cryptosporidium parvum
IIINYKYEYFLYRSKNHDYNDII

SEQ ID NO: 2243810 - protein, 19 aa, Cryptosporidium parvum
IIIPLQIPYLQSIFLTFTI

SEQ ID NO: 2243811 - protein, 17 aa, Cryptosporidium parvum
IIIRIWRESSLNKPCQF

SEQ ID NO: 2243812 - protein, 36 aa, Cryptosporidium parvum
IIIVSIIWGIQIVIVFLYFILRIITSFTRLFSKNNS

SEQ ID NO: 2243813 - protein, 30 aa, Cryptosporidium parvum
IIKKGLHPIITLIYKLLLFNRGLNVDAISI

SEQ ID NO: 2243814 - protein, 31 aa, Cryptosporidium parvum
IIKKNNALLILFLMIFLIIEIGIGIYIKLEM

SEQ ID NO: 2243815 - protein, 31 aa, Cryptosporidium parvum
IIKKSITLPFLCFPLSIFIMNNVIKIKSDEK

SEQ ID NO: 2243816 - protein, 17 aa, Cryptosporidium parvum
IIKLFIIKIFQENLKIK

SEQ ID NO: 2243817 - protein, 17 aa, Cryptosporidium parvum
IIKLSPKYQLLSNNVLP

SEQ ID NO: 2243818 - protein, 19 aa, Cryptosporidium parvum
IIKQFPLKQSFFDKVFIKN

SEQ ID NO: 2243819 - protein, 17 aa, Cryptosporidium parvum
IIKSFWMSLSSIFLSEL

SEQ ID NO: 2243820 - protein, 33 aa, Cryptosporidium parvum
IIKSILIIIIMKIFYFICLFISTILQDFYYTIH

SEQ ID NO: 2243821 - protein, 34 aa, Cryptosporidium parvum
IIKTFIYQRYALLKNFRLFVCSLFLIQIHKNNKL

SEQ ID NO: 2243822 - protein, 25 aa, Cryptosporidium parvum
IILARIDLLLVPVYIPCDHQINDRF

SEQ ID NO: 2243823 - protein, 24 aa, Cryptosporidium parvum
IILETRWVIWRYAILYLLGGISGN

SEQ ID NO: 2243824 - protein, 18 aa, Cryptosporidium parvum
IILIYPNCKVQISWLDIG

SEQ ID NO: 2243825 - protein, 19 aa, Cryptosporidium parvum
IILLKFLNEYYKICSKSLI

SEQ ID NO: 2243826 - protein, 27 aa, Cryptosporidium parvum
IILLLLFINFLFLFENITDNFLVKKDV

SEQ ID NO: 2243827 - protein, 17 aa, Cryptosporidium parvum
IILPFKYFKNEELMMDI

SEQ ID NO: 2243828 - protein, 21 aa, Cryptosporidium parvum
IILQTALVSNLYFFSQLLYRR

SEQ ID NO: 2243829 - protein, 19 aa, Cryptosporidium parvum
IILSWILNGCSPYLSLSIY

SEQ ID NO: 2243830 - protein, 17 aa, Cryptosporidium parvum
IILYPIHILISALVAHS

SEQ ID NO: 2243831 - protein, 17 aa, Cryptosporidium parvum
IIMSCILSWYLGDYSIT

SEQ ID NO: 2243832 - protein, 18 aa, Cryptosporidium parvum
IINGYLPKIFTYLHDLDV

SEQ ID NO: 2243833 - protein, 34 aa, Cryptosporidium parvum
IINNETLAYFLSRTYDFLISIGINPDGIRFRQHL

SEQ ID NO: 2243834 - protein, 17 aa, Cryptosporidium parvum
IINPCIIPIIKKTEKMV

SEQ ID NO: 2243835 - protein, 18 aa, Cryptosporidium parvum
IINQIIEILFNIYVDYYT

SEQ ID NO: 2243836 - protein, 18 aa, Cryptosporidium parvum
IINQVKFSHNGYLLASSS

SEQ ID NO: 2243837 - protein, 25 aa, Cryptosporidium parvum
IINTFLDQISFKSALFIFGFIIALI

SEQ ID NO: 2243838 - protein, 17 aa, Cryptosporidium parvum
IIPILKTYNSTIFLISR

SEQ ID NO: 2243839 - protein, 20 aa, Cryptosporidium parvum
IIPKLQIIPFCSSIIRGDTQ

SEQ ID NO: 2243840 - protein, 26 aa, Cryptosporidium parvum
IIPSLPNGLFIFFSKKRAIKCNKDEK

SEQ ID NO: 2243841 - protein, 27 aa, Cryptosporidium parvum
IIPTILFITPAIYILLSFRAAPQLYGS

SEQ ID NO: 2243842 - protein, 20 aa, Cryptosporidium parvum
IIQLHYYICNFNYNNNNKDY

SEQ ID NO: 2243843 - protein, 18 aa, Cryptosporidium parvum
IIQPILNLALDCACRDET

SEQ ID NO: 2243844 - protein, 25 aa, Cryptosporidium parvum
IIRNYLKLKYLVLRIIFNSNKTRLD

SEQ ID NO: 2243845 - protein, 23 aa, Cryptosporidium parvum
IIRTWILWIPIIKSITLVYNSLY

SEQ ID NO: 2243846 - protein, 19 aa, Cryptosporidium parvum
IIRYQPIVMLLTNSDPRDY

SEQ ID NO: 2243847 - protein, 31 aa, Cryptosporidium parvum
IISCYSTIVFPPCPILLFSLRDINSNSQNKI

SEQ ID NO: 2243848 - protein, 25 aa, Cryptosporidium parvum
IISDPFEIFLVVNAPIDYFTLIMND

SEQ ID NO: 2243849 - protein, 25 aa, Cryptosporidium parvum
IISGFFGFLRFFTHKDVIVSPIMTI

SEQ ID NO: 2243850 - protein, 19 aa, Cryptosporidium parvum
IISIFNANLVFSKHHKHSL

SEQ ID NO: 2243851 - protein, 17 aa, Cryptosporidium parvum
IISILIKLSFFILVEHD

SEQ ID NO: 2243852 - protein, 18 aa, Cryptosporidium parvum
IISKIRTLEYYEIPKVER

SEQ ID NO: 2243853 - protein, 19 aa, Cryptosporidium parvum
IISNRLDFSILGLDYTRLF

SEQ ID NO: 2243854 - protein, 20 aa, Cryptosporidium parvum
IISSLKLFLSKWTKVSELMI

SEQ ID NO: 2243855 - protein, 27 aa, Cryptosporidium parvum
IITFPRYVLWELIFTSRWIWLSLHFFS

SEQ ID NO: 2243856 - protein, 31 aa, Cryptosporidium parvum
IITNLESILFIKYYPLIKEIGITLKYIYNYS

SEQ ID NO: 2243857 - protein, 35 aa, Cryptosporidium parvum
IIVAVKVSFLNNLFFFIIALILFSSNIMDKISNVA

SEQ ID NO: 2243858 - protein, 27 aa, Cryptosporidium parvum
IIVDIKELLLLLRKYIRTNGSCLQSFC

SEQ ID NO: 2243859 - protein, 38 aa, Cryptosporidium parvum
IIVGIVGVVWLFVFGKSRNFLLFAWSTSSILSSSGIAY

SEQ ID NO: 2243860 - protein, 35 aa, Cryptosporidium parvum
IIVNNSTYHRFLWNNFDLLIQFINIISYSSSFKLS

SEQ ID NO: 2243861 - protein, 17 aa, Cryptosporidium parvum
IIWKLILGESVSLNDLK

SEQ ID NO: 2243862 - protein, 22 aa, Cryptosporidium parvum
IIYHLYGLGCNLLLFSKYHEIE

SEQ ID NO: 2243863 - protein, 22 aa, Cryptosporidium parvum
IKDFILFPARITCDVPSGDINH

SEQ ID NO: 2243864 - protein, 26 aa, Cryptosporidium parvum
IKDHIHVILIILINILYLNHNIMKIA

SEQ ID NO: 2243865 - protein, 17 aa, Cryptosporidium parvum
IKDKFGKILFKTSYSLV

SEQ ID NO: 2243866 - protein, 26 aa, Cryptosporidium parvum
IKDKSKNVFWIFYASYMTSSIDNGHD

SEQ ID NO: 2243867 - protein, 27 aa, Cryptosporidium parvum
IKDPKISYWLIIYTVKHLFISEESIKL

SEQ ID NO: 2243868 - protein, 25 aa, Cryptosporidium parvum
IKDSNLMIFKIWFSRNLKINNNQLI

SEQ ID NO: 2243869 - protein, 31 aa, Cryptosporidium parvum; identical to SEQ ID NO: 2131218

SEQ ID NO: 2243870 - protein, 32 aa, Cryptosporidium parvum
IKEFFNIYAQLLYYSYIYRIIFILQCKFTNKY

SEQ ID NO: 2243871 - protein, 18 aa, Cryptosporidium parvum
IKEFRRAIFSWNPRIPKK

SEQ ID NO: 2243872 - protein, 17 aa, Cryptosporidium parvum
IKEILCMESFLDLQFSI

SEQ ID NO: 2243873 - protein, 20 aa, Cryptosporidium parvum
IKELILLQDLDLKLLKELFN

SEQ ID NO: 2243874 - protein, 26 aa, Cryptosporidium parvum
IKELMANTLFIMSNYLIWKEYIKDEN

SEQ ID NO: 2243875 - protein, 24 aa, Cryptosporidium parvum
IKEMYSYIVVYLKDFRQYKSEVMV

SEQ ID NO: 2243876 - protein, 21 aa, Cryptosporidium parvum
IKETDIGLLLFQYSDDWPTRI

SEQ ID NO: 2243877 - protein, 17 aa, Cryptosporidium parvum
IKFELPCMAIMSCFSPK

SEQ ID NO: 2243878 - protein, 21 aa, Cryptosporidium parvum
IKFKIRDICIWSILYERIKRT

SEQ ID NO: 2243879 - protein, 22 aa, Cryptosporidium parvum
IKFPRILERLLYKACKLVNLME

SEQ ID NO: 2243880 - protein, 31 aa, Cryptosporidium parvum; identical to SEQ ID NO: 2131222

SEQ ID NO: 2243881 - protein, 27 aa, Cryptosporidium parvum
IKHIEIFVRTWFKFLELSVGRGSIQIL

SEQ ID NO: 2243882 - protein, 20 aa, Cryptosporidium parvum
IKIDLYQRAYHGIDRLGRPI

SEQ ID NO: 2243883 - protein, 24 aa, Cryptosporidium parvum
IKIKVPICQLCGYDAYCRSGGIMK

SEQ ID NO: 2243884 - protein, 24 aa, Cryptosporidium parvum
IKILGLESLFYWKINKSRINELKS

SEQ ID NO: 2243885 - protein, 18 aa, Cryptosporidium parvum
IKIMIVSSLWQQLDFLYY

SEQ ID NO: 2243886 - protein, 33 aa, Cryptosporidium parvum
IKIQLSNLMFNYWYLKILLIIIERIGMDLTVSE

SEQ ID NO: 2243887 - protein, 18 aa, Cryptosporidium parvum
IKISRPSILYLLSYHDHS

SEQ ID NO: 2243888 - protein, 24 aa, Cryptosporidium parvum
IKKDDFIMIYSFYGHLNNIKSVVQ

SEQ ID NO: 2243889 - protein, 25 aa, Cryptosporidium parvum
IKKNKFSYYYPTNYFYMFISGSKRF

SEQ ID NO: 2243890 - protein, 24 aa, Cryptosporidium parvum
IKKRKIPVIYKIKSFFKLIFCILS

SEQ ID NO: 2243891 - protein, 25 aa, Cryptosporidium parvum
IKKTTLIRRLSLKFPQPYLSLIENI

SEQ ID NO: 2243892 - protein, 34 aa, Cryptosporidium parvum
IKKYNFSIPICIFLSLYKCKIKIIYLSSIFNDGT

SEQ ID NO: 2243893 - protein, 23 aa, Cryptosporidium parvum
IKLEFRVVPLTNGLLKLPSINFG

SEQ ID NO: 2243894 - protein, 24 aa, Cryptosporidium parvum
IKLLFLLLLEVCAYKFTNGVPIAS

SEQ ID NO: 2243895 - protein, 20 aa, Cryptosporidium parvum
IKLNPLIALRMRLILHGFHS

SEQ ID NO: 2243896 - protein, 17 aa, Cryptosporidium parvum
IKMATFYNFRNPVDGKM

SEQ ID NO: 2243897 - protein, 17 aa, Cryptosporidium parvum
IKMIIISSSLDFILEKS

SEQ ID NO: 2243898 - protein, 17 aa, Cryptosporidium parvum
IKNLSLYPGNRGSSLLL

SEQ ID NO: 2243899 - protein, 30 aa, Cryptosporidium parvum
IKNQLLDHQYLFFGIIRMISGPRDKETINQ

SEQ ID NO: 2243900 - protein, 24 aa, Cryptosporidium parvum
IKNRLHLFKQILTFVNIIFNHMLL

SEQ ID NO: 2243901 - protein, 36 aa, Cryptosporidium parvum
IKNSWAFFIYLIFFTSIFLICKIIFYLTVIKINKNK

SEQ ID NO: 2243902 - protein, 17 aa, Cryptosporidium parvum
IKPLNSFLDPKAFARFA

SEQ ID NO: 2243903 - protein, 25 aa, Cryptosporidium parvum
IKPSKYFIYPFLFQYNTRSNIDMGI

SEQ ID NO: 2243904 - protein, 33 aa, Cryptosporidium parvum
IKQCMDYYLLRYYVYRIITFLFMISNLPEFKGK

SEQ ID NO: 2243905 - protein, 26 aa, Cryptosporidium parvum
IKQEKILINLYITLVKHLKNFNPEIN

SEQ ID NO: 2243906 - protein, 22 aa, Cryptosporidium parvum
IKQKLQIWLGFSQISLNIRQAC

SEQ ID NO: 2243907 - protein, 31 aa, Cryptosporidium parvum
IKQSEQLFKLVQILFEILYSRKIQAFESTTD

SEQ ID NO: 2243908 - protein, 18 aa, Cryptosporidium parvum
IKQVNHVFILVSGTNKYF

SEQ ID NO: 2243909 - protein, 23 aa, Cryptosporidium parvum
IKSELKFTWLGWLSFGRDQETGD

SEQ ID NO: 2243910 - protein, 20 aa, Cryptosporidium parvum
IKSGFLRKPLFFAKDCRLDE

SEQ ID NO: 2243911 - protein, 25 aa, Cryptosporidium parvum
IKSKTLLLNPCHSKCFMIVAGRLGS

SEQ ID NO: 2243912 - protein, 19 aa, Cryptosporidium parvum
IKSMLYLNPNMYSLISLGT

SEQ ID NO: 2243913 - protein, 24 aa, Cryptosporidium parvum
IKSQVKMDWLFDLDAFNIHKITHE

SEQ ID NO: 2243914 - protein, 19 aa, Cryptosporidium parvum
IKTRFNWDLSLFQTEFGYV

SEQ ID NO: 2243915 - protein, 23 aa, Cryptosporidium parvum
IKTVNWISIFYCNANLICNNSCS

SEQ ID NO: 2243916 - protein, 19 aa, Cryptosporidium parvum
IKVATFISLAISLFIILCY

SEQ ID NO: 2243917 - protein, 18 aa, Cryptosporidium parvum
IKYYVNGRFIGSIRKPNG

SEQ ID NO: 2243918 - protein, 17 aa, Cryptosporidium parvum
ILAGIIRLLVNKIRNGN

SEQ ID NO: 2243919 - protein, 20 aa, Cryptosporidium parvum
ILAIPLSFIFLMFRTRRRLG

SEQ ID NO: 2243920 - protein, 19 aa, Cryptosporidium parvum
ILATIHILTAILNIKLSET

SEQ ID NO: 2243921 - protein, 36 aa, Cryptosporidium parvum
ILCHPTSIKSLFLKTVFLFRILRYWNNDITSSSGLK

SEQ ID NO: 2243922 - protein, 17 aa, Cryptosporidium parvum
ILDLKYLKEYFTPIKYE

SEQ ID NO: 2243923 - protein, 21 aa, Cryptosporidium parvum
ILDLYITMNYFPSSNILRDVW

SEQ ID NO: 2243924 - protein, 21 aa, Cryptosporidium parvum
ILDSFILFMALISIIQIIYCL

SEQ ID NO: 2243925 - protein, 17 aa, Cryptosporidium parvum
ILDYFHSTKYYNSDENL

SEQ ID NO: 2243926 - protein, 31 aa, Cryptosporidium parvum
ILEALNKIKLLDFILLLPLKLETIIISQDSN

SEQ ID NO: 2243927 - protein, 17 aa, Cryptosporidium parvum
ILEIDKLDILFFVNCEY

SEQ ID NO: 2243928 - protein, 24 aa, Cryptosporidium parvum
ILENKLYWNIYIDATILSFGGNMV

SEQ ID NO: 2243929 - protein, 19 aa, Cryptosporidium parvum
ILENYLARQKVALDTIGYL

SEQ ID NO: 2243930 - protein, 24 aa, Cryptosporidium parvum
ILESGIAGLFLLSLPINDPFQRKR

SEQ ID NO: 2243931 - protein, 23 aa, Cryptosporidium parvum
ILESIIHVIPFKYGENRSFGVNI

SEQ ID NO: 2243932 - protein, 18 aa, Cryptosporidium parvum
ILFELFLSYFLEHIIKLL

SEQ ID NO: 2243933 - protein, 18 aa, Cryptosporidium parvum
ILFIINKIIEIQYGAYSN

SEQ ID NO: 2243934 - protein, 18 aa, Cryptosporidium parvum
ILFLVYAKSQKPIKNEIE

SEQ ID NO: 2243935 - protein, 31 aa, Cryptosporidium parvum
ILFSGSFCAIFWLKKRGLMPGLTFSNELISR

SEQ ID NO: 2243936 - protein, 20 aa, Cryptosporidium parvum
ILFTDMFQHKYLRDLVLNFN

SEQ ID NO: 2243937 - protein, 20 aa, Cryptosporidium parvum
ILFTSLGLLFKKYYGQFSIP

SEQ ID NO: 2243938 - protein, 18 aa, Cryptosporidium parvum
ILGFLSILAFAWITESNS

SEQ ID NO: 2243939 - protein, 18 aa, Cryptosporidium parvum
ILGIFPHLNILFSLVTLQ

SEQ ID NO: 2243940 - protein, 25 aa, Cryptosporidium parvum
ILGKYKFSGLYLPGLPLLNTHLEKL

SEQ ID NO: 2243941 - protein, 25 aa, Cryptosporidium parvum
ILGTILSFAVALPGWLRYSIFTVGE

SEQ ID NO: 2243942 - protein, 17 aa, Cryptosporidium parvum
ILGVFLPIIKYLDESDL

SEQ ID NO: 2243943 - protein, 24 aa, Cryptosporidium parvum
ILGYSILISVFLFIVFIIMKLLLL

SEQ ID NO: 2243944 - protein, 17 aa, Cryptosporidium parvum
ILHPLKSELHWPIGEKI

SEQ ID NO: 2243945 - protein, 22 aa, Cryptosporidium parvum
ILHYIYFVEIINHIFVEALVND

SEQ ID NO: 2243946 - protein, 22 aa, Cryptosporidium parvum
ILIIGPCILYFISTSKWLFMQH

SEQ ID NO: 2243947 - protein, 18 aa, Cryptosporidium parvum
ILILNIYSIITRNIFKYF

SEQ ID NO: 2243948 - protein, 25 aa, Cryptosporidium parvum
ILILTIFFFINIVSKALINILIFGF

SEQ ID NO: 2243949 - protein, 29 aa, Cryptosporidium parvum
ILISLAILSISVFYFLYKKKEVISRENNS

SEQ ID NO: 2243950 - protein, 18 aa, Cryptosporidium parvum
ILITIIILYILIYIINKL

SEQ ID NO: 2243951 - protein, 19 aa, Cryptosporidium parvum
ILIVTYLTVLLLGTVLFFI

SEQ ID NO: 2243952 - protein, 26 aa, Cryptosporidium parvum
ILIYCKACIKTLNDPNFLLLEKQKEE

SEQ ID NO: 2243953 - protein, 17 aa, Cryptosporidium parvum
ILKIILFFTSFTITFLS

SEQ ID NO: 2243954 - protein, 18 aa, Cryptosporidium parvum
ILKPHPFVLNRSTKYGIL

SEQ ID NO: 2243955 - protein, 44 aa, Cryptosporidium parvum; identical to SEQ ID NO: 2131259

SEQ ID NO: 2243956 - protein, 17 aa, Cryptosporidium parvum
ILLCYSLLSLNLLNIEG

SEQ ID NO: 2243957 - protein, 17 aa, Cryptosporidium parvum
ILLEFACMLIITGGIII

SEQ ID NO: 2243958 - protein, 17 aa, Cryptosporidium parvum
ILLFGILMILITWGNPS

SEQ ID NO: 2243959 - protein, 24 aa, Cryptosporidium parvum
ILLFYSLEILFQGLLTRTKTFEYS

SEQ ID NO: 2243960 - protein, 48 aa, Cryptosporidium parvum; identical to SEQ ID NO: 2131262

SEQ ID NO: 2243961 - protein, 17 aa, Cryptosporidium parvum
ILLLFKQEKNFQMDSYF

SEQ ID NO: 2243962 - protein, 18 aa, Cryptosporidium parvum
ILLPCRHCISCESCLRSL

SEQ ID NO: 2243963 - protein, 20 aa, Cryptosporidium parvum
ILLQIYIVQKYVICSKLTHY

SEQ ID NO: 2243964 - protein, 17 aa, Cryptosporidium parvum
ILLSIYYIIRNKFNTNI

SEQ ID NO: 2243965 - protein, 25 aa, Cryptosporidium parvum
ILLTLEHWIPTRVNKLLLLDPFLLN

SEQ ID NO: 2243966 - protein, 18 aa, Cryptosporidium parvum
ILMQIKYFRAQLLESAQL

SEQ ID NO: 2243967 - protein, 17 aa, Cryptosporidium parvum
ILNFIFMNRFANNVNSY

SEQ ID NO: 2243968 - protein, 40 aa, Cryptosporidium parvum; identical to SEQ ID NO: 2131270

SEQ ID NO: 2243969 - protein, 18 aa, Cryptosporidium parvum
ILNILNLPEIYNYNKNIK

SEQ ID NO: 2243970 - protein, 17 aa, Cryptosporidium parvum
ILNKAISSIVPLTGPMD

SEQ ID NO: 2243971 - protein, 19 aa, Cryptosporidium parvum
ILNLIAQLLKKRNYLNLKP

SEQ ID NO: 2243972 - protein, 17 aa, Cryptosporidium parvum
ILNPMIISSITSLFSSI

SEQ ID NO: 2243973 - protein, 36 aa, Cryptosporidium parvum; identical to SEQ ID NO: 2131274

SEQ ID NO: 2243974 - protein, 24 aa, Cryptosporidium parvum
ILNYPQILHCILLIVLTNYSEYYS

SEQ ID NO: 2243975 - protein, 28 aa, Cryptosporidium parvum
ILPCHRSLRILIELPLALLHIFQLYPHF

SEQ ID NO: 2243976 - protein, 19 aa, Cryptosporidium parvum
ILPEQSLWEYVWGDVPVSH

SEQ ID NO: 2243977 - protein, 24 aa, Cryptosporidium parvum
ILPKYIIKKKLVFSNLNKLHLVWL

SEQ ID NO: 2243978 - protein, 17 aa, Cryptosporidium parvum
ILPLKIHVKNRYPVHFF

SEQ ID NO: 2243979 - protein, 19 aa, Cryptosporidium parvum
ILPSFWMMISCIFITFLGY

SEQ ID NO: 2243980 - protein, 29 aa, Cryptosporidium parvum
ILQALELIQICFFLLNGLNVLSVFEEQRL

SEQ ID NO: 2243981 - protein, 18 aa, Cryptosporidium parvum
ILQLKLLNCLIAFCKYLD

SEQ ID NO: 2243982 - protein, 24 aa, Cryptosporidium parvum
ILQQLYYIKNILKEPVRNVVFMGM

SEQ ID NO: 2243983 - protein, 20 aa, Cryptosporidium parvum
ILQSLEFILTIIFSLISEKE

SEQ ID NO: 2243984 - protein, 27 aa, Cryptosporidium parvum
ILQSPIFNEIPNFKGFLKSGSSLQDHD

SEQ ID NO: 2243985 - protein, 19 aa, Cryptosporidium parvum
ILQVLKFTGFYKIIANRMQ

SEQ ID NO: 2243986 - protein, 19 aa, Cryptosporidium parvum
ILQWMSYGGYLTNPVLSHY

SEQ ID NO: 2243987 - protein, 20 aa, Cryptosporidium parvum
ILQYYPIRPKKPSDLYFCEI

SEQ ID NO: 2243988 - protein, 18 aa, Cryptosporidium parvum
ILRCYYFFVAIVYEIIST

SEQ ID NO: 2243989 - protein, 17 aa, Cryptosporidium parvum
ILRIVILAVLDPRKLHS

SEQ ID NO: 2243990 - protein, 32 aa, Cryptosporidium parvum; identical to SEQ ID NO: 2131280

SEQ ID NO: 2243991 - protein, 17 aa, Cryptosporidium parvum
ILSAYFLFGIGSVFCLN

SEQ ID NO: 2243992 - protein, 19 aa, Cryptosporidium parvum
ILSILNSRHRSGILNFIFM

SEQ ID NO: 2243993 - protein, 23 aa, Cryptosporidium parvum
ILSNKRLLIGILYELELAFCGVI

SEQ ID NO: 2243994 - protein, 17 aa, Cryptosporidium parvum
ILSNLKYIYLQILSFIM

SEQ ID NO: 2243995 - protein, 21 aa, Cryptosporidium parvum
ILSNRISYIFGFQGPSFTIDS

SEQ ID NO: 2243996 - protein, 22 aa, Cryptosporidium parvum
ILTELLLPILKVSFEQGLLSQL

SEQ ID NO: 2243997 - protein, 17 aa, Cryptosporidium parvum
ILTFLLCMGTSILFLSL

SEQ ID NO: 2243998 - protein, 20 aa, Cryptosporidium parvum
ILTSGWIFIRCALGGPLLGF

SEQ ID NO: 2243999 - protein, 17 aa, Cryptosporidium parvum
ILVFDLNPYFDKIEITW

SEQ ID NO: 2244000 - protein, 18 aa, Cryptosporidium parvum
ILVIQSFLIIVIDSIIRL

SEQ ID NO: 2244001 - protein, 22 aa, Cryptosporidium parvum
ILVSFILFFLLKMNSCTGRRCG

SEQ ID NO: 2244002 - protein, 18 aa, Cryptosporidium parvum
ILWVYNTIKQYLIKILTF

SEQ ID NO: 2244003 - protein, 24 aa, Cryptosporidium parvum
ILYEKLFILLFASKNLEEYSITLF

SEQ ID NO: 2244004 - protein, 17 aa, Cryptosporidium parvum
ILYIIYSITSIIGCLVH

SEQ ID NO: 2244005 - protein, 31 aa, Cryptosporidium parvum
ILYKIKQPIGWMLYDPLLPIKFFGSEDETNY

SEQ ID NO: 2244006 - protein, 18 aa, Cryptosporidium parvum
ILYLFEFLGKIVGKAIYE

SEQ ID NO: 2244007 - protein, 23 aa, Cryptosporidium parvum
ILYLTIILLALFATPIFVPKYNK

SEQ ID NO: 2244008 - protein, 21 aa, Cryptosporidium parvum
ILYTFSFIRLSNIISILYSCC

SEQ ID NO: 2244009 - protein, 26 aa, Cryptosporidium parvum
IMAVILLIFSILVYPLCFSAIIYTHF

SEQ ID NO: 2244010 - protein, 17 aa, Cryptosporidium parvum
IMAVTLIRIPITTLTFI

SEQ ID NO: 2244011 - protein, 21 aa, Cryptosporidium parvum
IMDCMITIVRPFPYTLEMSLL

SEQ ID NO: 2244012 - protein, 30 aa, Cryptosporidium parvum
IMDINAWKMKAYYLLTHTLEYESALFCMEE

SEQ ID NO: 2244013 - protein, 37 aa, Cryptosporidium parvum
IMGNQKMAFLLRGFLLIKFIRWVIMKDPFNNVQLEIF

SEQ ID NO: 2244014 - protein, 27 aa, Cryptosporidium parvum
IMLEKLFSIYKCFLSISYQFSECLDEV

SEQ ID NO: 2244015 - protein, 36 aa, Cryptosporidium parvum
IMLLNCFIDFIQFRKLGPFSHLWFHRTTFANPKRNI

SEQ ID NO: 2244016 - protein, 17 aa, Cryptosporidium parvum
IMMSSCTSLLIILSNSS

SEQ ID NO: 2244017 - protein, 19 aa, Cryptosporidium parvum
IMNSLQLILPFFATSFYKN

SEQ ID NO: 2244018 - protein, 22 aa, Cryptosporidium parvum
IMQHSFILLFNLINIEIMEYVY

SEQ ID NO: 2244019 - protein, 23 aa, Cryptosporidium parvum
IMSCIFLCILLFNTVDKYTNFGK

SEQ ID NO: 2244020 - protein, 19 aa, Cryptosporidium parvum
IMSWYVLSKVLGSSSALPT

SEQ ID NO: 2244021 - protein, 30 aa, Cryptosporidium parvum
INAIECFIFPLRLIIAYFVLKDSLGSSTTI

SEQ ID NO: 2244022 - protein, 28 aa, Cryptosporidium parvum
INDLLPPFLVVFLLPFSPEGDIELLDIN

SEQ ID NO: 2244023 - protein, 25 aa, Cryptosporidium parvum
INEIFIQWNILRAGLKYILHQIKNN

SEQ ID NO: 2244024 - protein, 26 aa, Cryptosporidium parvum
INENCIILVLCLNGVRSYYISTVIQQ

SEQ ID NO: 2244025 - protein, 25 aa, Cryptosporidium parvum
INEVMYILDYFLQLPKHRADTKSKQ

SEQ ID NO: 2244026 - protein, 19 aa, Cryptosporidium parvum
INFINYMLIKDYVIRMGTY

SEQ ID NO: 2244027 - protein, 28 aa, Cryptosporidium parvum
INFKLSTLEYFFLKPHILDPLIYNSKKL

SEQ ID NO: 2244028 - protein, 28 aa, Cryptosporidium parvum
INFYSLFLIIIFILILGPGKIIIEDPDF

SEQ ID NO: 2244029 - protein, 22 aa, Cryptosporidium parvum
INGAIYYLKIAVALAVAAIPEG

SEQ ID NO: 2244030 - protein, 23 aa, Cryptosporidium parvum
INGIITLKYLITSATFIPLLEML

SEQ ID NO: 2244031 - protein, 33 aa, Cryptosporidium parvum
INGNLHTCYIPIYLYILGCFSIDCLALKKNNLN

SEQ ID NO: 2244032 - protein, 33 aa, Cryptosporidium parvum; identical to SEQ ID NO: 2131309

SEQ ID NO: 2244033 - protein, 18 aa, Cryptosporidium parvum
INHIIFNIDRFFLTLNLY

SEQ ID NO: 2244034 - protein, 27 aa, Cryptosporidium parvum
INICFDIFFYIFNWKSIPKMGMAIEMI

SEQ ID NO: 2244035 - protein, 28 aa, Cryptosporidium parvum
INICIEFCIFLILQKDWKLYKLTVYYQP

SEQ ID NO: 2244036 - protein, 17 aa, Cryptosporidium parvum
INIISYSSSFKLSKENI

SEQ ID NO: 2244037 - protein, 20 aa, Cryptosporidium parvum
INIQYLPSCIMISVGCPSKH

SEQ ID NO: 2244038 - protein, 17 aa, Cryptosporidium parvum
INKFKPFCFIEIPLINA

SEQ ID NO: 2244039 - protein, 23 aa, Cryptosporidium parvum
INKKWPIKLNLLLIDPEWVNSRK

SEQ ID NO: 2244040 - protein, 25 aa, Cryptosporidium parvum
INKYKFPVINISKFYPRPGTPAAKM

SEQ ID NO: 2244041 - protein, 23 aa, Cryptosporidium parvum
INLARALYYFLYIQKTNQENNKS

SEQ ID NO: 2244042 - protein, 23 aa, Cryptosporidium parvum
INLGHIPYKTLPLSIDNLYDIQV

SEQ ID NO: 2244043 - protein, 28 aa, Cryptosporidium parvum
INLIDTWRRYVFNYPKLKSYRKDTPYQV

SEQ ID NO: 2244044 - protein, 18 aa, Cryptosporidium parvum
INLLKNKTVILATNKLDI

SEQ ID NO: 2244045 - protein, 18 aa, Cryptosporidium parvum
INLNTFSNSLLKPIINMD

SEQ ID NO: 2244046 - protein, 28 aa, Cryptosporidium parvum
INLPKYPKYISMLYGFLAGLIGAQCVLE

SEQ ID NO: 2244047 - protein, 17 aa, Cryptosporidium parvum
INLSSFLPSLPNSNLQS

SEQ ID NO: 2244048 - protein, 26 aa, Cryptosporidium parvum
INLVIFTIIMIIKYKFQANMEEILSK

SEQ ID NO: 2244049 - protein, 20 aa, Cryptosporidium parvum
INMLIYNNRIIPTPKLNLVP

SEQ ID NO: 2244050 - protein, 28 aa, Cryptosporidium parvum
INMNMTWVWGFMRSLRMELSSKVKILLI

SEQ ID NO: 2244051 - protein, 17 aa, Cryptosporidium parvum
INNFKAWSIPDVTPKYV

SEQ ID NO: 2244052 - protein, 19 aa, Cryptosporidium parvum
INNGMIFFDSKRFILEIDK

SEQ ID NO: 2244053 - protein, 26 aa, Cryptosporidium parvum
INNGMQIYFHLINQIKLNYFQHKHHF

SEQ ID NO: 2244054 - protein, 27 aa, Cryptosporidium parvum
INNPTGFWLLFIPTFGSLTLASNSLLP

SEQ ID NO: 2244055 - protein, 42 aa, Cryptosporidium parvum
INNQKHFLLFLAYVFLFCAYSLILICLRFYKCISYPLPNPSD

SEQ ID NO: 2244056 - protein, 22 aa, Cryptosporidium parvum
INNRLLHNLKNYMKQNQLKHAL

SEQ ID NO: 2244057 - protein, 23 aa, Cryptosporidium parvum
INPIFVDRFILYSFISIEQFWIK

SEQ ID NO: 2244058 - protein, 24 aa, Cryptosporidium parvum
INQNIFLHLLSPIMEQLFIIIEPF

SEQ ID NO: 2244059 - protein, 30 aa, Cryptosporidium parvum
INQSKIILTFRKIILKLLNYEINSSGLILE

SEQ ID NO: 2244060 - protein, 20 aa, Cryptosporidium parvum
INRELALNDALFKVSFEYID

SEQ ID NO: 2244061 - protein, 17 aa, Cryptosporidium parvum
INRFGIVAVPSFRFFRN

SEQ ID NO: 2244062 - protein, 30 aa, Cryptosporidium parvum; identical to SEQ ID NO: 2131323

SEQ ID NO: 2244063 - protein, 18 aa, Cryptosporidium parvum
INSFSIQWGPWLGEGMAS

SEQ ID NO: 2244064 - protein, 17 aa, Cryptosporidium parvum
INSLLSEYLTLVKLVNR

SEQ ID NO: 2244065 - protein, 27 aa, Cryptosporidium parvum
INSNDCYLLFQRWFLYFVNACKNHDRD

SEQ ID NO: 2244066 - protein, 35 aa, Cryptosporidium parvum
INSNQRIHFLVSSYTLPIIWLLKSMNLSDSISIND

SEQ ID NO: 2244067 - protein, 31 aa, Cryptosporidium parvum
INSQLSSIILLWIINFLKLQKQLPCLKQIPK

SEQ ID NO: 2244068 - protein, 17 aa, Cryptosporidium parvum
INSRIFIGIACSILCLI

SEQ ID NO: 2244069 - protein, 26 aa, Cryptosporidium parvum
INSVYEFLVDWRFWFCPDSNMLETGE

SEQ ID NO: 2244070 - protein, 20 aa, Cryptosporidium parvum
INTTMYYLYTACHLACFLSN

SEQ ID NO: 2244071 - protein, 17 aa, Cryptosporidium parvum
INVFWPFVEGIGIRDLE

SEQ ID NO: 2244072 - protein, 27 aa, Cryptosporidium parvum
INVIISLFRRFWMKNDAIRFFNSLYII

SEQ ID NO: 2244073 - protein, 24 aa, Cryptosporidium parvum
INYYKKLYLRPWWHSEFVSQIDLE

SEQ ID NO: 2244074 - protein, 19 aa, Cryptosporidium parvum
IPAPRGPLFVLGNNFIRKY

SEQ ID NO: 2244075 - protein, 28 aa, Cryptosporidium parvum
IPEGLAPVQLLWVNLVTDGLPATALGFN

SEQ ID NO: 2244076 - protein, 26 aa, Cryptosporidium parvum
IPGLYHFMIQILFSEKFLEIEYNWNP

SEQ ID NO: 2244077 - protein, 39 aa, Cryptosporidium parvum
IPIDCEGFDLSWIPSNPLDVFCLYSLRPDTDPTRRGRLK

SEQ ID NO: 2244078 - protein, 23 aa, Cryptosporidium parvum
IPIKNKIKIYFKNRIKSLREKKL

SEQ ID NO: 2244079 - protein, 23 aa, Cryptosporidium parvum
IPILVILMLYYYKLGEFSMLIFI

SEQ ID NO: 2244080 - protein, 29 aa, Cryptosporidium parvum
IPISFVPVVRFCTWIVLLANIIPIALVVS

SEQ ID NO: 2244081 - protein, 28 aa, Cryptosporidium parvum
IPLDIACTAMWFISQRWDFCPLVFKQLM

SEQ ID NO: 2244082 - protein, 25 aa, Cryptosporidium parvum
IPLEYSNLLCSLPYEYNQIIQMIDN

SEQ ID NO: 2244083 - protein, 26 aa, Cryptosporidium parvum
IPLFTMALGILFFKHKYRLSQIPPVI

SEQ ID NO: 2244084 - protein, 27 aa, Cryptosporidium parvum
IPLIAYGFYVLLLQWSEKYTSLSMPVN

SEQ ID NO: 2244085 - protein, 20 aa, Cryptosporidium parvum
IPLKNVSLSILLFSICMTGL

SEQ ID NO: 2244086 - protein, 31 aa, Cryptosporidium parvum; identical to SEQ ID NO: 2131339

SEQ ID NO: 2244087 - protein, 19 aa, Cryptosporidium parvum
IPLNHKVLDLAVFCLSLMG

SEQ ID NO: 2244088 - protein, 26 aa, Cryptosporidium parvum
IPLPNYLIGMQFLQIVSYIFENHSMI

SEQ ID NO: 2244089 - protein, 25 aa, Cryptosporidium parvum
IPLRWISFFLFKWRLELDESFVGGP

SEQ ID NO: 2244090 - protein, 19 aa, Cryptosporidium parvum
IPLSMKFLKRNGTFIELGK

SEQ ID NO: 2244091 - protein, 17 aa, Cryptosporidium parvum
IPLYIMGDIFHVLKALY

SEQ ID NO: 2244092 - protein, 27 aa, Cryptosporidium parvum
IPMKTNILLIIWNITMNFFILFCIWME

SEQ ID NO: 2244093 - protein, 21 aa, Cryptosporidium parvum
IPNLFFGIELPKIIYQNNYSQ

SEQ ID NO: 2244094 - protein, 18 aa, Cryptosporidium parvum
IPNLYRYIALLLIELCSC

SEQ ID NO: 2244095 - protein, 24 aa, Cryptosporidium parvum
IPPGIEEGFPLLRKLEHISGIESS

SEQ ID NO: 2244096 - protein, 22 aa, Cryptosporidium parvum
IPSWFVGILTLPTLKEGISLIP

SEQ ID NO: 2244097 - protein, 25 aa, Cryptosporidium parvum
IPSYQFVILCNIISLRLYHIHVING

SEQ ID NO: 2244098 - protein, 34 aa, Cryptosporidium parvum
IPSYRRPLIFIYLLNVILFILRLTAFNSKPIFHN

SEQ ID NO: 2244099 - protein, 25 aa, Cryptosporidium parvum
IPTLALPLVFVLFVGAVKDGWEDLN

SEQ ID NO: 2244100 - protein, 26 aa, Cryptosporidium parvum
IPVETKLFLIFIIKTSLLGIQNTFFA

SEQ ID NO: 2244101 - protein, 20 aa, Cryptosporidium parvum
IPVQVLRYLSISPLIFVVLS

SEQ ID NO: 2244102 - protein, 22 aa, Cryptosporidium parvum
IPYSKIFYTYIFEPLFDNDQPN

SEQ ID NO: 2244103 - protein, 30 aa, Cryptosporidium parvum; identical to SEQ ID NO: 2131349

SEQ ID NO: 2244104 - protein, 18 aa, Cryptosporidium parvum
IQAFFVLFSLLLPNRIIH

SEQ ID NO: 2244105 - protein, 23 aa, Cryptosporidium parvum
IQAILNMIVFLFKNKTIGICSKV

SEQ ID NO: 2244106 - protein, 22 aa, Cryptosporidium parvum
IQALYIIPCILFLIAHSRFESQ

SEQ ID NO: 2244107 - protein, 17 aa, Cryptosporidium parvum
IQAYKQFIIYYGTKQLS

SEQ ID NO: 2244108 - protein, 27 aa, Cryptosporidium parvum
IQDHYNIPYLMYKPIILKQAISNSHGI

SEQ ID NO: 2244109 - protein, 24 aa, Cryptosporidium parvum
IQDRDFFINTFKKLILLSSNKISF

SEQ ID NO: 2244110 - protein, 25 aa, Cryptosporidium parvum
IQDSIYSIIRFLLNSLIDGYTQDAY

SEQ ID NO: 2244111 - protein, 27 aa, Cryptosporidium parvum
IQEFFRNEGIWKVIAKLSGYNLSNAEL

SEQ ID NO: 2244112 - protein, 21 aa, Cryptosporidium parvum
IQFIYGFIWIEIAGVSLSNAC

SEQ ID NO: 2244113 - protein, 23 aa, Cryptosporidium parvum
IQGFLIIFSLFVFVSIIIIPSFN

SEQ ID NO: 2244114 - protein, 23 aa, Cryptosporidium parvum
IQGFSLIYITLLSNKKIYAFYPD

SEQ ID NO: 2244115 - protein, 23 aa, Cryptosporidium parvum
IQIITIFNQFIPLLLIGDNNKKK

SEQ ID NO: 2244116 - protein, 40 aa, Cryptosporidium parvum
IQINNPRFIVYWDLYGIILNWIITFYFKSIAVHLERKIDI

SEQ ID NO: 2244117 - protein, 23 aa, Cryptosporidium parvum
IQIQNIFSFIISTMLGYYCVWDV

SEQ ID NO: 2244118 - protein, 26 aa, Cryptosporidium parvum
IQITSLFSWITIFVVVLFAISIINEA

SEQ ID NO: 2244119 - protein, 29 aa, Cryptosporidium parvum
IQIYDTEYLLYQFCLFNLCFKYTNNLNNN

SEQ ID NO: 2244120 - protein, 26 aa, Cryptosporidium parvum
IQKFIPFRFIKDCFISCIPVSYMDRS

SEQ ID NO: 2244121 - protein, 17 aa, Cryptosporidium parvum
IQKLLINIYYDLTLQEK

SEQ ID NO: 2244122 - protein, 25 aa, Cryptosporidium parvum
IQKWKLSLRFEKMMEFLILETKKRA

SEQ ID NO: 2244123 - protein, 31 aa, Cryptosporidium parvum; identical to SEQ ID NO: 2131361

SEQ ID NO: 2244124 - protein, 19 aa, Cryptosporidium parvum
IQMIIYFVQLKFGPKCLIP

SEQ ID NO: 2244125 - protein, 17 aa, Cryptosporidium parvum
IQNLLGHSFFSSSYISL

SEQ ID NO: 2244126 - protein, 18 aa, Cryptosporidium parvum
IQNLYPTDKIIFLKHLNY

SEQ ID NO: 2244127 - protein, 21 aa, Cryptosporidium parvum
IQNWIYYVLGPPLLNGHIADQ

SEQ ID NO: 2244128 - protein, 18 aa, Cryptosporidium parvum
IQQIFFLSTFWQSKKVWS

SEQ ID NO: 2244129 - protein, 25 aa, Cryptosporidium parvum
IQRLLLFTHYFLKRNEISILLIDEP

SEQ ID NO: 2244130 - protein, 23 aa, Cryptosporidium parvum
IQRSPFGFIIKPSGILRSKILNR

SEQ ID NO: 2244131 - protein, 27 aa, Cryptosporidium parvum
IQRVLFLTIFCPVLLFIRGIISGVQCI

SEQ ID NO: 2244132 - protein, 21 aa, Cryptosporidium parvum
IQSVFMLFTNYLKEEAKLVKA

SEQ ID NO: 2244133 - protein, 26 aa, Cryptosporidium parvum
IQVFGSKFSWRWFLPTMTRPPFTTSN

SEQ ID NO: 2244134 - protein, 19 aa, Cryptosporidium parvum
IQVIILNIILPIFLELFII

SEQ ID NO: 2244135 - protein, 28 aa, Cryptosporidium parvum
IQVIKQFFKAFLSNSFPLPALAIAYACN

SEQ ID NO: 2244136 - protein, 19 aa, Cryptosporidium parvum
IQVMEIIRFNFLSDSAKNV

SEQ ID NO: 2244137 - protein, 28 aa, Cryptosporidium parvum
IRDDKFFRNITLLNYLKLLFQNGLVVSK

SEQ ID NO: 2244138 - protein, 18 aa, Cryptosporidium parvum
IRDLVYIFKLEAGNSDIS

SEQ ID NO: 2244139 - protein, 22 aa, Cryptosporidium parvum
IREEIRTLMRYQEFLRLDFTVM

SEQ ID NO: 2244140 - protein, 22 aa, Cryptosporidium parvum
IREIALYPPIFSKQLIPPVSNN

SEQ ID NO: 2244141 - protein, 19 aa, Cryptosporidium parvum
IRENILFGAPFDPEWYAQV

SEQ ID NO: 2244142 - protein, 18 aa, Cryptosporidium parvum
IRFDTLLNLLTTFNLNKA

SEQ ID NO: 2244143 - protein, 24 aa, Cryptosporidium parvum
IRFEGVKALRLGWAPTLIGYSAQG

SEQ ID NO: 2244144 - protein, 44 aa, Cryptosporidium parvum; identical to SEQ ID NO: 2131369

SEQ ID NO: 2244145 - protein, 27 aa, Cryptosporidium parvum
IRFRFFTLLFTFILFTLAHSFIMVLNL

SEQ ID NO: 2244146 - protein, 31 aa, Cryptosporidium parvum; identical to SEQ ID NO: 2131370

SEQ ID NO: 2244147 - protein, 23 aa, Cryptosporidium parvum
IRGPKVISLYFPSNVNFLEVVID

SEQ ID NO: 2244148 - protein, 23 aa, Cryptosporidium parvum
IRHPGIINVSFLWPAVDCEPSPT

SEQ ID NO: 2244149 - protein, 25 aa, Cryptosporidium parvum
IRISHFSVILLWISSAVLVQLLPNQ

SEQ ID NO: 2244150 - protein, 25 aa, Cryptosporidium parvum
IRKNAIIPIYYKRPVQKVPLEEKLT

SEQ ID NO: 2244151 - protein, 30 aa, Cryptosporidium parvum
IRKSIYMLTFNIILKIKYSSYFLALNQILR

SEQ ID NO: 2244152 - protein, 27 aa, Cryptosporidium parvum
IRLEVLLNSFLLKRLLIFGKLEENQDD

SEQ ID NO: 2244153 - protein, 19 aa, Cryptosporidium parvum
IRLMVDPRIFSLSSGHILV

SEQ ID NO: 2244154 - protein, 18 aa, Cryptosporidium parvum
IRLNFMKYFLNVNKEIEL

SEQ ID NO: 2244155 - protein, 25 aa, Cryptosporidium parvum
IRNDDFFLFLKSIVDFCIIEEDLKN

SEQ ID NO: 2244156 - protein, 18 aa, Cryptosporidium parvum
IRNIILLSRSGLPSKRCE

SEQ ID NO: 2244157 - protein, 19 aa, Cryptosporidium parvum
IRNILIFYSIFVCGTLAMV

SEQ ID NO: 2244158 - protein, 22 aa, Cryptosporidium parvum
IRPREYYVSNILLYYYMKKLSI

SEQ ID NO: 2244159 - protein, 18 aa, Cryptosporidium parvum
IRQILFNAISIILTNRIK

SEQ ID NO: 2244160 - protein, 34 aa, Cryptosporidium parvum
IRQLTSIFSLPLLSSWFGLQWTKNQLWSKDILPM

SEQ ID NO: 2244161 - protein, 25 aa, Cryptosporidium parvum
IRSNGARALFRGFPAVVFGNVPAHA

SEQ ID NO: 2244162 - protein, 35 aa, Cryptosporidium parvum
IRSRFSFSSYFWYFKLIGPKWMIVFTLGCVIKVII

SEQ ID NO: 2244163 - protein, 18 aa, Cryptosporidium parvum
IRYDLTTSILPKDYTRRI

SEQ ID NO: 2244164 - protein, 25 aa, Cryptosporidium parvum
IRYLDLLIHYDDCPIIWKSMPFHIY

SEQ ID NO: 2244165 - protein, 18 aa, Cryptosporidium parvum
IRYVPYLIFGISNSELET

SEQ ID NO: 2244166 - protein, 19 aa, Cryptosporidium parvum
ISAFPDSVWSYAYSCVYIL

SEQ ID NO: 2244167 - protein, 24 aa, Cryptosporidium parvum
ISAITNMIFSFIDDIIFEILYGWR

SEQ ID NO: 2244168 - protein, 35 aa, Cryptosporidium parvum
ISANAIRISMRILLLFLFALIFSISSINGSNLSES

SEQ ID NO: 2244169 - protein, 24 aa, Cryptosporidium parvum
ISAPTWLLVLYFRGSKKKIRPIVL

SEQ ID NO: 2244170 - protein, 19 aa, Cryptosporidium parvum
ISDLLLPYSIKQLIIEKEE

SEQ ID NO: 2244171 - protein, 27 aa, Cryptosporidium parvum
ISDLMRSLDIFIFKTIINKCYKNLLDD

SEQ ID NO: 2244172 - protein, 24 aa, Cryptosporidium parvum
ISDNNFVKLYLKSSIQRMFGIWRE

SEQ ID NO: 2244173 - protein, 34 aa, Cryptosporidium parvum
ISEERFLYGDYFKYAYVLFSWLTRVLYKQNRRRS

SEQ ID NO: 2244174 - protein, 25 aa, Cryptosporidium parvum
ISEFQHWRLFWDAFSFMPPCSAQQV

SEQ ID NO: 2244175 - protein, 22 aa, Cryptosporidium parvum
ISELIIGLYLFDSNETSWILLI

SEQ ID NO: 2244176 - protein, 27 aa, Cryptosporidium parvum
ISESDYKLFFRFLKARQFNVEKSTEML

SEQ ID NO: 2244177 - protein, 35 aa, Cryptosporidium parvum; identical to SEQ ID NO: 2131390

SEQ ID NO: 2244178 - protein, 23 aa, Cryptosporidium parvum
ISFAFIFIILSINGGGKLYRVAS

SEQ ID NO: 2244179 - protein, 34 aa, Cryptosporidium parvum
ISFCYRFVRIWLDFPTILLPIPLQWAKLSNISQK

SEQ ID NO: 2244180 - protein, 17 aa, Cryptosporidium parvum
ISFFWVTPYFCERILFK

SEQ ID NO: 2244181 - protein, 19 aa, Cryptosporidium parvum
ISFFYYLYGWEFLYETYLY

SEQ ID NO: 2244182 - protein, 17 aa, Cryptosporidium parvum
ISFKIESIKKLCKVWLL

SEQ ID NO: 2244183 - protein, 33 aa, Cryptosporidium parvum
ISGRVISIFLVIFGFIQFLKFKGPKAATKPLLD

SEQ ID NO: 2244184 - protein, 26 aa, Cryptosporidium parvum
ISGSLYWLVLYILAIPLSFIFLMFRT

SEQ ID NO: 2244185 - protein, 27 aa, Cryptosporidium parvum
ISGVDPRWITPLIQGYFCNQAIIISPE

SEQ ID NO: 2244186 - protein, 19 aa, Cryptosporidium parvum
ISGYNIGYGGILVPIYIAK

SEQ ID NO: 2244187 - protein, 22 aa, Cryptosporidium parvum
ISIFPARLFKKITRGLFNNVSK

SEQ ID NO: 2244188 - protein, 18 aa, Cryptosporidium parvum
ISIFPGEIPGAALLRKRV

SEQ ID NO: 2244189 - protein, 26 aa, Cryptosporidium parvum
ISIFSFELLYYIFLKNERFPVKTYKN

SEQ ID NO: 2244190 - protein, 26 aa, Cryptosporidium parvum
ISIIFSILHIKLFLSGRSHIGFFQSR

SEQ ID NO: 2244191 - protein, 24 aa, Cryptosporidium parvum
ISIILFYIDIFQSFPYVNLRENQH

SEQ ID NO: 2244192 - protein, 22 aa, Cryptosporidium parvum
ISIIQIIYCLLIRTTYPIDSLI

SEQ ID NO: 2244193 - protein, 26 aa, Cryptosporidium parvum
ISIPHIVFFQYRYIFRIYSSLATNIL

SEQ ID NO: 2244194 - protein, 22 aa, Cryptosporidium parvum
ISIPYSNILRPGSSSPLVVEID

SEQ ID NO: 2244195 - protein, 25 aa, Cryptosporidium parvum
ISIVFMIFCIINLFCKYKLNKEIFL

SEQ ID NO: 2244196 - protein, 21 aa, Cryptosporidium parvum
ISKCYFYFLFENKSSDSGGRS

SEQ ID NO: 2244197 - protein, 26 aa, Cryptosporidium parvum
ISKFTRKLFYLPGKLLLTIGNHYFVI

SEQ ID NO: 2244198 - protein, 19 aa, Cryptosporidium parvum
ISKIFPELVCRKGHDIIVE

SEQ ID NO: 2244199 - protein, 62 aa, Cryptosporidium parvum
ISLAIFNNIFKLFLLIIPNLLFQFYCEWSWTLLQLLDIVSLYIIFWTVLLPVFYGIYGVDVP

SEQ ID NO: 2244200 - protein, 19 aa, Cryptosporidium parvum
ISLARALYSLPIRYSAFSK

SEQ ID NO: 2244201 - protein, 23 aa, Cryptosporidium parvum
ISLFIILCYWHTLNIFQFMYIFT

SEQ ID NO: 2244202 - protein, 17 aa, Cryptosporidium parvum
ISLFTFLGTSRNISIAD

SEQ ID NO: 2244203 - protein, 23 aa, Cryptosporidium parvum
ISLIIPYFFVKLIFTILSITHIY

SEQ ID NO: 2244204 - protein, 27 aa, Cryptosporidium parvum
ISLILTIMVLLYNFLGDKPFMSKFTRI

SEQ ID NO: 2244205 - protein, 26 aa, Cryptosporidium parvum
ISLLILYFLIFLGNVKSSPTVTKKDD

SEQ ID NO: 2244206 - protein, 25 aa, Cryptosporidium parvum
ISLNNQLLKQLPIIKIQNLLFKNDI

SEQ ID NO: 2244207 - protein, 24 aa, Cryptosporidium parvum
ISLSELILLIKVDDLNISISPPLL

SEQ ID NO: 2244208 - protein, 36 aa, Cryptosporidium parvum
ISMELTPLFLLKISIFCWYFFEKLERWLSTFDQVIL

SEQ ID NO: 2244209 - protein, 20 aa, Cryptosporidium parvum
ISMIAFLQKAIIPNAKILIL

SEQ ID NO: 2244210 - protein, 21 aa, Cryptosporidium parvum
ISMIVFMIILDIISALLKGPL

SEQ ID NO: 2244211 - protein, 36 aa, Cryptosporidium parvum
ISMNIFPAIMTLINGYELLIFPKKSPLIDLKRTFEN

SEQ ID NO: 2244212 - protein, 20 aa, Cryptosporidium parvum
ISMPIFLGLMRVPFSQAVTF

SEQ ID NO: 2244213 - protein, 23 aa, Cryptosporidium parvum
ISNKQILNLFFNIGYFAQLSIQN

SEQ ID NO: 2244214 - protein, 22 aa, Cryptosporidium parvum
ISNRIIGILSISGSIFIGIFIW

SEQ ID NO: 2244215 - protein, 18 aa, Cryptosporidium parvum
ISNRISYVFGLKGPSITI

SEQ ID NO: 2244216 - protein, 18 aa, Cryptosporidium parvum
ISNRLSFIYGIKGPSVTI

SEQ ID NO: 2244217 - protein, 28 aa, Cryptosporidium parvum
ISNSRCVYFFFIQLNFQLIANVYALIAS

SEQ ID NO: 2244218 - protein, 18 aa, Cryptosporidium parvum
ISNTLIASLPGLGFGLTP

SEQ ID NO: 2244219 - protein, 28 aa, Cryptosporidium parvum
ISNVSQFLFGFIVGFYRGWKMALVMSAS

SEQ ID NO: 2244220 - protein, 24 aa, Cryptosporidium parvum
ISPDLLNLFFFTVYLNSCKSLIFE

SEQ ID NO: 2244221 - protein, 26 aa, Cryptosporidium parvum
ISPLTPLFIHMLLGVVVSYMIISVRT

SEQ ID NO: 2244222 - protein, 21 aa, Cryptosporidium parvum
ISPLYIGFMKKSRPEWFVLQT

SEQ ID NO: 2244223 - protein, 23 aa, Cryptosporidium parvum
ISPNLIAFQLTLIAGLQVFCIHQ

SEQ ID NO: 2244224 - protein, 24 aa, Cryptosporidium parvum
ISPQNKCIPPFLDSMIMLRNDGSP

SEQ ID NO: 2244225 - protein, 26 aa, Cryptosporidium parvum
ISPWTIRTILRHYGAWNTRGCLLSSS

SEQ ID NO: 2244226 - protein, 24 aa, Cryptosporidium parvum
ISPYFFQVSVIFLGLLQDELFLKV

SEQ ID NO: 2244227 - protein, 21 aa, Cryptosporidium parvum
ISQIPLIKYSKLGIIVRIHAS

SEQ ID NO: 2244228 - protein, 33 aa, Cryptosporidium parvum; identical to SEQ ID NO: 2131421

SEQ ID NO: 2244229 - protein, 19 aa, Cryptosporidium parvum
ISQLQLWFPQTIASLRSHF

SEQ ID NO: 2244230 - protein, 25 aa, Cryptosporidium parvum
ISQPITLQIHYPHVLDLYDVLLSMQ

SEQ ID NO: 2244231 - protein, 33 aa, Cryptosporidium parvum
ISQTIRDYFNYKLFWKYYINIEYLEITRPKWIP

SEQ ID NO: 2244232 - protein, 20 aa, Cryptosporidium parvum
ISQYKLWTSVYIFDGQNHIG

SEQ ID NO: 2244233 - protein, 18 aa, Cryptosporidium parvum
ISQYYLLGIPICSKDIAR

SEQ ID NO: 2244234 - protein, 27 aa, Cryptosporidium parvum
ISSATLFINLMIKYEFLWQSWKNNNCV

SEQ ID NO: 2244235 - protein, 23 aa, Cryptosporidium parvum
ISSGFAILYFNSAIPWYDENSRK

SEQ ID NO: 2244236 - protein, 25 aa, Cryptosporidium parvum
ISSHPLYIVFLIVEIIIQSETKLFD

SEQ ID NO: 2244237 - protein, 30 aa, Cryptosporidium parvum; identical to SEQ ID NO: 2191653

SEQ ID NO: 2244238 - protein, 20 aa, Cryptosporidium parvum
ISSLYMFSTVLFKSFFDCHS

SEQ ID NO: 2244239 - protein, 24 aa, Cryptosporidium parvum
ISSNLTLQIFKNLNYKILDCDIKL

SEQ ID NO: 2244240 - protein, 19 aa, Cryptosporidium parvum
ISSPIISVILALYHFHSLS

SEQ ID NO: 2244241 - protein, 28 aa, Cryptosporidium parvum
ISSRVMFALHFSLSILAISCPCVIGITV

SEQ ID NO: 2244242 - protein, 18 aa, Cryptosporidium parvum
ISSSDLLLLLISYSYPDV

SEQ ID NO: 2244243 - protein, 19 aa, Cryptosporidium parvum
ISTELFQHLYTSEVFMLMA

SEQ ID NO: 2244244 - protein, 29 aa, Cryptosporidium parvum
ISTFIELSFIPMIITTLIFGLIVYIKRIN

SEQ ID NO: 2244245 - protein, 33 aa, Cryptosporidium parvum
ISTLLPVVTLLLFSWLLFPGAISSVLMFPYNVY

SEQ ID NO: 2244246 - protein, 39 aa, Cryptosporidium parvum
ISTWIAGFIVTFLSLFLQPLVLALSYSIILLLSKKTSSF

SEQ ID NO: 2244247 - protein, 18 aa, Cryptosporidium parvum
ISVILALYHFHSLSSIFN

SEQ ID NO: 2244248 - protein, 18 aa, Cryptosporidium parvum
ISVILEYMEPLILLHEQN

SEQ ID NO: 2244249 - protein, 25 aa, Cryptosporidium parvum
ISVIRSIYHAFKNKSTQRLLIQAIE

SEQ ID NO: 2244250 - protein, 21 aa, Cryptosporidium parvum
ISVISLNGLFYLIVNNRLNEG

SEQ ID NO: 2244251 - protein, 20 aa, Cryptosporidium parvum
ISVPGLLKTIPKYGNNFNKE

SEQ ID NO: 2244252 - protein, 17 aa, Cryptosporidium parvum
ISVWYISVVFLSAMLIV

SEQ ID NO: 2244253 - protein, 24 aa, Cryptosporidium parvum
ISWGPILLYKLIKKTIHPPRYYKL

SEQ ID NO: 2244254 - protein, 22 aa, Cryptosporidium parvum
ISWQLFKELMLCSPLITGTTGA

SEQ ID NO: 2244255 - protein, 23 aa, Cryptosporidium parvum
ISYFPQVLIYLSFIRIICFPITE

SEQ ID NO: 2244256 - protein, 26 aa, Cryptosporidium parvum
ISYKNLLIIFLSFISLLSATPIKGML

SEQ ID NO: 2244257 - protein, 23 aa, Cryptosporidium parvum
ITAIKRGFDKKVIFSLLLPEIKA

SEQ ID NO: 2244258 - protein, 23 aa, Cryptosporidium parvum
ITALRMVFAYVHLFDGVILGIYL

SEQ ID NO: 2244259 - protein, 26 aa, Cryptosporidium parvum
ITATYQLLYFLPISALVVVLSKGRVH

SEQ ID NO: 2244260 - protein, 20 aa, Cryptosporidium parvum
ITCPNLENIFLPLSEYYVIS

SEQ ID NO: 2244261 - protein, 26 aa, Cryptosporidium parvum
ITCTRKYFVLGYLKSSLFLSNIVKHK

SEQ ID NO: 2244262 - protein, 25 aa, Cryptosporidium parvum
ITEMNSLLFLKINLGFNPQTLIDQV

SEQ ID NO: 2244263 - protein, 23 aa, Cryptosporidium parvum
ITESYLYRFCFNATLAVLIESII

SEQ ID NO: 2244264 - protein, 29 aa, Cryptosporidium parvum
ITFMLSCITLLYLLLERYLEKCISRKNSH

SEQ ID NO: 2244265 - protein, 26 aa, Cryptosporidium parvum
ITFQGGIVHLLMSILGRWIFNHQLNI

SEQ ID NO: 2244266 - protein, 26 aa, Cryptosporidium parvum
ITISLWAYITLVLQFLTITGVYRRQV

SEQ ID NO: 2244267 - protein, 27 aa, Cryptosporidium parvum
ITKKIAAYILNQIFLMLGYSSYKFSIN

SEQ ID NO: 2244268 - protein, 26 aa, Cryptosporidium parvum
ITLKQYVLLSFGLLLGLFVHLLSVYD

SEQ ID NO: 2244269 - protein, 35 aa, Cryptosporidium parvum
ITLQKLNVRPILFLWIFFLISMVYTFSIFLDEYIV

SEQ ID NO: 2244270 - protein, 17 aa, Cryptosporidium parvum
ITLVKHLKNFNPEINLL

SEQ ID NO: 2244271 - protein, 18 aa, Cryptosporidium parvum
ITLYLYSTPANINKGGYG

SEQ ID NO: 2244272 - protein, 28 aa, Cryptosporidium parvum
ITMQTVFFPLTLIHFITSKFKVSHFHFE

SEQ ID NO: 2244273 - protein, 22 aa, Cryptosporidium parvum
ITPIWFLYYPLNIVYTIICAVI

SEQ ID NO: 2244274 - protein, 25 aa, Cryptosporidium parvum
ITQHFQAFQIVPIIKNIWENNRKIF

SEQ ID NO: 2244275 - protein, 17 aa, Cryptosporidium parvum
ITQTTCILGLIHLLRKL

SEQ ID NO: 2244276 - protein, 31 aa, Cryptosporidium parvum
ITRFNYIYCFIHYLLHILSRIGMSHFYISFK

SEQ ID NO: 2244277 - protein, 27 aa, Cryptosporidium parvum
ITSASKLLLFNYLKLNSMKTTLIHNYG

SEQ ID NO: 2244278 - protein, 17 aa, Cryptosporidium parvum
ITSRRIVFSSELISNLT

SEQ ID NO: 2244279 - protein, 24 aa, Cryptosporidium parvum
ITVYIIYHITVLNLYPSIYTVNKE

SEQ ID NO: 2244280 - protein, 17 aa, Cryptosporidium parvum
ITYLLLFIIENWLPKIV

SEQ ID NO: 2244281 - protein, 35 aa, Cryptosporidium parvum; identical to SEQ ID NO: 2131454

SEQ ID NO: 2244282 - protein, 31 aa, Cryptosporidium parvum; identical to SEQ ID NO: 2131455

SEQ ID NO: 2244283 - protein, 23 aa, Cryptosporidium parvum
IVAKYIRVHFPQAGNFSNMTMVK

SEQ ID NO: 2244284 - protein, 39 aa, Cryptosporidium parvum; identical to SEQ ID NO: 2131457

SEQ ID NO: 2244285 - protein, 19 aa, Cryptosporidium parvum
IVCHGNVIRYMFCKGLQYP

SEQ ID NO: 2244286 - protein, 19 aa, Cryptosporidium parvum
IVEHILYWNYIFNHSNDNN

SEQ ID NO: 2244287 - protein, 19 aa, Cryptosporidium parvum
IVFDEFVNFFLINLTKHEP

SEQ ID NO: 2244288 - protein, 36 aa, Cryptosporidium parvum
IVFMMTNFIAIMSCYFLFIGLFEYNTRSVTFLLKSS

SEQ ID NO: 2244289 - protein, 26 aa, Cryptosporidium parvum
IVGGSFFPLWAPIRYIPAFMAERHRK

SEQ ID NO: 2244290 - protein, 26 aa, Cryptosporidium parvum
IVGIFTLIVFLIISFTCQIIASTYKA

SEQ ID NO: 2244291 - protein, 17 aa, Cryptosporidium parvum
IVGVNWIRNQLPFPNVI

SEQ ID NO: 2244292 - protein, 25 aa, Cryptosporidium parvum
IVHLILYPVRFGFFGYIFFNSNWNT

SEQ ID NO: 2244293 - protein, 17 aa, Cryptosporidium parvum
IVIIISSLVQIPLCWIL

SEQ ID NO: 2244294 - protein, 39 aa, Cryptosporidium parvum; identical to SEQ ID NO: 2131462

SEQ ID NO: 2244295 - protein, 47 aa, Cryptosporidium parvum
IVITICSILHFMLPISFMSILIYSITSISFYIILVPSMLMPIPNETQ

SEQ ID NO: 2244296 - protein, 26 aa, Cryptosporidium parvum
IVKLHKQFVIFLNKIDPKKNTVHLEE

SEQ ID NO: 2244297 - protein, 24 aa, Cryptosporidium parvum
IVLCSGIFEWYTPLSLNSTIVEIY

SEQ ID NO: 2244298 - protein, 22 aa, Cryptosporidium parvum
IVLERFPVIIFGLIEDIFKEGI

SEQ ID NO: 2244299 - protein, 17 aa, Cryptosporidium parvum
IVLEYIWEYFINGNTMI

SEQ ID NO: 2244300 - protein, 30 aa, Cryptosporidium parvum
IVLFGEFTIWYLNGFLRACLFRKLNYNIQN

SEQ ID NO: 2244301 - protein, 17 aa, Cryptosporidium parvum
IVLFITNKSFPINDNEI

SEQ ID NO: 2244302 - protein, 24 aa, Cryptosporidium parvum
IVLFLIIFFYISSFLCVSSDSKNK

SEQ ID NO: 2244303 - protein, 18 aa, Cryptosporidium parvum
IVLILINPLLFLDNSLTF

SEQ ID NO: 2244304 - protein, 28 aa, Cryptosporidium parvum
IVLLITEIILFQLVAYIFAARVLSTLDL

SEQ ID NO: 2244305 - protein, 26 aa, Cryptosporidium parvum
IVLLVISCFTLFTFAKSHRIKTSNSI

SEQ ID NO: 2244306 - protein, 27 aa, Cryptosporidium parvum
IVLLVRCVLGYIWSYYKVIFLSNESVQ

SEQ ID NO: 2244307 - protein, 17 aa, Cryptosporidium parvum
IVLYAMYILIISIEWCA

SEQ ID NO: 2244308 - protein, 17 aa, Cryptosporidium parvum
IVMLVFVTPLLLALFPF

SEQ ID NO: 2244309 - protein, 25 aa, Cryptosporidium parvum
IVNKWLPFDKSLYSAFGVLTYDDIQ

SEQ ID NO: 2244310 - protein, 20 aa, Cryptosporidium parvum
IVNNLLSEILPILGSFSISH

SEQ ID NO: 2244311 - protein, 24 aa, Cryptosporidium parvum
IVRIFSFFIFFSYASCIYSTAYCY

SEQ ID NO: 2244312 - protein, 26 aa, Cryptosporidium parvum
IVRLKALLTALLTVFRTSSGIIFSYE

SEQ ID NO: 2244313 - protein, 23 aa, Cryptosporidium parvum
IVSCFLLGIIVYYSFKDVEILNS

SEQ ID NO: 2244314 - protein, 26 aa, Cryptosporidium parvum
IVSIALIIIIVVFGLVVWKKVKDIEK

SEQ ID NO: 2244315 - protein, 27 aa, Cryptosporidium parvum
IVSSPIEFYWDKPTILYLIDCIKSYQT

SEQ ID NO: 2244316 - protein, 17 aa, Cryptosporidium parvum
IVTTFRPQILQVADKYF

SEQ ID NO: 2244317 - protein, 38 aa, Cryptosporidium parvum
IVYNPTWDFFMSLPFPIPYLLILSVLHLIIIHTTFIAS

SEQ ID NO: 2244318 - protein, 17 aa, Cryptosporidium parvum
IWDTLDKLSTRLYEKFK

SEQ ID NO: 2244319 - protein, 30 aa, Cryptosporidium parvum
IWEPDVFIYILLIIFYILSHITSTLLVRNG

SEQ ID NO: 2244320 - protein, 25 aa, Cryptosporidium parvum
IWEPNLPFIFGEIRKIFLMEFIRRI

SEQ ID NO: 2244321 - protein, 18 aa, Cryptosporidium parvum
IWLHLKPSDTKNPKEDTN

SEQ ID NO: 2244322 - protein, 18 aa, Cryptosporidium parvum
IWLKVISKYRIAATAAPN

SEQ ID NO: 2244323 - protein, 27 aa, Cryptosporidium parvum
IWRITISLILFIFFCGISIILGTVPSF

SEQ ID NO: 2244324 - protein, 32 aa, Cryptosporidium parvum; identical to SEQ ID NO: 2131479

SEQ ID NO: 2244325 - protein, 18 aa, Cryptosporidium parvum
IYCTEPFRIPFAGKLRIC

SEQ ID NO: 2244326 - protein, 24 aa, Cryptosporidium parvum
IYDFHSIVALLQPKKLISLLDCFF

SEQ ID NO: 2244327 - protein, 30 aa, Cryptosporidium parvum; identical to SEQ ID NO: 2131480

SEQ ID NO: 2244328 - protein, 19 aa, Cryptosporidium parvum
IYEESFNILYYLTSGGKDN

SEQ ID NO: 2244329 - protein, 20 aa, Cryptosporidium parvum
IYEICFSIIINVLKLNSVNK

SEQ ID NO: 2244330 - protein, 22 aa, Cryptosporidium parvum
IYFMEFQRKLIDPIFHGSFDPI

SEQ ID NO: 2244331 - protein, 18 aa, Cryptosporidium parvum
IYFMGKILILTSKMTNFL

SEQ ID NO: 2244332 - protein, 25 aa, Cryptosporidium parvum
IYHNLIINFNILLKHSAHFIISVAN

SEQ ID NO: 2244333 - protein, 18 aa, Cryptosporidium parvum
IYHRKNILMLIATVFGIF

SEQ ID NO: 2244334 - protein, 24 aa, Cryptosporidium parvum
IYIEKLNKLIKPSSSRRLVIVELI

SEQ ID NO: 2244335 - protein, 18 aa, Cryptosporidium parvum
IYIHLFMTLGQILIVLPT

SEQ ID NO: 2244336 - protein, 28 aa, Cryptosporidium parvum
IYIMNKLLFAIILVSYIYKFANCFISSF

SEQ ID NO: 2244337 - protein, 33 aa, Cryptosporidium parvum
IYIPSAVRYIILLLLWTIFTKNVYSKSSEETLL

SEQ ID NO: 2244338 - protein, 30 aa, Cryptosporidium parvum
IYKFKWVLIYLILLIFSAYIQLNCVGCYEV

SEQ ID NO: 2244339 - protein, 23 aa, Cryptosporidium parvum
IYKHCIIICLLNYYKYIKKTTLI

SEQ ID NO: 2244340 - protein, 26 aa, Cryptosporidium parvum
IYKPKRWFHAFSPRYLSFGFISPYMK

SEQ ID NO: 2244341 - protein, 22 aa, Cryptosporidium parvum
IYLIIYGIVSTLFWATTLYFTI

SEQ ID NO: 2244342 - protein, 17 aa, Cryptosporidium parvum
IYLLFFEDYRITKIMTN

SEQ ID NO: 2244343 - protein, 45 aa, Cryptosporidium parvum
IYNGTQVLTLMFFISVIIFGLFILAIALIPRYAKRFGFKSRRDEV

SEQ ID NO: 2244344 - protein, 26 aa, Cryptosporidium parvum
IYPSLSRVLFLIFNYSNIILKHGIVQ

SEQ ID NO: 2244345 - protein, 19 aa, Cryptosporidium parvum
IYRQKIFPFQLSPNISLVA

SEQ ID NO: 2244346 - protein, 22 aa, Cryptosporidium parvum
IYSFEFPVIYQFQLILEDIAVS

SEQ ID NO: 2244347 - protein, 18 aa, Cryptosporidium parvum
IYSFIYLIEAGSGTLGEA

SEQ ID NO: 2244348 - protein, 25 aa, Cryptosporidium parvum
IYSILYLIYLIQPKILVPQLIRNDH

SEQ ID NO: 2244349 - protein, 17 aa, Cryptosporidium parvum
IYSLPNHRLLKTLVPIT

SEQ ID NO: 2244350 - protein, 20 aa, Cryptosporidium parvum
IYSTAFLIILENWNLNMFEL

SEQ ID NO: 2244351 - protein, 31 aa, Cryptosporidium parvum
IYTERILHSAFWISLYRLSFIPSKNNIHYLY

SEQ ID NO: 2244352 - protein, 17 aa, Cryptosporidium parvum
IYVFLSSVLFEPAFVSM

SEQ ID NO: 2244353 - protein, 21 aa, Cryptosporidium parvum
IYVNILNGIWWIGLGFLSSVG

SEQ ID NO: 2244354 - protein, 27 aa, Cryptosporidium parvum
IYVTRKRPLIVYFRRAMNLLTVSEAHN

SEQ ID NO: 2244355 - protein, 23 aa, Cryptosporidium parvum
IYYNSIYFNLLEISINLICACFS

SEQ ID NO: 2244356 - protein, 18 aa, Cryptosporidium parvum
IYYVFFEYYIFDDYVIGS

SEQ ID NO: 2244357 - protein, 27 aa, Cryptosporidium parvum
KAALPTVVCPEPFVFDASLKMCIQDQI

SEQ ID NO: 2244358 - protein, 38 aa, Cryptosporidium parvum
KADVIMRLMCNFTFRLFACLFFIVVVILGIMFGKNVNT

SEQ ID NO: 2244359 - protein, 24 aa, Cryptosporidium parvum
KAESILTRFRAFVAISVILEYMEP

SEQ ID NO: 2244360 - protein, 32 aa, Cryptosporidium parvum
KAFKEDYCRYVILTFLLIALDAFVKYKGILFI

SEQ ID NO: 2244361 - protein, 25 aa, Cryptosporidium parvum
KAFSTQVLVLSLIAAWFAQNRDSVI

SEQ ID NO: 2244362 - protein, 24 aa, Cryptosporidium parvum
KAIWFLSCNLLIGMISFISLGLIS

SEQ ID NO: 2244363 - protein, 23 aa, Cryptosporidium parvum
KAKFFTNTLSSCLLLLLSNITQN

SEQ ID NO: 2244364 - protein, 23 aa, Cryptosporidium parvum
KAKFSNFLYTRLYSNGLVEVNLP

SEQ ID NO: 2244365 - protein, 34 aa, Cryptosporidium parvum
KAKPNKKFISFLTLLIFIIYILEFNSTLANSFEE

SEQ ID NO: 2244366 - protein, 19 aa, Cryptosporidium parvum
KALIFFINKDFKRSLFYIE

SEQ ID NO: 2244367 - protein, 37 aa, Cryptosporidium parvum
KANGNFFLILKLGHLLLFLLILKLLVYIYTKWTKTRG

SEQ ID NO: 2244368 - protein, 20 aa, Cryptosporidium parvum
KASIDFMAAFFSSTISLFLS

SEQ ID NO: 2244369 - protein, 18 aa, Cryptosporidium parvum
KATFLKLAGPQLVQMFIG

SEQ ID NO: 2244370 - protein, 21 aa, Cryptosporidium parvum
KAYFELFCVRYWYSENLKKFT

SEQ ID NO: 2244371 - protein, 21 aa, Cryptosporidium parvum
KAYFEVFVVGIYIFFAVLTRR

SEQ ID NO: 2244372 - protein, 44 aa, Cryptosporidium parvum; identical to SEQ ID NO: 2131511

SEQ ID NO: 2244373 - protein, 19 aa, Cryptosporidium parvum
KCGAYTIVYAPIKDQTDPA

SEQ ID NO: 2244374 - protein, 27 aa, Cryptosporidium parvum
KCIKWKILMVLIVWYNLITTFKNNQDL

SEQ ID NO: 2244375 - protein, 23 aa, Cryptosporidium parvum
KCKQIWKKPVYLSWVNACCNKIY

SEQ ID NO: 2244376 - protein, 18 aa, Cryptosporidium parvum
KCLSLPDLPIGLKFKENL

SEQ ID NO: 2244377 - protein, 20 aa, Cryptosporidium parvum
KCMEMFILNLQFQDNKMKEF

SEQ ID NO: 2244378 - protein, 18 aa, Cryptosporidium parvum
KCMEVIFSNIPYIKDIED

SEQ ID NO: 2244379 - protein, 38 aa, Cryptosporidium parvum
KCSLLNFTPFILSNLFIFGLIIYSVWVLRLEPTANEEE

SEQ ID NO: 2244380 - protein, 17 aa, Cryptosporidium parvum
KCSTILGWLATKYPNNY

SEQ ID NO: 2244381 - protein, 18 aa, Cryptosporidium parvum
KDDKWIQSFYKNYTNMAN

SEQ ID NO: 2244382 - protein, 18 aa, Cryptosporidium parvum
KDEFKFVRGFVFNDSVES

SEQ ID NO: 2244383 - protein, 30 aa, Cryptosporidium parvum
KDFICSQIPSYLWYLPSDKIFPFPITSNKC

SEQ ID NO: 2244384 - protein, 17 aa, Cryptosporidium parvum
KDFKRSLFYIEKINQLG

SEQ ID NO: 2244385 - protein, 19 aa, Cryptosporidium parvum
KDFPALPKFLTNFRDDLFA

SEQ ID NO: 2244386 - protein, 23 aa, Cryptosporidium parvum
KDGHIAFVPYFNIIPHNSVKVGG

SEQ ID NO: 2244387 - protein, 19 aa, Cryptosporidium parvum
KDIISVYELGLIKRVIFSN

SEQ ID NO: 2244388 - protein, 20 aa, Cryptosporidium parvum
KDIQYLYFNNIIVNSIISNI

SEQ ID NO: 2244389 - protein, 26 aa, Cryptosporidium parvum
KDIVNLGIIVWLKLIVRFQNIYMKEK

SEQ ID NO: 2244390 - protein, 21 aa, Cryptosporidium parvum
KDKFFLIFYSSQVASLSKITG

SEQ ID NO: 2244391 - protein, 24 aa, Cryptosporidium parvum
KDKPYYLLYPSCRIFEPLDNLKDE

SEQ ID NO: 2244392 - protein, 25 aa, Cryptosporidium parvum
KDLFNNLFVEIILLFKHHYSSEKGN

SEQ ID NO: 2244393 - protein, 19 aa, Cryptosporidium parvum
KDLPWLKPGLEYSGVSFQE

SEQ ID NO: 2244394 - protein, 21 aa, Cryptosporidium parvum
KDMVRLGKRFVYYNSFKQFPK

SEQ ID NO: 2244395 - protein, 23 aa, Cryptosporidium parvum
KDNDLFNTLYYSSNLYLLISAIF

SEQ ID NO: 2244396 - protein, 29 aa, Cryptosporidium parvum
KDQAIQQPLIRLLLYGIILPILEQCNAYC

SEQ ID NO: 2244397 - protein, 25 aa, Cryptosporidium parvum
KDQDGFIILPKFDPPSEKPSEYDLV

SEQ ID NO: 2244398 - protein, 24 aa, Cryptosporidium parvum
KDQILILWGREIIGPVFELLKSEL

SEQ ID NO: 2244399 - protein, 23 aa, Cryptosporidium parvum
KDRIDFFLLNESYLDQLLDIYDN

SEQ ID NO: 2244400 - protein, 25 aa, Cryptosporidium parvum
KDRSLFWYILNLPIKIFTTLNIDQL

SEQ ID NO: 2244401 - protein, 26 aa, Cryptosporidium parvum
KDSEDFLLVLVIYSKLWLNGSIAIYN

SEQ ID NO: 2244402 - protein, 22 aa, Cryptosporidium parvum
KDTHILKLRFLGGKLGKCLIEK

SEQ ID NO: 2244403 - protein, 22 aa, Cryptosporidium parvum
KDTLIVILNFATFIGFAISIVI

SEQ ID NO: 2244404 - protein, 18 aa, Cryptosporidium parvum
KDVLMSKNFKIFKSLKIE

SEQ ID NO: 2244405 - protein, 20 aa, Cryptosporidium parvum
KDYFREVALIKSYFLHNSRV

SEQ ID NO: 2244406 - protein, 24 aa, Cryptosporidium parvum
KDYKDLMILARHGSPLLVGVQSGH

SEQ ID NO: 2244407 - protein, 19 aa, Cryptosporidium parvum
KDYLYKIWYNLYTEEMYID

SEQ ID NO: 2244408 - protein, 25 aa, Cryptosporidium parvum
KEAIFLFAEYLLLISSIILGIYITY

SEQ ID NO: 2244409 - protein, 25 aa, Cryptosporidium parvum
KEARFLTHLTGKSLCLLFLSCLTST

SEQ ID NO: 2244410 - protein, 30 aa, Cryptosporidium parvum
KECINMLIEFYYLNRKLILFCPSRKLVENI

SEQ ID NO: 2244411 - protein, 20 aa, Cryptosporidium parvum
KEDCFCMPGFKPASLRDETC

SEQ ID NO: 2244412 - protein, 18 aa, Cryptosporidium parvum
KEDGVIIHLVPYARNQRN

SEQ ID NO: 2244413 - protein, 29 aa, Cryptosporidium parvum
KEETLLDFYTYLFPKVLLDFSILFSKENI

SEQ ID NO: 2244414 - protein, 18 aa, Cryptosporidium parvum
KEEYPLINVIKPITKQKL

SEQ ID NO: 2244415 - protein, 17 aa, Cryptosporidium parvum
KEFFFKISVDRINSVLK

SEQ ID NO: 2244416 - protein, 22 aa, Cryptosporidium parvum
KEFKAFLNLDRRRRNLEFLLNE

SEQ ID NO: 2244417 - protein, 20 aa, Cryptosporidium parvum
KEGIYVLRRMELFVGGVMGM

SEQ ID NO: 2244418 - protein, 26 aa, Cryptosporidium parvum
KEGLHLYIFLGLAALGLVRSNLHGPD

SEQ ID NO: 2244419 - protein, 17 aa, Cryptosporidium parvum
KEIGIKLIIIDFLLIIS

SEQ ID NO: 2244420 - protein, 36 aa, Cryptosporidium parvum
KEILLTALDLLKTGLYIIFIFERNAFFAFLSHVREM

SEQ ID NO: 2244421 - protein, 30 aa, Cryptosporidium parvum
KEINYLNICYWIQFIGWLCSSKGIYLSRFI

SEQ ID NO: 2244422 - protein, 26 aa, Cryptosporidium parvum
KEKDRKYYLNCVFIAYGIYSAYEAKI

SEQ ID NO: 2244423 - protein, 17 aa, Cryptosporidium parvum
KEKTLLKTFEEINFYFN

SEQ ID NO: 2244424 - protein, 19 aa, Cryptosporidium parvum
KEKYLCKFLFFQNDIFNHN

SEQ ID NO: 2244425 - protein, 20 aa, Cryptosporidium parvum
KELIYILSSLESQNCWIHCM

SEQ ID NO: 2244426 - protein, 23 aa, Cryptosporidium parvum
KENIFNFPILIQEYNFDNLMINN

SEQ ID NO: 2244427 - protein, 24 aa, Cryptosporidium parvum
KENNWFIYLMGHITIQLLLNQIIC

SEQ ID NO: 2244428 - protein, 25 aa, Cryptosporidium parvum
KENPILNNVLKLLRKVYKDCMNNEK

SEQ ID NO: 2244429 - protein, 32 aa, Cryptosporidium parvum
KEPISYNDKFGPTLLVMCLIISLTSVLLLNII

SEQ ID NO: 2244430 - protein, 37 aa, Cryptosporidium parvum
KEPRKLPGPLLPYGFSILILLSLFKIIPIWNKLSKID

SEQ ID NO: 2244431 - protein, 26 aa, Cryptosporidium parvum
KEPVEILLKYFLFPDYTRDSSAKSNL

SEQ ID NO: 2244432 - protein, 26 aa, Cryptosporidium parvum
KERDLSLLWVFQNLSPHIPMFTIHPK

SEQ ID NO: 2244433 - protein, 17 aa, Cryptosporidium parvum
KERKLLHYIRNKCLISL

SEQ ID NO: 2244434 - protein, 17 aa, Cryptosporidium parvum
KERLPFSFVYISSLSLT

SEQ ID NO: 2244435 - protein, 30 aa, Cryptosporidium parvum
KERRPVILRPIWILGVLFSCILNAILIIIS

SEQ ID NO: 2244436 - protein, 30 aa, Cryptosporidium parvum
KERRRIIGVLPQIPLLLKGWTIRDFLDPYE

SEQ ID NO: 2244437 - protein, 25 aa, Cryptosporidium parvum
KESILYPIVLFLADAMYFSFVYEVN

SEQ ID NO: 2244438 - protein, 26 aa, Cryptosporidium parvum
KESNMVWLYCYLMSANTPSKLMLIGV

SEQ ID NO: 2244439 - protein, 29 aa, Cryptosporidium parvum
KESSSFYYFMVLSFLMGFFAIAGAAASRP

SEQ ID NO: 2244440 - protein, 26 aa, Cryptosporidium parvum
KETKILEQFLLFTKIYARMSPKNKQT

SEQ ID NO: 2244441 - protein, 23 aa, Cryptosporidium parvum
KETPLLLATFALMIIFMAVCISG

SEQ ID NO: 2244442 - protein, 25 aa, Cryptosporidium parvum
KEVDIRMLEISKTLLRFFDYEYDLS

SEQ ID NO: 2244443 - protein, 21 aa, Cryptosporidium parvum
KEWDRICFDLLDSLKANKKSI

SEQ ID NO: 2244444 - protein, 29 aa, Cryptosporidium parvum
KEYEERSIFPLAEGLKLIKKLDILNKADC

SEQ ID NO: 2244445 - protein, 30 aa, Cryptosporidium parvum
KEYNNIIPLFNFPLITQLKILLTKNYKSNE

SEQ ID NO: 2244446 - protein, 24 aa, Cryptosporidium parvum
KEYYLYNYYYYKKSVENRKNIRNI

SEQ ID NO: 2244447 - protein, 30 aa, Cryptosporidium parvum
KFCFLYILYFFTFYFSMVVTISLRSPSNSG

SEQ ID NO: 2244448 - protein, 18 aa, Cryptosporidium parvum
KFCNSLCTLPFPGNDNWL

SEQ ID NO: 2244449 - protein, 24 aa, Cryptosporidium parvum
KFDCTILLEIGPQPILTKLSIQCI

SEQ ID NO: 2244450 - protein, 32 aa, Cryptosporidium parvum
KFEQRKLLIDSFFGYWIFEFLERVLNLLENVV

SEQ ID NO: 2244451 - protein, 17 aa, Cryptosporidium parvum
KFFCWKKVRSKSSHLLN

SEQ ID NO: 2244452 - protein, 18 aa, Cryptosporidium parvum
KFFDPFVFNFSIDVHQCI

SEQ ID NO: 2244453 - protein, 23 aa, Cryptosporidium parvum
KFFRKKVVPILKSVNFMASPGQL

SEQ ID NO: 2244454 - protein, 29 aa, Cryptosporidium parvum
KFGINNIFNLPIFELKLDNLRLIIRTKHT

SEQ ID NO: 2244455 - protein, 24 aa, Cryptosporidium parvum
KFGNIEYFFFAVETMFSIGYGSPR

SEQ ID NO: 2244456 - protein, 24 aa, Cryptosporidium parvum
KFGSWVYIPPNISIPFHPLDSKDV

SEQ ID NO: 2244457 - protein, 18 aa, Cryptosporidium parvum
KFIIQPEFKWVPLKVNNA

SEQ ID NO: 2244458 - protein, 21 aa, Cryptosporidium parvum
KFILQLIAACVCNRQLVYSDG

SEQ ID NO: 2244459 - protein, 21 aa, Cryptosporidium parvum
KFIRFKGIFKAKNSIESDHLN

SEQ ID NO: 2244460 - protein, 26 aa, Cryptosporidium parvum
KFKHIYLCLIFIATFIGYIFCSEYQN

SEQ ID NO: 2244461 - protein, 24 aa, Cryptosporidium parvum
KFKLPNHILYAIKYMNKMISNIHT

SEQ ID NO: 2244462 - protein, 29 aa, Cryptosporidium parvum
KFKPYSFEFLLNQLFVTQSLKINFLPFIF

SEQ ID NO: 2244463 - protein, 23 aa, Cryptosporidium parvum
KFKTELQRLFGNNAKDKCLWFSA

SEQ ID NO: 2244464 - protein, 18 aa, Cryptosporidium parvum
KFLILNLHQVTSVLNLLV

SEQ ID NO: 2244465 - protein, 21 aa, Cryptosporidium parvum
KFLLRLTCEFYMKAMREIQGY

SEQ ID NO: 2244466 - protein, 43 aa, Cryptosporidium parvum; identical to SEQ ID NO: 2131571

SEQ ID NO: 2244467 - protein, 36 aa, Cryptosporidium parvum
KFLRSKIIREFLFPITSYIKFYPLENILKILINIFE

SEQ ID NO: 2244468 - protein, 23 aa, Cryptosporidium parvum
KFLVRIIHHFSGLYYSLLRSLCI

SEQ ID NO: 2244469 - protein, 20 aa, Cryptosporidium parvum
KFMLNLFLSSLLFDLIFGVL

SEQ ID NO: 2244470 - protein, 29 aa, Cryptosporidium parvum
KFPFGSIKPLWYRQIPYTMAKFYFFERIN

SEQ ID NO: 2244471 - protein, 36 aa, Cryptosporidium parvum; identical to SEQ ID NO: 2131574

SEQ ID NO: 2244472 - protein, 31 aa, Cryptosporidium parvum; identical to SEQ ID NO: 2131575

SEQ ID NO: 2244473 - protein, 40 aa, Cryptosporidium parvum
KFQSTNRILIFHFIVVIFVVIITLIVFYFGSNDHFQKKNR

SEQ ID NO: 2244474 - protein, 37 aa, Cryptosporidium parvum; identical to SEQ ID NO: 2131576

SEQ ID NO: 2244475 - protein, 28 aa, Cryptosporidium parvum
KFRNYKLWITFILLCFFSVWISILESGI

SEQ ID NO: 2244476 - protein, 24 aa, Cryptosporidium parvum
KFRSWKAILSLIYTTKESSKQQKL

SEQ ID NO: 2244477 - protein, 29 aa, Cryptosporidium parvum
KFSATFARILLLWWYSIPDIREIQHRCIA

SEQ ID NO: 2244478 - protein, 26 aa, Cryptosporidium parvum
KFSCYFYYWSFCQCSKPWKLKFLNYF

SEQ ID NO: 2244479 - protein, 23 aa, Cryptosporidium parvum
KFSIGFYAAIFVALLPTGISLTY

SEQ ID NO: 2244480 - protein, 17 aa, Cryptosporidium parvum
KFSKLDSLISRYEYLSK

SEQ ID NO: 2244481 - protein, 20 aa, Cryptosporidium parvum
KFSNLLPAWTELHGKKIILT

SEQ ID NO: 2244482 - protein, 19 aa, Cryptosporidium parvum
KFSPLLKKINMLEKVLFHI

SEQ ID NO: 2244483 - protein, 21 aa, Cryptosporidium parvum
KFSTVALIGFLVSQYKHFNDS

SEQ ID NO: 2244484 - protein, 18 aa, Cryptosporidium parvum
KFSVIIAFFQMTLGVILK

SEQ ID NO: 2244485 - protein, 31 aa, Cryptosporidium parvum
KFTVNKVLKLVLWLLGWLSVTFIIPLCGIIL

SEQ ID NO: 2244486 - protein, 25 aa, Cryptosporidium parvum
KGADHFLDIVYPKLIRRKAARIVNI

SEQ ID NO: 2244487 - protein, 25 aa, Cryptosporidium parvum
KGAGILPLNMLYNAPLKSLENVDAI

SEQ ID NO: 2244488 - protein, 22 aa, Cryptosporidium parvum
KGDFFIYYQLRNFYQNNKSFIF

SEQ ID NO: 2244489 - protein, 19 aa, Cryptosporidium parvum
KGEELPLLWGQRATILHEN

SEQ ID NO: 2244490 - protein, 25 aa, Cryptosporidium parvum
KGERSFPYYYVYEPLPYLESIQDEN

SEQ ID NO: 2244491 - protein, 26 aa, Cryptosporidium parvum
KGFHWFKVNEYWDWSRNYLSCRNDSV

SEQ ID NO: 2244492 - protein, 23 aa, Cryptosporidium parvum
KGIIKLFLDFLMTQNAPGGGKTV

SEQ ID NO: 2244493 - protein, 18 aa, Cryptosporidium parvum
KGLFFLSGDVHWGQIFES

SEQ ID NO: 2244494 - protein, 24 aa, Cryptosporidium parvum
KGLKNHLRILWRRPRNDTSSNSDG

SEQ ID NO: 2244495 - protein, 31 aa, Cryptosporidium parvum; identical to SEQ ID NO: 2131590

SEQ ID NO: 2244496 - protein, 28 aa, Cryptosporidium parvum
KGNKIVAFIDKLIDLIISVIRSIYHAFK

SEQ ID NO: 2244497 - protein, 27 aa, Cryptosporidium parvum
KGSLGWGFYLLLLANSLLIVHILALVD

SEQ ID NO: 2244498 - protein, 23 aa, Cryptosporidium parvum
KGTLYLLSGILAMSIFRINFLEL

SEQ ID NO: 2244499 - protein, 22 aa, Cryptosporidium parvum
KGTWVSWMHCIALVLGRTCDSC

SEQ ID NO: 2244500 - protein, 19 aa, Cryptosporidium parvum
KGWYSFIISTLAGTVYTFG

SEQ ID NO: 2244501 - protein, 27 aa, Cryptosporidium parvum
KHFRSLTFPSVFFYLSQHLADMIALLV

SEQ ID NO: 2244502 - protein, 24 aa, Cryptosporidium parvum
KHGFYAFWNWFDSRSWYPLGRIIG

SEQ ID NO: 2244503 - protein, 24 aa, Cryptosporidium parvum
KHHFKIVRLYLDNTIDSKSLLGNW

SEQ ID NO: 2244504 - protein, 26 aa, Cryptosporidium parvum
KHKMVLKLLLTSLLGLLNIIVWANGE

SEQ ID NO: 2244505 - protein, 22 aa, Cryptosporidium parvum
KHKYYWKLIRVQNASHIIILFD

SEQ ID NO: 2244506 - protein, 29 aa, Cryptosporidium parvum
KHLNTLKLKKCFKMFLSVCGTSLSAIFGF

SEQ ID NO: 2244507 - protein, 24 aa, Cryptosporidium parvum
KHLSFLLRKEPRLVYRECWRGDYF

SEQ ID NO: 2244508 - protein, 28 aa, Cryptosporidium parvum
KHLYLSNLRFFIFGFISKLLASALTYPL

SEQ ID NO: 2244509 - protein, 25 aa, Cryptosporidium parvum
KHPRAVRFVFAWMLIAQVLRNYDTG

SEQ ID NO: 2244510 - protein, 34 aa, Cryptosporidium parvum
KHVPCDPNYLLTCFKYLLEKDWIYSIDSINKMMN

SEQ ID NO: 2244511 - protein, 31 aa, Cryptosporidium parvum; identical to SEQ ID NO: 2131603

SEQ ID NO: 2244512 - protein, 19 aa, Cryptosporidium parvum
KHYIRLNILSLSSIRYNEN

SEQ ID NO: 2244513 - protein, 17 aa, Cryptosporidium parvum
KIANVLCKVSFSPIPLK

SEQ ID NO: 2244514 - protein, 29 aa, Cryptosporidium parvum
KIDLITLLPIIFFLIQSIHFHITQRSKTN

SEQ ID NO: 2244515 - protein, 26 aa, Cryptosporidium parvum
KIEDLTYLDIFWMKWSRQLNETNDSL

SEQ ID NO: 2244516 - protein, 30 aa, Cryptosporidium parvum
KIESIKKLCKVWLLSPFNALDVLLTDSKQR

SEQ ID NO: 2244517 - protein, 31 aa, Cryptosporidium parvum
KIFELYNIPVWLYPYRILPMMFKDINNSVIY

SEQ ID NO: 2244518 - protein, 36 aa, Cryptosporidium parvum; identical to SEQ ID NO: 2131606

SEQ ID NO: 2244519 - protein, 26 aa, Cryptosporidium parvum
KIFILQLLWIGFFIILILGGLSDLIL

SEQ ID NO: 2244520 - protein, 18 aa, Cryptosporidium parvum
KIFPFQLSPNISLVAPEE

SEQ ID NO: 2244521 - protein, 28 aa, Cryptosporidium parvum
KIFSLIFFFFNILNLLNGEEIDNKSLQL

SEQ ID NO: 2244522 - protein, 20 aa, Cryptosporidium parvum
KIFVPILEYSVLRRIYEEFL

SEQ ID NO: 2244523 - protein, 19 aa, Cryptosporidium parvum
KIFYLIYKKSDPHDFFACS

SEQ ID NO: 2244524 - protein, 24 aa, Cryptosporidium parvum
KIGGFWITIRLNKNPFRTTPKVNV

SEQ ID NO: 2244525 - protein, 24 aa, Cryptosporidium parvum
KIGRWDLLDIFNKNLLIIMDGVIQ

SEQ ID NO: 2244526 - protein, 19 aa, Cryptosporidium parvum
KIGSRLLPRLLVSENKPSQ

SEQ ID NO: 2244527 - protein, 30 aa, Cryptosporidium parvum
KIHLSLIPDLSLLSILLYKKTDLKSFWISI

SEQ ID NO: 2244528 - protein, 32 aa, Cryptosporidium parvum
KIIDIGLSIFIFQDIFFVPILNEIVLSYFESS

SEQ ID NO: 2244529 - protein, 20 aa, Cryptosporidium parvum
KIIFLIMEKGLTLNTYFETE

SEQ ID NO: 2244530 - protein, 25 aa, Cryptosporidium parvum
KIIFSKFFDIYYNFNKKFKFAPDIE

SEQ ID NO: 2244531 - protein, 17 aa, Cryptosporidium parvum
KIILRRKKPNLFAEATK

SEQ ID NO: 2244532 - protein, 21 aa, Cryptosporidium parvum
KIINFCLISMFDLYGRLLSCN

SEQ ID NO: 2244533 - protein, 41 aa, Cryptosporidium parvum
KIIQKINAFPFKFPQLLYRRIISILPIMFHSSKPNYRIIAI

SEQ ID NO: 2244534 - protein, 20 aa, Cryptosporidium parvum
KIISFMLQYLYPLVGTANVT

SEQ ID NO: 2244535 - protein, 24 aa, Cryptosporidium parvum
KIKEGFLEQLRLPIKVKYGCIETI

SEQ ID NO: 2244536 - protein, 23 aa, Cryptosporidium parvum
KIKIIIIYFVIFLVGLFTNIVSE

SEQ ID NO: 2244537 - protein, 18 aa, Cryptosporidium parvum
KIKILFQKGIQQRLEDIH

SEQ ID NO: 2244538 - protein, 33 aa, Cryptosporidium parvum; identical to SEQ ID NO: 2131616

SEQ ID NO: 2244539 - protein, 25 aa, Cryptosporidium parvum
KIKKLLLGSLLYYNGTKNSCFQEEI

SEQ ID NO: 2244540 - protein, 22 aa, Cryptosporidium parvum
KIKLGFLKWFNEKLPKDLFGRL

SEQ ID NO: 2244541 - protein, 19 aa, Cryptosporidium parvum
KIKLLWVGGNIIARVIFQI

SEQ ID NO: 2244542 - protein, 27 aa, Cryptosporidium parvum
KIKSFFKLIFCILSSFLLLIKLQIFKF

SEQ ID NO: 2244543 - protein, 20 aa, Cryptosporidium parvum
KILMEIKIRKNIFNSILSFL

SEQ ID NO: 2244544 - protein, 21 aa, Cryptosporidium parvum
KILNIPLTLIIIIRGERIQSE

SEQ ID NO: 2244545 - protein, 18 aa, Cryptosporidium parvum
KILNYVETVLKLNSKYFP

SEQ ID NO: 2244546 - protein, 19 aa, Cryptosporidium parvum
KILVECFILYRPDIGYVEG

SEQ ID NO: 2244547 - protein, 17 aa, Cryptosporidium parvum
KILWRRNSLSEFSKGII

SEQ ID NO: 2244548 - protein, 29 aa, Cryptosporidium parvum
KILYWCTIPVTILVFCGVILRTILQTSSQ

SEQ ID NO: 2244549 - protein, 21 aa, Cryptosporidium parvum
KINDICLFEIRLQCLNMLLIK

SEQ ID NO: 2244550 - protein, 21 aa, Cryptosporidium parvum
KINIYEIYLLFFEDYRITKIM

SEQ ID NO: 2244551 - protein, 19 aa, Cryptosporidium parvum
KINLINAFIGTGFDTILQM

SEQ ID NO: 2244552 - protein, 25 aa, Cryptosporidium parvum
KINPFELWVVLMKYSSIISNDHGLI

SEQ ID NO: 2244553 - protein, 26 aa, Cryptosporidium parvum
KINQTLFFLTVLFYNLQNYQVEALDF

SEQ ID NO: 2244554 - protein, 20 aa, Cryptosporidium parvum
KINSILSRFLAHSIMGHSHF

SEQ ID NO: 2244555 - protein, 33 aa, Cryptosporidium parvum
KINTIWAIFRVQFLVLLLFLNNLACENEILDES

SEQ ID NO: 2244556 - protein, 29 aa, Cryptosporidium parvum
KIPELSGKLWLLWYVSFKQKDCQMRIIIE

SEQ ID NO: 2244557 - protein, 30 aa, Cryptosporidium parvum
KIPRIYVIFIIFIIFFSNVECLLKKANQTV

SEQ ID NO: 2244558 - protein, 26 aa, Cryptosporidium parvum
KIPTQYPILKLQLWSYGLIQSDNIGE

SEQ ID NO: 2244559 - protein, 26 aa, Cryptosporidium parvum
KIQISFIMIYLIFEFNEYFIFNGFLL

SEQ ID NO: 2244560 - protein, 21 aa, Cryptosporidium parvum
KIQRRRLVYGWWISGYENTNM

SEQ ID NO: 2244561 - protein, 23 aa, Cryptosporidium parvum
KIRESIYLHLTRYYLVMIDFHEE

SEQ ID NO: 2244562 - protein, 25 aa, Cryptosporidium parvum
KIRNYYTKLLFQIKGLKNALIDLPP

SEQ ID NO: 2244563 - protein, 21 aa, Cryptosporidium parvum
KIRYYKYVFPSYLLKDEEKIH

SEQ ID NO: 2244564 - protein, 23 aa, Cryptosporidium parvum
KISDYFVPMYTKERLFSIYYTNL

SEQ ID NO: 2244565 - protein, 21 aa, Cryptosporidium parvum
KISEKNIAFGIPTLNLKLNTR

SEQ ID NO: 2244566 - protein, 23 aa, Cryptosporidium parvum
KISLLRFLIYKRYDINEISLNCL

SEQ ID NO: 2244567 - protein, 20 aa, Cryptosporidium parvum
KISSDFLRKISVLKLCVYDT

SEQ ID NO: 2244568 - protein, 35 aa, Cryptosporidium parvum
KITAYNMILCTQNIYFWIISLERITNYQLKILEKR

SEQ ID NO: 2244569 - protein, 25 aa, Cryptosporidium parvum
KITCRTDFILLWKNTNNKFSILLSK

SEQ ID NO: 2244570 - protein, 21 aa, Cryptosporidium parvum
KITHYLIFLSSQIYCSLNTYN

SEQ ID NO: 2244571 - protein, 37 aa, Cryptosporidium parvum; identical to SEQ ID NO: 2131630

SEQ ID NO: 2244572 - protein, 28 aa, Cryptosporidium parvum
KIVYELISKKWVKLIPNFKVLNKSLNIL

SEQ ID NO: 2244573 - protein, 42 aa, Cryptosporidium parvum; identical to SEQ ID NO: 2131632

SEQ ID NO: 2244574 - protein, 20 aa, Cryptosporidium parvum
KIYDFILQEQLSLLDSVKFM

SEQ ID NO: 2244575 - protein, 31 aa, Cryptosporidium parvum
KIYESLTMSKLLHFLGFKKTRISNDVDFLVH

SEQ ID NO: 2244576 - protein, 19 aa, Cryptosporidium parvum
KIYTFFTVISGLIIPILLN

SEQ ID NO: 2244577 - protein, 32 aa, Cryptosporidium parvum
KKAAIWSILELLLSFGLVAIQVYYIKSYFQVK

SEQ ID NO: 2244578 - protein, 55 aa, Cryptosporidium parvum
KKASLRIWIYRKLGKILNYIFKIIKTLSLFLIIGTFLFIIWNSINHFGQYGESKM

SEQ ID NO: 2244579 - protein, 24 aa, Cryptosporidium parvum
KKASNLSIAFWTLKKKLLGQSEIE

SEQ ID NO: 2244580 - protein, 19 aa, Cryptosporidium parvum
KKCVLALIYIFKTGSKTCS

SEQ ID NO: 2244581 - protein, 25 aa, Cryptosporidium parvum
KKDCFTFLKQLLFYQINYSNNKVIN

SEQ ID NO: 2244582 - protein, 37 aa, Cryptosporidium parvum
KKDIQIFGISLLPYYLKISWYIYYLSTISDETNVLLN

SEQ ID NO: 2244583 - protein, 36 aa, Cryptosporidium parvum
KKDKFEYICSHGTFFWILKRYILPWDTYSDYNIKNI

SEQ ID NO: 2244584 - protein, 25 aa, Cryptosporidium parvum
KKFEKLLRNIQLFSRAITVYIIYHI

SEQ ID NO: 2244585 - protein, 49 aa, Cryptosporidium parvum
KKFHSELLYGCLLTYGIYLVYLINPSKSLNLFIWKFINTEYLKSNEEIK

SEQ ID NO: 2244586 - protein, 26 aa, Cryptosporidium parvum
KKGLVKPLPFHPYYYSNPLDIEIQNI

SEQ ID NO: 2244587 - protein, 20 aa, Cryptosporidium parvum
KKGNFLLEWLREMKTFIPSN

SEQ ID NO: 2244588 - protein, 24 aa, Cryptosporidium parvum
KKGVLEIFIIPIEKNRYLVVYSKF

SEQ ID NO: 2244589 - protein, 21 aa, Cryptosporidium parvum
KKHFNILLQHPLKMSEIINQP

SEQ ID NO: 2244590 - protein, 23 aa, Cryptosporidium parvum
KKHKDLFLNAKLDLLKKLISEDE

SEQ ID NO: 2244591 - protein, 17 aa, Cryptosporidium parvum
KKKCIIGLLLHSVWMKM

SEQ ID NO: 2244592 - protein, 24 aa, Cryptosporidium parvum
KKKENYIIKILIYESFNQVEDPNT

SEQ ID NO: 2244593 - protein, 25 aa, Cryptosporidium parvum
KKKIELEIFPMEFFKIILNVKQMEE

SEQ ID NO: 2244594 - protein, 36 aa, Cryptosporidium parvum
KKKKNRFIIIRDIIDLILNIILYRVFISGILVNDQL

SEQ ID NO: 2244595 - protein, 17 aa, Cryptosporidium parvum
KKKLYWTKRGPIKFCIV

SEQ ID NO: 2244596 - protein, 18 aa, Cryptosporidium parvum
KKLGFVGGKIKMISSHLS

SEQ ID NO: 2244597 - protein, 23 aa, Cryptosporidium parvum
KKLPLSVKVFPAIFIITSGYQYE

SEQ ID NO: 2244598 - protein, 31 aa, Cryptosporidium parvum
KKLTILIHLFIIYFLVIYNNEWNSLDSYYLK

SEQ ID NO: 2244599 - protein, 28 aa, Cryptosporidium parvum
KKNFNFCRSFPLFFYPLSIIMQNKMFSD

SEQ ID NO: 2244600 - protein, 22 aa, Cryptosporidium parvum
KKNILLFIFACYTPIILMFGFI

SEQ ID NO: 2244601 - protein, 28 aa, Cryptosporidium parvum
KKPYNSVFLLITLCLLIITRNSECVRYK

SEQ ID NO: 2244602 - protein, 43 aa, Cryptosporidium parvum; identical to SEQ ID NO: 2131648

SEQ ID NO: 2244603 - protein, 31 aa, Cryptosporidium parvum
KKSELMHSFLKFFIQEIFLSLGILIGNIEVE

SEQ ID NO: 2244604 - protein, 21 aa, Cryptosporidium parvum
KKSFILPKFWNVKERFSYIRN

SEQ ID NO: 2244605 - protein, 24 aa, Cryptosporidium parvum
KKSFYEFILIIIQEIDFIKNDNNC

SEQ ID NO: 2244606 - protein, 29 aa, Cryptosporidium parvum
KKSHWSTMYILPDIFSIRLILNLLKKEES

SEQ ID NO: 2244607 - protein, 17 aa, Cryptosporidium parvum
KKSNNILYLFEFLGKIV

SEQ ID NO: 2244608 - protein, 25 aa, Cryptosporidium parvum
KKSPRTSILPIKISKELLKKLMTKC

SEQ ID NO: 2244609 - protein, 25 aa, Cryptosporidium parvum
KKTAACILIIELLNHIPPIWAQTYF

SEQ ID NO: 2244610 - protein, 27 aa, Cryptosporidium parvum
KKTDQGWWLLALILNVVDLISIDYLNY

SEQ ID NO: 2244611 - protein, 30 aa, Cryptosporidium parvum
KKTRREVWSKCRNILIYVWQRSEVEAVTNY

SEQ ID NO: 2244612 - protein, 29 aa, Cryptosporidium parvum
KKVGFFEVWLLLSLWKRYPARIYRHMMKT

SEQ ID NO: 2244613 - protein, 26 aa, Cryptosporidium parvum
KKVHFPPIIECPNQYSLFPGGNCSKR

SEQ ID NO: 2244614 - protein, 26 aa, Cryptosporidium parvum
KKVSKYVYIQLLLMNPIQILCSTSKS

SEQ ID NO: 2244615 - protein, 28 aa, Cryptosporidium parvum
KKYDVWTSYILLYLFSRKDPVDLFKRIM

SEQ ID NO: 2244616 - protein, 21 aa, Cryptosporidium parvum
KKYEIWGILISSSLIIAILFS

SEQ ID NO: 2244617 - protein, 17 aa, Cryptosporidium parvum
KKYHLDLPKIYLNNLES

SEQ ID NO: 2244618 - protein, 19 aa, Cryptosporidium parvum
KKYLDYTFRLRWYGENEGS

SEQ ID NO: 2244619 - protein, 21 aa, Cryptosporidium parvum
KKYLIVHWDLSKDSGFEVLKN

SEQ ID NO: 2244620 - protein, 18 aa, Cryptosporidium parvum
KKYVIKMDPLRQVILKNE

SEQ ID NO: 2244621 - protein, 24 aa, Cryptosporidium parvum
KLAQHPCIVSYRQSFASLDFSQGS

SEQ ID NO: 2244622 - protein, 33 aa, Cryptosporidium parvum
KLASRCPIWFEYFCLILWRLLPIFEQSIPVSES

SEQ ID NO: 2244623 - protein, 19 aa, Cryptosporidium parvum
KLDILFFVNCEYMESFFKY

SEQ ID NO: 2244624 - protein, 23 aa, Cryptosporidium parvum
KLDLHLKRRLTKRLGIKLLKLLR

SEQ ID NO: 2244625 - protein, 17 aa, Cryptosporidium parvum
KLDLLNINKISLFSAME

SEQ ID NO: 2244626 - protein, 19 aa, Cryptosporidium parvum
KLDPFLKEWKNPDIQALFL

SEQ ID NO: 2244627 - protein, 26 aa, Cryptosporidium parvum
KLEFPDRSLDFTIPPVAGHNSCSIIV

SEQ ID NO: 2244628 - protein, 34 aa, Cryptosporidium parvum; identical to SEQ ID NO: 2131658

SEQ ID NO: 2244629 - protein, 28 aa, Cryptosporidium parvum
KLFIFNNIFLLIQNLLTNILYLNKYKNN

SEQ ID NO: 2244630 - protein, 17 aa, Cryptosporidium parvum
KLFLDRCHCIFSSVFQD

SEQ ID NO: 2244631 - protein, 29 aa, Cryptosporidium parvum
KLICKILDYILYMFYIKIKYINNQDIEEI

SEQ ID NO: 2244632 - protein, 18 aa, Cryptosporidium parvum
KLIFFLYYNAVGEEKECP

SEQ ID NO: 2244633 - protein, 18 aa, Cryptosporidium parvum
KLIIIDFLLIISGIFTSI

SEQ ID NO: 2244634 - protein, 22 aa, Cryptosporidium parvum
KLIKITFLLSILISTILCLDHG

SEQ ID NO: 2244635 - protein, 25 aa, Cryptosporidium parvum
KLILSLFFCLLLIWSRIIYKPWINT

SEQ ID NO: 2244636 - protein, 30 aa, Cryptosporidium parvum
KLISLYEKIIFIKPIFYSRLTKTLIIYQYP

SEQ ID NO: 2244637 - protein, 29 aa, Cryptosporidium parvum
KLITINFHIIPWKGILRWIDSWEGVFLQS

SEQ ID NO: 2244638 - protein, 27 aa, Cryptosporidium parvum
KLIVGFQGWRFAFLLVGVLSAILGGII

SEQ ID NO: 2244639 - protein, 32 aa, Cryptosporidium parvum
KLIYKATKYIFIYMIFALLLKKLEDNSHKISF

SEQ ID NO: 2244640 - protein, 25 aa, Cryptosporidium parvum
KLKCKPFRWFLDNVAPETYITQLDH

SEQ ID NO: 2244641 - protein, 20 aa, Cryptosporidium parvum
KLKFFDDFLYTNSGKPLLVF

SEQ ID NO: 2244642 - protein, 36 aa, Cryptosporidium parvum
KLKISVFNWFTFIIFVIYILLIGCRHIDLFFNFFSK

SEQ ID NO: 2244643 - protein, 29 aa, Cryptosporidium parvum
KLKKWVKKCYSLLPLFYSLIEKIMKTIKN

SEQ ID NO: 2244644 - protein, 31 aa, Cryptosporidium parvum; identical to SEQ ID NO: 2131670

SEQ ID NO: 2244645 - protein, 17 aa, Cryptosporidium parvum
KLLEEVAVLKLLDHPNI

SEQ ID NO: 2244646 - protein, 27 aa, Cryptosporidium parvum
KLLFFLFFQVSINLIIMSLICSISGTT

SEQ ID NO: 2244647 - protein, 26 aa, Cryptosporidium parvum
KLLGIDLIVILYYILACFILGNNNYQ

SEQ ID NO: 2244648 - protein, 24 aa, Cryptosporidium parvum
KLLIGFFTLLFYLGVFEVILGIFQ

SEQ ID NO: 2244649 - protein, 21 aa, Cryptosporidium parvum
KLLKELFNAVLYLFNPCWTFT

SEQ ID NO: 2244650 - protein, 23 aa, Cryptosporidium parvum
KLLKILLAYFTGFLPWIHIEEHV

SEQ ID NO: 2244651 - protein, 17 aa, Cryptosporidium parvum
KLLLSFFVILFICFGVI

SEQ ID NO: 2244652 - protein, 19 aa, Cryptosporidium parvum
KLLSFLPTIPICPFCKQEN

SEQ ID NO: 2244653 - protein, 25 aa, Cryptosporidium parvum
KLLVEFIFLIILLISKEIPCEDFIS

SEQ ID NO: 2244654 - protein, 28 aa, Cryptosporidium parvum
KLMLKKGGPLFIINPFGEGLTSSIIKQQ

SEQ ID NO: 2244655 - protein, 19 aa, Cryptosporidium parvum
KLMLPGIRDLVYIFKLEAG

SEQ ID NO: 2244656 - protein, 18 aa, Cryptosporidium parvum
KLMTGLWPEAIKVVLNIG

SEQ ID NO: 2244657 - protein, 18 aa, Cryptosporidium parvum
KLMTRRLIFYCHFPDQLL

SEQ ID NO: 2244658 - protein, 27 aa, Cryptosporidium parvum
KLNHIICDILYLLLQYTYVLDRVKISV

SEQ ID NO: 2244659 - protein, 33 aa, Cryptosporidium parvum
KLNIIFISSIIFTFKLKFFLGTMIFQNIRSYYS

SEQ ID NO: 2244660 - protein, 18 aa, Cryptosporidium parvum
KLNKILSLFLDPFNKLSR

SEQ ID NO: 2244661 - protein, 28 aa, Cryptosporidium parvum
KLNKSAFYFVRFNLLLHLAAIVIQCYFR

SEQ ID NO: 2244662 - protein, 19 aa, Cryptosporidium parvum
KLNLYRIITKNLLGIGITM

SEQ ID NO: 2244663 - protein, 28 aa, Cryptosporidium parvum
KLPKKSGYKFEYSWYPPISQGKLIDSVR

SEQ ID NO: 2244664 - protein, 23 aa, Cryptosporidium parvum
KLPQLYQHLLYTIGIHFESVVTP

SEQ ID NO: 2244665 - protein, 24 aa, Cryptosporidium parvum
KLPVLIKLLIDQYISIFSSPLFLC

SEQ ID NO: 2244666 - protein, 25 aa, Cryptosporidium parvum
KLQSSFFVTIWTPIFILNMQPCKDL

SEQ ID NO: 2244667 - protein, 26 aa, Cryptosporidium parvum
KLRRNEPFLLIKDPSLRYGPNVKRKT

SEQ ID NO: 2244668 - protein, 24 aa, Cryptosporidium parvum
KLSIPFFPLEFINLVKNVNLLPNS

SEQ ID NO: 2244669 - protein, 26 aa, Cryptosporidium parvum
KLSLPILHYISIGRPFFAFNLLCMRH

SEQ ID NO: 2244670 - protein, 32 aa, Cryptosporidium parvum
KLSRLISAHLFYSATFLLVALTLCLYSQLGIS

SEQ ID NO: 2244671 - protein, 38 aa, Cryptosporidium parvum
KLSSEILYRCYMKFFRGILRYFLIYGSNHRWVDLNELQ

SEQ ID NO: 2244672 - protein, 25 aa, Cryptosporidium parvum
KLVFNIWDQFYILIKQCMDYYLLRY

SEQ ID NO: 2244673 - protein, 32 aa, Cryptosporidium parvum
KLVLDIEQVLIFIQNILFVLKYEKVNKNGIFL

SEQ ID NO: 2244674 - protein, 24 aa, Cryptosporidium parvum
KLVPYCHHFCFFNILPHVSKLSTS

SEQ ID NO: 2244675 - protein, 17 aa, Cryptosporidium parvum
KLWIIEQMDTFSSQEDI

SEQ ID NO: 2244676 - protein, 17 aa, Cryptosporidium parvum
KLYEKISKMFKYAFQWL

SEQ ID NO: 2244677 - protein, 30 aa, Cryptosporidium parvum
KLYERRIISMIYLIKLFIFRVNNEIKNYFN

SEQ ID NO: 2244678 - protein, 26 aa, Cryptosporidium parvum
KLYKILRKMLIKFYIEEFGIILTYHM

SEQ ID NO: 2244679 - protein, 17 aa, Cryptosporidium parvum
KLYSRILEYYLLVIILA

SEQ ID NO: 2244680 - protein, 18 aa, Cryptosporidium parvum
KMCVAHENKMLWRPFTEQ

SEQ ID NO: 2244681 - protein, 25 aa, Cryptosporidium parvum
KMDTIIKIMLGIPFFKYFEEKESMI

SEQ ID NO: 2244682 - protein, 17 aa, Cryptosporidium parvum
KMFKSFFDNILLLKAGK

SEQ ID NO: 2244683 - protein, 19 aa, Cryptosporidium parvum
KMIISIIDCILLGENIILT

SEQ ID NO: 2244684 - protein, 27 aa, Cryptosporidium parvum
KMKTFGYLRGYILLALPGVLDEINSKK

SEQ ID NO: 2244685 - protein, 19 aa, Cryptosporidium parvum
KMKTFSIPLFFTGETKEMM

SEQ ID NO: 2244686 - protein, 23 aa, Cryptosporidium parvum
KMLEHFFNTIYLKNKGKPRKLIL

SEQ ID NO: 2244687 - protein, 19 aa, Cryptosporidium parvum
KMLIICGALIGSSGAILSH

SEQ ID NO: 2244688 - protein, 17 aa, Cryptosporidium parvum
KMQSVNAVLFLEGRKTE

SEQ ID NO: 2244689 - protein, 17 aa, Cryptosporidium parvum
KMSYYLVIALRKSFDLL

SEQ ID NO: 2244690 - protein, 25 aa, Cryptosporidium parvum
KMTFFVQFSFITLLIIMGLLINIVS

SEQ ID NO: 2244691 - protein, 32 aa, Cryptosporidium parvum
KMVLELFVIILIVNYLLLHFPKILRAINGSNS

SEQ ID NO: 2244692 - protein, 37 aa, Cryptosporidium parvum; identical to SEQ ID NO: 2131692

SEQ ID NO: 2244693 - protein, 17 aa, Cryptosporidium parvum
KNCLVVLLLIWHFLHAI

SEQ ID NO: 2244694 - protein, 23 aa, Cryptosporidium parvum
KNDGVEFLFLTKAVEGCLISQEI

SEQ ID NO: 2244695 - protein, 31 aa, Cryptosporidium parvum
KNDIIMHYLVYNTLFIVLLLNSNLFEFEIPI

SEQ ID NO: 2244696 - protein, 23 aa, Cryptosporidium parvum
KNDLEKIIWVPFSISEIEYYNNQ

SEQ ID NO: 2244697 - protein, 23 aa, Cryptosporidium parvum
KNDNILIMLIKNPISHIVIQDVF

SEQ ID NO: 2244698 - protein, 31 aa, Cryptosporidium parvum
KNDTYLCIIGPIPPKLLFITKSLSLQKQRRF

SEQ ID NO: 2244699 - protein, 27 aa, Cryptosporidium parvum
KNEFFKFMVHFIFSLIIFQIVNNINMN

SEQ ID NO: 2244700 - protein, 24 aa, Cryptosporidium parvum
KNELTLLGLIGFLDPPRPGVEKAI

SEQ ID NO: 2244701 - protein, 32 aa, Cryptosporidium parvum
KNFINMIFNFLMIDLFFIRYFELKILNKELEN

SEQ ID NO: 2244702 - protein, 25 aa, Cryptosporidium parvum
KNFNPDFFTLYLNPNTYTCMPMWTS

SEQ ID NO: 2244703 - protein, 17 aa, Cryptosporidium parvum
KNFNVKALIPTRIILAG

SEQ ID NO: 2244704 - protein, 25 aa, Cryptosporidium parvum
KNFSNAMLYLTVLQSFLGPYYVRYE

SEQ ID NO: 2244705 - protein, 26 aa, Cryptosporidium parvum
KNFVNNKFYPLYKPSVFKINMYDSTR

SEQ ID NO: 2244706 - protein, 38 aa, Cryptosporidium parvum; identical to SEQ ID NO: 2131698

SEQ ID NO: 2244707 - protein, 20 aa, Cryptosporidium parvum
KNILQGVRALLPINKTLKVT

SEQ ID NO: 2244708 - protein, 28 aa, Cryptosporidium parvum
KNINLINKLLLKLNFNSFYIGKIPASVE

SEQ ID NO: 2244709 - protein, 23 aa, Cryptosporidium parvum
KNIVFLYIILEIVCLACCSIQQN

SEQ ID NO: 2244710 - protein, 24 aa, Cryptosporidium parvum
KNKDHFILCAFNGLPLSSLSIKES

SEQ ID NO: 2244711 - protein, 27 aa, Cryptosporidium parvum
KNKEKFNIWRFLLSTAILLVSIFLSHV

SEQ ID NO: 2244712 - protein, 20 aa, Cryptosporidium parvum
KNKFLSLNILFNGILNHSKN

SEQ ID NO: 2244713 - protein, 20 aa, Cryptosporidium parvum
KNKFWWKNIKYTLILGCLVS

SEQ ID NO: 2244714 - protein, 27 aa, Cryptosporidium parvum
KNKGYGWTLTIIASLILIFTSFYESFI

SEQ ID NO: 2244715 - protein, 22 aa, Cryptosporidium parvum
KNLINLLIALFDFFKYSSTIEE

SEQ ID NO: 2244716 - protein, 24 aa, Cryptosporidium parvum
KNLLKTVYFIPLDGGWISVLISVI

SEQ ID NO: 2244717 - protein, 31 aa, Cryptosporidium parvum
KNLYKKSSLFIILLMLIMAIFQVCNYSGFNI

SEQ ID NO: 2244718 - protein, 33 aa, Cryptosporidium parvum
KNNCELLIFTSFRFYVYILVELKKKKNSLIHLS

SEQ ID NO: 2244719 - protein, 30 aa, Cryptosporidium parvum
KNNELKHLFKIPMNYLPYIPKDTGESDEKS

SEQ ID NO: 2244720 - protein, 27 aa, Cryptosporidium parvum
KNNEVYATLFIKKIPRNIWSKQWEMHE

SEQ ID NO: 2244721 - protein, 20 aa, Cryptosporidium parvum
KNPEYCHWFAFYLVKNRASK

SEQ ID NO: 2244722 - protein, 24 aa, Cryptosporidium parvum
KNPKIYFPIIALTATLTAGHIQNP

SEQ ID NO: 2244723 - protein, 31 aa, Cryptosporidium parvum
KNPSQIRFVHYFNFLLKHTFPESVIKRGSNF

SEQ ID NO: 2244724 - protein, 21 aa, Cryptosporidium parvum
KNRFLSTLGLIGVVIGGVWYI

SEQ ID NO: 2244725 - protein, 20 aa, Cryptosporidium parvum
KNRGHYITSILFFMEANLLE

SEQ ID NO: 2244726 - protein, 25 aa, Cryptosporidium parvum
KNRNIRIYLIKYLKGFIKIPELSGK

SEQ ID NO: 2244727 - protein, 29 aa, Cryptosporidium parvum
KNSFIFTILTLFITLPIYYFGINIPGISN

SEQ ID NO: 2244728 - protein, 24 aa, Cryptosporidium parvum
KNSSVMPLIPILNHGLRRIKLEYK

SEQ ID NO: 2244729 - protein, 24 aa, Cryptosporidium parvum
KNSTKMLLFDILKQTLFNSEENPV

SEQ ID NO: 2244730 - protein, 23 aa, Cryptosporidium parvum
KNTLLVFLVVYINYFSGSELELI

SEQ ID NO: 2244731 - protein, 55 aa, Cryptosporidium parvum
KNTNLQSIIKYLFFFIQIISLIYLFTILFLISEYDYIWFLIGVIITATLCSSVRI

SEQ ID NO: 2244732 - protein, 28 aa, Cryptosporidium parvum
KNTSFNPTWFHCLVWKSLTERDNLELKV

SEQ ID NO: 2244733 - protein, 42 aa, Cryptosporidium parvum; identical to SEQ ID NO: 2131716

SEQ ID NO: 2244734 - protein, 50 aa, Cryptosporidium parvum
KNYLVAPRSNFLEMEDISLILSLFVLAVDHLPAFLNRYMASSPSNVVYRS

SEQ ID NO: 2244735 - protein, 21 aa, Cryptosporidium parvum
KPFKLNYILKGSLTLKKEKKI

SEQ ID NO: 2244736 - protein, 19 aa, Cryptosporidium parvum
KPIYKLVLGPWTHSGRASC

SEQ ID NO: 2244737 - protein, 27 aa, Cryptosporidium parvum
KPKEYLNLFYHMAIPILIISIYVPFSN

SEQ ID NO: 2244738 - protein, 24 aa, Cryptosporidium parvum
KPLKYWNLFLALFSFIGTLRLMPY

SEQ ID NO: 2244739 - protein, 28 aa, Cryptosporidium parvum
KPNFTTLFDYFYFTIITISTVGYGDYTP

SEQ ID NO: 2244740 - protein, 32 aa, Cryptosporidium parvum
KPNNNQNLPVWLPLLVQGVTSCNILLRPNSTE

SEQ ID NO: 2244741 - protein, 28 aa, Cryptosporidium parvum
KPNRLTYFLYSFILKIRQLDTWMENLVE

SEQ ID NO: 2244742 - protein, 20 aa, Cryptosporidium parvum
KPPKIITGKITYKLPKKIKK

SEQ ID NO: 2244743 - protein, 20 aa, Cryptosporidium parvum
KPQLVLIWHGSKFPTESLSI

SEQ ID NO: 2244744 - protein, 26 aa, Cryptosporidium parvum
KPSDLYFCEIFTDFFLGIGDVLCKSI

SEQ ID NO: 2244745 - protein, 28 aa, Cryptosporidium parvum
KPVFSNLILLILCYIVEIEPYIPKSLEY

SEQ ID NO: 2244746 - protein, 21 aa, Cryptosporidium parvum
KPYYFIKFDRIIQRCKSEYKD

SEQ ID NO: 2244747 - protein, 17 aa, Cryptosporidium parvum
KQEMFLKQALSVNKRIV

SEQ ID NO: 2244748 - protein, 27 aa, Cryptosporidium parvum
KQGILTIPIYFLLLRDQERATKILVNT

SEQ ID NO: 2244749 - protein, 18 aa, Cryptosporidium parvum
KQIYRVLILFNKSDLITS

SEQ ID NO: 2244750 - protein, 17 aa, Cryptosporidium parvum
KQKHCVSFLAWSSDFTV

SEQ ID NO: 2244751 - protein, 43 aa, Cryptosporidium parvum
KQKNQYFKWIILGFVLIFAILPPFIMDIYIYAKIRFQDYKINS

SEQ ID NO: 2244752 - protein, 19 aa, Cryptosporidium parvum
KQLFLIENLLYNFYLDNNS

SEQ ID NO: 2244753 - protein, 25 aa, Cryptosporidium parvum
KQNELLIRLIIYFKIIIEEKLDIYF

SEQ ID NO: 2244754 - protein, 25 aa, Cryptosporidium parvum
KQNNTFYIFLIDLSYKTGIFEKIMS

SEQ ID NO: 2244755 - protein, 27 aa, Cryptosporidium parvum
KQNPKSYWAPLSLLLVAITLGFGKLSS

SEQ ID NO: 2244756 - protein, 25 aa, Cryptosporidium parvum
KQRISLPAFILDIFLIISGIITSIV

SEQ ID NO: 2244757 - protein, 19 aa, Cryptosporidium parvum
KQRKRLCIVLVQHIPTQFK

SEQ ID NO: 2244758 - protein, 20 aa, Cryptosporidium parvum
KQRWTGIHNVGFYTNPKANF

SEQ ID NO: 2244759 - protein, 36 aa, Cryptosporidium parvum; identical to SEQ ID NO: 2131732

SEQ ID NO: 2244760 - protein, 22 aa, Cryptosporidium parvum
KQVFTSLLKTLLYNLVSTEPSV

SEQ ID NO: 2244761 - protein, 30 aa, Cryptosporidium parvum; identical to SEQ ID NO: 2131734

SEQ ID NO: 2244762 - protein, 25 aa, Cryptosporidium parvum
KRAGSIYFNIIGLLSQLLMEIHLEG

SEQ ID NO: 2244763 - protein, 23 aa, Cryptosporidium parvum
KRDKIGLMLFSYNPRSMELENVW

SEQ ID NO: 2244764 - protein, 18 aa, Cryptosporidium parvum
KREKLYYPRGYNPEWDNG

SEQ ID NO: 2244765 - protein, 20 aa, Cryptosporidium parvum
KRFKIVVRPLNGRDLTVEAS

SEQ ID NO: 2244766 - protein, 27 aa, Cryptosporidium parvum
KRFRFNFGIIILHFILANIKNGIFEKF

SEQ ID NO: 2244767 - protein, 25 aa, Cryptosporidium parvum
KRFSSLYIRNPWGYTLNNILGVPDL

SEQ ID NO: 2244768 - protein, 23 aa, Cryptosporidium parvum
KRGYCILFMRLLEIPGESVPISA

SEQ ID NO: 2244769 - protein, 20 aa, Cryptosporidium parvum
KRHILNNYCILFPIIEEQTF

SEQ ID NO: 2244770 - protein, 18 aa, Cryptosporidium parvum
KRIFGQMPAIKNICALVA

SEQ ID NO: 2244771 - protein, 27 aa, Cryptosporidium parvum
KRIKITPYYILSILFSLDIPRKEIYNQ

SEQ ID NO: 2244772 - protein, 21 aa, Cryptosporidium parvum
KRIKSISLTLSIPPLTKPTDF

SEQ ID NO: 2244773 - protein, 21 aa, Cryptosporidium parvum
KRISILFVSIFSFIEIVSPRP

SEQ ID NO: 2244774 - protein, 30 aa, Cryptosporidium parvum
KRKELFILAPFKFILNWILSKYVLFMIGLS

SEQ ID NO: 2244775 - protein, 17 aa, Cryptosporidium parvum
KRKISLVDFDRLVERFY

SEQ ID NO: 2244776 - protein, 25 aa, Cryptosporidium parvum
KRKLTVGLLVPLGEEQDWLYSTRKG

SEQ ID NO: 2244777 - protein, 24 aa, Cryptosporidium parvum
KRKVMVLIIVYRYLVIIQNDIASN

SEQ ID NO: 2244778 - protein, 29 aa, Cryptosporidium parvum
KRLDNRAEIIWILVHSFFSTLTSLYIHSD

SEQ ID NO: 2244779 - protein, 23 aa, Cryptosporidium parvum
KRLKLIAVVPFKGIFSTNTIQLL

SEQ ID NO: 2244780 - protein, 26 aa, Cryptosporidium parvum
KRLYILGLILVIFSYIPICSLLFFSN

SEQ ID NO: 2244781 - protein, 28 aa, Cryptosporidium parvum
KRNKSLIFVYLLLSTVPLLSFKIIEYKI

SEQ ID NO: 2244782 - protein, 20 aa, Cryptosporidium parvum
KRRELILIRFFTTFKVDKSN

SEQ ID NO: 2244783 - protein, 38 aa, Cryptosporidium parvum
KRSTRKMLLFLIIVIACSIAILHSPIYTLLKNLIGYLV

SEQ ID NO: 2244784 - protein, 23 aa, Cryptosporidium parvum
KRVKIYVWYNFGVNFITSYNCKR

SEQ ID NO: 2244785 - protein, 24 aa, Cryptosporidium parvum
KRYRSINIQKLFDQLILTVVFHRD

SEQ ID NO: 2244786 - protein, 28 aa, Cryptosporidium parvum
KSALFIFGFIIALIIGNYFVLSSTFCFN

SEQ ID NO: 2244787 - protein, 23 aa, Cryptosporidium parvum
KSAYLMSILIIKYIQIKVDNDSD

SEQ ID NO: 2244788 - protein, 24 aa, Cryptosporidium parvum
KSCKYLIMLLNPWDLPIDCISEEF

SEQ ID NO: 2244789 - protein, 17 aa, Cryptosporidium parvum
KSDAKWQIAKPTVTLVG

SEQ ID NO: 2244790 - protein, 18 aa, Cryptosporidium parvum
KSDILECFIKWKNDHYYT

SEQ ID NO: 2244791 - protein, 31 aa, Cryptosporidium parvum; identical to SEQ ID NO: 2131747

SEQ ID NO: 2244792 - protein, 26 aa, Cryptosporidium parvum
KSEFEDKIRWFGLSKYSSQKLDSFTK

SEQ ID NO: 2244793 - protein, 21 aa, Cryptosporidium parvum
KSEFFINPTLPSFFRDENPKK

SEQ ID NO: 2244794 - protein, 17 aa, Cryptosporidium parvum
KSFLVLGASFFINKDVI

SEQ ID NO: 2244795 - protein, 33 aa, Cryptosporidium parvum
KSFSGFSIHPFLLQLLFDFIKLYNIEEIIKGNS

SEQ ID NO: 2244796 - protein, 23 aa, Cryptosporidium parvum
KSGARFYILTKNAIPIEKIIRTD

SEQ ID NO: 2244797 - protein, 20 aa, Cryptosporidium parvum
KSGKLPISLFFIEIKNEEDF

SEQ ID NO: 2244798 - protein, 24 aa, Cryptosporidium parvum
KSHHTSPFMLILNAQNLTINYSIN

SEQ ID NO: 2244799 - protein, 27 aa, Cryptosporidium parvum
KSIELFLFRKVFEFMNLILEYNFQEFF

SEQ ID NO: 2244800 - protein, 34 aa, Cryptosporidium parvum
KSIISTLPFWPYLPKKFLFSIIDQVLIFMKNGTN

SEQ ID NO: 2244801 - protein, 27 aa, Cryptosporidium parvum
KSIKNFNIPFPFVAKLARLFPESMRTK

SEQ ID NO: 2244802 - protein, 33 aa, Cryptosporidium parvum
KSIKRNWNFTPEPLWILCFIYGTFIALTDSYTL

SEQ ID NO: 2244803 - protein, 25 aa, Cryptosporidium parvum
KSIKYLFEELVLPISLATLVTISEH

SEQ ID NO: 2244804 - protein, 40 aa, Cryptosporidium parvum
KSINSKMIIILVALFIFFALYNHYYYFFNEPNFCNSNIYG

SEQ ID NO: 2244805 - protein, 26 aa, Cryptosporidium parvum
KSKFKRHRMIRILKSDWDKFYSGQKG

SEQ ID NO: 2244806 - protein, 24 aa, Cryptosporidium parvum
KSKIPIFYHILEEINIIKIRLPIL

SEQ ID NO: 2244807 - protein, 32 aa, Cryptosporidium parvum
KSKITILFILIFYLFLLLIVYKNILNRWNILI

SEQ ID NO: 2244808 - protein, 17 aa, Cryptosporidium parvum
KSKLINLNTFSNSLLKP

SEQ ID NO: 2244809 - protein, 24 aa, Cryptosporidium parvum
KSKLSLIIWMFISSIFTISQPLVD

SEQ ID NO: 2244810 - protein, 24 aa, Cryptosporidium parvum
KSKSPGLFLLTFLVCLLTSSVAVL

SEQ ID NO: 2244811 - protein, 60 aa, Cryptosporidium parvum
KSKWSIYRLVFIYSFLLIMYQFLDILLKFSIIYLLIQMSFWPWNFLITTTLQLIFMGMCF

SEQ ID NO: 2244812 - protein, 26 aa, Cryptosporidium parvum
KSLEYYNYLLKWLSIIITFFSLNCND

SEQ ID NO: 2244813 - protein, 17 aa, Cryptosporidium parvum
KSLIWRLIPMGSMVFHS

SEQ ID NO: 2244814 - protein, 17 aa, Cryptosporidium parvum
KSLLAVVRCDLTYRFTG

SEQ ID NO: 2244815 - protein, 51 aa, Cryptosporidium parvum
KSLREKKLLWTFRILSGILLLFYFVIGWLGTFYPPLYWPNPIGVISFSDGA

SEQ ID NO: 2244816 - protein, 26 aa, Cryptosporidium parvum
KSLRFNCLDLYIQYKLFTESKKLETT

SEQ ID NO: 2244817 - protein, 25 aa, Cryptosporidium parvum
KSNIPEVPALYFIKPTEENIDKLCD

SEQ ID NO: 2244818 - protein, 22 aa, Cryptosporidium parvum
KSNMDFWMDLISDFALGIVTFK

SEQ ID NO: 2244819 - protein, 32 aa, Cryptosporidium parvum
KSNYMWSVLGIKLIRYFDFRIKNGLLYDCKIN

SEQ ID NO: 2244820 - protein, 19 aa, Cryptosporidium parvum
KSPLIQFIVQSIFAYFNSL

SEQ ID NO: 2244821 - protein, 27 aa, Cryptosporidium parvum
KSPLKFLTIILPLKLILSLFFCLLLIW

SEQ ID NO: 2244822 - protein, 24 aa, Cryptosporidium parvum
KSPNDKLVIIFSKRLKYVYLYHRV

SEQ ID NO: 2244823 - protein, 32 aa, Cryptosporidium parvum
KSPSILVSILRLLILNPRLALSSRMPRFSEEV

SEQ ID NO: 2244824 - protein, 23 aa, Cryptosporidium parvum
KSRERLFSLIKKTKPKGLFFLSG

SEQ ID NO: 2244825 - protein, 20 aa, Cryptosporidium parvum
KSRIKTLGPPPIRRIYDLKI

SEQ ID NO: 2244826 - protein, 24 aa, Cryptosporidium parvum
KSRKIVFMALINGKQHILDFTKPH

SEQ ID NO: 2244827 - protein, 22 aa, Cryptosporidium parvum
KSSFLIHLENFLKFIISSVLSI

SEQ ID NO: 2244828 - protein, 21 aa, Cryptosporidium parvum
KSSLFSAILRLFDPSFGAILI

SEQ ID NO: 2244829 - protein, 22 aa, Cryptosporidium parvum
KSSLLHFNGNISTPLYAMERIT

SEQ ID NO: 2244830 - protein, 24 aa, Cryptosporidium parvum
KSSLNNLFKYYWNKNDILEELSDF

SEQ ID NO: 2244831 - protein, 17 aa, Cryptosporidium parvum
KSSLYIFTTSCLILAFS

SEQ ID NO: 2244832 - protein, 17 aa, Cryptosporidium parvum
KSSLYSNDLKKLVLILL

SEQ ID NO: 2244833 - protein, 32 aa, Cryptosporidium parvum
KSSRLHIFIFVGIAIIILLISSIILINSWNKK

SEQ ID NO: 2244834 - protein, 20 aa, Cryptosporidium parvum
KSTFQFLQKTLSNILSVFSD

SEQ ID NO: 2244835 - protein, 18 aa, Cryptosporidium parvum
KSTFYSLNLFVNHSLQDC

SEQ ID NO: 2244836 - protein, 26 aa, Cryptosporidium parvum
KSTGLPIDPMVGLPFDPKSGNLVHPY

SEQ ID NO: 2244837 - protein, 17 aa, Cryptosporidium parvum
KSTIRIEAYWWLIDRIS

SEQ ID NO: 2244838 - protein, 30 aa, Cryptosporidium parvum
KSTTLIWNVLFQFILLRIKLPVSTILSCFL

SEQ ID NO: 2244839 - protein, 27 aa, Cryptosporidium parvum
KSTTVCYSLLLQYFLLGIRAKLSSVLS

SEQ ID NO: 2244840 - protein, 20 aa, Cryptosporidium parvum
KSVILTFDLSSEDLFSKISL

SEQ ID NO: 2244841 - protein, 23 aa, Cryptosporidium parvum
KSVKLLRLLYSSIIDIFISMDHE

SEQ ID NO: 2244842 - protein, 26 aa, Cryptosporidium parvum
KSVLIFFIVTIFYGYQIKLLECATAN

SEQ ID NO: 2244843 - protein, 19 aa, Cryptosporidium parvum
KSYIFFPKDKEEKYFYQVF

SEQ ID NO: 2244844 - protein, 38 aa, Cryptosporidium parvum
KTFKCYRLLFIVQVICLIFSFLITMKLPFNCYSSPEFS

SEQ ID NO: 2244845 - protein, 24 aa, Cryptosporidium parvum
KTFTNLLHNSFFLDMFMLNHRNVK

SEQ ID NO: 2244846 - protein, 17 aa, Cryptosporidium parvum
KTGRFLPKLLSPIIAAY

SEQ ID NO: 2244847 - protein, 26 aa, Cryptosporidium parvum
KTGTEFLLNILQWLSSMPFSNVPIEF

SEQ ID NO: 2244848 - protein, 21 aa, Cryptosporidium parvum
KTIETIFFSYFKIMTDNTYLN

SEQ ID NO: 2244849 - protein, 19 aa, Cryptosporidium parvum
KTILNFCTTFQRVAIVYKE

SEQ ID NO: 2244850 - protein, 19 aa, Cryptosporidium parvum
KTINYLPIKDHYSWISTYR

SEQ ID NO: 2244851 - protein, 20 aa, Cryptosporidium parvum
KTIPYYVAQSQANTLQLHSG

SEQ ID NO: 2244852 - protein, 21 aa, Cryptosporidium parvum
KTIYCWKSIEIYKIIIKQCFS

SEQ ID NO: 2244853 - protein, 25 aa, Cryptosporidium parvum
KTKKIELLNRKLLSLGILKVQLDDH

SEQ ID NO: 2244854 - protein, 19 aa, Cryptosporidium parvum
KTKPKGLFFLSGDVHWGQI

SEQ ID NO: 2244855 - protein, 17 aa, Cryptosporidium parvum
KTKYPWYDYLAVIVITI

SEQ ID NO: 2244856 - protein, 17 aa, Cryptosporidium parvum
KTLLYNLVSTEPSVYAG

SEQ ID NO: 2244857 - protein, 22 aa, Cryptosporidium parvum
KTMKCRAYLKNMQKVKFSLCSI

SEQ ID NO: 2244858 - protein, 25 aa, Cryptosporidium parvum
KTNINYFDKLPKFDYKWTISKNISE

SEQ ID NO: 2244859 - protein, 35 aa, Cryptosporidium parvum
KTNSIQMFTRKMIVLFLFAGFLGLFPGSFFHNRTP

SEQ ID NO: 2244860 - protein, 27 aa, Cryptosporidium parvum
KTNYNLYYVWRYLKPNHKISFSRDEYG

SEQ ID NO: 2244861 - protein, 17 aa, Cryptosporidium parvum
KTRFYQFINYKKATEFE

SEQ ID NO: 2244862 - protein, 20 aa, Cryptosporidium parvum
KTRNALILGLGGGILASILR

SEQ ID NO: 2244863 - protein, 32 aa, Cryptosporidium parvum
KTSDITILYLFDSIYEELYSFGFLLIGSCMTL

SEQ ID NO: 2244864 - protein, 29 aa, Cryptosporidium parvum
KTSILRKIIGFPILITRSIILSICLIMFT

SEQ ID NO: 2244865 - protein, 27 aa, Cryptosporidium parvum
KTSLPIIFIRYIQYTLCLSPYALLCLW

SEQ ID NO: 2244866 - protein, 40 aa, Cryptosporidium parvum; identical to SEQ ID NO: 2131800

SEQ ID NO: 2244867 - protein, 17 aa, Cryptosporidium parvum
KTTFIEAILGDLFRIRG

SEQ ID NO: 2244868 - protein, 17 aa, Cryptosporidium parvum
KTWHLFLGISIKVNEEF

SEQ ID NO: 2244869 - protein, 23 aa, Cryptosporidium parvum
KVELSTIKPFKLIKKPKIESLQI

SEQ ID NO: 2244870 - protein, 25 aa, Cryptosporidium parvum
KVENFPTIIFLDKILISLPIESICD

SEQ ID NO: 2244871 - protein, 18 aa, Cryptosporidium parvum
KVFFDVLQTLATLSLRSF

SEQ ID NO: 2244872 - protein, 32 aa, Cryptosporidium parvum; identical to SEQ ID NO: 2131807

SEQ ID NO: 2244873 - protein, 23 aa, Cryptosporidium parvum
KVFYESILPHLMLKLDTLAVEPN

SEQ ID NO: 2244874 - protein, 22 aa, Cryptosporidium parvum
KVGFQIFNRLFGPNGLLLTVSS

SEQ ID NO: 2244875 - protein, 22 aa, Cryptosporidium parvum
KVGIIMAIFFNMWSTITASRFF

SEQ ID NO: 2244876 - protein, 25 aa, Cryptosporidium parvum
KVGRVKCWIPNQSIELPLRRALQIR

SEQ ID NO: 2244877 - protein, 24 aa, Cryptosporidium parvum
KVGSLKYTWYFDFDDITVNFLDGF

SEQ ID NO: 2244878 - protein, 25 aa, Cryptosporidium parvum
KVIDRYLDFVSLSPTKFSLGMDKVY

SEQ ID NO: 2244879 - protein, 17 aa, Cryptosporidium parvum
KVIFFDLNKKKLFIGLN

SEQ ID NO: 2244880 - protein, 32 aa, Cryptosporidium parvum
KVIFKHRMLFVSFLVLGLALVTYILIGSYKIK

SEQ ID NO: 2244881 - protein, 17 aa, Cryptosporidium parvum
KVIYYKIASFFYTINFI

SEQ ID NO: 2244882 - protein, 25 aa, Cryptosporidium parvum
KVLIYSIFLVLISSLLFSIYVGEFN

SEQ ID NO: 2244883 - protein, 26 aa, Cryptosporidium parvum
KVLKYELVITLLTGWSLICDRNRRFE

SEQ ID NO: 2244884 - protein, 24 aa, Cryptosporidium parvum
KVLNIPLDKVALYDLYPLAVIRKY

SEQ ID NO: 2244885 - protein, 30 aa, Cryptosporidium parvum
KVLSFIYYTWFMFGFYWILSVRPNVETFSG

SEQ ID NO: 2244886 - protein, 33 aa, Cryptosporidium parvum
KVLTNPIFFEVYFKELFYVPYSILSFGTCINQH

SEQ ID NO: 2244887 - protein, 26 aa, Cryptosporidium parvum
KVLVFCIVLNILNLSFVTSKNTLNFK

SEQ ID NO: 2244888 - protein, 32 aa, Cryptosporidium parvum
KVLVSTWFLAQLGLLFLIFSEPSLITCFFKIN

SEQ ID NO: 2244889 - protein, 24 aa, Cryptosporidium parvum
KVLVVVKLLSILGFGTNYGLVNAD

SEQ ID NO: 2244890 - protein, 23 aa, Cryptosporidium parvum
KVNCAVLLIMDIFTKVTSLDLPN

SEQ ID NO: 2244891 - protein, 24 aa, Cryptosporidium parvum
KVNIDKFWITRDASILPLITETIK

SEQ ID NO: 2244892 - protein, 27 aa, Cryptosporidium parvum
KVNSILSYFLRLLKVLLTRESKNYFNE

SEQ ID NO: 2244893 - protein, 19 aa, Cryptosporidium parvum
KVPIISYLGFSQILKFILN

SEQ ID NO: 2244894 - protein, 23 aa, Cryptosporidium parvum
KVPLPVIVFISIISIWIINQVIN

SEQ ID NO: 2244895 - protein, 27 aa, Cryptosporidium parvum
KVRAIIVFLFLVFSIFLATNLQDLLLL

SEQ ID NO: 2244896 - protein, 21 aa, Cryptosporidium parvum
KVRAMIELAMYLAPEECPARK

SEQ ID NO: 2244897 - protein, 18 aa, Cryptosporidium parvum
KVRLPLSVVLFGYGIMMD

SEQ ID NO: 2244898 - protein, 26 aa, Cryptosporidium parvum
KVSELLYSIIYYGPPPDWQLSVTIST

SEQ ID NO: 2244899 - protein, 24 aa, Cryptosporidium parvum
KVTFAICLLVWSCILFIACGTVAD

SEQ ID NO: 2244900 - protein, 32 aa, Cryptosporidium parvum
KVTFLPSIEYISYLKWYFVGINKLLTSDLTLA

SEQ ID NO: 2244901 - protein, 19 aa, Cryptosporidium parvum
KVTLEQIPAYLFINGGTKL

SEQ ID NO: 2244902 - protein, 20 aa, Cryptosporidium parvum
KVVWFTLELNYYLYLREISK

SEQ ID NO: 2244903 - protein, 25 aa, Cryptosporidium parvum
KVYGNWIPRTFFGYGTTLFSYIRII

SEQ ID NO: 2244904 - protein, 19 aa, Cryptosporidium parvum
KWFEFYKYILSNGTHDIII

SEQ ID NO: 2244905 - protein, 31 aa, Cryptosporidium parvum
KWIHIFYIEIKYLFWIWKSNYLQNAPSTEIP

SEQ ID NO: 2244906 - protein, 20 aa, Cryptosporidium parvum
KWLRRKWVDVKYTTLLSFPG

SEQ ID NO: 2244907 - protein, 27 aa, Cryptosporidium parvum
KWNEISHPFLLKRMLSPIINLNKIVKD

SEQ ID NO: 2244908 - protein, 36 aa, Cryptosporidium parvum
KYAFFHYMCAYLFILTVISFLYWDGFTEILEMNQVS

SEQ ID NO: 2244909 - protein, 26 aa, Cryptosporidium parvum
KYASYKLFMLLLSNINIQDLRKSKVK

SEQ ID NO: 2244910 - protein, 30 aa, Cryptosporidium parvum
KYDIEKIIFIITPLHLLINYFKNIGNYCIR

SEQ ID NO: 2244911 - protein, 33 aa, Cryptosporidium parvum; identical to SEQ ID NO: 2131831

SEQ ID NO: 2244912 - protein, 17 aa, Cryptosporidium parvum
KYGKFIRFKGIFKAKNS

SEQ ID NO: 2244913 - protein, 21 aa, Cryptosporidium parvum
KYGLLALAYILTIVKCQRKIP

SEQ ID NO: 2244914 - protein, 32 aa, Cryptosporidium parvum
KYICIFSFKVIMFRFFLLISRQGKTRLEKWYS

SEQ ID NO: 2244915 - protein, 17 aa, Cryptosporidium parvum
KYIFRSLQLIQEDHFFP

SEQ ID NO: 2244916 - protein, 17 aa, Cryptosporidium parvum
KYKPEFPFIRMVNPSPI

SEQ ID NO: 2244917 - protein, 24 aa, Cryptosporidium parvum
KYLILLCYAFNIFLSLVFCQELTS

SEQ ID NO: 2244918 - protein, 21 aa, Cryptosporidium parvum
KYLSLAFKKYSDHLPCAVWLP

SEQ ID NO: 2244919 - protein, 26 aa, Cryptosporidium parvum
KYLSNLWLLSLINKDPWLSIISILNY

SEQ ID NO: 2244920 - protein, 32 aa, Cryptosporidium parvum
KYNLLQFVFVSLWTRSKRFPIAISFLSILISF

SEQ ID NO: 2244921 - protein, 30 aa, Cryptosporidium parvum; identical to SEQ ID NO: 2131838

SEQ ID NO: 2244922 - protein, 17 aa, Cryptosporidium parvum
KYQLLSNNVLPISPIPL

SEQ ID NO: 2244923 - protein, 26 aa, Cryptosporidium parvum
KYQNNIFFLSILRSLFRSITPGGKAS

SEQ ID NO: 2244924 - protein, 21 aa, Cryptosporidium parvum
KYRNKFACKLLKPLIDDYINK

SEQ ID NO: 2244925 - protein, 18 aa, Cryptosporidium parvum
KYSAFSPAFDIIPFWVLI

SEQ ID NO: 2244926 - protein, 23 aa, Cryptosporidium parvum
KYSFNILVFLLIQIIQRNSRNIL

SEQ ID NO: 2244927 - protein, 19 aa, Cryptosporidium parvum
KYSRTPPFGYFPIFEMDTN

SEQ ID NO: 2244928 - protein, 23 aa, Cryptosporidium parvum
KYVPCDVHLFLIGIRLRNQNDSN

SEQ ID NO: 2244929 - protein, 27 aa, Cryptosporidium parvum
KYVQMWSILFFFIPMFGTGEVIPAFTT

SEQ ID NO: 2244930 - protein, 23 aa, Cryptosporidium parvum
KYYLDLLFLLPIIYNFLSIPNRT

SEQ ID NO: 2244931 - protein, 23 aa, Cryptosporidium parvum
LAAYLLLCFVIGNGLGPLILFSN

SEQ ID NO: 2244932 - protein, 19 aa, Cryptosporidium parvum
LAFACKPVFRLLLPKLLII

SEQ ID NO: 2244933 - protein, 30 aa, Cryptosporidium parvum; identical to SEQ ID NO: 2131845

SEQ ID NO: 2244934 - protein, 24 aa, Cryptosporidium parvum
LAGLLKVLLVMSRRFFPGIGNLIN

SEQ ID NO: 2244935 - protein, 22 aa, Cryptosporidium parvum
LAILILNSLLILATFFTIFFLN

SEQ ID NO: 2244936 - protein, 24 aa, Cryptosporidium parvum
LAILKSFFISLKFNDRRLPRLFSK

SEQ ID NO: 2244937 - protein, 23 aa, Cryptosporidium parvum
LAKRHFPELISTILLRCCSTLGY

SEQ ID NO: 2244938 - protein, 19 aa, Cryptosporidium parvum
LALFGWMLLLLYCGVLIDI

SEQ ID NO: 2244939 - protein, 18 aa, Cryptosporidium parvum
LALHPSSIYRRLLTFILE

SEQ ID NO: 2244940 - protein, 22 aa, Cryptosporidium parvum
LALILFFLTKISQIYCDINCSR

SEQ ID NO: 2244941 - protein, 17 aa, Cryptosporidium parvum
LALISHISAHIGSLLAW

SEQ ID NO: 2244942 - protein, 22 aa, Cryptosporidium parvum
LANIDKFQWSDDPFIKAGALIA

SEQ ID NO: 2244943 - protein, 18 aa, Cryptosporidium parvum
LAQCILLTELSIRILSKS

SEQ ID NO: 2244944 - protein, 17 aa, Cryptosporidium parvum
LAQSIVLRKLLLCMQNP

SEQ ID NO: 2244945 - protein, 24 aa, Cryptosporidium parvum
LARILLCLTTIPRLSFILDDDIFS

SEQ ID NO: 2244946 - protein, 19 aa, Cryptosporidium parvum
LASILLPLIKKYRVDFIIS

SEQ ID NO: 2244947 - protein, 27 aa, Cryptosporidium parvum
LASLWFGSYIHITNLKRLPTDGWMLLG

SEQ ID NO: 2244948 - protein, 24 aa, Cryptosporidium parvum
LATATFLVVALWISSLFSANWQNY

SEQ ID NO: 2244949 - protein, 26 aa, Cryptosporidium parvum
LAVKFKKIIRYLSIFKFNFENINCIL

SEQ ID NO: 2244950 - protein, 17 aa, Cryptosporidium parvum
LAYILTIVKCQRKIPEY

SEQ ID NO: 2244951 - protein, 18 aa, Cryptosporidium parvum
LCARFLTESKFLLESSCC

SEQ ID NO: 2244952 - protein, 31 aa, Cryptosporidium parvum
LCDDLRNLYYESYYVNFISPCTDRLLEYFAK

SEQ ID NO: 2244953 - protein, 20 aa, Cryptosporidium parvum
LCDSKMVPPQPLFPELKRVQ

SEQ ID NO: 2244954 - protein, 17 aa, Cryptosporidium parvum
LCFFKMDSSVESSIMEV

SEQ ID NO: 2244955 - protein, 23 aa, Cryptosporidium parvum
LCHLTFQFLFLSSGTYKKFPIMT

SEQ ID NO: 2244956 - protein, 19 aa, Cryptosporidium parvum
LCIEKFKIFVKYPSNNFSG

SEQ ID NO: 2244957 - protein, 18 aa, Cryptosporidium parvum
LCIINYPEVAQKLGMEVI

SEQ ID NO: 2244958 - protein, 27 aa, Cryptosporidium parvum
LCLIAEVGLFMIYDIKRNMKVSKVMKE

SEQ ID NO: 2244959 - protein, 19 aa, Cryptosporidium parvum
LCLPLISIYEFGSSDFYFK

SEQ ID NO: 2244960 - protein, 27 aa, Cryptosporidium parvum
LCPIKLIGMVFVLSPSPLLQSCTDELL

SEQ ID NO: 2244961 - protein, 29 aa, Cryptosporidium parvum
LCSDPISLYFLSLLPWYTIDQNVNDALSI

SEQ ID NO: 2244962 - protein, 20 aa, Cryptosporidium parvum
LCVKQWHAIIRQFMDLKFHQ

SEQ ID NO: 2244963 - protein, 25 aa, Cryptosporidium parvum
LDAVARIWDLFFLEGVDLIFKISIA

SEQ ID NO: 2244964 - protein, 34 aa, Cryptosporidium parvum
LDDQDNWYFIYVLYVWLSTLVLIPFSFEVLDSKY

SEQ ID NO: 2244965 - protein, 37 aa, Cryptosporidium parvum
LDDQFRLTCDIWIHPICLEWLIIARVQVFSLNNVILI

SEQ ID NO: 2244966 - protein, 30 aa, Cryptosporidium parvum
LDDSIITSPPWWMVWQSQFYPRLSIEKNIK

SEQ ID NO: 2244967 - protein, 25 aa, Cryptosporidium parvum
LDEIKYQILINKLNPMYITEKKYYE

SEQ ID NO: 2244968 - protein, 23 aa, Cryptosporidium parvum
LDEKLVYFPSYFRNNIISQRLEF

SEQ ID NO: 2244969 - protein, 25 aa, Cryptosporidium parvum
LDESMLIERWKWVLAIFAIHNIIGG

SEQ ID NO: 2244970 - protein, 20 aa, Cryptosporidium parvum
LDFDFINWLGDYSGYYLPFQ

SEQ ID NO: 2244971 - protein, 20 aa, Cryptosporidium parvum
LDFENQFLFCLSNRNFQILS

SEQ ID NO: 2244972 - protein, 21 aa, Cryptosporidium parvum
LDFLRGSRIFGMISESIGSLC

SEQ ID NO: 2244973 - protein, 19 aa, Cryptosporidium parvum
LDFYGDLHILLTPPPHVFA

SEQ ID NO: 2244974 - protein, 30 aa, Cryptosporidium parvum
LDGIYLGYFYTWMILFAAAQLFWVLSNIGN

SEQ ID NO: 2244975 - protein, 18 aa, Cryptosporidium parvum
LDHPNIMKLYDFFEDKRN

SEQ ID NO: 2244976 - protein, 28 aa, Cryptosporidium parvum
LDHSFVEIQLIYYLVYSLSIHNISSSSQ

SEQ ID NO: 2244977 - protein, 21 aa, Cryptosporidium parvum
LDIFIAKFFIAVSMVFSFPIQ

SEQ ID NO: 2244978 - protein, 18 aa, Cryptosporidium parvum
LDIIIQPEVFFNSIYRTN

SEQ ID NO: 2244979 - protein, 17 aa, Cryptosporidium parvum
LDILISLIDNCRRLQSE

SEQ ID NO: 2244980 - protein, 19 aa, Cryptosporidium parvum
LDIVLLMKVLCYPDTSWNA

SEQ ID NO: 2244981 - protein, 22 aa, Cryptosporidium parvum
LDKPQPRSLPLRGFPSSLATDS

SEQ ID NO: 2244982 - protein, 20 aa, Cryptosporidium parvum
LDLCLRILHIFKYESVVIVD

SEQ ID NO: 2244983 - protein, 17 aa, Cryptosporidium parvum
LDLICRVPIQCKLTINQ

SEQ ID NO: 2244984 - protein, 20 aa, Cryptosporidium parvum
LDLIFNFHKAYFILDEIILA

SEQ ID NO: 2244985 - protein, 26 aa, Cryptosporidium parvum
LDLKHHLLIYFFIEAFISLIEVLTSI

SEQ ID NO: 2244986 - protein, 25 aa, Cryptosporidium parvum
LDMIDLILFHIKKIRSFSLDCLNLK

SEQ ID NO: 2244987 - protein, 22 aa, Cryptosporidium parvum
LDMITWYSQTCLKNLIFKENLQ

SEQ ID NO: 2244988 - protein, 26 aa, Cryptosporidium parvum
LDNAFSIIVLPIPTCPLASPSERLRC

SEQ ID NO: 2244989 - protein, 32 aa, Cryptosporidium parvum; identical to SEQ ID NO: 2131878

SEQ ID NO: 2244990 - protein, 33 aa, Cryptosporidium parvum
LDRTNALQWYIAWTWFVDLILSISTCSLENSNL

SEQ ID NO: 2244991 - protein, 23 aa, Cryptosporidium parvum
LDSFPSIYSALTLWNHGSAWSGF

SEQ ID NO: 2244992 - protein, 23 aa, Cryptosporidium parvum
LDSLPIWVSPILHRQIKRVNSQL

SEQ ID NO: 2244993 - protein, 24 aa, Cryptosporidium parvum
LDTNEIGVPLMFALNLTIPERVGT

SEQ ID NO: 2244994 - protein, 25 aa, Cryptosporidium parvum
LDTPYSWMLILFRAGPIGGMILMIP

SEQ ID NO: 2244995 - protein, 26 aa, Cryptosporidium parvum
LDTSIFLPLTIKVVSYFKIDSIMLFL

SEQ ID NO: 2244996 - protein, 24 aa, Cryptosporidium parvum
LDVIKHVIQLILIVAPTLDPGNED

SEQ ID NO: 2244997 - protein, 20 aa, Cryptosporidium parvum
LDYMPFFVRQCISVTTAFVR

SEQ ID NO: 2244998 - protein, 25 aa, Cryptosporidium parvum
LDYSIAFILCRIICELSQHGFLHIG

SEQ ID NO: 2244999 - protein, 26 aa, Cryptosporidium parvum
LEAWRSVLIPIYLPDTSVRGKYMTDI

SEQ ID NO: 2245000 - protein, 17 aa, Cryptosporidium parvum
LEELKFEFPLDGLCSWW

SEQ ID NO: 2245001 - protein, 22 aa, Cryptosporidium parvum
LEENNEILLHLSNGLAKCAQSL

SEQ ID NO: 2245002 - protein, 21 aa, Cryptosporidium parvum
LEEVAVLKLLDHPNIMKLYDF

SEQ ID NO: 2245003 - protein, 25 aa, Cryptosporidium parvum
LEEYSITLFWILKLNKQISEPFDNF

SEQ ID NO: 2245004 - protein, 17 aa, Cryptosporidium parvum
LEFHFLSKLIQIEWLYI

SEQ ID NO: 2245005 - protein, 18 aa, Cryptosporidium parvum
LEFPKLPCDILGVRIINL

SEQ ID NO: 2245006 - protein, 21 aa, Cryptosporidium parvum
LEFYLKIERIWKRSFIEDEKI

SEQ ID NO: 2245007 - protein, 24 aa, Cryptosporidium parvum
LEGFYIVSIIPFISLLVSMFYVIS

SEQ ID NO: 2245008 - protein, 28 aa, Cryptosporidium parvum
LEICRVGGILIFFYLISNYWKNQYDYLT

SEQ ID NO: 2245009 - protein, 20 aa, Cryptosporidium parvum
LEIFDGLYLFFNTNDQIIPR

SEQ ID NO: 2245010 - protein, 23 aa, Cryptosporidium parvum
LEIFEVMQFIYKIPIMVFEMNQE

SEQ ID NO: 2245011 - protein, 33 aa, Cryptosporidium parvum
LEIFITPHFVSDIYSLLYLYNSVIIIPEKIQKE

SEQ ID NO: 2245012 - protein, 26 aa, Cryptosporidium parvum
LEIIPYSLPIIPFKQVWDFAQTTMIQ

SEQ ID NO: 2245013 - protein, 25 aa, Cryptosporidium parvum
LEIKYPIAVNYLYPKKIISLTTKLN

SEQ ID NO: 2245014 - protein, 26 aa, Cryptosporidium parvum
LEIRTPFYLFILHTLRQHGVEYFLPE

SEQ ID NO: 2245015 - protein, 19 aa, Cryptosporidium parvum
LEISFYWNRPEAWEYPKNT

SEQ ID NO: 2245016 - protein, 18 aa, Cryptosporidium parvum
LEITQYIYKPWMGFLYLE

SEQ ID NO: 2245017 - protein, 20 aa, Cryptosporidium parvum
LEIVRKVILTSPARLRLQIS

SEQ ID NO: 2245018 - protein, 17 aa, Cryptosporidium parvum
LEKATLRWPSDLTFKIG

SEQ ID NO: 2245019 - protein, 28 aa, Cryptosporidium parvum
LEKSDIWMLSYMKFYCLFGKEKLSCVNN

SEQ ID NO: 2245020 - protein, 31 aa, Cryptosporidium parvum
LELDFVDPWKSLISMILYEPVRRSSLKFDEV

SEQ ID NO: 2245021 - protein, 20 aa, Cryptosporidium parvum
LELEGILELYNWVQKYDQSK

SEQ ID NO: 2245022 - protein, 23 aa, Cryptosporidium parvum
LELFDSLILIKTLMNKKILKKLG

SEQ ID NO: 2245023 - protein, 35 aa, Cryptosporidium parvum; identical to SEQ ID NO: 2131900

SEQ ID NO: 2245024 - protein, 17 aa, Cryptosporidium parvum
LELGTLSSTLLSSAMMI

SEQ ID NO: 2245025 - protein, 17 aa, Cryptosporidium parvum
LELILKYIDDLSLMYEA

SEQ ID NO: 2245026 - protein, 20 aa, Cryptosporidium parvum
LELLASVLCYIHPQSFGDII

SEQ ID NO: 2245027 - protein, 27 aa, Cryptosporidium parvum
LELMDNKLLLLPKNRLLWLNDQALKST

SEQ ID NO: 2245028 - protein, 23 aa, Cryptosporidium parvum
LELPIYINILFITITSLLLTQIF

SEQ ID NO: 2245029 - protein, 28 aa, Cryptosporidium parvum
LELTTVILGFFIFLIPTGYAQSKVIKGS

SEQ ID NO: 2245030 - protein, 26 aa, Cryptosporidium parvum
LEMFHASLTFRIIYYYGGGAADFLQS

SEQ ID NO: 2245031 - protein, 25 aa, Cryptosporidium parvum
LENDKLRVVLSLLLHERHGQNLNQQ

SEQ ID NO: 2245032 - protein, 33 aa, Cryptosporidium parvum
LENFFKSKLPILIEKIFLMLRNGSEKHTLWDIS

SEQ ID NO: 2245033 - protein, 22 aa, Cryptosporidium parvum
LENISFVFKIYAGLSAFSVLWF

SEQ ID NO: 2245034 - protein, 19 aa, Cryptosporidium parvum
LENIWRKKSFRRMVNEHIQ

SEQ ID NO: 2245035 - protein, 19 aa, Cryptosporidium parvum
LENKLFYTYFTYNLESSFD

SEQ ID NO: 2245036 - protein, 31 aa, Cryptosporidium parvum
LENPNNYLIPKLFWMLNHLITYINGLDDFKS

SEQ ID NO: 2245037 - protein, 30 aa, Cryptosporidium parvum
LENTINSMILPYFQLLPIPSSEFKPIKSNE

SEQ ID NO: 2245038 - protein, 23 aa, Cryptosporidium parvum
LEPDGWAFLKPPFKKKYVHNIPN

SEQ ID NO: 2245039 - protein, 17 aa, Cryptosporidium parvum
LEQIFRTAYDISPLVRM

SEQ ID NO: 2245040 - protein, 31 aa, Cryptosporidium parvum
LEQKKLDFFVKHLLEYILINQTLNIKKKGFL

SEQ ID NO: 2245041 - protein, 22 aa, Cryptosporidium parvum
LERLRTTFLISLNISKSVLEVD

SEQ ID NO: 2245042 - protein, 27 aa, Cryptosporidium parvum
LESERNLLFLRSLSVFGLLLNSMDSAT

SEQ ID NO: 2245043 - protein, 20 aa, Cryptosporidium parvum
LESIYNSKLKLLLGLYKLEI

SEQ ID NO: 2245044 - protein, 36 aa, Cryptosporidium parvum; identical to SEQ ID NO: 2131912

SEQ ID NO: 2245045 - protein, 46 aa, Cryptosporidium parvum
LESQNCWIHCMILMPPKFTFIHIQRIYLFLHDLYLSSKSLNNDFCK

SEQ ID NO: 2245046 - protein, 25 aa, Cryptosporidium parvum
LESSFFYIYVSLFSPLLRPLVFEGQ

SEQ ID NO: 2245047 - protein, 41 aa, Cryptosporidium parvum
LESYSWYLFGFFGKKNIILLIILFILLSLLICSIDTIVILW

SEQ ID NO: 2245048 - protein, 34 aa, Cryptosporidium parvum
LETKMVPYYIPYLEIGPYVWGLFIFIHCIAFYIR

SEQ ID NO: 2245049 - protein, 26 aa, Cryptosporidium parvum
LETNEKFLKILHIKRLKFPIYSIITQ

SEQ ID NO: 2245050 - protein, 26 aa, Cryptosporidium parvum
LETNLKMSLLSYYGLVLSIDQKSKST

SEQ ID NO: 2245051 - protein, 30 aa, Cryptosporidium parvum
LEVKSLIIFNYLFIIKLLKKIIQIESTSSG

SEQ ID NO: 2245052 - protein, 33 aa, Cryptosporidium parvum; identical to SEQ ID NO: 2131915

SEQ ID NO: 2245053 - protein, 18 aa, Cryptosporidium parvum
LEWIGPMGFLPFDNIKSI

SEQ ID NO: 2245054 - protein, 19 aa, Cryptosporidium parvum
LEWLGKATHWSRFSTAASL

SEQ ID NO: 2245055 - protein, 18 aa, Cryptosporidium parvum
LEYILKILSTHQANLEIP

SEQ ID NO: 2245056 - protein, 20 aa, Cryptosporidium parvum
LEYKKEAHIIFMFRQYYKLY

SEQ ID NO: 2245057 - protein, 34 aa, Cryptosporidium parvum
LEYLKDEYFLSALYFLLVLPFATKSKVSELDFLG

SEQ ID NO: 2245058 - protein, 19 aa, Cryptosporidium parvum
LFAALIPLKNTFFGDLPIC

SEQ ID NO: 2245059 - protein, 25 aa, Cryptosporidium parvum
LFATVYWPCISLSVPPTLLGTALGV

SEQ ID NO: 2245060 - protein, 20 aa, Cryptosporidium parvum
LFCDLNHELLLCKPNLPFGW

SEQ ID NO: 2245061 - protein, 25 aa, Cryptosporidium parvum
LFCSNTVCYFLPAVLHLKLFSDSPW

SEQ ID NO: 2245062 - protein, 19 aa, Cryptosporidium parvum
LFCTIYFAVSLSIAGSPLS

SEQ ID NO: 2245063 - protein, 20 aa, Cryptosporidium parvum
LFCVPLNILLPALFHFIIFR

SEQ ID NO: 2245064 - protein, 20 aa, Cryptosporidium parvum
LFDFLVFLDCLFCIPLFLIV

SEQ ID NO: 2245065 - protein, 24 aa, Cryptosporidium parvum
LFDGVILGIYLCMVVGIGLPLMQE

SEQ ID NO: 2245066 - protein, 18 aa, Cryptosporidium parvum
LFDYLYYSVVTIGTVGYG

SEQ ID NO: 2245067 - protein, 19 aa, Cryptosporidium parvum
LFEFEIPIINLYYTYLEEN

SEQ ID NO: 2245068 - protein, 19 aa, Cryptosporidium parvum
LFEFLHAGIPFGAIGAFMG

SEQ ID NO: 2245069 - protein, 19 aa, Cryptosporidium parvum
LFELIFRATAQDVILESEE

SEQ ID NO: 2245070 - protein, 18 aa, Cryptosporidium parvum
LFFIYLSNEKYQTGGFSF

SEQ ID NO: 2245071 - protein, 19 aa, Cryptosporidium parvum
LFFLLHFQNIFTYRRRLTA

SEQ ID NO: 2245072 - protein, 17 aa, Cryptosporidium parvum
LFFRLISVTFSNMSFKK

SEQ ID NO: 2245073 - protein, 17 aa, Cryptosporidium parvum
LFFSFIQTFVTLFIFHL

SEQ ID NO: 2245074 - protein, 17 aa, Cryptosporidium parvum
LFGAPFDPEWYAQVVDA

SEQ ID NO: 2245075 - protein, 17 aa, Cryptosporidium parvum
LFGDDMYQYILPSKYSK

SEQ ID NO: 2245076 - protein, 20 aa, Cryptosporidium parvum
LFGILLMILDVPGSPRWSAR

SEQ ID NO: 2245077 - protein, 18 aa, Cryptosporidium parvum
LFHLFLRREVAILSAKRH

SEQ ID NO: 2245078 - protein, 17 aa, Cryptosporidium parvum
LFHWTLNDPITSKTKYL

SEQ ID NO: 2245079 - protein, 22 aa, Cryptosporidium parvum
LFKLLCKVLFYQGDFLECSIVL

SEQ ID NO: 2245080 - protein, 17 aa, Cryptosporidium parvum
LFKRLVRILACLNSSIT

SEQ ID NO: 2245081 - protein, 25 aa, Cryptosporidium parvum
LFKSKAYVLKLLQLDIDPKTNEEAV

SEQ ID NO: 2245082 - protein, 24 aa, Cryptosporidium parvum
LFKSKIHRFFSHQLMMFCFENWGY

SEQ ID NO: 2245083 - protein, 27 aa, Cryptosporidium parvum
LFKTEIYLIRILDFGIKLRYTQFKDLE

SEQ ID NO: 2245084 - protein, 22 aa, Cryptosporidium parvum
LFLIMVYIIIIVFRILNSLFIR

SEQ ID NO: 2245085 - protein, 17 aa, Cryptosporidium parvum
LFLLYFQKRANKLKNNV

SEQ ID NO: 2245086 - protein, 21 aa, Cryptosporidium parvum
LFLVAFFFTRNIILPYAFHTQ

SEQ ID NO: 2245087 - protein, 18 aa, Cryptosporidium parvum
LFLVQISYIKVGYGLNVE

SEQ ID NO: 2245088 - protein, 19 aa, Cryptosporidium parvum
LFNILRKDIFLNSSNSLDC

SEQ ID NO: 2245089 - protein, 25 aa, Cryptosporidium parvum
LFNNRTLFAVFLQPIVIDSIGKLSF

SEQ ID NO: 2245090 - protein, 22 aa, Cryptosporidium parvum
LFPDFDLKLLKDINLPLINFLF

SEQ ID NO: 2245091 - protein, 17 aa, Cryptosporidium parvum
LFPFYNDLSPSLFMIAQ

SEQ ID NO: 2245092 - protein, 18 aa, Cryptosporidium parvum
LFQETLYYELYNNPESNY

SEQ ID NO: 2245093 - protein, 25 aa, Cryptosporidium parvum
LFQKLRVFRIHRLRIAQFGPLEEPE

SEQ ID NO: 2245094 - protein, 20 aa, Cryptosporidium parvum
LFQVLFKVLAFLSFIFGPFF

SEQ ID NO: 2245095 - protein, 25 aa, Cryptosporidium parvum
LFQYIYVTILLGISLIFVCAEEVQN

SEQ ID NO: 2245096 - protein, 19 aa, Cryptosporidium parvum
LFREFGITNFNFIQGYEIV

SEQ ID NO: 2245097 - protein, 18 aa, Cryptosporidium parvum
LFRMFFGGMPAEVSFNRQ

SEQ ID NO: 2245098 - protein, 18 aa, Cryptosporidium parvum
LFSAVLIINIVEYILCFE

SEQ ID NO: 2245099 - protein, 26 aa, Cryptosporidium parvum
LFSGYKISVLYWESVRFYIISGIINV

SEQ ID NO: 2245100 - protein, 17 aa, Cryptosporidium parvum
LFSLYLAYKFLPVYWVN

SEQ ID NO: 2245101 - protein, 25 aa, Cryptosporidium parvum
LFSPKIAIILFLIGGVFHAVFAAFF

SEQ ID NO: 2245102 - protein, 17 aa, Cryptosporidium parvum
LFSRAITVYIIYHITVL

SEQ ID NO: 2245103 - protein, 20 aa, Cryptosporidium parvum
LFSSIYFVILERLKTRQFKQ

SEQ ID NO: 2245104 - protein, 35 aa, Cryptosporidium parvum
LFSSMISFLEGIIFPGWLIPGWSKLSKKILKSSML

SEQ ID NO: 2245105 - protein, 23 aa, Cryptosporidium parvum
LFTIEKIITLVPILQDIAELDDV

SEQ ID NO: 2245106 - protein, 20 aa, Cryptosporidium parvum
LFTKQFTTHLGLLSIFSYIL

SEQ ID NO: 2245107 - protein, 46 aa, Cryptosporidium parvum; identical to SEQ ID NO: 2131947

SEQ ID NO: 2245108 - protein, 19 aa, Cryptosporidium parvum
LFVASMLILIFGEALAIYG

SEQ ID NO: 2245109 - protein, 20 aa, Cryptosporidium parvum
LFVHIFLNSINATYGQIRLN

SEQ ID NO: 2245110 - protein, 17 aa, Cryptosporidium parvum
LFVLFADERQISLNQQS

SEQ ID NO: 2245111 - protein, 20 aa, Cryptosporidium parvum
LFVVPFSVIVGWLLGKPMTL

SEQ ID NO: 2245112 - protein, 21 aa, Cryptosporidium parvum
LGCDFFTYDMMNRVCLFKAAK

SEQ ID NO: 2245113 - protein, 17 aa, Cryptosporidium parvum
LGEFKFKSAVSGSPCLM

SEQ ID NO: 2245114 - protein, 26 aa, Cryptosporidium parvum
LGEISRLLIINFLKNKTPEIFFQKNS

SEQ ID NO: 2245115 - protein, 37 aa, Cryptosporidium parvum
LGFNSIISKVFILKEGLSLPYFPSNFYYIEQVHVSRL

SEQ ID NO: 2245116 - protein, 20 aa, Cryptosporidium parvum
LGFTIYSVIIKLSEKFESEI

SEQ ID NO: 2245117 - protein, 21 aa, Cryptosporidium parvum
LGGIFLLLVAFIAYAQRYRKL

SEQ ID NO: 2245118 - protein, 20 aa, Cryptosporidium parvum
LGIFLFMIHNFVPDSCLYQF

SEQ ID NO: 2245119 - protein, 20 aa, Cryptosporidium parvum
LGIGWKLLAAVGFTAIVLQI

SEQ ID NO: 2245120 - protein, 33 aa, Cryptosporidium parvum; identical to SEQ ID NO: 2193091

SEQ ID NO: 2245121 - protein, 26 aa, Cryptosporidium parvum
LGILYKLFLEFYFKLKFIIHLIYSFI

SEQ ID NO: 2245122 - protein, 26 aa, Cryptosporidium parvum
LGIPSVFNFILPLSIEFILLFCDHSV

SEQ ID NO: 2245123 - protein, 26 aa, Cryptosporidium parvum
LGIQYFDPIFLSKLKCKLNLHSNFHK

SEQ ID NO: 2245124 - protein, 17 aa, Cryptosporidium parvum
LGIWRFLNQFGLVLATL

SEQ ID NO: 2245125 - protein, 22 aa, Cryptosporidium parvum
LGKERIPLYGPVLFVGNHMNQF

SEQ ID NO: 2245126 - protein, 21 aa, Cryptosporidium parvum
LGLSELLVLELKIFQFCSLIE

SEQ ID NO: 2245127 - protein, 27 aa, Cryptosporidium parvum
LGLTEDFLLVFMNFSLVRILSSNSYGN

SEQ ID NO: 2245128 - protein, 41 aa, Cryptosporidium parvum; identical to SEQ ID NO: 2131965

SEQ ID NO: 2245129 - protein, 31 aa, Cryptosporidium parvum
LGNAILCMTIFPWMISILLFYFITRESQKIV

SEQ ID NO: 2245130 - protein, 24 aa, Cryptosporidium parvum
LGNVIILNPIIVKSSFPISVDMVR

SEQ ID NO: 2245131 - protein, 28 aa, Cryptosporidium parvum
LGRQRLRMILTLQQGILLLCFNEEKIFV

SEQ ID NO: 2245132 - protein, 33 aa, Cryptosporidium parvum
LGSELLSKALYILFLLKLVMLIGFGSYYFNKRK

SEQ ID NO: 2245133 - protein, 31 aa, Cryptosporidium parvum
LGSSNFTPLPSGIPAHLLAPGNLPSATSVEE

SEQ ID NO: 2245134 - protein, 22 aa, Cryptosporidium parvum
LGSYPLSLWKLIFSEFTSVLNI

SEQ ID NO: 2245135 - protein, 24 aa, Cryptosporidium parvum
LGTPILCTIIPFNSYCDPISVVKV

SEQ ID NO: 2245136 - protein, 18 aa, Cryptosporidium parvum
LGTTLILDYNRKLGERKW

SEQ ID NO: 2245137 - protein, 36 aa, Cryptosporidium parvum
LGWRGPFYIFGLIGVIWSIVWLFLDVKSLSWTNKPR

SEQ ID NO: 2245138 - protein, 25 aa, Cryptosporidium parvum
LGYFKSIFRITKELKLFYIALQETF

SEQ ID NO: 2245139 - protein, 24 aa, Cryptosporidium parvum
LHDLPLFFNSLSKVLLKNIKTKDL

SEQ ID NO: 2245140 - protein, 24 aa, Cryptosporidium parvum
LHDRVFYILCAFLALYVAMESICI

SEQ ID NO: 2245141 - protein, 18 aa, Cryptosporidium parvum
LHEIFPSGALKLPGRHFL

SEQ ID NO: 2245142 - protein, 18 aa, Cryptosporidium parvum
LHFAYLGVVLCIVLSTFG

SEQ ID NO: 2245143 - protein, 24 aa, Cryptosporidium parvum
LHGKKIILTIPSRILYSIDCLIVD

SEQ ID NO: 2245144 - protein, 19 aa, Cryptosporidium parvum
LHHYLPIFNFSEEFVAPNR

SEQ ID NO: 2245145 - protein, 28 aa, Cryptosporidium parvum
LHIEFLIPIFIYVLFYLVSILFKNDTHL

SEQ ID NO: 2245146 - protein, 25 aa, Cryptosporidium parvum
LHILNKIVLIFPQSIYFNIRSSYLE

SEQ ID NO: 2245147 - protein, 17 aa, Cryptosporidium parvum
LHIVWIVFYLSPENSRQ

SEQ ID NO: 2245148 - protein, 26 aa, Cryptosporidium parvum
LHKLVKYTIKLLIIASLNINLFNGII

SEQ ID NO: 2245149 - protein, 24 aa, Cryptosporidium parvum
LHLRKLLARLSLNALILDISDNFF

SEQ ID NO: 2245150 - protein, 23 aa, Cryptosporidium parvum
LHNHGIEIVNWLKHLFDINSKVS

SEQ ID NO: 2245151 - protein, 33 aa, Cryptosporidium parvum
LHPGQIIMIWGFLLFILATILYCTFSVVYDIIV

SEQ ID NO: 2245152 - protein, 17 aa, Cryptosporidium parvum
LHPINILRLGSLWQGIF

SEQ ID NO: 2245153 - protein, 19 aa, Cryptosporidium parvum
LHTHYPHFIPNISERKLYT

SEQ ID NO: 2245154 - protein, 27 aa, Cryptosporidium parvum
LIASVCIFLYLVQYFLEIVLNVSRRYK

SEQ ID NO: 2245155 - protein, 19 aa, Cryptosporidium parvum
LICIRFLCNMFHNSTNREA

SEQ ID NO: 2245156 - protein, 18 aa, Cryptosporidium parvum
LICRVPIQCKLTINQKFN

SEQ ID NO: 2245157 - protein, 18 aa, Cryptosporidium parvum
LICVPPELKLQIPPGSQN

SEQ ID NO: 2245158 - protein, 18 aa, Cryptosporidium parvum
LIDNGLIFSAISLILYFN

SEQ ID NO: 2245159 - protein, 30 aa, Cryptosporidium parvum
LIDSLLNMNRGFIPFILCGDLSPINNIDPS

SEQ ID NO: 2245160 - protein, 18 aa, Cryptosporidium parvum
LIEFLSEFYLGIGSTFED

SEQ ID NO: 2245161 - protein, 23 aa, Cryptosporidium parvum
LIEKELIAAFIRMLLILQERNKE

SEQ ID NO: 2245162 - protein, 21 aa, Cryptosporidium parvum
LIELTLWLNKFSQNYPNIIKD

SEQ ID NO: 2245163 - protein, 23 aa, Cryptosporidium parvum
LIEQYFFNLLNSIISRFAKTKML

SEQ ID NO: 2245164 - protein, 20 aa, Cryptosporidium parvum
LIFGMLNYTLYILISFGDPG

SEQ ID NO: 2245165 - protein, 40 aa, Cryptosporidium parvum
LIFGVYTMLFSFYTACKKYKFIQPWHFMLLSAMSCVGGLI

SEQ ID NO: 2245166 - protein, 18 aa, Cryptosporidium parvum
LIFRNYLRCLLKAGFPHI

SEQ ID NO: 2245167 - protein, 19 aa, Cryptosporidium parvum
LIGRLTWAITLIPITIIDD

SEQ ID NO: 2245168 - protein, 26 aa, Cryptosporidium parvum
LIGTILFTIFVLILPTITAFYINFLF

SEQ ID NO: 2245169 - protein, 22 aa, Cryptosporidium parvum
LIGYIYYCTMFPLINIISGIVI

SEQ ID NO: 2245170 - protein, 25 aa, Cryptosporidium parvum
LIHRDKLILPLDFSKLILNKRATYF

SEQ ID NO: 2245171 - protein, 17 aa, Cryptosporidium parvum
LIHVLVELAFQTLVILE

SEQ ID NO: 2245172 - protein, 25 aa, Cryptosporidium parvum
LIIAEWLIKCKNIRNIILLSRSGLP

SEQ ID NO: 2245173 - protein, 18 aa, Cryptosporidium parvum
LIICIWNVNIGFGHNDDP

SEQ ID NO: 2245174 - protein, 18 aa, Cryptosporidium parvum
LIIHHLGFISSKMSVIPL

SEQ ID NO: 2245175 - protein, 19 aa, Cryptosporidium parvum
LIIIGLIGSSIYYFFIRYF

SEQ ID NO: 2245176 - protein, 20 aa, Cryptosporidium parvum
LIIKPNILNRIQNYIKYLHI

SEQ ID NO: 2245177 - protein, 24 aa, Cryptosporidium parvum
LIILHDLYILHTPLVDPHLISMFN

SEQ ID NO: 2245178 - protein, 25 aa, Cryptosporidium parvum
LIINCIFGILFILFKQGIIVRWINI

SEQ ID NO: 2245179 - protein, 30 aa, Cryptosporidium parvum
LIKDKISFIIIIWCPLIIINYSNLDCILKI

SEQ ID NO: 2245180 - protein, 24 aa, Cryptosporidium parvum
LIKDKNFVELLKFDQFLLEKKSDN

SEQ ID NO: 2245181 - protein, 18 aa, Cryptosporidium parvum
LIKIVDFGLSAVFENQKK

SEQ ID NO: 2245182 - protein, 17 aa, Cryptosporidium parvum
LIKKYRVDFIISGHDHH

SEQ ID NO: 2245183 - protein, 35 aa, Cryptosporidium parvum
LIKLATRSIISQLYLKFSLIWKPYTDILIKLVKSI

SEQ ID NO: 2245184 - protein, 28 aa, Cryptosporidium parvum
LIKMPQLVAIFHSLVGLAALFVSYSYFY

SEQ ID NO: 2245185 - protein, 27 aa, Cryptosporidium parvum
LILATFFTIFFLNIGYYRWGFSNGSNV

SEQ ID NO: 2245186 - protein, 25 aa, Cryptosporidium parvum
LILDKKLHILPLRLTKSTSSNNNHW

SEQ ID NO: 2245187 - protein, 20 aa, Cryptosporidium parvum
LILDPWVLVHIVYNMGSIKY

SEQ ID NO: 2245188 - protein, 17 aa, Cryptosporidium parvum
LILFQSLVRNELIGLII

SEQ ID NO: 2245189 - protein, 22 aa, Cryptosporidium parvum
LILLIFNINYSQGLGLRRNYNS

SEQ ID NO: 2245190 - protein, 24 aa, Cryptosporidium parvum
LILLNSIFYALLPFSFEPLIFLSA

SEQ ID NO: 2245191 - protein, 24 aa, Cryptosporidium parvum
LILQNFIILLNKLLNKFSENFKFV

SEQ ID NO: 2245192 - protein, 26 aa, Cryptosporidium parvum
LILSHNILPCFLIGDLLFLKKGVTGV

SEQ ID NO: 2245193 - protein, 24 aa, Cryptosporidium parvum
LILTALQHCKLGFILELSDLIEKF

SEQ ID NO: 2245194 - protein, 17 aa, Cryptosporidium parvum
LILYPISLFFFSVAFLV

SEQ ID NO: 2245195 - protein, 17 aa, Cryptosporidium parvum
LIMVIVPIYVWFNWINN

SEQ ID NO: 2245196 - protein, 25 aa, Cryptosporidium parvum
LINEKFWYKKLPSHKYWTLKDVFYE

SEQ ID NO: 2245197 - protein, 18 aa, Cryptosporidium parvum
LINFLFTIINVKFDSNSS

SEQ ID NO: 2245198 - protein, 28 aa, Cryptosporidium parvum
LINGLAFIYRYHGIKLRWDVTSGVSIGT

SEQ ID NO: 2245199 - protein, 26 aa, Cryptosporidium parvum
LINVNKLLIRLLGINICFDTHFIYIL

SEQ ID NO: 2245200 - protein, 21 aa, Cryptosporidium parvum
LINWIDGILLYAMKNGDWVIL

SEQ ID NO: 2245201 - protein, 22 aa, Cryptosporidium parvum
LIPPWYFFIFSFFFPQLYPGVL

SEQ ID NO: 2245202 - protein, 25 aa, Cryptosporidium parvum
LIPVGLVYWFFLGNWNMIILLLTII

SEQ ID NO: 2245203 - protein, 18 aa, Cryptosporidium parvum
LIQDSWGDYIFLDARKLN

SEQ ID NO: 2245204 - protein, 35 aa, Cryptosporidium parvum
LIQENIDFLLNILLVLFDLGIERFLGSSAFALFSF

SEQ ID NO: 2245205 - protein, 18 aa, Cryptosporidium parvum
LIQENIFSFSTIPVYITS

SEQ ID NO: 2245206 - protein, 20 aa, Cryptosporidium parvum
LIQKPIILIFKAIKYIIKFF

SEQ ID NO: 2245207 - protein, 22 aa, Cryptosporidium parvum
LIQRPAPSLQRLTYRSIFGKET

SEQ ID NO: 2245208 - protein, 23 aa, Cryptosporidium parvum
LIRGKPMILCPYRWTKLQNIIQK

SEQ ID NO: 2245209 - protein, 25 aa, Cryptosporidium parvum
LIRIIFFLVYFFIYGGFVYSFSFDG

SEQ ID NO: 2245210 - protein, 18 aa, Cryptosporidium parvum
LIRIPITTLTFILGLNVL

SEQ ID NO: 2245211 - protein, 23 aa, Cryptosporidium parvum
LIRKIISKLRFYDGVHFYNTIGT

SEQ ID NO: 2245212 - protein, 20 aa, Cryptosporidium parvum
LISATALHFRALERKPYLIY

SEQ ID NO: 2245213 - protein, 24 aa, Cryptosporidium parvum
LISEPYLIPIFRSLSASIFSIIVL

SEQ ID NO: 2245214 - protein, 17 aa, Cryptosporidium parvum
LISKSKLLLFILHTLRQ

SEQ ID NO: 2245215 - protein, 19 aa, Cryptosporidium parvum
LISLKNFTNFCRKLFISES

SEQ ID NO: 2245216 - protein, 18 aa, Cryptosporidium parvum
LISMFDLYGRLLSCNLKN

SEQ ID NO: 2245217 - protein, 17 aa, Cryptosporidium parvum
LISNRSPLKSSLKDLLI

SEQ ID NO: 2245218 - protein, 20 aa, Cryptosporidium parvum
LISVFVLKLNAKRLREFILL

SEQ ID NO: 2245219 - protein, 27 aa, Cryptosporidium parvum
LITILEICLAFFKWTYLVRRDERMNLM

SEQ ID NO: 2245220 - protein, 18 aa, Cryptosporidium parvum
LITSMIMRDITIGGVIGV

SEQ ID NO: 2245221 - protein, 24 aa, Cryptosporidium parvum
LIVGVLLLLLDIPGQPRWSAKFRS

SEQ ID NO: 2245222 - protein, 25 aa, Cryptosporidium parvum
LIVSQYQKYFIWKLKNKKNIRQISN

SEQ ID NO: 2245223 - protein, 23 aa, Cryptosporidium parvum
LIYILLFEIIYGWLLNFDIVPNS

SEQ ID NO: 2245224 - protein, 22 aa, Cryptosporidium parvum
LIYIYIIVFFGVFHSFTKEITC

SEQ ID NO: 2245225 - protein, 19 aa, Cryptosporidium parvum
LIYKSYFLRQKMLLLTTGI

SEQ ID NO: 2245226 - protein, 27 aa, Cryptosporidium parvum
LIYPTKQWIPIGILRRNQILPKEMFDL

SEQ ID NO: 2245227 - protein, 21 aa, Cryptosporidium parvum
LIYSDLIFFNTYVIRRAFQEA

SEQ ID NO: 2245228 - protein, 17 aa, Cryptosporidium parvum
LIYYRRILKYYFGDNFD

SEQ ID NO: 2245229 - protein, 24 aa, Cryptosporidium parvum
LKAIKTFFYIFRGLKSNIFSNIDH

SEQ ID NO: 2245230 - protein, 18 aa, Cryptosporidium parvum
LKAYFFSILKDQETILAF

SEQ ID NO: 2245231 - protein, 21 aa, Cryptosporidium parvum
LKCAITLFNSLLPNVISTFNS

SEQ ID NO: 2245232 - protein, 24 aa, Cryptosporidium parvum
LKCPILMVLHIWKAYVYFNYKENN

SEQ ID NO: 2245233 - protein, 28 aa, Cryptosporidium parvum
LKDDTLYRRAYRLGILGFLLVLEPESGT

SEQ ID NO: 2245234 - protein, 31 aa, Cryptosporidium parvum
LKDYNLPIEYLYEFLIPTISLVIMSIEDPAM

SEQ ID NO: 2245235 - protein, 30 aa, Cryptosporidium parvum
LKENLVIINKFSLLFSKIFSRFISRLLESF

SEQ ID NO: 2245236 - protein, 25 aa, Cryptosporidium parvum
LKERKMNFSFLFNKKTLASSKLYRF

SEQ ID NO: 2245237 - protein, 25 aa, Cryptosporidium parvum
LKESILVFNLYFYFELNNYICLSEL

SEQ ID NO: 2245238 - protein, 39 aa, Cryptosporidium parvum
LKGKGLRIYKPLIKVFWFQCLMVLLLKVFFDVLQTLATL

SEQ ID NO: 2245239 - protein, 25 aa, Cryptosporidium parvum
LKIGKPLYIRTLKISDIIVTITIRT

SEQ ID NO: 2245240 - protein, 21 aa, Cryptosporidium parvum
LKILHQIVTVLDKYLFKQGDQ

SEQ ID NO: 2245241 - protein, 20 aa, Cryptosporidium parvum
LKILMFLPLILSNIGYIQKY

SEQ ID NO: 2245242 - protein, 25 aa, Cryptosporidium parvum
LKINKNFCQILKLIYNNVINKKWFE

SEQ ID NO: 2245243 - protein, 18 aa, Cryptosporidium parvum
LKINSILLLHSGSKIRIG

SEQ ID NO: 2245244 - protein, 31 aa, Cryptosporidium parvum
LKLICFQMVIYLPFIFLRDIENLGFLSVLAN

SEQ ID NO: 2245245 - protein, 29 aa, Cryptosporidium parvum
LKLKNSIYNLFLLRVLDLKSWLSQYRKQY

SEQ ID NO: 2245246 - protein, 21 aa, Cryptosporidium parvum
LKLLFYFTVTALIYNKANAET

SEQ ID NO: 2245247 - protein, 26 aa, Cryptosporidium parvum
LKLNAELMTKLLFFSIKEIMVGLHIL

SEQ ID NO: 2245248 - protein, 21 aa, Cryptosporidium parvum
LKLVFGSKLIFGNSILYLNPK

SEQ ID NO: 2245249 - protein, 17 aa, Cryptosporidium parvum
LKNDLKIPFFTKKKTKA

SEQ ID NO: 2245250 - protein, 23 aa, Cryptosporidium parvum
LKNLHIFLESIIEIIIFGTCLKG

SEQ ID NO: 2245251 - protein, 22 aa, Cryptosporidium parvum
LKPSNFIIFITSKAFFNNNNEY

SEQ ID NO: 2245252 - protein, 19 aa, Cryptosporidium parvum
LKQYRFFSIYALKCLKNQV

SEQ ID NO: 2245253 - protein, 27 aa, Cryptosporidium parvum
LKRIRLKHIFLIFIFTVLYVSCFLMEH

SEQ ID NO: 2245254 - protein, 29 aa, Cryptosporidium parvum
LKRSFAVIILLFEFDIKLLSSAFLFYLLV

SEQ ID NO: 2245255 - protein, 26 aa, Cryptosporidium parvum
LKSKRKKILRWYKYVSPWSTNKVANQ

SEQ ID NO: 2245256 - protein, 26 aa, Cryptosporidium parvum
LKSSLKDLLILKNEYLKYISNFDICV

SEQ ID NO: 2245257 - protein, 23 aa, Cryptosporidium parvum
LKTDISIILNYLNNFNLITSFFE

SEQ ID NO: 2245258 - protein, 17 aa, Cryptosporidium parvum
LKTIPKYGNNFNKESFN

SEQ ID NO: 2245259 - protein, 17 aa, Cryptosporidium parvum
LKVIFAKYDVGKTGFLN

SEQ ID NO: 2245260 - protein, 25 aa, Cryptosporidium parvum
LKVKNFMYSLFKWPKILTTLRGLGS

SEQ ID NO: 2245261 - protein, 38 aa, Cryptosporidium parvum
LKVNTLQMRNLLKLILTLSFAPLFVTCLYDSSSQVKVI

SEQ ID NO: 2245262 - protein, 27 aa, Cryptosporidium parvum
LKVYSQYILFMLSTFYLIYYSDGKSNF

SEQ ID NO: 2245263 - protein, 30 aa, Cryptosporidium parvum
LKYVIGMLLGVFFGIWILSICFKGETKKQT

SEQ ID NO: 2245264 - protein, 17 aa, Cryptosporidium parvum
LLAFSKSRFNGFSKWLQ

SEQ ID NO: 2245265 - protein, 17 aa, Cryptosporidium parvum
LLAIPAALSLSIMHIRS

SEQ ID NO: 2245266 - protein, 17 aa, Cryptosporidium parvum
LLALVVLIDFIIRKNNA

SEQ ID NO: 2245267 - protein, 29 aa, Cryptosporidium parvum
LLARVFMLFYWILYPLFKLSIVPGRRLHI

SEQ ID NO: 2245268 - protein, 17 aa, Cryptosporidium parvum
LLCCIAFILLGELYAVN

SEQ ID NO: 2245269 - protein, 17 aa, Cryptosporidium parvum
LLCFCFNVTLGEKLLQH

SEQ ID NO: 2245270 - protein, 28 aa, Cryptosporidium parvum
LLCFNHNYWYNLMVCLIYLITDEAASIE

SEQ ID NO: 2245271 - protein, 25 aa, Cryptosporidium parvum
LLCKVSGIFMFLTIIFPDCKTIGSL

SEQ ID NO: 2245272 - protein, 19 aa, Cryptosporidium parvum
LLCYLFIHNPDITTSMISF

SEQ ID NO: 2245273 - protein, 26 aa, Cryptosporidium parvum
LLDDDFLKLLISWYKNRILKFEKHKI

SEQ ID NO: 2245274 - protein, 22 aa, Cryptosporidium parvum
LLDTLIDILVNQSIWLTPEEQS

SEQ ID NO: 2245275 - protein, 43 aa, Cryptosporidium parvum
LLEAFTSWSLVLFSIIICAFLFFLSILCFPYIFHIPELELAAK

SEQ ID NO: 2245276 - protein, 29 aa, Cryptosporidium parvum
LLEALLEVIPYEFLVIWINSHTISKEQYD

SEQ ID NO: 2245277 - protein, 18 aa, Cryptosporidium parvum
LLEETMLILYRFTGTELQ

SEQ ID NO: 2245278 - protein, 21 aa, Cryptosporidium parvum
LLEILFRYICMKSVKKIFLSW

SEQ ID NO: 2245279 - protein, 18 aa, Cryptosporidium parvum
LLEILYSILSYAIIPAFL

SEQ ID NO: 2245280 - protein, 25 aa, Cryptosporidium parvum
LLELKQIFIKYYSLKGLVLSFKKKP

SEQ ID NO: 2245281 - protein, 18 aa, Cryptosporidium parvum
LLELVKIMVPYQIEKHCE

SEQ ID NO: 2245282 - protein, 19 aa, Cryptosporidium parvum
LLERVIYKFKNQHGRLGYF

SEQ ID NO: 2245283 - protein, 18 aa, Cryptosporidium parvum
LLEWLREMKTFIPSNHFV

SEQ ID NO: 2245284 - protein, 18 aa, Cryptosporidium parvum
LLEYFAKKALETGNANRI

SEQ ID NO: 2245285 - protein, 29 aa, Cryptosporidium parvum
LLFAYALHLWLNLTIIWVWNLIYFLKKFN

SEQ ID NO: 2245286 - protein, 20 aa, Cryptosporidium parvum
LLFHGDSPLIWIYRLRESFS

SEQ ID NO: 2245287 - protein, 21 aa, Cryptosporidium parvum
LLFPLFLIIICISLPFTECER

SEQ ID NO: 2245288 - protein, 21 aa, Cryptosporidium parvum
LLFSNNLLQVPHWFNFMAIES

SEQ ID NO: 2245289 - protein, 19 aa, Cryptosporidium parvum
LLGIKYYIREQILLELLEI

SEQ ID NO: 2245290 - protein, 18 aa, Cryptosporidium parvum
LLGIWRYDKGITKCLFVT

SEQ ID NO: 2245291 - protein, 17 aa, Cryptosporidium parvum
LLHRPLKYALKNAIEIA

SEQ ID NO: 2245292 - protein, 18 aa, Cryptosporidium parvum
LLIATLFCNFFERINSTK

SEQ ID NO: 2245293 - protein, 21 aa, Cryptosporidium parvum
LLIEKFHLSLFPIITYTTIED

SEQ ID NO: 2245294 - protein, 17 aa, Cryptosporidium parvum
LLILYNPAWTIADPLCT

SEQ ID NO: 2245295 - protein, 19 aa, Cryptosporidium parvum
LLIQKIFNLIKEITILFPE

SEQ ID NO: 2245296 - protein, 18 aa, Cryptosporidium parvum
LLISSIILINSWNKKRKN

SEQ ID NO: 2245297 - protein, 25 aa, Cryptosporidium parvum
LLIVIIFLFFWFLIINKQELFSNLI

SEQ ID NO: 2245298 - protein, 20 aa, Cryptosporidium parvum
LLKAIWISCFLVSSSAFLVL

SEQ ID NO: 2245299 - protein, 32 aa, Cryptosporidium parvum
LLKEKQFWLIFWLLFLFSQYVHFIASWWKNIG

SEQ ID NO: 2245300 - protein, 20 aa, Cryptosporidium parvum
LLKEVINKIDLYLIGMITNS

SEQ ID NO: 2245301 - protein, 20 aa, Cryptosporidium parvum
LLKISIFILKIFSSNEVIPI

SEQ ID NO: 2245302 - protein, 23 aa, Cryptosporidium parvum
LLKIYMFMIIIQDLISKIKGSKD

SEQ ID NO: 2245303 - protein, 44 aa, Cryptosporidium parvum
LLKLRQRIIFFSLNILPRWISTRKIPGLLFNTLIIYSVLKSTEN

SEQ ID NO: 2245304 - protein, 27 aa, Cryptosporidium parvum
LLKSGKLVWMVPLININRINLYLVLNN

SEQ ID NO: 2245305 - protein, 27 aa, Cryptosporidium parvum
LLKSQILYFMNCVYELLLRAFEIVRKE

SEQ ID NO: 2245306 - protein, 29 aa, Cryptosporidium parvum
LLKTFEEINFYFNQVFRELIPNGDAKLIL

SEQ ID NO: 2245307 - protein, 46 aa, Cryptosporidium parvum
LLKTFSCLKLHSLLVKVKYIYVKFKTLLTYLFTYFKESDIDLEGIR

SEQ ID NO: 2245308 - protein, 23 aa, Cryptosporidium parvum
LLKTLVPITIPERPSIPLGYIRL

SEQ ID NO: 2245309 - protein, 17 aa, Cryptosporidium parvum
LLLELGTLSSTLLSSAM

SEQ ID NO: 2245310 - protein, 19 aa, Cryptosporidium parvum
LLLELKLIEKELIAAFIRM

SEQ ID NO: 2245311 - protein, 19 aa, Cryptosporidium parvum
LLLFLTTLIAIKIAEERVT

SEQ ID NO: 2245312 - protein, 19 aa, Cryptosporidium parvum
LLLNTLLVLIYFVLGALSV

SEQ ID NO: 2245313 - protein, 18 aa, Cryptosporidium parvum
LLLVLHANVSRIEDLLFI

SEQ ID NO: 2245314 - protein, 19 aa, Cryptosporidium parvum
LLLVMMFDSVFKEEIFPDI

SEQ ID NO: 2245315 - protein, 26 aa, Cryptosporidium parvum
LLMKIEQFLIYLVKLISNMGFKEGEN

SEQ ID NO: 2245316 - protein, 21 aa, Cryptosporidium parvum
LLNAILILGGLIRYLYLPNEI

SEQ ID NO: 2245317 - protein, 28 aa, Cryptosporidium parvum
LLNDKIISLLMLFKSWIPFLENEFNTNM

SEQ ID NO: 2245318 - protein, 17 aa, Cryptosporidium parvum
LLNFLSFSWMKWSMHVR

SEQ ID NO: 2245319 - protein, 26 aa, Cryptosporidium parvum
LLNHPSIFHLLKLIIGILFCQGQDQD

SEQ ID NO: 2245320 - protein, 18 aa, Cryptosporidium parvum
LLNIDPYQILKPLERKIE

SEQ ID NO: 2245321 - protein, 20 aa, Cryptosporidium parvum
LLNLVYISSIFIVCLSLINS

SEQ ID NO: 2245322 - protein, 24 aa, Cryptosporidium parvum
LLNNWIDLCYLYLLDLEDNPKLRA

SEQ ID NO: 2245323 - protein, 20 aa, Cryptosporidium parvum
LLNRILWIPEYENFNTILDM

SEQ ID NO: 2245324 - protein, 27 aa, Cryptosporidium parvum
LLPCLNALFWLFFISNGWLAMYSMHFI

SEQ ID NO: 2245325 - protein, 24 aa, Cryptosporidium parvum
LLPGFVYWLLIFVIKNFDKLELST

SEQ ID NO: 2245326 - protein, 27 aa, Cryptosporidium parvum
LLPRVIFIFVIQCLSLIIVANSLPWIP

SEQ ID NO: 2245327 - protein, 31 aa, Cryptosporidium parvum
LLPYDFNYYNIINTVFLILTITAISIYFSKR

SEQ ID NO: 2245328 - protein, 32 aa, Cryptosporidium parvum
LLRAEEMYILLFAFYYSIYQTLKYCKIVVDTF

SEQ ID NO: 2245329 - protein, 18 aa, Cryptosporidium parvum
LLRELYKDLSELAFAAEK

SEQ ID NO: 2245330 - protein, 19 aa, Cryptosporidium parvum
LLRLSYSRLFYSYNSEKWR

SEQ ID NO: 2245331 - protein, 28 aa, Cryptosporidium parvum
LLSCDNPPILPATLLLHLSTKLRCWHIA

SEQ ID NO: 2245332 - protein, 18 aa, Cryptosporidium parvum
LLSFFVILFICFGVIDMI

SEQ ID NO: 2245333 - protein, 27 aa, Cryptosporidium parvum
LLSFTYVLFLFFQLYTHINLFRDESVA

SEQ ID NO: 2245334 - protein, 21 aa, Cryptosporidium parvum
LLSNNVLPISPIPLASPSSPS

SEQ ID NO: 2245335 - protein, 36 aa, Cryptosporidium parvum; identical to SEQ ID NO: 2132092

SEQ ID NO: 2245336 - protein, 20 aa, Cryptosporidium parvum
LLSSILIIISVVTYMCIFIP

SEQ ID NO: 2245337 - protein, 27 aa, Cryptosporidium parvum
LLSSLKVYPLFARGWITWAQYTDRLLY

SEQ ID NO: 2245338 - protein, 17 aa, Cryptosporidium parvum
LLSVFFVWDASNYSEEY

SEQ ID NO: 2245339 - protein, 17 aa, Cryptosporidium parvum
LLSVIVSAVFSAPAVPL

SEQ ID NO: 2245340 - protein, 17 aa, Cryptosporidium parvum
LLSYSVIMPFNYIAGPL

SEQ ID NO: 2245341 - protein, 20 aa, Cryptosporidium parvum
LLTFLVVNLVVAKFSFDDPK

SEQ ID NO: 2245342 - protein, 20 aa, Cryptosporidium parvum
LLTIFGFLCSLIAMLLTMMT

SEQ ID NO: 2245343 - protein, 27 aa, Cryptosporidium parvum
LLTILYYFMHYLLMLIAMTFNWGLFFS

SEQ ID NO: 2245344 - protein, 23 aa, Cryptosporidium parvum
LLTYSMTIILNQLKLSYPENINN

SEQ ID NO: 2245345 - protein, 18 aa, Cryptosporidium parvum
LLVHGRLAYRRICKLALY

SEQ ID NO: 2245346 - protein, 18 aa, Cryptosporidium parvum
LLVLFISYYQVNSQDAYH

SEQ ID NO: 2245347 - protein, 20 aa, Cryptosporidium parvum
LLVLIILYNVFGNKGLFTFD

SEQ ID NO: 2245348 - protein, 21 aa, Cryptosporidium parvum
LLVLVFTIICGFGVIESAIYK

SEQ ID NO: 2245349 - protein, 21 aa, Cryptosporidium parvum
LLWSFTIPEFKIKLPSLNTTG

SEQ ID NO: 2245350 - protein, 22 aa, Cryptosporidium parvum
LLYGHKMIIIEYTMLKDVNDSE

SEQ ID NO: 2245351 - protein, 17 aa, Cryptosporidium parvum
LLYKYSAFSPAFDIIPF

SEQ ID NO: 2245352 - protein, 17 aa, Cryptosporidium parvum
LMADHIHYLLGFAVAFS

SEQ ID NO: 2245353 - protein, 26 aa, Cryptosporidium parvum
LMDIEFVYYFFIRLKNKQMINNPLIK

SEQ ID NO: 2245354 - protein, 18 aa, Cryptosporidium parvum
LMGIKIHPKFLASNISYQ

SEQ ID NO: 2245355 - protein, 24 aa, Cryptosporidium parvum
LMGIYLFLVLFVASSLLILVLFAN

SEQ ID NO: 2245356 - protein, 46 aa, Cryptosporidium parvum
LMHSILFQCVLYSYPELQPVLRLLKYWLHIRRLPVAKDGGLPCIVW

SEQ ID NO: 2245357 - protein, 30 aa, Cryptosporidium parvum
LMKIRKLSLILTLSFMKFFYVFCFDESSNS

SEQ ID NO: 2245358 - protein, 31 aa, Cryptosporidium parvum
LMKRWNNYFFKYKLWLFVNQFLIECFAIKSL

SEQ ID NO: 2245359 - protein, 20 aa, Cryptosporidium parvum
LMLEFINSYLFLGANKFYLY

SEQ ID NO: 2245360 - protein, 17 aa, Cryptosporidium parvum
LMLIILATAIEAIWLSF

SEQ ID NO: 2245361 - protein, 17 aa, Cryptosporidium parvum
LMLLRSKKYFRPSNFEM

SEQ ID NO: 2245362 - protein, 19 aa, Cryptosporidium parvum
LMLNSGLTIILLFSKILTD

SEQ ID NO: 2245363 - protein, 17 aa, Cryptosporidium parvum
LMLPLNKVYVLLLKLTK

SEQ ID NO: 2245364 - protein, 23 aa, Cryptosporidium parvum
LMMEDDDPFPLSSKFRYISDEEY

SEQ ID NO: 2245365 - protein, 18 aa, Cryptosporidium parvum
LMQFRECTFVLIQIISYL

SEQ ID NO: 2245366 - protein, 25 aa, Cryptosporidium parvum
LMSNLEIISLYWIINPVYEVRKKTS

SEQ ID NO: 2245367 - protein, 17 aa, Cryptosporidium parvum
LMSYYNYYYGFGDNNKK

SEQ ID NO: 2245368 - protein, 18 aa, Cryptosporidium parvum
LMVQIRGKLRTTFYGYLI

SEQ ID NO: 2245369 - protein, 19 aa, Cryptosporidium parvum
LMYDKYFLRGLTAFFSKDF

SEQ ID NO: 2245370 - protein, 26 aa, Cryptosporidium parvum
LMYKQDYCLLILRRALSSTNRRVSSI

SEQ ID NO: 2245371 - protein, 27 aa, Cryptosporidium parvum
LMYLEHLRIIFFSIFLNGLSRVILLCF

SEQ ID NO: 2245372 - protein, 33 aa, Cryptosporidium parvum; identical to SEQ ID NO: 2132111

SEQ ID NO: 2245373 - protein, 28 aa, Cryptosporidium parvum
LMYYDDYCLMCFLIRPLINSLAARLRNT

SEQ ID NO: 2245374 - protein, 23 aa, Cryptosporidium parvum
LNAILIIISLNFASAMIVTPFSG

SEQ ID NO: 2245375 - protein, 19 aa, Cryptosporidium parvum
LNCSLLYHTLKRYNDLDLI

SEQ ID NO: 2245376 - protein, 24 aa, Cryptosporidium parvum
LNDRIIKLVLFPNGKMLDPQSDDL

SEQ ID NO: 2245377 - protein, 17 aa, Cryptosporidium parvum
LNDYLLPILNPVETNSY

SEQ ID NO: 2245378 - protein, 22 aa, Cryptosporidium parvum
LNDYRKYLENWADTVQVLLQGP

SEQ ID NO: 2245379 - protein, 19 aa, Cryptosporidium parvum
LNEIIRLNFKYSPKFIVEV

SEQ ID NO: 2245380 - protein, 23 aa, Cryptosporidium parvum
LNEKLRMKISILFASVLLDHISL

SEQ ID NO: 2245381 - protein, 25 aa, Cryptosporidium parvum
LNEWKKIVLLILFLSQVFTAVHGYK

SEQ ID NO: 2245382 - protein, 21 aa, Cryptosporidium parvum
LNFMQQYRFPFLNAPSRMEFI

SEQ ID NO: 2245383 - protein, 28 aa, Cryptosporidium parvum
LNHIMLWFGLIIFWAITQIYGKSPVEHG

SEQ ID NO: 2245384 - protein, 25 aa, Cryptosporidium parvum
LNHVQKPIWFIPHRKCLLEVKSLII

SEQ ID NO: 2245385 - protein, 26 aa, Cryptosporidium parvum
LNIILPIFLELFIIKNIYANNIEPNQ

SEQ ID NO: 2245386 - protein, 26 aa, Cryptosporidium parvum
LNIKCGLVILIEYILEFFISKGEVIS

SEQ ID NO: 2245387 - protein, 28 aa, Cryptosporidium parvum
LNIKKLIFEYILSYTGSLIWNIWNQKNI

SEQ ID NO: 2245388 - protein, 25 aa, Cryptosporidium parvum
LNINSFILILVISIFFSSLDAAKKV

SEQ ID NO: 2245389 - protein, 26 aa, Cryptosporidium parvum
LNITFDFFLIYYYAMIIYSNFTDLKF

SEQ ID NO: 2245390 - protein, 25 aa, Cryptosporidium parvum
LNKDLRLLYSLISQQLYLIGGNEGV

SEQ ID NO: 2245391 - protein, 24 aa, Cryptosporidium parvum
LNKEFTILHPIPVLLNTIIYNQKK

SEQ ID NO: 2245392 - protein, 25 aa, Cryptosporidium parvum
LNKFNMTILDLFKLLDKNQTGSISS

SEQ ID NO: 2245393 - protein, 25 aa, Cryptosporidium parvum
LNKGVLFPTLIQFLMNQKQFVKTLK

SEQ ID NO: 2245394 - protein, 22 aa, Cryptosporidium parvum
LNKLHLVWLDRFNLNMNKESEL

SEQ ID NO: 2245395 - protein, 25 aa, Cryptosporidium parvum
LNKPCQFIQTLYLRFNNRPFVRNED

SEQ ID NO: 2245396 - protein, 26 aa, Cryptosporidium parvum
LNKSFKYIWLIYHRNNLLPHQRRSVT

SEQ ID NO: 2245397 - protein, 30 aa, Cryptosporidium parvum
LNKSILRLVVPVLLRILMIKRISFNKTFQV

SEQ ID NO: 2245398 - protein, 20 aa, Cryptosporidium parvum
LNLDIPNIIWKLILGESVSL

SEQ ID NO: 2245399 - protein, 25 aa, Cryptosporidium parvum
LNLISLLSLCSFLVITGLQGTIENN

SEQ ID NO: 2245400 - protein, 17 aa, Cryptosporidium parvum
LNLLKDPENLKKYVIKM

SEQ ID NO: 2245401 - protein, 27 aa, Cryptosporidium parvum
LNLNGKWNYIYSVDLFKLNSISWSKDG

SEQ ID NO: 2245402 - protein, 27 aa, Cryptosporidium parvum
LNLNYVFARYLILFVLSIYSILVFFES

SEQ ID NO: 2245403 - protein, 19 aa, Cryptosporidium parvum
LNLQKRLFNLVFNSQNNYF

SEQ ID NO: 2245404 - protein, 25 aa, Cryptosporidium parvum
LNLTQLSIFILFKKLVEKIINYESY

SEQ ID NO: 2245405 - protein, 23 aa, Cryptosporidium parvum
LNMMIFGTIMFTINKYFSVFAYN

SEQ ID NO: 2245406 - protein, 33 aa, Cryptosporidium parvum; identical to SEQ ID NO: 2132133

SEQ ID NO: 2245407 - protein, 31 aa, Cryptosporidium parvum
LNPKDYFEFPIQILFWFGYENTRLVAYKIKS

SEQ ID NO: 2245408 - protein, 26 aa, Cryptosporidium parvum
LNPSTSIPIVPYFPDTIRLNYKNLSD

SEQ ID NO: 2245409 - protein, 25 aa, Cryptosporidium parvum
LNQQNLYLYSGLASGLMLVINTLVK

SEQ ID NO: 2245410 - protein, 22 aa, Cryptosporidium parvum
LNRKLIIFFEGRRIKGNKINLE

SEQ ID NO: 2245411 - protein, 23 aa, Cryptosporidium parvum
LNSFRLYTYYTTHYLFQITSIFS

SEQ ID NO: 2245412 - protein, 24 aa, Cryptosporidium parvum
LNSMPITYFNYLHLPSEHYEEIVG

SEQ ID NO: 2245413 - protein, 22 aa, Cryptosporidium parvum
LNSNLLYIYLLLSTHNEHIKTS

SEQ ID NO: 2245414 - protein, 23 aa, Cryptosporidium parvum
LNSRHRSGILNFIFMNRFANNVN

SEQ ID NO: 2245415 - protein, 21 aa, Cryptosporidium parvum
LNTKHIFFDYFTLVDLEKDEM

SEQ ID NO: 2245416 - protein, 24 aa, Cryptosporidium parvum
LNVLGWFLIYDYYQNLILFNNVKH

SEQ ID NO: 2245417 - protein, 24 aa, Cryptosporidium parvum
LNVYGFILSAFIALPVLVWGMFVT

SEQ ID NO: 2245418 - protein, 40 aa, Cryptosporidium parvum
LNWLKVLIKYFKIFSHSLVPLLIIFDLMDLPLNSDLEKLE

SEQ ID NO: 2245419 - protein, 24 aa, Cryptosporidium parvum
LNYQDSITPLLIWITNEIMDRIKH

SEQ ID NO: 2245420 - protein, 18 aa, Cryptosporidium parvum
LPALIFSYASIVVQTPNR

SEQ ID NO: 2245421 - protein, 19 aa, Cryptosporidium parvum
LPDKIFLKKYEWGNEISQW

SEQ ID NO: 2245422 - protein, 19 aa, Cryptosporidium parvum
LPFDLGIMQLYLESQVVSS

SEQ ID NO: 2245423 - protein, 29 aa, Cryptosporidium parvum
LPGDDCIGGWLPPPVAIPCPSHAPTSSHA

SEQ ID NO: 2245424 - protein, 21 aa, Cryptosporidium parvum
LPHVFQLVHRVSYGLLDESTS

SEQ ID NO: 2245425 - protein, 17 aa, Cryptosporidium parvum
LPIFHKLVTNNIKFNDQ

SEQ ID NO: 2245426 - protein, 19 aa, Cryptosporidium parvum
LPIMTAFGAGAFIALALVH

SEQ ID NO: 2245427 - protein, 17 aa, Cryptosporidium parvum
LPIWLARELYSRGFVGI

SEQ ID NO: 2245428 - protein, 18 aa, Cryptosporidium parvum
LPKNLLLHILYSLLSFDE

SEQ ID NO: 2245429 - protein, 18 aa, Cryptosporidium parvum
LPKSQLLFNILRKDIFLN

SEQ ID NO: 2245430 - protein, 25 aa, Cryptosporidium parvum
LPMLTVFYGIFFSLAFMHGQNLNSK

SEQ ID NO: 2245431 - protein, 24 aa, Cryptosporidium parvum
LPPLDTSMMFCPLTKIGMSQSLLP

SEQ ID NO: 2245432 - protein, 20 aa, Cryptosporidium parvum
LPSELLISQGFLRNQKNSNG

SEQ ID NO: 2245433 - protein, 18 aa, Cryptosporidium parvum
LPSILGRLALMFKDSIRE

SEQ ID NO: 2245434 - protein, 22 aa, Cryptosporidium parvum
LPSKRLDFKVPTGNLLVIGFKE

SEQ ID NO: 2245435 - protein, 19 aa, Cryptosporidium parvum
LPTILLIPAIVRKDITIGG

SEQ ID NO: 2245436 - protein, 19 aa, Cryptosporidium parvum
LPTKALPCCGLLDPLKPVQ

SEQ ID NO: 2245437 - protein, 19 aa, Cryptosporidium parvum
LPVIFVVVIIMCLYLIYTF

SEQ ID NO: 2245438 - protein, 21 aa, Cryptosporidium parvum
LPVLVWGMFVTLISKYSDFNL

SEQ ID NO: 2245439 - protein, 20 aa, Cryptosporidium parvum
LPWFKRQIFKLLKLKQENLK

SEQ ID NO: 2245440 - protein, 18 aa, Cryptosporidium parvum
LQELCYLIYYISEGNNAL

SEQ ID NO: 2245441 - protein, 20 aa, Cryptosporidium parvum
LQELLRLLIVMIESWDELVI

SEQ ID NO: 2245442 - protein, 23 aa, Cryptosporidium parvum
LQFLDWWLFYQASNKYPYIFSMD

SEQ ID NO: 2245443 - protein, 24 aa, Cryptosporidium parvum
LQHFVYLLIRNVVSFKFQAAISEI

SEQ ID NO: 2245444 - protein, 25 aa, Cryptosporidium parvum
LQHGYKLEWIVIYLICAEIVIEVVW

SEQ ID NO: 2245445 - protein, 20 aa, Cryptosporidium parvum
LQILACNDGKWSLPGPDERM

SEQ ID NO: 2245446 - protein, 18 aa, Cryptosporidium parvum
LQILKVFIYERYFKAQSA

SEQ ID NO: 2245447 - protein, 33 aa, Cryptosporidium parvum
LQKGPKYKFIINLSLLWFLAFSQEPETPNTTEV

SEQ ID NO: 2245448 - protein, 18 aa, Cryptosporidium parvum
LQKRLWYEEFPLATFTIW

SEQ ID NO: 2245449 - protein, 23 aa, Cryptosporidium parvum
LQLNMLTMVNLIMSIGISVDYST

SEQ ID NO: 2245450 - protein, 26 aa, Cryptosporidium parvum
LQMENLSAFILYKSHIPYKCTKEQYQ

SEQ ID NO: 2245451 - protein, 20 aa, Cryptosporidium parvum
LQMGTLWKFITGNYSSIIRV

SEQ ID NO: 2245452 - protein, 21 aa, Cryptosporidium parvum
LQMLQGIFRFYYKIILERERI

SEQ ID NO: 2245453 - protein, 25 aa, Cryptosporidium parvum
LQSDHILFYLCRVLYSIGKSASQRE

SEQ ID NO: 2245454 - protein, 23 aa, Cryptosporidium parvum
LQSQLLLCFVFKSNPTFINYLLI

SEQ ID NO: 2245455 - protein, 27 aa, Cryptosporidium parvum
LQSVIVPFFWIIVYPKEKWRSITWEVQ

SEQ ID NO: 2245456 - protein, 21 aa, Cryptosporidium parvum
LQVCFVWNRLLRGFQTPPKRN

SEQ ID NO: 2245457 - protein, 17 aa, Cryptosporidium parvum
LQVPHWFNFMAIESESQ

SEQ ID NO: 2245458 - protein, 38 aa, Cryptosporidium parvum
LQWYSNFIYMLYKKDIALFYYVIHYLPIQKIIMELDWN

SEQ ID NO: 2245459 - protein, 25 aa, Cryptosporidium parvum
LQYENLIKLVFGLDLDLSKYFKKQI

SEQ ID NO: 2245460 - protein, 23 aa, Cryptosporidium parvum
LQYKLALALNNLHSKGLCHLDFT

SEQ ID NO: 2245461 - protein, 22 aa, Cryptosporidium parvum
LQYRGSIPIVWRQPPNLKKTPP

SEQ ID NO: 2245462 - protein, 23 aa, Cryptosporidium parvum
LRALLILLSLILGFLSILAFAWI

SEQ ID NO: 2245463 - protein, 30 aa, Cryptosporidium parvum
LRATLILTILLPFILEIYYLIPNFVSFYSG

SEQ ID NO: 2245464 - protein, 24 aa, Cryptosporidium parvum
LRDCIVSWVFPRARRMGLMPQNSS

SEQ ID NO: 2245465 - protein, 27 aa, Cryptosporidium parvum
LRDTIDLIFQLLFGFSKHSFGASSVED

SEQ ID NO: 2245466 - protein, 25 aa, Cryptosporidium parvum
LRDVLLLTGMSLKYPTWSGEQLTNI

SEQ ID NO: 2245467 - protein, 20 aa, Cryptosporidium parvum
LREFGTNHPKFKFLSSLWLS

SEQ ID NO: 2245468 - protein, 19 aa, Cryptosporidium parvum
LRERKIFDFVKYLVSDKTI

SEQ ID NO: 2245469 - protein, 20 aa, Cryptosporidium parvum
LRFCLSLLELSLISNLSFSI

SEQ ID NO: 2245470 - protein, 19 aa, Cryptosporidium parvum
LRFICMNPHHLSIGERLII

SEQ ID NO: 2245471 - protein, 19 aa, Cryptosporidium parvum
LRGKIIRSILYPSKYSFGL

SEQ ID NO: 2245472 - protein, 22 aa, Cryptosporidium parvum
LRIIIRLFVTPIIKTLSTVLII

SEQ ID NO: 2245473 - protein, 24 aa, Cryptosporidium parvum
LRKASIYNILSKLYVKLPYSDLSN

SEQ ID NO: 2245474 - protein, 29 aa, Cryptosporidium parvum
LRKLERLIDFLVPYFLLESAKICIEYLIQ

SEQ ID NO: 2245475 - protein, 21 aa, Cryptosporidium parvum
LRLALEMFLKEGLTHIPIVFE

SEQ ID NO: 2245476 - protein, 18 aa, Cryptosporidium parvum
LRLSRFKLFSCIESLLDG

SEQ ID NO: 2245477 - protein, 25 aa, Cryptosporidium parvum
LRMGLLFELMCYLGLTMISYNYTNQ

SEQ ID NO: 2245478 - protein, 25 aa, Cryptosporidium parvum
LRNLLELLYLSDASEFFFCLECIRS

SEQ ID NO: 2245479 - protein, 27 aa, Cryptosporidium parvum
LRQMLLPFIQLILIRFTFIFDYEIQQI

SEQ ID NO: 2245480 - protein, 18 aa, Cryptosporidium parvum
LRSFLLRMTGKNHLGASL

SEQ ID NO: 2245481 - protein, 17 aa, Cryptosporidium parvum
LRSFPKLNEAMIILDNL

SEQ ID NO: 2245482 - protein, 30 aa, Cryptosporidium parvum
LRSIYILVLYQLILFNILNSSSQTLNKVTK

SEQ ID NO: 2245483 - protein, 24 aa, Cryptosporidium parvum
LRSKARYRFNIDSPFFEVALSMFS

SEQ ID NO: 2245484 - protein, 32 aa, Cryptosporidium parvum
LRSRKVGFLAVFLLNIIFFDANIGLFKNEGIC

SEQ ID NO: 2245485 - protein, 27 aa, Cryptosporidium parvum
LRVKAILLLWKILYLHFTNSDSIQGNS

SEQ ID NO: 2245486 - protein, 18 aa, Cryptosporidium parvum
LSALALVVPIDYSENIYQ

SEQ ID NO: 2245487 - protein, 22 aa, Cryptosporidium parvum
LSALFGIFMIISIGGADMPVII

SEQ ID NO: 2245488 - protein, 26 aa, Cryptosporidium parvum
LSALIIITLLLSFGSALFSGLTLGMM

SEQ ID NO: 2245489 - protein, 19 aa, Cryptosporidium parvum
LSCPTIFFKVCELMCSIED

SEQ ID NO: 2245490 - protein, 21 aa, Cryptosporidium parvum
LSDDLIYELLLSLSRSVQNLG

SEQ ID NO: 2245491 - protein, 19 aa, Cryptosporidium parvum
LSDGTIPILLLFKQEKNFQ

SEQ ID NO: 2245492 - protein, 36 aa, Cryptosporidium parvum; identical to SEQ ID NO: 2132192

SEQ ID NO: 2245493 - protein, 18 aa, Cryptosporidium parvum
LSDRFHIQKLLLDFDREA

SEQ ID NO: 2245494 - protein, 20 aa, Cryptosporidium parvum
LSDVVLNLPLTPYSEQFLPY

SEQ ID NO: 2245495 - protein, 26 aa, Cryptosporidium parvum
LSEAHFLQLLILAQNQLKLFLESRFI

SEQ ID NO: 2245496 - protein, 47 aa, Cryptosporidium parvum
LSEDNSLLQVPPWANPLLLIAILISVFVHLVILYVPPISVIFNVVPL

SEQ ID NO: 2245497 - protein, 25 aa, Cryptosporidium parvum
LSEEIIIIIWHYYVINGSFLSNNSK

SEQ ID NO: 2245498 - protein, 23 aa, Cryptosporidium parvum
LSELQIFLFFGSRFSSSSLVLLA

SEQ ID NO: 2245499 - protein, 24 aa, Cryptosporidium parvum
LSELYYTFIESSKTIFDLLTVSKL

SEQ ID NO: 2245500 - protein, 19 aa, Cryptosporidium parvum
LSEYKLLGKTFLFGTNIGS

SEQ ID NO: 2245501 - protein, 21 aa, Cryptosporidium parvum
LSFDLLCELLNNMRIQLPVRE

SEQ ID NO: 2245502 - protein, 19 aa, Cryptosporidium parvum
LSFLIYVNGIRNFPTLDVK

SEQ ID NO: 2245503 - protein, 26 aa, Cryptosporidium parvum
LSFNKSIYRYLLVQYLIRKNRSRSEI

SEQ ID NO: 2245504 - protein, 18 aa, Cryptosporidium parvum
LSFSFVWFFKTLSFHHVC

SEQ ID NO: 2245505 - protein, 23 aa, Cryptosporidium parvum
LSHLPYYKLFLPFTYFLTIHSPE

SEQ ID NO: 2245506 - protein, 25 aa, Cryptosporidium parvum
LSHPYDIPFWLPETITFLANYSGNR

SEQ ID NO: 2245507 - protein, 19 aa, Cryptosporidium parvum
LSIAIAAQLPIPIAALQIL

SEQ ID NO: 2245508 - protein, 27 aa, Cryptosporidium parvum
LSIAKYILFFSFIYKSYTQFSNSISFG

SEQ ID NO: 2245509 - protein, 24 aa, Cryptosporidium parvum
LSICFEMVSLFILTQFIFSNQSTS

SEQ ID NO: 2245510 - protein, 19 aa, Cryptosporidium parvum
LSIFEAIFQSIIPKHVFAE

SEQ ID NO: 2245511 - protein, 22 aa, Cryptosporidium parvum
LSIFGVINYVISRVLYLSSSLS

SEQ ID NO: 2245512 - protein, 23 aa, Cryptosporidium parvum
LSIFTLVLNFQFLISKKIWKSES

SEQ ID NO: 2245513 - protein, 20 aa, Cryptosporidium parvum
LSIHYLLLNMLFHESYASRT

SEQ ID NO: 2245514 - protein, 19 aa, Cryptosporidium parvum
LSILQEIYLLLNYNNEYFK

SEQ ID NO: 2245515 - protein, 28 aa, Cryptosporidium parvum
LSISIVIITFYGAYIYFKKSLYIEIDFG

SEQ ID NO: 2245516 - protein, 24 aa, Cryptosporidium parvum
LSKKLFPTFSSRFGWRRVEEIIKS

SEQ ID NO: 2245517 - protein, 24 aa, Cryptosporidium parvum
LSKLEFKSFPWKVTPSYMTSGYWN

SEQ ID NO: 2245518 - protein, 27 aa, Cryptosporidium parvum
LSKLNYPIIYFASFIYKIKVKSSGTSD

SEQ ID NO: 2245519 - protein, 23 aa, Cryptosporidium parvum
LSKNAPLFIFRAITEGKKLPNYL

SEQ ID NO: 2245520 - protein, 22 aa, Cryptosporidium parvum
LSLFFLSIVLYEHPFKRTHSAC

SEQ ID NO: 2245521 - protein, 25 aa, Cryptosporidium parvum
LSLFNTLFLYFKFQNGIITTISVSI

SEQ ID NO: 2245522 - protein, 17 aa, Cryptosporidium parvum
LSLIHVLVELAFQTLVI

SEQ ID NO: 2245523 - protein, 18 aa, Cryptosporidium parvum
LSLKGIYKKSILGYLTEH

SEQ ID NO: 2245524 - protein, 24 aa, Cryptosporidium parvum
LSLKHILKCKPFEWYIGKFRPAFE

SEQ ID NO: 2245525 - protein, 19 aa, Cryptosporidium parvum
LSLNLLWKINHFTNGFIIS

SEQ ID NO: 2245526 - protein, 20 aa, Cryptosporidium parvum
LSLPALIAPVKCSILPISSN

SEQ ID NO: 2245527 - protein, 24 aa, Cryptosporidium parvum
LSLTRWFACFLLIFGVIMIPKKSK

SEQ ID NO: 2245528 - protein, 24 aa, Cryptosporidium parvum
LSLVFRSIFLYFLIARVPTAVSYF

SEQ ID NO: 2245529 - protein, 25 aa, Cryptosporidium parvum
LSLVTVMIIFLYSVQIISSLSVILH

SEQ ID NO: 2245530 - protein, 32 aa, Cryptosporidium parvum; identical to SEQ ID NO: 2132218

SEQ ID NO: 2245531 - protein, 23 aa, Cryptosporidium parvum
LSMLLDRSFWVQYLRHDLSEEII

SEQ ID NO: 2245532 - protein, 36 aa, Cryptosporidium parvum; identical to SEQ ID NO: 2132220

SEQ ID NO: 2245533 - protein, 25 aa, Cryptosporidium parvum
LSNKILLNKTFPLKIRDVYYSWLHK

SEQ ID NO: 2245534 - protein, 22 aa, Cryptosporidium parvum
LSNKYLTICIPKLLLAASNYQI

SEQ ID NO: 2245535 - protein, 18 aa, Cryptosporidium parvum
LSNQVPIFSKKFNRKLLK

SEQ ID NO: 2245536 - protein, 24 aa, Cryptosporidium parvum
LSNSELIYIIIKFSLITEIQKLNI

SEQ ID NO: 2245537 - protein, 25 aa, Cryptosporidium parvum
LSNVFPCVIIPLKVQKIFSILSNHT

SEQ ID NO: 2245538 - protein, 23 aa, Cryptosporidium parvum
LSPNHLIFIQYLGEKPHEGNCYY

SEQ ID NO: 2245539 - protein, 22 aa, Cryptosporidium parvum
LSPNNFIVFSKAKMLSKNSECR

SEQ ID NO: 2245540 - protein, 36 aa, Cryptosporidium parvum
LSQILGLRFVIVLVLSALLYPLLSSSVWIQINSSAF

SEQ ID NO: 2245541 - protein, 20 aa, Cryptosporidium parvum
LSQKFWVGAKLNKLLDTEGN

SEQ ID NO: 2245542 - protein, 31 aa, Cryptosporidium parvum
LSQTPSTFLKIPLPLLLAVGAVLILETDYES

SEQ ID NO: 2245543 - protein, 19 aa, Cryptosporidium parvum
LSRIADWMIGTFILEKHIP

SEQ ID NO: 2245544 - protein, 22 aa, Cryptosporidium parvum
LSRIKHPFLVRMFGTFKDDRYL

SEQ ID NO: 2245545 - protein, 27 aa, Cryptosporidium parvum
LSRLDILLLFILPFNNITLFNSGFMVN

SEQ ID NO: 2245546 - protein, 24 aa, Cryptosporidium parvum
LSRNKILNPFLYPLLVIGETNSLE

SEQ ID NO: 2245547 - protein, 26 aa, Cryptosporidium parvum
LSRRDGTVLFVFIDTFILSSSFPDHK

SEQ ID NO: 2245548 - protein, 22 aa, Cryptosporidium parvum
LSRYITLILVLKLLHLISHIRI

SEQ ID NO: 2245549 - protein, 41 aa, Cryptosporidium parvum; identical to SEQ ID NO: 2132231

SEQ ID NO: 2245550 - protein, 17 aa, Cryptosporidium parvum
LSSFIHDLILLSPKTKE

SEQ ID NO: 2245551 - protein, 18 aa, Cryptosporidium parvum
LSSFLLLIKLQIFKFIGI

SEQ ID NO: 2245552 - protein, 31 aa, Cryptosporidium parvum
LSSGRKFLSKYYRGPWKLWKNKPREILSPKI

SEQ ID NO: 2245553 - protein, 41 aa, Cryptosporidium parvum
LSSSWFVSDPWIWLDLIETSFLPLITFDFEFPYNLETRRAN

SEQ ID NO: 2245554 - protein, 24 aa, Cryptosporidium parvum
LSSYTPLNPPYLIKFKKSISNNTL

SEQ ID NO: 2245555 - protein, 24 aa, Cryptosporidium parvum
LSTKKLLIIFKVIEIPIVKIYLED

SEQ ID NO: 2245556 - protein, 26 aa, Cryptosporidium parvum
LSTNLAGILFYFYKSFINLQSIKQFI

SEQ ID NO: 2245557 - protein, 30 aa, Cryptosporidium parvum
LSTNYKIVPLPPMYRFFTSLENLKNMKIGS

SEQ ID NO: 2245558 - protein, 25 aa, Cryptosporidium parvum
LSTTRWFACFLLFVGVLLVQKTNIR

SEQ ID NO: 2245559 - protein, 20 aa, Cryptosporidium parvum
LSVCIISVTIVTIISILYSI

SEQ ID NO: 2245560 - protein, 20 aa, Cryptosporidium parvum
LSVYLQILNSLLSKKSKYFP

SEQ ID NO: 2245561 - protein, 35 aa, Cryptosporidium parvum
LSYFYSREEFYVYQAIFNYSISLIASLDSFLNLRR

SEQ ID NO: 2245562 - protein, 20 aa, Cryptosporidium parvum
LSYILVIFQSICTMYLVFKI

SEQ ID NO: 2245563 - protein, 19 aa, Cryptosporidium parvum
LTCIDKHRIRIGQWSAIVH

SEQ ID NO: 2245564 - protein, 19 aa, Cryptosporidium parvum
LTDISFFNLFLGNFAVIPA

SEQ ID NO: 2245565 - protein, 24 aa, Cryptosporidium parvum
LTDRFFQMISFSFAEYLFEENYIN

SEQ ID NO: 2245566 - protein, 19 aa, Cryptosporidium parvum
LTEDASPFWNSPWSFKCTV

SEQ ID NO: 2245567 - protein, 19 aa, Cryptosporidium parvum
LTESKFLLESSCCPLNLIR

SEQ ID NO: 2245568 - protein, 24 aa, Cryptosporidium parvum
LTFGRSPVFLSHIFDLLAFDQSIQ

SEQ ID NO: 2245569 - protein, 17 aa, Cryptosporidium parvum
LTFHLFIGVFAEDSSSE

SEQ ID NO: 2245570 - protein, 19 aa, Cryptosporidium parvum
LTGDLSIHYLLLNMLFHES

SEQ ID NO: 2245571 - protein, 19 aa, Cryptosporidium parvum
LTGSFGFGWLSKGMMNIKC

SEQ ID NO: 2245572 - protein, 21 aa, Cryptosporidium parvum
LTHILLFSIIICLLSLRSDQG

SEQ ID NO: 2245573 - protein, 28 aa, Cryptosporidium parvum
LTHSRLFIPEYNSMLYIVMLIENGTRVI

SEQ ID NO: 2245574 - protein, 26 aa, Cryptosporidium parvum
LTIAWTTAMIYLIISSTLVPLAGIVG

SEQ ID NO: 2245575 - protein, 27 aa, Cryptosporidium parvum
LTICITKYILTFIKLHDLPLFFNSLSK

SEQ ID NO: 2245576 - protein, 23 aa, Cryptosporidium parvum
LTIFIQFLIWALLVYEFANYLDS

SEQ ID NO: 2245577 - protein, 37 aa, Cryptosporidium parvum
LTIGILTTHIFKLFDIIWIKLSYLWCGERHLLLEPLN

SEQ ID NO: 2245578 - protein, 27 aa, Cryptosporidium parvum
LTIIFNIIIFLYLLSSFNIIRCNGEKM

SEQ ID NO: 2245579 - protein, 20 aa, Cryptosporidium parvum
LTIIFVYFLNEVWDILFVFL

SEQ ID NO: 2245580 - protein, 18 aa, Cryptosporidium parvum
LTIILLFSKILTDSTRPW

SEQ ID NO: 2245581 - protein, 22 aa, Cryptosporidium parvum
LTISNIQFIKPLIFPNELGRNP

SEQ ID NO: 2245582 - protein, 27 aa, Cryptosporidium parvum
LTISVLLPLLIAIYYIIMPVHTVIILR

SEQ ID NO: 2245583 - protein, 19 aa, Cryptosporidium parvum
LTKKLLIFSLTVIKGKKSF

SEQ ID NO: 2245584 - protein, 27 aa, Cryptosporidium parvum
LTKRLGIKLLKLLRLLLEFTKEYGYIK

SEQ ID NO: 2245585 - protein, 25 aa, Cryptosporidium parvum
LTLFFNIIFSIFILKQQISTICIFG

SEQ ID NO: 2245586 - protein, 32 aa, Cryptosporidium parvum
LTLLLVSYGFMLMVCHWLLFDSIQCIITLLIG

SEQ ID NO: 2245587 - protein, 24 aa, Cryptosporidium parvum
LTLNLELWDLLINSLSSCCCPSVS

SEQ ID NO: 2245588 - protein, 19 aa, Cryptosporidium parvum
LTMTSTRVIILILASIFLA

SEQ ID NO: 2245589 - protein, 23 aa, Cryptosporidium parvum
LTNCNAKWKIYSLLFEQFTSTIN

SEQ ID NO: 2245590 - protein, 25 aa, Cryptosporidium parvum
LTNLFMSVLLVGRLGAALGGIGGLG

SEQ ID NO: 2245591 - protein, 25 aa, Cryptosporidium parvum
LTNQNSYRIIIFLELCAILNKHDSE

SEQ ID NO: 2245592 - protein, 31 aa, Cryptosporidium parvum
LTPENQISVWLFLTASLLTSLLLYRNVQKEQ

SEQ ID NO: 2245593 - protein, 20 aa, Cryptosporidium parvum
LTPYSEQFLPYKQKLDKALS

SEQ ID NO: 2245594 - protein, 23 aa, Cryptosporidium parvum
LTQDLFTNWTYFDNSFSFLSNYF

SEQ ID NO: 2245595 - protein, 18 aa, Cryptosporidium parvum
LTQDLWYKMTSKHKQITK

SEQ ID NO: 2245596 - protein, 25 aa, Cryptosporidium parvum
LTRISPLSILIMELSSFYGDSTEKD

SEQ ID NO: 2245597 - protein, 28 aa, Cryptosporidium parvum
LTRLDLYLYNLFKHLFSIKIKNFKSTTK

SEQ ID NO: 2245598 - protein, 31 aa, Cryptosporidium parvum; identical to SEQ ID NO: 2132256

SEQ ID NO: 2245599 - protein, 24 aa, Cryptosporidium parvum
LTSCYYDIFFPPPITNQPSMTSIQ

SEQ ID NO: 2245600 - protein, 32 aa, Cryptosporidium parvum
LTSGKWKKISWIGFKISFFIPRTSISWIHQNE

SEQ ID NO: 2245601 - protein, 35 aa, Cryptosporidium parvum; identical to SEQ ID NO: 2132259

SEQ ID NO: 2245602 - protein, 33 aa, Cryptosporidium parvum
LTTLKLCLSRLTFNLYRLAVFCQTAIKSLIKAI

SEQ ID NO: 2245603 - protein, 27 aa, Cryptosporidium parvum
LTVRRALNLFIPLLHNIKPIIKDDTLN

SEQ ID NO: 2245604 - protein, 19 aa, Cryptosporidium parvum
LTYYRISLAIFNNIFKLFL

SEQ ID NO: 2245605 - protein, 20 aa, Cryptosporidium parvum
LVALTLCLYSQLGISALFGI

SEQ ID NO: 2245606 - protein, 25 aa, Cryptosporidium parvum
LVCLRYLVCLISKISIGFSLQFIPD

SEQ ID NO: 2245607 - protein, 17 aa, Cryptosporidium parvum
LVCPLFQDWVLELEREV

SEQ ID NO: 2245608 - protein, 29 aa, Cryptosporidium parvum
LVESNIRFPTIGSFFSWLGSFNSLYVKYE

SEQ ID NO: 2245609 - protein, 26 aa, Cryptosporidium parvum
LVETQMFCFLPLFILSHNIIKQYYQS

SEQ ID NO: 2245610 - protein, 34 aa, Cryptosporidium parvum
LVFCKGFDTLWYVSFARFMLLLSSIIPISLRVNL

SEQ ID NO: 2245611 - protein, 18 aa, Cryptosporidium parvum
LVFEPYQRLMSFAIEICM

SEQ ID NO: 2245612 - protein, 21 aa, Cryptosporidium parvum
LVFHLLNERIDFSLKFFSTHA

SEQ ID NO: 2245613 - protein, 17 aa, Cryptosporidium parvum
LVGWIAYCILNISKITL

SEQ ID NO: 2245614 - protein, 18 aa, Cryptosporidium parvum
LVIAILMSLRISCYKCDN

SEQ ID NO: 2245615 - protein, 25 aa, Cryptosporidium parvum
LVIFSSYSLGFWYGGVLVADSMDSG

SEQ ID NO: 2245616 - protein, 19 aa, Cryptosporidium parvum
LVIFYFVCCNLHKLDTVDC

SEQ ID NO: 2245617 - protein, 18 aa, Cryptosporidium parvum
LVIIKLIKIQLSNLMFNY

SEQ ID NO: 2245618 - protein, 20 aa, Cryptosporidium parvum
LVIYTKLFKLKLDSDLRILD

SEQ ID NO: 2245619 - protein, 17 aa, Cryptosporidium parvum
LVKTWHLFLGISIKVNE

SEQ ID NO: 2245620 - protein, 17 aa, Cryptosporidium parvum
LVKYRYLAPLTVDIGEL

SEQ ID NO: 2245621 - protein, 26 aa, Cryptosporidium parvum
LVLHKYEVPLMFACETKKLICHNTST

SEQ ID NO: 2245622 - protein, 18 aa, Cryptosporidium parvum
LVLKFIQLIQQQSKYFHI

SEQ ID NO: 2245623 - protein, 19 aa, Cryptosporidium parvum
LVNLYNKYLSNLWLLSLIN

SEQ ID NO: 2245624 - protein, 30 aa, Cryptosporidium parvum
LVNNDDLCIILKPPFWYCPIEGTGMDEDEQ

SEQ ID NO: 2245625 - protein, 23 aa, Cryptosporidium parvum
LVNSNLIFKFLIELYSRYSNKNK

SEQ ID NO: 2245626 - protein, 25 aa, Cryptosporidium parvum
LVPRSTLNYLLYRALKLPNDFGKTR

SEQ ID NO: 2245627 - protein, 34 aa, Cryptosporidium parvum
LVPTTNWNLIALSHNYFFGALYGRMKTAKQCQER

SEQ ID NO: 2245628 - protein, 27 aa, Cryptosporidium parvum
LVQDEKMWFTFYYLNKKSSICNVQGSS

SEQ ID NO: 2245629 - protein, 27 aa, Cryptosporidium parvum
LVRELGYCSDWIVLNMLGKFQTTIKEG

SEQ ID NO: 2245630 - protein, 19 aa, Cryptosporidium parvum
LVRNMDIKILLAESSPILS

SEQ ID NO: 2245631 - protein, 22 aa, Cryptosporidium parvum
LVSCLNIVSLFPRDFHPKLMGS

SEQ ID NO: 2245632 - protein, 28 aa, Cryptosporidium parvum
LVSHYYFLKRLLKGIFIEILIISTLIKL

SEQ ID NO: 2245633 - protein, 40 aa, Cryptosporidium parvum; identical to SEQ ID NO: 2132279

SEQ ID NO: 2245634 - protein, 17 aa, Cryptosporidium parvum
LVSMHFLGLISNNMLLM

SEQ ID NO: 2245635 - protein, 31 aa, Cryptosporidium parvum; identical to SEQ ID NO: 2132281

SEQ ID NO: 2245636 - protein, 27 aa, Cryptosporidium parvum
LVVEKLRWPGGFYFYISGSGPYYPCHS

SEQ ID NO: 2245637 - protein, 18 aa, Cryptosporidium parvum
LVVLLLIWHFLHAIIFGG

SEQ ID NO: 2245638 - protein, 23 aa, Cryptosporidium parvum
LVVLVILFCLCMTGSLLTYKYIF

SEQ ID NO: 2245639 - protein, 17 aa, Cryptosporidium parvum
LVVTIVVYINNLNFNNN

SEQ ID NO: 2245640 - protein, 17 aa, Cryptosporidium parvum
LVWNTIWKEIKYNLISE

SEQ ID NO: 2245641 - protein, 23 aa, Cryptosporidium parvum
LVYSLLNLIIRKTTIQLSNNLDY

SEQ ID NO: 2245642 - protein, 19 aa, Cryptosporidium parvum
LWMLITCSWMLLLLSYFFG

SEQ ID NO: 2245643 - protein, 17 aa, Cryptosporidium parvum
LWTSVYIFDGQNHIGKK

SEQ ID NO: 2245644 - protein, 27 aa, Cryptosporidium parvum
LYANPHSILFLFNIIPPLLSCSSTGTP

SEQ ID NO: 2245645 - protein, 18 aa, Cryptosporidium parvum
LYCKLIQSSVYRIGSSEN

SEQ ID NO: 2245646 - protein, 32 aa, Cryptosporidium parvum; identical to SEQ ID NO: 2235359

SEQ ID NO: 2245647 - protein, 19 aa, Cryptosporidium parvum
LYDAPLIDILFGGGNLDIS

SEQ ID NO: 2245648 - protein, 38 aa, Cryptosporidium parvum; identical to SEQ ID NO: 2132289

SEQ ID NO: 2245649 - protein, 18 aa, Cryptosporidium parvum
LYDLYPLAVIRKYIEFRG

SEQ ID NO: 2245650 - protein, 18 aa, Cryptosporidium parvum
LYDTFKKNYFDLWTSNIQ

SEQ ID NO: 2245651 - protein, 17 aa, Cryptosporidium parvum
LYFIKKHHKLLLKSNLS

SEQ ID NO: 2245652 - protein, 18 aa, Cryptosporidium parvum
LYFIPAFAFIYISIIINT

SEQ ID NO: 2245653 - protein, 19 aa, Cryptosporidium parvum
LYHFDWNIFVRKKALLSII

SEQ ID NO: 2245654 - protein, 31 aa, Cryptosporidium parvum
LYIILKFFILFIFFVYLKTRHDLIKYDHTLT

SEQ ID NO: 2245655 - protein, 19 aa, Cryptosporidium parvum
LYILNCTIPIEYLLNMDIN

SEQ ID NO: 2245656 - protein, 18 aa, Cryptosporidium parvum
LYIMGDIFHVLKALYSKL

SEQ ID NO: 2245657 - protein, 36 aa, Cryptosporidium parvum
LYIPNTCKIFFYQDGFLSSLWKFIKNIYFSSNIFSE

SEQ ID NO: 2245658 - protein, 17 aa, Cryptosporidium parvum
LYISFKYEDPTSTFDQC

SEQ ID NO: 2245659 - protein, 27 aa, Cryptosporidium parvum
LYISNEVVHRFLPWDSLNELMDILERD

SEQ ID NO: 2245660 - protein, 20 aa, Cryptosporidium parvum
LYKATILWSKLFVIPSSRSK

SEQ ID NO: 2245661 - protein, 20 aa, Cryptosporidium parvum
LYKDFLQFTLMRNLERRDSV

SEQ ID NO: 2245662 - protein, 18 aa, Cryptosporidium parvum
LYKELDGYFLKKFNEASN

SEQ ID NO: 2245663 - protein, 17 aa, Cryptosporidium parvum
LYKKTLKLAFKILRICM

SEQ ID NO: 2245664 - protein, 27 aa, Cryptosporidium parvum
LYKRIPYLFEVLYINLGIPILHNVVPN

SEQ ID NO: 2245665 - protein, 28 aa, Cryptosporidium parvum
LYLAYKFLPVYWVNLLLTSYLFIIGAVA

SEQ ID NO: 2245666 - protein, 17 aa, Cryptosporidium parvum
LYLGYPKAYTIRTWNSN

SEQ ID NO: 2245667 - protein, 17 aa, Cryptosporidium parvum
LYLLNKRSPILYNFFVK

SEQ ID NO: 2245668 - protein, 26 aa, Cryptosporidium parvum
LYLNRKFPVDVIFTSLLIFESLQLTL

SEQ ID NO: 2245669 - protein, 18 aa, Cryptosporidium parvum
LYNDHSIHFWYKNKKNLN

SEQ ID NO: 2245670 - protein, 24 aa, Cryptosporidium parvum
LYNHNFFCYPFSWIDIEGIKEIPN

SEQ ID NO: 2245671 - protein, 23 aa, Cryptosporidium parvum
LYNKFTLIIFGVFTITSIIINEV

SEQ ID NO: 2245672 - protein, 31 aa, Cryptosporidium parvum; identical to SEQ ID NO: 2132304

SEQ ID NO: 2245673 - protein, 25 aa, Cryptosporidium parvum
LYNRKYFILFLAWSFLSCFLISIFS

SEQ ID NO: 2245674 - protein, 23 aa, Cryptosporidium parvum
LYNYAMFLIGCAEIYFNINSKRR

SEQ ID NO: 2245675 - protein, 17 aa, Cryptosporidium parvum
LYNYLKAFPIRIKDFEK

SEQ ID NO: 2245676 - protein, 17 aa, Cryptosporidium parvum
LYPFYHCHFLFQKSLII

SEQ ID NO: 2245677 - protein, 17 aa, Cryptosporidium parvum
LYQAFVLIDLYICFGNK

SEQ ID NO: 2245678 - protein, 29 aa, Cryptosporidium parvum
LYQFQYPHLFQFTRFYPLTVSFLHFTAFI

SEQ ID NO: 2245679 - protein, 17 aa, Cryptosporidium parvum
LYRPKILILSNKPSPTL

SEQ ID NO: 2245680 - protein, 29 aa, Cryptosporidium parvum
LYSALLVIYNILFDWYMIDLRSIERELDM

SEQ ID NO: 2245681 - protein, 19 aa, Cryptosporidium parvum
LYSIKYYRGTNSFHYLFDL

SEQ ID NO: 2245682 - protein, 23 aa, Cryptosporidium parvum
LYSLYHFFVLIRFSSIHCSILST

SEQ ID NO: 2245683 - protein, 35 aa, Cryptosporidium parvum
LYSQPKFVLYCFVNISFILICTYLSFFGLDGTEEN

SEQ ID NO: 2245684 - protein, 20 aa, Cryptosporidium parvum
LYTNLFSFFKDIFRNRKLLK

SEQ ID NO: 2245685 - protein, 25 aa, Cryptosporidium parvum
LYTTPKFHRMFFKKVMKSINEEYRL

SEQ ID NO: 2245686 - protein, 24 aa, Cryptosporidium parvum
LYTTSFIFTTIAYLGLVSFFNIFT

SEQ ID NO: 2245687 - protein, 29 aa, Cryptosporidium parvum
LYVGIATVGIFVWWYVWGIDPSDGNTLVS

SEQ ID NO: 2245688 - protein, 18 aa, Cryptosporidium parvum
LYVLKEKVLWIGNLEISF

SEQ ID NO: 2245689 - protein, 20 aa, Cryptosporidium parvum
LYVYNIPLVTGIMVFNTLKI

SEQ ID NO: 2245690 - protein, 19 aa, Cryptosporidium parvum
LYYISDIKLLLHYQTIHEW

SEQ ID NO: 2245691 - protein, 32 aa, Cryptosporidium parvum
LYYNLGIIMGFPYFAPRFSLGFHYSKWEYTSE

SEQ ID NO: 2245692 - protein, 19 aa, Cryptosporidium parvum
LYYNPFLYEFELNTKIVCH

SEQ ID NO: 2245693 - protein, 20 aa, Cryptosporidium parvum
LYYYRFRRDRRFDESFPSFV

SEQ ID NO: 2245694 - protein, 29 aa, Cryptosporidium parvum
MAHRYKIQGFPTLLMFPAGEKREITPVNY

SEQ ID NO: 2245695 - protein, 17 aa, Cryptosporidium parvum
MAPLTVRPILKFSTLIT

SEQ ID NO: 2245696 - protein, 21 aa, Cryptosporidium parvum
MCINFVSYNLLWFGMTKYFEV

SEQ ID NO: 2245697 - protein, 26 aa, Cryptosporidium parvum
MCISTLEVLYYFTKFYLKLNSAEIKF

SEQ ID NO: 2245698 - protein, 19 aa, Cryptosporidium parvum
MCMHAYFEGGPLKEAFFIH

SEQ ID NO: 2245699 - protein, 18 aa, Cryptosporidium parvum
MCPGVEFLSKGFIEKLIV

SEQ ID NO: 2245700 - protein, 23 aa, Cryptosporidium parvum
  misc_feature (21)..(21): Xaa can be any naturally occurring amino acid
MDDFTTYSMYIVTVLTIVGAXYV

SEQ ID NO: 2245701 - protein, 23 aa, Cryptosporidium parvum
MDEIPHLHLHRFRSIRSDPNSES

SEQ ID NO: 2245702 - protein, 20 aa, Cryptosporidium parvum
MDILERDCGWRRPRITIPPP

SEQ ID NO: 2245703 - protein, 27 aa, Cryptosporidium parvum
MDKPKSYRLLWHLITRGPFNIEDILPK

SEQ ID NO: 2245704 - protein, 41 aa, Cryptosporidium parvum; identical to SEQ ID NO: 2132318

SEQ ID NO: 2245705 - protein, 17 aa, Cryptosporidium parvum
MDRKYFSVLKNFSFYKL

SEQ ID NO: 2245706 - protein, 27 aa, Cryptosporidium parvum
MDVATYLFMMIVRLIIFRLILPWLCPE

SEQ ID NO: 2245707 - protein, 23 aa, Cryptosporidium parvum
MEALQFYMMSLLSFDKVDISNLK

SEQ ID NO: 2245708 - protein, 25 aa, Cryptosporidium parvum
MEDEVLSNLLYKFLLVSPQCNIKEF

SEQ ID NO: 2245709 - protein, 35 aa, Cryptosporidium parvum
MEEIETLLYNLKLYMDYLLGIKYKGKNIKASWSSY

SEQ ID NO: 2245710 - protein, 24 aa, Cryptosporidium parvum
MEESYFFMLITNFPVLSLTIGIVL

SEQ ID NO: 2245711 - protein, 22 aa, Cryptosporidium parvum
MEILCFMAISFYCYCNQHTGSE

SEQ ID NO: 2245712 - protein, 24 aa, Cryptosporidium parvum
MFCFENWGYFLLGNNFQLLDHIIE

SEQ ID NO: 2245713 - protein, 23 aa, Cryptosporidium parvum
MFCHFFHTKYVYDLLSKLCTLSC

SEQ ID NO: 2245714 - protein, 28 aa, Cryptosporidium parvum
MFGTKFNLFMFITYDKYIDLLLESGQEL

SEQ ID NO: 2245715 - protein, 18 aa, Cryptosporidium parvum
MFIDRFISFPQFLSAIIN

SEQ ID NO: 2245716 - protein, 17 aa, Cryptosporidium parvum
MFLNIFIAIWSISSILY

SEQ ID NO: 2245717 - protein, 19 aa, Cryptosporidium parvum
MFLSSQGVFYSFYKNVLFA

SEQ ID NO: 2245718 - protein, 17 aa, Cryptosporidium parvum
MFPFIMKKSQSDTWPHE

SEQ ID NO: 2245719 - protein, 19 aa, Cryptosporidium parvum
MFPTIIEFGILLIITVINI

SEQ ID NO: 2245720 - protein, 17 aa, Cryptosporidium parvum
MFSTFLASINTFGGFYV

SEQ ID NO: 2245721 - protein, 30 aa, Cryptosporidium parvum; identical to SEQ ID NO: 2132332

SEQ ID NO: 2245722 - protein, 21 aa, Cryptosporidium parvum
MFVLAFHVIPTLVVNKYLLFE

SEQ ID NO: 2245723 - protein, 29 aa, Cryptosporidium parvum
MGFFPVKFFPILFFSITINNGLFSRNYEE

SEQ ID NO: 2245724 - protein, 17 aa, Cryptosporidium parvum
MGFLYLETDNNNSSKII

SEQ ID NO: 2245725 - protein, 23 aa, Cryptosporidium parvum
MGISILLLSMLSSKIKIFRTNGR

SEQ ID NO: 2245726 - protein, 18 aa, Cryptosporidium parvum
MGITILDYLKFSLELQNY

SEQ ID NO: 2245727 - protein, 18 aa, Cryptosporidium parvum
MGLCIFVRLFAVVRYEAI

SEQ ID NO: 2245728 - protein, 18 aa, Cryptosporidium parvum
MGLDLKVLAPPSSQVYKF

SEQ ID NO: 2245729 - protein, 19 aa, Cryptosporidium parvum
MGQTLVLDDLQYLYTHLKI

SEQ ID NO: 2245730 - protein, 19 aa, Cryptosporidium parvum
MGTDWPLFIKEACRTLKDN

SEQ ID NO: 2245731 - protein, 22 aa, Cryptosporidium parvum
MGTIGCITWFLETVDTYWFFHS

SEQ ID NO: 2245732 - protein, 23 aa, Cryptosporidium parvum
MGTLNCIFGLISINLLAIVISLY

SEQ ID NO: 2245733 - protein, 23 aa, Cryptosporidium parvum
MHGHRWFPPLLDQIRHFLVKGYM

SEQ ID NO: 2245734 - protein, 17 aa, Cryptosporidium parvum
MHGYMKCLFSRPIQQNE

SEQ ID NO: 2245735 - protein, 19 aa, Cryptosporidium parvum
MHLSPSFFQTLLDSNERFI

SEQ ID NO: 2245736 - protein, 18 aa, Cryptosporidium parvum
MIDIIQFDEKVRPVIEQI

SEQ ID NO: 2245737 - protein, 33 aa, Cryptosporidium parvum
MIECRIQNFIFFNFLLYLASIGPQLFISFILFY

SEQ ID NO: 2245738 - protein, 22 aa, Cryptosporidium parvum
MIIMSIFGLIRMAISKSSESGN

SEQ ID NO: 2245739 - protein, 27 aa, Cryptosporidium parvum
MIITKTGLNLLILFGIAFMGFCVSGPD

SEQ ID NO: 2245740 - protein, 17 aa, Cryptosporidium parvum
MIKPISWYETYFSKFGR

SEQ ID NO: 2245741 - protein, 25 aa, Cryptosporidium parvum
MILNWDKEFLKIINTFSISYLESDT

SEQ ID NO: 2245742 - protein, 24 aa, Cryptosporidium parvum
MILQVALLGIMWSLTYYMLSKYSE

SEQ ID NO: 2245743 - protein, 19 aa, Cryptosporidium parvum
MIPSSKIFYLIYKKSDPHD

SEQ ID NO: 2245744 - protein, 36 aa, Cryptosporidium parvum; identical to SEQ ID NO: 2132349

SEQ ID NO: 2245745 - protein, 24 aa, Cryptosporidium parvum
MIQEIWITKWNQELLQDLALGGRE

SEQ ID NO: 2245746 - protein, 17 aa, Cryptosporidium parvum
MIRFCVAHFITTRFKFR

SEQ ID NO: 2245747 - protein, 17 aa, Cryptosporidium parvum
MIRIGMTNPPYILDQID

SEQ ID NO: 2245748 - protein, 17 aa, Cryptosporidium parvum
MIRSSLTLPMKDLDDPS

SEQ ID NO: 2245749 - protein, 23 aa, Cryptosporidium parvum
MISQTLFVYDFVSLLYPNNSNYS

SEQ ID NO: 2245750 - protein, 30 aa, Cryptosporidium parvum; identical to SEQ ID NO: 2132351

SEQ ID NO: 2245751 - protein, 19 aa, Cryptosporidium parvum
MIWYAVRKFLDLKEYEFLY

SEQ ID NO: 2245752 - protein, 25 aa, Cryptosporidium parvum
MKELDLLSIILLSSTLYLAKIKQMR

SEQ ID NO: 2245753 - protein, 18 aa, Cryptosporidium parvum
MKFENWPFIGIQNEWKHI

SEQ ID NO: 2245754 - protein, 32 aa, Cryptosporidium parvum
MKHASVQIILLDYLVTWILINVSVFKVCTKDL

SEQ ID NO: 2245755 - protein, 30 aa, Cryptosporidium parvum
MKIPSHAIKIFPITFLPSIKILEIGLSDKS

SEQ ID NO: 2245756 - protein, 19 aa, Cryptosporidium parvum
MKIPVLFETIKLISNQDSK

SEQ ID NO: 2245757 - protein, 17 aa, Cryptosporidium parvum
MKITRLIHCAKAIIIDE

SEQ ID NO: 2245758 - protein, 29 aa, Cryptosporidium parvum
MKNITLIINCLFALGYKKIALVKMDNNAL

SEQ ID NO: 2245759 - protein, 22 aa, Cryptosporidium parvum
MKVKVLLAKIVPLVSIGLLNIE

SEQ ID NO: 2245760 - protein, 19 aa, Cryptosporidium parvum
MLCVYFIGVLFLAGFQEFI

SEQ ID NO: 2245761 - protein, 31 aa, Cryptosporidium parvum
MLEEIGIAFRIPFKWLPSASEKLSFLSKLKI

SEQ ID NO: 2245762 - protein, 27 aa, Cryptosporidium parvum
MLFTGFGSFFILFFAAALIVTCTWAFQ

SEQ ID NO: 2245763 - protein, 21 aa, Cryptosporidium parvum
MLGRKVVQILDLLWRQVAESQ

SEQ ID NO: 2245764 - protein, 18 aa, Cryptosporidium parvum
MLIFIPLALPIITFSLAG

SEQ ID NO: 2245765 - protein, 17 aa, Cryptosporidium parvum
MLILFAELVSSIPDLII

SEQ ID NO: 2245766 - protein, 35 aa, Cryptosporidium parvum; identical to SEQ ID NO: 2132364

SEQ ID NO: 2245767 - protein, 17 aa, Cryptosporidium parvum
MLIWNFLSNFIYQNTRG

SEQ ID NO: 2245768 - protein, 22 aa, Cryptosporidium parvum
MLKESHLFLRILENVIPKILEN

SEQ ID NO: 2245769 - protein, 17 aa, Cryptosporidium parvum
MLLLYSGSELIINVNIT

SEQ ID NO: 2245770 - protein, 23 aa, Cryptosporidium parvum
MLNPWISLFYQASFIINSYLSII

SEQ ID NO: 2245771 - protein, 29 aa, Cryptosporidium parvum
MLPDIIYLEVAMLLRRLAKRIDLFRSAEE

SEQ ID NO: 2245772 - protein, 17 aa, Cryptosporidium parvum
MLSKCIIIFSILYENDI

SEQ ID NO: 2245773 - protein, 26 aa, Cryptosporidium parvum
MLSKLNFCTFEFMLSPTLIGVPNTRV

SEQ ID NO: 2245774 - protein, 40 aa, Cryptosporidium parvum
MLSMSWGSLILFIFLVYILLAIILAIIHFIITFGDAANCI

SEQ ID NO: 2245775 - protein, 17 aa, Cryptosporidium parvum
MLTFSWFTKIMDKAYNS

SEQ ID NO: 2245776 - protein, 17 aa, Cryptosporidium parvum
MLTIPQYATSYLSYQGT

SEQ ID NO: 2245777 - protein, 19 aa, Cryptosporidium parvum
MLYHLLFYHLPQPLEVWVT

SEQ ID NO: 2245778 - protein, 19 aa, Cryptosporidium parvum
MLYIVMLIENGTRVINISF

SEQ ID NO: 2245779 - protein, 17 aa, Cryptosporidium parvum
MMEFVIGGEFFTYLRRC

SEQ ID NO: 2245780 - protein, 18 aa, Cryptosporidium parvum
MMGDLFPCSILLGNLISL

SEQ ID NO: 2245781 - protein, 19 aa, Cryptosporidium parvum
MMIGPMINGVFRGFEILFK

SEQ ID NO: 2245782 - protein, 46 aa, Cryptosporidium parvum; identical to SEQ ID NO: 2132370

SEQ ID NO: 2245783 - protein, 27 aa, Cryptosporidium parvum
MNAIHIIQRYWRIYMYRNQIMRELLIK

SEQ ID NO: 2245784 - protein, 31 aa, Cryptosporidium parvum; identical to SEQ ID NO: 2132372

SEQ ID NO: 2245785 - protein, 23 aa, Cryptosporidium parvum
MNHPVYFTIWKDENYNLKWLERE

SEQ ID NO: 2245786 - protein, 17 aa, Cryptosporidium parvum
MNIAMTPVGIILNIILI

SEQ ID NO: 2245787 - protein, 24 aa, Cryptosporidium parvum
MNIEKWIYHYVALNDSLVVSKLLE

SEQ ID NO: 2245788 - protein, 19 aa, Cryptosporidium parvum
MNIWSWQITQTFIPNFYAV

SEQ ID NO: 2245789 - protein, 24 aa, Cryptosporidium parvum
MNKNLLIITILFPILYNIINFSNF

SEQ ID NO: 2245790 - protein, 25 aa, Cryptosporidium parvum
MNKVDIYEIYLMKLLYTECGYTFIS

SEQ ID NO: 2245791 - protein, 17 aa, Cryptosporidium parvum
MNLDLICRVPIQCKLTI

SEQ ID NO: 2245792 - protein, 26 aa, Cryptosporidium parvum
MNMQWKPWFTAPVAEALLFGFFNSIN

SEQ ID NO: 2245793 - protein, 23 aa, Cryptosporidium parvum
MNNWTIFITFTPTLGLDCIITTS

SEQ ID NO: 2245794 - protein, 19 aa, Cryptosporidium parvum
MNPILFESLKIPTLTNLIV

SEQ ID NO: 2245795 - protein, 33 aa, Cryptosporidium parvum; identical to SEQ ID NO: 2132379

SEQ ID NO: 2245796 - protein, 25 aa, Cryptosporidium parvum
MNYSTMIHLIAILYIPIIKRVNMSL

SEQ ID NO: 2245797 - protein, 32 aa, Cryptosporidium parvum; identical to SEQ ID NO: 2132382

SEQ ID NO: 2245798 - protein, 37 aa, Cryptosporidium parvum
MQIQAWQERFARLDIPRLCYTVHLLALISHISAHIGS

SEQ ID NO: 2245799 - protein, 19 aa, Cryptosporidium parvum
MQRIRFLQHTSLIWCNTRI

SEQ ID NO: 2245800 - protein, 17 aa, Cryptosporidium parvum
MRGITSNGMLLCASSAP

SEQ ID NO: 2245801 - protein, 17 aa, Cryptosporidium parvum
MRIENICVDWEGGWWSK

SEQ ID NO: 2245802 - protein, 17 aa, Cryptosporidium parvum
MRPIYIQSSLEAWLKIR

SEQ ID NO: 2245803 - protein, 21 aa, Cryptosporidium parvum
MRQAGLLYRSFGRYFCQEAVN

SEQ ID NO: 2245804 - protein, 17 aa, Cryptosporidium parvum
MRRILSKDSLKPNIYLT

SEQ ID NO: 2245805 - protein, 20 aa, Cryptosporidium parvum
MRRPSCFILVYREYTWKYIN

SEQ ID NO: 2245806 - protein, 17 aa, Cryptosporidium parvum
MRRYIVLGLFYFCIGES

SEQ ID NO: 2245807 - protein, 19 aa, Cryptosporidium parvum
MSFLTISLIFIVLVGFVQS

SEQ ID NO: 2245808 - protein, 25 aa, Cryptosporidium parvum
MSGIAQLVLFLLAVYKGIQYSREHN

SEQ ID NO: 2245809 - protein, 27 aa, Cryptosporidium parvum
MSKLLVGFLLKYRFLRLINCNWTKLRP

SEQ ID NO: 2245810 - protein, 19 aa, Cryptosporidium parvum
MSLFAYFALKKAESYDFLK

SEQ ID NO: 2245811 - protein, 18 aa, Cryptosporidium parvum
MSLLDTFVAWLFKNNINR

SEQ ID NO: 2245812 - protein, 26 aa, Cryptosporidium parvum
MSRYQIFLDLFELILEILEGMKARES

SEQ ID NO: 2245813 - protein, 17 aa, Cryptosporidium parvum
MSTVCILPLLFAFSYPY

SEQ ID NO: 2245814 - protein, 27 aa, Cryptosporidium parvum
MSYSDYYPLIKILKRFINSFPLSDKHY

SEQ ID NO: 2245815 - protein, 18 aa, Cryptosporidium parvum
MTFESYLILLTSLGICIS

SEQ ID NO: 2245816 - protein, 23 aa, Cryptosporidium parvum
MTKIRLLLIESIPSDFDLVLERY

SEQ ID NO: 2245817 - protein, 27 aa, Cryptosporidium parvum
MTLHVLQFILVLLTWEIFPQEKTVMRG

SEQ ID NO: 2245818 - protein, 18 aa, Cryptosporidium parvum
MTPIVSWIHDFEIFHFGT

SEQ ID NO: 2245819 - protein, 30 aa, Cryptosporidium parvum; identical to SEQ ID NO: 2132397

SEQ ID NO: 2245820 - protein, 17 aa, Cryptosporidium parvum
MTYYVLELLLLNINLRK

SEQ ID NO: 2245821 - protein, 20 aa, Cryptosporidium parvum
MVEDWFPRPIADFQNYLNIS

SEQ ID NO: 2245822 - protein, 25 aa, Cryptosporidium parvum
MVGYNFFYRDISLELQLNGSIARVL

SEQ ID NO: 2245823 - protein, 24 aa, Cryptosporidium parvum
MVLEKYLYLLDRLIEIYNVKIMDQ

SEQ ID NO: 2245824 - protein, 23 aa, Cryptosporidium parvum
MVLLMMSIFLSSWLYNAAGKGFY

SEQ ID NO: 2245825 - protein, 18 aa, Cryptosporidium parvum
MVNPAVFITLLNDVEWYS

SEQ ID NO: 2245826 - protein, 20 aa, Cryptosporidium parvum
MVPPQPLFPELKRVQMIVTT

SEQ ID NO: 2245827 - protein, 28 aa, Cryptosporidium parvum
MVQPVPVPMPMPMPMPMPIPQQRQIMAQ

SEQ ID NO: 2245828 - protein, 33 aa, Cryptosporidium parvum
MVSKKTYYWYFSKLKWSWTIALFILCYSKTMFD

SEQ ID NO: 2245829 - protein, 25 aa, Cryptosporidium parvum
MVTEKPITRWILPSGFEPQYFQMYA

SEQ ID NO: 2245830 - protein, 31 aa, Cryptosporidium parvum
MVVRSYISCYLHHLGLYYNIFQLCESLFNFG

SEQ ID NO: 2245831 - protein, 17 aa, Cryptosporidium parvum
MVVVAVIQTLFGGFLAP

SEQ ID NO: 2245832 - protein, 17 aa, Cryptosporidium parvum
MVYFRLSTFFASSTYRN

SEQ ID NO: 2245833 - protein, 19 aa, Cryptosporidium parvum
MWTPFNALRSRKVGFLAVF

SEQ ID NO: 2245834 - protein, 23 aa, Cryptosporidium parvum
MYASQWFMTIFAYSFNLDAVARI

SEQ ID NO: 2245835 - protein, 29 aa, Cryptosporidium parvum
MYEDSFKGVYPLLPYFGLKADFSKKYPNF

SEQ ID NO: 2245836 - protein, 24 aa, Cryptosporidium parvum
MYFLSILVLFSWISIVIGGEGNLD

SEQ ID NO: 2245837 - protein, 19 aa, Cryptosporidium parvum
MYISYFALFFDFFIKRYIT

SEQ ID NO: 2245838 - protein, 30 aa, Cryptosporidium parvum; identical to SEQ ID NO: 2132411

SEQ ID NO: 2245839 - protein, 21 aa, Cryptosporidium parvum
MYYYFIFSRWMYNTLFGMTAF

SEQ ID NO: 2245840 - protein, 19 aa, Cryptosporidium parvum
NAASCKIASLWKGYKTRKF

SEQ ID NO: 2245841 - protein, 23 aa, Cryptosporidium parvum
NAILIIIQLFFAGVVVILLDELM

SEQ ID NO: 2245842 - protein, 21 aa, Cryptosporidium parvum
NAKYLLIYLNKVKVLSKHNFN

SEQ ID NO: 2245843 - protein, 26 aa, Cryptosporidium parvum
NALIQKSLLKWLLGVGLVSSSFEVQT

SEQ ID NO: 2245844 - protein, 25 aa, Cryptosporidium parvum
NATTPTLFIIFDGTHEFWTITSSLD

SEQ ID NO: 2245845 - protein, 25 aa, Cryptosporidium parvum
NAVVLVVLGILYRIFACIAFALFFR

SEQ ID NO: 2245846 - protein, 22 aa, Cryptosporidium parvum
NAYFYAQALLHYMIVWRGDYSG

SEQ ID NO: 2245847 - protein, 18 aa, Cryptosporidium parvum
NCDEFFSLLLKQYSIIPI

SEQ ID NO: 2245848 - protein, 30 aa, Cryptosporidium parvum
NCDSCNEILLFPLIIPCPKLHLVCTYCIME

SEQ ID NO: 2245849 - protein, 25 aa, Cryptosporidium parvum
NCEKILIDEIPSLYLPFITSPNIEH

SEQ ID NO: 2245850 - protein, 18 aa, Cryptosporidium parvum
NCFHYWFIFGASVGYYTF

SEQ ID NO: 2245851 - protein, 30 aa, Cryptosporidium parvum
NCGFCYTMMGLLFAWGYPPIINNTHGWIGV

SEQ ID NO: 2245852 - protein, 18 aa, Cryptosporidium parvum
NCHHSWNDLLKFIETEYN

SEQ ID NO: 2245853 - protein, 28 aa, Cryptosporidium parvum
NCIGYFNYKFFFLALLYGCASLTYMMFS

SEQ ID NO: 2245854 - protein, 19 aa, Cryptosporidium parvum
NCIIKLVRYGRSTLTTVLL

SEQ ID NO: 2245855 - protein, 20 aa, Cryptosporidium parvum
NCIKPLPKDIARLALYIVCI

SEQ ID NO: 2245856 - protein, 20 aa, Cryptosporidium parvum
NCLEISLILLSLKKLNLDLR

SEQ ID NO: 2245857 - protein, 27 aa, Cryptosporidium parvum
NCLTIQFSFGLWLDYIDSFISHYNNGL

SEQ ID NO: 2245858 - protein, 25 aa, Cryptosporidium parvum
NCNCTDMLYFYDKSKFFENLNHRDF

SEQ ID NO: 2245859 - protein, 24 aa, Cryptosporidium parvum
NCPGFLPIMLHLIIPKNENMLKKL

SEQ ID NO: 2245860 - protein, 26 aa, Cryptosporidium parvum
NCSKNILYFNYLRISSILVEVTYRGS

SEQ ID NO: 2245861 - protein, 26 aa, Cryptosporidium parvum
NCTLNYSTYWWSSSPDRFLLKNGIIL

SEQ ID NO: 2245862 - protein, 25 aa, Cryptosporidium parvum
NCVCHLILLGFLFSIIFESIADEYF

SEQ ID NO: 2245863 - protein, 24 aa, Cryptosporidium parvum
NCVDEFLLLNWNNSRYSLLKSDPI

SEQ ID NO: 2245864 - protein, 25 aa, Cryptosporidium parvum
NCVPIKAFFLLLDKLSNTNWHATIF

SEQ ID NO: 2245865 - protein, 22 aa, Cryptosporidium parvum
NDCAIKIWQLFLKSGSENCILK

SEQ ID NO: 2245866 - protein, 22 aa, Cryptosporidium parvum
NDDKFFILKINNLKICNTSINR

SEQ ID NO: 2245867 - protein, 24 aa, Cryptosporidium parvum
NDELNLLRFLNILPSQYKFSDLKG

SEQ ID NO: 2245868 - protein, 40 aa, Cryptosporidium parvum
NDEVESLFFLLVSPYSICPTLCSLFLLLKSKVIRSRFKYI

SEQ ID NO: 2245869 - protein, 27 aa, Cryptosporidium parvum
NDFITTSIFIPAGLLIIVSISLCILGI

SEQ ID NO: 2245870 - protein, 25 aa, Cryptosporidium parvum
NDFMRYIYYLIGVTLNSFFSGWLSI

SEQ ID NO: 2245871 - protein, 29 aa, Cryptosporidium parvum
NDIILAKYWISNIPKLIFFLYYNAVGEEK

SEQ ID NO: 2245872 - protein, 31 aa, Cryptosporidium parvum; identical to SEQ ID NO: 2132430

SEQ ID NO: 2245873 - protein, 24 aa, Cryptosporidium parvum
NDKELIEEFFYSGAFELCCEFLRI

SEQ ID NO: 2245874 - protein, 32 aa, Cryptosporidium parvum
NDLNLMDYWPNDIIYFVRILSLLRGICAELNE

SEQ ID NO: 2245875 - protein, 25 aa, Cryptosporidium parvum
NDLNRMIYLWGLITTSALLAIGVNQ

SEQ ID NO: 2245876 - protein, 19 aa, Cryptosporidium parvum
NDLYKKFIELGIFGYNWDT

SEQ ID NO: 2245877 - protein, 21 aa, Cryptosporidium parvum
NDLYLLTYENCKDKYHVSLWS

SEQ ID NO: 2245878 - protein, 23 aa, Cryptosporidium parvum
NDNIWILFSHIFQSFVYSKLPQL

SEQ ID NO: 2245879 - protein, 33 aa, Cryptosporidium parvum
NDNLFWGDWPPSYSWVFFLGNILFYEISQFEFW

SEQ ID NO: 2245880 - protein, 36 aa, Cryptosporidium parvum; identical to SEQ ID NO: 2132433

SEQ ID NO: 2245881 - protein, 37 aa, Cryptosporidium parvum; identical to SEQ ID NO: 2132434

SEQ ID NO: 2245882 - protein, 24 aa, Cryptosporidium parvum
NDRYIIMVLFIFIEYLIILKEDEK

SEQ ID NO: 2245883 - protein, 20 aa, Cryptosporidium parvum
NDSMKCAFDFLFRGIRRVQR

SEQ ID NO: 2245884 - protein, 24 aa, Cryptosporidium parvum
NDSVPIPIKCGVLKLFLSLALSSS

SEQ ID NO: 2245885 - protein, 24 aa, Cryptosporidium parvum
NDVDYLMWRSSFYGQPLIMCFFVT

SEQ ID NO: 2245886 - protein, 18 aa, Cryptosporidium parvum
NDWYINNAPFLIVYSLIF

SEQ ID NO: 2245887 - protein, 23 aa, Cryptosporidium parvum
NDYLENILSLFNSYKPIIIHFFG

SEQ ID NO: 2245888 - protein, 24 aa, Cryptosporidium parvum
NEAMSFFQELIYGNGFHLYKKLDL

SEQ ID NO: 2245889 - protein, 31 aa, Cryptosporidium parvum; identical to SEQ ID NO: 2132442

SEQ ID NO: 2245890 - protein, 24 aa, Cryptosporidium parvum
NEDLELWNLLGYKNAPKGLGVMFS

SEQ ID NO: 2245891 - protein, 26 aa, Cryptosporidium parvum
NEECENPEYLFPWGNDYLNSCLSFQC

SEQ ID NO: 2245892 - protein, 23 aa, Cryptosporidium parvum
NEEMIVWQQLRDVLLLTGMSLKY

SEQ ID NO: 2245893 - protein, 29 aa, Cryptosporidium parvum
NEEMWVVCDNSWTIGKFGLSLTPFSHSNK

SEQ ID NO: 2245894 - protein, 32 aa, Cryptosporidium parvum
NEFDPFFLQIFRYLLFYSLTLLSFSSSVIWSC

SEQ ID NO: 2245895 - protein, 30 aa, Cryptosporidium parvum
NEIFEEILITLLFLAILHPKTSDITILYLF

SEQ ID NO: 2245896 - protein, 25 aa, Cryptosporidium parvum
NEILHPFFIFQVCAVCIWFKNSYVE

SEQ ID NO: 2245897 - protein, 26 aa, Cryptosporidium parvum
NEIRQDIWILFNHIIGRLFDKSRVKK

SEQ ID NO: 2245898 - protein, 27 aa, Cryptosporidium parvum
NEKEKYYLPCQLLITSLGFKPKYDYIF

SEQ ID NO: 2245899 - protein, 25 aa, Cryptosporidium parvum
NEKISIFTLIYRYLDIMNIPERRFV

SEQ ID NO: 2245900 - protein, 18 aa, Cryptosporidium parvum
NELDFFYSRQFLSGQFFV

SEQ ID NO: 2245901 - protein, 23 aa, Cryptosporidium parvum
NELLGLLQIPLLDDLLVVSTQGM

SEQ ID NO: 2245902 - protein, 23 aa, Cryptosporidium parvum
NELLYNRRFRLMFIPPNEVQHNS

SEQ ID NO: 2245903 - protein, 30 aa, Cryptosporidium parvum
NENDFLTFIPIFRNFLPFEKIRVLEGLYIT

SEQ ID NO: 2245904 - protein, 30 aa, Cryptosporidium parvum
NEQCSLTTYKVFYSVLLSALISVSVSSSKC

SEQ ID NO: 2245905 - protein, 26 aa, Cryptosporidium parvum
NEQWQLLRLYGVLNSPQLVLIYPVYT

SEQ ID NO: 2245906 - protein, 23 aa, Cryptosporidium parvum
NERQPNPNYWYRKEYELNDYYRR

SEQ ID NO: 2245907 - protein, 17 aa, Cryptosporidium parvum
NERTDICPIKYICLMLS

SEQ ID NO: 2245908 - protein, 28 aa, Cryptosporidium parvum
NESTQDYISLAFWNVIRKSIIFPKNWFN

SEQ ID NO: 2245909 - protein, 17 aa, Cryptosporidium parvum
NEVFTLIDLIISYLKQV

SEQ ID NO: 2245910 - protein, 23 aa, Cryptosporidium parvum
NEVSSFLNVLRHLGYWLGQITIG

SEQ ID NO: 2245911 - protein, 35 aa, Cryptosporidium parvum; identical to SEQ ID NO: 2132454

SEQ ID NO: 2245912 - protein, 17 aa, Cryptosporidium parvum
NEYLPHVFQLVHRVSYG

SEQ ID NO: 2245913 - protein, 17 aa, Cryptosporidium parvum
NEYSITIQYLVLNTIKL

SEQ ID NO: 2245914 - protein, 19 aa, Cryptosporidium parvum
NFDHFYHLDFPILDNKIIK

SEQ ID NO: 2245915 - protein, 21 aa, Cryptosporidium parvum
NFEIIKIMQGCVWGIAIELSI

SEQ ID NO: 2245916 - protein, 19 aa, Cryptosporidium parvum
NFEPLSISNTLIASLPGLG

SEQ ID NO: 2245917 - protein, 18 aa, Cryptosporidium parvum
NFFLGIIIIWCIHTTSPI

SEQ ID NO: 2245918 - protein, 25 aa, Cryptosporidium parvum
NFGFFNIHLLLKSKITILFILIFYL

SEQ ID NO: 2245919 - protein, 26 aa, Cryptosporidium parvum
NFGILRVFFVLLMFLLCVSYVVHSVW

SEQ ID NO: 2245920 - protein, 17 aa, Cryptosporidium parvum
NFGVRSVHLLLVSKLVQ

SEQ ID NO: 2245921 - protein, 29 aa, Cryptosporidium parvum
NFIIYIWTFIFFILVVLYLFLTLKSFFQN

SEQ ID NO: 2245922 - protein, 28 aa, Cryptosporidium parvum
NFKAIHKYWGFLYLYKSVITNEVDLSQR

SEQ ID NO: 2245923 - protein, 37 aa, Cryptosporidium parvum
NFKDPMTCIPIGFLFLLFIYWNYLSYFINTCRTLRLL

SEQ ID NO: 2245924 - protein, 24 aa, Cryptosporidium parvum
NFKIYPMVIHLTFNLNLLKSSINS

SEQ ID NO: 2245925 - protein, 17 aa, Cryptosporidium parvum
NFKLIYMMEDVYSAIDA

SEQ ID NO: 2245926 - protein, 17 aa, Cryptosporidium parvum
NFNSFYIGKIPASVETW

SEQ ID NO: 2245927 - protein, 31 aa, Cryptosporidium parvum
NFNSSLFSFNPLPFIISVNLALSYLMGGHYQ

SEQ ID NO: 2245928 - protein, 24 aa, Cryptosporidium parvum
NFPLYPLGFILIGLPQGPIFNSVV

SEQ ID NO: 2245929 - protein, 21 aa, Cryptosporidium parvum
NFQSITLVSLLKATANYDSSD

SEQ ID NO: 2245930 - protein, 40 aa, Cryptosporidium parvum
NFRFLTFSYRRSFLPLFLVFVFLALQFIGLSIMIFINFSS

SEQ ID NO: 2245931 - protein, 28 aa, Cryptosporidium parvum
NFSDWSFPPVLLDKLYFFTRFSKNNKKD

SEQ ID NO: 2245932 - protein, 17 aa, Cryptosporidium parvum
NFSIFFKGLITASYSNI

SEQ ID NO: 2245933 - protein, 18 aa, Cryptosporidium parvum
NFSILKYLESLTKSIFNV

SEQ ID NO: 2245934 - protein, 35 aa, Cryptosporidium parvum; identical to SEQ ID NO: 2132472

SEQ ID NO: 2245935 - protein, 17 aa, Cryptosporidium parvum
NFSMPPKSNPVFSQLSE

SEQ ID NO: 2245936 - protein, 24 aa, Cryptosporidium parvum
NFSNMTMVKLLNKETKREFAAKMI

SEQ ID NO: 2245937 - protein, 25 aa, Cryptosporidium parvum
NFSNTIFLYLKKYVPSSLSFDKLII

SEQ ID NO: 2245938 - protein, 33 aa, Cryptosporidium parvum; identical to SEQ ID NO: 2132474

SEQ ID NO: 2245939 - protein, 25 aa, Cryptosporidium parvum
NFTGAYILYRWRLTQELRVQFRKKF

SEQ ID NO: 2245940 - protein, 27 aa, Cryptosporidium parvum
NFTMDFGLVFMLNIPFPSKNNIKLGLL

SEQ ID NO: 2245941 - protein, 19 aa, Cryptosporidium parvum
NFVFSIIMNLISRSDHLTS

SEQ ID NO: 2245942 - protein, 20 aa, Cryptosporidium parvum
NFVIKDWFASQSIFKFYLLE

SEQ ID NO: 2245943 - protein, 23 aa, Cryptosporidium parvum
NFVNKFGLILITGEMKNITLIIN

SEQ ID NO: 2245944 - protein, 23 aa, Cryptosporidium parvum
NFWERFCNFLRKSTNKKFTLFYF

SEQ ID NO: 2245945 - protein, 31 aa, Cryptosporidium parvum
NFYSSKYLIYVFFIALFSFTVKLTIFSCQHL

SEQ ID NO: 2245946 - protein, 17 aa, Cryptosporidium parvum
NGDFYLLGLCEGNFCMG

SEQ ID NO: 2245947 - protein, 28 aa, Cryptosporidium parvum
NGELIDPISGKYFSGSIAGFISGKAGSQ

SEQ ID NO: 2245948 - protein, 29 aa, Cryptosporidium parvum
NGFNSNCLLFESPYLFYQVEHRNIKDQLG

SEQ ID NO: 2245949 - protein, 24 aa, Cryptosporidium parvum
NGGLFLLLLLLTFGSLISLISNTS

SEQ ID NO: 2245950 - protein, 17 aa, Cryptosporidium parvum
NGGLIYRFFRIIANRVY

SEQ ID NO: 2245951 - protein, 24 aa, Cryptosporidium parvum
NGIKKWFRDLKQKIFRFLDFGKQT

SEQ ID NO: 2245952 - protein, 20 aa, Cryptosporidium parvum
NGILLFGVIIRILKGERSFP

SEQ ID NO: 2245953 - protein, 25 aa, Cryptosporidium parvum
NGILQPIIYLFIGSSLYISIGVNSV

SEQ ID NO: 2245954 - protein, 46 aa, Cryptosporidium parvum
NGITYGKIKKFSLGWNLWLGITISCIVLIWTAIYASRLLNIAHKLK

SEQ ID NO: 2245955 - protein, 41 aa, Cryptosporidium parvum
NGKCLPFSCLFILQILVALATITWVIVNVLFFVNTNNNVSK

SEQ ID NO: 2245956 - protein, 18 aa, Cryptosporidium parvum
NGKEKLLDALYKYSIQNA

SEQ ID NO: 2245957 - protein, 26 aa, Cryptosporidium parvum
NGKFLQYYCPKLVLHCILVLEFLIKN

SEQ ID NO: 2245958 - protein, 26 aa, Cryptosporidium parvum
NGLEENFFLDFILFTSIQIIKRDHNN

SEQ ID NO: 2245959 - protein, 21 aa, Cryptosporidium parvum
NGLIVELVIARSLYAESGVIY

SEQ ID NO: 2245960 - protein, 30 aa, Cryptosporidium parvum; identical to SEQ ID NO: 2132483

SEQ ID NO: 2245961 - protein, 31 aa, Cryptosporidium parvum
NGLVMLLQVFYYLSFIFSLINPALPSQEPRK

SEQ ID NO: 2245962 - protein, 19 aa, Cryptosporidium parvum
NGMPDYIVLLFAHWEIMIY

SEQ ID NO: 2245963 - protein, 23 aa, Cryptosporidium parvum
NGNKYLYMVFANETIMNVNKLNS

SEQ ID NO: 2245964 - protein, 34 aa, Cryptosporidium parvum; identical to SEQ ID NO: 2132486

SEQ ID NO: 2245965 - protein, 19 aa, Cryptosporidium parvum
NGRVYYFPRDHVCDFKYCN

SEQ ID NO: 2245966 - protein, 17 aa, Cryptosporidium parvum
NGSLLLNGKVANITTFD

SEQ ID NO: 2245967 - protein, 21 aa, Cryptosporidium parvum
NGSPLEYCSYPLFTNTHETTD

SEQ ID NO: 2245968 - protein, 32 aa, Cryptosporidium parvum
NGSSHPWFLIFWLVLCYIWIVAYTAFISISIF

SEQ ID NO: 2245969 - protein, 21 aa, Cryptosporidium parvum
NGSVVYTLVIARKYISFFSSL

SEQ ID NO: 2245970 - protein, 25 aa, Cryptosporidium parvum
NGTISHRFGLWLAAQRLSEQKTELL

SEQ ID NO: 2245971 - protein, 23 aa, Cryptosporidium parvum
NGTNLLYSFFIIKTLITQPNHSS

SEQ ID NO: 2245972 - protein, 24 aa, Cryptosporidium parvum
NGVFLTVINYLLYSELNFTVVISE

SEQ ID NO: 2245973 - protein, 20 aa, Cryptosporidium parvum
NGYIWANMAGTPIFKDKPKI

SEQ ID NO: 2245974 - protein, 28 aa, Cryptosporidium parvum
NGYYLIKQRKYHWSLCFFILSRSYDEIA

SEQ ID NO: 2245975 - protein, 18 aa, Cryptosporidium parvum
NHFIGKYNNYIYGFCSRA

SEQ ID NO: 2245976 - protein, 25 aa, Cryptosporidium parvum
NHHFFSILLLLPFTASSLSLFHFNR

SEQ ID NO: 2245977 - protein, 21 aa, Cryptosporidium parvum
NHIFTIWENFIYLTSFFSKSQ

SEQ ID NO: 2245978 - protein, 26 aa, Cryptosporidium parvum
NHIIIIWLILFILKYLTSFIIVSISQ

SEQ ID NO: 2245979 - protein, 25 aa, Cryptosporidium parvum
NHKHLLLLILYSAISCAFITITLGP

SEQ ID NO: 2245980 - protein, 24 aa, Cryptosporidium parvum
NHKIPVDFVFGRGPDIWNILTIYI

SEQ ID NO: 2245981 - protein, 21 aa, Cryptosporidium parvum
NHMVSWFKWNFLQVKSQSLIL

SEQ ID NO: 2245982 - protein, 17 aa, Cryptosporidium parvum
NHNFMVKMLSFLHEYSL

SEQ ID NO: 2245983 - protein, 31 aa, Cryptosporidium parvum; identical to SEQ ID NO: 2132493

SEQ ID NO: 2245984 - protein, 27 aa, Cryptosporidium parvum
NHVFFTPIHYLIGGSPLILGALWDVTD

SEQ ID NO: 2245985 - protein, 21 aa, Cryptosporidium parvum
NIAPTILLRKYQLSHFNKWYN

SEQ ID NO: 2245986 - protein, 32 aa, Cryptosporidium parvum
NICIKYLNDPQLLFLLLKLLLNSNGINDNEKN

SEQ ID NO: 2245987 - protein, 23 aa, Cryptosporidium parvum
NICNLTQIFLLRKLLECIQSSEL

SEQ ID NO: 2245988 - protein, 19 aa, Cryptosporidium parvum
NICVDWEGGWWSKEFLSRR

SEQ ID NO: 2245989 - protein, 23 aa, Cryptosporidium parvum
NIDIIIILILDHISDWIKKNDKC

SEQ ID NO: 2245990 - protein, 32 aa, Cryptosporidium parvum
NIDVRKLLILVSYILLFIYQSQNNFIYGKELR

SEQ ID NO: 2245991 - protein, 28 aa, Cryptosporidium parvum
NIEEETLFLFLFFLSYLPSTNNSNSIFD

SEQ ID NO: 2245992 - protein, 17 aa, Cryptosporidium parvum
NIEFYKAYLLLDSFYAI

SEQ ID NO: 2245993 - protein, 19 aa, Cryptosporidium parvum
NIEILKFVNSLPKLRYILI

SEQ ID NO: 2245994 - protein, 31 aa, Cryptosporidium parvum
NIEIQSLIIQVLFWLTIPPDESWRSFRSKTM

SEQ ID NO: 2245995 - protein, 19 aa, Cryptosporidium parvum
NIERAWYRQILNTAFHKIM

SEQ ID NO: 2245996 - protein, 25 aa, Cryptosporidium parvum
NIETPLFIIAIMDYIRARLVYMTYA

SEQ ID NO: 2245997 - protein, 31 aa, Cryptosporidium parvum; identical to SEQ ID NO: 2132504

SEQ ID NO: 2245998 - protein, 19 aa, Cryptosporidium parvum
NIFKALIFSKLINVYVDIP

SEQ ID NO: 2245999 - protein, 33 aa, Cryptosporidium parvum
NIFKEPFPISWVNLYWTQPPYGGAAELFSSSNA

SEQ ID NO: 2246000 - protein, 24 aa, Cryptosporidium parvum
NIGPQILKCIKPFKLVGDQCVHQV

SEQ ID NO: 2246001 - protein, 33 aa, Cryptosporidium parvum
NIGVNFQWFALEWFLCFFVTSLPLKSIMEILDL

SEQ ID NO: 2246002 - protein, 30 aa, Cryptosporidium parvum
NIHEFVMFARFIRLFIRILEFNSSKKLQGP

SEQ ID NO: 2246003 - protein, 18 aa, Cryptosporidium parvum
NIHLAVAPFLRIIFVCIK

SEQ ID NO: 2246004 - protein, 23 aa, Cryptosporidium parvum
NIIGEKLWNTILISFPDIPINKY

SEQ ID NO: 2246005 - protein, 19 aa, Cryptosporidium parvum
NIIISWFNFAIEELSIELI

SEQ ID NO: 2246006 - protein, 18 aa, Cryptosporidium parvum
NIIKNLHDWYYIVSDIDT

SEQ ID NO: 2246007 - protein, 31 aa, Cryptosporidium parvum
NIIKSLWYHLDDYIIFILIKSNHNDNKSTSK

SEQ ID NO: 2246008 - protein, 20 aa, Cryptosporidium parvum
NIIPLIHVINYVAGILRTVP

SEQ ID NO: 2246009 - protein, 33 aa, Cryptosporidium parvum; identical to SEQ ID NO: 2132513

SEQ ID NO: 2246010 - protein, 38 aa, Cryptosporidium parvum
NIKASYFFLIWSVWLFTISFLFIFMLSCPCNTLKIILR

SEQ ID NO: 2246011 - protein, 17 aa, Cryptosporidium parvum
NIKFFLEISGYSVIYLH

SEQ ID NO: 2246012 - protein, 24 aa, Cryptosporidium parvum
NIKGFFSIFQLLLNFWDNKKAEFS

SEQ ID NO: 2246013 - protein, 24 aa, Cryptosporidium parvum
NIKLNLCTYIIFGYNLITDCIYIM

SEQ ID NO: 2246014 - protein, 18 aa, Cryptosporidium parvum
NIKLRLFIKIDLSKVNNN

SEQ ID NO: 2246015 - protein, 17 aa, Cryptosporidium parvum
NIKLVNFDRVISLIIDL

SEQ ID NO: 2246016 - protein, 42 aa, Cryptosporidium parvum; identical to SEQ ID NO: 2132515

SEQ ID NO: 2246017 - protein, 25 aa, Cryptosporidium parvum
NILAVNLPIFFLHNDGIKLMKSINF

SEQ ID NO: 2246018 - protein, 31 aa, Cryptosporidium parvum
NILNNQCSLKFRIYVRKILISLIKRFGAEKT

SEQ ID NO: 2246019 - protein, 35 aa, Cryptosporidium parvum
NILRKYPLVLQPLIQFLNIFIEFFTLVLQSNNSME

SEQ ID NO: 2246020 - protein, 18 aa, Cryptosporidium parvum
NINFNGCFLLIKQPSTEK

SEQ ID NO: 2246021 - protein, 23 aa, Cryptosporidium parvum
NINPINIFNYLLLTNVDKYFNNV

SEQ ID NO: 2246022 - protein, 22 aa, Cryptosporidium parvum
NINPLLILLDKHNKTKFLGLDN

SEQ ID NO: 2246023 - protein, 24 aa, Cryptosporidium parvum
NINYQTLKIYIIEKLFVLYDQLNI

SEQ ID NO: 2246024 - protein, 33 aa, Cryptosporidium parvum
NINYYHLTFQEMCLIFGSILIYRARKRLQEETT

SEQ ID NO: 2246025 - protein, 18 aa, Cryptosporidium parvum
NIPKIRWVPKSKGLRPLI

SEQ ID NO: 2246026 - protein, 26 aa, Cryptosporidium parvum
NIPNHCSILILSYLIISNSLERGSET

SEQ ID NO: 2246027 - protein, 20 aa, Cryptosporidium parvum
NIPNILKFLQLPIICDKTRN

SEQ ID NO: 2246028 - protein, 31 aa, Cryptosporidium parvum; identical to SEQ ID NO: 2132521

SEQ ID NO: 2246029 - protein, 19 aa, Cryptosporidium parvum
NIRMFSLLIKLKSLSFFPI

SEQ ID NO: 2246030 - protein, 18 aa, Cryptosporidium parvum
NIRNLLFEQPLILEKNEE

SEQ ID NO: 2246031 - protein, 30 aa, Cryptosporidium parvum
NISIMDTLRFLFALELFSLNFTSLLKAKNI

SEQ ID NO: 2246032 - protein, 25 aa, Cryptosporidium parvum
NISQKLLIKLFAKKVNPISLSYINY

SEQ ID NO: 2246033 - protein, 24 aa, Cryptosporidium parvum
NISSIHCILILTLFINFKVSGDLI

SEQ ID NO: 2246034 - protein, 39 aa, Cryptosporidium parvum
NISYVSFIVPLTLPFEVILIIFILRYIGDRLLLTYRDAQ

SEQ ID NO: 2246035 - protein, 25 aa, Cryptosporidium parvum
NITIHSIIICSLICNSKFLTSQGLQ

SEQ ID NO: 2246036 - protein, 25 aa, Cryptosporidium parvum
NITMNFFILFCIWMEPSRLGCILRI

SEQ ID NO: 2246037 - protein, 23 aa, Cryptosporidium parvum
NIVKPIILLIVVNRLIKIGNKSI

SEQ ID NO: 2246038 - protein, 34 aa, Cryptosporidium parvum
NIVYKQLMGIFRFKLCYVWKFSILNSYCLAIINN

SEQ ID NO: 2246039 - protein, 20 aa, Cryptosporidium parvum
NIWCKLFGNYYIRVLEKFPV

SEQ ID NO: 2246040 - protein, 35 aa, Cryptosporidium parvum
NIWEITTYLSQIIYLIVILLIGILHTFNYVVAYYA

SEQ ID NO: 2246041 - protein, 17 aa, Cryptosporidium parvum
NIWQFIVSRSKLLYNID

SEQ ID NO: 2246042 - protein, 20 aa, Cryptosporidium parvum
NIYHIWFNSYIGLLYCNKYI

SEQ ID NO: 2246043 - protein, 18 aa, Cryptosporidium parvum
NIYINRYMLSFKSIFMLA

SEQ ID NO: 2246044 - protein, 43 aa, Cryptosporidium parvum
NIYITIFVSLIWALFVHGMKLWFEILFGVWILRRISPFSKILI

SEQ ID NO: 2246045 - protein, 31 aa, Cryptosporidium parvum
NKACYSSLQALKFRLLCLRAHLIKCGPVLPK

SEQ ID NO: 2246046 - protein, 24 aa, Cryptosporidium parvum
NKDETTILLWKLLSNLNESGLLCR

SEQ ID NO: 2246047 - protein, 30 aa, Cryptosporidium parvum
NKDRFQKILFYYFLMLIINGAINCARTDMS

SEQ ID NO: 2246048 - protein, 23 aa, Cryptosporidium parvum
NKDSYLILDKLPPEYDSRVKAME

SEQ ID NO: 2246049 - protein, 25 aa, Cryptosporidium parvum
NKEMPRIPLLILIRANIGVIEDESI

SEQ ID NO: 2246050 - protein, 37 aa, Cryptosporidium parvum; identical to SEQ ID NO: 2132531

SEQ ID NO: 2246051 - protein, 32 aa, Cryptosporidium parvum
NKFPVLLYEAEGLVFWLFRVHNLVTLRVATES

SEQ ID NO: 2246052 - protein, 21 aa, Cryptosporidium parvum
NKGTIFGRKLPLCNFPLLDNN

SEQ ID NO: 2246053 - protein, 26 aa, Cryptosporidium parvum
NKHPNWLISLLGPTFVYLTPNLFYKS

SEQ ID NO: 2246054 - protein, 19 aa, Cryptosporidium parvum
NKHWDILRKILLGETKDIN

SEQ ID NO: 2246055 - protein, 21 aa, Cryptosporidium parvum
NKIDPTLALLPWTFNNKSNID

SEQ ID NO: 2246056 - protein, 24 aa, Cryptosporidium parvum
NKIFDTLDLIKCSDFVMALFGFND

SEQ ID NO: 2246057 - protein, 18 aa, Cryptosporidium parvum
NKIPSISYLINKYFRHCI

SEQ ID NO: 2246058 - protein, 28 aa, Cryptosporidium parvum
NKKDFLPNTKWIIPTSKYRKITAIYGNE

SEQ ID NO: 2246059 - protein, 24 aa, Cryptosporidium parvum
NKKKFLDESLLLDINKVLLILKNN

SEQ ID NO: 2246060 - protein, 30 aa, Cryptosporidium parvum
NKKLFNITQLLYYLFIWSDRLSRNFQIEML

SEQ ID NO: 2246061 - protein, 29 aa, Cryptosporidium parvum
NKKSVFVLTLIFAIVRIALSSLFGALNFF

SEQ ID NO: 2246062 - protein, 29 aa, Cryptosporidium parvum
NKKYKKSMWLFFGIGIVQMTLSLFLDTFV

SEQ ID NO: 2246063 - protein, 27 aa, Cryptosporidium parvum
NKLEKYFLLDFTLNPKIFTNLFSRIIP

SEQ ID NO: 2246064 - protein, 22 aa, Cryptosporidium parvum
NKLKPLLNFTLESLALLSCISK

SEQ ID NO: 2246065 - protein, 26 aa, Cryptosporidium parvum
NKLRMEMIIYSYYMGLNFGLAFQLMD

SEQ ID NO: 2246066 - protein, 35 aa, Cryptosporidium parvum; identical to SEQ ID NO: 2132541

SEQ ID NO: 2246067 - protein, 29 aa, Cryptosporidium parvum
NKMPNSIFLFYLKLLSQPITIAWGISKCL

SEQ ID NO: 2246068 - protein, 22 aa, Cryptosporidium parvum
NKNCEYFIAFSSITSLIGNIGQ

SEQ ID NO: 2246069 - protein, 26 aa, Cryptosporidium parvum
NKNEKEWFLYWSSIFGKLCGKEPILR

SEQ ID NO: 2246070 - protein, 18 aa, Cryptosporidium parvum
NKNGIFLPWYDKSTRNGL

SEQ ID NO: 2246071 - protein, 24 aa, Cryptosporidium parvum
NKNIHFSYILLDLILKNVGNNIDI

SEQ ID NO: 2246072 - protein, 25 aa, Cryptosporidium parvum
NKNKSWKILLKKPLGDKFQVKTEVN

SEQ ID NO: 2246073 - protein, 17 aa, Cryptosporidium parvum
NKNLFVYAIPKILSELD

SEQ ID NO: 2246074 - protein, 22 aa, Cryptosporidium parvum
NKNNVWILEGPHIWKVLIYDKM

SEQ ID NO: 2246075 - protein, 22 aa, Cryptosporidium parvum
NKNSLFFVSILKFDSYTFRLKN

SEQ ID NO: 2246076 - protein, 23 aa, Cryptosporidium parvum
NKNSRWFVFGKPMGIDIPEGKQQ

SEQ ID NO: 2246077 - protein, 25 aa, Cryptosporidium parvum
NKNYHFDIIKLIYKLNNHPAEIQSN

SEQ ID NO: 2246078 - protein, 24 aa, Cryptosporidium parvum
NKPSPTLLIRSFALRWSSTFELAY

SEQ ID NO: 2246079 - protein, 26 aa, Cryptosporidium parvum
NKQLSKIRWLSLLLLTIGAVLVQTGK

SEQ ID NO: 2246080 - protein, 17 aa, Cryptosporidium parvum
NKRIRFVAIRPIGNIIA

SEQ ID NO: 2246081 - protein, 29 aa, Cryptosporidium parvum
NKSDLLGLMLFRLGLINEALLIYEQLLDD

SEQ ID NO: 2246082 - protein, 24 aa, Cryptosporidium parvum
NKSNSLHYSLFKFAYCIILDIKSI

SEQ ID NO: 2246083 - protein, 28 aa, Cryptosporidium parvum
NKSSFSIFSFFNSLLFKPSLSYSERSIH

SEQ ID NO: 2246084 - protein, 25 aa, Cryptosporidium parvum
NKSVKLLRLLYSSITGIFISMDHED

SEQ ID NO: 2246085 - protein, 19 aa, Cryptosporidium parvum
NKSWFYGDLFCNYKMNQII

SEQ ID NO: 2246086 - protein, 28 aa, Cryptosporidium parvum
NKTIQSYYYFIYSLIFRESYPFNEDEVK

SEQ ID NO: 2246087 - protein, 25 aa, Cryptosporidium parvum
NKTYGDFFFIILISTFLKEVSRIHL

SEQ ID NO: 2246088 - protein, 25 aa, Cryptosporidium parvum
NKVGIFDNLFLTTKWVMKKLKSQLK

SEQ ID NO: 2246089 - protein, 30 aa, Cryptosporidium parvum
NKVQVQIYSIRFLKLILLHPNWSEFLRSRS

SEQ ID NO: 2246090 - protein, 21 aa, Cryptosporidium parvum
NKVSIFNFEFLKKLKYKGQIS

SEQ ID NO: 2246091 - protein, 20 aa, Cryptosporidium parvum
NKYIKKFIINSRIIHRFLNP

SEQ ID NO: 2246092 - protein, 20 aa, Cryptosporidium parvum
NKYLIGIDDYNYFGLRSNVA

SEQ ID NO: 2246093 - protein, 25 aa, Cryptosporidium parvum
NKYPKALRIINDIRFSVFLCGPDML

SEQ ID NO: 2246094 - protein, 19 aa, Cryptosporidium parvum
NKYTLLGRGLSNLPKHSST

SEQ ID NO: 2246095 - protein, 19 aa, Cryptosporidium parvum
NLAGLFSLQLYFASSYSRV

SEQ ID NO: 2246096 - protein, 18 aa, Cryptosporidium parvum
NLCIVVGLLSYFMIYSDH

SEQ ID NO: 2246097 - protein, 23 aa, Cryptosporidium parvum
NLDFKHIVLFFYEMLLEEERIIN

SEQ ID NO: 2246098 - protein, 28 aa, Cryptosporidium parvum
NLDHYSLPFYYFELLFEATCKRVLVEKI

SEQ ID NO: 2246099 - protein, 26 aa, Cryptosporidium parvum
NLDLVLKKILIYLLQTPDFAYKITSF

SEQ ID NO: 2246100 - protein, 25 aa, Cryptosporidium parvum
NLDSFIERFNFYKIPYFGTEKKYNG

SEQ ID NO: 2246101 - protein, 24 aa, Cryptosporidium parvum
NLELKFGLRKWSPLLEKFNGEVSS

SEQ ID NO: 2246102 - protein, 35 aa, Cryptosporidium parvum
NLEMHIKKVNPWFAVILCISLLNGISIWDRIQLNL

SEQ ID NO: 2246103 - protein, 20 aa, Cryptosporidium parvum
NLERLVVQTLYFMISKEIEN

SEQ ID NO: 2246104 - protein, 29 aa, Cryptosporidium parvum
NLEVANFMIFICDKLFILNIQEFCNKIQS

SEQ ID NO: 2246105 - protein, 25 aa, Cryptosporidium parvum
NLFGLYCHVVFSLCKFVSVIINAIL

SEQ ID NO: 2246106 - protein, 18 aa, Cryptosporidium parvum
NLFIDRLPKVLILIGNSG

SEQ ID NO: 2246107 - protein, 19 aa, Cryptosporidium parvum
NLFINWIINLIKNNEFRSS

SEQ ID NO: 2246108 - protein, 19 aa, Cryptosporidium parvum
NLFYILSMITKIIKDRAGL

SEQ ID NO: 2246109 - protein, 25 aa, Cryptosporidium parvum
NLGNNDMLILYLKQQLHDIDDIADN

SEQ ID NO: 2246110 - protein, 30 aa, Cryptosporidium parvum
NLGQRKPRFLPNLMMTIIFSTCTDLLTFDL

SEQ ID NO: 2246111 - protein, 26 aa, Cryptosporidium parvum
NLGSLWINLLYWPIKYSGLITSIQFT

SEQ ID NO: 2246112 - protein, 38 aa, Cryptosporidium parvum; identical to SEQ ID NO: 2132566

SEQ ID NO: 2246113 - protein, 22 aa, Cryptosporidium parvum
NLIIFCFSIMQVILGKKVNILI

SEQ ID NO: 2246114 - protein, 17 aa, Cryptosporidium parvum
NLILLLVIGIRGDEINA

SEQ ID NO: 2246115 - protein, 17 aa, Cryptosporidium parvum
NLIQVMEIIRFNFLSDS

SEQ ID NO: 2246116 - protein, 25 aa, Cryptosporidium parvum
NLKKLVFLLRWCCDRNFASISKQAL

SEQ ID NO: 2246117 - protein, 32 aa, Cryptosporidium parvum
NLKLDLTKYEFGWPLLFNKSWFYGDLFCNYKM

SEQ ID NO: 2246118 - protein, 27 aa, Cryptosporidium parvum
NLKTQIHWVLLLLILKADKYKERPKGM

SEQ ID NO: 2246119 - protein, 18 aa, Cryptosporidium parvum
NLLFRRKSWLTEQGVYGA

SEQ ID NO: 2246120 - protein, 20 aa, Cryptosporidium parvum
NLLISSFSLNFIKGFVLIKH

SEQ ID NO: 2246121 - protein, 27 aa, Cryptosporidium parvum
NLLKECLIPFKDLLLKSFIALQDQAFD

SEQ ID NO: 2246122 - protein, 18 aa, Cryptosporidium parvum
NLLNEAWIAQGHELLFFY

SEQ ID NO: 2246123 - protein, 19 aa, Cryptosporidium parvum
NLLNFFSSSLIALPILCLC

SEQ ID NO: 2246124 - protein, 39 aa, Cryptosporidium parvum; identical to SEQ ID NO: 2132574

SEQ ID NO: 2246125 - protein, 25 aa, Cryptosporidium parvum
NLLPEDFLVQIITKLLIRISNKEFS

SEQ ID NO: 2246126 - protein, 21 aa, Cryptosporidium parvum
NLLSIYYIISSWNFSPDTLIT

SEQ ID NO: 2246127 - protein, 28 aa, Cryptosporidium parvum
NLMECQKWFTEYLSKLWPPFNMESFKAD

SEQ ID NO: 2246128 - protein, 26 aa, Cryptosporidium parvum
NLMNDIYFPLNQVPNIIFENIYFYNN

SEQ ID NO: 2246129 - protein, 20 aa, Cryptosporidium parvum
NLNLNIYFRNFLHNFVTENQ

SEQ ID NO: 2246130 - protein, 20 aa, Cryptosporidium parvum
NLNNLIYMVLFLLQENFSSK

SEQ ID NO: 2246131 - protein, 24 aa, Cryptosporidium parvum
NLNYGGPICTKKLFNNGQISCPKG

SEQ ID NO: 2246132 - protein, 27 aa, Cryptosporidium parvum
NLNYRQEVIWNFRFASILGFTMNIKDF

SEQ ID NO: 2246133 - protein, 19 aa, Cryptosporidium parvum
NLPAYFPCSDSNLLFELWN

SEQ ID NO: 2246134 - protein, 20 aa, Cryptosporidium parvum
NLPIPQIIFEIADLPFIIIY

SEQ ID NO: 2246135 - protein, 27 aa, Cryptosporidium parvum
NLPLLIRLMWVFHAIALPASFIVSIVY

SEQ ID NO: 2246136 - protein, 23 aa, Cryptosporidium parvum
NLQAISLIFSLYSLFANFEGKTL

SEQ ID NO: 2246137 - protein, 17 aa, Cryptosporidium parvum
NLRKRFYSLLISNKIDS

SEQ ID NO: 2246138 - protein, 26 aa, Cryptosporidium parvum
NLRNINIVFILWIYNFVLEQRIKVLH

SEQ ID NO: 2246139 - protein, 22 aa, Cryptosporidium parvum
NLSALCFYLTPISDIIFSFLDQ

SEQ ID NO: 2246140 - protein, 26 aa, Cryptosporidium parvum
NLSFSIFNLIFFFGSRLKFAAEVFLA

SEQ ID NO: 2246141 - protein, 28 aa, Cryptosporidium parvum
NLSIVSIIFFQLLLFMIKTKFESKDLNY

SEQ ID NO: 2246142 - protein, 25 aa, Cryptosporidium parvum
NLSNNKWIIFSNPLTQFIPNNIYKT

SEQ ID NO: 2246143 - protein, 26 aa, Cryptosporidium parvum
NLSSQVFLNLIFRKYLSLSFGDIQTV

SEQ ID NO: 2246144 - protein, 25 aa, Cryptosporidium parvum
NLSVLAYIILYLISLTLQVVGSLYK

SEQ ID NO: 2246145 - protein, 28 aa, Cryptosporidium parvum
NLTLQSFCLDWFYRDLNMIYEKVKLNQQ

SEQ ID NO: 2246146 - protein, 23 aa, Cryptosporidium parvum
NLTNYFTLFIFRKKQSNSNQPKN

SEQ ID NO: 2246147 - protein, 23 aa, Cryptosporidium parvum
NLTSIIFFHLVNSPISLVHDRNN

SEQ ID NO: 2246148 - protein, 26 aa, Cryptosporidium parvum
NLTSKEVMLYWKFNISKILNSSIGAE

SEQ ID NO: 2246149 - protein, 26 aa, Cryptosporidium parvum
NLVFYIFKLVPLFKYTRQAIEKNKMS

SEQ ID NO: 2246150 - protein, 19 aa, Cryptosporidium parvum
NLVLSGICNYAIIAMFYAS

SEQ ID NO: 2246151 - protein, 21 aa, Cryptosporidium parvum
NLVVYLCWMFIPDEYLNQINI

SEQ ID NO: 2246152 - protein, 18 aa, Cryptosporidium parvum
NLWSIEILALLNSFSSSF

SEQ ID NO: 2246153 - protein, 23 aa, Cryptosporidium parvum
NLYDLKSIWKIGNLVPYVTSNIN

SEQ ID NO: 2246154 - protein, 22 aa, Cryptosporidium parvum
NLYLNWLLVINEYQIWRLATCF

SEQ ID NO: 2246155 - protein, 20 aa, Cryptosporidium parvum
NLYWIIPHMVAVFFMGSFLT

SEQ ID NO: 2246156 - protein, 24 aa, Cryptosporidium parvum
NMAFQAVSLLWKLTDLIGASLSKN

SEQ ID NO: 2246157 - protein, 34 aa, Cryptosporidium parvum
NMEEYLFFYVVKFTCIYVLLLGSFINTLQYIFTS

SEQ ID NO: 2246158 - protein, 22 aa, Cryptosporidium parvum
NMFTINLHIPFHFIIVAEGKTT

SEQ ID NO: 2246159 - protein, 28 aa, Cryptosporidium parvum
NMIGGLKSFLLNLFKSIFGGAGELWEYI

SEQ ID NO: 2246160 - protein, 19 aa, Cryptosporidium parvum
NMILLGCGTSFHAALFAQL

SEQ ID NO: 2246161 - protein, 26 aa, Cryptosporidium parvum
NMLDETWMKYIKLFGVLTQLDPFSQD

SEQ ID NO: 2246162 - protein, 20 aa, Cryptosporidium parvum
NMLHCNQSFLSSLLFCRFLQ

SEQ ID NO: 2246163 - protein, 17 aa, Cryptosporidium parvum
NMLKGDLMFYRGDGGNC

SEQ ID NO: 2246164 - protein, 33 aa, Cryptosporidium parvum
NMPGVRCLILHDKVYYLPVSPIVFSPGRDESET

SEQ ID NO: 2246165 - protein, 26 aa, Cryptosporidium parvum
NMSILFKILDYFLLTNKTEVFISEIF

SEQ ID NO: 2246166 - protein, 32 aa, Cryptosporidium parvum
NMVNIYYNLVENFPLLYFNRAFQTAQLPCLLE

SEQ ID NO: 2246167 - protein, 20 aa, Cryptosporidium parvum
NMVRMQFLYPLYEPGEGPES

SEQ ID NO: 2246168 - protein, 36 aa, Cryptosporidium parvum
NMVSFIVTLFLLSLLFFIVFLSGIYFLWKKYPANNY

SEQ ID NO: 2246169 - protein, 19 aa, Cryptosporidium parvum
NMYNLFGLCNLMAVLIELF

SEQ ID NO: 2246170 - protein, 24 aa, Cryptosporidium parvum
NMYQRLLTKFYTFLFGRKHHFLEF

SEQ ID NO: 2246171 - protein, 20 aa, Cryptosporidium parvum
NMYTSLMHSILFQCVLYSYP

SEQ ID NO: 2246172 - protein, 26 aa, Cryptosporidium parvum
NNAKYLVWLLVLVPVFICIPCLIWVW

SEQ ID NO: 2246173 - protein, 26 aa, Cryptosporidium parvum
NNCADLFQLILISPYFTMKSLNSNVF

SEQ ID NO: 2246174 - protein, 20 aa, Cryptosporidium parvum
NNDIIFVYLASENRAIIRWG

SEQ ID NO: 2246175 - protein, 21 aa, Cryptosporidium parvum
NNDIIWVHRNNFRFLLEKSCE

SEQ ID NO: 2246176 - protein, 29 aa, Cryptosporidium parvum
NNDINLNQFYYSLKYFLSGKSFPVKQSPS

SEQ ID NO: 2246177 - protein, 43 aa, Cryptosporidium parvum
NNFEPINWFVIYYDSIWHSLLPLKFSIGWLTCPSILISRIVRK

SEQ ID NO: 2246178 - protein, 19 aa, Cryptosporidium parvum
NNFITWWIVTKGVVLFRNN

SEQ ID NO: 2246179 - protein, 20 aa, Cryptosporidium parvum
NNFPKLCQNYWKKSVKSLIS

SEQ ID NO: 2246180 - protein, 23 aa, Cryptosporidium parvum
NNGPAQMIFLMNSKVFYTSKDGI

SEQ ID NO: 2246181 - protein, 17 aa, Cryptosporidium parvum
NNHKSCLIILSKGLGIF

SEQ ID NO: 2246182 - protein, 21 aa, Cryptosporidium parvum
NNHKYFILNPIQYNDFVLNII

SEQ ID NO: 2246183 - protein, 19 aa, Cryptosporidium parvum
NNICRVIVLDWLIGVHRKF

SEQ ID NO: 2246184 - protein, 31 aa, Cryptosporidium parvum
NNIEVVKGFRIIWYPYNNFSPTNYKSLEILI

SEQ ID NO: 2246185 - protein, 33 aa, Cryptosporidium parvum
NNIGIKYLLSTRNIWIIPIANPWGFYHNKRTEE

SEQ ID NO: 2246186 - protein, 34 aa, Cryptosporidium parvum
NNIKSLKFISITNYPLSVFIILGSNLEIGVFIAS

SEQ ID NO: 2246187 - protein, 21 aa, Cryptosporidium parvum
NNINKLLSRRVFPYNNTLGIL

SEQ ID NO: 2246188 - protein, 25 aa, Cryptosporidium parvum
NNISQLRMKFLQLWNIYSNKNLIEK

SEQ ID NO: 2246189 - protein, 23 aa, Cryptosporidium parvum
NNIYQFLLSIFKFGNEVTHIVFH

SEQ ID NO: 2246190 - protein, 23 aa, Cryptosporidium parvum
NNKRVIEVILLLTFYKRIEKYNN

SEQ ID NO: 2246191 - protein, 20 aa, Cryptosporidium parvum
NNLDVFILANMLAARMIPQI

SEQ ID NO: 2246192 - protein, 21 aa, Cryptosporidium parvum
NNLFNWIELDKQFLYGARACE

SEQ ID NO: 2246193 - protein, 39 aa, Cryptosporidium parvum
NNLIEGLITGLLRSLLIIMSIIINFWQVPKKMYRQMGNW

SEQ ID NO: 2246194 - protein, 26 aa, Cryptosporidium parvum
NNLIRQILFSPFWLSDSTPTSYLMNR

SEQ ID NO: 2246195 - protein, 39 aa, Cryptosporidium parvum
NNLVGNIMLIRVFSIIIILISLVFTATIFIPLILIESEK

SEQ ID NO: 2246196 - protein, 23 aa, Cryptosporidium parvum
NNMPYLITFGLIKFNPVDYENFF

SEQ ID NO: 2246197 - protein, 28 aa, Cryptosporidium parvum
NNNDDFYKNIIFLLRLIALYSEKNEQKY

SEQ ID NO: 2246198 - protein, 25 aa, Cryptosporidium parvum
NNNDSILLVLRAPQFSLSTLTIIYL

SEQ ID NO: 2246199 - protein, 23 aa, Cryptosporidium parvum
NNNFDWFFIINSYTRFNPILLNE

SEQ ID NO: 2246200 - protein, 24 aa, Cryptosporidium parvum
NNNKFLFPLFSPRSSSSFFAQEEF

SEQ ID NO: 2246201 - protein, 25 aa, Cryptosporidium parvum
NNNKLMRLDLFPNPYIYGNKLFLYL

SEQ ID NO: 2246202 - protein, 29 aa, Cryptosporidium parvum
NNNNYYYYYLIYILKQIIIKFLTLLPAGI

SEQ ID NO: 2246203 - protein, 24 aa, Cryptosporidium parvum
NNNPWIFEFIAIITKRIANCILTY

SEQ ID NO: 2246204 - protein, 25 aa, Cryptosporidium parvum
NNNSPSFFTAYYLILAHLYRKHSEL

SEQ ID NO: 2246205 - protein, 40 aa, Cryptosporidium parvum; identical to SEQ ID NO: 2236014

SEQ ID NO: 2246206 - protein, 24 aa, Cryptosporidium parvum
NNPQLTLMQLFNNSGGFSGSGAAN

SEQ ID NO: 2246207 - protein, 24 aa, Cryptosporidium parvum
NNSKYYIQSIFNYVNHFFSHENKA

SEQ ID NO: 2246208 - protein, 26 aa, Cryptosporidium parvum
NNSLPLLCLIPLGIVLHLVKFTSNPE

SEQ ID NO: 2246209 - protein, 25 aa, Cryptosporidium parvum
NNSNNWKIINSLWSIFICALDDIIR

SEQ ID NO: 2246210 - protein, 33 aa, Cryptosporidium parvum
NNSQDFLFHIFSFLIKFLFGYRYRDLKQQINYQ

SEQ ID NO: 2246211 - protein, 33 aa, Cryptosporidium parvum
NNSQMEIFFKNRYFWIISCLFTILFKTNNIITK

SEQ ID NO: 2246212 - protein, 17 aa, Cryptosporidium parvum
NNTIFESYFRYCTMIIL

SEQ ID NO: 2246213 - protein, 25 aa, Cryptosporidium parvum
NNTSFYSMIFFNLTTLFKKLYENDK

SEQ ID NO: 2246214 - protein, 28 aa, Cryptosporidium parvum
NNVSILPLLSIIWLFKDISEKIITKLNM

SEQ ID NO: 2246215 - protein, 21 aa, Cryptosporidium parvum
NNVYPYLLVGKLLVEANMEKC

SEQ ID NO: 2246216 - protein, 30 aa, Cryptosporidium parvum
NNWGKIGRIILFIYISFLSMLHDITGIVIP

SEQ ID NO: 2246217 - protein, 18 aa, Cryptosporidium parvum
NNWKILWRRNSLSEFSKG

SEQ ID NO: 2246218 - protein, 21 aa, Cryptosporidium parvum
NNYSLIPWNIHNLVTKKGYNL

SEQ ID NO: 2246219 - protein, 20 aa, Cryptosporidium parvum
NNYYNIFKTLRSKVINNYFI

SEQ ID NO: 2246220 - protein, 31 aa, Cryptosporidium parvum
NPDSCELIIIIDFMLEYLLLLLENGLDINKY

SEQ ID NO: 2246221 - protein, 30 aa, Cryptosporidium parvum; identical to SEQ ID NO: 2132629

SEQ ID NO: 2246222 - protein, 19 aa, Cryptosporidium parvum
NPGRRWCWKFVKHAQVSYF

SEQ ID NO: 2246223 - protein, 38 aa, Cryptosporidium parvum
NPILIQVISLILLLFRWVILLMYIVAQLFLPIKAVRQI

SEQ ID NO: 2246224 - protein, 24 aa, Cryptosporidium parvum
NPKAKIISLIIYSSAIMFSVPLQL

SEQ ID NO: 2246225 - protein, 21 aa, Cryptosporidium parvum
NPNYCLGINLYLIPVQNITQE

SEQ ID NO: 2246226 - protein, 25 aa, Cryptosporidium parvum
NPSNFFYFHLFYVVSSFIMYVTPIN

SEQ ID NO: 2246227 - protein, 24 aa, Cryptosporidium parvum
NPSSKLIQCLILIGLQTFKIFLDS

SEQ ID NO: 2246228 - protein, 19 aa, Cryptosporidium parvum
NPTFLECLFLRVKIESDPL

SEQ ID NO: 2246229 - protein, 17 aa, Cryptosporidium parvum
NPVYLSIMLDPEKLQKD

SEQ ID NO: 2246230 - protein, 55 aa, Cryptosporidium parvum; identical to SEQ ID NO: 2132645

SEQ ID NO: 2246231 - protein, 50 aa, Cryptosporidium parvum
NPYEIRLITLMIASKMGFGPWFSFFYYWKFIPLTFYYNIIKSYSDLSLYE

SEQ ID NO: 2246232 - protein, 20 aa, Cryptosporidium parvum
NPYRNLFLQRLSRQGLLRMD

SEQ ID NO: 2246233 - protein, 18 aa, Cryptosporidium parvum
NPYTPFDLSLRPSDEDTK

SEQ ID NO: 2246234 - protein, 25 aa, Cryptosporidium parvum
NQDSKLFFIGLQIILNYMYKRRNNE

SEQ ID NO: 2246235 - protein, 27 aa, Cryptosporidium parvum
NQECNSFVDLLLLKRIYRFSQITLDEN

SEQ ID NO: 2246236 - protein, 25 aa, Cryptosporidium parvum
NQEFYQFLRKFFPSLVKVFREAFLK

SEQ ID NO: 2246237 - protein, 24 aa, Cryptosporidium parvum
NQEIRIITRILIFSISTLSVTYIL

SEQ ID NO: 2246238 - protein, 20 aa, Cryptosporidium parvum
NQFFLVLRSQGILGYKKAPV

SEQ ID NO: 2246239 - protein, 22 aa, Cryptosporidium parvum
NQFFSIKIYHLSNTLLLLDEIN

SEQ ID NO: 2246240 - protein, 17 aa, Cryptosporidium parvum
NQFGIFIIQKFFIEFQR

SEQ ID NO: 2246241 - protein, 25 aa, Cryptosporidium parvum
NQHLIIPVIIQFLLSIAIPSKNEFN

SEQ ID NO: 2246242 - protein, 19 aa, Cryptosporidium parvum
NQIHCQYIFLCHGQIQNSS

SEQ ID NO: 2246243 - protein, 23 aa, Cryptosporidium parvum
NQIILDNIWPLFIDIIANMIKEE

SEQ ID NO: 2246244 - protein, 23 aa, Cryptosporidium parvum
NQIIPLISSYFIFDNLSIDITEK

SEQ ID NO: 2246245 - protein, 25 aa, Cryptosporidium parvum
NQIQLLYYQLILSSIMFIPILIVTG

SEQ ID NO: 2246246 - protein, 25 aa, Cryptosporidium parvum
NQIQPYLIGLVLQLSTDRTNGIKGF

SEQ ID NO: 2246247 - protein, 18 aa, Cryptosporidium parvum
NQISDFIPFISTNNKKNK

SEQ ID NO: 2246248 - protein, 35 aa, Cryptosporidium parvum
NQISYYSSKFWLKLRKEAIGWFIYTIEDPKYSVDI

SEQ ID NO: 2246249 - protein, 25 aa, Cryptosporidium parvum
NQKKKWILLYFTSVILLEFWQFSVF

SEQ ID NO: 2246250 - protein, 27 aa, Cryptosporidium parvum
NQKNNKLGLILLPIGTLGISYSDFNRD

SEQ ID NO: 2246251 - protein, 24 aa, Cryptosporidium parvum
NQLDIRKLFLRNAPKRTGYRPVPG

SEQ ID NO: 2246252 - protein, 26 aa, Cryptosporidium parvum
NQLDSFMFWYEYFIFSPTNELSDGHI

SEQ ID NO: 2246253 - protein, 25 aa, Cryptosporidium parvum
NQLVGIYILIIFRSTLQIVSSRRDH

SEQ ID NO: 2246254 - protein, 25 aa, Cryptosporidium parvum
NQNLLVTYLFKLFQRNQIKVAIHFY

SEQ ID NO: 2246255 - protein, 24 aa, Cryptosporidium parvum
NQQKMAMWIIIFSSVVGFNLKYFF

SEQ ID NO: 2246256 - protein, 35 aa, Cryptosporidium parvum; identical to SEQ ID NO: 2132652

SEQ ID NO: 2246257 - protein, 19 aa, Cryptosporidium parvum
NQRWVVITIKYLLGTEFTS

SEQ ID NO: 2246258 - protein, 32 aa, Cryptosporidium parvum; identical to SEQ ID NO: 2132654

SEQ ID NO: 2246259 - protein, 22 aa, Cryptosporidium parvum
NQSMLLEDYLTSAALDVSRLIE

SEQ ID NO: 2246260 - protein, 27 aa, Cryptosporidium parvum
NQTIFDHDLLNRLLPKVLRRTKVYLSK

SEQ ID NO: 2246261 - protein, 32 aa, Cryptosporidium parvum
NRASMYWYRVFRSLSLLLYFSRKYIKEYATRL

SEQ ID NO: 2246262 - protein, 21 aa, Cryptosporidium parvum
NREKNHVLRRALSSNIPEKPL

SEQ ID NO: 2246263 - protein, 38 aa, Cryptosporidium parvum
NRHFPYIDIPPYSRRSIPLSWFLLSDMEPSIVPILSHK

SEQ ID NO: 2246264 - protein, 20 aa, Cryptosporidium parvum
NRHIIPSLIQIGLQKLFLTQ

SEQ ID NO: 2246265 - protein, 17 aa, Cryptosporidium parvum
NRIIILSSILPFERKVG

SEQ ID NO: 2246266 - protein, 20 aa, Cryptosporidium parvum
NRIIKPLFNRYFKLISSEDQ

SEQ ID NO: 2246267 - protein, 31 aa, Cryptosporidium parvum
NRIILDLMERVLFLWAIRNPASGYVQGINDL

SEQ ID NO: 2246268 - protein, 17 aa, Cryptosporidium parvum
NRIQILRSILICIETKD

SEQ ID NO: 2246269 - protein, 25 aa, Cryptosporidium parvum
NRLDRIYAMPISVLIEFILDENGEY

SEQ ID NO: 2246270 - protein, 22 aa, Cryptosporidium parvum
NRLLMDLKKIKSVRITLVCLKK

SEQ ID NO: 2246271 - protein, 26 aa, Cryptosporidium parvum
NRMKLPYFAYQLLYTNLLEQEFLLNS

SEQ ID NO: 2246272 - protein, 19 aa, Cryptosporidium parvum
NRNGILLCYSLLSLNLLNI

SEQ ID NO: 2246273 - protein, 22 aa, Cryptosporidium parvum
NRNLIKLFVLKRRNMLLECKFN

SEQ ID NO: 2246274 - protein, 19 aa, Cryptosporidium parvum
NRTYLMYGNSLLSMLLGIH

SEQ ID NO: 2246275 - protein, 26 aa, Cryptosporidium parvum
NRVEYWFKLLSAKVIPKILLKFFPDL

SEQ ID NO: 2246276 - protein, 35 aa, Cryptosporidium parvum
NRYCFSSLKYKYGLKLYWIRKVSKTLKFLKLTNQS

SEQ ID NO: 2246277 - protein, 23 aa, Cryptosporidium parvum
NRYLYQYVYFTPSIIKSLTILRS

SEQ ID NO: 2246278 - protein, 18 aa, Cryptosporidium parvum
NRYPYIYNFTLSFAGSCG

SEQ ID NO: 2246279 - protein, 21 aa, Cryptosporidium parvum
NSAFFGFLLNKVTFAICLLVW

SEQ ID NO: 2246280 - protein, 25 aa, Cryptosporidium parvum
NSASYLFLGTRLFSNLIFPILMNTK

SEQ ID NO: 2246281 - protein, 21 aa, Cryptosporidium parvum
NSCIWDLSWDDHGISFISGSS

SEQ ID NO: 2246282 - protein, 29 aa, Cryptosporidium parvum
NSDDKMYIDFPIRNFWKIAKTPIDMESPQ

SEQ ID NO: 2246283 - protein, 30 aa, Cryptosporidium parvum; identical to SEQ ID NO: 2132666

SEQ ID NO: 2246284 - protein, 26 aa, Cryptosporidium parvum
NSDIYRPLFKNIFIIGRRGWIQNSFK

SEQ ID NO: 2246285 - protein, 26 aa, Cryptosporidium parvum
NSEILVDIIKFLYYRNLIVTYDNSKV

SEQ ID NO: 2246286 - protein, 26 aa, Cryptosporidium parvum
NSELISRIPILLRRMVLYSEIGDIVL

SEQ ID NO: 2246287 - protein, 17 aa, Cryptosporidium parvum
NSEYWVLGSNDKSFRST

SEQ ID NO: 2246288 - protein, 24 aa, Cryptosporidium parvum
NSFILSIVVSFLYFLFNYKKNENN

SEQ ID NO: 2246289 - protein, 25 aa, Cryptosporidium parvum
NSFSWGLFTFFFALGSMNSTFPLYL

SEQ ID NO: 2246290 - protein, 31 aa, Cryptosporidium parvum
NSFVGFYNYHYFWDPALLLNAFYSQAEILSI

SEQ ID NO: 2246291 - protein, 24 aa, Cryptosporidium parvum
NSFYALLFSIGLKKNIRGGISFIT

SEQ ID NO: 2246292 - protein, 26 aa, Cryptosporidium parvum
NSGDIVHLGYFFTDGHLLICIGDTCF

SEQ ID NO: 2246293 - protein, 24 aa, Cryptosporidium parvum
NSGIWVFSFVLIGIQCFIFLIFLI

SEQ ID NO: 2246294 - protein, 23 aa, Cryptosporidium parvum
NSHAKEILLTKYYLNYYFNASQF

SEQ ID NO: 2246295 - protein, 29 aa, Cryptosporidium parvum
NSHQYFLSCFLFYPNIIHCMVRIILSLNG

SEQ ID NO: 2246296 - protein, 18 aa, Cryptosporidium parvum
NSIFNMRPSILYNTYIVC

SEQ ID NO: 2246297 - protein, 39 aa, Cryptosporidium parvum
NSIFSPMIFLSFIIQALIHLFVIYFGWKISYSLMPLNYS

SEQ ID NO: 2246298 - protein, 32 aa, Cryptosporidium parvum
NSIICLCIRLLTLAQYPPFWTSCRHLLQLIGQ

SEQ ID NO: 2246299 - protein, 22 aa, Cryptosporidium parvum
NSIINLIRYLTYLEFSFEFVKD

SEQ ID NO: 2246300 - protein, 18 aa, Cryptosporidium parvum
NSILLDENLFFQKNLNFK

SEQ ID NO: 2246301 - protein, 30 aa, Cryptosporidium parvum
NSIRLMHKIFPNYDKIPLIRLDRLPLKNKN

SEQ ID NO: 2246302 - protein, 24 aa, Cryptosporidium parvum
NSISILSLLLLLNKNYTSKVVLQS

SEQ ID NO: 2246303 - protein, 26 aa, Cryptosporidium parvum
NSKDQINIFIFDSFFRMVKHDIIHCT

SEQ ID NO: 2246304 - protein, 21 aa, Cryptosporidium parvum
NSKFNIFDCLPYIIISTLELI

SEQ ID NO: 2246305 - protein, 21 aa, Cryptosporidium parvum
NSKIILASWSISSNLTLQIFK

SEQ ID NO: 2246306 - protein, 21 aa, Cryptosporidium parvum
NSKKKWLCGLGVHYVSSSRDH

SEQ ID NO: 2246307 - protein, 44 aa, Cryptosporidium parvum
NSKLTETFFFPLKTLLGISLSPIIGLSWFNCHPQTFVAGSCLLG

SEQ ID NO: 2246308 - protein, 22 aa, Cryptosporidium parvum
NSKLYMMLLILISSWANSCITM

SEQ ID NO: 2246309 - protein, 43 aa, Cryptosporidium parvum
NSLDSYILYSKLLFHGIKLIPSTMSILLRFLINKLISLESEIH

SEQ ID NO: 2246310 - protein, 23 aa, Cryptosporidium parvum
NSLFEIFKLFLTTYFHNRKNKNI

SEQ ID NO: 2246311 - protein, 23 aa, Cryptosporidium parvum
NSLHQPHRFQTRPSILVTLCKLL

SEQ ID NO: 2246312 - protein, 26 aa, Cryptosporidium parvum
NSLIRRSLITLIFIQGVLVTFISQFK

SEQ ID NO: 2246313 - protein, 24 aa, Cryptosporidium parvum
NSLLSMLLGIHLVASIGGADMPVA

SEQ ID NO: 2246314 - protein, 17 aa, Cryptosporidium parvum
NSLPWIPDYEFSNPITV

SEQ ID NO: 2246315 - protein, 32 aa, Cryptosporidium parvum; identical to SEQ ID NO: 2132682

SEQ ID NO: 2246316 - protein, 27 aa, Cryptosporidium parvum
NSLSLPMVMGYYYLPPDTLYLGKFSRS

SEQ ID NO: 2246317 - protein, 22 aa, Cryptosporidium parvum
NSLYQLILGLKNRGIRHIHIMT

SEQ ID NO: 2246318 - protein, 17 aa, Cryptosporidium parvum
NSMILNWDKEFLKIINT

SEQ ID NO: 2246319 - protein, 24 aa, Cryptosporidium parvum
NSMYLIIPAFLMALVFHPSLNSWM

SEQ ID NO: 2246320 - protein, 17 aa, Cryptosporidium parvum
NSNLLLAFSARIATYYS

SEQ ID NO: 2246321 - protein, 26 aa, Cryptosporidium parvum
NSNNNICILKKMRFFFLISDDNNDDE

SEQ ID NO: 2246322 - protein, 24 aa, Cryptosporidium parvum
NSNNRPVLILLDRDIDLSTMINHS

SEQ ID NO: 2246323 - protein, 17 aa, Cryptosporidium parvum
NSNSIIIKSLRYFQDQL

SEQ ID NO: 2246324 - protein, 22 aa, Cryptosporidium parvum
NSPFRIACQFSLIKCTLANIKS

SEQ ID NO: 2246325 - protein, 25 aa, Cryptosporidium parvum
NSPHRLFVFVVLAVTQIVPHFFFSQ

SEQ ID NO: 2246326 - protein, 26 aa, Cryptosporidium parvum
NSPKCRIIYFLRKLSKFTGVVWSCSQ

SEQ ID NO: 2246327 - protein, 27 aa, Cryptosporidium parvum
NSPKLFGYSWIPYRIIKYYKNDKKIEE

SEQ ID NO: 2246328 - protein, 22 aa, Cryptosporidium parvum
NSQKLAQAALLYMASKLTSQEE

SEQ ID NO: 2246329 - protein, 24 aa, Cryptosporidium parvum
NSQKYRLLLLDELPNYRLTTEDGG

SEQ ID NO: 2246330 - protein, 29 aa, Cryptosporidium parvum
NSRGIIKYILPFYSFQMFLKDTYLHLNGF

SEQ ID NO: 2246331 - protein, 20 aa, Cryptosporidium parvum
NSRLLVPLFCPISDTFCNLS

SEQ ID NO: 2246332 - protein, 27 aa, Cryptosporidium parvum
NSRNLFFTFFVFFVIIILSFENKFQGN

SEQ ID NO: 2246333 - protein, 25 aa, Cryptosporidium parvum
NSRPLKLIWIVPKTELQKVLTPQIL

SEQ ID NO: 2246334 - protein, 21 aa, Cryptosporidium parvum
NSSIKSLKFLSRNLLSISSVK

SEQ ID NO: 2246335 - protein, 26 aa, Cryptosporidium parvum
NSSNNYYIFYEKKLHNWVLTDKFDLD

SEQ ID NO: 2246336 - protein, 25 aa, Cryptosporidium parvum
NSSVALAHFWLHPALIHTSSHSNLW

SEQ ID NO: 2246337 - protein, 23 aa, Cryptosporidium parvum
NSTLNILLNFILNPFKYSKMVDN

SEQ ID NO: 2246338 - protein, 18 aa, Cryptosporidium parvum
NSTPEYLLQAFPAILTFT

SEQ ID NO: 2246339 - protein, 18 aa, Cryptosporidium parvum
NSTQFYFNPCIISIFGES

SEQ ID NO: 2246340 - protein, 23 aa, Cryptosporidium parvum
NSTVPLVRLINLSMGLYNKNGNV

SEQ ID NO: 2246341 - protein, 27 aa, Cryptosporidium parvum
NSTVVKQPWYAPLKKIGINIISGKNTI

SEQ ID NO: 2246342 - protein, 27 aa, Cryptosporidium parvum
NSVINFLLVFFIMLFSSISIPHIVFFQ

SEQ ID NO: 2246343 - protein, 20 aa, Cryptosporidium parvum
NSYAFGVFSFFDLAFDTFSG

SEQ ID NO: 2246344 - protein, 23 aa, Cryptosporidium parvum
NSYQQFLNCIVPFIIYSEILRDG

SEQ ID NO: 2246345 - protein, 24 aa, Cryptosporidium parvum
NSYSTLFFYILKAANRFKYPKNWS

SEQ ID NO: 2246346 - protein, 25 aa, Cryptosporidium parvum
NSYSYIFMALAIISGFFGFLRFFTH

SEQ ID NO: 2246347 - protein, 27 aa, Cryptosporidium parvum
NSYVEYAIFIILITIVSLINSIYETRC

SEQ ID NO: 2246348 - protein, 24 aa, Cryptosporidium parvum
NTDDFIIIGILLYNNIIGEYSIFY

SEQ ID NO: 2246349 - protein, 19 aa, Cryptosporidium parvum
NTEALYSLHLRKLLARLSL

SEQ ID NO: 2246350 - protein, 34 aa, Cryptosporidium parvum
NTEIKLTFNRAMNYGHWAWFNITGRTTGHLIHIP

SEQ ID NO: 2246351 - protein, 23 aa, Cryptosporidium parvum
NTELFIGPLSFFQTNTKGCETLY

SEQ ID NO: 2246352 - protein, 24 aa, Cryptosporidium parvum
NTENLYWCKLIGSRIDLYKWEAFH

SEQ ID NO: 2246353 - protein, 29 aa, Cryptosporidium parvum
NTFDNNVCLLRYSPLYLGAIKANIGHLEG

SEQ ID NO: 2246354 - protein, 24 aa, Cryptosporidium parvum
NTFTNGLDWFILHSTLGLESTFIS

SEQ ID NO: 2246355 - protein, 25 aa, Cryptosporidium parvum
NTGRTGVLPIGRPGLAVATIPISNF

SEQ ID NO: 2246356 - protein, 36 aa, Cryptosporidium parvum; identical to SEQ ID NO: 2132706

SEQ ID NO: 2246357 - protein, 18 aa, Cryptosporidium parvum
NTILPFSILCITFIFLKI

SEQ ID NO: 2246358 - protein, 17 aa, Cryptosporidium parvum
NTIWYYWDNEIHKEYVQ

SEQ ID NO: 2246359 - protein, 25 aa, Cryptosporidium parvum
NTKSIYLKSFPIKYELFSNLYNSLI

SEQ ID NO: 2246360 - protein, 24 aa, Cryptosporidium parvum
NTKWTNMLKYWPSRFSKQLYHDNV

SEQ ID NO: 2246361 - protein, 35 aa, Cryptosporidium parvum
NTLRQSYIRLRYLIENLYLRMIVDWMKKALKELNI

SEQ ID NO: 2246362 - protein, 20 aa, Cryptosporidium parvum
NTNCIKWNPLNSYLIGALHE

SEQ ID NO: 2246363 - protein, 25 aa, Cryptosporidium parvum
NTNKLRYFYGRHLWLLSSKVNLNNL

SEQ ID NO: 2246364 - protein, 23 aa, Cryptosporidium parvum
NTNLLILNPFIYSVNIVYYQITT

SEQ ID NO: 2246365 - protein, 31 aa, Cryptosporidium parvum
NTNTFKKSFTYLLLLALVGIIIIDFIFRRFG

SEQ ID NO: 2246366 - protein, 18 aa, Cryptosporidium parvum
NTPFMDFLHAPLSLRTIP

SEQ ID NO: 2246367 - protein, 24 aa, Cryptosporidium parvum
NTRLFLRTKLIPSQYLIVIGSNFV

SEQ ID NO: 2246368 - protein, 20 aa, Cryptosporidium parvum
NTRVYIFHGSKDKLIPFHIF

SEQ ID NO: 2246369 - protein, 19 aa, Cryptosporidium parvum
NTSIGGFPGAMMFGAIRLD

SEQ ID NO: 2246370 - protein, 27 aa, Cryptosporidium parvum
NTSKTKKKITFLKKLFSRISNDDVNLI

SEQ ID NO: 2246371 - protein, 17 aa, Cryptosporidium parvum
NTSLILNLVPFSGSKHA

SEQ ID NO: 2246372 - protein, 20 aa, Cryptosporidium parvum
NTTKPIINLIENIKPRINLI

SEQ ID NO: 2246373 - protein, 34 aa, Cryptosporidium parvum
NVDFWMCFGKETMISWIPILKYSTELGIILGLES

SEQ ID NO: 2246374 - protein, 23 aa, Cryptosporidium parvum
NVDIWQLYLLAVIQKYSSMRNGK

SEQ ID NO: 2246375 - protein, 27 aa, Cryptosporidium parvum
NVDVTLEFAWLEIFRSRILIAGARLSI

SEQ ID NO: 2246376 - protein, 25 aa, Cryptosporidium parvum
NVESNLFLILNSYPSFIKLGGINGR

SEQ ID NO: 2246377 - protein, 25 aa, Cryptosporidium parvum
NVETVFELLMVPLILRFDNNLTYEQ

SEQ ID NO: 2246378 - protein, 25 aa, Cryptosporidium parvum
NVFIHPNIKFRLLSAIALSKLVPYC

SEQ ID NO: 2246379 - protein, 25 aa, Cryptosporidium parvum
NVFPFSWKFELVGWIAASFLICIFI

SEQ ID NO: 2246380 - protein, 41 aa, Cryptosporidium parvum
NVFPLAWKVEFIFWNYFSILSMSLIYWWISSNSNLKKVKFS

SEQ ID NO: 2246381 - protein, 21 aa, Cryptosporidium parvum
NVFSIFFVITNASIALGQSTP

SEQ ID NO: 2246382 - protein, 22 aa, Cryptosporidium parvum
NVFSRIFLSYYNVCKSFILNNK

SEQ ID NO: 2246383 - protein, 19 aa, Cryptosporidium parvum
NVFWMKIEDEYFGKIDDRM

SEQ ID NO: 2246384 - protein, 31 aa, Cryptosporidium parvum
NVIFFLETVSSLRWFLLDKKVLFSSLRQDLH

SEQ ID NO: 2246385 - protein, 28 aa, Cryptosporidium parvum
NVIKTARYSLLFFLPKNLYDQFNNVANI

SEQ ID NO: 2246386 - protein, 25 aa, Cryptosporidium parvum
NVIRYMFCKGLQYPTSGWLRLNHLN

SEQ ID NO: 2246387 - protein, 21 aa, Cryptosporidium parvum
NVIVWLHGLCSSAVEWERFLI

SEQ ID NO: 2246388 - protein, 31 aa, Cryptosporidium parvum
NVKMRLDFFDMLFKELMPSLAYHFDLLSITS

SEQ ID NO: 2246389 - protein, 22 aa, Cryptosporidium parvum
NVLLELFGIKYFESLSPKIANI

SEQ ID NO: 2246390 - protein, 24 aa, Cryptosporidium parvum
NVLQFILFEVYFSIFIYKKYDQLS

SEQ ID NO: 2246391 - protein, 27 aa, Cryptosporidium parvum
NVLTQYCAIFHRLYAPAILPGHTAYTD

SEQ ID NO: 2246392 - protein, 23 aa, Cryptosporidium parvum
NVNGLYMPWKAPKNGKAVWNGGE

SEQ ID NO: 2246393 - protein, 38 aa, Cryptosporidium parvum
NVPLKTIMLFFRKIIGIFFLINLIILTLALGIIIYLHI

SEQ ID NO: 2246394 - protein, 17 aa, Cryptosporidium parvum
NVPVPFEMFFDKVFIYS

SEQ ID NO: 2246395 - protein, 29 aa, Cryptosporidium parvum
NVQEFIQIVSYWRSAIQHILYKNTKLWTS

SEQ ID NO: 2246396 - protein, 17 aa, Cryptosporidium parvum
NVQKLLYKYPVSLKVNL

SEQ ID NO: 2246397 - protein, 18 aa, Cryptosporidium parvum
NVSKFILFPVSIGNEKYG

SEQ ID NO: 2246398 - protein, 45 aa, Cryptosporidium parvum
NVSLILGDILNNYYWKLLLFIIIRRHSLIFFKLNSKSILLTNFTQ

SEQ ID NO: 2246399 - protein, 27 aa, Cryptosporidium parvum
NVSMMNYLVYLFPSIFHTTITNYNKFI

SEQ ID NO: 2246400 - protein, 17 aa, Cryptosporidium parvum
NVSNRIIILSSILPFER

SEQ ID NO: 2246401 - protein, 23 aa, Cryptosporidium parvum
NVSQIILTSWTISKSFFPGRHYT

SEQ ID NO: 2246402 - protein, 23 aa, Cryptosporidium parvum
NVYEFYFWCLDLINNEINKINEF

SEQ ID NO: 2246403 - protein, 22 aa, Cryptosporidium parvum
NVYRYNLFLSNGIHQVVFKVYY

SEQ ID NO: 2246404 - protein, 23 aa, Cryptosporidium parvum
NVYTIKTIGIPLALDALLQKGSG

SEQ ID NO: 2246405 - protein, 20 aa, Cryptosporidium parvum
NWCDRLVFHNCIGFELEYME

SEQ ID NO: 2246406 - protein, 19 aa, Cryptosporidium parvum
NWDCEFIGIRPFNVRKSVW

SEQ ID NO: 2246407 - protein, 17 aa, Cryptosporidium parvum
NWILNSLSSVREELISV

SEQ ID NO: 2246408 - protein, 24 aa, Cryptosporidium parvum
NWISKFFIDRYPISLVYSLSDEFE

SEQ ID NO: 2246409 - protein, 24 aa, Cryptosporidium parvum
NYDDKWIVVQKYYNGKLLNNLSLS

SEQ ID NO: 2246410 - protein, 18 aa, Cryptosporidium parvum
NYFAPIYEEAYWGQYDKE

SEQ ID NO: 2246411 - protein, 23 aa, Cryptosporidium parvum
NYIIEMLFSFDFLNNIFSMFLAS

SEQ ID NO: 2246412 - protein, 23 aa, Cryptosporidium parvum
NYIKFILVYFICQCLLIYVYVCT

SEQ ID NO: 2246413 - protein, 19 aa, Cryptosporidium parvum
NYISTLPKVRLIRNAKRSG

SEQ ID NO: 2246414 - protein, 29 aa, Cryptosporidium parvum
NYKFYSQLIIRMIYLCTWMIVDNNYESYK

SEQ ID NO: 2246415 - protein, 18 aa, Cryptosporidium parvum
NYKREFLHVPINSRFRFI

SEQ ID NO: 2246416 - protein, 22 aa, Cryptosporidium parvum
NYKVPVILILELFQFIKDETST

SEQ ID NO: 2246417 - protein, 19 aa, Cryptosporidium parvum
NYKWWWFSFLNGLSPCVYF

SEQ ID NO: 2246418 - protein, 21 aa, Cryptosporidium parvum
NYLDNTLFLMFKYFNVEESYK

SEQ ID NO: 2246419 - protein, 17 aa, Cryptosporidium parvum
NYLHLPSEHYEEIVGFL

SEQ ID NO: 2246420 - protein, 22 aa, Cryptosporidium parvum
NYLSVFLMYMDPPSAFKCMLNL

SEQ ID NO: 2246421 - protein, 20 aa, Cryptosporidium parvum
NYLYNYIHSFGNSLLPFIDI

SEQ ID NO: 2246422 - protein, 28 aa, Cryptosporidium parvum
NYPLGSLLGLIFYLLEKLLIVENLNIEI

SEQ ID NO: 2246423 - protein, 32 aa, Cryptosporidium parvum; identical to SEQ ID NO: 2132738

SEQ ID NO: 2246424 - protein, 26 aa, Cryptosporidium parvum
NYSEILLFPSILILKLLSIQNYEKSI

SEQ ID NO: 2246425 - protein, 31 aa, Cryptosporidium parvum; identical to SEQ ID NO: 2132740

SEQ ID NO: 2246426 - protein, 26 aa, Cryptosporidium parvum
NYSNLLYDLFYFHVDVTIRIFYRENE

SEQ ID NO: 2246427 - protein, 18 aa, Cryptosporidium parvum
NYTCKLRLILKNYQRKKC

SEQ ID NO: 2246428 - protein, 30 aa, Cryptosporidium parvum
NYTCNVLSLLVYFVSSLPEYSFPYLNMVVD

SEQ ID NO: 2246429 - protein, 18 aa, Cryptosporidium parvum
NYTLYILISFGDPGYLKS

SEQ ID NO: 2246430 - protein, 25 aa, Cryptosporidium parvum
NYTRYISYIIRLLPYKSHTSDSSLS

SEQ ID NO: 2246431 - protein, 23 aa, Cryptosporidium parvum
NYTYYKFMPCNPNQQGKLLCNNI

SEQ ID NO: 2246432 - protein, 29 aa, Cryptosporidium parvum
NYVKSNRGLIIKLFLLLIAFIIFYVIFLT

SEQ ID NO: 2246433 - protein, 25 aa, Cryptosporidium parvum
NYYENIWICTLYILNDIRLTDKATY

SEQ ID NO: 2246434 - protein, 21 aa, Cryptosporidium parvum
NYYIQEILGLFLFDSKQVRIE

SEQ ID NO: 2246435 - protein, 30 aa, Cryptosporidium parvum
NYYPPIFESNLIAIPLFMPCNGRVAWGKEH

SEQ ID NO: 2246436 - protein, 18 aa, Cryptosporidium parvum
PADFLWMLITCSWMLLLL

SEQ ID NO: 2246437 - protein, 19 aa, Cryptosporidium parvum
PADLLIPKLKKMMPKTRAI

SEQ ID NO: 2246438 - protein, 29 aa, Cryptosporidium parvum
PAEWSTQILVWISSLLRISDFNGVLKILI

SEQ ID NO: 2246439 - protein, 25 aa, Cryptosporidium parvum
PAFDIIPFWVLICLLFCNYGKITLS

SEQ ID NO: 2246440 - protein, 21 aa, Cryptosporidium parvum
PAKLFDLHYLNAYFKQSDIIK

SEQ ID NO: 2246441 - protein, 46 aa, Cryptosporidium parvum
PALLVMKRIFFCPTFILQYLMLSTTFFLRFFTWSFCWSALILYTNL

SEQ ID NO: 2246442 - protein, 32 aa, Cryptosporidium parvum
PAMAWLFIDIFCTLLPLLLFSFSRPKEYKIKN

SEQ ID NO: 2246443 - protein, 19 aa, Cryptosporidium parvum
PAMIIVILNGYESIYGPIV

SEQ ID NO: 2246444 - protein, 25 aa, Cryptosporidium parvum
PAVLTLLFNYFPLSSAFLGRKHLRL

SEQ ID NO: 2246445 - protein, 25 aa, Cryptosporidium parvum
PCAFFLFITISFVRGILLSLIAFEW

SEQ ID NO: 2246446 - protein, 17 aa, Cryptosporidium parvum
PCCWLDDKFKHLPSLII

SEQ ID NO: 2246447 - protein, 18 aa, Cryptosporidium parvum
PCEYSCELSPWYSNSKKS

SEQ ID NO: 2246448 - protein, 18 aa, Cryptosporidium parvum
PCHPLALCINKEGSYSCV

SEQ ID NO: 2246449 - protein, 20 aa, Cryptosporidium parvum
PCIKYLMQFLHDFVAHWSIE

SEQ ID NO: 2246450 - protein, 29 aa, Cryptosporidium parvum
PCIRNYNELLFYSHFRWLKGEYIKKKRFE

SEQ ID NO: 2246451 - protein, 17 aa, Cryptosporidium parvum
PCMAIMSCFSPKDDLKM

SEQ ID NO: 2246452 - protein, 39 aa, Cryptosporidium parvum
PCMIFHYSVLFSYLVFILKTTPWWLNISDLINLTFINKL

SEQ ID NO: 2246453 - protein, 25 aa, Cryptosporidium parvum
PCNGDFMFHYIYKYEKSLSLTGSFG

SEQ ID NO: 2246454 - protein, 25 aa, Cryptosporidium parvum
PCSDSNLLFELWNGESKPTLIGKFK

SEQ ID NO: 2246455 - protein, 20 aa, Cryptosporidium parvum
PCTDRLLEYFAKKALETGNA

SEQ ID NO: 2246456 - protein, 23 aa, Cryptosporidium parvum
PDCSWIMKALYMNDLQRIDVADP

SEQ ID NO: 2246457 - protein, 19 aa, Cryptosporidium parvum
PDLPIGLKFKENLAMLGLK

SEQ ID NO: 2246458 - protein, 23 aa, Cryptosporidium parvum
PDRIIIMIHHFPTFLNVFINSRM

SEQ ID NO: 2246459 - protein, 31 aa, Cryptosporidium parvum; identical to SEQ ID NO: 2132758

SEQ ID NO: 2246460 - protein, 18 aa, Cryptosporidium parvum
PDSVWSYAYSCVYILDEN

SEQ ID NO: 2246461 - protein, 33 aa, Cryptosporidium parvum
PDSYLLVPCNKPMWFVIGFQEDIFLEYIALFSL

SEQ ID NO: 2246462 - protein, 28 aa, Cryptosporidium parvum
PDVKDLALFYYRLLQFDYKIARNIILND

SEQ ID NO: 2246463 - protein, 20 aa, Cryptosporidium parvum
PECWKIFWRLEENKIQFPLE

SEQ ID NO: 2246464 - protein, 27 aa, Cryptosporidium parvum
PEDSCLFFGTRIFGQLLLEVGNETNNL

SEQ ID NO: 2246465 - protein, 17 aa, Cryptosporidium parvum
PEDSFLKRKLFYCELES

SEQ ID NO: 2246466 - protein, 25 aa, Cryptosporidium parvum
PEGINYLDLPFFKKKLVKKEKKNTG

SEQ ID NO: 2246467 - protein, 20 aa, Cryptosporidium parvum
PEIEYLYLGYPKAYTIRTWN

SEQ ID NO: 2246468 - protein, 19 aa, Cryptosporidium parvum
PEIGHILNLLRYYFKQVNP

SEQ ID NO: 2246469 - protein, 26 aa, Cryptosporidium parvum
PEKALEFPLVLYSSVTTPLILENITS

SEQ ID NO: 2246470 - protein, 26 aa, Cryptosporidium parvum
PEKKPTLPSSMPWAPNSSSFHIPQNS

SEQ ID NO: 2246471 - protein, 37 aa, Cryptosporidium parvum
PEKQYLRYAFAAPPEYLYPVTITIYSSASFLASIKFS

SEQ ID NO: 2246472 - protein, 27 aa, Cryptosporidium parvum
PELIDDLFVKFFYIKPSILSNIICRAL

SEQ ID NO: 2246473 - protein, 24 aa, Cryptosporidium parvum
PELKVFFYDVFKRKPTYYLFHRKP

SEQ ID NO: 2246474 - protein, 22 aa, Cryptosporidium parvum
PELRIYWKLILNSIPETLHIDQ

SEQ ID NO: 2246475 - protein, 29 aa, Cryptosporidium parvum
PELRTGPLFTYIAPLLLVLSITIGKEAID

SEQ ID NO: 2246476 - protein, 25 aa, Cryptosporidium parvum
PEMKRMIFGILIVITNWVCNFDAEV

SEQ ID NO: 2246477 - protein, 26 aa, Cryptosporidium parvum
PFCKNTIETLFFTSNPRYFEYLIDDS

SEQ ID NO: 2246478 - protein, 22 aa, Cryptosporidium parvum
PFEPIKIFRLVTQAGLKNASVD

SEQ ID NO: 2246479 - protein, 26 aa, Cryptosporidium parvum
PFFEVALSMFSEFFKSPLFDENYAEK

SEQ ID NO: 2246480 - protein, 21 aa, Cryptosporidium parvum
PFIFLGLFQSIFLFCSGEEIL

SEQ ID NO: 2246481 - protein, 20 aa, Cryptosporidium parvum
PFIISFRLFNISQEPFFSPD

SEQ ID NO: 2246482 - protein, 25 aa, Cryptosporidium parvum
PFKFRYVFITILIKYLPMFFVVLFV

SEQ ID NO: 2246483 - protein, 30 aa, Cryptosporidium parvum
PFREILLWTTLFSIPIYILPLALVTGLNLN

SEQ ID NO: 2246484 - protein, 17 aa, Cryptosporidium parvum
PFSFVYISSLSLTLYAT

SEQ ID NO: 2246485 - protein, 22 aa, Cryptosporidium parvum
PFSILCITFIFLKISKLLIKKP

SEQ ID NO: 2246486 - protein, 18 aa, Cryptosporidium parvum
PFSKIEEWYENKAYLPYA

SEQ ID NO: 2246487 - protein, 26 aa, Cryptosporidium parvum
PFSWRIEFVIICLTTMFLTVSLFSLI

SEQ ID NO: 2246488 - protein, 31 aa, Cryptosporidium parvum
PFVDINIDILLILLSLSWTRYRDAEKVILEL

SEQ ID NO: 2246489 - protein, 25 aa, Cryptosporidium parvum
PFVSILFFCFLVSNLIYQLLAGIPN

SEQ ID NO: 2246490 - protein, 20 aa, Cryptosporidium parvum
PGCKYTEWSAWSSCDCSGTQ

SEQ ID NO: 2246491 - protein, 25 aa, Cryptosporidium parvum
PGEIPGAALLRKRVYRRLNNIEDIV

SEQ ID NO: 2246492 - protein, 26 aa, Cryptosporidium parvum
PGFLSTFLLLFLINLVLDSTALVIVP

SEQ ID NO: 2246493 - protein, 26 aa, Cryptosporidium parvum
PGGGYYYYYNFYPPPPPMQPEPFPYY

SEQ ID NO: 2246494 - protein, 23 aa, Cryptosporidium parvum
PGKSKFLYYLSSVVLRGPDLRSL

SEQ ID NO: 2246495 - protein, 32 aa, Cryptosporidium parvum
PGNKMKFVDFPLLFLRRFLPKKRSSLNLFINK

SEQ ID NO: 2246496 - protein, 25 aa, Cryptosporidium parvum
PGQALLIADLYYNPLLVSSKLTLYS

SEQ ID NO: 2246497 - protein, 27 aa, Cryptosporidium parvum
PGRVKYWMMLCEAVGNFYHWLSIIKET

SEQ ID NO: 2246498 - protein, 21 aa, Cryptosporidium parvum
PGSNIFFLTMAAHGQLVLSGT

SEQ ID NO: 2246499 - protein, 21 aa, Cryptosporidium parvum
PGTFLILFSIIIDTANIRASK

SEQ ID NO: 2246500 - protein, 18 aa, Cryptosporidium parvum
PGVLIYPQNFREPRVLEA

SEQ ID NO: 2246501 - protein, 18 aa, Cryptosporidium parvum
PHALARTFRSIFCLCREG

SEQ ID NO: 2246502 - protein, 24 aa, Cryptosporidium parvum
PHDFKLLICHIIDKILINYNILAG

SEQ ID NO: 2246503 - protein, 25 aa, Cryptosporidium parvum
PHIRTFSMGMLFRLKKHIICVLSSN

SEQ ID NO: 2246504 - protein, 18 aa, Cryptosporidium parvum
PHPKIKLGFLKWFNEKLP

SEQ ID NO: 2246505 - protein, 18 aa, Cryptosporidium parvum
PHTNIRVFIIKTADILSN

SEQ ID NO: 2246506 - protein, 17 aa, Cryptosporidium parvum
PIHISMLCYAFSLADIV

SEQ ID NO: 2246507 - protein, 28 aa, Cryptosporidium parvum
PIKDLDFPILLHRKLINISLRKLNNINN

SEQ ID NO: 2246508 - protein, 26 aa, Cryptosporidium parvum
PIKTIRLWNVVPISTLLLSASLLYIM

SEQ ID NO: 2246509 - protein, 17 aa, Cryptosporidium parvum
PIKYELFSNLYNSLISS

SEQ ID NO: 2246510 - protein, 26 aa, Cryptosporidium parvum
PILAFSILCLVFWYNLMKVTNVEFSD

SEQ ID NO: 2246511 - protein, 19 aa, Cryptosporidium parvum
PILCQSYCNLWYDACYEDY

SEQ ID NO: 2246512 - protein, 39 aa, Cryptosporidium parvum
PILEKCIFSVYYFYDHLILYDPYVKPFKKSHRKYLHSTF

SEQ ID NO: 2246513 - protein, 33 aa, Cryptosporidium parvum
PILEQILSILTLFENLLPFNIPSINLSINGIPS

SEQ ID NO: 2246514 - protein, 41 aa, Cryptosporidium parvum
PINILRLGSLWQGIFLRFYIWAVLWAIMIIFTTFKTLKVII

SEQ ID NO: 2246515 - protein, 26 aa, Cryptosporidium parvum
PIQLESFLITFFWNCITLQYQNFISH

SEQ ID NO: 2246516 - protein, 31 aa, Cryptosporidium parvum; identical to SEQ ID NO: 2132799

SEQ ID NO: 2246517 - protein, 23 aa, Cryptosporidium parvum
PIRTLEIPFRLKKDFISPLSSPV

SEQ ID NO: 2246518 - protein, 20 aa, Cryptosporidium parvum
PISLIIILISTFSSAFVASR

SEQ ID NO: 2246519 - protein, 17 aa, Cryptosporidium parvum
PISLRLKLNRGTGLLFS

SEQ ID NO: 2246520 - protein, 19 aa, Cryptosporidium parvum
PISRSFIHFIPASNLYTLY

SEQ ID NO: 2246521 - protein, 23 aa, Cryptosporidium parvum
PISSYYIFIKPILQLIVSEAKSK

SEQ ID NO: 2246522 - protein, 25 aa, Cryptosporidium parvum
PISTLEPFWIKLKGGARLNNHVGDI

SEQ ID NO: 2246523 - protein, 46 aa, Cryptosporidium parvum
PITVYIIECIFTYWISNLIFEILKGLIILLFFVKQRKRLCIVLVQH

SEQ ID NO: 2246524 - protein, 28 aa, Cryptosporidium parvum
PIYGQNSWMFLLLSLNQSHYTRKFWTEV

SEQ ID NO: 2246525 - protein, 26 aa, Cryptosporidium parvum
PKEIFQLMIFIAQTCPYYYKYGVCNK

SEQ ID NO: 2246526 - protein, 24 aa, Cryptosporidium parvum
PKHNTILEIYPIPSLILQDINGEK

SEQ ID NO: 2246527 - protein, 27 aa, Cryptosporidium parvum
PKIPFLKCNLFIFKLGFFRLQIDDTGT

SEQ ID NO: 2246528 - protein, 26 aa, Cryptosporidium parvum
PKIPTNFLRLLFNQWLFSNNYCMQLS

SEQ ID NO: 2246529 - protein, 30 aa, Cryptosporidium parvum
PKIVSPLFKAKLIDPLWSSTKFPMNDDSVA

SEQ ID NO: 2246530 - protein, 17 aa, Cryptosporidium parvum
PKIVYLEILLPSLLIED

SEQ ID NO: 2246531 - protein, 24 aa, Cryptosporidium parvum
PKKHLGKYLAKIKKVIPTKKPSKP

SEQ ID NO: 2246532 - protein, 29 aa, Cryptosporidium parvum
PKKSPIMTRDWWIFGNIPHAIFEAICVLS

SEQ ID NO: 2246533 - protein, 33 aa, Cryptosporidium parvum
PKLASLIRRISFALNLIWRFGSIGFIIVRIQDN

SEQ ID NO: 2246534 - protein, 25 aa, Cryptosporidium parvum
PKMFEPPFTLEIFQNIILITSFHSN

SEQ ID NO: 2246535 - protein, 20 aa, Cryptosporidium parvum
PKSIGAWNIHYITTSLLEHI

SEQ ID NO: 2246536 - protein, 37 aa, Cryptosporidium parvum; identical to SEQ ID NO: 2132813

SEQ ID NO: 2246537 - protein, 31 aa, Cryptosporidium parvum; identical to SEQ ID NO: 2132815

SEQ ID NO: 2246538 - protein, 35 aa, Cryptosporidium parvum; identical to SEQ ID NO: 2132816

SEQ ID NO: 2246539 - protein, 18 aa, Cryptosporidium parvum
PKTIIKIQFNDNYYNCLC

SEQ ID NO: 2246540 - protein, 21 aa, Cryptosporidium parvum
PKYISFCFFLGIMGSLHLMSF

SEQ ID NO: 2246541 - protein, 20 aa, Cryptosporidium parvum
PLEMCMFEFSGWVLCDDYNR

SEQ ID NO: 2246542 - protein, 18 aa, Cryptosporidium parvum
PLEVGFTFSFPIVQSKIA

SEQ ID NO: 2246543 - protein, 17 aa, Cryptosporidium parvum
PLFFMKNVEMIFGNAKD

SEQ ID NO: 2246544 - protein, 18 aa, Cryptosporidium parvum
PLFRSIFSEMFVVQFLLE

SEQ ID NO: 2246545 - protein, 18 aa, Cryptosporidium parvum
PLFVDFLNDFKSIIGIFE

SEQ ID NO: 2246546 - protein, 19 aa, Cryptosporidium parvum
PLHWAVRLELPKVVHRLVK

SEQ ID NO: 2246547 - protein, 22 aa, Cryptosporidium parvum
PLIDIQIVLFIAPLLTLGSLCG

SEQ ID NO: 2246548 - protein, 27 aa, Cryptosporidium parvum
PLKQSFFDKVFIKNFKIYPMVIHLTFN

SEQ ID NO: 2246549 - protein, 18 aa, Cryptosporidium parvum
PLNLIIKKAQRIPKKLII

SEQ ID NO: 2246550 - protein, 18 aa, Cryptosporidium parvum
PLNLIRFCDNKQLLNAAI

SEQ ID NO: 2246551 - protein, 24 aa, Cryptosporidium parvum
PLNLSLFISLLLFLYQTFDAADGK

SEQ ID NO: 2246552 - protein, 19 aa, Cryptosporidium parvum
PLPELGNHFLPSPWSENRI

SEQ ID NO: 2246553 - protein, 31 aa, Cryptosporidium parvum
PLPKNLEIFSWWYRFILSTPSRVFNTGKTII

SEQ ID NO: 2246554 - protein, 27 aa, Cryptosporidium parvum
PLQFNSILEFAPWLAPKVLACIQHLIL

SEQ ID NO: 2246555 - protein, 48 aa, Cryptosporidium parvum
PLQQQLYHWNIITLRPNIFAFEYIYLLSPVLSTLTKLLWGFGSVGQNS

SEQ ID NO: 2246556 - protein, 24 aa, Cryptosporidium parvum
PLRENFALPFIWINNMILISIIKY

SEQ ID NO: 2246557 - protein, 18 aa, Cryptosporidium parvum
PLSLPKIRRNPFVEIITI

SEQ ID NO: 2246558 - protein, 34 aa, Cryptosporidium parvum; identical to SEQ ID NO: 2132835

SEQ ID NO: 2246559 - protein, 22 aa, Cryptosporidium parvum
PLTVRPILKFSTLITGVNYAIS

SEQ ID NO: 2246560 - protein, 20 aa, Cryptosporidium parvum
PLTWVVHSKYWFNSVGSELN

SEQ ID NO: 2246561 - protein, 27 aa, Cryptosporidium parvum
PLVLQAGFRRFYICPIVSNCPRISSAT

SEQ ID NO: 2246562 - protein, 23 aa, Cryptosporidium parvum
PLVNSIRNGYWLVLDELNLAPSE

SEQ ID NO: 2246563 - protein, 25 aa, Cryptosporidium parvum
PMAKLLFSFIYLISTYTQSLYCIDN

SEQ ID NO: 2246564 - protein, 28 aa, Cryptosporidium parvum
PMDYSSITNFLWPRIVFAISSSSSSALS

SEQ ID NO: 2246565 - protein, 18 aa, Cryptosporidium parvum
PMFIFRSRITLTDIHNGR

SEQ ID NO: 2246566 - protein, 21 aa, Cryptosporidium parvum
PMFLNTLRLYQTMKRYPILTH

SEQ ID NO: 2246567 - protein, 19 aa, Cryptosporidium parvum
PMKKPLKWFNSNLLARIVG

SEQ ID NO: 2246568 - protein, 24 aa, Cryptosporidium parvum
PMLAPTFFSLHPCFVSEPINFYSI

SEQ ID NO: 2246569 - protein, 31 aa, Cryptosporidium parvum
PMNDDSVAPLLIFKWFDQTTLDITLLSASIC

SEQ ID NO: 2246570 - protein, 26 aa, Cryptosporidium parvum
PNAISSSYLLFGPKINLQGPFASLTF

SEQ ID NO: 2246571 - protein, 22 aa, Cryptosporidium parvum
PNARKCLTPLRVLPIGVAQSVP

SEQ ID NO: 2246572 - protein, 33 aa, Cryptosporidium parvum
PNCDDLVLMITSPKYLLFITYRLKANRNEFNKE

SEQ ID NO: 2246573 - protein, 22 aa, Cryptosporidium parvum
PNCDKLKWLRDKYPSIYRQTMR

SEQ ID NO: 2246574 - protein, 32 aa, Cryptosporidium parvum
PNDCRIWYIIQWLICMLITLSFYTLSYIDKKN

SEQ ID NO: 2246575 - protein, 24 aa, Cryptosporidium parvum
PNDGIPFWTFTISRNASCPYMYLT

SEQ ID NO: 2246576 - protein, 25 aa, Cryptosporidium parvum
PNEMRDYWLKFKDKISKIILDSRKI

SEQ ID NO: 2246577 - protein, 25 aa, Cryptosporidium parvum
PNFKQKFIFAPKILEILKMEKAIMA

SEQ ID NO: 2246578 - protein, 27 aa, Cryptosporidium parvum
PNFTKFVGMIYLFFLDIFRVEKDLNLE

SEQ ID NO: 2246579 - protein, 17 aa, Cryptosporidium parvum
PNGLTLELSLTKLPEKL

SEQ ID NO: 2246580 - protein, 24 aa, Cryptosporidium parvum
PNIELTMYDLLYNSSKKLKNKIES

SEQ ID NO: 2246581 - protein, 23 aa, Cryptosporidium parvum
PNIENIFREFFNLANKLQNNNEF

SEQ ID NO: 2246582 - protein, 17 aa, Cryptosporidium parvum
PNIFYLIKNNTVEFLYN

SEQ ID NO: 2246583 - protein, 34 aa, Cryptosporidium parvum; identical to SEQ ID NO: 2132843

SEQ ID NO: 2246584 - protein, 23 aa, Cryptosporidium parvum
PNNFDLFKSIREKSLRSKIEKLE

SEQ ID NO: 2246585 - protein, 27 aa, Cryptosporidium parvum
PNNYVLMSVRNIIYQLALPHSMLQENA

SEQ ID NO: 2246586 - protein, 26 aa, Cryptosporidium parvum
PNSHSKLPWFPTLSSALYLTEDASPF

SEQ ID NO: 2246587 - protein, 23 aa, Cryptosporidium parvum
PNSNPVFGIILVAVGFAVSSIPE

SEQ ID NO: 2246588 - protein, 24 aa, Cryptosporidium parvum
PNSPFSLLLLNYSFFNYIQVNKNY

SEQ ID NO: 2246589 - protein, 24 aa, Cryptosporidium parvum
PNVFSLIPIIYLNSKLWNVQKLLY

SEQ ID NO: 2246590 - protein, 17 aa, Cryptosporidium parvum
PNYRFPSALDRLAPLLT

SEQ ID NO: 2246591 - protein, 23 aa, Cryptosporidium parvum
PPALALRWLMNLYSLTNSYVKLS

SEQ ID NO: 2246592 - protein, 17 aa, Cryptosporidium parvum
PPDTLYLGKFSRSKKGD

SEQ ID NO: 2246593 - protein, 18 aa, Cryptosporidium parvum
PPFNLKSVPIMLGISLIP

SEQ ID NO: 2246594 - protein, 24 aa, Cryptosporidium parvum
PPGFNFAYDIWRKQKNKKTMEVIQ

SEQ ID NO: 2246595 - protein, 17 aa, Cryptosporidium parvum
PPILFKEMKSPIVGVGD

SEQ ID NO: 2246596 - protein, 20 aa, Cryptosporidium parvum
PPIRRIYDLKISLNKFSINL

SEQ ID NO: 2246597 - protein, 17 aa, Cryptosporidium parvum
PPKKYHLDLPKIYLNNL

SEQ ID NO: 2246598 - protein, 21 aa, Cryptosporidium parvum
PPMLHNWFFKKFSTKSSYIWL

SEQ ID NO: 2246599 - protein, 39 aa, Cryptosporidium parvum
PPNSWIHKFAVPGIPSRCILLIYIGLSSPVYFGSVWLRV

SEQ ID NO: 2246600 - protein, 23 aa, Cryptosporidium parvum
PPRTLSCSLYYRLKVVKISCKNT

SEQ ID NO: 2246601 - protein, 18 aa, Cryptosporidium parvum
PPVDLIDVSIYSSIGEIL

SEQ ID NO: 2246602 - protein, 27 aa, Cryptosporidium parvum
PPWVLQAFFVIFFGFLADKLVSSSVKP

SEQ ID NO: 2246603 - protein, 33 aa, Cryptosporidium parvum
PQEQFLELIPNSRYSPVLPLQKSGFIILNDNTP

SEQ ID NO: 2246604 - protein, 22 aa, Cryptosporidium parvum
PQLVALFHSFVGLAAMLISFAN

SEQ ID NO: 2246605 - protein, 25 aa, Cryptosporidium parvum
PQNQSFTFNLLLSSLTFNDEQNPSF

SEQ ID NO: 2246606 - protein, 20 aa, Cryptosporidium parvum
PQPFLACCAANMLSFDGICR

SEQ ID NO: 2246607 - protein, 23 aa, Cryptosporidium parvum
PQPLKRLVSFLKYEYVFDHDLET

SEQ ID NO: 2246608 - protein, 20 aa, Cryptosporidium parvum
PQQKIHCHVLMKGNLHSGAI

SEQ ID NO: 2246609 - protein, 24 aa, Cryptosporidium parvum
PQRRKIPIALISLGLNSPFLSFKN

SEQ ID NO: 2246610 - protein, 18 aa, Cryptosporidium parvum
PQSWTFSVYKYRSNSIIN

SEQ ID NO: 2246611 - protein, 20 aa, Cryptosporidium parvum
PQWIILLFPSFIVNLIGCMI

SEQ ID NO: 2246612 - protein, 26 aa, Cryptosporidium parvum
PRDLSIIEKLIFITRKINVEEAIISE

SEQ ID NO: 2246613 - protein, 24 aa, Cryptosporidium parvum
PRDLSPNQIEFLRKIDLRKQNRFS

SEQ ID NO: 2246614 - protein, 23 aa, Cryptosporidium parvum
PRFEKWPFFDKWVISFQRQEYGI

SEQ ID NO: 2246615 - protein, 19 aa, Cryptosporidium parvum
PRLELFYGYLNIPLRYISL

SEQ ID NO: 2246616 - protein, 31 aa, Cryptosporidium parvum
PRLHNTVFSTFLPLIDRYLELSISSQKSNFT

SEQ ID NO: 2246617 - protein, 25 aa, Cryptosporidium parvum
PRPSIFKYSWLKMTRRYLSLSLKEV

SEQ ID NO: 2246618 - protein, 18 aa, Cryptosporidium parvum
PRQDLLTGILLQPLLRNY

SEQ ID NO: 2246619 - protein, 19 aa, Cryptosporidium parvum
PRQKSLLLMIPLIEMMNQL

SEQ ID NO: 2246620 - protein, 24 aa, Cryptosporidium parvum
PRTDWRVSNILPLKSRHFYKDITN

SEQ ID NO: 2246621 - protein, 30 aa, Cryptosporidium parvum
PSDFDLVLERYIFGILTFLSEKILNNDEFS

SEQ ID NO: 2246622 - protein, 25 aa, Cryptosporidium parvum
PSDHKKFFFFLVEKNFDTDKALELV

SEQ ID NO: 2246623 - protein, 25 aa, Cryptosporidium parvum
PSFEKYRLWSLVDISQQKIIQEFVE

SEQ ID NO: 2246624 - protein, 21 aa, Cryptosporidium parvum
PSFTKLFIDSFSKYFLVIIYL

SEQ ID NO: 2246625 - protein, 17 aa, Cryptosporidium parvum
PSGALKLPGRHFLNALM

SEQ ID NO: 2246626 - protein, 17 aa, Cryptosporidium parvum
PSIFHTTITNYNKFISQ

SEQ ID NO: 2246627 - protein, 19 aa, Cryptosporidium parvum
PSIIRHKIDLVLESDQSLL

SEQ ID NO: 2246628 - protein, 29 aa, Cryptosporidium parvum
PSKNNIHYLYTVLLPFLNERNLYDNWITT

SEQ ID NO: 2246629 - protein, 18 aa, Cryptosporidium parvum
PSLILTSGWIFIRCALGG

SEQ ID NO: 2246630 - protein, 33 aa, Cryptosporidium parvum
PSLLIFIFTLFYPLLLIFLWFLFREKNLLVDPL

SEQ ID NO: 2246631 - protein, 25 aa, Cryptosporidium parvum
PSLSLKSIIPFLQSLDPNTYYRNVE

SEQ ID NO: 2246632 - protein, 17 aa, Cryptosporidium parvum
PSMLQQPQLQRRVSLHP

SEQ ID NO: 2246633 - protein, 37 aa, Cryptosporidium parvum
PSMRINSYIYIPANLLLLIGIYYLPLEEICNLIEIII

SEQ ID NO: 2246634 - protein, 17 aa, Cryptosporidium parvum
PSRFPLISGDKRGKHKK

SEQ ID NO: 2246635 - protein, 26 aa, Cryptosporidium parvum
PSRNQFVWCLLWTTTEYTRTFARFRI

SEQ ID NO: 2246636 - protein, 25 aa, Cryptosporidium parvum
PSSIYRRLLTFILEKHPNIGKDKAS

SEQ ID NO: 2246637 - protein, 28 aa, Cryptosporidium parvum
PSSLESLYFRINFAYRFSFIVCCQLNQV

SEQ ID NO: 2246638 - protein, 20 aa, Cryptosporidium parvum
PSSYFYWQTPDWDSLSGYIS

SEQ ID NO: 2246639 - protein, 19 aa, Cryptosporidium parvum
PSTPYYILALSLTGTCGQF

SEQ ID NO: 2246640 - protein, 26 aa, Cryptosporidium parvum
PSTRSKLLLMLRIRYRILKLKNEDKD

SEQ ID NO: 2246641 - protein, 19 aa, Cryptosporidium parvum
PSYIKPMVFSWPSGNSFLE

SEQ ID NO: 2246642 - protein, 21 aa, Cryptosporidium parvum
PSYYNLSFYKLDTLDITKLYD

SEQ ID NO: 2246643 - protein, 23 aa, Cryptosporidium parvum
PTDGWMLLGMKRYLMRQMAKKLC

SEQ ID NO: 2246644 - protein, 27 aa, Cryptosporidium parvum
PTETNFFNLVTLLKSLIFSKIRLMKNK

SEQ ID NO: 2246645 - protein, 27 aa, Cryptosporidium parvum
PTILFTIIYSLMWFVRLYFTVNMKSIL

SEQ ID NO: 2246646 - protein, 44 aa, Cryptosporidium parvum
PTINVIIIKIIIILKEIWIGMGIKNLLLINILRNKELIISYDIG

SEQ ID NO: 2246647 - protein, 19 aa, Cryptosporidium parvum
PTKHYLYPVHTSKSFIFIN

SEQ ID NO: 2246648 - protein, 17 aa, Cryptosporidium parvum
PTKKIHLSLIPDLSLLS

SEQ ID NO: 2246649 - protein, 20 aa, Cryptosporidium parvum
PTYLCWHEDLLVLVIGFENS

SEQ ID NO: 2246650 - protein, 34 aa, Cryptosporidium parvum
PVDPKTGFPIDPISYLPFAKNGELIDPISGKYFS

SEQ ID NO: 2246651 - protein, 29 aa, Cryptosporidium parvum
PVEYKEEISLLWRLLTLLVGNSSKNNYTT

SEQ ID NO: 2246652 - protein, 24 aa, Cryptosporidium parvum
PVFICIPCLIWVWCSDHCLQILKY

SEQ ID NO: 2246653 - protein, 33 aa, Cryptosporidium parvum
PVFSLKVRAKFLKLLSISLFSPLIPMTVLSCFI

SEQ ID NO: 2246654 - protein, 27 aa, Cryptosporidium parvum
PVGTEMYIPSRFLLGLIPQIFLETHEF

SEQ ID NO: 2246655 - protein, 47 aa, Cryptosporidium parvum; identical to SEQ ID NO: 2132885

SEQ ID NO: 2246656 - protein, 18 aa, Cryptosporidium parvum
PVIILQQAFPFGFLTRVS

SEQ ID NO: 2246657 - protein, 20 aa, Cryptosporidium parvum
PVIYPPSLWDLRCNAQLILS

SEQ ID NO: 2246658 - protein, 17 aa, Cryptosporidium parvum
PVLTIGILTTHIFKLFD

SEQ ID NO: 2246659 - protein, 19 aa, Cryptosporidium parvum
PVNGMFLLDLSKLEFKSFP

SEQ ID NO: 2246660 - protein, 19 aa, Cryptosporidium parvum
PVPFEMFFDKVFIYSNDME

SEQ ID NO: 2246661 - protein, 25 aa, Cryptosporidium parvum
PVRLLFSLFFIISVLGSVNSLLKLF

SEQ ID NO: 2246662 - protein, 19 aa, Cryptosporidium parvum
PVRVPLVFELAYLPLMMRV

SEQ ID NO: 2246663 - protein, 19 aa, Cryptosporidium parvum
PVSLMLFDNSTGVMYDPNT

SEQ ID NO: 2246664 - protein, 17 aa, Cryptosporidium parvum
PVVIYLLSNQFSSEKKK

SEQ ID NO: 2246665 - protein, 18 aa, Cryptosporidium parvum
PVVLLYKYSAFSPAFDII

SEQ ID NO: 2246666 - protein, 24 aa, Cryptosporidium parvum
PVYFGSVWLRVNGTRWILLENTIT

SEQ ID NO: 2246667 - protein, 21 aa, Cryptosporidium parvum
PWIEREFVIKIFGYESPQRHL

SEQ ID NO: 2246668 - protein, 21 aa, Cryptosporidium parvum
PWIHGGRLIWYKTGKNSSNNY

SEQ ID NO: 2246669 - protein, 20 aa, Cryptosporidium parvum
PWKLKFLNYFIPPLYDCYPS

SEQ ID NO: 2246670 - protein, 25 aa, Cryptosporidium parvum
PWSNRLRMLMLTGKLNIIFISSIIF

SEQ ID NO: 2246671 - protein, 23 aa, Cryptosporidium parvum
PWVNSCFITIISQSLDLLLRGYL

SEQ ID NO: 2246672 - protein, 31 aa, Cryptosporidium parvum
PWYLQSTFIFSFVGIIFLLIAGAIAIFYIAA

SEQ ID NO: 2246673 - protein, 26 aa, Cryptosporidium parvum
PYIYGNKLFLYLYRLKVICTEKLGYY

SEQ ID NO: 2246674 - protein, 25 aa, Cryptosporidium parvum
PYKYPQDTLLLPILFRYVKESNNNN

SEQ ID NO: 2246675 - protein, 20 aa, Cryptosporidium parvum
PYLLILHLICLTVETYKFIN

SEQ ID NO: 2246676 - protein, 22 aa, Cryptosporidium parvum
PYLSSLRIFVALRIFHFNNKLN

SEQ ID NO: 2246677 - protein, 25 aa, Cryptosporidium parvum
PYNIPPFLHFIFGKEPFLIPDSQFH

SEQ ID NO: 2246678 - protein, 19 aa, Cryptosporidium parvum
PYPFGFDPVWKGAVNEMSF

SEQ ID NO: 2246679 - protein, 17 aa, Cryptosporidium parvum
PYREIWLEISLTVPARL

SEQ ID NO: 2246680 - protein, 37 aa, Cryptosporidium parvum
PYWSNRALVFISLWLECFFLCFFYRSTKSSFEQFFYY

SEQ ID NO: 2246681 - protein, 25 aa, Cryptosporidium parvum
QAARPVISYTFKQLRHSLLPKHFKS

SEQ ID NO: 2246682 - protein, 29 aa, Cryptosporidium parvum
QAESILSVLRLIVYLIKSVFNIFSNISSN

SEQ ID NO: 2246683 - protein, 19 aa, Cryptosporidium parvum
QALFLIFLSGLIDAINSSD

SEQ ID NO: 2246684 - protein, 30 aa, Cryptosporidium parvum
QAMFFLNIIKIIFIIHFFTLIHGTEFKLDH

SEQ ID NO: 2246685 - protein, 26 aa, Cryptosporidium parvum
QANLNNFRFIFSLATFSVSAPYIQRI

SEQ ID NO: 2246686 - protein, 38 aa, Cryptosporidium parvum; identical to SEQ ID NO: 2132908

SEQ ID NO: 2246687 - protein, 26 aa, Cryptosporidium parvum
QAPPSIPAIPIALLVSYIKGAHLIID

SEQ ID NO: 2246688 - protein, 34 aa, Cryptosporidium parvum; identical to SEQ ID NO: 2132909

SEQ ID NO: 2246689 - protein, 32 aa, Cryptosporidium parvum
QAVNMIAPIFPKLLEFLYFNASEKYLQDSLLS

SEQ ID NO: 2246690 - protein, 21 aa, Cryptosporidium parvum
QAVVLPFISPIPFGSRIQPMN

SEQ ID NO: 2246691 - protein, 22 aa, Cryptosporidium parvum
QCGFKLFSRRLARVIFPSLHIK

SEQ ID NO: 2246692 - protein, 25 aa, Cryptosporidium parvum
QCKESGFIQLIEPKGAPLLYVDGDG

SEQ ID NO: 2246693 - protein, 28 aa, Cryptosporidium parvum
QCNAYCTYFYFPLITDMRIMSSIQLLAH

SEQ ID NO: 2246694 - protein, 23 aa, Cryptosporidium parvum
QCSGNVYFLLLNSNKPYENLGVS

SEQ ID NO: 2246695 - protein, 27 aa, Cryptosporidium parvum
QCVRFHPWNPEFLLSAGIDSIIKLSII

SEQ ID NO: 2246696 - protein, 40 aa, Cryptosporidium parvum
QDCEQILKYYVTFSSDSFLYILMEYAEGGSLYGLYSKYGS

SEQ ID NO: 2246697 - protein, 17 aa, Cryptosporidium parvum
QDEEIVQLLLGLNPDEN

SEQ ID NO: 2246698 - protein, 21 aa, Cryptosporidium parvum
QDELRWKIIGVLFRCVTRKDL

SEQ ID NO: 2246699 - protein, 18 aa, Cryptosporidium parvum
QDFDILRLLLRCEDLDVN

SEQ ID NO: 2246700 - protein, 22 aa, Cryptosporidium parvum
QDKLVDVFVEKLSFEIPSTVPF

SEQ ID NO: 2246701 - protein, 23 aa, Cryptosporidium parvum
QDKNRFPLLRILRGKDYGPATKF

SEQ ID NO: 2246702 - protein, 25 aa, Cryptosporidium parvum
QDLKKLYLEILRRYYLKIFEEKKSL

SEQ ID NO: 2246703 - protein, 18 aa, Cryptosporidium parvum
QDLRRILYSLNRGSLRSF

SEQ ID NO: 2246704 - protein, 41 aa, Cryptosporidium parvum
QDRSMFYFNTRIADIYMLGIIMFWIWSDGGIWKYSDTRQDH

SEQ ID NO: 2246705 - protein, 25 aa, Cryptosporidium parvum
QDSSQYIWVLPKNTSPLSLSNADLL

SEQ ID NO: 2246706 - protein, 22 aa, Cryptosporidium parvum
QDVIIPELLLMLSNVQLELCSA

SEQ ID NO: 2246707 - protein, 22 aa, Cryptosporidium parvum
QEDNWVSIALKWGPGAYDSGSI

SEQ ID NO: 2246708 - protein, 25 aa, Cryptosporidium parvum
QEESCFKLIFYEIPLISWISETELF

SEQ ID NO: 2246709 - protein, 21 aa, Cryptosporidium parvum
QEGNYFPWTARFHPFISTINN

SEQ ID NO: 2246710 - protein, 27 aa, Cryptosporidium parvum
QEHYCSIGYIPLDIPAPRGPLFVLGNN

SEQ ID NO: 2246711 - protein, 24 aa, Cryptosporidium parvum
QEILGSPFWMAPEIILGSGTRIQT

SEQ ID NO: 2246712 - protein, 26 aa, Cryptosporidium parvum
QEINSTLYLLVLRNLSIIFQQIKSKG

SEQ ID NO: 2246713 - protein, 28 aa, Cryptosporidium parvum
QELCILLEIYWRRMQIRFPIFFGGSMTE

SEQ ID NO: 2246714 - protein, 20 aa, Cryptosporidium parvum
QELPRLIKIIIEVILFGMKP

SEQ ID NO: 2246715 - protein, 25 aa, Cryptosporidium parvum
QEPLKRMPYLNLLGLLIINSSFILR

SEQ ID NO: 2246716 - protein, 26 aa, Cryptosporidium parvum
QETCLMLRMLLHLYSGMRTRTQFLNI

SEQ ID NO: 2246717 - protein, 23 aa, Cryptosporidium parvum
QETFPPVLSCPSGFQKNSQNLNY

SEQ ID NO: 2246718 - protein, 37 aa, Cryptosporidium parvum
QETLFLWYSFYFLIIVSLYIIFRRLGIIYILIQKPII

SEQ ID NO: 2246719 - protein, 41 aa, Cryptosporidium parvum
QFASDLLLKLYLIPMQKSELLCRLFFLYRGLRLTEERNEPT

SEQ ID NO: 2246720 - protein, 19 aa, Cryptosporidium parvum
QFEIFFRSKFFNKRYFGLI

SEQ ID NO: 2246721 - protein, 23 aa, Cryptosporidium parvum
QFFFSMCFWGLFSAVLGPLSQKI

SEQ ID NO: 2246722 - protein, 28 aa, Cryptosporidium parvum
QFFTDQIFSTFFKFGSPLFRVKNIPLRL

SEQ ID NO: 2246723 - protein, 21 aa, Cryptosporidium parvum
QFFWGYSLAILAFLTSILLPL

SEQ ID NO: 2246724 - protein, 19 aa, Cryptosporidium parvum
QFGKLYRYFEHSLTTSFTS

SEQ ID NO: 2246725 - protein, 24 aa, Cryptosporidium parvum
QFHNKPFITSILYQICQLIMNPDT

SEQ ID NO: 2246726 - protein, 17 aa, Cryptosporidium parvum
QFLYPLYEPGEGPESPN

SEQ ID NO: 2246727 - protein, 20 aa, Cryptosporidium parvum
QFRLQFIQQWSDIIAKIINK

SEQ ID NO: 2246728 - protein, 18 aa, Cryptosporidium parvum
QFSFRWMNCLLTREFPTK

SEQ ID NO: 2246729 - protein, 29 aa, Cryptosporidium parvum
QFSSCEYILFITLVFLISISIMYRNQYDT

SEQ ID NO: 2246730 - protein, 20 aa, Cryptosporidium parvum
QFVTGYWGGGVFGGDNQYKF

SEQ ID NO: 2246731 - protein, 19 aa, Cryptosporidium parvum
QFYFNPCIISIFGESNNNS

SEQ ID NO: 2246732 - protein, 26 aa, Cryptosporidium parvum
QFYLINNLFFILKVLKTLISSNKTHR

SEQ ID NO: 2246733 - protein, 17 aa, Cryptosporidium parvum
QGDGFLTPEDLFRMFFG

SEQ ID NO: 2246734 - protein, 23 aa, Cryptosporidium parvum
QGEILKYYLGWSLSSALGSNIEM

SEQ ID NO: 2246735 - protein, 24 aa, Cryptosporidium parvum
QGFSWLTILVIFLNAYGGFIVVGV

SEQ ID NO: 2246736 - protein, 21 aa, Cryptosporidium parvum
QGHLIELMILLRFSDNRTSKN

SEQ ID NO: 2246737 - protein, 23 aa, Cryptosporidium parvum
QGILLTIFCAFLSSLSLYLLSSI

SEQ ID NO: 2246738 - protein, 28 aa, Cryptosporidium parvum
QGIMDLRMLLLQLYFKDGQFIDSAISRL

SEQ ID NO: 2246739 - protein, 36 aa, Cryptosporidium parvum
QGKKSNLLQFLWIRFYGFRVIFRKFNDLLLTSVPKN

SEQ ID NO: 2246740 - protein, 21 aa, Cryptosporidium parvum
QGKMIFLLGLLEFWENRGHSK

SEQ ID NO: 2246741 - protein, 23 aa, Cryptosporidium parvum
QGLARLLELLCFCFNVTLGEKLL

SEQ ID NO: 2246742 - protein, 23 aa, Cryptosporidium parvum
QGNLVLRYLYRHLGFGLQIEPKY

SEQ ID NO: 2246743 - protein, 21 aa, Cryptosporidium parvum
QGPGIINTRAEYRPPNFHLDS

SEQ ID NO: 2246744 - protein, 27 aa, Cryptosporidium parvum
QGPVVAFLEAYYWKEGWILPKTTLDLQ

SEQ ID NO: 2246745 - protein, 22 aa, Cryptosporidium parvum
QGSFPIKLFYTSNIPIILQTAL

SEQ ID NO: 2246746 - protein, 25 aa, Cryptosporidium parvum
QGSLVILLGLILIVVTLYSNVGYYE

SEQ ID NO: 2246747 - protein, 28 aa, Cryptosporidium parvum
QGSVRSQWDFLLQEMTWMSKDYYEERRW

SEQ ID NO: 2246748 - protein, 19 aa, Cryptosporidium parvum
QGYFKPLIALIAPKNIQEH

SEQ ID NO: 2246749 - protein, 21 aa, Cryptosporidium parvum
QGYFYVFHEILRPSGRLFLKS

SEQ ID NO: 2246750 - protein, 21 aa, Cryptosporidium parvum
QGYGCDMPLLQVSFSLAERFG

SEQ ID NO: 2246751 - protein, 21 aa, Cryptosporidium parvum
QHAPKLLSVYLQILNSLLSKK

SEQ ID NO: 2246752 - protein, 19 aa, Cryptosporidium parvum
QHCSFLRLGAFLENDFDIE

SEQ ID NO: 2246753 - protein, 22 aa, Cryptosporidium parvum
QHPKLCFFPRTKTFGISHGFEP

SEQ ID NO: 2246754 - protein, 17 aa, Cryptosporidium parvum
QHRGFGKTLLRAAEYLA

SEQ ID NO: 2246755 - protein, 30 aa, Cryptosporidium parvum
QIALQMVILHYYFTYYSNLDLPIQLLDNFL

SEQ ID NO: 2246756 - protein, 31 aa, Cryptosporidium parvum
QIDKFNSINIPIFIDFKLGGFNRLLNNDLVC

SEQ ID NO: 2246757 - protein, 22 aa, Cryptosporidium parvum
QIELVILNLIPEMTILISIREL

SEQ ID NO: 2246758 - protein, 18 aa, Cryptosporidium parvum
QIFNLPLHYLILAGIQAL

SEQ ID NO: 2246759 - protein, 29 aa, Cryptosporidium parvum
QIHSIIQMIIILPYIFEKLLLIIELDQER

SEQ ID NO: 2246760 - protein, 27 aa, Cryptosporidium parvum
QIINNLHWGFIVNFVLSLSSIIHYNAK

SEQ ID NO: 2246761 - protein, 18 aa, Cryptosporidium parvum
QIIPFCSSIIRGDTQSDK

SEQ ID NO: 2246762 - protein, 19 aa, Cryptosporidium parvum
QIIQCVSLLSWLSNIIISP

SEQ ID NO: 2246763 - protein, 20 aa, Cryptosporidium parvum
QIIQLPHLLQNPNPPSPTHV

SEQ ID NO: 2246764 - protein, 33 aa, Cryptosporidium parvum; identical to SEQ ID NO: 2132956

SEQ ID NO: 2246765 - protein, 21 aa, Cryptosporidium parvum
QIKFLKLGDIYLIQSLNLVGS

SEQ ID NO: 2246766 - protein, 17 aa, Cryptosporidium parvum
QIKIGDFGLARLMFDGD

SEQ ID NO: 2246767 - protein, 22 aa, Cryptosporidium parvum
QIKQKPFLIWKTQNLTIGHYIL

SEQ ID NO: 2246768 - protein, 20 aa, Cryptosporidium parvum
QILAVLIPLFLDDSKKMKGG

SEQ ID NO: 2246769 - protein, 24 aa, Cryptosporidium parvum
QILEFIVTLLNFCPASFWGLGWDR

SEQ ID NO: 2246770 - protein, 19 aa, Cryptosporidium parvum
QILENIFTPFILALSQKEL

SEQ ID NO: 2246771 - protein, 17 aa, Cryptosporidium parvum
QILFPPGTNAKLKCSSG

SEQ ID NO: 2246772 - protein, 19 aa, Cryptosporidium parvum
QILGLLEIFFFVGNGIVTT

SEQ ID NO: 2246773 - protein, 22 aa, Cryptosporidium parvum
QILLLLGILSRYSIRISMNLNE

SEQ ID NO: 2246774 - protein, 23 aa, Cryptosporidium parvum
QINKIRTTVWFTTSVMLSIPEQT

SEQ ID NO: 2246775 - protein, 18 aa, Cryptosporidium parvum
QIPKVWKSSPIWLHLKPS

SEQ ID NO: 2246776 - protein, 30 aa, Cryptosporidium parvum
QIQKEILLLFYSIMKTLIIFIFVTNNIISN

SEQ ID NO: 2246777 - protein, 26 aa, Cryptosporidium parvum
QIRDSACYIIWSLARGVPPKVLKPYS

SEQ ID NO: 2246778 - protein, 23 aa, Cryptosporidium parvum
QIRNLILSAFPRNMKLPDPFLPT

SEQ ID NO: 2246779 - protein, 28 aa, Cryptosporidium parvum
QIRTLTMPIIILLDRLASLWFGSYIHIT

SEQ ID NO: 2246780 - protein, 27 aa, Cryptosporidium parvum
QIRYLSFIQFIISPLKYQLLLIDEPPY

SEQ ID NO: 2246781 - protein, 30 aa, Cryptosporidium parvum; identical to SEQ ID NO: 2132964

SEQ ID NO: 2246782 - protein, 17 aa, Cryptosporidium parvum
QITQTFIPNFYAVVVVD

SEQ ID NO: 2246783 - protein, 26 aa, Cryptosporidium parvum
QITQYLYIELEFLIAYSSIASLLGNI

SEQ ID NO: 2246784 - protein, 24 aa, Cryptosporidium parvum
QITRLLVLAFTNYLLEKDSENSPI

SEQ ID NO: 2246785 - protein, 26 aa, Cryptosporidium parvum
QITRYNPYFLGWILSELIALLTNQST

SEQ ID NO: 2246786 - protein, 17 aa, Cryptosporidium parvum
QIVGVFCFGILSLSRRT

SEQ ID NO: 2246787 - protein, 20 aa, Cryptosporidium parvum
QIVLRIRKYNSFGGAEFFIS

SEQ ID NO: 2246788 - protein, 39 aa, Cryptosporidium parvum; identical to SEQ ID NO: 2132973

SEQ ID NO: 2246789 - protein, 34 aa, Cryptosporidium parvum; identical to SEQ ID NO: 2195745

SEQ ID NO: 2246790 - protein, 20 aa, Cryptosporidium parvum
QIWLFALLIVVIICEIRCKV

SEQ ID NO: 2246791 - protein, 23 aa, Cryptosporidium parvum
QIWRFLTSFFFVGPFSIGWIMSQ

SEQ ID NO: 2246792 - protein, 25 aa, Cryptosporidium parvum
QIYNLLLVTYMLFCGLEAFFSSIFP

SEQ ID NO: 2246793 - protein, 19 aa, Cryptosporidium parvum
QKALLKDLVFLLGNREFDV

SEQ ID NO: 2246794 - protein, 28 aa, Cryptosporidium parvum
QKANQFQLFLNWSILRLMEEDFSYCIKN

SEQ ID NO: 2246795 - protein, 24 aa, Cryptosporidium parvum
QKDHLKLYKKKLFVLRKILPELVI

SEQ ID NO: 2246796 - protein, 24 aa, Cryptosporidium parvum
QKDLPFPVFMSWAQQLIGMAIMST

SEQ ID NO: 2246797 - protein, 33 aa, Cryptosporidium parvum; identical to SEQ ID NO: 2132980

SEQ ID NO: 2246798 - protein, 22 aa, Cryptosporidium parvum
QKIYILFLFYLACSSSLTIVSS

SEQ ID NO: 2246799 - protein, 36 aa, Cryptosporidium parvum
QKKPSLIYTLILTFKWELFIIFSLVVLADTCLLAQS

SEQ ID NO: 2246800 - protein, 20 aa, Cryptosporidium parvum
QKMFFITFFIFRISYHIIGY

SEQ ID NO: 2246801 - protein, 21 aa, Cryptosporidium parvum
QKMKSFIFPIKASRVYIRKEE

SEQ ID NO: 2246802 - protein, 18 aa, Cryptosporidium parvum
QKNLLINPFLLINNRNQL

SEQ ID NO: 2246803 - protein, 24 aa, Cryptosporidium parvum
QKNRKSFFALIKKNNLYIEDYNSA

SEQ ID NO: 2246804 - protein, 28 aa, Cryptosporidium parvum
QKQDLVALGYIILALCCGSLTIINDLNH

SEQ ID NO: 2246805 - protein, 30 aa, Cryptosporidium parvum
QKQWRVNLIFKSFLFYFKSKITSGYSTLIK

SEQ ID NO: 2246806 - protein, 21 aa, Cryptosporidium parvum
QKRMLLLLRLALNSQKYRLLL

SEQ ID NO: 2246807 - protein, 18 aa, Cryptosporidium parvum
QKRSWPIDPLDNIINYIS

SEQ ID NO: 2246808 - protein, 26 aa, Cryptosporidium parvum
QKRVLLMIILLLISYYIYIGGFTYSK

SEQ ID NO: 2246809 - protein, 23 aa, Cryptosporidium parvum
QKSNLRALWGILQCNLLKNDAYN

SEQ ID NO: 2246810 - protein, 26 aa, Cryptosporidium parvum
QKTFAYMTLWPIAYSVKRSIRHSWQE

SEQ ID NO: 2246811 - protein, 45 aa, Cryptosporidium parvum
QKTFYYSYAIGIWRLIRTLFCGILLMFVLFICPTISRILNFELPL

SEQ ID NO: 2246812 - protein, 35 aa, Cryptosporidium parvum
QKYITLALLISVPWMFFPKPLYLIYKSRKQKKASE

SEQ ID NO: 2246813 - protein, 31 aa, Cryptosporidium parvum; identical to SEQ ID NO: 2132990

SEQ ID NO: 2246814 - protein, 21 aa, Cryptosporidium parvum
QLAFLDTLCFLASLRPSPIGI

SEQ ID NO: 2246815 - protein, 21 aa, Cryptosporidium parvum
QLDILSLLEHIWIIFQNYYIN

SEQ ID NO: 2246816 - protein, 19 aa, Cryptosporidium parvum
QLEFTMLDPYIRTYLKQSE

SEQ ID NO: 2246817 - protein, 18 aa, Cryptosporidium parvum
QLEKIHFGIPWEFRTYKT

SEQ ID NO: 2246818 - protein, 32 aa, Cryptosporidium parvum
QLEQLYQLLRFQPLVIKAFLGRLVFPELLEYS

SEQ ID NO: 2246819 - protein, 26 aa, Cryptosporidium parvum
QLETWYKCAIVKVPIFPPSESLSDEA

SEQ ID NO: 2246820 - protein, 53 aa, Cryptosporidium parvum
QLFESIRLSILNLFGYFYNHFQTLIIALLFTTLFISQIILFKKYISLKRRLHN

SEQ ID NO: 2246821 - protein, 24 aa, Cryptosporidium parvum
QLFTIYLIIILISSIFNLIGIYLF

SEQ ID NO: 2246822 - protein, 36 aa, Cryptosporidium parvum; identical to SEQ ID NO: 2132995

SEQ ID NO: 2246823 - protein, 27 aa, Cryptosporidium parvum
QLITAILFTMIMFKVKNPSKFKSFEVV

SEQ ID NO: 2246824 - protein, 19 aa, Cryptosporidium parvum
QLKKVFKLFSSMISFLEGI

SEQ ID NO: 2246825 - protein, 18 aa, Cryptosporidium parvum
QLKLIDYSLDRYRQSTMG

SEQ ID NO: 2246826 - protein, 18 aa, Cryptosporidium parvum
QLKLLLFVNKILYNYDIL

SEQ ID NO: 2246827 - protein, 24 aa, Cryptosporidium parvum
QLKNPIKLIIYLTGKLLDSNKFKN

SEQ ID NO: 2246828 - protein, 26 aa, Cryptosporidium parvum
QLKSSFFILLLPYFTLTVFRSDSIKA

SEQ ID NO: 2246829 - protein, 31 aa, Cryptosporidium parvum
QLLNKKRFRNLLEASFCRLPIRMLIHSANIS

SEQ ID NO: 2246830 - protein, 55 aa, Cryptosporidium parvum
QLMVFVTHFCLFLWKIIKPFIILSIFILISFIVKIIIFPVILFVLTKTKSREIIL

SEQ ID NO: 2246831 - protein, 20 aa, Cryptosporidium parvum
QLPIRLTLKMIYELSVFANH

SEQ ID NO: 2246832 - protein, 17 aa, Cryptosporidium parvum
QLQEIMRPIYIQSSLEA

SEQ ID NO: 2246833 - protein, 29 aa, Cryptosporidium parvum
QLRSSIKKLLIPLLVRLEGPTLELSRSVW

SEQ ID NO: 2246834 - protein, 35 aa, Cryptosporidium parvum
QLSGFYGHLYFIFALLLIGVSFYFALDRLNKSIKG

SEQ ID NO: 2246835 - protein, 18 aa, Cryptosporidium parvum
QLSIRFIVAFSKFINIHD

SEQ ID NO: 2246836 - protein, 27 aa, Cryptosporidium parvum
QLSLSTLFKYLKLLNMNLFLMDNYDLN

SEQ ID NO: 2246837 - protein, 20 aa, Cryptosporidium parvum
QLTILLTSWASYGLVYFICG

SEQ ID NO: 2246838 - protein, 18 aa, Cryptosporidium parvum
QLTLVLLPTGISSLQKII

SEQ ID NO: 2246839 - protein, 38 aa, Cryptosporidium parvum
QLTLYNKYFKSAYFFFLVFFALHFFIVKGQIQLIFRSQ

SEQ ID NO: 2246840 - protein, 26 aa, Cryptosporidium parvum
QLTYSTARLGIFRLLCDYYKNQMVYQ

SEQ ID NO: 2246841 - protein, 18 aa, Cryptosporidium parvum
QLWLIISYITIIAFRVIH

SEQ ID NO: 2246842 - protein, 25 aa, Cryptosporidium parvum
QLYCVFDCIISVFLYYISKTNNFNL

SEQ ID NO: 2246843 - protein, 20 aa, Cryptosporidium parvum
QLYQMRIFCTHIPVIHMKSI

SEQ ID NO: 2246844 - protein, 17 aa, Cryptosporidium parvum
QMCCLFQFIKVIGLFLA

SEQ ID NO: 2246845 - protein, 18 aa, Cryptosporidium parvum
QMDSYFFQWFISLCENYQ

SEQ ID NO: 2246846 - protein, 17 aa, Cryptosporidium parvum
QMLILLCFMGAFLSLMG

SEQ ID NO: 2246847 - protein, 18 aa, Cryptosporidium parvum
QMLYSTFLVLFNIYSNTI

SEQ ID NO: 2246848 - protein, 20 aa, Cryptosporidium parvum
QMNLYYIYFNETSAYEHEKC

SEQ ID NO: 2246849 - protein, 26 aa, Cryptosporidium parvum
QMRMLLFVNFFLKREKLRILLVDEPP

SEQ ID NO: 2246850 - protein, 25 aa, Cryptosporidium parvum
QNARNIIGLIFFVSTSISFFSIKGL

SEQ ID NO: 2246851 - protein, 18 aa, Cryptosporidium parvum
QNCVWLPSLLESKARFKL

SEQ ID NO: 2246852 - protein, 30 aa, Cryptosporidium parvum
QNDFLSNFLIKSVLPILRIVILAVLDPRKL

SEQ ID NO: 2246853 - protein, 25 aa, Cryptosporidium parvum
QNESLIGIKYLKQVKWTWSNVICDF

SEQ ID NO: 2246854 - protein, 18 aa, Cryptosporidium parvum
QNIFTYRRRLTALHLRFK

SEQ ID NO: 2246855 - protein, 17 aa, Cryptosporidium parvum
QNLFPFYNDLSPSLFMI

SEQ ID NO: 2246856 - protein, 24 aa, Cryptosporidium parvum
QNMYIKSILLSNILHLVLPQLFEV

SEQ ID NO: 2246857 - protein, 25 aa, Cryptosporidium parvum
QNRLMKDILIPLSKKLLLSNYYEYY

SEQ ID NO: 2246858 - protein, 24 aa, Cryptosporidium parvum
QNSDKIFYSFFDLSIIESQQKLPT

SEQ ID NO: 2246859 - protein, 26 aa, Cryptosporidium parvum
QNSFHLLRVMFITNIDLGLTLNPLEI

SEQ ID NO: 2246860 - protein, 22 aa, Cryptosporidium parvum
QNSIDLPLLCKIIINYSNSEKV

SEQ ID NO: 2246861 - protein, 27 aa, Cryptosporidium parvum
QNSVSLCTPFHFLLEIFPVSSNTSGCS

SEQ ID NO: 2246862 - protein, 35 aa, Cryptosporidium parvum
QNVFIPFSPIRFLSSQLTFFKVLGLVKIYHDSVER

SEQ ID NO: 2246863 - protein, 19 aa, Cryptosporidium parvum
QNWPILWCICQLLALVFVS

SEQ ID NO: 2246864 - protein, 24 aa, Cryptosporidium parvum
QPANWDKFIDKIGIRYGILKEITS

SEQ ID NO: 2246865 - protein, 36 aa, Cryptosporidium parvum
QPCPILEEEGLRIFWKGPIHTVPTINLTLVQRLPNK

SEQ ID NO: 2246866 - protein, 21 aa, Cryptosporidium parvum
QPFTPLISLIILFIFTYKSNK

SEQ ID NO: 2246867 - protein, 22 aa, Cryptosporidium parvum
QPISGKFFLLTGSQNKSLFLWK

SEQ ID NO: 2246868 - protein, 19 aa, Cryptosporidium parvum
QPQLQRRVSLHPNHLSFNA

SEQ ID NO: 2246869 - protein, 36 aa, Cryptosporidium parvum
QPSDSTMPLFYILSCWKLLWCLSINELIGEGLRNMI

SEQ ID NO: 2246870 - protein, 28 aa, Cryptosporidium parvum
QQAAYSYFRLWSIWLTSSFCILITIVLS

SEQ ID NO: 2246871 - protein, 24 aa, Cryptosporidium parvum
QQEYFPVFFPECAVPVDMFPFTKH

SEQ ID NO: 2246872 - protein, 19 aa, Cryptosporidium parvum
QQIIWLWDILENEFSTEEQ

SEQ ID NO: 2246873 - protein, 25 aa, Cryptosporidium parvum
QQPRLLTGMILILVFGEALAIYGVI

SEQ ID NO: 2246874 - protein, 27 aa, Cryptosporidium parvum
QQRSAILFTILLIKSLTILSPSSIIEM

SEQ ID NO: 2246875 - protein, 18 aa, Cryptosporidium parvum
QRDKINLINAFIGTGFDT

SEQ ID NO: 2246876 - protein, 19 aa, Cryptosporidium parvum
QREIIQLLRRLLSTETSSQ

SEQ ID NO: 2246877 - protein, 26 aa, Cryptosporidium parvum
QRIQVLRYFLLAYPDINQNIFNSLKR

SEQ ID NO: 2246878 - protein, 32 aa, Cryptosporidium parvum
QRKNANFLLKHPFILLKAKRPNSLGIFIQMIS

SEQ ID NO: 2246879 - protein, 24 aa, Cryptosporidium parvum
QRLAFARIFIFKPSICFLDEATSA

SEQ ID NO: 2246880 - protein, 24 aa, Cryptosporidium parvum
QRLGFARMLIKKSPIWILDEPTSA

SEQ ID NO: 2246881 - protein, 29 aa, Cryptosporidium parvum
QRLLELLQHLIFYEIPRYSPIGLLSSLGA

SEQ ID NO: 2246882 - protein, 37 aa, Cryptosporidium parvum
QRMFGIWRENGFYQNLTLFLQLIKFQKYLSKIKNQVN

SEQ ID NO: 2246883 - protein, 23 aa, Cryptosporidium parvum
QRNQIFPDYFIAINYLLSGMVDT

SEQ ID NO: 2246884 - protein, 30 aa, Cryptosporidium parvum; identical to SEQ ID NO: 2195932

SEQ ID NO: 2246885 - protein, 20 aa, Cryptosporidium parvum
QRPYYRIFYSLLQEYESIGF

SEQ ID NO: 2246886 - protein, 25 aa, Cryptosporidium parvum
QRSVFGIICKKASWFIVIYQEETVD

SEQ ID NO: 2246887 - protein, 24 aa, Cryptosporidium parvum
QRYPKPWYKVLKKIYDGFNYVYRS

SEQ ID NO: 2246888 - protein, 29 aa, Cryptosporidium parvum
QSDITAYQYILLTKLIGVGCLLCFKLSTI

SEQ ID NO: 2246889 - protein, 24 aa, Cryptosporidium parvum
QSDPQLHLYKFYRETMHGAYNGNK

SEQ ID NO: 2246890 - protein, 22 aa, Cryptosporidium parvum
QSEVYDFSYFSLLFPVLCETCC

SEQ ID NO: 2246891 - protein, 22 aa, Cryptosporidium parvum
QSFLSSLLFCRFLQDYIENNRR

SEQ ID NO: 2246892 - protein, 19 aa, Cryptosporidium parvum
QSFWCIHALQHALITATIL

SEQ ID NO: 2246893 - protein, 22 aa, Cryptosporidium parvum
QSGVIVITILTSPGAFSCKHDC

SEQ ID NO: 2246894 - protein, 25 aa, Cryptosporidium parvum
QSIIEAVLDLLLTIGLTSASMEDGD

SEQ ID NO: 2246895 - protein, 26 aa, Cryptosporidium parvum
QSIKTAVFSLIKKFIFELISLIGYQK

SEQ ID NO: 2246896 - protein, 22 aa, Cryptosporidium parvum
QSILEFIEMLNIKKLIFEYILS

SEQ ID NO: 2246897 - protein, 25 aa, Cryptosporidium parvum
QSKSFEFFVTLYKKNLLTDEELQIG

SEQ ID NO: 2246898 - protein, 26 aa, Cryptosporidium parvum
QSLKINFLPFIFRNIASYIVMNSINC

SEQ ID NO: 2246899 - protein, 19 aa, Cryptosporidium parvum
QSLKKRWIQSYFGNFLNLV

SEQ ID NO: 2246900 - protein, 29 aa, Cryptosporidium parvum
QSNKQESLLLRWVDDFLFLTSDLESAKKF

SEQ ID NO: 2246901 - protein, 27 aa, Cryptosporidium parvum
QSNPLLLNWKAFFPNIIFDKNKSEFII

SEQ ID NO: 2246902 - protein, 23 aa, Cryptosporidium parvum
QSPTTMLLVTKLLSKMPLKRWFE

SEQ ID NO: 2246903 - protein, 24 aa, Cryptosporidium parvum
QSQDLFIKVLKWANSQNLNDDSIF

SEQ ID NO: 2246904 - protein, 28 aa, Cryptosporidium parvum
QSQLEILFWIAFCLLLMVGYKYLSDGSF

SEQ ID NO: 2246905 - protein, 21 aa, Cryptosporidium parvum
QSRIFLIGFSQGSAMALITSM

SEQ ID NO: 2246906 - protein, 23 aa, Cryptosporidium parvum
QSSLLYYLWSGILTWYTILTLLT

SEQ ID NO: 2246907 - protein, 21 aa, Cryptosporidium parvum
QSTKYLTVSDPFKIFIWLCMY

SEQ ID NO: 2246908 - protein, 22 aa, Cryptosporidium parvum
QSTPWITFIVLVRSSRTGLLGL

SEQ ID NO: 2246909 - protein, 22 aa, Cryptosporidium parvum
QSVWLIPTFYHPLNDIIFFVYY

SEQ ID NO: 2246910 - protein, 17 aa, Cryptosporidium parvum
QSYPLTLSLINTEFYRI

SEQ ID NO: 2246911 - protein, 44 aa, Cryptosporidium parvum; identical to SEQ ID NO: 2133052

SEQ ID NO: 2246912 - protein, 25 aa, Cryptosporidium parvum
QTAYRIWIRSQFLRRDTPKVPFSPY

SEQ ID NO: 2246913 - protein, 24 aa, Cryptosporidium parvum
QTGLMKTYLVPLPCLGFLTSVFEG

SEQ ID NO: 2246914 - protein, 29 aa, Cryptosporidium parvum
QTHSDFLYSFYRIGIIVPEGFWVAEQRGT

SEQ ID NO: 2246915 - protein, 37 aa, Cryptosporidium parvum
QTIFIVYTFPYFTPFFLIWIMLIIKPICLKFISSYRE

SEQ ID NO: 2246916 - protein, 28 aa, Cryptosporidium parvum
QTIRNPMHILWCRLISLATNIFVSLEKS

SEQ ID NO: 2246917 - protein, 17 aa, Cryptosporidium parvum
QTLFFIATLVLSIAGFF

SEQ ID NO: 2246918 - protein, 24 aa, Cryptosporidium parvum
QTPRTPECKARILCAFELVKIGDM

SEQ ID NO: 2246919 - protein, 24 aa, Cryptosporidium parvum
QTQSPFILVLIVNVLHIFGIAWWF

SEQ ID NO: 2246920 - protein, 21 aa, Cryptosporidium parvum
QTRKHWSIMSFLKNYNNFSID

SEQ ID NO: 2246921 - protein, 23 aa, Cryptosporidium parvum
QTSLLNPYLILTGSFPIYNTLLL

SEQ ID NO: 2246922 - protein, 29 aa, Cryptosporidium parvum
QTSRLNWSSYFYFIRRMSSFSIITVIFAS

SEQ ID NO: 2246923 - protein, 23 aa, Cryptosporidium parvum
QTTCILGLIHLLRKLLTWNIEQK

SEQ ID NO: 2246924 - protein, 39 aa, Cryptosporidium parvum; identical to SEQ ID NO: 2133059

SEQ ID NO: 2246925 - protein, 30 aa, Cryptosporidium parvum
QTVLFVAIIMVLGLLLISFGIFCGVLGYIG

SEQ ID NO: 2246926 - protein, 22 aa, Cryptosporidium parvum
QVCGMIFYLIAYATLSLFGIDN

SEQ ID NO: 2246927 - protein, 25 aa, Cryptosporidium parvum
QVENSKFFFLGIKIDKNKLETLLKS

SEQ ID NO: 2246928 - protein, 18 aa, Cryptosporidium parvum
QVGLLLLNKVQRKSFKKL

SEQ ID NO: 2246929 - protein, 26 aa, Cryptosporidium parvum
QVIFSRLFLRGYKEILCRIMVGWSNN

SEQ ID NO: 2246930 - protein, 26 aa, Cryptosporidium parvum
QVIQEYLVMLFRRFDLKTITKSKSYG

SEQ ID NO: 2246931 - protein, 32 aa, Cryptosporidium parvum
QVIVSKYLWMDAFIFLIRLCGINLSTDRLPSV

SEQ ID NO: 2246932 - protein, 40 aa, Cryptosporidium parvum; identical to SEQ ID NO: 2133065

SEQ ID NO: 2246933 - protein, 26 aa, Cryptosporidium parvum
QVLEAQIYPFFIWADSRRTSHRICKY

SEQ ID NO: 2246934 - protein, 24 aa, Cryptosporidium parvum
QVLLKVIQTVLLFLSPEILEFNEA

SEQ ID NO: 2246935 - protein, 18 aa, Cryptosporidium parvum
QVLLQGPGIINTRAEYRP

SEQ ID NO: 2246936 - protein, 25 aa, Cryptosporidium parvum
QVNYFILSRSFLDRYDIPLLFNLLY

SEQ ID NO: 2246937 - protein, 18 aa, Cryptosporidium parvum
QVPILYIIYSITSIIGCL

SEQ ID NO: 2246938 - protein, 18 aa, Cryptosporidium parvum
QVRPIRDSVLFILDSFPG

SEQ ID NO: 2246939 - protein, 22 aa, Cryptosporidium parvum
QVRSLIENLLPKKFKKYSQNIA

SEQ ID NO: 2246940 - protein, 29 aa, Cryptosporidium parvum
QVSDPSMIYLYIFRMMNVRMRQIWGLYLE

SEQ ID NO: 2246941 - protein, 25 aa, Cryptosporidium parvum
QVSPYYRYVLSEKSTYWFKCIQSLC

SEQ ID NO: 2246942 - protein, 17 aa, Cryptosporidium parvum
QVSSLILCILEQLNKQG

SEQ ID NO: 2246943 - protein, 19 aa, Cryptosporidium parvum
QWAGFWMNIAMTPVGIILN

SEQ ID NO: 2246944 - protein, 25 aa, Cryptosporidium parvum
QWHPKKRICVFHLLRLCLEHGLQDQ

SEQ ID NO: 2246945 - protein, 18 aa, Cryptosporidium parvum
QWIAGDIFLLTSSGYDFL

SEQ ID NO: 2246946 - protein, 31 aa, Cryptosporidium parvum; identical to SEQ ID NO: 2133072

SEQ ID NO: 2246947 - protein, 26 aa, Cryptosporidium parvum
QWLNHHLILIFLLKNELIIPYSISSI

SEQ ID NO: 2246948 - protein, 32 aa, Cryptosporidium parvum
QWLTNNHWVFLWTQILKKVLVIVLSYIQDSSY

SEQ ID NO: 2246949 - protein, 18 aa, Cryptosporidium parvum
QWSFIILQVPKLIDPINT

SEQ ID NO: 2246950 - protein, 33 aa, Cryptosporidium parvum; identical to SEQ ID NO: 2133074

SEQ ID NO: 2246951 - protein, 18 aa, Cryptosporidium parvum
QYLCYQLTILLTSWASYG

SEQ ID NO: 2246952 - protein, 18 aa, Cryptosporidium parvum
QYLSIYKHDLSLSYSALI

SEQ ID NO: 2246953 - protein, 29 aa, Cryptosporidium parvum
QYMSKFRPQIMPIILKWSKGESFASILEN

SEQ ID NO: 2246954 - protein, 18 aa, Cryptosporidium parvum
QYQFLYDTFKKNYFDLWT

SEQ ID NO: 2246955 - protein, 22 aa, Cryptosporidium parvum
QYSSVFIRRAVPISLAALSIGN

SEQ ID NO: 2246956 - protein, 36 aa, Cryptosporidium parvum
QYSTFKVIFKTFYLRIINILLFKLIYDIIQMCRPWQ

SEQ ID NO: 2246957 - protein, 32 aa, Cryptosporidium parvum
QYVSNSLLGIFFKMNFLLGQSLILVGIYIISR

SEQ ID NO: 2246958 - protein, 20 aa, Cryptosporidium parvum
QYYHIPVPNLFLRQPISQIV

SEQ ID NO: 2246959 - protein, 34 aa, Cryptosporidium parvum
QYYVTSTPFITKGAYLYADLLIKAIDGPWPVKKN

SEQ ID NO: 2246960 - protein, 17 aa, Cryptosporidium parvum
RAEPPFPRIWSRSPKCR

SEQ ID NO: 2246961 - protein, 19 aa, Cryptosporidium parvum
RAIITPMFVITIVISITVT

SEQ ID NO: 2246962 - protein, 18 aa, Cryptosporidium parvum
RALERKPYLIYQDQRIRY

SEQ ID NO: 2246963 - protein, 26 aa, Cryptosporidium parvum
RALRLCISLLFYNFYYLSGFLDTLFQ

SEQ ID NO: 2246964 - protein, 22 aa, Cryptosporidium parvum
RAQEFNIILDDVSLTHLSFSQD

SEQ ID NO: 2246965 - protein, 24 aa, Cryptosporidium parvum
RARSTVFCFFNYIFTDLSRAHDIV

SEQ ID NO: 2246966 - protein, 32 aa, Cryptosporidium parvum
RATYFDIVQIIFLRQIFILLSVKDFRKVCNRI

SEQ ID NO: 2246967 - protein, 23 aa, Cryptosporidium parvum
RCDSSNWFKSEQMKWILSIDTGN

SEQ ID NO: 2246968 - protein, 27 aa, Cryptosporidium parvum
RCIEFTSRMFVFIQKVPIISYLGFSQI

SEQ ID NO: 2246969 - protein, 17 aa, Cryptosporidium parvum
RCIVALEPLIFVASKTL

SEQ ID NO: 2246970 - protein, 24 aa, Cryptosporidium parvum
RCKVYFPYIDYLINLIQNLEFTNT

SEQ ID NO: 2246971 - protein, 27 aa, Cryptosporidium parvum
RCPFHSSLFPGLYLTGSRTSDVLAIDL

SEQ ID NO: 2246972 - protein, 36 aa, Cryptosporidium parvum
RCTLKEYYLLFDFVIFLFYIINAYKSAVEKLDKFIS

SEQ ID NO: 2246973 - protein, 30 aa, Cryptosporidium parvum
RCWIQVLPPEIAIIRPIYPLNPPTVETCQV

SEQ ID NO: 2246974 - protein, 18 aa, Cryptosporidium parvum
RCYCLIQRWLGIHIDILG

SEQ ID NO: 2246975 - protein, 28 aa, Cryptosporidium parvum
RDCGWRRPRITIPPPVDSIDASPLAIFI

SEQ ID NO: 2246976 - protein, 25 aa, Cryptosporidium parvum
RDDTRTVIFLTRLLSRSNTINSIQG

SEQ ID NO: 2246977 - protein, 17 aa, Cryptosporidium parvum
RDEVMSMVYIMLNFIEE

SEQ ID NO: 2246978 - protein, 23 aa, Cryptosporidium parvum
RDPILDIFIPSLNSCFVLSRNIQ

SEQ ID NO: 2246979 - protein, 22 aa, Cryptosporidium parvum
RDPRGFGCFGLNTAYTVKKNSW

SEQ ID NO: 2246980 - protein, 24 aa, Cryptosporidium parvum
RDSAYFVIFSVAEAPFFEICNLSN

SEQ ID NO: 2246981 - protein, 24 aa, Cryptosporidium parvum
RDSKKLLEKLFPLLSGESYNNRIL

SEQ ID NO: 2246982 - protein, 19 aa, Cryptosporidium parvum
RDVLRSRFSCIVKKRILKF

SEQ ID NO: 2246983 - protein, 28 aa, Cryptosporidium parvum
REALENLLKRRFFIAPSFEIYGGVAGLF

SEQ ID NO: 2246984 - protein, 23 aa, Cryptosporidium parvum
REEIYIIHPLLKSISLLVLFLTI

SEQ ID NO: 2246985 - protein, 35 aa, Cryptosporidium parvum
REEPFMQLFCGLFFQLSYFITFAQILSDKSFLNHS

SEQ ID NO: 2246986 - protein, 20 aa, Cryptosporidium parvum
REFLHVPINSRFRFICKKGC

SEQ ID NO: 2246987 - protein, 30 aa, Cryptosporidium parvum; identical to SEQ ID NO: 2133097

SEQ ID NO: 2246988 - protein, 18 aa, Cryptosporidium parvum
REILLNRSNKHWDILRKI

SEQ ID NO: 2246989 - protein, 17 aa, Cryptosporidium parvum
REILLYNLKEVFIFSAV

SEQ ID NO: 2246990 - protein, 23 aa, Cryptosporidium parvum
REIPLNIYYILSGTIYEAPTLSN

SEQ ID NO: 2246991 - protein, 18 aa, Cryptosporidium parvum
REISAKSFIIEMVALLWG

SEQ ID NO: 2246992 - protein, 17 aa, Cryptosporidium parvum
REKEIFLDIFSRGISII

SEQ ID NO: 2246993 - protein, 22 aa, Cryptosporidium parvum
REKIITLHYLLGWSPLVCRIAQ

SEQ ID NO: 2246994 - protein, 30 aa, Cryptosporidium parvum
REKLIILKRWIYYLFYSTLSWFSSSFSGER

SEQ ID NO: 2246995 - protein, 30 aa, Cryptosporidium parvum
REKMLNLPLFLIFLCVFRVLSNFFLTVILL

SEQ ID NO: 2246996 - protein, 25 aa, Cryptosporidium parvum
RENAEWQMLKLIQYFFEDQSQNSIA

SEQ ID NO: 2246997 - protein, 23 aa, Cryptosporidium parvum
RENDILIIPISNSYFKILDYSLD

SEQ ID NO: 2246998 - protein, 27 aa, Cryptosporidium parvum
RERLYARLVFITFGIASLFMWNTYLSC

SEQ ID NO: 2246999 - protein, 32 aa, Cryptosporidium parvum
RESILINKCPFLALLLLYISSHRRHLKERVDE

SEQ ID NO: 2247000 - protein, 26 aa, Cryptosporidium parvum
REVIVIKRFPFINYIHGRTLACDLEE

SEQ ID NO: 2247001 - protein, 19 aa, Cryptosporidium parvum
REVLEVVPLLLIKDISVMI

SEQ ID NO: 2247002 - protein, 18 aa, Cryptosporidium parvum
REWKASKLIFLPSSDKHL

SEQ ID NO: 2247003 - protein, 24 aa, Cryptosporidium parvum
REYRKRIIFSLLSLGVAKLATIQV

SEQ ID NO: 2247004 - protein, 21 aa, Cryptosporidium parvum
RFCGQFLFGGIKNSSDWWDSF

SEQ ID NO: 2247005 - protein, 20 aa, Cryptosporidium parvum
RFCVAHFITTRFKFRKNMGI

SEQ ID NO: 2247006 - protein, 26 aa, Cryptosporidium parvum
RFEVTKPLLRFIANKLGVQFSSKFKK

SEQ ID NO: 2247007 - protein, 25 aa, Cryptosporidium parvum
RFFDHYIYQIILYSLNIKELKYDWN

SEQ ID NO: 2247008 - protein, 19 aa, Cryptosporidium parvum
RFFKLNYGIIILSVFSMLV

SEQ ID NO: 2247009 - protein, 26 aa, Cryptosporidium parvum
RFFNRFYCGILMHKSLLKLIIESLKD

SEQ ID NO: 2247010 - protein, 19 aa, Cryptosporidium parvum
RFIIPYFPILLITTSLGIY

SEQ ID NO: 2247011 - protein, 19 aa, Cryptosporidium parvum
RFISFLPNSVATVLAICSF

SEQ ID NO: 2247012 - protein, 24 aa, Cryptosporidium parvum
RFISINLSIILWSFAKAGKFNKNL

SEQ ID NO: 2247013 - protein, 40 aa, Cryptosporidium parvum
RFKKRYAGVLGFAILICFLIGFYLILFSAKHPTSKISKNK

SEQ ID NO: 2247014 - protein, 31 aa, Cryptosporidium parvum
RFPEVVVIIRNLLRMIHFIGRKGISLDKDAL

SEQ ID NO: 2247015 - protein, 24 aa, Cryptosporidium parvum
RFRKYTAIPYFKYQCKESGFIQLI

SEQ ID NO: 2247016 - protein, 19 aa, Cryptosporidium parvum
RFTIHSSYGDKYFCLYKLR

SEQ ID NO: 2247017 - protein, 21 aa, Cryptosporidium parvum
RFTLYYIKHNITLIFAISVGL

SEQ ID NO: 2247018 - protein, 17 aa, Cryptosporidium parvum
RFVAIRPIGNIIAIGYS

SEQ ID NO: 2247019 - protein, 27 aa, Cryptosporidium parvum
RGDDWFMLSIRVFCAIFLAGAIYQLSK

SEQ ID NO: 2247020 - protein, 24 aa, Cryptosporidium parvum
RGFSILIHHILVRSYNFHKGENVD

SEQ ID NO: 2247021 - protein, 31 aa, Cryptosporidium parvum
RGGLPCLSVLRLLPPNLLGARTLLRFIIQTD

SEQ ID NO: 2247022 - protein, 35 aa, Cryptosporidium parvum
RGIPIKLFKPEILGQLQIPLFPDKSAMIKKTIREE

SEQ ID NO: 2247023 - protein, 17 aa, Cryptosporidium parvum
RGKIPDSINLFASKFNG

SEQ ID NO: 2247024 - protein, 26 aa, Cryptosporidium parvum
RGKKAYFRIFFNIVLKGKPLYTIEKE

SEQ ID NO: 2247025 - protein, 19 aa, Cryptosporidium parvum
RGKLRTTFYGYLISNNETP

SEQ ID NO: 2247026 - protein, 18 aa, Cryptosporidium parvum
RGKYLNLIFEIFSENKNS

SEQ ID NO: 2247027 - protein, 24 aa, Cryptosporidium parvum
RGLMRGDLLLWRKSFEKSSSDNSY

SEQ ID NO: 2247028 - protein, 21 aa, Cryptosporidium parvum
RGLVRMIIDIILGKDTTKQYK

SEQ ID NO: 2247029 - protein, 23 aa, Cryptosporidium parvum
RGNLNLRGFRLKEKNYQELNESR

SEQ ID NO: 2247030 - protein, 28 aa, Cryptosporidium parvum
RGPDIWNILTIYILFEDNTIFSICPVIM

SEQ ID NO: 2247031 - protein, 17 aa, Cryptosporidium parvum
RGSIQILLCTISLYLTQ

SEQ ID NO: 2247032 - protein, 18 aa, Cryptosporidium parvum
RGSLRSFPKLNEAMIILD

SEQ ID NO: 2247033 - protein, 22 aa, Cryptosporidium parvum
RGSSLLLKAIKKVSSALSSRNS

SEQ ID NO: 2247034 - protein, 27 aa, Cryptosporidium parvum
RGSSSPPFVIIYWDSVSDSLSILRENA

SEQ ID NO: 2247035 - protein, 23 aa, Cryptosporidium parvum
RGSYWTIIPLKIEGTVYPNWFLM

SEQ ID NO: 2247036 - protein, 17 aa, Cryptosporidium parvum
RGTGGALVLILYDEIKK

SEQ ID NO: 2247037 - protein, 28 aa, Cryptosporidium parvum
RGVLIVCTLALLIIGIIIIILDRKEKAE

SEQ ID NO: 2247038 - protein, 19 aa, Cryptosporidium parvum
RHIEEVLLIIAYEIFGMEK

SEQ ID NO: 2247039 - protein, 27 aa, Cryptosporidium parvum
RHLKKGEMFLKPPILPHISCPICKVWC

SEQ ID NO: 2247040 - protein, 18 aa, Cryptosporidium parvum
RHYHSHIIELALVKVNNV

SEQ ID NO: 2247041 - protein, 18 aa, Cryptosporidium parvum
RIAILKDFFKFIRNIKLI

SEQ ID NO: 2247042 - protein, 25 aa, Cryptosporidium parvum
RICKYFWKPIDLFRDVLAIVTISFV

SEQ ID NO: 2247043 - protein, 19 aa, Cryptosporidium parvum
RICNLSKVKLPNLLRRVSG

SEQ ID NO: 2247044 - protein, 29 aa, Cryptosporidium parvum
RIDSQFYIGYNMLLNLLRLEGADPEYMIN

SEQ ID NO: 2247045 - protein, 17 aa, Cryptosporidium parvum
RIFIEEISMIYFSKDLS

SEQ ID NO: 2247046 - protein, 26 aa, Cryptosporidium parvum
RIIGFTLIIILIIFTGKIVSPKTKRK

SEQ ID NO: 2247047 - protein, 26 aa, Cryptosporidium parvum
RIIKLNNPYYLYRLITRAQGISDPYF

SEQ ID NO: 2247048 - protein, 20 aa, Cryptosporidium parvum
RIILCYTPGIDFIYSFYGCL

SEQ ID NO: 2247049 - protein, 21 aa, Cryptosporidium parvum
RIILLELFVELLYCIKLNSNE

SEQ ID NO: 2247050 - protein, 18 aa, Cryptosporidium parvum
RIILSKFINSLNLGNLSE

SEQ ID NO: 2247051 - protein, 18 aa, Cryptosporidium parvum
RIITIGIILLFINIGENR

SEQ ID NO: 2247052 - protein, 18 aa, Cryptosporidium parvum
RIKNKLEFLWLKMNNHKQ

SEQ ID NO: 2247053 - protein, 22 aa, Cryptosporidium parvum
RIKVLHNLFFRFYHYDSKANQE

SEQ ID NO: 2247054 - protein, 20 aa, Cryptosporidium parvum
RILKTNIRNLLFEQPLILEK

SEQ ID NO: 2247055 - protein, 23 aa, Cryptosporidium parvum
RILNFELPLWITRFAHSFQSGLL

SEQ ID NO: 2247056 - protein, 18 aa, Cryptosporidium parvum
RILYRIHIFKIQNMLLLI

SEQ ID NO: 2247057 - protein, 26 aa, Cryptosporidium parvum
RIMSDKIYIFINSSPFGRIIVTLILI

SEQ ID NO: 2247058 - protein, 27 aa, Cryptosporidium parvum
RINFTILICFLILSFLEALKSIQFVER

SEQ ID NO: 2247059 - protein, 22 aa, Cryptosporidium parvum
RIPTMYIKYLLDGNYKGILRKY

SEQ ID NO: 2247060 - protein, 23 aa, Cryptosporidium parvum
RISKLIDILLNSYLNLTNFDLNG

SEQ ID NO: 2247061 - protein, 20 aa, Cryptosporidium parvum
RISLLTLILFLSCIIGICFQ

SEQ ID NO: 2247062 - protein, 22 aa, Cryptosporidium parvum
RISMLIFLLIVSILCIYNIIML

SEQ ID NO: 2247063 - protein, 21 aa, Cryptosporidium parvum
RITAVILPLISLLFNISYVSF

SEQ ID NO: 2247064 - protein, 18 aa, Cryptosporidium parvum
RITCGTWLVYLYELKRCH

SEQ ID NO: 2247065 - protein, 20 aa, Cryptosporidium parvum
RITSLQLLRQIILYGKDQVT

SEQ ID NO: 2247066 - protein, 33 aa, Cryptosporidium parvum
RITTAFEILFYKYRLLIRLILNKERIILNNKSD

SEQ ID NO: 2247067 - protein, 18 aa, Cryptosporidium parvum
RIVRSIHLTKLFPIIIFL

SEQ ID NO: 2247068 - protein, 18 aa, Cryptosporidium parvum
RIYKANVIVILLNAILIL

SEQ ID NO: 2247069 - protein, 27 aa, Cryptosporidium parvum
RIYRRKYDVFPFLKFKLNNKRSKYLFI

SEQ ID NO: 2247070 - protein, 22 aa, Cryptosporidium parvum
RIYVEYLNTYSFPKIKKKDILD

SEQ ID NO: 2247071 - protein, 18 aa, Cryptosporidium parvum
RKCYEIYKFFGGLDKFLK

SEQ ID NO: 2247072 - protein, 24 aa, Cryptosporidium parvum
RKEIDNGRLFRLLTKINTIADRTQ

SEQ ID NO: 2247073 - protein, 26 aa, Cryptosporidium parvum
RKFPMLAQEFLIMLNWYIYNAMGSDP

SEQ ID NO: 2247074 - protein, 18 aa, Cryptosporidium parvum
RKIFLMEFIRRIKQDDAR

SEQ ID NO: 2247075 - protein, 31 aa, Cryptosporidium parvum; identical to SEQ ID NO: 2133153

SEQ ID NO: 2247076 - protein, 18 aa, Cryptosporidium parvum
RKIFTQEFVKITLDDVYV

SEQ ID NO: 2247077 - protein, 17 aa, Cryptosporidium parvum
RKIVRRIKWDLKDAGTS

SEQ ID NO: 2247078 - protein, 25 aa, Cryptosporidium parvum
RKKDPFKLIAVLRIIPTFNVDSSKK

SEQ ID NO: 2247079 - protein, 21 aa, Cryptosporidium parvum
RKKIEDFAPFAFFTTSKGSGG

SEQ ID NO: 2247080 - protein, 19 aa, Cryptosporidium parvum
RKKLRLLIYIEDFYNEIKP

SEQ ID NO: 2247081 - protein, 42 aa, Cryptosporidium parvum
RKKNMTIINYLLLLLKERKWLKFINNLIIIIDKLLGEFDNIL

SEQ ID NO: 2247082 - protein, 25 aa, Cryptosporidium parvum
RKLNRDKYFILLNNNFRNFHNLNQS

SEQ ID NO: 2247083 - protein, 17 aa, Cryptosporidium parvum
RKNIFNSILSFLDNHVF

SEQ ID NO: 2247084 - protein, 29 aa, Cryptosporidium parvum
RKNINLLVIPSPFLKKLGLQLILEVSDNK

SEQ ID NO: 2247085 - protein, 49 aa, Cryptosporidium parvum; identical to SEQ ID NO: 2133160

SEQ ID NO: 2247086 - protein, 22 aa, Cryptosporidium parvum
RKPYLIFFSILQVIGFLLLATN

SEQ ID NO: 2247087 - protein, 21 aa, Cryptosporidium parvum
RKQDIILLSLKQTFNSLKSSI

SEQ ID NO: 2247088 - protein, 23 aa, Cryptosporidium parvum
RKQKPFTGAEKLPRKWKLSKGHA

SEQ ID NO: 2247089 - protein, 23 aa, Cryptosporidium parvum
RKQNLESILSLPLRVTLQELDIE

SEQ ID NO: 2247090 - protein, 20 aa, Cryptosporidium parvum
RKQVHILERLAWELTGFQVE

SEQ ID NO: 2247091 - protein, 20 aa, Cryptosporidium parvum
RKRFYSLLISNKIDSLGIIL

SEQ ID NO: 2247092 - protein, 18 aa, Cryptosporidium parvum
RKRGFPIAIYRPGRIGGN

SEQ ID NO: 2247093 - protein, 23 aa, Cryptosporidium parvum
RKRSLLSVLLMKLALMNYYDISP

SEQ ID NO: 2247094 - protein, 20 aa, Cryptosporidium parvum
RKRVEFLRKAFSKPFVCSEK

SEQ ID NO: 2247095 - protein, 22 aa, Cryptosporidium parvum
RKSLAIWFFEWYDSKGRRLPYG

SEQ ID NO: 2247096 - protein, 32 aa, Cryptosporidium parvum
RKSTNKKFTLFYFFFRWITYYVEMEIAANYER

SEQ ID NO: 2247097 - protein, 36 aa, Cryptosporidium parvum
RKTNTFIFFGLIRLVILFISMYWIILCKSIDLMIVS

SEQ ID NO: 2247098 - protein, 20 aa, Cryptosporidium parvum
RKVSYFVLIVAFLSYNSDSS

SEQ ID NO: 2247099 - protein, 29 aa, Cryptosporidium parvum
RKWIILLIIIEFVIKINLLYGLRNNVFGQ

SEQ ID NO: 2247100 - protein, 33 aa, Cryptosporidium parvum
RKYKRKYMYWIWRRWRYLLSAKERMPILVEDKD

SEQ ID NO: 2247101 - protein, 26 aa, Cryptosporidium parvum
RKYLCYKYKFMLVPSMLILVIKNEIT

SEQ ID NO: 2247102 - protein, 19 aa, Cryptosporidium parvum
RLDLLICSLLEYCLKDEHS

SEQ ID NO: 2247103 - protein, 18 aa, Cryptosporidium parvum
RLEKLFLVSIYLHLPNSS

SEQ ID NO: 2247104 - protein, 26 aa, Cryptosporidium parvum
RLFDLYEEYFFLSNLKLLELVDDFHK

SEQ ID NO: 2247105 - protein, 19 aa, Cryptosporidium parvum
RLFELYKKIITKRGAAPYL

SEQ ID NO: 2247106 - protein, 17 aa, Cryptosporidium parvum
RLFNCIPLYFTLMGYFF

SEQ ID NO: 2247107 - protein, 18 aa, Cryptosporidium parvum
RLGAFLENDFDIELVRIV

SEQ ID NO: 2247108 - protein, 29 aa, Cryptosporidium parvum
RLGGFIGFMSLIVLVIIVIVALLTNYKDP

SEQ ID NO: 2247109 - protein, 34 aa, Cryptosporidium parvum; identical to SEQ ID NO: 2196376

SEQ ID NO: 2247110 - protein, 18 aa, Cryptosporidium parvum
RLHSIPFTILKMLIHEIM

SEQ ID NO: 2247111 - protein, 22 aa, Cryptosporidium parvum
RLIAYSKWKCLLANSIYMLSIT

SEQ ID NO: 2247112 - protein, 23 aa, Cryptosporidium parvum
RLIIFRLILPWLCPEGRIFAALS

SEQ ID NO: 2247113 - protein, 17 aa, Cryptosporidium parvum
RLKIWNSVDYYFNLSKR

SEQ ID NO: 2247114 - protein, 27 aa, Cryptosporidium parvum
RLKPELIKDLLLIQINSFWSSSSRYKT

SEQ ID NO: 2247115 - protein, 33 aa, Cryptosporidium parvum
RLLFTNLMFGFLCKLSRFLPFSSLVFQKIADNL

SEQ ID NO: 2247116 - protein, 20 aa, Cryptosporidium parvum
RLLKQLFRYIGQNPQHETIL

SEQ ID NO: 2247117 - protein, 27 aa, Cryptosporidium parvum
RLLNCLHYLFFILNKMDDINSKQCYII

SEQ ID NO: 2247118 - protein, 17 aa, Cryptosporidium parvum
RLMSFAIEICMIPSIWY

SEQ ID NO: 2247119 - protein, 17 aa, Cryptosporidium parvum
RLNFHLLSALNLNISPW

SEQ ID NO: 2247120 - protein, 17 aa, Cryptosporidium parvum
RLNILSLSSIRYNENGI

SEQ ID NO: 2247121 - protein, 22 aa, Cryptosporidium parvum
RLNSIVRFYLSINILRGNFGKI

SEQ ID NO: 2247122 - protein, 24 aa, Cryptosporidium parvum
RLNSNISKLAFIVKKMTRGGRAGN

SEQ ID NO: 2247123 - protein, 19 aa, Cryptosporidium parvum
RLPNKWDSMILWNDLFVWR

SEQ ID NO: 2247124 - protein, 32 aa, Cryptosporidium parvum
RLTQELRVQFRKKFVWIILEDLGEVDSNSPEI

SEQ ID NO: 2247125 - protein, 45 aa, Cryptosporidium parvum
RLYALYAQHSYIFFLSIPLFISYVVLYNLIFKIIIHHIIPDPATC

SEQ ID NO: 2247126 - protein, 24 aa, Cryptosporidium parvum
RLYKYNLSIIYNYARSFDALKYRF

SEQ ID NO: 2247127 - protein, 17 aa, Cryptosporidium parvum
RLYLIELPIYKLVETRS

SEQ ID NO: 2247128 - protein, 17 aa, Cryptosporidium parvum
RLYNYCIRQFERSLYEC

SEQ ID NO: 2247129 - protein, 27 aa, Cryptosporidium parvum
RMAALLNILLIIDISLVFKYYGLLSKD

SEQ ID NO: 2247130 - protein, 17 aa, Cryptosporidium parvum
RMKKNYFAPIYEEAYWG

SEQ ID NO: 2247131 - protein, 31 aa, Cryptosporidium parvum
RMLDILSYFFLFWFTGFHPIFIFINAIIGLG

SEQ ID NO: 2247132 - protein, 17 aa, Cryptosporidium parvum
RMLIHSIQLIHSASLLH

SEQ ID NO: 2247133 - protein, 36 aa, Cryptosporidium parvum; identical to SEQ ID NO: 2133178

SEQ ID NO: 2247134 - protein, 22 aa, Cryptosporidium parvum
RMMLAIIFYISFFAVGFIDQLL

SEQ ID NO: 2247135 - protein, 26 aa, Cryptosporidium parvum
RMVAQLIYLLQCEIKFFLKPERNIQI

SEQ ID NO: 2247136 - protein, 32 aa, Cryptosporidium parvum
RNDFGIYFDPLWFIDLPFMYNNAWWDSYSSIH

SEQ ID NO: 2247137 - protein, 30 aa, Cryptosporidium parvum
RNERFCIYRPLIKTLWRPTLEALLLRLCFD

SEQ ID NO: 2247138 - protein, 18 aa, Cryptosporidium parvum
RNFLNKFSDDFSLSKYRE

SEQ ID NO: 2247139 - protein, 19 aa, Cryptosporidium parvum
RNGFCTVPIFINLTFEAIE

SEQ ID NO: 2247140 - protein, 36 aa, Cryptosporidium parvum; identical to SEQ ID NO: 2133183

SEQ ID NO: 2247141 - protein, 17 aa, Cryptosporidium parvum
RNGNTALHLAYMYGMMG

SEQ ID NO: 2247142 - protein, 37 aa, Cryptosporidium parvum
RNHLAMTTGIILFIVNVILLFVLLSKRKHTASVNNQQ

SEQ ID NO: 2247143 - protein, 17 aa, Cryptosporidium parvum
RNIIDSIRICPPGFVFE

SEQ ID NO: 2247144 - protein, 19 aa, Cryptosporidium parvum
RNILIPFIDSIFSKSHNLI

SEQ ID NO: 2247145 - protein, 26 aa, Cryptosporidium parvum
RNKLNSLQLASIKPILARKGSKIVHM

SEQ ID NO: 2247146 - protein, 25 aa, Cryptosporidium parvum
RNLHFRELIPMKTINYLPIKDHYSW

SEQ ID NO: 2247147 - protein, 29 aa, Cryptosporidium parvum
RNLQYFSINLLLDHLLPLVTINFANESSE

SEQ ID NO: 2247148 - protein, 25 aa, Cryptosporidium parvum
RNNFKLKVVFIYDLKFQFGNNTNSS

SEQ ID NO: 2247149 - protein, 21 aa, Cryptosporidium parvum
RNNIERFLPLKPAPKHNTILE

SEQ ID NO: 2247150 - protein, 18 aa, Cryptosporidium parvum
RNNLLTSELIFPTPLVIS

SEQ ID NO: 2247151 - protein, 23 aa, Cryptosporidium parvum
RNPKIWMMGIILSKYLFTVLGII

SEQ ID NO: 2247152 - protein, 17 aa, Cryptosporidium parvum
RNQLPFPNVIPKTKNKL

SEQ ID NO: 2247153 - protein, 23 aa, Cryptosporidium parvum
RNRKSEFLLAFLQDLHNFSKTNP

SEQ ID NO: 2247154 - protein, 24 aa, Cryptosporidium parvum
RNRRFEMHLIYHSFLEEILNNHED

SEQ ID NO: 2247155 - protein, 30 aa, Cryptosporidium parvum
RNRSIDLIRPWLGKMDVIIIGCGLGREKDI

SEQ ID NO: 2247156 - protein, 17 aa, Cryptosporidium parvum
RNSFVNSGFFILSRSRA

SEQ ID NO: 2247157 - protein, 26 aa, Cryptosporidium parvum
RNTLAMYMEWIWLNNHIQSVIEQGYD

SEQ ID NO: 2247158 - protein, 33 aa, Cryptosporidium parvum
RNVNIKYCIMLQLHYLLFFYKNNKMDFLINNKY

SEQ ID NO: 2247159 - protein, 24 aa, Cryptosporidium parvum
RNWNDAFILQLFKSKNPNGFIKGI

SEQ ID NO: 2247160 - protein, 20 aa, Cryptosporidium parvum
RNYCTVYFNFFSIDELKEFL

SEQ ID NO: 2247161 - protein, 23 aa, Cryptosporidium parvum
RNYYLLYLIVYYHSLISYVGALF

SEQ ID NO: 2247162 - protein, 32 aa, Cryptosporidium parvum
RPNLEACFILIRYFWLAKLIKINKRKYRPLKT

SEQ ID NO: 2247163 - protein, 30 aa, Cryptosporidium parvum; identical to SEQ ID NO: 2133200

SEQ ID NO: 2247164 - protein, 37 aa, Cryptosporidium parvum
RPQSAAGFSLFFQFWFWFPLVHCISLSYVPTCIVGLD

SEQ ID NO: 2247165 - protein, 24 aa, Cryptosporidium parvum
RPSGILWMYKDTKDFGKPIPAPYV

SEQ ID NO: 2247166 - protein, 24 aa, Cryptosporidium parvum
RPSILVTLCKLLKPAPPIPLPVSQ

SEQ ID NO: 2247167 - protein, 25 aa, Cryptosporidium parvum
RPSTNNMLFYPSKILRSFLLRMTGK

SEQ ID NO: 2247168 - protein, 28 aa, Cryptosporidium parvum
RPTLEALLLRLCFDILVILSSIFLSYFS

SEQ ID NO: 2247169 - protein, 18 aa, Cryptosporidium parvum
RQAAYIGLGLLLMQQNES

SEQ ID NO: 2247170 - protein, 25 aa, Cryptosporidium parvum
RQELSVHRFLKPSFSSYYIPYTGGG

SEQ ID NO: 2247171 - protein, 22 aa, Cryptosporidium parvum
RQFSEYYILRVPFSRFVSLHTS

SEQ ID NO: 2247172 - protein, 27 aa, Cryptosporidium parvum
RQGEMIRMFWAMWMHTGFIHIGFNVIS

SEQ ID NO: 2247173 - protein, 21 aa, Cryptosporidium parvum
RQIDALKQITRLLVLAFTNYL

SEQ ID NO: 2247174 - protein, 20 aa, Cryptosporidium parvum
RQKDIVLKEIKLPFLKEKTE

SEQ ID NO: 2247175 - protein, 35 aa, Cryptosporidium parvum
RQLKFLLIIEFMTLIILFVLVPTGGTVWVLLQVFS

SEQ ID NO: 2247176 - protein, 19 aa, Cryptosporidium parvum
RQLLLKHLSLNWLESMRRL

SEQ ID NO: 2247177 - protein, 18 aa, Cryptosporidium parvum
RQLRVCTTIAIAIISEIC

SEQ ID NO: 2247178 - protein, 24 aa, Cryptosporidium parvum
RQLVYYLLVIQIISSIFGFFVRYS

SEQ ID NO: 2247179 - protein, 34 aa, Cryptosporidium parvum
RQMGNWGIFLGMFLAIVRIIPAGFASFLTLFYGV

SEQ ID NO: 2247180 - protein, 25 aa, Cryptosporidium parvum
RQSPPSVLIFVILPSGTPDPQSCVT

SEQ ID NO: 2247181 - protein, 19 aa, Cryptosporidium parvum
RRELAPYWSNRALVFISLW

SEQ ID NO: 2247182 - protein, 20 aa, Cryptosporidium parvum
RRFMDFLHIDDDLLPSIIMI

SEQ ID NO: 2247183 - protein, 22 aa, Cryptosporidium parvum
RRIFSKILSCESFLALTSKETY

SEQ ID NO: 2247184 - protein, 22 aa, Cryptosporidium parvum
RRIILCFIVWTLSCGILLRFDR

SEQ ID NO: 2247185 - protein, 17 aa, Cryptosporidium parvum
RRILYSLNRGSLRSFPK

SEQ ID NO: 2247186 - protein, 23 aa, Cryptosporidium parvum
RRKENFPLYLLGGIFELMLDDLR

SEQ ID NO: 2247187 - protein, 26 aa, Cryptosporidium parvum
RRMDVHWPFTLFSLWGEPKSVSMNIW

SEQ ID NO: 2247188 - protein, 19 aa, Cryptosporidium parvum
RRMVDPVSLMLFDNSTGVM

SEQ ID NO: 2247189 - protein, 26 aa, Cryptosporidium parvum
RRNEKYINFIARNGSLKRAVSQILEL

SEQ ID NO: 2247190 - protein, 19 aa, Cryptosporidium parvum
RRNLGLLSKSIWKSATSKG

SEQ ID NO: 2247191 - protein, 19 aa, Cryptosporidium parvum
RRNLRLIHALSHLSKITGQ

SEQ ID NO: 2247192 - protein, 25 aa, Cryptosporidium parvum
RRNQTFIWHSKPLLSLAFEPDITVP

SEQ ID NO: 2247193 - protein, 27 aa, Cryptosporidium parvum
RRNRSGIWRLLLIRLSETNKEIMVTIQ

SEQ ID NO: 2247194 - protein, 44 aa, Cryptosporidium parvum; identical to SEQ ID NO: 2133219

SEQ ID NO: 2247195 - protein, 21 aa, Cryptosporidium parvum
RRSLIKLFLFLAAISACSVLL

SEQ ID NO: 2247196 - protein, 22 aa, Cryptosporidium parvum
RRSRPSTLCSIYPISAFSRIHE

SEQ ID NO: 2247197 - protein, 24 aa, Cryptosporidium parvum
RRTSRENGILFALPTGNNGKQELD

SEQ ID NO: 2247198 - protein, 31 aa, Cryptosporidium parvum
RSATVLLLILDKIIYFPPIYNYDTLKIIQSK

SEQ ID NO: 2247199 - protein, 21 aa, Cryptosporidium parvum
RSEIFYPIRNLYHPPIDFINK

SEQ ID NO: 2247200 - protein, 35 aa, Cryptosporidium parvum
RSEYVNSYFLLNILQYLIVLLQVYPSISDPGLLRK

SEQ ID NO: 2247201 - protein, 23 aa, Cryptosporidium parvum
RSFESLYITMEYLNPISLFKQHL

SEQ ID NO: 2247202 - protein, 24 aa, Cryptosporidium parvum
RSFLSFITECCAIIGGIFAFSGMI

SEQ ID NO: 2247203 - protein, 19 aa, Cryptosporidium parvum
RSFSLFRRRFSNEVGNTHN

SEQ ID NO: 2247204 - protein, 40 aa, Cryptosporidium parvum
RSGIWPLYLIIMLICTFRIIFMVSFFYFVFPTVVSSEYSD

SEQ ID NO: 2247205 - protein, 21 aa, Cryptosporidium parvum
RSILTITFFSTLLITFGMLNP

SEQ ID NO: 2247206 - protein, 19 aa, Cryptosporidium parvum
RSIRHSWQERIATDPSLVD

SEQ ID NO: 2247207 - protein, 24 aa, Cryptosporidium parvum
RSKFGYRFFLVCNRVQNIGFGFEY

SEQ ID NO: 2247208 - protein, 24 aa, Cryptosporidium parvum
RSKIKYKFFRNFQLSPFLPENSNK

SEQ ID NO: 2247209 - protein, 31 aa, Cryptosporidium parvum; identical to SEQ ID NO: 2133231

SEQ ID NO: 2247210 - protein, 25 aa, Cryptosporidium parvum
RSLLTVIFCIVFLKLLKAKYGSFEQ

SEQ ID NO: 2247211 - protein, 18 aa, Cryptosporidium parvum
RSLNWWRLKRKFSRAIQS

SEQ ID NO: 2247212 - protein, 29 aa, Cryptosporidium parvum
RSLTIVDLVIYISLYSYFESLKDQNQDYI

SEQ ID NO: 2247213 - protein, 17 aa, Cryptosporidium parvum
RSMAIIIDVYRQHVWND

SEQ ID NO: 2247214 - protein, 18 aa, Cryptosporidium parvum
RSMGYFCYGIISIYVWYN

SEQ ID NO: 2247215 - protein, 28 aa, Cryptosporidium parvum
RSQIIQFLSIINLKIHFKDAIAILPCTL

SEQ ID NO: 2247216 - protein, 31 aa, Cryptosporidium parvum
RSQLKKVISYIIQLFLNLVVDSIVALSPNFA

SEQ ID NO: 2247217 - protein, 25 aa, Cryptosporidium parvum
RSQQVRILELLNSLMRHFLASSFSI

SEQ ID NO: 2247218 - protein, 30 aa, Cryptosporidium parvum
RSRFDRVMISLFWAIITFGAFKANSFFFFS

SEQ ID NO: 2247219 - protein, 25 aa, Cryptosporidium parvum
RSRLTFFFEHYLPEILEFLQYCLNY

SEQ ID NO: 2247220 - protein, 24 aa, Cryptosporidium parvum
RSSGILEYISPYSPLIILSCNIFQ

SEQ ID NO: 2247221 - protein, 26 aa, Cryptosporidium parvum
RSTLTTVLLMYKLMGLNSIVSAFSMS

SEQ ID NO: 2247222 - protein, 33 aa, Cryptosporidium parvum
RSTTSFILIYITSLLFLLLLFETKHVVSDNTSE

SEQ ID NO: 2247223 - protein, 27 aa, Cryptosporidium parvum
RSYETLFIMYMLLISLGWRVLRDSLLS

SEQ ID NO: 2247224 - protein, 20 aa, Cryptosporidium parvum
RSYLWEFLDSEWKTLPQFYK

SEQ ID NO: 2247225 - protein, 25 aa, Cryptosporidium parvum
RTAILLFVVIFIIGPASYPTSLAEL

SEQ ID NO: 2247226 - protein, 20 aa, Cryptosporidium parvum
RTDICPIKYICLMLSNSFYG

SEQ ID NO: 2247227 - protein, 30 aa, Cryptosporidium parvum; identical to SEQ ID NO: 2133241

SEQ ID NO: 2247228 - protein, 22 aa, Cryptosporidium parvum
RTEFHRPLMSILALVSLYKDNA

SEQ ID NO: 2247229 - protein, 33 aa, Cryptosporidium parvum
RTEIGSIIIYLRPLILQELLCLFKRTTSPYIST

SEQ ID NO: 2247230 - protein, 23 aa, Cryptosporidium parvum
RTFLHNVLNWLTLDIKYRYTKLA

SEQ ID NO: 2247231 - protein, 20 aa, Cryptosporidium parvum
RTILDYGIKPWFLFSVSSVN

SEQ ID NO: 2247232 - protein, 17 aa, Cryptosporidium parvum
RTLLHMRIKLQQKIRDL

SEQ ID NO: 2247233 - protein, 25 aa, Cryptosporidium parvum
RTLLINGVFLSLFFIYILYQEEHSD

SEQ ID NO: 2247234 - protein, 17 aa, Cryptosporidium parvum
RTMLDALHAFFPTPGEG

SEQ ID NO: 2247235 - protein, 29 aa, Cryptosporidium parvum
RTNFKILTRLCRFFDIMLQTSTSVWFQTH

SEQ ID NO: 2247236 - protein, 29 aa, Cryptosporidium parvum
RTSFSIPINFLWVIPLGTLPSPHILPKVI

SEQ ID NO: 2247237 - protein, 31 aa, Cryptosporidium parvum
RTSGSASLIFTLWEFFWFLSVKISRKHATSI

SEQ ID NO: 2247238 - protein, 24 aa, Cryptosporidium parvum
RTSLQLIYIYLDYISRTKGYLDLN

SEQ ID NO: 2247239 - protein, 19 aa, Cryptosporidium parvum
RTVENMLIWNFLSNFIYQN

SEQ ID NO: 2247240 - protein, 42 aa, Cryptosporidium parvum; identical to SEQ ID NO: 2133248

SEQ ID NO: 2247241 - protein, 20 aa, Cryptosporidium parvum
RTYEMYWRGKRLWLSGFSEI

SEQ ID NO: 2247242 - protein, 33 aa, Cryptosporidium parvum; identical to SEQ ID NO: 2133249

SEQ ID NO: 2247243 - protein, 22 aa, Cryptosporidium parvum
RVANKHFLLKTFGLIMSIIFSL

SEQ ID NO: 2247244 - protein, 23 aa, Cryptosporidium parvum
RVASFLSFLSLMTLFLTASIQIV

SEQ ID NO: 2247245 - protein, 17 aa, Cryptosporidium parvum
RVDILNILLKLSCPTIF

SEQ ID NO: 2247246 - protein, 24 aa, Cryptosporidium parvum
RVDYYSFLGGRYNLMNALWSDKIE

SEQ ID NO: 2247247 - protein, 17 aa, Cryptosporidium parvum
RVFIIKTADILSNKLSS

SEQ ID NO: 2247248 - protein, 32 aa, Cryptosporidium parvum
RVGESIWFTVLLCFILILLITSSIFEFRKQIY

SEQ ID NO: 2247249 - protein, 17 aa, Cryptosporidium parvum
RVHFFGLPKLTPNDIKA

SEQ ID NO: 2247250 - protein, 22 aa, Cryptosporidium parvum
RVHHLPQLKCPLGTNLMNSYCI

SEQ ID NO: 2247251 - protein, 19 aa, Cryptosporidium parvum
RVHRIWGLAFILYFIVCMS

SEQ ID NO: 2247252 - protein, 36 aa, Cryptosporidium parvum; identical to SEQ ID NO: 2133255

SEQ ID NO: 2247253 - protein, 21 aa, Cryptosporidium parvum
RVITDLFLALIFNARNQIVLS

SEQ ID NO: 2247254 - protein, 20 aa, Cryptosporidium parvum
RVIVKRIVLVGNLFKVRKSK

SEQ ID NO: 2247255 - protein, 17 aa, Cryptosporidium parvum
RVKLLWDILIHLKNKDD

SEQ ID NO: 2247256 - protein, 17 aa, Cryptosporidium parvum
RVLENPSNKLRYIYNFG

SEQ ID NO: 2247257 - protein, 32 aa, Cryptosporidium parvum; identical to SEQ ID NO: 2133256

SEQ ID NO: 2247258 - protein, 24 aa, Cryptosporidium parvum
RVLQTPFVLFGLGKTNNYIEELYV

SEQ ID NO: 2247259 - protein, 25 aa, Cryptosporidium parvum
RVNKLLLLDPFLLNSNTFDLDDYFG

SEQ ID NO: 2247260 - protein, 30 aa, Cryptosporidium parvum; identical to SEQ ID NO: 2133257

SEQ ID NO: 2247261 - protein, 34 aa, Cryptosporidium parvum; identical to SEQ ID NO: 2133258

SEQ ID NO: 2247262 - protein, 17 aa, Cryptosporidium parvum
RVQCVRFHPWNPEFLLS

SEQ ID NO: 2247263 - protein, 20 aa, Cryptosporidium parvum
RVRPCLRIMVTLIKSFIGTG

SEQ ID NO: 2247264 - protein, 17 aa, Cryptosporidium parvum
RVSPLCIELLQAWSKYV

SEQ ID NO: 2247265 - protein, 25 aa, Cryptosporidium parvum
RVSSWKNYIALFNHLLFRGHSSTES

SEQ ID NO: 2247266 - protein, 19 aa, Cryptosporidium parvum
RVWHHGIFIQWENHWSLNS

SEQ ID NO: 2247267 - protein, 22 aa, Cryptosporidium parvum
RWFLLLLYFLISFSVCGLVGSF

SEQ ID NO: 2247268 - protein, 24 aa, Cryptosporidium parvum
RWIQSYFGNFLNLVLSGICNYAII

SEQ ID NO: 2247269 - protein, 17 aa, Cryptosporidium parvum
RWMLLVCISLVTMGIMY

SEQ ID NO: 2247270 - protein, 26 aa, Cryptosporidium parvum
RYASPSMLFYYLQLCKRLSLGADFTM

SEQ ID NO: 2247271 - protein, 24 aa, Cryptosporidium parvum
RYDIFQELLTFRKSWRKLSTSLEE

SEQ ID NO: 2247272 - protein, 21 aa, Cryptosporidium parvum
RYFRHPVWIKIVRQADKWYLE

SEQ ID NO: 2247273 - protein, 19 aa, Cryptosporidium parvum
RYFYRYPYVKKDVAQIIRE

SEQ ID NO: 2247274 - protein, 39 aa, Cryptosporidium parvum; identical to SEQ ID NO: 2133265

SEQ ID NO: 2247275 - protein, 25 aa, Cryptosporidium parvum
RYGNYGIYLFRYYLMKSNEFTSKES

SEQ ID NO: 2247276 - protein, 26 aa, Cryptosporidium parvum
RYHLDIAYIWLYLRLEVIGCMTLVVT

SEQ ID NO: 2247277 - protein, 19 aa, Cryptosporidium parvum
RYHYWFLMAPTMCFQFWYP

SEQ ID NO: 2247278 - protein, 17 aa, Cryptosporidium parvum
RYISVANWKVRLNTTAL

SEQ ID NO: 2247279 - protein, 23 aa, Cryptosporidium parvum
RYKYTFYKYVKYSLIIDLILICL

SEQ ID NO: 2247280 - protein, 18 aa, Cryptosporidium parvum
RYLDGWILLNRRNDKYQL

SEQ ID NO: 2247281 - protein, 17 aa, Cryptosporidium parvum
RYLINDAAVYYKKPVVS

SEQ ID NO: 2247282 - protein, 25 aa, Cryptosporidium parvum
RYNRMAALPLFRLFMKQDKEWINRQ

SEQ ID NO: 2247283 - protein, 24 aa, Cryptosporidium parvum
RYSYRMGWYYSMLSIVSGIIILVS

SEQ ID NO: 2247284 - protein, 26 aa, Cryptosporidium parvum
SAEMKKLLKILPMSICFVGLVAFGNI

SEQ ID NO: 2247285 - protein, 19 aa, Cryptosporidium parvum
SAFKCMLNLINSFDFLFIS

SEQ ID NO: 2247286 - protein, 24 aa, Cryptosporidium parvum
SAFSKLFPEIWNQGPNKLFGSPIK

SEQ ID NO: 2247287 - protein, 17 aa, Cryptosporidium parvum
SAFSLHRIPRNLTSIVG

SEQ ID NO: 2247288 - protein, 32 aa, Cryptosporidium parvum
SAIALVAVIMNPLFSLAFKSSNRLEMRIESSG

SEQ ID NO: 2247289 - protein, 18 aa, Cryptosporidium parvum
SAILFGKPWNEELYMLVT

SEQ ID NO: 2247290 - protein, 21 aa, Cryptosporidium parvum
SAIPIVLPGLYYKPYSYTTNL

SEQ ID NO: 2247291 - protein, 24 aa, Cryptosporidium parvum
SAKLGWTTFISLLVSAILAYCWSL

SEQ ID NO: 2247292 - protein, 24 aa, Cryptosporidium parvum
SAKMEVLFFSWVICLDNWLEYLRT

SEQ ID NO: 2247293 - protein, 24 aa, Cryptosporidium parvum
SAKNIKIYLYLNTSLNYNSIFTVF

SEQ ID NO: 2247294 - protein, 29 aa, Cryptosporidium parvum
SALKAGHWYFLIFTTLIASIVTIAILYYL

SEQ ID NO: 2247295 - protein, 27 aa, Cryptosporidium parvum
SALPCIHSIFWVPFDIYDDDNLWIIQS

SEQ ID NO: 2247296 - protein, 25 aa, Cryptosporidium parvum
SAMNPFIPIYIFQVHKSNCFWSGII

SEQ ID NO: 2247297 - protein, 23 aa, Cryptosporidium parvum
SAMQIQACWRSFLTRFGASLCEG

SEQ ID NO: 2247298 - protein, 21 aa, Cryptosporidium parvum
SANLEMLFRKNFIRNLHDVEE

SEQ ID NO: 2247299 - protein, 22 aa, Cryptosporidium parvum
SANRCFILKGRVYLIPPEIMDN

SEQ ID NO: 2247300 - protein, 25 aa, Cryptosporidium parvum
SANSLAEFYILNLPFSDIMDSHYIE

SEQ ID NO: 2247301 - protein, 23 aa, Cryptosporidium parvum
SASFTFLLVFSLALTISAYTTFG

SEQ ID NO: 2247302 - protein, 25 aa, Cryptosporidium parvum
SASTFVSYWFVSSYYWFLIIFGCIL

SEQ ID NO: 2247303 - protein, 25 aa, Cryptosporidium parvum
SATIFISFVLIFQGILFDSAVSPSI

SEQ ID NO: 2247304 - protein, 23 aa, Cryptosporidium parvum
SAVLLIIVVPFFLFHAYITSRNE

SEQ ID NO: 2247305 - protein, 29 aa, Cryptosporidium parvum
SAVLTFLIVFSLGFFLQIIGSLFKAPFMR

SEQ ID NO: 2247306 - protein, 31 aa, Cryptosporidium parvum
SCCCLCTRFDGILLPLRKGYQIDFSGTKTRK

SEQ ID NO: 2247307 - protein, 17 aa, Cryptosporidium parvum
SCDIPIVPIAYLIKNEI

SEQ ID NO: 2247308 - protein, 25 aa, Cryptosporidium parvum
SCDLTAAVYLLLFALKQLSSLSEVE

SEQ ID NO: 2247309 - protein, 25 aa, Cryptosporidium parvum
SCDPSLSFEFILSKLLLKVKAGSEY

SEQ ID NO: 2247310 - protein, 29 aa, Cryptosporidium parvum
SCETYFYFHFFFTTNSKPLTFFFNEKMNI

SEQ ID NO: 2247311 - protein, 30 aa, Cryptosporidium parvum
SCFCLHYLWKYFEKEFGIITSLLSISIVII

SEQ ID NO: 2247312 - protein, 23 aa, Cryptosporidium parvum
SCFEFKLFKKFNIDSLIISFGRE

SEQ ID NO: 2247313 - protein, 21 aa, Cryptosporidium parvum
SCGLGSRLRARWLLSEPENEE

SEQ ID NO: 2247314 - protein, 30 aa, Cryptosporidium parvum; identical to SEQ ID NO: 2133290

SEQ ID NO: 2247315 - protein, 31 aa, Cryptosporidium parvum
SCGRKWNKFIVFINFISFLSIITKINGNLLH

SEQ ID NO: 2247316 - protein, 24 aa, Cryptosporidium parvum
SCIIRYYTLNLLAYLLSYLHNNKS

SEQ ID NO: 2247317 - protein, 21 aa, Cryptosporidium parvum
SCINMFFLMDIDSGEGLCLNK

SEQ ID NO: 2247318 - protein, 26 aa, Cryptosporidium parvum
SCIRYRISWFEFLIGKRDRSYSEICN

SEQ ID NO: 2247319 - protein, 18 aa, Cryptosporidium parvum
SCISLCVIIPLFTVSICN

SEQ ID NO: 2247320 - protein, 21 aa, Cryptosporidium parvum
SCLIFKYYCLRYPCLINYLFK

SEQ ID NO: 2247321 - protein, 26 aa, Cryptosporidium parvum
SCLIVRLSAYIAFKKKFRSMLASDLI

SEQ ID NO: 2247322 - protein, 24 aa, Cryptosporidium parvum
SCLQDIIFVLYWSPMWFSMQWKTN

SEQ ID NO: 2247323 - protein, 24 aa, Cryptosporidium parvum
SCLSYIRTILMLQANWRRNQNQLK

SEQ ID NO: 2247324 - protein, 18 aa, Cryptosporidium parvum
SCLYQFFSAKIRINSISG

SEQ ID NO: 2247325 - protein, 27 aa, Cryptosporidium parvum
SCNDLDLWLRYNAYLRKSRLEFTNSRL

SEQ ID NO: 2247326 - protein, 36 aa, Cryptosporidium parvum; identical to SEQ ID NO: 2133296

SEQ ID NO: 2247327 - protein, 21 aa, Cryptosporidium parvum
SCTNGEWIFDNVLICASKCST

SEQ ID NO: 2247328 - protein, 24 aa, Cryptosporidium parvum
SDAAAPWRILEYIYGLVCNIQPID

SEQ ID NO: 2247329 - protein, 26 aa, Cryptosporidium parvum
SDDFKDFFLELYFKRLNINKKGDCEV

SEQ ID NO: 2247330 - protein, 19 aa, Cryptosporidium parvum
SDEDFSALILKKVKDDSAK

SEQ ID NO: 2247331 - protein, 47 aa, Cryptosporidium parvum
SDERFPWYVEPIIRPVYRRIYPEPSLYIFFLNFPIERWCIGDTWPIN

SEQ ID NO: 2247332 - protein, 17 aa, Cryptosporidium parvum
SDFYFKLSLIELKAVGG

SEQ ID NO: 2247333 - protein, 26 aa, Cryptosporidium parvum
SDHHSFILFTLIAYALPLIREEMRNS

SEQ ID NO: 2247334 - protein, 25 aa, Cryptosporidium parvum
SDHKLHLKLIMIAQSLLFVINNAID

SEQ ID NO: 2247335 - protein, 22 aa, Cryptosporidium parvum
SDISIVIGVNLLISPQAYIVFS

SEQ ID NO: 2247336 - protein, 25 aa, Cryptosporidium parvum
SDIWNEWFILIKKWETTKGIISMLK

SEQ ID NO: 2247337 - protein, 33 aa, Cryptosporidium parvum; identical to SEQ ID NO: 2133303

SEQ ID NO: 2247338 - protein, 21 aa, Cryptosporidium parvum
SDIYLGRILISIKTELLRNKD

SEQ ID NO: 2247339 - protein, 24 aa, Cryptosporidium parvum
SDKISFYHRQTLINILRFETFENE

SEQ ID NO: 2247340 - protein, 25 aa, Cryptosporidium parvum
SDKQIELPIYFVAKVRYLIKSSNNV

SEQ ID NO: 2247341 - protein, 28 aa, Cryptosporidium parvum
SDKVDLYLPIFLLFLETFSFEDLNGDLF

SEQ ID NO: 2247342 - protein, 30 aa, Cryptosporidium parvum
SDLEFYILYCRFLFLIPTIISLIMIIAVRF

SEQ ID NO: 2247343 - protein, 23 aa, Cryptosporidium parvum
SDLTFKIGLTYCLERLVYSEMGD

SEQ ID NO: 2247344 - protein, 17 aa, Cryptosporidium parvum
SDLTIISYLLLQNDLRP

SEQ ID NO: 2247345 - protein, 18 aa, Cryptosporidium parvum
SDMYFCHFYKTNVELEKL

SEQ ID NO: 2247346 - protein, 26 aa, Cryptosporidium parvum
SDNILPYVVMLLALGFVIVSLWNNFS

SEQ ID NO: 2247347 - protein, 27 aa, Cryptosporidium parvum
SDPIHTFFYISFVLISCALFSKTWIEV

SEQ ID NO: 2247348 - protein, 22 aa, Cryptosporidium parvum
SDPILFCSLIGIYLARDYSYIQ

SEQ ID NO: 2247349 - protein, 27 aa, Cryptosporidium parvum
SDPYYLIYIIFCFICALAVLIVINNEE

SEQ ID NO: 2247350 - protein, 24 aa, Cryptosporidium parvum
SDQIFKFCILRFKSYLSKIRGLLE

SEQ ID NO: 2247351 - protein, 26 aa, Cryptosporidium parvum
SDRRKFLLTKLLKLSNPLDLSSYLFE

SEQ ID NO: 2247352 - protein, 34 aa, Cryptosporidium parvum
SDSIKMLLDILILKSFYILHIWKVKDHSLLGRPC

SEQ ID NO: 2247353 - protein, 18 aa, Cryptosporidium parvum
SDSKFFCWKKVRSKSSHL

SEQ ID NO: 2247354 - protein, 23 aa, Cryptosporidium parvum
SDSKLTLTRYIGMNPQKVKITLV

SEQ ID NO: 2247355 - protein, 32 aa, Cryptosporidium parvum; identical to SEQ ID NO: 2133315

SEQ ID NO: 2247356 - protein, 26 aa, Cryptosporidium parvum
SDTFGILFGMVNIPIVFAIDGAGIPV

SEQ ID NO: 2247357 - protein, 20 aa, Cryptosporidium parvum
SDVRTYCRYILKKTMEDEIN

SEQ ID NO: 2247358 - protein, 28 aa, Cryptosporidium parvum
SDYDDAYIWQYLFDTPWFKIDCVPDVIC

SEQ ID NO: 2247359 - protein, 27 aa, Cryptosporidium parvum
SDYGLFLEIVILFYSSFIFGTICKFIG

SEQ ID NO: 2247360 - protein, 23 aa, Cryptosporidium parvum
SEALYVLICKIIQIIPHPSTQLK

SEQ ID NO: 2247361 - protein, 24 aa, Cryptosporidium parvum
SECKYLMQRLWNLYMFLSNEVNCC

SEQ ID NO: 2247362 - protein, 19 aa, Cryptosporidium parvum
SECYLAEPLLKECPTGFQM

SEQ ID NO: 2247363 - protein, 24 aa, Cryptosporidium parvum
SEDKGCWWFIGARNGYIEAKPGSK

SEQ ID NO: 2247364 - protein, 23 aa, Cryptosporidium parvum
SEDLFSKISLISDSKLTLTRYIG

SEQ ID NO: 2247365 - protein, 24 aa, Cryptosporidium parvum
SEDSYFYINQGKKPAFLLTSMHHS

SEQ ID NO: 2247366 - protein, 26 aa, Cryptosporidium parvum
SEFCKDIFLWSFQQKGLIKIAEISHR

SEQ ID NO: 2247367 - protein, 26 aa, Cryptosporidium parvum
SEFEKRQLYWYYKDYIGIKEINKIWK

SEQ ID NO: 2247368 - protein, 32 aa, Cryptosporidium parvum
SEFSKYLYLGIFLLNILVLFSGLFRAQSGSRF

SEQ ID NO: 2247369 - protein, 26 aa, Cryptosporidium parvum
SEFVLVSLIFICRLIYNCINGQFPVS

SEQ ID NO: 2247370 - protein, 17 aa, Cryptosporidium parvum
SEIILSWILNGCSPYLS

SEQ ID NO: 2247371 - protein, 24 aa, Cryptosporidium parvum
SEILTFVIQLLFKSLIKHCQIILS

SEQ ID NO: 2247372 - protein, 20 aa, Cryptosporidium parvum
SEIWIQMLIGFVTVVKATVG

SEQ ID NO: 2247373 - protein, 33 aa, Cryptosporidium parvum
SEKERNILRYFYLKLFLFVYKLSIGLANKVVVN

SEQ ID NO: 2247374 - protein, 36 aa, Cryptosporidium parvum
SEKHTLWDISRLISLMTWVLAYKRTVFFEVTKSEKD

SEQ ID NO: 2247375 - protein, 22 aa, Cryptosporidium parvum
SEKLPVFALVDIFHVPPESRQK

SEQ ID NO: 2247376 - protein, 18 aa, Cryptosporidium parvum
SEKLSFLSKLKISGSKNL

SEQ ID NO: 2247377 - protein, 19 aa, Cryptosporidium parvum
SELCKYIEMIIGKKNVKEF

SEQ ID NO: 2247378 - protein, 20 aa, Cryptosporidium parvum
SELFERKPGFSFFLEEKQTG

SEQ ID NO: 2247379 - protein, 21 aa, Cryptosporidium parvum
SELILTAILAFFVLKRKVTVR

SEQ ID NO: 2247380 - protein, 26 aa, Cryptosporidium parvum
SELLTAYAYFLHFSGYKVICKDENLF

SEQ ID NO: 2247381 - protein, 25 aa, Cryptosporidium parvum
SELTVVLIIVLEYLYRKTAMTVSQA

SEQ ID NO: 2247382 - protein, 20 aa, Cryptosporidium parvum
SELYVALGFGFYSHALLNLL

SEQ ID NO: 2247383 - protein, 27 aa, Cryptosporidium parvum
SEMNTLLHLIVPIYLKYLRHKNINGNS

SEQ ID NO: 2247384 - protein, 26 aa, Cryptosporidium parvum
SENDYLFYVNVLIKTLLKSLERKTKR

SEQ ID NO: 2247385 - protein, 28 aa, Cryptosporidium parvum
SENFKFVLKVYLLLNSFQVPLNTHIFNI

SEQ ID NO: 2247386 - protein, 25 aa, Cryptosporidium parvum
SEPIPPVYIPIFWTSIHRNKVELDL

SEQ ID NO: 2247387 - protein, 25 aa, Cryptosporidium parvum
SEQDKTLLFPIPPSKVYKFREKGYE

SEQ ID NO: 2247388 - protein, 23 aa, Cryptosporidium parvum
SEREIIIYIKTIHIKKYNFSIPI

SEQ ID NO: 2247389 - protein, 29 aa, Cryptosporidium parvum
SERGLFYTMLFCMVSAIFATLFGALALIV

SEQ ID NO: 2247390 - protein, 23 aa, Cryptosporidium parvum
SETAMRVGLPFYPKKDLKSTLFP

SEQ ID NO: 2247391 - protein, 34 aa, Cryptosporidium parvum
SETRTIALLKPFIPLFPSYTLIGLFGDSIEFKNP

SEQ ID NO: 2247392 - protein, 26 aa, Cryptosporidium parvum
SEVDFPIHILLFLIAIDQIISSIQFQ

SEQ ID NO: 2247393 - protein, 18 aa, Cryptosporidium parvum
SEVIFFELITRIQNFCSN

SEQ ID NO: 2247394 - protein, 26 aa, Cryptosporidium parvum
SEVSISLIRRLRYISSLKLDIFREIL

SEQ ID NO: 2247395 - protein, 28 aa, Cryptosporidium parvum
SEWNYKVLFLFLRIIGLTLFVEHLLIHT

SEQ ID NO: 2247396 - protein, 24 aa, Cryptosporidium parvum
SEYILIIDIFPYELCINELFINKK

SEQ ID NO: 2247397 - protein, 33 aa, Cryptosporidium parvum; identical to SEQ ID NO: 2133340

SEQ ID NO: 2247398 - protein, 20 aa, Cryptosporidium parvum
SFARSLYCKLIQSSVYRIGS

SEQ ID NO: 2247399 - protein, 19 aa, Cryptosporidium parvum
SFDAKWNMWQWKVTANLAQ

SEQ ID NO: 2247400 - protein, 24 aa, Cryptosporidium parvum
SFDDLYRKLPFNLKPIKLNSGSKS

SEQ ID NO: 2247401 - protein, 24 aa, Cryptosporidium parvum
SFDISLFLIVWKNYVTLITRKEYR

SEQ ID NO: 2247402 - protein, 22 aa, Cryptosporidium parvum
SFDKLIIQIPFFLINNMNDDDL

SEQ ID NO: 2247403 - protein, 18 aa, Cryptosporidium parvum
SFDYYYYLNKSNSLPWFK

SEQ ID NO: 2247404 - protein, 18 aa, Cryptosporidium parvum
SFEEFPIRIATFVELCNL

SEQ ID NO: 2247405 - protein, 21 aa, Cryptosporidium parvum
SFESRILPFYRRIAEKLMHEI

SEQ ID NO: 2247406 - protein, 28 aa, Cryptosporidium parvum
SFFGHNVLSFWFSFYNTALIISMVSICF

SEQ ID NO: 2247407 - protein, 24 aa, Cryptosporidium parvum
SFFSSFLWLQYFRQWNLTGSSSTF

SEQ ID NO: 2247408 - protein, 26 aa, Cryptosporidium parvum
SFGIGRIIYCLLEHSFKIREDLSEIQ

SEQ ID NO: 2247409 - protein, 36 aa, Cryptosporidium parvum
SFGLYDQLPIVWLFLSIIVALIIFKQGNSFSWGLFT

SEQ ID NO: 2247410 - protein, 24 aa, Cryptosporidium parvum
SFGMSIIFYIYFKSAMYDENLPAW

SEQ ID NO: 2247411 - protein, 18 aa, Cryptosporidium parvum
SFGQLIIPSLPNGLFIFF

SEQ ID NO: 2247412 - protein, 18 aa, Cryptosporidium parvum
SFIKMMIDSAYEIGYLLI

SEQ ID NO: 2247413 - protein, 19 aa, Cryptosporidium parvum
SFILILSIFILLYTKRWNS

SEQ ID NO: 2247414 - protein, 20 aa, Cryptosporidium parvum
SFILTFFLTSILLSLDFWTV

SEQ ID NO: 2247415 - protein, 27 aa, Cryptosporidium parvum
SFISSICIPYFQALLKFDPEIVQECIQ

SEQ ID NO: 2247416 - protein, 47 aa, Cryptosporidium parvum
SFKKGSILILPTGYGKSLCFQYLSLLLNMWFGKVTIVITPLISLMQD

SEQ ID NO: 2247417 - protein, 33 aa, Cryptosporidium parvum
SFKSLRDSIPKFWSLLFDIMLGPDLDSKDLDAI

SEQ ID NO: 2247418 - protein, 32 aa, Cryptosporidium parvum; identical to SEQ ID NO: 2133350

SEQ ID NO: 2247419 - protein, 19 aa, Cryptosporidium parvum
SFLIFNNFLSQINQLLYID

SEQ ID NO: 2247420 - protein, 22 aa, Cryptosporidium parvum
SFLNILYNIVMNDKLRSICKVE

SEQ ID NO: 2247421 - protein, 19 aa, Cryptosporidium parvum
SFLSTLFCWIFIGGNYAIF

SEQ ID NO: 2247422 - protein, 20 aa, Cryptosporidium parvum
SFLSVKWRIVVSKTIFHIYF

SEQ ID NO: 2247423 - protein, 18 aa, Cryptosporidium parvum
SFMLANLGEFGFVLASKG

SEQ ID NO: 2247424 - protein, 30 aa, Cryptosporidium parvum; identical to SEQ ID NO: 2133355

SEQ ID NO: 2247425 - protein, 18 aa, Cryptosporidium parvum
SFNLLKQFAKNIIKNNPS

SEQ ID NO: 2247426 - protein, 19 aa, Cryptosporidium parvum
SFNRPLRFLSQVYSNSNLS

SEQ ID NO: 2247427 - protein, 27 aa, Cryptosporidium parvum
SFNTGGICSFLWIMAKFPDYVYCDKGE

SEQ ID NO: 2247428 - protein, 31 aa, Cryptosporidium parvum; identical to SEQ ID NO: 2133356

SEQ ID NO: 2247429 - protein, 21 aa, Cryptosporidium parvum
SFPESICYIWNIKGHNALGEI

SEQ ID NO: 2247430 - protein, 19 aa, Cryptosporidium parvum
SFPKLNEAMIILDNLASQF

SEQ ID NO: 2247431 - protein, 47 aa, Cryptosporidium parvum
SFQYSLISLIIKFSKAFNFIKLISILTFFIWIVISQIYEEIVCFVLL

SEQ ID NO: 2247432 - protein, 33 aa, Cryptosporidium parvum
SFRFNYTIFSISISFAFLAKYYFQNTRKQLNMK

SEQ ID NO: 2247433 - protein, 19 aa, Cryptosporidium parvum
SFSGFFSLGNLKIKILEKY

SEQ ID NO: 2247434 - protein, 26 aa, Cryptosporidium parvum
SFSNWRFNVPWLLWADSAFIGIQNAF

SEQ ID NO: 2247435 - protein, 19 aa, Cryptosporidium parvum
SFSSDWINKIFLKSIFGLL

SEQ ID NO: 2247436 - protein, 18 aa, Cryptosporidium parvum
SFTYDSPIPLNTLVNRLV

SEQ ID NO: 2247437 - protein, 30 aa, Cryptosporidium parvum
SFVAFFAQTLLLIGLLFNSPCRRLAAARPF

SEQ ID NO: 2247438 - protein, 25 aa, Cryptosporidium parvum
SFVLLFCLFFYQLDKLHAEVIYAVN

SEQ ID NO: 2247439 - protein, 23 aa, Cryptosporidium parvum
SFVNIFNVINLLISATLNLIYIS

SEQ ID NO: 2247440 - protein, 18 aa, Cryptosporidium parvum
SFVNILDFLNSKNIELLY

SEQ ID NO: 2247441 - protein, 20 aa, Cryptosporidium parvum
SFWNRILLNNLNTKLIKKMN

SEQ ID NO: 2247442 - protein, 26 aa, Cryptosporidium parvum
SGANSKIILFVLRISIIISNYTKHLI

SEQ ID NO: 2247443 - protein, 26 aa, Cryptosporidium parvum
SGDLARTIGFISPKSLKYLELIFCEE

SEQ ID NO: 2247444 - protein, 24 aa, Cryptosporidium parvum
SGEKSFMIFCIPISWLDSTDDYIK

SEQ ID NO: 2247445 - protein, 24 aa, Cryptosporidium parvum
SGFLFKLSIILITAPVPWARWYVE

SEQ ID NO: 2247446 - protein, 25 aa, Cryptosporidium parvum
SGFSNYYVGVILVSSLILDTKNQDK

SEQ ID NO: 2247447 - protein, 27 aa, Cryptosporidium parvum
SGGLQWFWYSLILTLKMVFLVWHKSFD

SEQ ID NO: 2247448 - protein, 37 aa, Cryptosporidium parvum
SGGQKTLVALAFLFALHRADPAPMYLLDEVDAALDDQ

SEQ ID NO: 2247449 - protein, 17 aa, Cryptosporidium parvum
SGIINQVKFSHNGYLLA

SEQ ID NO: 2247450 - protein, 18 aa, Cryptosporidium parvum
SGILFILLSIYYIIRNKF

SEQ ID NO: 2247451 - protein, 32 aa, Cryptosporidium parvum
SGILLSCAFFALYLICWIFAYVKDLSDWVSIL

SEQ ID NO: 2247452 - protein, 33 aa, Cryptosporidium parvum
SGKAVKFQLLAFGLSILIFMGGTFYMLINSSRN

SEQ ID NO: 2247453 - protein, 21 aa, Cryptosporidium parvum
SGLFVIILMACIDIGLFGFMY

SEQ ID NO: 2247454 - protein, 23 aa, Cryptosporidium parvum
SGLLFLDGKWLFNKDMRKNRNDY

SEQ ID NO: 2247455 - protein, 22 aa, Cryptosporidium parvum
SGLLPILIGISGWLRNNDDIFM

SEQ ID NO: 2247456 - protein, 36 aa, Cryptosporidium parvum
SGLPGIFIVYDFQPFLLQKIYKRVPISHLITSFCAI

SEQ ID NO: 2247457 - protein, 25 aa, Cryptosporidium parvum
SGNIWKMFQPILNIKYHSSLMIGDG

SEQ ID NO: 2247458 - protein, 22 aa, Cryptosporidium parvum
SGNPYNAWNPFYSQLLQKFFGN

SEQ ID NO: 2247459 - protein, 23 aa, Cryptosporidium parvum
SGPLNWFMNLILNNSFNNNKNKF

SEQ ID NO: 2247460 - protein, 27 aa, Cryptosporidium parvum
SGQQNSYFWILTIVAVALGVIAISLLS

SEQ ID NO: 2247461 - protein, 27 aa, Cryptosporidium parvum
SGSIFIGIFIWILIKSKFHRDKVEFNQ

SEQ ID NO: 2247462 - protein, 28 aa, Cryptosporidium parvum
SGSSSYIFTVFFKMMIMVVGFGIFHGAV

SEQ ID NO: 2247463 - protein, 24 aa, Cryptosporidium parvum
SGSYLYFILILMTGINIIGTAFDY

SEQ ID NO: 2247464 - protein, 27 aa, Cryptosporidium parvum
SGTIHTWIFHPNKAKLALFSSWTEGCN

SEQ ID NO: 2247465 - protein, 21 aa, Cryptosporidium parvum
SGVLYRKLLLMDSFEFNMPSQ

SEQ ID NO: 2247466 - protein, 24 aa, Cryptosporidium parvum
SGVTIFFIFVVFSFAISSACLCTS

SEQ ID NO: 2247467 - protein, 26 aa, Cryptosporidium parvum
SHAILNPPFFLFQRPTLDGFDVDSIS

SEQ ID NO: 2247468 - protein, 30 aa, Cryptosporidium parvum; identical to SEQ ID NO: 2133386

SEQ ID NO: 2247469 - protein, 45 aa, Cryptosporidium parvum
SHFALLVWSFLNPLGFLWVLIIQRFRIFLYIINNLLKRRKKRKLT

SEQ ID NO: 2247470 - protein, 34 aa, Cryptosporidium parvum; identical to SEQ ID NO: 2133387

SEQ ID NO: 2247471 - protein, 24 aa, Cryptosporidium parvum
SHFGKVYNGLYPVGPRLPSFSSSN

SEQ ID NO: 2247472 - protein, 18 aa, Cryptosporidium parvum
SHGISLKSPFSISIFNFL

SEQ ID NO: 2247473 - protein, 34 aa, Cryptosporidium parvum
SHIFNNLILEPPTIIKPIHLWTGKQVFTSLLKTL

SEQ ID NO: 2247474 - protein, 25 aa, Cryptosporidium parvum
SHIGKIVLTLPPPQTLMFEAFNYKT

SEQ ID NO: 2247475 - protein, 29 aa, Cryptosporidium parvum
SHISAHIGSLLAWLFQNMAQHVEQDRLIE

SEQ ID NO: 2247476 - protein, 19 aa, Cryptosporidium parvum
SHIVKLRKYIRADKSDLLT

SEQ ID NO: 2247477 - protein, 22 aa, Cryptosporidium parvum
SHNSHIFLVPWVDHLPTNYQFR

SEQ ID NO: 2247478 - protein, 25 aa, Cryptosporidium parvum
SHQPAILELLLNKFLIECVPSLLYI

SEQ ID NO: 2247479 - protein, 24 aa, Cryptosporidium parvum
SHSNLWTFFLEWDTSSKTWLIRDC

SEQ ID NO: 2247480 - protein, 51 aa, Cryptosporidium parvum
SHSYTYIMYRDIGEPIFITGDHQRIILGPVGTLYLISIDSFYPEFGDPSFE

SEQ ID NO: 2247481 - protein, 28 aa, Cryptosporidium parvum
SIAGLGLLGGLGYGLKRKRTRGGDLTGD

SEQ ID NO: 2247482 - protein, 23 aa, Cryptosporidium parvum
SICQKFIDLLTKPTSSSSTTTTS

SEQ ID NO: 2247483 - protein, 17 aa, Cryptosporidium parvum
SICQMILKSKSIVAQNP

SEQ ID NO: 2247484 - protein, 20 aa, Cryptosporidium parvum
SIDIYFSFLQAIKLNSKHIS

SEQ ID NO: 2247485 - protein, 31 aa, Cryptosporidium parvum
  misc_feature (27)..(27): Xaa can be any naturally occurring amino acid
SIDYITGKFYLFYLFIYYYYFFFFTIXLGGG

SEQ ID NO: 2247486 - protein, 18 aa, Cryptosporidium parvum
SIEFHNISFLFLAGYFKN

SEQ ID NO: 2247487 - protein, 24 aa, Cryptosporidium parvum
SIEHHYITILLAWKVKEETKTMDY

SEQ ID NO: 2247488 - protein, 25 aa, Cryptosporidium parvum
SIEKYALFELIITKLLPLCSSMLDD

SEQ ID NO: 2247489 - protein, 29 aa, Cryptosporidium parvum
SIEYAEMMLLRSIGIFPDIIFGHSLGEYL

SEQ ID NO: 2247490 - protein, 20 aa, Cryptosporidium parvum
SIFCICIYLFGKVEASLTDI

SEQ ID NO: 2247491 - protein, 19 aa, Cryptosporidium parvum
SIFHQRCCTLLLNSVRSII

SEQ ID NO: 2247492 - protein, 19 aa, Cryptosporidium parvum
SIFLHSQFSPLLRNSNDIS

SEQ ID NO: 2247493 - protein, 17 aa, Cryptosporidium parvum
SIFLNFPTERCVLLMLG

SEQ ID NO: 2247494 - protein, 26 aa, Cryptosporidium parvum
SIFSIIVLILPCAIFWFVFYSEMVPQ

SEQ ID NO: 2247495 - protein, 19 aa, Cryptosporidium parvum
SIFTMNYIIKAVYLKELHS

SEQ ID NO: 2247496 - protein, 24 aa, Cryptosporidium parvum
SIFVLNALLLYVLKVSISKFNKIR

SEQ ID NO: 2247497 - protein, 17 aa, Cryptosporidium parvum
SIFYLLLLKRYETNFCD

SEQ ID NO: 2247498 - protein, 24 aa, Cryptosporidium parvum
SIGDSFFPEIWNFYCNYFKCCLEK

SEQ ID NO: 2247499 - protein, 43 aa, Cryptosporidium parvum
SIGFLLGIKLIFIIFILLSFSNYLIFFIISRYFAKKNFIINHE

SEQ ID NO: 2247500 - protein, 27 aa, Cryptosporidium parvum
SIGGDYLLFFLYLSLNLEDLKEFYEKA

SEQ ID NO: 2247501 - protein, 24 aa, Cryptosporidium parvum
SIGQFIYSLIFLSSTLFACFKTFG

SEQ ID NO: 2247502 - protein, 35 aa, Cryptosporidium parvum; identical to SEQ ID NO: 2133406

SEQ ID NO: 2247503 - protein, 17 aa, Cryptosporidium parvum
SIGYFKPLKVPFLSWSE

SEQ ID NO: 2247504 - protein, 26 aa, Cryptosporidium parvum
SIHLKRILIFEDYLKYYILNGNSSNN

SEQ ID NO: 2247505 - protein, 28 aa, Cryptosporidium parvum
SIHLTKLFPIIIFLSVYQKVILRNSTHT

SEQ ID NO: 2247506 - protein, 25 aa, Cryptosporidium parvum
SIIEFRRKLGMPGNSLQWGAWAEQG

SEQ ID NO: 2247507 - protein, 23 aa, Cryptosporidium parvum
SIIEMHLGLLPKTDYIRSNSLIK

SEQ ID NO: 2247508 - protein, 20 aa, Cryptosporidium parvum
SIIGFAALGVVLIISIIYIL

SEQ ID NO: 2247509 - protein, 18 aa, Cryptosporidium parvum
SIIGLVERLFFNLNNLKE

SEQ ID NO: 2247510 - protein, 30 aa, Cryptosporidium parvum
SIIIKSLRYFQDQLFKFLIQKNHRTTTLKV

SEQ ID NO: 2247511 - protein, 19 aa, Cryptosporidium parvum
SIIKMIKPISWYETYFSKF

SEQ ID NO: 2247512 - protein, 29 aa, Cryptosporidium parvum
SIILIIFSLLCIFVHILKQFLQKKGFEVS

SEQ ID NO: 2247513 - protein, 23 aa, Cryptosporidium parvum
SIINNFPCMATSMIFNLIQILRD

SEQ ID NO: 2247514 - protein, 17 aa, Cryptosporidium parvum
SIIPNTAPYKFMRGLMC

SEQ ID NO: 2247515 - protein, 26 aa, Cryptosporidium parvum
SIIQHTILVALIKLITLGVTNITFKK

SEQ ID NO: 2247516 - protein, 27 aa, Cryptosporidium parvum
SIIQKYFYFLIIFLSSIFHLKVDQMYF

SEQ ID NO: 2247517 - protein, 33 aa, Cryptosporidium parvum
SIISKHIFVIFNYWILPIMAPKFGISGKDSELN

SEQ ID NO: 2247518 - protein, 24 aa, Cryptosporidium parvum
SIITKVIYLFFIRLILQSKNAKNH

SEQ ID NO: 2247519 - protein, 19 aa, Cryptosporidium parvum
SIKFKRFKKRYAGVLGFAI

SEQ ID NO: 2247520 - protein, 18 aa, Cryptosporidium parvum
SIKFNMISQYYLLGIPIC

SEQ ID NO: 2247521 - protein, 23 aa, Cryptosporidium parvum
SIKIHPRFRLFSCMNPVIVPIEQ

SEQ ID NO: 2247522 - protein, 23 aa, Cryptosporidium parvum
SIKNIILFGRPLNQLKYDVILDC

SEQ ID NO: 2247523 - protein, 29 aa, Cryptosporidium parvum
SILASFISRIIFAIWITTTLSLNFNSYRK

SEQ ID NO: 2247524 - protein, 20 aa, Cryptosporidium parvum
SILHLCILGNIPNIALYIFN

SEQ ID NO: 2247525 - protein, 20 aa, Cryptosporidium parvum
SILISFFTKQKNQYFKWIIL

SEQ ID NO: 2247526 - protein, 22 aa, Cryptosporidium parvum
SILKLILRLYDPDKGKILLDGL

SEQ ID NO: 2247527 - protein, 28 aa, Cryptosporidium parvum
SILKNNLTQQFPFNGSLLLNGKVANITT

SEQ ID NO: 2247528 - protein, 18 aa, Cryptosporidium parvum
SILLLDFLSFIENSEFTE

SEQ ID NO: 2247529 - protein, 21 aa, Cryptosporidium parvum
SILNCLYGLFPPQLEYVEVFE

SEQ ID NO: 2247530 - protein, 23 aa, Cryptosporidium parvum
SILNWLVSLIYIPLSYIISDLSV

SEQ ID NO: 2247531 - protein, 22 aa, Cryptosporidium parvum
SILPIFELFPLPLKRIFSKFNS

SEQ ID NO: 2247532 - protein, 18 aa, Cryptosporidium parvum
SILPMLVIASNFCWDCVK

SEQ ID NO: 2247533 - protein, 19 aa, Cryptosporidium parvum
SILRYILENFGLYLNNYVP

SEQ ID NO: 2247534 - protein, 28 aa, Cryptosporidium parvum
SINEHCKLLTSKLLYYMAITPKEIIENF

SEQ ID NO: 2247535 - protein, 27 aa, Cryptosporidium parvum
SINNMVPILLIFPTRIKSNGIITTTYE

SEQ ID NO: 2247536 - protein, 23 aa, Cryptosporidium parvum
SINTLIFFCIGKIMLVAIYNKKN

SEQ ID NO: 2247537 - protein, 28 aa, Cryptosporidium parvum
SIPCSIGIFFLLFLTSNIIWFFVGFSRN

SEQ ID NO: 2247538 - protein, 24 aa, Cryptosporidium parvum
SIPNDIIHGLLLRVVLPSIKDPSI

SEQ ID NO: 2247539 - protein, 38 aa, Cryptosporidium parvum; identical to SEQ ID NO: 2133432

SEQ ID NO: 2247540 - protein, 21 aa, Cryptosporidium parvum
SIQILLCTISLYLTQSTYFSL

SEQ ID NO: 2247541 - protein, 47 aa, Cryptosporidium parvum; identical to SEQ ID NO: 2133434

SEQ ID NO: 2247542 - protein, 17 aa, Cryptosporidium parvum
SIQRMFGIWRENGFYQN

SEQ ID NO: 2247543 - protein, 18 aa, Cryptosporidium parvum
SIQWGPWLGEGMASNNLS

SEQ ID NO: 2247544 - protein, 36 aa, Cryptosporidium parvum
SIRFFSIFSVIVNYFFIFIILFSVLGIKIYKRVLPM

SEQ ID NO: 2247545 - protein, 21 aa, Cryptosporidium parvum
SIRLILNLLKKEESLLFMISS

SEQ ID NO: 2247546 - protein, 28 aa, Cryptosporidium parvum
SIRVCSAPLFAFLPFDITISPINKKLIN

SEQ ID NO: 2247547 - protein, 28 aa, Cryptosporidium parvum
SISISLWKTIFPWIWNNLEHQQRNELTL

SEQ ID NO: 2247548 - protein, 24 aa, Cryptosporidium parvum
SISISRRFILFSYVEGIRMYIQAL

SEQ ID NO: 2247549 - protein, 27 aa, Cryptosporidium parvum
SISKHLTLIIIYLISTLNLIKKKKVEI

SEQ ID NO: 2247550 - protein, 31 aa, Cryptosporidium parvum
SISLCILGIIKPWIFMAWLTTAVTEFEKNLR

SEQ ID NO: 2247551 - protein, 26 aa, Cryptosporidium parvum
SISLFNILLKILPYAFLWGFGTALGE

SEQ ID NO: 2247552 - protein, 24 aa, Cryptosporidium parvum
SISLLNNFLLSHCDTLILGIMQEK

SEQ ID NO: 2247553 - protein, 20 aa, Cryptosporidium parvum
SISLLVFIFHEFQNAVNSRM

SEQ ID NO: 2247554 - protein, 23 aa, Cryptosporidium parvum
SISPILILPFDIAGSLLGYENNN

SEQ ID NO: 2247555 - protein, 20 aa, Cryptosporidium parvum
SISPLIFVVLSRVPQIVKCY

SEQ ID NO: 2247556 - protein, 24 aa, Cryptosporidium parvum
SISPPLLSILLEIAKNLFSDGPTI

SEQ ID NO: 2247557 - protein, 18 aa, Cryptosporidium parvum
SISYFMIITKTGLNLLIL

SEQ ID NO: 2247558 - protein, 30 aa, Cryptosporidium parvum
SISYGVFPYLWEGLLDMFLLINQTVSRSLI

SEQ ID NO: 2247559 - protein, 19 aa, Cryptosporidium parvum
SISYIHFAFIPFVKTNNTS

SEQ ID NO: 2247560 - protein, 39 aa, Cryptosporidium parvum
SITDYLIEMYYISSIFTRVIFIWLFQSFGKSQLNDLIHK

SEQ ID NO: 2247561 - protein, 25 aa, Cryptosporidium parvum
SITFHSISPYLWKLQINLQELYEIV

SEQ ID NO: 2247562 - protein, 28 aa, Cryptosporidium parvum
SITKYFIPGFLILYFIQPFSYYISSEYP

SEQ ID NO: 2247563 - protein, 17 aa, Cryptosporidium parvum
SITLTCLTSCAALFLGT

SEQ ID NO: 2247564 - protein, 31 aa, Cryptosporidium parvum; identical to SEQ ID NO: 2133446

SEQ ID NO: 2247565 - protein, 25 aa, Cryptosporidium parvum
SITSFNWNIFNLILNMLRILDLNIH

SEQ ID NO: 2247566 - protein, 19 aa, Cryptosporidium parvum
SITTFPLILEPKEIYKILE

SEQ ID NO: 2247567 - protein, 29 aa, Cryptosporidium parvum
SIVILDYLNTFFNIVYLIQMDQLQIVTNH

SEQ ID NO: 2247568 - protein, 19 aa, Cryptosporidium parvum
SIVLFQIQPSLRPLVPLAL

SEQ ID NO: 2247569 - protein, 17 aa, Cryptosporidium parvum
SIVLSPIDDIKQLNKSH

SEQ ID NO: 2247570 - protein, 26 aa, Cryptosporidium parvum
SIVLVTSLLFQLAIPLNFIGMIYRES

SEQ ID NO: 2247571 - protein, 20 aa, Cryptosporidium parvum
SIVSYYFSLLIGSFWSALET

SEQ ID NO: 2247572 - protein, 25 aa, Cryptosporidium parvum
SIVYKLYWKLMLTCGVATICTLAAV

SEQ ID NO: 2247573 - protein, 24 aa, Cryptosporidium parvum
SIYIAVFGFIFSHFEWKNIPASMN

SEQ ID NO: 2247574 - protein, 19 aa, Cryptosporidium parvum
SIYILPETFKCEEPHVEVM

SEQ ID NO: 2247575 - protein, 24 aa, Cryptosporidium parvum
SIYNSFVLYFRFGRINSFVTIYSE

SEQ ID NO: 2247576 - protein, 23 aa, Cryptosporidium parvum
SIYPLFVYSIIWGRRKSFFTNFC

SEQ ID NO: 2247577 - protein, 26 aa, Cryptosporidium parvum
SIYRSCLMLILMYPETYSLLNYSLVI

SEQ ID NO: 2247578 - protein, 32 aa, Cryptosporidium parvum
SIYSILFYALISFIILILLLIKLVLCKRSSKR

SEQ ID NO: 2247579 - protein, 26 aa, Cryptosporidium parvum
SIYTALYSTLPVYQPNGLRIEAISTT

SEQ ID NO: 2247580 - protein, 20 aa, Cryptosporidium parvum
SKAFLYNIILIISLTISIYG

SEQ ID NO: 2247581 - protein, 28 aa, Cryptosporidium parvum
SKCLHGYFRIYWLEIPKLAFKLTSLLPF

SEQ ID NO: 2247582 - protein, 26 aa, Cryptosporidium parvum
SKDELDLYGFIRLRVRFKDEEVVAQN

SEQ ID NO: 2247583 - protein, 22 aa, Cryptosporidium parvum
SKDFNFILRKQSLLLLSDLIGQ

SEQ ID NO: 2247584 - protein, 17 aa, Cryptosporidium parvum
SKDGLFLLYFQKRANKL

SEQ ID NO: 2247585 - protein, 25 aa, Cryptosporidium parvum
SKDRFYRFNIFHIYSLISHYKSYET

SEQ ID NO: 2247586 - protein, 25 aa, Cryptosporidium parvum
SKEDKLLLKLPILITTTTTSTTTTS

SEQ ID NO: 2247587 - protein, 27 aa, Cryptosporidium parvum
SKEENLFVLLSYLDLFWGVIRNKGQIY

SEQ ID NO: 2247588 - protein, 28 aa, Cryptosporidium parvum
SKEKKILPRFYRYLGLYYSLICISRMKR

SEQ ID NO: 2247589 - protein, 22 aa, Cryptosporidium parvum
SKESFKCVYSPKVQGLWNIHQI

SEQ ID NO: 2247590 - protein, 29 aa, Cryptosporidium parvum
SKESRIHLLLWLSSVIILLLFPNISLPKR

SEQ ID NO: 2247591 - protein, 28 aa, Cryptosporidium parvum
SKFAVFVFYAFFILQNSIVNAIDQLDII

SEQ ID NO: 2247592 - protein, 23 aa, Cryptosporidium parvum
SKFIFFGVFTVLCSWFPFTSLLA

SEQ ID NO: 2247593 - protein, 21 aa, Cryptosporidium parvum
SKFLPYYIEIINKSDFQNFEK

SEQ ID NO: 2247594 - protein, 21 aa, Cryptosporidium parvum
SKFTFSWFTPIIDSAYDHILS

SEQ ID NO: 2247595 - protein, 17 aa, Cryptosporidium parvum
SKGFIEKLIVSLTKDGC

SEQ ID NO: 2247596 - protein, 47 aa, Cryptosporidium parvum
SKGLSGPALYAILFAPLILGMLILAILFWFRRYKWKKNLEDDQNTEV

SEQ ID NO: 2247597 - protein, 26 aa, Cryptosporidium parvum
SKHEKMLFLMVLWIKHYLSNKVENKS

SEQ ID NO: 2247598 - protein, 26 aa, Cryptosporidium parvum
SKHLSILLDYLFSLKNSPFENLIPIT

SEQ ID NO: 2247599 - protein, 21 aa, Cryptosporidium parvum
SKIELEMFSFLPKILEFQVKD

SEQ ID NO: 2247600 - protein, 18 aa, Cryptosporidium parvum
SKIGWTPLSILNGNYYVQ

SEQ ID NO: 2247601 - protein, 30 aa, Cryptosporidium parvum; identical to SEQ ID NO: 2133464

SEQ ID NO: 2247602 - protein, 27 aa, Cryptosporidium parvum
SKKEGLFNFLFLFQKLNGRPTENENLE

SEQ ID NO: 2247603 - protein, 23 aa, Cryptosporidium parvum
SKKLIELSLFAIIEWISNCLSNL

SEQ ID NO: 2247604 - protein, 22 aa, Cryptosporidium parvum
SKKLQPLFPVFGIILGISKNDQ

SEQ ID NO: 2247605 - protein, 24 aa, Cryptosporidium parvum
SKKQLIFHRIYFDLGTYSDHKLTQ

SEQ ID NO: 2247606 - protein, 31 aa, Cryptosporidium parvum
SKKWPLFFKITIFALFFLFIVLDKYQYQIIR

SEQ ID NO: 2247607 - protein, 38 aa, Cryptosporidium parvum
SKLFSFQFPWSHQSHNIPMYWLVPLLVSCLGSKTLVDP

SEQ ID NO: 2247608 - protein, 22 aa, Cryptosporidium parvum
SKLLLFILHTLRQLGIQYTLPV

SEQ ID NO: 2247609 - protein, 24 aa, Cryptosporidium parvum
SKLRKILNILKYYGSRDLEDLGIY

SEQ ID NO: 2247610 - protein, 24 aa, Cryptosporidium parvum
SKLVLGVVFLSFIASVLLFSSIEL

SEQ ID NO: 2247611 - protein, 21 aa, Cryptosporidium parvum
SKNFRYIPMIPKVTVCDFEDL

SEQ ID NO: 2247612 - protein, 24 aa, Cryptosporidium parvum
SKNRNHFWLPLLQVYGRSIVNVLF

SEQ ID NO: 2247613 - protein, 27 aa, Cryptosporidium parvum
SKNWSCEVWFYVPFEITFHPYCLISNS

SEQ ID NO: 2247614 - protein, 17 aa, Cryptosporidium parvum
SKPFPWPMELLNPSHNL

SEQ ID NO: 2247615 - protein, 22 aa, Cryptosporidium parvum
SKPILLITISFLENYMVEYYRK

SEQ ID NO: 2247616 - protein, 25 aa, Cryptosporidium parvum
SKQFGFWMFPFLLSSLSGIVLFTLL

SEQ ID NO: 2247617 - protein, 25 aa, Cryptosporidium parvum
SKQKRRKLLRRFKKLDLENKKHGLK

SEQ ID NO: 2247618 - protein, 23 aa, Cryptosporidium parvum
SKRVAYCRLKIIDIPHYIENKPL

SEQ ID NO: 2247619 - protein, 18 aa, Cryptosporidium parvum
SKRVKNCLTYLLVAAFTT

SEQ ID NO: 2247620 - protein, 31 aa, Cryptosporidium parvum
SKSFCFTFLVLFYLCVYLYLYEEKIVVRTYT

SEQ ID NO: 2247621 - protein, 37 aa, Cryptosporidium parvum; identical to SEQ ID NO: 2133477

SEQ ID NO: 2247622 - protein, 30 aa, Cryptosporidium parvum; identical to SEQ ID NO: 2133478

SEQ ID NO: 2247623 - protein, 25 aa, Cryptosporidium parvum
SKSSKLIFGLFLRSNSHFSEVEDKL

SEQ ID NO: 2247624 - protein, 18 aa, Cryptosporidium parvum
SKTISLLGLIYSTVRYQD

SEQ ID NO: 2247625 - protein, 31 aa, Cryptosporidium parvum
SKTNTFHKLNLYSYIRWLKTSLQKAYYFPIY

SEQ ID NO: 2247626 - protein, 28 aa, Cryptosporidium parvum
SKVIAVICLIVWVINFRNFQDPAHGSTI

SEQ ID NO: 2247627 - protein, 30 aa, Cryptosporidium parvum; identical to SEQ ID NO: 2133482

SEQ ID NO: 2247628 - protein, 27 aa, Cryptosporidium parvum
SKVPTKRSIFLVIKSKLNLKVVNKNSL

SEQ ID NO: 2247629 - protein, 68 aa, Cryptosporidium parvum
SKVSWTRILQKIRILNIPDIYIQATAKKILKFNIYIYRIYTDKYKRKIIKRVQGILRNLKIVNKSQMI

SEQ ID NO: 2247630 - protein, 24 aa, Cryptosporidium parvum
SKVTRYICILLSENTFTREKEADL

SEQ ID NO: 2247631 - protein, 33 aa, Cryptosporidium parvum; identical to SEQ ID NO: 2133485

SEQ ID NO: 2247632 - protein, 25 aa, Cryptosporidium parvum
SKYDLPDWYKHICIIYASLKEKNRI

SEQ ID NO: 2247633 - protein, 20 aa, Cryptosporidium parvum
SKYLILNLNGILFSNLNSFE

SEQ ID NO: 2247634 - protein, 24 aa, Cryptosporidium parvum
SKYQAIFVVPIVNSVLIASSGFCN

SEQ ID NO: 2247635 - protein, 19 aa, Cryptosporidium parvum
SLAILAFLTSILLPLFGCY

SEQ ID NO: 2247636 - protein, 19 aa, Cryptosporidium parvum
SLALFLVFKLILNPFSDHD

SEQ ID NO: 2247637 - protein, 21 aa, Cryptosporidium parvum
SLANFYYLYSLKDKSAETEIL

SEQ ID NO: 2247638 - protein, 25 aa, Cryptosporidium parvum
SLANKSLLFPFSIFSILSSEHINVR

SEQ ID NO: 2247639 - protein, 20 aa, Cryptosporidium parvum
SLANSILELVKYRYLAPLTV

SEQ ID NO: 2247640 - protein, 25 aa, Cryptosporidium parvum
SLARIQTFLFSRIYDYPILKDREFV

SEQ ID NO: 2247641 - protein, 22 aa, Cryptosporidium parvum
SLASLLGIFSISQLFLSPGSYL

SEQ ID NO: 2247642 - protein, 31 aa, Cryptosporidium parvum; identical to SEQ ID NO: 2133492

SEQ ID NO: 2247643 - protein, 27 aa, Cryptosporidium parvum
SLDEIAIICFDFFNLLEFYTDQYNYGN

SEQ ID NO: 2247644 - protein, 19 aa, Cryptosporidium parvum
SLDRTWPISASPMGGDPKL

SEQ ID NO: 2247645 - protein, 29 aa, Cryptosporidium parvum
SLDSTFPSLLIWVRFFHQTILKNQETKEA

SEQ ID NO: 2247646 - protein, 19 aa, Cryptosporidium parvum
SLDYFIEIYKDLYSEPLNV

SEQ ID NO: 2247647 - protein, 17 aa, Cryptosporidium parvum
SLELVEKLYLISAGNIL

SEQ ID NO: 2247648 - protein, 26 aa, Cryptosporidium parvum
SLESFFMDLFIILIKIMVEFKAEDKE

SEQ ID NO: 2247649 - protein, 30 aa, Cryptosporidium parvum
SLESLIFLMMLIFCSLIASSYVLYYGINDP

SEQ ID NO: 2247650 - protein, 26 aa, Cryptosporidium parvum
SLESYYTILLHFLHKKFIKIDENQFK

SEQ ID NO: 2247651 - protein, 20 aa, Cryptosporidium parvum
SLEVILFQVIIPLCELILLK

SEQ ID NO: 2247652 - protein, 22 aa, Cryptosporidium parvum
SLFFIIPLHIYPMLDALTNFID

SEQ ID NO: 2247653 - protein, 17 aa, Cryptosporidium parvum
SLFFIYILYQEEHSDAK

SEQ ID NO: 2247654 - protein, 19 aa, Cryptosporidium parvum
SLFFLLPSNTISKRSIFNF

SEQ ID NO: 2247655 - protein, 26 aa, Cryptosporidium parvum
SLFLKEGILIWILSKEIFAPVSNKKL

SEQ ID NO: 2247656 - protein, 26 aa, Cryptosporidium parvum
SLFRNLVQIPYLTSLMIYLALQELDS

SEQ ID NO: 2247657 - protein, 20 aa, Cryptosporidium parvum
SLFSELPYIISNIPFQVLLD

SEQ ID NO: 2247658 - protein, 19 aa, Cryptosporidium parvum
SLGLLLRHYSRHFCVKNSK

SEQ ID NO: 2247659 - protein, 17 aa, Cryptosporidium parvum
SLIAAWFAQNRDSVISQ

SEQ ID NO: 2247660 - protein, 24 aa, Cryptosporidium parvum
SLIAFIIRLDVMNCLSWILKHYTK

SEQ ID NO: 2247661 - protein, 31 aa, Cryptosporidium parvum
SLIAISTCIFIFFILYIVLNALSRNKEIQTN

SEQ ID NO: 2247662 - protein, 23 aa, Cryptosporidium parvum
SLIALPILCLCIPAKILEVIYIE

SEQ ID NO: 2247663 - protein, 20 aa, Cryptosporidium parvum
SLICIDHVVIFVTLKKKKCF

SEQ ID NO: 2247664 - protein, 17 aa, Cryptosporidium parvum
SLIFIRKTDKESNFEIV

SEQ ID NO: 2247665 - protein, 21 aa, Cryptosporidium parvum
SLIIDLILICLFVINSLIYKY

SEQ ID NO: 2247666 - protein, 35 aa, Cryptosporidium parvum
SLILWDSLFCYLKLKKVPIPSLKKYLLTLFKNTLT

SEQ ID NO: 2247667 - protein, 25 aa, Cryptosporidium parvum
SLINSPKIFWLKNIQYYWNKRINMR

SEQ ID NO: 2247668 - protein, 39 aa, Cryptosporidium parvum
SLIPERILFGKLIFFLLGLLNIMYIKELKICGFKTYRDE

SEQ ID NO: 2247669 - protein, 22 aa, Cryptosporidium parvum
SLISILFGPKWVRPENIQLFSA

SEQ ID NO: 2247670 - protein, 21 aa, Cryptosporidium parvum
SLISLGKTYLARNIYFLIVYL

SEQ ID NO: 2247671 - protein, 31 aa, Cryptosporidium parvum
SLISNLIKYTSLPLDWIFKGLKNQSYDHNIP

SEQ ID NO: 2247672 - protein, 19 aa, Cryptosporidium parvum
SLISQALFLIFLSGLIDAI

SEQ ID NO: 2247673 - protein, 29 aa, Cryptosporidium parvum
SLISYLEFVVLLFGTIFQFLIIRQDYSPS

SEQ ID NO: 2247674 - protein, 23 aa, Cryptosporidium parvum
SLKDIINLLRFALQIHKIGSSFF

SEQ ID NO: 2247675 - protein, 31 aa, Cryptosporidium parvum
SLKHIYLPIIQLLEQVLIRIFSKLLISNDNV

SEQ ID NO: 2247676 - protein, 23 aa, Cryptosporidium parvum
SLKLHSLVLLILKEHNWHNVQYE

SEQ ID NO: 2247677 - protein, 23 aa, Cryptosporidium parvum
SLKPLLCYPIWGRDKEDSTSLLF

SEQ ID NO: 2247678 - protein, 26 aa, Cryptosporidium parvum
SLKYIYSVLILLSQIFLCIVVWNVVC

SEQ ID NO: 2247679 - protein, 17 aa, Cryptosporidium parvum
SLKYRLFESCQLILHDV

SEQ ID NO: 2247680 - protein, 20 aa, Cryptosporidium parvum
SLLEFFEKQLLMNISEKNEQ

SEQ ID NO: 2247681 - protein, 26 aa, Cryptosporidium parvum
SLLEHIPLLIMFSSISALIGNNGQTN

SEQ ID NO: 2247682 - protein, 22 aa, Cryptosporidium parvum
SLLKRFIYLFIIFWSVIASTRS

SEQ ID NO: 2247683 - protein, 28 aa, Cryptosporidium parvum
SLLNSQLSHFGWFKLILNGGEKIQLEEN

SEQ ID NO: 2247684 - protein, 31 aa, Cryptosporidium parvum; identical to SEQ ID NO: 2133516

SEQ ID NO: 2247685 - protein, 17 aa, Cryptosporidium parvum
SLLRSLCILAKKFEFIL

SEQ ID NO: 2247686 - protein, 39 aa, Cryptosporidium parvum
SLLRTSMYFLKRSINFNYIMLPSYYLWGNIYSILGQWDD

SEQ ID NO: 2247687 - protein, 18 aa, Cryptosporidium parvum
SLLTLIIIGLIGSSIYYF

SEQ ID NO: 2247688 - protein, 29 aa, Cryptosporidium parvum
SLLYSDVISMILIALILGLPNIENRRELI

SEQ ID NO: 2247689 - protein, 18 aa, Cryptosporidium parvum
SLLYSFTSGIISLALFLV

SEQ ID NO: 2247690 - protein, 20 aa, Cryptosporidium parvum
SLMKYFSGIHFLHAALLCRK

SEQ ID NO: 2247691 - protein, 20 aa, Cryptosporidium parvum
SLMNLTLSKCIKPFLRNVSL

SEQ ID NO: 2247692 - protein, 23 aa, Cryptosporidium parvum
SLNEFPILILITISNSSFKIRRN

SEQ ID NO: 2247693 - protein, 38 aa, Cryptosporidium parvum
SLNFEDPLLPFLTLSILVILTIILNLGLYLFNLIMGNQ

SEQ ID NO: 2247694 - protein, 39 aa, Cryptosporidium parvum
SLNFLLFYVNINVMIFPLLLLLLLLISIDFIQCEDFENN

SEQ ID NO: 2247695 - protein, 20 aa, Cryptosporidium parvum
SLNFYWMNLSSTVLLRGFEH

SEQ ID NO: 2247696 - protein, 26 aa, Cryptosporidium parvum
SLNLILEVYPAWIPITVRLFEGSETN

SEQ ID NO: 2247697 - protein, 18 aa, Cryptosporidium parvum
SLNLVGSYLERFLGKYYS

SEQ ID NO: 2247698 - protein, 33 aa, Cryptosporidium parvum; identical to SEQ ID NO: 2133523

SEQ ID NO: 2247699 - protein, 28 aa, Cryptosporidium parvum
SLPFNFLLLFTLLVFSIGVVSVKSNDNS

SEQ ID NO: 2247700 - protein, 21 aa, Cryptosporidium parvum
SLPFPIQIRLKMASGLKLPAL

SEQ ID NO: 2247701 - protein, 18 aa, Cryptosporidium parvum
SLPLLLSIDKGKFYSDLD

SEQ ID NO: 2247702 - protein, 19 aa, Cryptosporidium parvum
SLPNHRLLKTLVPITIPER

SEQ ID NO: 2247703 - protein, 17 aa, Cryptosporidium parvum
SLPPFNLKSVPIMLGIS

SEQ ID NO: 2247704 - protein, 23 aa, Cryptosporidium parvum
SLPQPIKYSLIYPPNHPNSDQDL

SEQ ID NO: 2247705 - protein, 20 aa, Cryptosporidium parvum
SLQFIPDHPTIYLKYVQEER

SEQ ID NO: 2247706 - protein, 22 aa, Cryptosporidium parvum
SLQFQVSLITKALYALSVLKDT

SEQ ID NO: 2247707 - protein, 25 aa, Cryptosporidium parvum
SLQIEYMCLLNLLAFSFTMTNCTFF

SEQ ID NO: 2247708 - protein, 19 aa, Cryptosporidium parvum
SLRLFLSLNGMPLASHFNF

SEQ ID NO: 2247709 - protein, 25 aa, Cryptosporidium parvum
SLSSTFPMDIPLAGKLKVLCLDKTG

SEQ ID NO: 2247710 - protein, 25 aa, Cryptosporidium parvum
SLSVPIIDLWRILALHPQSSDIHKK

SEQ ID NO: 2247711 - protein, 24 aa, Cryptosporidium parvum
SLSYFTCIGSWLRHSRTLIYNTPN

SEQ ID NO: 2247712 - protein, 23 aa, Cryptosporidium parvum
SLTDLYFLFSILKSKIKNMDQDL

SEQ ID NO: 2247713 - protein, 27 aa, Cryptosporidium parvum
SLTDTSYLFFISRLLVVVSLFFIIPLH

SEQ ID NO: 2247714 - protein, 19 aa, Cryptosporidium parvum
SLTIWLRAWLIKRQLQPRN

SEQ ID NO: 2247715 - protein, 22 aa, Cryptosporidium parvum
SLTIYCIMGSLFSFLIKIKSFS

SEQ ID NO: 2247716 - protein, 25 aa, Cryptosporidium parvum
SLTTKLNIIYRATTIFLIFSDGKKL

SEQ ID NO: 2247717 - protein, 23 aa, Cryptosporidium parvum
SLVILVYICKLLRAKYGVSGKLK

SEQ ID NO: 2247718 - protein, 23 aa, Cryptosporidium parvum
SLVPSLSALLKYYNQEYIQSLLG

SEQ ID NO: 2247719 - protein, 18 aa, Cryptosporidium parvum
SLYMMIYIAIISSKGPEN

SEQ ID NO: 2247720 - protein, 18 aa, Cryptosporidium parvum
SLYPGNRGSSLLLKAIKK

SEQ ID NO: 2247721 - protein, 20 aa, Cryptosporidium parvum
SLYPYLDFENQFLFCLSNRN

SEQ ID NO: 2247722 - protein, 17 aa, Cryptosporidium parvum
SLYYNSLLCMKCFNFSL

SEQ ID NO: 2247723 - protein, 28 aa, Cryptosporidium parvum
SMASQTIKFIFIIFKPNNLSINTPLSKI

SEQ ID NO: 2247724 - protein, 26 aa, Cryptosporidium parvum
SMCLILYFLEPFFETFFYLRETLDKC

SEQ ID NO: 2247725 - protein, 24 aa, Cryptosporidium parvum
SMDDLKKPIFLLYVVSRNDHHSST

SEQ ID NO: 2247726 - protein, 25 aa, Cryptosporidium parvum
SMDDSLRFYSLINLNLMGNKISEFE

SEQ ID NO: 2247727 - protein, 18 aa, Cryptosporidium parvum
SMDILQEIKLFINYFKDV

SEQ ID NO: 2247728 - protein, 23 aa, Cryptosporidium parvum
SMGLYPICYFSPLTILSDLVQNL

SEQ ID NO: 2247729 - protein, 28 aa, Cryptosporidium parvum
SMGVLLVAMFLLEYIRFLPEAVLGAIIS

SEQ ID NO: 2247730 - protein, 37 aa, Cryptosporidium parvum
SMIALLKLFLLIFLNITNIFMFLITGKSTYFQNDSII

SEQ ID NO: 2247731 - protein, 27 aa, Cryptosporidium parvum
SMIDFIILRSIFGNGLLIFLLFEIHYL

SEQ ID NO: 2247732 - protein, 26 aa, Cryptosporidium parvum
SMILTTFFMYYFVGGIFDWTCSLLIS

SEQ ID NO: 2247733 - protein, 24 aa, Cryptosporidium parvum
SMKQLPLSLMLWIQATRLISDNID

SEQ ID NO: 2247734 - protein, 19 aa, Cryptosporidium parvum
SMKTLPSFATYDLGSRAGG

SEQ ID NO: 2247735 - protein, 17 aa, Cryptosporidium parvum
SMLMFSIFLCYADRIIM

SEQ ID NO: 2247736 - protein, 25 aa, Cryptosporidium parvum
SMLQLTLKCMLSIFTNFRSSTKTQL

SEQ ID NO: 2247737 - protein, 29 aa, Cryptosporidium parvum
SMLVTTLFKLCSILLITLLLSIKKHNSDF

SEQ ID NO: 2247738 - protein, 28 aa, Cryptosporidium parvum
SMQENQVIFLYYLGFPINHSNMNYYIPE

SEQ ID NO: 2247739 - protein, 25 aa, Cryptosporidium parvum
SNDLKKLVLILLSKPALNKNNLDVF

SEQ ID NO: 2247740 - protein, 23 aa, Cryptosporidium parvum
SNDMDFIHNLILKTVYGITYSES

SEQ ID NO: 2247741 - protein, 29 aa, Cryptosporidium parvum
SNDVISSKLWGKFKSIPYFVVLEICNESF

SEQ ID NO: 2247742 - protein, 23 aa, Cryptosporidium parvum
SNEDLVLYFILKNFNGYCDNLIQ

SEQ ID NO: 2247743 - protein, 22 aa, Cryptosporidium parvum
SNEKLFKILNDFNIPILQENEK

SEQ ID NO: 2247744 - protein, 26 aa, Cryptosporidium parvum
SNELKYMGIFLQSHFRFLYSAIKSIN

SEQ ID NO: 2247745 - protein, 24 aa, Cryptosporidium parvum
SNELWKLDIAYFSFQKFGMDKSCK

SEQ ID NO: 2247746 - protein, 28 aa, Cryptosporidium parvum
SNEPPMTRYLLWIDIYEISCRPAFDGEV

SEQ ID NO: 2247747 - protein, 36 aa, Cryptosporidium parvum
SNFSKLVYYMMIYDLEWTWKYILSTKNGRFLLNLIS

SEQ ID NO: 2247748 - protein, 17 aa, Cryptosporidium parvum
SNFTWRSTIYDIIIFDK

SEQ ID NO: 2247749 - protein, 24 aa, Cryptosporidium parvum
SNGGIYIITSRILLTDLLSEKLDF

SEQ ID NO: 2247750 - protein, 47 aa, Cryptosporidium parvum; identical to SEQ ID NO: 2133560

SEQ ID NO: 2247751 - protein, 17 aa, Cryptosporidium parvum
SNGNPNWYTLKPIFDMS

SEQ ID NO: 2247752 - protein, 25 aa, Cryptosporidium parvum
SNIFTFLVISIIRKIDPVIVPCIIF

SEQ ID NO: 2247753 - protein, 40 aa, Cryptosporidium parvum; identical to SEQ ID NO: 2133562

SEQ ID NO: 2247754 - protein, 28 aa, Cryptosporidium parvum
SNILALIISFISIPFIKPGITSDIISLS

SEQ ID NO: 2247755 - protein, 25 aa, Cryptosporidium parvum
SNISLPFFHSMPIFEKLLNLHKSLD

SEQ ID NO: 2247756 - protein, 27 aa, Cryptosporidium parvum
SNLDLPIQLLDNFLLSWIIEHVEQKKL

SEQ ID NO: 2247757 - protein, 17 aa, Cryptosporidium parvum
SNLEIRQKFKNKFVFGC

SEQ ID NO: 2247758 - protein, 24 aa, Cryptosporidium parvum
SNLFKNIHPLLLDGLVLENKLSIN

SEQ ID NO: 2247759 - protein, 19 aa, Cryptosporidium parvum
SNLILRKLLIDENGSKKII

SEQ ID NO: 2247760 - protein, 20 aa, Cryptosporidium parvum
SNLNILIPLAIYGLNKPSKK

SEQ ID NO: 2247761 - protein, 30 aa, Cryptosporidium parvum
SNLNSFMLVIKLDIPLIIENNLLIPVQLSF

SEQ ID NO: 2247762 - protein, 22 aa, Cryptosporidium parvum
SNLPLLITLSFLLEDKKKSLLV

SEQ ID NO: 2247763 - protein, 18 aa, Cryptosporidium parvum
SNLPLNSTILDQIKETRS

SEQ ID NO: 2247764 - protein, 17 aa, Cryptosporidium parvum
SNLPLVALLLLNGANID

SEQ ID NO: 2247765 - protein, 30 aa, Cryptosporidium parvum
SNLSPFEKFPIPSWLYKLFSRLVEVDFTEY

SEQ ID NO: 2247766 - protein, 26 aa, Cryptosporidium parvum
SNLVCQLVFLLLLFSRVMSITIEHYL

SEQ ID NO: 2247767 - protein, 20 aa, Cryptosporidium parvum
SNLYIFFRLLSNNICNSSVS

SEQ ID NO: 2247768 - protein, 26 aa, Cryptosporidium parvum
SNMDPNQFFMLFSEHLHVSNLFKSES

SEQ ID NO: 2247769 - protein, 23 aa, Cryptosporidium parvum
SNNKLFQRLPFQNNLKIGNFISY

SEQ ID NO: 2247770 - protein, 32 aa, Cryptosporidium parvum
SNNNINELWPFFYLHYNYIQKKLIISSHNLIL

SEQ ID NO: 2247771 - protein, 31 aa, Cryptosporidium parvum
SNNNNIFLTLYTIVGYFFTSIAIIYYNHWLF

SEQ ID NO: 2247772 - protein, 33 aa, Cryptosporidium parvum
SNNPNFIWIYTFIVLFQGLLCALLFIGEAIGGV

SEQ ID NO: 2247773 - protein, 30 aa, Cryptosporidium parvum
SNNRSEFLLWMNGLNDLVCNLSLIGGSKKI

SEQ ID NO: 2247774 - protein, 17 aa, Cryptosporidium parvum
SNPAKLFDLHYLNAYFK

SEQ ID NO: 2247775 - protein, 29 aa, Cryptosporidium parvum
SNPTFINYLLIFFFILFDSVTLFESKSGF

SEQ ID NO: 2247776 - protein, 30 aa, Cryptosporidium parvum; identical to SEQ ID NO: 2133575

SEQ ID NO: 2247777 - protein, 26 aa, Cryptosporidium parvum
SNSITKLLPSFLWPHDPNNIILKESN

SEQ ID NO: 2247778 - protein, 24 aa, Cryptosporidium parvum
SNSKQFLHIFKYFKNSKFNLNKKS

SEQ ID NO: 2247779 - protein, 17 aa, Cryptosporidium parvum
SNSPLHFLSFLLNYKST

SEQ ID NO: 2247780 - protein, 25 aa, Cryptosporidium parvum
SNSWLFKSDLYYIFLLASNIKLNYK

SEQ ID NO: 2247781 - protein, 24 aa, Cryptosporidium parvum
SNSYKWNWSSIPNNFVNFNRILKS

SEQ ID NO: 2247782 - protein, 42 aa, Cryptosporidium parvum; identical to SEQ ID NO: 2133581

SEQ ID NO: 2247783 - protein, 30 aa, Cryptosporidium parvum
SNVALPKIQYIFDKIPFNLFENIVIKISNK

SEQ ID NO: 2247784 - protein, 26 aa, Cryptosporidium parvum
SNVFRQHIIVLLRDFGLITFQGGIVH

SEQ ID NO: 2247785 - protein, 24 aa, Cryptosporidium parvum
SNVSFGFFVFISVLVSIGLGYIID

SEQ ID NO: 2247786 - protein, 24 aa, Cryptosporidium parvum
SNVTYIAHTFGYRLYIHELRENNE

SEQ ID NO: 2247787 - protein, 18 aa, Cryptosporidium parvum
SNWNTFLFVNKVIELFIF

SEQ ID NO: 2247788 - protein, 31 aa, Cryptosporidium parvum
SNYFRVIATFIFLLFCILFALLAKNAAQYVE

SEQ ID NO: 2247789 - protein, 23 aa, Cryptosporidium parvum
SNYGELLDWTLLSNVKGIPEDVV

SEQ ID NO: 2247790 - protein, 23 aa, Cryptosporidium parvum
SNYHPELWQPAWGIRTMLDALHA

SEQ ID NO: 2247791 - protein, 21 aa, Cryptosporidium parvum
SNYKALFFLGDIRRGIHFGML

SEQ ID NO: 2247792 - protein, 28 aa, Cryptosporidium parvum
SNYYSINILIFNILRPLKINFFELLIEA

SEQ ID NO: 2247793 - protein, 18 aa, Cryptosporidium parvum
SPAPPPFYVPYRTNITES

SEQ ID NO: 2247794 - protein, 21 aa, Cryptosporidium parvum
SPCPVDCVLSFWSPWTGCSKF

SEQ ID NO: 2247795 - protein, 40 aa, Cryptosporidium parvum
SPFGRIIVTLILITTVIWSIIGLLGIILIFKVYKDNKKEK

SEQ ID NO: 2247796 - protein, 19 aa, Cryptosporidium parvum
SPFREKLINLFGVSSFIIE

SEQ ID NO: 2247797 - protein, 25 aa, Cryptosporidium parvum
SPIFRVVLGVLRWLRWESRVNPCKQ

SEQ ID NO: 2247798 - protein, 19 aa, Cryptosporidium parvum
SPIHKLLMFGISNKSNMSS

SEQ ID NO: 2247799 - protein, 27 aa, Cryptosporidium parvum
SPKCRPWSIWGTLPYRNASALAQYKPC

SEQ ID NO: 2247800 - protein, 24 aa, Cryptosporidium parvum
SPKRPCWRIILLDDVIWNGVQSSI

SEQ ID NO: 2247801 - protein, 25 aa, Cryptosporidium parvum
SPKYPITDDLWYLMAHFRNPDSKME

SEQ ID NO: 2247802 - protein, 33 aa, Cryptosporidium parvum
SPLKTATFMFFSFALFGLIPMLSFVSFKYIFSL

SEQ ID NO: 2247803 - protein, 21 aa, Cryptosporidium parvum
SPLYPSGIIYPQSPITLPGMG

SEQ ID NO: 2247804 - protein, 27 aa, Cryptosporidium parvum
SPNEFLQYFSIAAGINSLIFSLSNTIY

SEQ ID NO: 2247805 - protein, 24 aa, Cryptosporidium parvum
SPNFPTWCLPSPSKKLRNLMVLQQ

SEQ ID NO: 2247806 - protein, 27 aa, Cryptosporidium parvum
SPQIGYCRGFYYRLLVHPRGGSCNDSE

SEQ ID NO: 2247807 - protein, 22 aa, Cryptosporidium parvum
SPQISLIFHYWGVQQHTAKVFY

SEQ ID NO: 2247808 - protein, 31 aa, Cryptosporidium parvum
SPQKASCILPKLPEAFLFLSKKEDQVRKGNG

SEQ ID NO: 2247809 - protein, 21 aa, Cryptosporidium parvum
SPQLVLIYPVYTIQLKSMCLP

SEQ ID NO: 2247810 - protein, 24 aa, Cryptosporidium parvum
SPRQWMWEIVTGFKWGSSSYGSSS

SEQ ID NO: 2247811 - protein, 23 aa, Cryptosporidium parvum
SPSARFQILINLIILIDSTRTLK

SEQ ID NO: 2247812 - protein, 23 aa, Cryptosporidium parvum
SPSYYFLFIPVVALVYYNVNSYY

SEQ ID NO: 2247813 - protein, 24 aa, Cryptosporidium parvum
SPWETIIEVIFLLNSIKITPHKTF

SEQ ID NO: 2247814 - protein, 25 aa, Cryptosporidium parvum
SQCLNAFNYFYVHPNLITCTPSPSK

SEQ ID NO: 2247815 - protein, 24 aa, Cryptosporidium parvum
SQDNLFFIVELINTSFAPCEAPDR

SEQ ID NO: 2247816 - protein, 28 aa, Cryptosporidium parvum
SQDNYYLLHQLFSQFFWALHDDPELEHL

SEQ ID NO: 2247817 - protein, 25 aa, Cryptosporidium parvum
SQEGEGFAFWFVSEAYGSIYPKSNE

SEQ ID NO: 2247818 - protein, 28 aa, Cryptosporidium parvum
SQELPVFSLILIDTGMLLLYSGSELIIN

SEQ ID NO: 2247819 - protein, 18 aa, Cryptosporidium parvum
SQFNIGSIFFILGTLLQL

SEQ ID NO: 2247820 - protein, 21 aa, Cryptosporidium parvum
SQGFLWINSLISFSSSITIKI

SEQ ID NO: 2247821 - protein, 24 aa, Cryptosporidium parvum
SQIDQICLLWPLDVINLQDHEQLE

SEQ ID NO: 2247822 - protein, 17 aa, Cryptosporidium parvum
SQILPNYFFQNGSLNEG

SEQ ID NO: 2247823 - protein, 24 aa, Cryptosporidium parvum
SQLKHIFFPISFIISEPPPSNRAS

SEQ ID NO: 2247824 - protein, 27 aa, Cryptosporidium parvum
SQMESLDWWWWLNIKDNFEGLLTQNMS

SEQ ID NO: 2247825 - protein, 43 aa, Cryptosporidium parvum
SQMIKDRHFLGAYTIFGSLLTALLLLSIATFHGRQYAEKSEDI

SEQ ID NO: 2247826 - protein, 20 aa, Cryptosporidium parvum
SQNFTVIWSCLIDLGNDIKL

SEQ ID NO: 2247827 - protein, 24 aa, Cryptosporidium parvum
SQNKSLFLWKIPEAKLIKTITNSH

SEQ ID NO: 2247828 - protein, 45 aa, Cryptosporidium parvum
SQNLQLLIVWTIFLGIIVLFFHLIYKYLIKNIFNYILNFISKKDS

SEQ ID NO: 2247829 - protein, 28 aa, Cryptosporidium parvum
SQNTTLLRLYLMHIPSILPSIYTKSLQI

SEQ ID NO: 2247830 - protein, 22 aa, Cryptosporidium parvum
SQPPPLIFKHSFISISLTKISS

SEQ ID NO: 2247831 - protein, 26 aa, Cryptosporidium parvum
SQSDKMMLIVLNLIKLILLSYKNNGT

SEQ ID NO: 2247832 - protein, 17 aa, Cryptosporidium parvum
SQSILRYILENFGLYLN

SEQ ID NO: 2247833 - protein, 25 aa, Cryptosporidium parvum
SQVGLGLSAFLFPSLFTPTDQQGQP

SEQ ID NO: 2247834 - protein, 22 aa, Cryptosporidium parvum
SQYIFDLHITAIFFPLGIFVCA

SEQ ID NO: 2247835 - protein, 24 aa, Cryptosporidium parvum
SQYKIVLRFLSYLDHLLNFMSHTI

SEQ ID NO: 2247836 - protein, 23 aa, Cryptosporidium parvum
SRELQRMCLVLYSPLCGVFSEAM

SEQ ID NO: 2247837 - protein, 26 aa, Cryptosporidium parvum
SRFFIGFFQAFSIVYLPLWVERFSPQ

SEQ ID NO: 2247838 - protein, 33 aa, Cryptosporidium parvum
SRFGAKEIVFLKRPLHYLQNAYLACGGKGISSS

SEQ ID NO: 2247839 - protein, 26 aa, Cryptosporidium parvum
SRFINEALLTMLPPKFSRNSWINHLP

SEQ ID NO: 2247840 - protein, 22 aa, Cryptosporidium parvum
SRFPTITLGFPGLKVEWEPAQY

SEQ ID NO: 2247841 - protein, 18 aa, Cryptosporidium parvum
SRFSCIVKKRILKFQFNR

SEQ ID NO: 2247842 - protein, 22 aa, Cryptosporidium parvum
SRFVYGIGIPKQKIINFSKTQR

SEQ ID NO: 2247843 - protein, 33 aa, Cryptosporidium parvum
SRGKNNLLLFPRLNKFRYIISILLCSSIIAYTI

SEQ ID NO: 2247844 - protein, 25 aa, Cryptosporidium parvum
SRHLVCDYIYIHEKFPEAALGRRGQ

SEQ ID NO: 2247845 - protein, 19 aa, Cryptosporidium parvum
SRIFIGIACSILCLIAEVG

SEQ ID NO: 2247846 - protein, 17 aa, Cryptosporidium parvum
SRIIPISNMLLVISSRL

SEQ ID NO: 2247847 - protein, 48 aa, Cryptosporidium parvum
SRILEYYLLVIILAKLFFIFSRKMLSMILLLNHILIYILDNFEDYTFM

SEQ ID NO: 2247848 - protein, 26 aa, Cryptosporidium parvum
SRISLPEIYFVLTVDGTLWSIGENGK

SEQ ID NO: 2247849 - protein, 22 aa, Cryptosporidium parvum
SRKQIFFDSILKKLNLSLNLLW

SEQ ID NO: 2247850 - protein, 22 aa, Cryptosporidium parvum
SRLRYTKLSFFESTPIGRILNR

SEQ ID NO: 2247851 - protein, 22 aa, Cryptosporidium parvum
SRNNPYFIVRQGKVAELATMSD

SEQ ID NO: 2247852 - protein, 19 aa, Cryptosporidium parvum
SRNTPQELFLVVLDNLHSK

SEQ ID NO: 2247853 - protein, 19 aa, Cryptosporidium parvum
SRNYFLEVVKLLIQFLGIS

SEQ ID NO: 2247854 - protein, 21 aa, Cryptosporidium parvum
SRPSILYLLSYHDHSDIAIVL

SEQ ID NO: 2247855 - protein, 21 aa, Cryptosporidium parvum
SRQTVFLPVIGLVPENELKPG

SEQ ID NO: 2247856 - protein, 17 aa, Cryptosporidium parvum
SRRVHFFGLPKLTPNDI

SEQ ID NO: 2247857 - protein, 27 aa, Cryptosporidium parvum
SRSALIKKSFWLDSWSQFDIFATGRKN

SEQ ID NO: 2247858 - protein, 20 aa, Cryptosporidium parvum
SRSCCLILLLIAFVENNRNL

SEQ ID NO: 2247859 - protein, 19 aa, Cryptosporidium parvum
SRSILECLRFSLFGEISIP

SEQ ID NO: 2247860 - protein, 24 aa, Cryptosporidium parvum
SRVIPIVIRILLSKLGKDKEGPKK

SEQ ID NO: 2247861 - protein, 17 aa, Cryptosporidium parvum
SRWIWLSLHFFSATYSI

SEQ ID NO: 2247862 - protein, 25 aa, Cryptosporidium parvum
SRWQFLYVLLVIIASLIGISLSFMS

SEQ ID NO: 2247863 - protein, 23 aa, Cryptosporidium parvum
SRYKLVPIKWSWSVQEISEIFIL

SEQ ID NO: 2247864 - protein, 25 aa, Cryptosporidium parvum
SSAEMLTYFLRLLAVPEQKAKNEHL

SEQ ID NO: 2247865 - protein, 25 aa, Cryptosporidium parvum
SSAFLLLPLFFLNLVSYHTFSIFQV

SEQ ID NO: 2247866 - protein, 27 aa, Cryptosporidium parvum
SSAKFLYERLIQALKLPSPVIPSSIMC

SEQ ID NO: 2247867 - protein, 22 aa, Cryptosporidium parvum
SSDDIYHYIFNNTLTGINSVPI

SEQ ID NO: 2247868 - protein, 24 aa, Cryptosporidium parvum
SSDEVELQLLLKSSTYNLPTVDSA

SEQ ID NO: 2247869 - protein, 18 aa, Cryptosporidium parvum
SSDQILFPPGTNAKLKCS

SEQ ID NO: 2247870 - protein, 17 aa, Cryptosporidium parvum
SSDSIVKGIILWGLPFY

SEQ ID NO: 2247871 - protein, 26 aa, Cryptosporidium parvum
SSDYLCNQLYLRKNEFLPYSEIYLNI

SEQ ID NO: 2247872 - protein, 22 aa, Cryptosporidium parvum
SSERLFIIPLCNRKTFLERVIE

SEQ ID NO: 2247873 - protein, 29 aa, Cryptosporidium parvum
SSEVMRICIVIIWTIACVVLGFSGAMMII

SEQ ID NO: 2247874 - protein, 26 aa, Cryptosporidium parvum
SSFGLTLWEYLPLVAILSGCTGIFII

SEQ ID NO: 2247875 - protein, 22 aa, Cryptosporidium parvum
SSFKIRRNIFLTDLISLKGIGD

SEQ ID NO: 2247876 - protein, 22 aa, Cryptosporidium parvum
SSFLVLSLTIIIAFPNTITSLI

SEQ ID NO: 2247877 - protein, 23 aa, Cryptosporidium parvum
SSGIFYVTAYRKLPGDDCIGGWL

SEQ ID NO: 2247878 - protein, 28 aa, Cryptosporidium parvum
SSGSYILHMMFILIGSLDYYNLDFWKNQ

SEQ ID NO: 2247879 - protein, 23 aa, Cryptosporidium parvum
SSHSLFDLVFDRIKIFARSNPEH

SEQ ID NO: 2247880 - protein, 25 aa, Cryptosporidium parvum
SSHSQVFPQLLNYTSFFFNSATSLN

SEQ ID NO: 2247881 - protein, 23 aa, Cryptosporidium parvum
SSHTIIAWISSDSKFFCWKKVRS

SEQ ID NO: 2247882 - protein, 35 aa, Cryptosporidium parvum
SSIESYLMIFLLILPPIMVKLGESLLLIILREESI

SEQ ID NO: 2247883 - protein, 23 aa, Cryptosporidium parvum
SSIFSMDSFINPIGNLLKGKKPS

SEQ ID NO: 2247884 - protein, 19 aa, Cryptosporidium parvum
SSIFYYKMVLFKSKIDTNE

SEQ ID NO: 2247885 - protein, 17 aa, Cryptosporidium parvum
SSIILINSWNKKRKNRI

SEQ ID NO: 2247886 - protein, 17 aa, Cryptosporidium parvum
SSIILLYTQLKGGNHHE

SEQ ID NO: 2247887 - protein, 36 aa, Cryptosporidium parvum
SSIMFIPILIVTGEIRFFFILFDINQGIFKICLLLN

SEQ ID NO: 2247888 - protein, 27 aa, Cryptosporidium parvum
SSIQLPQPPLPPLLPPLSTSVQNEDER

SEQ ID NO: 2247889 - protein, 18 aa, Cryptosporidium parvum
SSISGICILIFATGLILS

SEQ ID NO: 2247890 - protein, 23 aa, Cryptosporidium parvum
SSISYILCCLYYNFLDLNPEIQN

SEQ ID NO: 2247891 - protein, 25 aa, Cryptosporidium parvum
SSKFLSCWAIFFLTTAFAAGLNKFT

SEQ ID NO: 2247892 - protein, 18 aa, Cryptosporidium parvum
SSKLNQFYQILSISFINN

SEQ ID NO: 2247893 - protein, 41 aa, Cryptosporidium parvum
SSKLTKRLLLIPIPLLIQLLQAIFMFLTARNTTMLSPLMLS

SEQ ID NO: 2247894 - protein, 17 aa, Cryptosporidium parvum
SSKLYKATILWSKLFVI

SEQ ID NO: 2247895 - protein, 37 aa, Cryptosporidium parvum; identical to SEQ ID NO: 2133650

SEQ ID NO: 2247896 - protein, 17 aa, Cryptosporidium parvum
SSKRIRLGSLENLYAIG

SEQ ID NO: 2247897 - protein, 27 aa, Cryptosporidium parvum
SSKRRARKIMTKKGLSLLIKEFNTSKT

SEQ ID NO: 2247898 - protein, 21 aa, Cryptosporidium parvum
SSKSMISYPIKNQSKYESEDE

SEQ ID NO: 2247899 - protein, 30 aa, Cryptosporidium parvum
SSLAKLFYNLFFSISLFFTERYRCIIFFCV

SEQ ID NO: 2247900 - protein, 20 aa, Cryptosporidium parvum
SSLCLWWKHPVNYPLSVVLA

SEQ ID NO: 2247901 - protein, 28 aa, Cryptosporidium parvum
SSLFFERPELLLIHKKKVLRDMLNGNNY

SEQ ID NO: 2247902 - protein, 21 aa, Cryptosporidium parvum
SSLILPISRYYLIGMLVLSSE

SEQ ID NO: 2247903 - protein, 25 aa, Cryptosporidium parvum
SSLKIIIISSILPRLIHFLGASESV

SEQ ID NO: 2247904 - protein, 44 aa, Cryptosporidium parvum
SSLLRIILDYIGLLLYYFINIAKLIFHYILNPRLNTLKELYPHH

SEQ ID NO: 2247905 - protein, 27 aa, Cryptosporidium parvum
SSLLSIFIFLITSIQMIIYFVQLKFGP

SEQ ID NO: 2247906 - protein, 42 aa, Cryptosporidium parvum
SSLNILTILTLEWIYFNIFLRYYYSSIDLINKIWSSLLNLYQ

SEQ ID NO: 2247907 - protein, 41 aa, Cryptosporidium parvum; identical to SEQ ID NO: 2133654

SEQ ID NO: 2247908 - protein, 25 aa, Cryptosporidium parvum
SSLSTIIYILYLWDELNTEKKSKKE

SEQ ID NO: 2247909 - protein, 17 aa, Cryptosporidium parvum
SSLTALLRDFLRAGLEH

SEQ ID NO: 2247910 - protein, 23 aa, Cryptosporidium parvum
SSLTFMTMYLQYCDLSNFQAALV

SEQ ID NO: 2247911 - protein, 28 aa, Cryptosporidium parvum
SSLTSLIKLLNPGLLWTSGQDNSSSSSS

SEQ ID NO: 2247912 - protein, 22 aa, Cryptosporidium parvum
SSLVIFNILYYGFSPEYCQEYT

SEQ ID NO: 2247913 - protein, 29 aa, Cryptosporidium parvum
SSLWQQLDFLYYTLTILFNIGTCRYYPHI

SEQ ID NO: 2247914 - protein, 23 aa, Cryptosporidium parvum
SSMKLFVALLIRPKSVEWFNGLF

SEQ ID NO: 2247915 - protein, 32 aa, Cryptosporidium parvum
SSMWEWNLRDIIRLLRFLQLNLIRNLNLRKEI

SEQ ID NO: 2247916 - protein, 23 aa, Cryptosporidium parvum
SSNIPEKPLLGREWIQREKSKKQ

SEQ ID NO: 2247917 - protein, 24 aa, Cryptosporidium parvum
SSNLLNILHLIPLSLSILNQLFEN

SEQ ID NO: 2247918 - protein, 25 aa, Cryptosporidium parvum
SSNLQRFLFWNFREFYRFHESYYFT

SEQ ID NO: 2247919 - protein, 34 aa, Cryptosporidium parvum
SSNQILHFYCIKFLWKFLPLTSTKDFLEQYSRRL

SEQ ID NO: 2247920 - protein, 24 aa, Cryptosporidium parvum
SSNWIAFDFINFINGLMGLKILHY

SEQ ID NO: 2247921 - protein, 24 aa, Cryptosporidium parvum
SSNYTFYFTTISILVINVIIWDNI

SEQ ID NO: 2247922 - protein, 22 aa, Cryptosporidium parvum
SSPTVFLFCDLLDKLVNGPSSR

SEQ ID NO: 2247923 - protein, 23 aa, Cryptosporidium parvum
SSQAAFKIIFGEITALKSMTNIQ

SEQ ID NO: 2247924 - protein, 31 aa, Cryptosporidium parvum
SSSDPIQLPGIRYFALFIFSKQVNVCMSKVF

SEQ ID NO: 2247925 - protein, 24 aa, Cryptosporidium parvum
SSSKILIINTFFRSGTKFEVISNE

SEQ ID NO: 2247926 - protein, 27 aa, Cryptosporidium parvum
SSSLLICYGNILFILWLDYSNQSNEER

SEQ ID NO: 2247927 - protein, 23 aa, Cryptosporidium parvum
SSSVKPFRPILVINQSGYDIQLI

SEQ ID NO: 2247928 - protein, 17 aa, Cryptosporidium parvum
SSSWYLARLARESFMNM

SEQ ID NO: 2247929 - protein, 30 aa, Cryptosporidium parvum
SSTDGYIWVKLDSLMKLFQGLDSEEFSLYP

SEQ ID NO: 2247930 - protein, 34 aa, Cryptosporidium parvum
SSTLDSIGMRWLIPWYLIEALLTKPNQINLLSNG

SEQ ID NO: 2247931 - protein, 26 aa, Cryptosporidium parvum
SSTLYQQFIFKIKSEFKWIMSGTPLP

SEQ ID NO: 2247932 - protein, 24 aa, Cryptosporidium parvum
SSTSYIYIPHHITILIAFIDFIST

SEQ ID NO: 2247933 - protein, 23 aa, Cryptosporidium parvum
SSVCIFILPWIITYFSHNISVKQ

SEQ ID NO: 2247934 - protein, 24 aa, Cryptosporidium parvum
SSVPICPITFLPINVFAIYKHLSC

SEQ ID NO: 2247935 - protein, 18 aa, Cryptosporidium parvum
SSWILLCSGLTIGLSNLF

SEQ ID NO: 2247936 - protein, 24 aa, Cryptosporidium parvum
SSYGDKYFCLYKLRVYGEQVNNNI

SEQ ID NO: 2247937 - protein, 23 aa, Cryptosporidium parvum
SSYPFDPLIFQNISNMYISLFGH

SEQ ID NO: 2247938 - protein, 26 aa, Cryptosporidium parvum
SSYSHYIWTFIRLAIGGPAVGVVFGF

SEQ ID NO: 2247939 - protein, 25 aa, Cryptosporidium parvum
STAFFASFTIIKMTAGLWGLALVFV

SEQ ID NO: 2247940 - protein, 18 aa, Cryptosporidium parvum
STALLYPELYRHLKAGRV

SEQ ID NO: 2247941 - protein, 36 aa, Cryptosporidium parvum
STDTVTFNLLFMLFLHIFGLVLTRNFFEILSATYSI

SEQ ID NO: 2247942 - protein, 33 aa, Cryptosporidium parvum
STENNLFVIYIDWLHYLFTLYSTIESDINYQDE

SEQ ID NO: 2247943 - protein, 28 aa, Cryptosporidium parvum
STFRDWCWYFIFSWVIYCFNIWSDNSMV

SEQ ID NO: 2247944 - protein, 30 aa, Cryptosporidium parvum
STFWKVLLGNIFLIILCLSNVYSTWNLEWL

SEQ ID NO: 2247945 - protein, 21 aa, Cryptosporidium parvum
STFYNLFSQLLKHGRLAIGIY

SEQ ID NO: 2247946 - protein, 33 aa, Cryptosporidium parvum; identical to SEQ ID NO: 2133677

SEQ ID NO: 2247947 - protein, 18 aa, Cryptosporidium parvum
STGLVWNTIWKEIKYNLI

SEQ ID NO: 2247948 - protein, 33 aa, Cryptosporidium parvum; identical to SEQ ID NO: 2133678

SEQ ID NO: 2247949 - protein, 23 aa, Cryptosporidium parvum
STHIKNLLLLYLSIFWTDIGTTE

SEQ ID NO: 2247950 - protein, 20 aa, Cryptosporidium parvum
STHTIFLAIKLSILMSLRDH

SEQ ID NO: 2247951 - protein, 21 aa, Cryptosporidium parvum
STHYPMLHFPLTNGIKMNDYF

SEQ ID NO: 2247952 - protein, 30 aa, Cryptosporidium parvum; identical to SEQ ID NO: 2133680

SEQ ID NO: 2247953 - protein, 26 aa, Cryptosporidium parvum
STIRHPYYIILVLPICRALETLLEKK

SEQ ID NO: 2247954 - protein, 21 aa, Cryptosporidium parvum
STKLYFYRELKFTLQRLISNW

SEQ ID NO: 2247955 - protein, 26 aa, Cryptosporidium parvum
STKNGRFLLNLISLLNHPSIFHLLKL

SEQ ID NO: 2247956 - protein, 40 aa, Cryptosporidium parvum
STKNSHLIKFKLIQHIFQDLIPLPLPWTHPQKKENCFWSF

SEQ ID NO: 2247957 - protein, 22 aa, Cryptosporidium parvum
STKRKIVGVLPQVPLILKGWTV

SEQ ID NO: 2247958 - protein, 17 aa, Cryptosporidium parvum
STKRNFSMPPKSNPVFS

SEQ ID NO: 2247959 - protein, 32 aa, Cryptosporidium parvum; identical to SEQ ID NO: 2133681

SEQ ID NO: 2247960 - protein, 46 aa, Cryptosporidium parvum
STKSGILKHVLLGSIIAVIFGCVSKYYFFDKIVLTEENLPNISSIN

SEQ ID NO: 2247961 - protein, 31 aa, Cryptosporidium parvum
STLEQKVLIRFHLFTVLNIWNLYLKELQAKL

SEQ ID NO: 2247962 - protein, 32 aa, Cryptosporidium parvum
STLIKDIYSCRIWILILLAVFESTGEYGIYCL

SEQ ID NO: 2247963 - protein, 24 aa, Cryptosporidium parvum
STLILLVSFLHSKYNSPLIINVCF

SEQ ID NO: 2247964 - protein, 22 aa, Cryptosporidium parvum
STLKWLEMFYFEPNMAVYFTLE

SEQ ID NO: 2247965 - protein, 37 aa, Cryptosporidium parvum
STLNTVIWGFLTFTVIFSFLVFALFAFEIIEYLRFKA

SEQ ID NO: 2247966 - protein, 36 aa, Cryptosporidium parvum
STLSIKYRIWISFAFTIIILTLIALLRISRYSFTHS

SEQ ID NO: 2247967 - protein, 18 aa, Cryptosporidium parvum
STLTCFFTYLFEGRVHFD

SEQ ID NO: 2247968 - protein, 26 aa, Cryptosporidium parvum
STNFQDFLINIFPIKLEFSTMNTLSS

SEQ ID NO: 2247969 - protein, 28 aa, Cryptosporidium parvum
STNTVFQIFPLFSLVFALLAGYFVTFDQ

SEQ ID NO: 2247970 - protein, 25 aa, Cryptosporidium parvum
STPLSIMDRLLWSSSNLFVPTLRSQ

SEQ ID NO: 2247971 - protein, 25 aa, Cryptosporidium parvum
STRDVLVLFYTPWCGHCKTFDPIYN

SEQ ID NO: 2247972 - protein, 23 aa, Cryptosporidium parvum
STRPWLLIITLSHQLWKFIIDSS

SEQ ID NO: 2247973 - protein, 25 aa, Cryptosporidium parvum
STRRPIFMLQTFPIFVFSFTCHHNF

SEQ ID NO: 2247974 - protein, 30 aa, Cryptosporidium parvum; identical to SEQ ID NO: 2133687

SEQ ID NO: 2247975 - protein, 26 aa, Cryptosporidium parvum
STSDELLITELLFNNVFFQELKIEYI

SEQ ID NO: 2247976 - protein, 23 aa, Cryptosporidium parvum
STSIKIIRYIYNSQIQTKNSSGV

SEQ ID NO: 2247977 - protein, 20 aa, Cryptosporidium parvum
STSILAFRRSLIHALDGGPN

SEQ ID NO: 2247978 - protein, 23 aa, Cryptosporidium parvum
STSILLLLCLLFEKDESERNNLS

SEQ ID NO: 2247979 - protein, 32 aa, Cryptosporidium parvum; identical to SEQ ID NO: 2133691

SEQ ID NO: 2247980 - protein, 24 aa, Cryptosporidium parvum
STTGDWFVLFYLPNCQQSQMSLVE

SEQ ID NO: 2247981 - protein, 25 aa, Cryptosporidium parvum
STVFSIFQWQLIWMSRKLSFSSLIN

SEQ ID NO: 2247982 - protein, 21 aa, Cryptosporidium parvum
STYFFIVFLIGSVNSIFFSKL

SEQ ID NO: 2247983 - protein, 26 aa, Cryptosporidium parvum
STYQSICYIWLWDLFVEYFGGSEQIV

SEQ ID NO: 2247984 - protein, 20 aa, Cryptosporidium parvum
SVACLFLFNENPISSNIGSK

SEQ ID NO: 2247985 - protein, 23 aa, Cryptosporidium parvum
SVACSFILEMIAKLKLGNKNLEK

SEQ ID NO: 2247986 - protein, 18 aa, Cryptosporidium parvum
SVAEAPFFEICNLSNYYI

SEQ ID NO: 2247987 - protein, 33 aa, Cryptosporidium parvum; identical to SEQ ID NO: 2133700

SEQ ID NO: 2247988 - protein, 24 aa, Cryptosporidium parvum
SVAKLDIPLLNQYISQDLIAEVGS

SEQ ID NO: 2247989 - protein, 20 aa, Cryptosporidium parvum
SVALPNFQSGALGCPVSASI

SEQ ID NO: 2247990 - protein, 26 aa, Cryptosporidium parvum
SVCFIVFVNICYILYKNSSIERYRNF

SEQ ID NO: 2247991 - protein, 20 aa, Cryptosporidium parvum
SVEDIIILYSLYPGNLDSDY

SEQ ID NO: 2247992 - protein, 25 aa, Cryptosporidium parvum
SVEEYLSRLPGIDIQLKLIDYSLDR

SEQ ID NO: 2247993 - protein, 26 aa, Cryptosporidium parvum
SVEILQKLFVTFPLLFSTSKESTFKI

SEQ ID NO: 2247994 - protein, 43 aa, Cryptosporidium parvum
SVETTMRLLPFLTSPFYILNTPVKLPLLFGSILMFVLLINVNF

SEQ ID NO: 2247995 - protein, 18 aa, Cryptosporidium parvum
SVFFYLFYLTMYSVKEVL

SEQ ID NO: 2247996 - protein, 26 aa, Cryptosporidium parvum
SVFGYFFQIYFLLISILLYGYVEVII

SEQ ID NO: 2247997 - protein, 30 aa, Cryptosporidium parvum; identical to SEQ ID NO: 2133706

SEQ ID NO: 2247998 - protein, 32 aa, Cryptosporidium parvum
SVFLEALYHESYPDDWIFPNVRFQLSVVNFLD

SEQ ID NO: 2247999 - protein, 20 aa, Cryptosporidium parvum
SVFLSWLVLFSTYTNYQIQS

SEQ ID NO: 2248000 - protein, 33 aa, Cryptosporidium parvum
SVGVITPQFLFFIPPIFYAFYCVAKKYPPIIRQ

SEQ ID NO: 2248001 - protein, 30 aa, Cryptosporidium parvum
SVIGTQFAFLIFYTVFYIISPKYSHRFVGY

SEQ ID NO: 2248002 - protein, 24 aa, Cryptosporidium parvum
SVISAAIWWGFFGTVITFIMESEL

SEQ ID NO: 2248003 - protein, 24 aa, Cryptosporidium parvum
SVIYAIPAIPWFLKPLFGMRRKPY

SEQ ID NO: 2248004 - protein, 27 aa, Cryptosporidium parvum
SVLELYMNRLFVTPLNKMSLTVPINDQ

SEQ ID NO: 2248005 - protein, 18 aa, Cryptosporidium parvum
SVLILKRKLSLTRWFACF

SEQ ID NO: 2248006 - protein, 17 aa, Cryptosporidium parvum
SVLILTTNAYYIFERPK

SEQ ID NO: 2248007 - protein, 22 aa, Cryptosporidium parvum
SVLLTLICSIGFIPGIPKWVDS

SEQ ID NO: 2248008 - protein, 27 aa, Cryptosporidium parvum
SVLNNGLVHLWLVPNIDSYSLPGYSPT

SEQ ID NO: 2248009 - protein, 28 aa, Cryptosporidium parvum
SVLSFAYGIVLLNLKMRYSKKLALINEK

SEQ ID NO: 2248010 - protein, 33 aa, Cryptosporidium parvum
SVNEYFEIFKKFISYILLFLNVSRTASNIVFVI

SEQ ID NO: 2248011 - protein, 25 aa, Cryptosporidium parvum
SVNKITLLLIFIGVLITVFGGILSQ

SEQ ID NO: 2248012 - protein, 29 aa, Cryptosporidium parvum
SVQHIIWMSILEPWQWSPPSSLNSSNRRG

SEQ ID NO: 2248013 - protein, 29 aa, Cryptosporidium parvum
SVQKRLIYAIFFCLVFTLIEVVVGILSNS

SEQ ID NO: 2248014 - protein, 25 aa, Cryptosporidium parvum
SVSFPLIRINLIKDWDWKNKQLIGF

SEQ ID NO: 2248015 - protein, 27 aa, Cryptosporidium parvum
SVSIIDLVITIWFRLALLASSSDHKIV

SEQ ID NO: 2248016 - protein, 24 aa, Cryptosporidium parvum
SVSINFNLRVTWKKNLYPSSSTRI

SEQ ID NO: 2248017 - protein, 24 aa, Cryptosporidium parvum
SVSKLLNIMIFQIIPTTAEFLMVL

SEQ ID NO: 2248018 - protein, 24 aa, Cryptosporidium parvum
SVTAYFIICGVVATCSLFLIISFF

SEQ ID NO: 2248019 - protein, 32 aa, Cryptosporidium parvum; identical to SEQ ID NO: 2133720

SEQ ID NO: 2248020 - protein, 30 aa, Cryptosporidium parvum
SVVGFNLKYFFTQWGWWFCIERATSEIDIQ

SEQ ID NO: 2248021 - protein, 28 aa, Cryptosporidium parvum
SVVSNYFWYIFLLIPIYIIYKIGKLIIN

SEQ ID NO: 2248022 - protein, 25 aa, Cryptosporidium parvum
SVVTYMCIFIPINWLWTEDSSLKYS

SEQ ID NO: 2248023 - protein, 20 aa, Cryptosporidium parvum
SVVWFFHGFVSLISLSTSYF

SEQ ID NO: 2248024 - protein, 21 aa, Cryptosporidium parvum
SVWGFFPVNLLPRFNPYNSGM

SEQ ID NO: 2248025 - protein, 20 aa, Cryptosporidium parvum
SVYELGLIKRVIFSNFTLSD

SEQ ID NO: 2248026 - protein, 25 aa, Cryptosporidium parvum
SVYLRDYMYLKLNNGIKVILISDAI

SEQ ID NO: 2248027 - protein, 34 aa, Cryptosporidium parvum; identical to SEQ ID NO: 2133725

SEQ ID NO: 2248028 - protein, 25 aa, Cryptosporidium parvum
SWLNYYMNWFVCFCKKSLTLVNNKH

SEQ ID NO: 2248029 - protein, 20 aa, Cryptosporidium parvum
SWLQNILHRTPPGAGIYIVI

SEQ ID NO: 2248030 - protein, 18 aa, Cryptosporidium parvum
SWLSNSWLNYYMNWFVCF

SEQ ID NO: 2248031 - protein, 19 aa, Cryptosporidium parvum
SWNQFILNSPFKLVVNHLS

SEQ ID NO: 2248032 - protein, 29 aa, Cryptosporidium parvum
SWSDLMVLNFFLTAFKGLAMLFRESLTPF

SEQ ID NO: 2248033 - protein, 18 aa, Cryptosporidium parvum
SYAFVMVYSFYIYYDTQK

SEQ ID NO: 2248034 - protein, 20 aa, Cryptosporidium parvum
SYECMLYSINDKRGLRPLFD

SEQ ID NO: 2248035 - protein, 24 aa, Cryptosporidium parvum
SYELDAILPLNALLTITVFHKNKN

SEQ ID NO: 2248036 - protein, 25 aa, Cryptosporidium parvum
SYFKIDSIMLFLRSISISKMVNSIC

SEQ ID NO: 2248037 - protein, 28 aa, Cryptosporidium parvum
SYFLSCRILPYLWSFYESYPTYKDIYTR

SEQ ID NO: 2248038 - protein, 22 aa, Cryptosporidium parvum
SYGYINFLAFSASGASLLLHAT

SEQ ID NO: 2248039 - protein, 17 aa, Cryptosporidium parvum
SYIFGFQGPSFTIDSAC

SEQ ID NO: 2248040 - protein, 19 aa, Cryptosporidium parvum
SYIKNLLMKIVPVRNLDLK

SEQ ID NO: 2248041 - protein, 23 aa, Cryptosporidium parvum
SYLDSFQRWIWDKGDLQCWASVL

SEQ ID NO: 2248042 - protein, 17 aa, Cryptosporidium parvum
SYLGLFSKTISLLGLIY

SEQ ID NO: 2248043 - protein, 27 aa, Cryptosporidium parvum
SYLIIDFLKQMLFLRGFFALTKDSILM

SEQ ID NO: 2248044 - protein, 27 aa, Cryptosporidium parvum
SYLIRDSTLYFLYNKSPITVYIIECIF

SEQ ID NO: 2248045 - protein, 17 aa, Cryptosporidium parvum
SYLNWTCWYAWMIQSFL

SEQ ID NO: 2248046 - protein, 21 aa, Cryptosporidium parvum
SYLQDMPWTMIKFASIARKSH

SEQ ID NO: 2248047 - protein, 19 aa, Cryptosporidium parvum
SYMITQIISLLLCCSSQII

SEQ ID NO: 2248048 - protein, 53 aa, Cryptosporidium parvum
SYNIALNFINRLHILLWPHLIHFIYELLPVAITIRLKRLLFKSSDDLLFDPRL

SEQ ID NO: 2248049 - protein, 18 aa, Cryptosporidium parvum
SYNLLWFGMTKYFEVFCG

SEQ ID NO: 2248050 - protein, 17 aa, Cryptosporidium parvum
SYNWCDRLVFHNCIGFE

SEQ ID NO: 2248051 - protein, 25 aa, Cryptosporidium parvum
SYPEFLFCIPIKPASNILGCELDTF

SEQ ID NO: 2248052 - protein, 22 aa, Cryptosporidium parvum
SYRMSLFACFGRDLLLECLQGV

SEQ ID NO: 2248053 - protein, 18 aa, Cryptosporidium parvum
SYRSVLISIIKNLSMKIF

SEQ ID NO: 2248054 - protein, 24 aa, Cryptosporidium parvum
SYSIKLTPLLKVTNSLPFPIQIRL

SEQ ID NO: 2248055 - protein, 30 aa, Cryptosporidium parvum
SYSILSIRILFIVPIIFSLILSLIWILKLN

SEQ ID NO: 2248056 - protein, 17 aa, Cryptosporidium parvum
SYSPQLPWIPSGSVRSA

SEQ ID NO: 2248057 - protein, 18 aa, Cryptosporidium parvum
SYSVIMPFNYIAGPLIVE

SEQ ID NO: 2248058 - protein, 23 aa, Cryptosporidium parvum
SYTSKIIVPIKFRVDFNVENVID

SEQ ID NO: 2248059 - protein, 22 aa, Cryptosporidium parvum
SYTTFDHFFLIRSYDFAPEEMK

SEQ ID NO: 2248060 - protein, 18 aa, Cryptosporidium parvum
SYWCAFPINMDEPYEWHF

SEQ ID NO: 2248061 - protein, 28 aa, Cryptosporidium parvum
SYYIPEHLLLNYKFQAYYRIKSHIITFS

SEQ ID NO: 2248062 - protein, 26 aa, Cryptosporidium parvum
SYYLSIESLIICYLILSGNTDEIDTF

SEQ ID NO: 2248063 - protein, 31 aa, Cryptosporidium parvum
SYYNTIRGGYLLILQKILFATRPNLHSIPSK

SEQ ID NO: 2248064 - protein, 31 aa, Cryptosporidium parvum; identical to SEQ ID NO: 2133743

SEQ ID NO: 2248065 - protein, 26 aa, Cryptosporidium parvum
TADPELIYCLWAGQISLLWKLQLTLN

SEQ ID NO: 2248066 - protein, 18 aa, Cryptosporidium parvum
TAEVISILHLFLVWICEF

SEQ ID NO: 2248067 - protein, 35 aa, Cryptosporidium parvum
TAFEFLIYYFGLISDKLFYYIKYYKNGQNNKGKQI

SEQ ID NO: 2248068 - protein, 25 aa, Cryptosporidium parvum
TAIISLFSLLFFPICIPSGCFNWIG

SEQ ID NO: 2248069 - protein, 24 aa, Cryptosporidium parvum
TALISFEFLGLAAMNLSLLDKIKF

SEQ ID NO: 2248070 - protein, 25 aa, Cryptosporidium parvum
TALIVLTLVFSWLFNLRECKEVNTS

SEQ ID NO: 2248071 - protein, 21 aa, Cryptosporidium parvum
TALSWFCAYLALFLKLKREKN

SEQ ID NO: 2248072 - protein, 23 aa, Cryptosporidium parvum
TAMEFYMAYADYYDLMDLTEELI

SEQ ID NO: 2248073 - protein, 22 aa, Cryptosporidium parvum
TAMLLHSQTLRNDPDFGRISFQ

SEQ ID NO: 2248074 - protein, 24 aa, Cryptosporidium parvum
TASDWNVFFSDKNTLIIKKLHKET

SEQ ID NO: 2248075 - protein, 27 aa, Cryptosporidium parvum
TATIFFRRYFVVFFIIPSYLKGDIDFG

SEQ ID NO: 2248076 - protein, 18 aa, Cryptosporidium parvum
TATIFIPLILIESEKGKE

SEQ ID NO: 2248077 - protein, 20 aa, Cryptosporidium parvum
TAVFIYIDSWTLTQDPFKKT

SEQ ID NO: 2248078 - protein, 20 aa, Cryptosporidium parvum
TCFWDFDMPIPFTATSVLIN

SEQ ID NO: 2248079 - protein, 18 aa, Cryptosporidium parvum
TCIAIIIYTFHGFRIDEN

SEQ ID NO: 2248080 - protein, 20 aa, Cryptosporidium parvum
TCIGIKAIFYLKFSRLISTD

SEQ ID NO: 2248081 - protein, 30 aa, Cryptosporidium parvum
TCLFCLLGIIVVLYYFKEYRFYPRMADYIT

SEQ ID NO: 2248082 - protein, 19 aa, Cryptosporidium parvum
TCLTSCAALFLGTVVDFPI

SEQ ID NO: 2248083 - protein, 19 aa, Cryptosporidium parvum
TCMFILMSIFDHMVLFGEI

SEQ ID NO: 2248084 - protein, 21 aa, Cryptosporidium parvum
TCNYICLFPDIISGPSVEWRN

SEQ ID NO: 2248085 - protein, 27 aa, Cryptosporidium parvum
TCRKPQLPEFLLQRSVINSGANSGIVG

SEQ ID NO: 2248086 - protein, 23 aa, Cryptosporidium parvum
TDDYQWIYLKEYITRLKEARKNN

SEQ ID NO: 2248087 - protein, 27 aa, Cryptosporidium parvum
TDFHLKYLNFVRLLLNRKKYKIILLDE

SEQ ID NO: 2248088 - protein, 24 aa, Cryptosporidium parvum
TDGFSFDNLYWDSINQFILENNII

SEQ ID NO: 2248089 - protein, 30 aa, Cryptosporidium parvum; identical to SEQ ID NO: 2133759

SEQ ID NO: 2248090 - protein, 26 aa, Cryptosporidium parvum
TDHIKLLIQLIIFKDIKHYLDSIDHS

SEQ ID NO: 2248091 - protein, 19 aa, Cryptosporidium parvum
TDKIIFLKHLNYLKYLSDP

SEQ ID NO: 2248092 - protein, 22 aa, Cryptosporidium parvum
TDLVPILRRYIPYVPGDVEGKS

SEQ ID NO: 2248093 - protein, 26 aa, Cryptosporidium parvum
TDMFSLLLNHILINFAREFISKPQLI

SEQ ID NO: 2248094 - protein, 24 aa, Cryptosporidium parvum
TDMIIPIIYRNVKINPLLATSDSM

SEQ ID NO: 2248095 - protein, 23 aa, Cryptosporidium parvum
TDSIFYIRRISCLPIFWCSHDPW

SEQ ID NO: 2248096 - protein, 32 aa, Cryptosporidium parvum
TDTVTFNLLFLILTDIFGLVLKRNFSGILSAT

SEQ ID NO: 2248097 - protein, 25 aa, Cryptosporidium parvum
TEINQIRFFFNPESFIKMMIDSAYE

SEQ ID NO: 2248098 - protein, 29 aa, Cryptosporidium parvum
TEINRNILLILLGNLLLIARNIGLDGEIF

SEQ ID NO: 2248099 - protein, 18 aa, Cryptosporidium parvum
TEKIKLNKQLPYLVANIV

SEQ ID NO: 2248100 - protein, 23 aa, Cryptosporidium parvum
TEKKNCSFYSIWQEFTDQVNNMC

SEQ ID NO: 2248101 - protein, 31 aa, Cryptosporidium parvum; identical to SEQ ID NO: 2133772

SEQ ID NO: 2248102 - protein, 28 aa, Cryptosporidium parvum
TEKQLKLLLDFLDYTVFLYGDFSAGSCP

SEQ ID NO: 2248103 - protein, 29 aa, Cryptosporidium parvum
TELLLLYSALILNFFFIKKFLDSGERILF

SEQ ID NO: 2248104 - protein, 23 aa, Cryptosporidium parvum
TELSFFIENLLPIALKLNEYCSK

SEQ ID NO: 2248105 - protein, 20 aa, Cryptosporidium parvum
TENISFLTYLFIEFDLDINS

SEQ ID NO: 2248106 - protein, 22 aa, Cryptosporidium parvum
TENPFLFSLMKRVFNKQLLSLE

SEQ ID NO: 2248107 - protein, 35 aa, Cryptosporidium parvum; identical to SEQ ID NO: 2133777

SEQ ID NO: 2248108 - protein, 23 aa, Cryptosporidium parvum
TESILLMIITNIQLWWKEVLTNY

SEQ ID NO: 2248109 - protein, 32 aa, Cryptosporidium parvum; identical to SEQ ID NO: 2133778

SEQ ID NO: 2248110 - protein, 26 aa, Cryptosporidium parvum
TEYLELLGIQFQLLYGLPVCPLPSMP

SEQ ID NO: 2248111 - protein, 25 aa, Cryptosporidium parvum
TEYVKLIYCLIFRIVRSIHLTKLFP

SEQ ID NO: 2248112 - protein, 30 aa, Cryptosporidium parvum; identical to SEQ ID NO: 2133779

SEQ ID NO: 2248113 - protein, 29 aa, Cryptosporidium parvum
TFALMAYLIFEKYFLYTRNPDLEGGFATE

SEQ ID NO: 2248114 - protein, 17 aa, Cryptosporidium parvum
TFDLFKKNLAQNIYFVE

SEQ ID NO: 2248115 - protein, 21 aa, Cryptosporidium parvum
TFELVLNRPIGWDKPSINFSE

SEQ ID NO: 2248116 - protein, 21 aa, Cryptosporidium parvum
TFEMLALRSLGADKYIKLHSI

SEQ ID NO: 2248117 - protein, 35 aa, Cryptosporidium parvum; identical to SEQ ID NO: 2133781

SEQ ID NO: 2248118 - protein, 30 aa, Cryptosporidium parvum
TFFGKLSFISLMENIKLMLKKGGPLFIINP

SEQ ID NO: 2248119 - protein, 17 aa, Cryptosporidium parvum
TFIEAILGDLFRIRGDT

SEQ ID NO: 2248120 - protein, 30 aa, Cryptosporidium parvum
TFKAKFINLFFFFFFFLTEKKGIGYLFFFF

SEQ ID NO: 2248121 - protein, 21 aa, Cryptosporidium parvum
TFLSTFLPKSIGAWNIHYITT

SEQ ID NO: 2248122 - protein, 25 aa, Cryptosporidium parvum
TFLTTFALLILINARIRQYALIWMT

SEQ ID NO: 2248123 - protein, 21 aa, Cryptosporidium parvum
TFLVIFGIFYAITLCSTIQYI

SEQ ID NO: 2248124 - protein, 20 aa, Cryptosporidium parvum
TFNFGIENCLFVYDFITIYD

SEQ ID NO: 2248125 - protein, 29 aa, Cryptosporidium parvum
TFPILLGALLVLFFFSSYGIIGLILLGDY

SEQ ID NO: 2248126 - protein, 25 aa, Cryptosporidium parvum
TFQLIYQWCLWSYSFLQVGHFLIGF

SEQ ID NO: 2248127 - protein, 25 aa, Cryptosporidium parvum
TFQTIFFCLLAIIISRLRVLALPYI

SEQ ID NO: 2248128 - protein, 18 aa, Cryptosporidium parvum
TFQWQMVFQFIKILKEYF

SEQ ID NO: 2248129 - protein, 28 aa, Cryptosporidium parvum
TFSIGIIFRLLYIIVYLAINILPKFIEN

SEQ ID NO: 2248130 - protein, 21 aa, Cryptosporidium parvum
TFSLHFFWNAYVLLYYCASLE

SEQ ID NO: 2248131 - protein, 32 aa, Cryptosporidium parvum
TFVEQYRKVLPLWAFLFMKVVEQSLRIFITIM

SEQ ID NO: 2248132 - protein, 25 aa, Cryptosporidium parvum
TFYHPLNDIIFFVYYIIEGKISMER

SEQ ID NO: 2248133 - protein, 22 aa, Cryptosporidium parvum
TFYYYYFTMLSSSILALLTSIF

SEQ ID NO: 2248134 - protein, 24 aa, Cryptosporidium parvum
TGDRYICKLFREYLFQQTDSQGRP

SEQ ID NO: 2248135 - protein, 39 aa, Cryptosporidium parvum
TGEINLEILQRGMYLVFLMTFLTILFPMLKQQEYRLVTN

SEQ ID NO: 2248136 - protein, 26 aa, Cryptosporidium parvum
TGEPVFNWRLVYPHLVTPISGCLLQI

SEQ ID NO: 2248137 - protein, 20 aa, Cryptosporidium parvum
TGFPDRILYLMTGCNKSCEL

SEQ ID NO: 2248138 - protein, 24 aa, Cryptosporidium parvum
TGIESIVFVLVHPYGIMGGSSSNM

SEQ ID NO: 2248139 - protein, 19 aa, Cryptosporidium parvum
TGIIFLPGTFRVSGIISGN

SEQ ID NO: 2248140 - protein, 19 aa, Cryptosporidium parvum
TGIQIWISTLSFQIWTSTK

SEQ ID NO: 2248141 - protein, 32 aa, Cryptosporidium parvum; identical to SEQ ID NO: 2133793

SEQ ID NO: 2248142 - protein, 31 aa, Cryptosporidium parvum
TGLPSDPSTGLPFIPGFNVLVDPQTGEQIKG

SEQ ID NO: 2248143 - protein, 19 aa, Cryptosporidium parvum
TGMQWWVYDSFKTIIGLNV

SEQ ID NO: 2248144 - protein, 22 aa, Cryptosporidium parvum
TGMSRIMLPQMLLSIPNENLSL

SEQ ID NO: 2248145 - protein, 17 aa, Cryptosporidium parvum
TGPCCWLDDKFKHLPSL

SEQ ID NO: 2248146 - protein, 24 aa, Cryptosporidium parvum
TGSFPIYNTLLLRSLYSIMCSTIP

SEQ ID NO: 2248147 - protein, 19 aa, Cryptosporidium parvum
THDFIIYPHKIELRVRLVP

SEQ ID NO: 2248148 - protein, 22 aa, Cryptosporidium parvum
THEFWTITSSLDPGLKPLAFLP

SEQ ID NO: 2248149 - protein, 18 aa, Cryptosporidium parvum
THFYFIHNLSFPLLLLSI

SEQ ID NO: 2248150 - protein, 18 aa, Cryptosporidium parvum
THICGGWNLGKFERILLA

SEQ ID NO: 2248151 - protein, 28 aa, Cryptosporidium parvum
THIKKIVEILLFVLFEIHIPKQIYSCKQ

SEQ ID NO: 2248152 - protein, 42 aa, Cryptosporidium parvum
THIYHSCFKLIPSFKLFLFIFFLFRFRKSIIKSLRDEVKTLE

SEQ ID NO: 2248153 - protein, 32 aa, Cryptosporidium parvum
THKNYNYNIFFYISYMNWIPKIFINSNDKLIS

SEQ ID NO: 2248154 - protein, 24 aa, Cryptosporidium parvum
TIAEFAAFFNFFVPITLTAITDII

SEQ ID NO: 2248155 - protein, 28 aa, Cryptosporidium parvum
TICKFIGLPLLLGYIIGGYVVGPSGFGY

SEQ ID NO: 2248156 - protein, 26 aa, Cryptosporidium parvum
TICYRRSLLNQVLPTILCLNRLGSNL

SEQ ID NO: 2248157 - protein, 28 aa, Cryptosporidium parvum
TIEKLLAFFLLIMAVLILILCLSAIFIG

SEQ ID NO: 2248158 - protein, 23 aa, Cryptosporidium parvum
TIEVWVKLPPLFDKLEEIKEEKE

SEQ ID NO: 2248159 - protein, 17 aa, Cryptosporidium parvum
TIFFLEAILWVKNIFKT

SEQ ID NO: 2248160 - protein, 17 aa, Cryptosporidium parvum
TIFLIPWISYIIKNIES

SEQ ID NO: 2248161 - protein, 31 aa, Cryptosporidium parvum
TIFLTMGIVMFIFSSYVIRLLYQINRTSVRT

SEQ ID NO: 2248162 - protein, 37 aa, Cryptosporidium parvum
TIFSATPIGYLLITLIRLIAFMTDKLLLLSRRRKNQH

SEQ ID NO: 2248163 - protein, 17 aa, Cryptosporidium parvum
TIFSMVIELMYLEHLRI

SEQ ID NO: 2248164 - protein, 21 aa, Cryptosporidium parvum
TIGILILQDLLLGIVLALIPA

SEQ ID NO: 2248165 - protein, 26 aa, Cryptosporidium parvum
TIGKKSIFNFCKWYNIISTSNISIQA

SEQ ID NO: 2248166 - protein, 23 aa, Cryptosporidium parvum
TIGLINYLFPIYSISRTNTVDKI

SEQ ID NO: 2248167 - protein, 37 aa, Cryptosporidium parvum
TIGYVCLFISIIKFFVNFLIFFAFGHMIKLSAFTSFM

SEQ ID NO: 2248168 - protein, 19 aa, Cryptosporidium parvum
TIHFLIQPYSGLQQKVEER

SEQ ID NO: 2248169 - protein, 39 aa, Cryptosporidium parvum
TIIDLFTFRVRIFLAFSLFIAIVFFFCLKRRVSSYLNKR

SEQ ID NO: 2248170 - protein, 18 aa, Cryptosporidium parvum
TIIHLNSSYFKYYDIFDS

SEQ ID NO: 2248171 - protein, 22 aa, Cryptosporidium parvum
TIIIDYPTISELCKYIEMIIGK

SEQ ID NO: 2248172 - protein, 19 aa, Cryptosporidium parvum
TIIQQLHYMLYGTNKNYIN

SEQ ID NO: 2248173 - protein, 20 aa, Cryptosporidium parvum
TIKFLHLTLKLILSSKRILE

SEQ ID NO: 2248174 - protein, 24 aa, Cryptosporidium parvum
TILIIMMLLLIFMQVLRSEFSRYF

SEQ ID NO: 2248175 - protein, 20 aa, Cryptosporidium parvum
TILIWYNLYIGFLSFEFLAL

SEQ ID NO: 2248176 - protein, 18 aa, Cryptosporidium parvum
TILLGKYLKALSTLKHRI

SEQ ID NO: 2248177 - protein, 20 aa, Cryptosporidium parvum
TILRNILKLIVELIELPKLI

SEQ ID NO: 2248178 - protein, 21 aa, Cryptosporidium parvum
TILSFCIMFGLSFLFEIIGAF

SEQ ID NO: 2248179 - protein, 18 aa, Cryptosporidium parvum
TILSFLMSTSKLLKDFNP

SEQ ID NO: 2248180 - protein, 18 aa, Cryptosporidium parvum
TILSIDLTTLLYFINNQP

SEQ ID NO: 2248181 - protein, 26 aa, Cryptosporidium parvum
TILSMIAMIILFYSELKYYLNITRKD

SEQ ID NO: 2248182 - protein, 31 aa, Cryptosporidium parvum
TILTRIKREKPLLWRLVLIHDLNKCIQVVGD

SEQ ID NO: 2248183 - protein, 25 aa, Cryptosporidium parvum
TIMLEKNLFIKLISKKKAIIPLTCL

SEQ ID NO: 2248184 - protein, 20 aa, Cryptosporidium parvum
TINQFILQGGPYHVLRSIVD

SEQ ID NO: 2248185 - protein, 25 aa, Cryptosporidium parvum
TIPERPSIPLGYIRLSIYVLGENDL

SEQ ID NO: 2248186 - protein, 28 aa, Cryptosporidium parvum
TIPPEDLPLTILPPRLRSIFSINYVKVD

SEQ ID NO: 2248187 - protein, 18 aa, Cryptosporidium parvum
TIPTFSAFKVDILKSLLA

SEQ ID NO: 2248188 - protein, 20 aa, Cryptosporidium parvum
TIRIEAYWWLIDRISCCSRF

SEQ ID NO: 2248189 - protein, 19 aa, Cryptosporidium parvum
TISFFLCGLIPTLILPCLH

SEQ ID NO: 2248190 - protein, 21 aa, Cryptosporidium parvum
TISFLSFILGFSFKFFSRIPR

SEQ ID NO: 2248191 - protein, 20 aa, Cryptosporidium parvum
TISIIILDLTWPIVSEYRLL

SEQ ID NO: 2248192 - protein, 22 aa, Cryptosporidium parvum
TISISFYSLFLFAFGSPFSETE

SEQ ID NO: 2248193 - protein, 26 aa, Cryptosporidium parvum
TISSFLFIWVLYCFSIIKYLKGDQHI

SEQ ID NO: 2248194 - protein, 24 aa, Cryptosporidium parvum
TISSLLLVSAIFFAIIRLGFSVFS

SEQ ID NO: 2248195 - protein, 33 aa, Cryptosporidium parvum
TITAFYINFLFIWSCVYIALVLLFFTISTINTF

SEQ ID NO: 2248196 - protein, 26 aa, Cryptosporidium parvum
TITMTSIMLYFFSLSSMRNFNGQPKD

SEQ ID NO: 2248197 - protein, 32 aa, Cryptosporidium parvum
TITYKNLWKSIRIISHFLLNELSLKKGDRIIL

SEQ ID NO: 2248198 - protein, 27 aa, Cryptosporidium parvum
TIVRGIEILVFFAFKKNYLSIFFFDLV

SEQ ID NO: 2248199 - protein, 23 aa, Cryptosporidium parvum
TIVWIIIFTLFITDYRLGISLFS

SEQ ID NO: 2248200 - protein, 18 aa, Cryptosporidium parvum
TIYSFLMKVLENILVIDL

SEQ ID NO: 2248201 - protein, 24 aa, Cryptosporidium parvum
TKCKIHYILARPLPKELNKLDLAT

SEQ ID NO: 2248202 - protein, 17 aa, Cryptosporidium parvum
TKEFRVLENPSNKLRYI

SEQ ID NO: 2248203 - protein, 24 aa, Cryptosporidium parvum
TKEKIRLIFVWFKSINRQVKYPII

SEQ ID NO: 2248204 - protein, 26 aa, Cryptosporidium parvum
TKENCKYVCYLSIKYSLINAINSIQN

SEQ ID NO: 2248205 - protein, 38 aa, Cryptosporidium parvum
TKESFWSFKLPLIIKNIIFFIYWKIIKQISIYFSTHSI

SEQ ID NO: 2248206 - protein, 29 aa, Cryptosporidium parvum
TKKLKYAFAFILFLQFIVLLMRIVTLTDV

SEQ ID NO: 2248207 - protein, 27 aa, Cryptosporidium parvum
TKLFWILIPIIICIISLSTNIFDINSI

SEQ ID NO: 2248208 - protein, 26 aa, Cryptosporidium parvum
TKLHAIAVLLLFIRLLEISLFSSNTS

SEQ ID NO: 2248209 - protein, 20 aa, Cryptosporidium parvum
TKMFHYYVKLIPTQYFSGNG

SEQ ID NO: 2248210 - protein, 18 aa, Cryptosporidium parvum
TKNMLGIYTLSWPTYNGI

SEQ ID NO: 2248211 - protein, 24 aa, Cryptosporidium parvum
TKNNLIFPLISYNHEYFNIELNYY

SEQ ID NO: 2248212 - protein, 31 aa, Cryptosporidium parvum
TKPHYLQESYLNDFPLIYIFINDEKSNFDLM

SEQ ID NO: 2248213 - protein, 29 aa, Cryptosporidium parvum
TKTKKLFIERFWLLNPFHFSINISNDKKD

SEQ ID NO: 2248214 - protein, 23 aa, Cryptosporidium parvum
TKTPFTISLVTLLSIILSDLASK

SEQ ID NO: 2248215 - protein, 27 aa, Cryptosporidium parvum
TKTSRYLQHLFPLFVRSTNEFLSKLFA

SEQ ID NO: 2248216 - protein, 19 aa, Cryptosporidium parvum
TKVLLLTITIKYGLFSNLS

SEQ ID NO: 2248217 - protein, 26 aa, Cryptosporidium parvum
TLAIFPLFRLVLMGIFVLWGSGISIC

SEQ ID NO: 2248218 - protein, 19 aa, Cryptosporidium parvum
TLAIYYLLKDDLRLSPPEV

SEQ ID NO: 2248219 - protein, 24 aa, Cryptosporidium parvum
TLAPILLKYLNLSTAFFASFTIIK

SEQ ID NO: 2248220 - protein, 25 aa, Cryptosporidium parvum
TLASSKLYRFAKFSTSSIILSGIVT

SEQ ID NO: 2248221 - protein, 20 aa, Cryptosporidium parvum
TLCACALIHLILWNGIKESF

SEQ ID NO: 2248222 - protein, 22 aa, Cryptosporidium parvum
TLCFLASLRPSPIGIPSTIIRR

SEQ ID NO: 2248223 - protein, 20 aa, Cryptosporidium parvum
TLDFVIISILELLMSPEFDD

SEQ ID NO: 2248224 - protein, 27 aa, Cryptosporidium parvum
TLEFSNWLLTNWVFRTISNLPILFSDY

SEQ ID NO: 2248225 - protein, 17 aa, Cryptosporidium parvum
TLELNYYLYLREISKKY

SEQ ID NO: 2248226 - protein, 18 aa, Cryptosporidium parvum
TLELSLTKLPEKLSSSLD

SEQ ID NO: 2248227 - protein, 24 aa, Cryptosporidium parvum
TLEPITWTFFKDHRLAISITGADT

SEQ ID NO: 2248228 - protein, 19 aa, Cryptosporidium parvum
TLFCWIFIGGNYAIFKEIH

SEQ ID NO: 2248229 - protein, 20 aa, Cryptosporidium parvum
TLFIFVLKFVAIAANQDKNL

SEQ ID NO: 2248230 - protein, 26 aa, Cryptosporidium parvum
TLFSDLYIPLMGFITYILADGVINGV

SEQ ID NO: 2248231 - protein, 29 aa, Cryptosporidium parvum
TLGIISIICHWFPNFYRWMNFKASTISEC

SEQ ID NO: 2248232 - protein, 21 aa, Cryptosporidium parvum
TLGLMGIPIFHGAMSTQFAVT

SEQ ID NO: 2248233 - protein, 22 aa, Cryptosporidium parvum
TLGNILVFSLSVIVGYYCIWNV

SEQ ID NO: 2248234 - protein, 18 aa, Cryptosporidium parvum
TLIEVVIKYFFNKTKNKN

SEQ ID NO: 2248235 - protein, 31 aa, Cryptosporidium parvum
TLKTKIIIGIILHIVLFIIALVFTRNRKYHK

SEQ ID NO: 2248236 - protein, 21 aa, Cryptosporidium parvum
TLLGHILYQESPLLMDCKMDV

SEQ ID NO: 2248237 - protein, 25 aa, Cryptosporidium parvum
TLLHTTQLILIFDVTFEQIPLNTEC

SEQ ID NO: 2248238 - protein, 20 aa, Cryptosporidium parvum
TLLNLYLSCLLGAIKTSCGL

SEQ ID NO: 2248239 - protein, 24 aa, Cryptosporidium parvum
TLLRAAEYLALIHGFSRIVVISGV

SEQ ID NO: 2248240 - protein, 17 aa, Cryptosporidium parvum
TLLSLKHLMKQSCSPFI

SEQ ID NO: 2248241 - protein, 27 aa, Cryptosporidium parvum
TLMWSLCLQFLILGIKVKLTSLISCAI

SEQ ID NO: 2248242 - protein, 26 aa, Cryptosporidium parvum
TLNYFERFFMVYSRFVFRHSMAVIIA

SEQ ID NO: 2248243 - protein, 20 aa, Cryptosporidium parvum
TLPKVRLIRNAKRSGIVGAR

SEQ ID NO: 2248244 - protein, 21 aa, Cryptosporidium parvum
TLPLHPYFILTSLIGKAFVPI

SEQ ID NO: 2248245 - protein, 25 aa, Cryptosporidium parvum
TLPTMGYFYYSIFVNFPSVWGIKRS

SEQ ID NO: 2248246 - protein, 22 aa, Cryptosporidium parvum
TLPVLHALLSSRFVKLFSAEQL

SEQ ID NO: 2248247 - protein, 18 aa, Cryptosporidium parvum
TLRCYLFVSPKITNEYIL

SEQ ID NO: 2248248 - protein, 23 aa, Cryptosporidium parvum
TLSKCIKPFLRNVSLILGDILNN

SEQ ID NO: 2248249 - protein, 24 aa, Cryptosporidium parvum
TLSKHVVRYYTWWCEEPEALQNYV

SEQ ID NO: 2248250 - protein, 20 aa, Cryptosporidium parvum
TLSLFLDTFVINKFNFNGSF

SEQ ID NO: 2248251 - protein, 34 aa, Cryptosporidium parvum
TLSYKRMFRFLFIIKIFPILILKVNCQIQLIIKQ

SEQ ID NO: 2248252 - protein, 24 aa, Cryptosporidium parvum
TLTIIYLEVLIKIINMLKLKSKRV

SEQ ID NO: 2248253 - protein, 36 aa, Cryptosporidium parvum
TLTMSLSLLLINYLKSYWLVVIFGVGFSYAGMYSIA

SEQ ID NO: 2248254 - protein, 27 aa, Cryptosporidium parvum
TLTPEALLFMNILPLDTPHMILNVSSL

SEQ ID NO: 2248255 - protein, 27 aa, Cryptosporidium parvum
TLTPRKELFLAYIWKNYRINNPKLINC

SEQ ID NO: 2248256 - protein, 20 aa, Cryptosporidium parvum
TLVIARKYISFFSSLYSGEA

SEQ ID NO: 2248257 - protein, 25 aa, Cryptosporidium parvum
TLVPTIWCYVSASPLIPQLCDPVPT

SEQ ID NO: 2248258 - protein, 26 aa, Cryptosporidium parvum
TLVSKLYLLVPIWKSILSNYTIEKIV

SEQ ID NO: 2248259 - protein, 17 aa, Cryptosporidium parvum
TLVYNYLSTLSISNPHS

SEQ ID NO: 2248260 - protein, 17 aa, Cryptosporidium parvum
TLYLFGEFWGLCQSPPL

SEQ ID NO: 2248261 - protein, 24 aa, Cryptosporidium parvum
TMIDWLAVLICSLPVILIDEVLKA

SEQ ID NO: 2248262 - protein, 24 aa, Cryptosporidium parvum
TMKYYVVYTILRLILESITSFGMS

SEQ ID NO: 2248263 - protein, 19 aa, Cryptosporidium parvum
TMMNFFRRTAQMNNWTIFI

SEQ ID NO: 2248264 - protein, 20 aa, Cryptosporidium parvum
TMRYLGATDLFLYPRNNTIV

SEQ ID NO: 2248265 - protein, 25 aa, Cryptosporidium parvum
TMSKVPIYIVTGFLGSGKTTLLRHI

SEQ ID NO: 2248266 - protein, 21 aa, Cryptosporidium parvum
TMTLTIIAFLLFILLILQWVL

SEQ ID NO: 2248267 - protein, 28 aa, Cryptosporidium parvum
TMYSYYKLHPRLYPFNISYIKDQINLAV

SEQ ID NO: 2248268 - protein, 32 aa, Cryptosporidium parvum
TNAASMDLLIPLYIGFWFINSILDAIVYILQQ

SEQ ID NO: 2248269 - protein, 21 aa, Cryptosporidium parvum
TNASIKLIRAWNSHMILRSKR

SEQ ID NO: 2248270 - protein, 36 aa, Cryptosporidium parvum
TNDYFLFKEGLLKYQEKKILRYYLYDVGNKVHSDTI

SEQ ID NO: 2248271 - protein, 18 aa, Cryptosporidium parvum
TNHPLISLFTFLGTSRNI

SEQ ID NO: 2248272 - protein, 23 aa, Cryptosporidium parvum
TNIDKMMILNILKNIFNSLLDNV

SEQ ID NO: 2248273 - protein, 24 aa, Cryptosporidium parvum
TNIIIIFNLYFLLYFSSSREIASK

SEQ ID NO: 2248274 - protein, 24 aa, Cryptosporidium parvum
TNISFPMKFIISKLNFDIIKIITS

SEQ ID NO: 2248275 - protein, 20 aa, Cryptosporidium parvum
TNKEYWLVRNSWGEAWGEKG

SEQ ID NO: 2248276 - protein, 26 aa, Cryptosporidium parvum
TNKYYLIFSLAFFILHSSFQMLAFKN

SEQ ID NO: 2248277 - protein, 23 aa, Cryptosporidium parvum
TNLFAMILCGILSLFLEGKEPYL

SEQ ID NO: 2248278 - protein, 26 aa, Cryptosporidium parvum
TNLLLYYQKFLLLNKKVMNFWGLETN

SEQ ID NO: 2248279 - protein, 23 aa, Cryptosporidium parvum
TNLNFLRETLISNILDGLLTPDI

SEQ ID NO: 2248280 - protein, 18 aa, Cryptosporidium parvum
TNLNLFRSNIKSCPVHTA

SEQ ID NO: 2248281 - protein, 17 aa, Cryptosporidium parvum
TNLSYNLPIISRPDLLI

SEQ ID NO: 2248282 - protein, 23 aa, Cryptosporidium parvum
TNMETGIFTIWKPIPPSNQFVSL

SEQ ID NO: 2248283 - protein, 23 aa, Cryptosporidium parvum
TNPEFLFYEYYSAEIILSLQRSG

SEQ ID NO: 2248284 - protein, 24 aa, Cryptosporidium parvum
TNRTRLPRVFYSKSQVLAPFSKEH

SEQ ID NO: 2248285 - protein, 25 aa, Cryptosporidium parvum
TNSSFIIPILVKPISLIAYMIYYIT

SEQ ID NO: 2248286 - protein, 37 aa, Cryptosporidium parvum
TNSSYNRIISLFKFKFFNEPLWNAISWYSTDKILRDY

SEQ ID NO: 2248287 - protein, 31 aa, Cryptosporidium parvum
TNSTLVQFFDYYSLVYYLVNLPSNFLIETST

SEQ ID NO: 2248288 - protein, 28 aa, Cryptosporidium parvum
TNSYFDSNFWLFLKRVCTRILECLAIQN

SEQ ID NO: 2248289 - protein, 31 aa, Cryptosporidium parvum
TNTGNLWFISYLFGRQFLNPSLFKLKQKNIL

SEQ ID NO: 2248290 - protein, 29 aa, Cryptosporidium parvum
TNTIQLLIREKYPFFPNYIKTGNKGDLKN

SEQ ID NO: 2248291 - protein, 23 aa, Cryptosporidium parvum
TNYLNIIYFVLLASASVSIFGVA

SEQ ID NO: 2248292 - protein, 20 aa, Cryptosporidium parvum
TNYYLRLNNINKLLSRRVFP

SEQ ID NO: 2248293 - protein, 21 aa, Cryptosporidium parvum
TPALYILCFDWQKYPINTNNS

SEQ ID NO: 2248294 - protein, 18 aa, Cryptosporidium parvum
TPCFELIDLLYKSLINET

SEQ ID NO: 2248295 - protein, 20 aa, Cryptosporidium parvum
TPCNIFIRQLNTSSWNHFNP

SEQ ID NO: 2248296 - protein, 23 aa, Cryptosporidium parvum
TPDCRYYSYGAFLKGPGSIIGTC

SEQ ID NO: 2248297 - protein, 30 aa, Cryptosporidium parvum
TPETLFSNWLRLMIAILIQDSYNLPLQQQL

SEQ ID NO: 2248298 - protein, 17 aa, Cryptosporidium parvum
TPEVFIRAFKFQSTKYL

SEQ ID NO: 2248299 - protein, 17 aa, Cryptosporidium parvum
TPFLSTRDFYCDRNGPT

SEQ ID NO: 2248300 - protein, 24 aa, Cryptosporidium parvum
TPFTSIFAASLRFFASIFGYGHSY

SEQ ID NO: 2248301 - protein, 25 aa, Cryptosporidium parvum
TPGIDFIYSFYGCLASGIVAIPVYP

SEQ ID NO: 2248302 - protein, 24 aa, Cryptosporidium parvum
TPGIIFQPLRYLFISAMNYGRRVV

SEQ ID NO: 2248303 - protein, 20 aa, Cryptosporidium parvum
TPICNYALVFSYFIVKVLEK

SEQ ID NO: 2248304 - protein, 18 aa, Cryptosporidium parvum
TPIKIPKKSKDLLISDRM

SEQ ID NO: 2248305 - protein, 28 aa, Cryptosporidium parvum
TPIVKIIVIIIWLGFLGVSIYGFTKMES

SEQ ID NO: 2248306 - protein, 20 aa, Cryptosporidium parvum
TPLILCLIALFSCFTIAAIT

SEQ ID NO: 2248307 - protein, 32 aa, Cryptosporidium parvum
TPNTNVIVIFKFQKYFLPLVYLGAKLKRGQIS

SEQ ID NO: 2248308 - protein, 22 aa, Cryptosporidium parvum
TPRKRIIPIFIKNRTPRKASNN

SEQ ID NO: 2248309 - protein, 24 aa, Cryptosporidium parvum
TPTRKIYNSFLSPLPTSKPSPILL

SEQ ID NO: 2248310 - protein, 24 aa, Cryptosporidium parvum
TPVGIILNIILIQLGFQSQSSSAF

SEQ ID NO: 2248311 - protein, 17 aa, Cryptosporidium parvum
TQCRKLQVSDMWYQWIL

SEQ ID NO: 2248312 - protein, 28 aa, Cryptosporidium parvum
TQLTSALYIPLFGLVLLISYFRGELSRD

SEQ ID NO: 2248313 - protein, 21 aa, Cryptosporidium parvum
TQRIRLTLIMPSNLFDCNFVC

SEQ ID NO: 2248314 - protein, 30 aa, Cryptosporidium parvum
TQRNIIIRDILLNILSIFSLKIHQLRRQIY

SEQ ID NO: 2248315 - protein, 23 aa, Cryptosporidium parvum
TQSIRRLIFDSFTSIWFHNSSKV

SEQ ID NO: 2248316 - protein, 33 aa, Cryptosporidium parvum
TQSSDFCRIWLLTALVRLIHIPSGGLAIGVSRL

SEQ ID NO: 2248317 - protein, 31 aa, Cryptosporidium parvum
TQTFSLILLIIIFTPLIFFSIHIIISSKFKT

SEQ ID NO: 2248318 - protein, 23 aa, Cryptosporidium parvum
TQYIYKPWMGFLYLETDNNNSSK

SEQ ID NO: 2248319 - protein, 23 aa, Cryptosporidium parvum
TREYFESIIYLFKCSNYKDYFQN

SEQ ID NO: 2248320 - protein, 19 aa, Cryptosporidium parvum
TRILLERLIVHRPHPWGLL

SEQ ID NO: 2248321 - protein, 18 aa, Cryptosporidium parvum
TRIYDYLVSLKGGYIRIP

SEQ ID NO: 2248322 - protein, 25 aa, Cryptosporidium parvum
TRKFMDSIIKDVYIKWIWNNDDSAN

SEQ ID NO: 2248323 - protein, 22 aa, Cryptosporidium parvum
TRMEKFYMIPEFPKPSFLDSII

SEQ ID NO: 2248324 - protein, 24 aa, Cryptosporidium parvum
TRNSESTRWTWWNKSKNQGSSSGS

SEQ ID NO: 2248325 - protein, 25 aa, Cryptosporidium parvum
TRQLEFIGMILYILKNITFDFKKEI

SEQ ID NO: 2248326 - protein, 32 aa, Cryptosporidium parvum
TRSAKFWHQWVSGLLWAAIAGPITLLKAALQA

SEQ ID NO: 2248327 - protein, 30 aa, Cryptosporidium parvum
TRSNACIFEFIIPLVLEPIMIRLITVLASN

SEQ ID NO: 2248328 - protein, 30 aa, Cryptosporidium parvum
TRSYISFFWGMIIILFFLTSTLPMSIIVIM

SEQ ID NO: 2248329 - protein, 25 aa, Cryptosporidium parvum
TRVIILILASIFLAVSIYSSIKLKM

SEQ ID NO: 2248330 - protein, 23 aa, Cryptosporidium parvum
TSCRHLLQLIGQLDPKTYIYILG

SEQ ID NO: 2248331 - protein, 22 aa, Cryptosporidium parvum
TSDFDILVLDDILLKYLAKSND

SEQ ID NO: 2248332 - protein, 29 aa, Cryptosporidium parvum
TSDQMNKLLSFLLFLFDKGLKNHEICSRL

SEQ ID NO: 2248333 - protein, 27 aa, Cryptosporidium parvum
TSEPFVLLWLITFLSWPCIEYIQLFWK

SEQ ID NO: 2248334 - protein, 23 aa, Cryptosporidium parvum
TSESFKVFLWITTIVLCVSATAG

SEQ ID NO: 2248335 - protein, 35 aa, Cryptosporidium parvum
TSEVVIGLFFLSQLNPLCLLLFALEITKLSGSHDI

SEQ ID NO: 2248336 - protein, 21 aa, Cryptosporidium parvum
TSFEAFHIFKLFVANPNKSPG

SEQ ID NO: 2248337 - protein, 22 aa, Cryptosporidium parvum
TSFIILFYIIITWYFRGIQKHS

SEQ ID NO: 2248338 - protein, 18 aa, Cryptosporidium parvum
TSFLAYLPLYLSSAYIGL

SEQ ID NO: 2248339 - protein, 40 aa, Cryptosporidium parvum
TSFPGIIFAFLQLEKNWIIDFLLLKRLLYHRMNPFNIIYR

SEQ ID NO: 2248340 - protein, 19 aa, Cryptosporidium parvum
TSGIISLALFLVFKLILNP

SEQ ID NO: 2248341 - protein, 17 aa, Cryptosporidium parvum
TSGVIYFTTGVESSYSI

SEQ ID NO: 2248342 - protein, 25 aa, Cryptosporidium parvum
TSIFTYFTIYLATFISFWILAINNI

SEQ ID NO: 2248343 - protein, 20 aa, Cryptosporidium parvum
TSILPKDYTRRIPLEGLEMY

SEQ ID NO: 2248344 - protein, 37 aa, Cryptosporidium parvum
TSISRLLSHGFFLTLVFLLFSILSRIFSVIINIKVTI

SEQ ID NO: 2248345 - protein, 17 aa, Cryptosporidium parvum
TSIWRDRNSFQGKMIFL

SEQ ID NO: 2248346 - protein, 19 aa, Cryptosporidium parvum
TSKARNIILPLKFDTKTIE

SEQ ID NO: 2248347 - protein, 21 aa, Cryptosporidium parvum
TSLILAICLVLFLVLENVSCE

SEQ ID NO: 2248348 - protein, 25 aa, Cryptosporidium parvum
TSLLAHIILYWTGLSVDFFGFITAL

SEQ ID NO: 2248349 - protein, 24 aa, Cryptosporidium parvum
TSNSILRWFPLSFILNRLTNDQLH

SEQ ID NO: 2248350 - protein, 21 aa, Cryptosporidium parvum
TSPILLVMKYSIGSGSVTTLF

SEQ ID NO: 2248351 - protein, 24 aa, Cryptosporidium parvum
TSPSQILAIWRRPSNSRIKSEVDW

SEQ ID NO: 2248352 - protein, 24 aa, Cryptosporidium parvum
TSQKIFWLTVYILNFFLGSIIFFL

SEQ ID NO: 2248353 - protein, 17 aa, Cryptosporidium parvum
TSRYYEKLPRRIKKETN

SEQ ID NO: 2248354 - protein, 25 aa, Cryptosporidium parvum
TSSFDQLAILYSAPKKLPSRNFLEQ

SEQ ID NO: 2248355 - protein, 36 aa, Cryptosporidium parvum; identical to SEQ ID NO: 2133923

SEQ ID NO: 2248356 - protein, 22 aa, Cryptosporidium parvum
TSSKFLVYFPSILIESLRSKEF

SEQ ID NO: 2248357 - protein, 30 aa, Cryptosporidium parvum
TSSTINWALTLWRSGAVGFFIWKYSQINLK

SEQ ID NO: 2248358 - protein, 31 aa, Cryptosporidium parvum
TSTLDLLIFPIRFLLTWILLKEHVGSVATSA

SEQ ID NO: 2248359 - protein, 21 aa, Cryptosporidium parvum
TSTQYSVYGLLFTATDDSDQT

SEQ ID NO: 2248360 - protein, 27 aa, Cryptosporidium parvum
TSVNHQLSLLRLLSLIISSYAISGDAV

SEQ ID NO: 2248361 - protein, 17 aa, Cryptosporidium parvum
TSVYIFDGQNHIGKKLI

SEQ ID NO: 2248362 - protein, 22 aa, Cryptosporidium parvum
TSWILLIEIFIGIAISAWKLWK

SEQ ID NO: 2248363 - protein, 23 aa, Cryptosporidium parvum
TSYFNQIILLLKKTTRQIMIQYT

SEQ ID NO: 2248364 - protein, 20 aa, Cryptosporidium parvum
TTAPIAPAIPALAAYPIIQN

SEQ ID NO: 2248365 - protein, 24 aa, Cryptosporidium parvum
TTFERLFDIFFSRKKYLTLKQKKE

SEQ ID NO: 2248366 - protein, 24 aa, Cryptosporidium parvum
TTIPVRWYNFYGNSALNIELGNKY

SEQ ID NO: 2248367 - protein, 26 aa, Cryptosporidium parvum
TTLAKLIYRIFEPNSGKIRIFGKEIE

SEQ ID NO: 2248368 - protein, 22 aa, Cryptosporidium parvum
TTLCIVSWMPLMLENCSPALSD

SEQ ID NO: 2248369 - protein, 27 aa, Cryptosporidium parvum
TTLFSYIRIIYTSLIMFFFVMMTSFSL

SEQ ID NO: 2248370 - protein, 20 aa, Cryptosporidium parvum
TTLHFPLFMAAITFIWAVSD

SEQ ID NO: 2248371 - protein, 26 aa, Cryptosporidium parvum
TTLIITSVTWWFVAIFGLICKKRIAI

SEQ ID NO: 2248372 - protein, 33 aa, Cryptosporidium parvum
TTLNTYILNNRLFSLWLFVQKRLTTIQIAIKVM

SEQ ID NO: 2248373 - protein, 18 aa, Cryptosporidium parvum
TTLPIRLWKSYRFEYSSI

SEQ ID NO: 2248374 - protein, 26 aa, Cryptosporidium parvum
TTLSTILPFLFIIIHTYDTAGCNRRE

SEQ ID NO: 2248375 - protein, 26 aa, Cryptosporidium parvum
TTLSYFPEHIFIQILNVINQRIAETE

SEQ ID NO: 2248376 - protein, 23 aa, Cryptosporidium parvum
TTMQDIYPIAFRNSLDSYILYSK

SEQ ID NO: 2248377 - protein, 18 aa, Cryptosporidium parvum
TTNFFRFNILHEEYFSIK

SEQ ID NO: 2248378 - protein, 20 aa, Cryptosporidium parvum
TTQHFFLHIASCISQQFIHR

SEQ ID NO: 2248379 - protein, 26 aa, Cryptosporidium parvum
TTRAKTYIIFYMSGLSMCLILYFLEP

SEQ ID NO: 2248380 - protein, 19 aa, Cryptosporidium parvum
TTRFLILVLVILSNIGELL

SEQ ID NO: 2248381 - protein, 23 aa, Cryptosporidium parvum
TTRHISWLSLIAGFLFAITVIQY

SEQ ID NO: 2248382 - protein, 23 aa, Cryptosporidium parvum
TTSFGFLCIFSLIQFTQDLFQEK

SEQ ID NO: 2248383 - protein, 24 aa, Cryptosporidium parvum
TTSFWLLMTQFQTGVVYSFRLSVL

SEQ ID NO: 2248384 - protein, 26 aa, Cryptosporidium parvum
TTSGYLIFRISVIVGLLIVAIILYIY

SEQ ID NO: 2248385 - protein, 28 aa, Cryptosporidium parvum
TTSMTISSPFRLPLALFATHSPHNVVLF

SEQ ID NO: 2248386 - protein, 25 aa, Cryptosporidium parvum
TTVNQLLISFILMSPLGIIIGQLFS

SEQ ID NO: 2248387 - protein, 42 aa, Cryptosporidium parvum; identical to SEQ ID NO: 2133947

SEQ ID NO: 2248388 - protein, 25 aa, Cryptosporidium parvum
TTYIIGYFIMFNRLSSKPWFQSSKN

SEQ ID NO: 2248389 - protein, 19 aa, Cryptosporidium parvum
TVDGFWAHIRCALGNSSVL

SEQ ID NO: 2248390 - protein, 20 aa, Cryptosporidium parvum
TVDILLQIIFVLTRTSDDSN

SEQ ID NO: 2248391 - protein, 21 aa, Cryptosporidium parvum
TVEIFLRFGSVLTGTEVTPRS

SEQ ID NO: 2248392 - protein, 29 aa, Cryptosporidium parvum
TVESIIMSGLFFLVLKNKPAKKLVPQKPP

SEQ ID NO: 2248393 - protein, 20 aa, Cryptosporidium parvum
TVFKGEFPVGGPFSSPSDSS

SEQ ID NO: 2248394 - protein, 17 aa, Cryptosporidium parvum
TVFRRKSTWRSSKFRSW

SEQ ID NO: 2248395 - protein, 24 aa, Cryptosporidium parvum
TVKSSSVIFPFTFYVKSSDNNSDQ

SEQ ID NO: 2248396 - protein, 24 aa, Cryptosporidium parvum
TVLQQQMFLRFVWGRSRLPSKGAQ

SEQ ID NO: 2248397 - protein, 19 aa, Cryptosporidium parvum
TVLYNMLHCNQSFLSSLLF

SEQ ID NO: 2248398 - protein, 17 aa, Cryptosporidium parvum
TVNLFTMYSYYKLHPRL

SEQ ID NO: 2248399 - protein, 33 aa, Cryptosporidium parvum; identical to SEQ ID NO: 2133951

SEQ ID NO: 2248400 - protein, 33 aa, Cryptosporidium parvum
TVRMKSNLILVPILTFLIFFNFVDSSSIDHAQV

SEQ ID NO: 2248401 - protein, 30 aa, Cryptosporidium parvum
TVSDPFKIFIWLCMYAHDPHIYNGVLAYWS

SEQ ID NO: 2248402 - protein, 25 aa, Cryptosporidium parvum
TVSQSLLLGYPRFEGYFSLPEKING

SEQ ID NO: 2248403 - protein, 26 aa, Cryptosporidium parvum
TVSSFLSIPISDIPRIRAWPGSYVVE

SEQ ID NO: 2248404 - protein, 24 aa, Cryptosporidium parvum
TVTISLDWILKIYKRSLYPEISHL

SEQ ID NO: 2248405 - protein, 27 aa, Cryptosporidium parvum
TWDTSEDIILVYFVSQYSSTPSCGVLS

SEQ ID NO: 2248406 - protein, 17 aa, Cryptosporidium parvum
TWHRLTGSHYWEIKIKD

SEQ ID NO: 2248407 - protein, 17 aa, Cryptosporidium parvum
TWIWRELKKDSSSYIPK

SEQ ID NO: 2248408 - protein, 17 aa, Cryptosporidium parvum
TWKEAKQLISKLKSSTK

SEQ ID NO: 2248409 - protein, 17 aa, Cryptosporidium parvum
TWLPLSSDKVLISETDY

SEQ ID NO: 2248410 - protein, 19 aa, Cryptosporidium parvum
TWRFSFITILIHQIIWHFT

SEQ ID NO: 2248411 - protein, 23 aa, Cryptosporidium parvum
TWTKDSLFDLLFISIVDQGSKSP

SEQ ID NO: 2248412 - protein, 17 aa, Cryptosporidium parvum
TYFKQILFKSSVNCLEI

SEQ ID NO: 2248413 - protein, 47 aa, Cryptosporidium parvum
TYFPGILLIILFNHTILNWIFLTISSLFNMMFLYNSLFINGSRTHTH

SEQ ID NO: 2248414 - protein, 23 aa, Cryptosporidium parvum
TYFSVLWMMMFLDCGPNYFSFFY

SEQ ID NO: 2248415 - protein, 39 aa, Cryptosporidium parvum; identical to SEQ ID NO: 2133958

SEQ ID NO: 2248416 - protein, 31 aa, Cryptosporidium parvum
TYLARNIYFLIVYLVFPILRRHFYATEIEGS

SEQ ID NO: 2248417 - protein, 45 aa, Cryptosporidium parvum
TYMKYIFSYEKLTLFKLLIFVSLLVAIYVLITFFIGIWLENANEE

SEQ ID NO: 2248418 - protein, 21 aa, Cryptosporidium parvum
TYNIFFYLVMMEMIECILMVL

SEQ ID NO: 2248419 - protein, 18 aa, Cryptosporidium parvum
TYPVYLRNDIKVNYWSSP

SEQ ID NO: 2248420 - protein, 20 aa, Cryptosporidium parvum
TYRGLIWFILPSCLVICNDI

SEQ ID NO: 2248421 - protein, 20 aa, Cryptosporidium parvum
TYRGYLVSLIIEILDYIETL

SEQ ID NO: 2248422 - protein, 36 aa, Cryptosporidium parvum
TYSEIKHIFYFLSFFFFILSIFLFERSWNGVTKVKV

SEQ ID NO: 2248423 - protein, 23 aa, Cryptosporidium parvum
TYSIFIWYIFLNALIIGFFIVTY

SEQ ID NO: 2248424 - protein, 30 aa, Cryptosporidium parvum; identical to SEQ ID NO: 2133965

SEQ ID NO: 2248425 - protein, 28 aa, Cryptosporidium parvum
TYSLLNYSLVIQLLIPLVSNDPTIVPDL

SEQ ID NO: 2248426 - protein, 20 aa, Cryptosporidium parvum
TYYQHLVLYSIIRNTVSTFS

SEQ ID NO: 2248427 - protein, 17 aa, Cryptosporidium parvum
VAFLMLYSRSFKVEDNK

SEQ ID NO: 2248428 - protein, 26 aa, Cryptosporidium parvum
VAGGVAVVGALLYYLFRSDSSENKDE

SEQ ID NO: 2248429 - protein, 20 aa, Cryptosporidium parvum
VALNAIFALGLISAGTNNSR

SEQ ID NO: 2248430 - protein, 23 aa, Cryptosporidium parvum
VALNFLCFILVFYTSYQPDISKI

SEQ ID NO: 2248431 - protein, 19 aa, Cryptosporidium parvum
VARISKHLSFLLRKEPRLV

SEQ ID NO: 2248432 - protein, 29 aa, Cryptosporidium parvum
VASGVSWFIFRYFFDFIRYFIEENKCFVF

SEQ ID NO: 2248433 - protein, 17 aa, Cryptosporidium parvum
VASIFLTAALGIPEGLA

SEQ ID NO: 2248434 - protein, 43 aa, Cryptosporidium parvum
VASNKPFIIRNYLNGTLALILTWLIVLIVMKFSKKLQHYVNQQ

SEQ ID NO: 2248435 - protein, 20 aa, Cryptosporidium parvum
VASYGLLSAIFKKLADDISF

SEQ ID NO: 2248436 - protein, 28 aa, Cryptosporidium parvum
VASYTFQGYVLFAVKWVPMMIISIIANI

SEQ ID NO: 2248437 - protein, 24 aa, Cryptosporidium parvum
VATIPISNFSIPITIRATSSTGIP

SEQ ID NO: 2248438 - protein, 28 aa, Cryptosporidium parvum
VCHIISGFIFSRNMFWLANWTGRKKLLD

SEQ ID NO: 2248439 - protein, 31 aa, Cryptosporidium parvum; identical to SEQ ID NO: 2133981

SEQ ID NO: 2248440 - protein, 27 aa, Cryptosporidium parvum
VCIFKKKWLVAFLAFIAGLISSIFHAA

SEQ ID NO: 2248441 - protein, 17 aa, Cryptosporidium parvum
VCIIWSIISSMDPESIF

SEQ ID NO: 2248442 - protein, 17 aa, Cryptosporidium parvum
VCKCLAAILLSTSSSLL

SEQ ID NO: 2248443 - protein, 26 aa, Cryptosporidium parvum
VCKYMHLVFVLDLGSLLWFSELFDDI

SEQ ID NO: 2248444 - protein, 32 aa, Cryptosporidium parvum
VCLDWIYCDLCNNWYHWYCLGLHKDNIPSENE

SEQ ID NO: 2248445 - protein, 18 aa, Cryptosporidium parvum
VCLLIMTSIILDSGQDFL

SEQ ID NO: 2248446 - protein, 28 aa, Cryptosporidium parvum
VCQDFINFILLWLRFGEIPLEGKISFCN

SEQ ID NO: 2248447 - protein, 23 aa, Cryptosporidium parvum
VCSIKCIFAYIDLLIHLRSSNDI

SEQ ID NO: 2248448 - protein, 25 aa, Cryptosporidium parvum
VCTAMIFSFLRHIWNFDKSSIKIIF

SEQ ID NO: 2248449 - protein, 18 aa, Cryptosporidium parvum
VCTTIAIAIISEICMPYT

SEQ ID NO: 2248450 - protein, 20 aa, Cryptosporidium parvum
VCVYIVLSLELVEKLYLISA

SEQ ID NO: 2248451 - protein, 28 aa, Cryptosporidium parvum
VDAKSIYLCIIILIITGLISIISQWLSS

SEQ ID NO: 2248452 - protein, 20 aa, Cryptosporidium parvum
VDEFFRSELFERKPGFSFFL

SEQ ID NO: 2248453 - protein, 28 aa, Cryptosporidium parvum
VDEILHYQLLILTNNYYYLIKLESYSHI

SEQ ID NO: 2248454 - protein, 19 aa, Cryptosporidium parvum
VDFLQFSFRWMNCLLTREF

SEQ ID NO: 2248455 - protein, 27 aa, Cryptosporidium parvum
VDFVPAFVHLLYHIKEFRRAIFSWNPR

SEQ ID NO: 2248456 - protein, 24 aa, Cryptosporidium parvum
VDHLPWRFLVYKALNTFIDDIFSF

SEQ ID NO: 2248457 - protein, 18 aa, Cryptosporidium parvum
VDIAEFFHFLVSSYSRQL

SEQ ID NO: 2248458 - protein, 24 aa, Cryptosporidium parvum
VDQVYRVYLYYNSIYKFFSSDVFI

SEQ ID NO: 2248459 - protein, 18 aa, Cryptosporidium parvum
VDSIFVFLFPALIHHRVI

SEQ ID NO: 2248460 - protein, 20 aa, Cryptosporidium parvum
VDSLLSYAFVMVYSFYIYYD

SEQ ID NO: 2248461 - protein, 24 aa, Cryptosporidium parvum
VEADGIIRVYLFLSNLIDSEFKDI

SEQ ID NO: 2248462 - protein, 41 aa, Cryptosporidium parvum; identical to SEQ ID NO: 2133995

SEQ ID NO: 2248463 - protein, 19 aa, Cryptosporidium parvum
VEAETIKKLGFVGGKIKMI

SEQ ID NO: 2248464 - protein, 23 aa, Cryptosporidium parvum
VEARMHVAEYYLMHDRLLSASES

SEQ ID NO: 2248465 - protein, 25 aa, Cryptosporidium parvum
VECDVTFYRFSFFKSPVVQNAIDQT

SEQ ID NO: 2248466 - protein, 19 aa, Cryptosporidium parvum
VEDFLQLETWYKCAIVKVP

SEQ ID NO: 2248467 - protein, 19 aa, Cryptosporidium parvum
VEDHRILWKILSELSLENR

SEQ ID NO: 2248468 - protein, 26 aa, Cryptosporidium parvum
VEECISAYFGSILFGQNKVYGVMTDN

SEQ ID NO: 2248469 - protein, 22 aa, Cryptosporidium parvum
VEENMWTKWGLLKVDPETQEIQ

SEQ ID NO: 2248470 - protein, 28 aa, Cryptosporidium parvum
VEGMSHIAMILLLFNINLMEAFKTFTNL

SEQ ID NO: 2248471 - protein, 18 aa, Cryptosporidium parvum
VEIIYKLCYNISYLSPYS

SEQ ID NO: 2248472 - protein, 27 aa, Cryptosporidium parvum
VEIPKTDPYLFWADIYEISGLGLPSEV

SEQ ID NO: 2248473 - protein, 26 aa, Cryptosporidium parvum
VEKEISFFPTYKYIRGEYIYDLTRTP

SEQ ID NO: 2248474 - protein, 25 aa, Cryptosporidium parvum
VEKFHNFYVILPKKIAEMIFEFHYL

SEQ ID NO: 2248475 - protein, 24 aa, Cryptosporidium parvum
VELFTKWYKHILILFGITLTIMGL

SEQ ID NO: 2248476 - protein, 25 aa, Cryptosporidium parvum
VENGIWIINDSLYYIILPKEVEVKS

SEQ ID NO: 2248477 - protein, 25 aa, Cryptosporidium parvum
VENLYCWYEVIVPAKPQYCSTMKLP

SEQ ID NO: 2248478 - protein, 18 aa, Cryptosporidium parvum
VEPFRLFSTITLTPYIYK

SEQ ID NO: 2248479 - protein, 21 aa, Cryptosporidium parvum
VEPRDIWPPLPNIKLNSQQSN

SEQ ID NO: 2248480 - protein, 24 aa, Cryptosporidium parvum
VESFWRRHFVLAEDMLEISATCLT

SEQ ID NO: 2248481 - protein, 29 aa, Cryptosporidium parvum
VESNSTWMYTITGVAVIVVIIGVSIALYF

SEQ ID NO: 2248482 - protein, 24 aa, Cryptosporidium parvum
VESPSKFLWPPNETSKRSEEYTLD

SEQ ID NO: 2248483 - protein, 31 aa, Cryptosporidium parvum
VESRDIFILLGYYMIALGNRGLFRTALEYCL

SEQ ID NO: 2248484 - protein, 25 aa, Cryptosporidium parvum
VESSPSPYLHWTLKEIYDQPHALAR

SEQ ID NO: 2248485 - protein, 24 aa, Cryptosporidium parvum
VEVRYSVALLILKISRIQGFDYSK

SEQ ID NO: 2248486 - protein, 19 aa, Cryptosporidium parvum
VEYYALIYGLIYIGRSLGV

SEQ ID NO: 2248487 - protein, 26 aa, Cryptosporidium parvum
VFDYDQAFILIIKYTDLLIKIDSLNT

SEQ ID NO: 2248488 - protein, 19 aa, Cryptosporidium parvum
VFELAYLPLMMRVDECLGQ

SEQ ID NO: 2248489 - protein, 19 aa, Cryptosporidium parvum
VFFQTLLLIFLFSSKFENK

SEQ ID NO: 2248490 - protein, 26 aa, Cryptosporidium parvum
VFGGSLLHLNPIKWKALNSTPDKLNF

SEQ ID NO: 2248491 - protein, 21 aa, Cryptosporidium parvum
VFIILPPIFYISRVSFEMIMP

SEQ ID NO: 2248492 - protein, 24 aa, Cryptosporidium parvum
VFITYFLIIYTVSATELDSTENVV

SEQ ID NO: 2248493 - protein, 31 aa, Cryptosporidium parvum
VFKEWKEIIIPLLPLILTYYYDSIDEKKSIL

SEQ ID NO: 2248494 - protein, 25 aa, Cryptosporidium parvum
VFKLRSRAIKYIRNYFDRLGFLEVE

SEQ ID NO: 2248495 - protein, 22 aa, Cryptosporidium parvum
VFMDFKQLISMLVLFCVYLTGR

SEQ ID NO: 2248496 - protein, 33 aa, Cryptosporidium parvum
VFPSNGLIQFFYRLLSKIFTKNFFFLPYLNVNE

SEQ ID NO: 2248497 - protein, 28 aa, Cryptosporidium parvum
VFSRSDWVLAFFYRYMQWGFHVAGISPI

SEQ ID NO: 2248498 - protein, 21 aa, Cryptosporidium parvum
VFVGLCNIDWSLYLLNERSCN

SEQ ID NO: 2248499 - protein, 27 aa, Cryptosporidium parvum
VGAIVLIGLIIFFITKSRSNNSQGQDP

SEQ ID NO: 2248500 - protein, 23 aa, Cryptosporidium parvum
VGDKPGEFKWEYGILSLCLINGD

SEQ ID NO: 2248501 - protein, 29 aa, Cryptosporidium parvum
VGEKNFMCTLWLVILRTTQVRYPALEVIL

SEQ ID NO: 2248502 - protein, 19 aa, Cryptosporidium parvum
VGGPILFLNAVLAGGASML

SEQ ID NO: 2248503 - protein, 25 aa, Cryptosporidium parvum
VGGSKLWWKNWIFNQNKFDDLYDSV

SEQ ID NO: 2248504 - protein, 27 aa, Cryptosporidium parvum
VGIIIIDFIFRRFGALTLFDNITNITL

SEQ ID NO: 2248505 - protein, 23 aa, Cryptosporidium parvum
VGIKKDPIHTLLFDRLSNTNSNA

SEQ ID NO: 2248506 - protein, 18 aa, Cryptosporidium parvum
VGILIILISASLIYMNLR

SEQ ID NO: 2248507 - protein, 24 aa, Cryptosporidium parvum
VGKSALLCKLPYNQHFNAAKTFGQ

SEQ ID NO: 2248508 - protein, 35 aa, Cryptosporidium parvum; identical to SEQ ID NO: 2134019

SEQ ID NO: 2248509 - protein, 25 aa, Cryptosporidium parvum
VGLPIYRTITIWLQSSSLFEEPQIL

SEQ ID NO: 2248510 - protein, 27 aa, Cryptosporidium parvum
VGLWNGLLLVLFYLVHVYISTQFNFWE

SEQ ID NO: 2248511 - protein, 25 aa, Cryptosporidium parvum
VGNMQLYKKLLLSEKQWLYVENSME

SEQ ID NO: 2248512 - protein, 23 aa, Cryptosporidium parvum
VGNYFEKYLLKSYYKTASLFSFG

SEQ ID NO: 2248513 - protein, 37 aa, Cryptosporidium parvum
VGRICGLIMAPVAIFFIAYSYYIYLKRNRALETKEPI

SEQ ID NO: 2248514 - protein, 26 aa, Cryptosporidium parvum
VGRPIIIIIMFILLSKSALERLSELL

SEQ ID NO: 2248515 - protein, 35 aa, Cryptosporidium parvum; identical to SEQ ID NO: 2134025

SEQ ID NO: 2248516 - protein, 27 aa, Cryptosporidium parvum
VGVKIMLYISLPTFFFYSLATFCSYFN

SEQ ID NO: 2248517 - protein, 20 aa, Cryptosporidium parvum
VGWDEFLLKKGGAANAYTSA

SEQ ID NO: 2248518 - protein, 20 aa, Cryptosporidium parvum
VGYWVIIMQIVQLALMGDFV

SEQ ID NO: 2248519 - protein, 18 aa, Cryptosporidium parvum
VHFDLAILLLFISVICTL

SEQ ID NO: 2248520 - protein, 18 aa, Cryptosporidium parvum
VHISEYLLDLIRSDAANK

SEQ ID NO: 2248521 - protein, 21 aa, Cryptosporidium parvum
VHKGAFIYELGDFGGLIVMAN

SEQ ID NO: 2248522 - protein, 23 aa, Cryptosporidium parvum
VHKYGYYFIKVNVGFPITQQQTL

SEQ ID NO: 2248523 - protein, 21 aa, Cryptosporidium parvum
VHPIIQFLSYYSVSVSTLTSI

SEQ ID NO: 2248524 - protein, 29 aa, Cryptosporidium parvum
VIAIGERILPPYWYMNWVEQTSTRSKERF

SEQ ID NO: 2248525 - protein, 18 aa, Cryptosporidium parvum
VIATFLLMSKIRSLPDID

SEQ ID NO: 2248526 - protein, 18 aa, Cryptosporidium parvum
VIAYLKFLWTIDSKETFP

SEQ ID NO: 2248527 - protein, 22 aa, Cryptosporidium parvum
VIDNKIIWPAAAFIEMILGVAR

SEQ ID NO: 2248528 - protein, 35 aa, Cryptosporidium parvum
VIELKGYIRILLKLIDIKASQVGLLLLNKVQRKSF

SEQ ID NO: 2248529 - protein, 23 aa, Cryptosporidium parvum
VIFELLHMYFGDIELCFSKFNYG

SEQ ID NO: 2248530 - protein, 22 aa, Cryptosporidium parvum
VIFLSYYLIVNLKVNAFLRNDL

SEQ ID NO: 2248531 - protein, 22 aa, Cryptosporidium parvum
VIFSCFLLVIFLANISQILAED

SEQ ID NO: 2248532 - protein, 17 aa, Cryptosporidium parvum
VIISTKILHYISGAIHS

SEQ ID NO: 2248533 - protein, 23 aa, Cryptosporidium parvum
VIKQIFGIVKLFSSFIDNYGIEF

SEQ ID NO: 2248534 - protein, 26 aa, Cryptosporidium parvum
VIKRQKYSPIWWLYVSNIDILRRKFN

SEQ ID NO: 2248535 - protein, 25 aa, Cryptosporidium parvum
VIKSPFQQIPPNSPFSLLLLNYSFF

SEQ ID NO: 2248536 - protein, 38 aa, Cryptosporidium parvum; identical to SEQ ID NO: 2134043

SEQ ID NO: 2248537 - protein, 17 aa, Cryptosporidium parvum
VILASAIQIYYLKTILT

SEQ ID NO: 2248538 - protein, 17 aa, Cryptosporidium parvum
VILYERQLQYLLGNVER

SEQ ID NO: 2248539 - protein, 37 aa, Cryptosporidium parvum
VINNIERWIPFYTPHYLILIYIFVGITFITVGIFLQI

SEQ ID NO: 2248540 - protein, 20 aa, Cryptosporidium parvum
VIRVIFFQIVMNYFMGGHKN

SEQ ID NO: 2248541 - protein, 25 aa, Cryptosporidium parvum
VISGRLNIVALLLLTGIDANIKLKK

SEQ ID NO: 2248542 - protein, 26 aa, Cryptosporidium parvum
VISILHLFLVWICEFVFDYKSKIPIF

SEQ ID NO: 2248543 - protein, 23 aa, Cryptosporidium parvum
VISSFLRFFGLYIDQKWPSEEES

SEQ ID NO: 2248544 - protein, 24 aa, Cryptosporidium parvum
VIVKYLPTWIRLIHVFTFCQINTL

SEQ ID NO: 2248545 - protein, 25 aa, Cryptosporidium parvum
VIVRSIRFMIYANELLLRSGVKNKA

SEQ ID NO: 2248546 - protein, 26 aa, Cryptosporidium parvum
VIVSYILMIQLLPINIFVSVLNVIHP

SEQ ID NO: 2248547 - protein, 21 aa, Cryptosporidium parvum
VIVVIIGVSIALYFQNKNKES

SEQ ID NO: 2248548 - protein, 38 aa, Cryptosporidium parvum
VIVYNIIPLIYITLQFLISFISFFYSKLRPIIAVYYFK

SEQ ID NO: 2248549 - protein, 25 aa, Cryptosporidium parvum
VIYESFACRWVFERILEYRCWFPNC

SEQ ID NO: 2248550 - protein, 25 aa, Cryptosporidium parvum
VIYITLSIVIIVNFFAFSDSFLTSV

SEQ ID NO: 2248551 - protein, 20 aa, Cryptosporidium parvum
VIYQFQLILEDIAVSKKFTI

SEQ ID NO: 2248552 - protein, 20 aa, Cryptosporidium parvum
VIYRHFYPINLFNTISQQNI

SEQ ID NO: 2248553 - protein, 17 aa, Cryptosporidium parvum
VIYSIIQLTLVSVISYF

SEQ ID NO: 2248554 - protein, 26 aa, Cryptosporidium parvum
VIYSSIILLRRMIPLTLLGSENSLTN

SEQ ID NO: 2248555 - protein, 18 aa, Cryptosporidium parvum
VIYVKFLYTLERKSKLQS

SEQ ID NO: 2248556 - protein, 23 aa, Cryptosporidium parvum
VKCSKLIEIAWKSLVNDSNNEDS

SEQ ID NO: 2248557 - protein, 32 aa, Cryptosporidium parvum
VKDWYIHPNYLSYLVLFIVIVSVIFSLNLIKM

SEQ ID NO: 2248558 - protein, 26 aa, Cryptosporidium parvum
VKEIVELLFGESFIKVLFSTETFSMG

SEQ ID NO: 2248559 - protein, 29 aa, Cryptosporidium parvum
VKFDLFQYNIYLVLWIQLHVRKEFSLQFK

SEQ ID NO: 2248560 - protein, 18 aa, Cryptosporidium parvum
VKFKIILISTILESLHVA

SEQ ID NO: 2248561 - protein, 18 aa, Cryptosporidium parvum
VKFLLFESSQRDLGLSVS

SEQ ID NO: 2248562 - protein, 24 aa, Cryptosporidium parvum
VKFSSLIFPWSAFLAVIISYVLTS

SEQ ID NO: 2248563 - protein, 38 aa, Cryptosporidium parvum
VKGQIQLIFRSQLFFTLFTFVISLLALISLILIIILLT

SEQ ID NO: 2248564 - protein, 21 aa, Cryptosporidium parvum
VKIPMIRWLGVFNSSFLTILI

SEQ ID NO: 2248565 - protein, 23 aa, Cryptosporidium parvum
VKKEWISLLIILKDNPAISKTIR

SEQ ID NO: 2248566 - protein, 47 aa, Cryptosporidium parvum
VKKYIELRYSLIPYWYTLLAKYSFYGIPIIKPLFWLNQKDFNLRSIN

SEQ ID NO: 2248567 - protein, 24 aa, Cryptosporidium parvum
VKLCESIIISPWDYKRISLRFKGI

SEQ ID NO: 2248568 - protein, 18 aa, Cryptosporidium parvum
VKLEKLRYDLIIEKEKIA

SEQ ID NO: 2248569 - protein, 20 aa, Cryptosporidium parvum
VKLPNLLRRVSGRRQIQYNN

SEQ ID NO: 2248570 - protein, 19 aa, Cryptosporidium parvum
VKMLWGFLNSDLFRFHEPT

SEQ ID NO: 2248571 - protein, 25 aa, Cryptosporidium parvum
VKTDLIILEFIYKDLNYFEISNSIQ

SEQ ID NO: 2248572 - protein, 25 aa, Cryptosporidium parvum
VKTVYVWPRNALGLFKSLFDRSEFE

SEQ ID NO: 2248573 - protein, 28 aa, Cryptosporidium parvum
VKVESKLFLDKLWLWHSGKYVNKFKTSN

SEQ ID NO: 2248574 - protein, 30 aa, Cryptosporidium parvum; identical to SEQ ID NO: 2134064

SEQ ID NO: 2248575 - protein, 24 aa, Cryptosporidium parvum
VLAERFYITQFLELLMPTMTFSEK

SEQ ID NO: 2248576 - protein, 17 aa, Cryptosporidium parvum
VLAIFAIHNIIGGLLFV

SEQ ID NO: 2248577 - protein, 21 aa, Cryptosporidium parvum
VLCIYFGYKMKVSWYAPTFYP

SEQ ID NO: 2248578 - protein, 18 aa, Cryptosporidium parvum
VLCLTTIVVITILLALKL

SEQ ID NO: 2248579 - protein, 17 aa, Cryptosporidium parvum
VLELWDAYGGGDGPRLV

SEQ ID NO: 2248580 - protein, 24 aa, Cryptosporidium parvum
VLFREWLIRIWDISPAIGRDPLFV

SEQ ID NO: 2248581 - protein, 17 aa, Cryptosporidium parvum
VLFTLTCNYLSLGQFEL

SEQ ID NO: 2248582 - protein, 40 aa, Cryptosporidium parvum; identical to SEQ ID NO: 2134070

SEQ ID NO: 2248583 - protein, 28 aa, Cryptosporidium parvum
VLGKHDFVFKLFYKKGYYYLDSSFTSLT

SEQ ID NO: 2248584 - protein, 24 aa, Cryptosporidium parvum
VLHCILVLEFLIKNSIGLIENIVF

SEQ ID NO: 2248585 - protein, 20 aa, Cryptosporidium parvum
VLIIPFRMILVITMLTRTMG

SEQ ID NO: 2248586 - protein, 27 aa, Cryptosporidium parvum
VLKLKNMFYIFILSASIYFFKKEIKVF

SEQ ID NO: 2248587 - protein, 30 aa, Cryptosporidium parvum
VLKYQNLIKIIKFVIILKSYQKLDLHLKRR

SEQ ID NO: 2248588 - protein, 27 aa, Cryptosporidium parvum
VLLISIQIFISLTKPYPKLFSQVIQRI

SEQ ID NO: 2248589 - protein, 20 aa, Cryptosporidium parvum
VLLLCFSLTIWLRAWLIKRQ

SEQ ID NO: 2248590 - protein, 21 aa, Cryptosporidium parvum
VLMFFLNILTSIIPLALPIIT

SEQ ID NO: 2248591 - protein, 40 aa, Cryptosporidium parvum
VLMSMNALIGLILTFIGGFYAPLYMGLEDINSRIFIGIAC

SEQ ID NO: 2248592 - protein, 30 aa, Cryptosporidium parvum
VLNGFAKFHLYMPELVYVQSIDTVLSRLAT

SEQ ID NO: 2248593 - protein, 37 aa, Cryptosporidium parvum
VLNIIRIMTLLDALFYSFIVWPLCWSIITFYTISWSI

SEQ ID NO: 2248594 - protein, 21 aa, Cryptosporidium parvum
VLNILVPCIFFVQGWLKAFEI

SEQ ID NO: 2248595 - protein, 27 aa, Cryptosporidium parvum
VLNYLSFDTCWVLVLFLSIHNRIIFNN

SEQ ID NO: 2248596 - protein, 25 aa, Cryptosporidium parvum
VLRGTLFRILFGKILCEILGMFIAD

SEQ ID NO: 2248597 - protein, 29 aa, Cryptosporidium parvum
VLRNGFHTNILRLYIPFETYDLESLASNG

SEQ ID NO: 2248598 - protein, 22 aa, Cryptosporidium parvum
VLSCIISHLITFLLIGIPLSQL

SEQ ID NO: 2248599 - protein, 31 aa, Cryptosporidium parvum; identical to SEQ ID NO: 2134082

SEQ ID NO: 2248600 - protein, 32 aa, Cryptosporidium parvum
VLSKIKLPKYKLLLTFLLILGSSIVSYYFSLL

SEQ ID NO: 2248601 - protein, 17 aa, Cryptosporidium parvum
VLSLVWIYVHFCSSFEN

SEQ ID NO: 2248602 - protein, 29 aa, Cryptosporidium parvum
VLSNLNCLYLLLRLLILLISDVVKLSHPF

SEQ ID NO: 2248603 - protein, 27 aa, Cryptosporidium parvum
VLSRPAMFCIIFISLLITILEICLAFF

SEQ ID NO: 2248604 - protein, 19 aa, Cryptosporidium parvum
VLSTFDKFLGLLSTVLMSK

SEQ ID NO: 2248605 - protein, 25 aa, Cryptosporidium parvum
VLTSFSWYYLFYNDDYRLVLAPFVT

SEQ ID NO: 2248606 - protein, 26 aa, Cryptosporidium parvum
VLVKHNLFVFFLYSLVHSNSYFISYC

SEQ ID NO: 2248607 - protein, 24 aa, Cryptosporidium parvum
VLVQNLIQIILIDGVYTLIHKLTY

SEQ ID NO: 2248608 - protein, 25 aa, Cryptosporidium parvum
VLWVICCHIFLLYLCISSPNALTCL

SEQ ID NO: 2248609 - protein, 24 aa, Cryptosporidium parvum
VLYNFINYFNQWSSFLKASQYIYN

SEQ ID NO: 2248610 - protein, 24 aa, Cryptosporidium parvum
VMALKLFYIIIVICITSIIYFILP

SEQ ID NO: 2248611 - protein, 23 aa, Cryptosporidium parvum
VMIGNSLFLENAFGIFTCPRIFS

SEQ ID NO: 2248612 - protein, 17 aa, Cryptosporidium parvum
VMIGYILNILLNLVIPY

SEQ ID NO: 2248613 - protein, 43 aa, Cryptosporidium parvum
VMNICLLIALAPWTLPIFLIMMGLILFKIFLPMISASRNLQRI

SEQ ID NO: 2248614 - protein, 18 aa, Cryptosporidium parvum
VMRLGVLEMILYGSIFFN

SEQ ID NO: 2248615 - protein, 25 aa, Cryptosporidium parvum
VMSILQVMISLFGMGFNLYTHIRSL

SEQ ID NO: 2248616 - protein, 26 aa, Cryptosporidium parvum
VMSTKTFFCWVWKSLYQGTVIMLGAF

SEQ ID NO: 2248617 - protein, 24 aa, Cryptosporidium parvum
VMYAIPVAFFFSFNISFNNICLTH

SEQ ID NO: 2248618 - protein, 27 aa, Cryptosporidium parvum
VNFNKYFLLVVTIIVYFNNLMFNNEEK

SEQ ID NO: 2248619 - protein, 25 aa, Cryptosporidium parvum
VNFNSHLLWIIADSSQYWLAKISRY

SEQ ID NO: 2248620 - protein, 27 aa, Cryptosporidium parvum
VNGGIGCTLGFLWKLIEHAFPQQISPD

SEQ ID NO: 2248621 - protein, 24 aa, Cryptosporidium parvum
VNGLEFLFTLLFNIYDSKIDDESI

SEQ ID NO: 2248622 - protein, 20 aa, Cryptosporidium parvum
VNHVFILVSGTNKYFPGTNY

SEQ ID NO: 2248623 - protein, 23 aa, Cryptosporidium parvum
VNIQTPIPKLLPLSSRELKEYNE

SEQ ID NO: 2248624 - protein, 25 aa, Cryptosporidium parvum
VNIWITWKLLSKQVGLIAALPGIIT

SEQ ID NO: 2248625 - protein, 21 aa, Cryptosporidium parvum
VNKFIFKILSLILGCFETYIA

SEQ ID NO: 2248626 - protein, 25 aa, Cryptosporidium parvum
VNKGWFRYFYLVGVFTTLICVYLGY

SEQ ID NO: 2248627 - protein, 18 aa, Cryptosporidium parvum
VNKKKLPKYFYSSALYIS

SEQ ID NO: 2248628 - protein, 18 aa, Cryptosporidium parvum
VNKRIVIYSIIQLTLVSV

SEQ ID NO: 2248629 - protein, 25 aa, Cryptosporidium parvum
VNLLVIFGFLWLVSPILITLTASFS

SEQ ID NO: 2248630 - protein, 27 aa, Cryptosporidium parvum
VNNDAKFFIRFYSFQKNTFSLSFKRED

SEQ ID NO: 2248631 - protein, 42 aa, Cryptosporidium parvum
VNNLLIQINIKTWFFWIVYSFLVFIIYFSADYLYIFKNSILG

SEQ ID NO: 2248632 - protein, 27 aa, Cryptosporidium parvum
VNQYLLIPNIFLLSVPFILNLLKAKRN

SEQ ID NO: 2248633 - protein, 23 aa, Cryptosporidium parvum
VNRITLFIDFDSDKYQFMFADLE

SEQ ID NO: 2248634 - protein, 27 aa, Cryptosporidium parvum
VNSIYSMSALILLAPTPLGIYYKDFMK

SEQ ID NO: 2248635 - protein, 21 aa, Cryptosporidium parvum
VNSLICWNKLIPNFLLCYSEV

SEQ ID NO: 2248636 - protein, 28 aa, Cryptosporidium parvum
VNTLSKILFLLLIITSFVLVFCKGFDTL

SEQ ID NO: 2248637 - protein, 25 aa, Cryptosporidium parvum
VNVINIVGIFLYFELVIFNEMTFSK

SEQ ID NO: 2248638 - protein, 30 aa, Cryptosporidium parvum; identical to SEQ ID NO: 2134105

SEQ ID NO: 2248639 - protein, 30 aa, Cryptosporidium parvum
VNYYDYNLCFIIKILIYLISNVKDGLDLSL

SEQ ID NO: 2248640 - protein, 25 aa, Cryptosporidium parvum
VPARLKSLLPYMGQLISPMLNALES

SEQ ID NO: 2248641 - protein, 29 aa, Cryptosporidium parvum
VPDYIKRDFLLFINHLKIFSTPSGIRKSN

SEQ ID NO: 2248642 - protein, 19 aa, Cryptosporidium parvum
VPEIPFSSYISPLTKTHIS

SEQ ID NO: 2248643 - protein, 26 aa, Cryptosporidium parvum
VPFNHPDLLLNSKPKIFPVFGKRPIE

SEQ ID NO: 2248644 - protein, 19 aa, Cryptosporidium parvum
VPIFSKKFNRKLLKEQLNI

SEQ ID NO: 2248645 - protein, 25 aa, Cryptosporidium parvum
VPILEKLRFIKWFVKVILENMDDYM

SEQ ID NO: 2248646 - protein, 20 aa, Cryptosporidium parvum
VPILYFSIIGLEKKTYEWIV

SEQ ID NO: 2248647 - protein, 18 aa, Cryptosporidium parvum
VPIMPSMKTLPSFATYDL

SEQ ID NO: 2248648 - protein, 25 aa, Cryptosporidium parvum
VPIVEDIIILKLWDNSTKPPAIITQ

SEQ ID NO: 2248649 - protein, 20 aa, Cryptosporidium parvum
VPKELLIYDISAYPSKWVEK

SEQ ID NO: 2248650 - protein, 29 aa, Cryptosporidium parvum
VPKMAYNGMPFQPGFPPAIPGPFNGQFQY

SEQ ID NO: 2248651 - protein, 25 aa, Cryptosporidium parvum
VPLAFVYPPLFYFSLNRERISKAGQ

SEQ ID NO: 2248652 - protein, 24 aa, Cryptosporidium parvum
VPQLIQHRFIGRRAALRFQDSIQE

SEQ ID NO: 2248653 - protein, 18 aa, Cryptosporidium parvum
VPQPLILSIKRFMNKNIR

SEQ ID NO: 2248654 - protein, 32 aa, Cryptosporidium parvum
VPSMVLQNLLLLFSLYQFIGISAFIGYIIIVL

SEQ ID NO: 2248655 - protein, 21 aa, Cryptosporidium parvum
VPVHELLRTYFPHCTVFVVAH

SEQ ID NO: 2248656 - protein, 24 aa, Cryptosporidium parvum
VPYNKVKMILYPSIPSHPPSFQLN

SEQ ID NO: 2248657 - protein, 43 aa, Cryptosporidium parvum
VQCIFGKIILLIVSIILLLGLLVWIFQEKLLFFPNINGKRDLA

SEQ ID NO: 2248658 - protein, 25 aa, Cryptosporidium parvum
VQDNSLILLSIHKLALHYLSIHGQR

SEQ ID NO: 2248659 - protein, 29 aa, Cryptosporidium parvum
VQDYMIACSKIILWFVHFFRGFNGDEHIS

SEQ ID NO: 2248660 - protein, 22 aa, Cryptosporidium parvum
VQELSCIILLVLSVAWGETSKV

SEQ ID NO: 2248661 - protein, 17 aa, Cryptosporidium parvum
VQFSFFYILCQLGEMAK

SEQ ID NO: 2248662 - protein, 19 aa, Cryptosporidium parvum
VQIKLIKLLSIIVLKNSEV

SEQ ID NO: 2248663 - protein, 25 aa, Cryptosporidium parvum
VQISWRLVFFIEYLGPIIIFPIFYF

SEQ ID NO: 2248664 - protein, 26 aa, Cryptosporidium parvum
VQLGIQHTDYWVLKLINRGCYMRQIV

SEQ ID NO: 2248665 - protein, 22 aa, Cryptosporidium parvum
VQNLECYLWLIDELQTICIHPR

SEQ ID NO: 2248666 - protein, 21 aa, Cryptosporidium parvum
VQSLIPCSILFLKALESCIDD

SEQ ID NO: 2248667 - protein, 19 aa, Cryptosporidium parvum
VQVLPAYRLSRAIDTLFPK

SEQ ID NO: 2248668 - protein, 21 aa, Cryptosporidium parvum
VQYSYFIWKFAVKNRINFSLE

SEQ ID NO: 2248669 - protein, 24 aa, Cryptosporidium parvum
VRDLVTLNLLWERVIPIRDYLKSN

SEQ ID NO: 2248670 - protein, 20 aa, Cryptosporidium parvum
VRENSIAFALLYPLMKLFSK

SEQ ID NO: 2248671 - protein, 24 aa, Cryptosporidium parvum
VRHQSLCRYINYSNPTLECPPGSF

SEQ ID NO: 2248672 - protein, 26 aa, Cryptosporidium parvum
VRKIALKYIYLITKFQIQGIGVGIID

SEQ ID NO: 2248673 - protein, 27 aa, Cryptosporidium parvum
VRLISIMSICIWLSLLVFEGSYLFTEV

SEQ ID NO: 2248674 - protein, 28 aa, Cryptosporidium parvum
VRLNTTALLAILFPLIDPSLSAGNYNSE

SEQ ID NO: 2248675 - protein, 19 aa, Cryptosporidium parvum
VRPFPYTLEMSLLKRKENY

SEQ ID NO: 2248676 - protein, 31 aa, Cryptosporidium parvum
VRSRQPLFISFWFIMAKYFSSILIFSTIPLS

SEQ ID NO: 2248677 - protein, 21 aa, Cryptosporidium parvum
VRSVYWRIYNNLYIGSQDSLV

SEQ ID NO: 2248678 - protein, 26 aa, Cryptosporidium parvum
VRVYERLFRQLLCTLITLLGVSSVWF

SEQ ID NO: 2248679 - protein, 27 aa, Cryptosporidium parvum
VSADSCDMFWYPGIIRQVSSESLPDKC

SEQ ID NO: 2248680 - protein, 24 aa, Cryptosporidium parvum
VSAIIAAFFKRFNKPRNQITIAID

SEQ ID NO: 2248681 - protein, 25 aa, Cryptosporidium parvum
VSAILQIRFIQKCLPKWEPISEISK

SEQ ID NO: 2248682 - protein, 28 aa, Cryptosporidium parvum
VSAPLSALWLWVLMAGSAILAICLNQCT

SEQ ID NO: 2248683 - protein, 26 aa, Cryptosporidium parvum
VSCIHFFGLLLFFTLYFINFPNEAGL

SEQ ID NO: 2248684 - protein, 30 aa, Cryptosporidium parvum
VSEVKRNYFLKLFWKITRKITIALRNEISN

SEQ ID NO: 2248685 - protein, 25 aa, Cryptosporidium parvum
VSFYNKYEFVSQLPFPIVIHRFTNS

SEQ ID NO: 2248686 - protein, 17 aa, Cryptosporidium parvum
VSFYSQYNFINYSQVLI

SEQ ID NO: 2248687 - protein, 18 aa, Cryptosporidium parvum
VSFYWYCIELQSTNIRNL

SEQ ID NO: 2248688 - protein, 28 aa, Cryptosporidium parvum
VSGLSILKQIFFQLAKFSSNIDLEELKA

SEQ ID NO: 2248689 - protein, 26 aa, Cryptosporidium parvum
VSGQFFRGFPLCHIYPAPSIGMNRSG

SEQ ID NO: 2248690 - protein, 18 aa, Cryptosporidium parvum
VSIFGVAFLMLYSRSFKV

SEQ ID NO: 2248691 - protein, 21 aa, Cryptosporidium parvum
VSILLIIREKLLPDSITNISK

SEQ ID NO: 2248692 - protein, 28 aa, Cryptosporidium parvum
VSILPQTLYNMGCALIAVLLASLILMPS

SEQ ID NO: 2248693 - protein, 30 aa, Cryptosporidium parvum
VSIMKNHDAWIPLLRSMTYQDPEFRPSAEN

SEQ ID NO: 2248694 - protein, 18 aa, Cryptosporidium parvum
VSISRYFSRKRSTITIQN

SEQ ID NO: 2248695 - protein, 17 aa, Cryptosporidium parvum
VSKDFWPFEALLAGNAM

SEQ ID NO: 2248696 - protein, 23 aa, Cryptosporidium parvum
VSLAISLLLIYWGNTKLKYQYKF

SEQ ID NO: 2248697 - protein, 18 aa, Cryptosporidium parvum
VSLISAPIQPSELFNEVY

SEQ ID NO: 2248698 - protein, 26 aa, Cryptosporidium parvum
VSLKHQRYLIAYPIALLYASFTIVTI

SEQ ID NO: 2248699 - protein, 22 aa, Cryptosporidium parvum
VSLLNLSLIWRNPSLLEVIPSI

SEQ ID NO: 2248700 - protein, 18 aa, Cryptosporidium parvum
VSMINLLLSMGFAVDYST

SEQ ID NO: 2248701 - protein, 39 aa, Cryptosporidium parvum
VSNEKFVIPSLPSDLDPTTFLLIDSTGKKFSPYTGKHAD

SEQ ID NO: 2248702 - protein, 20 aa, Cryptosporidium parvum
VSNIMIFWKNDKLSNHSNGN

SEQ ID NO: 2248703 - protein, 31 aa, Cryptosporidium parvum
VSNKNIFNNLRRFPWININSHPLVKLETDRK

SEQ ID NO: 2248704 - protein, 24 aa, Cryptosporidium parvum
VSNLYFFSQLLYRRFKSNMLVNIL

SEQ ID NO: 2248705 - protein, 24 aa, Cryptosporidium parvum
VSNWINFLQYKLHSSYPLYTFPII

SEQ ID NO: 2248706 - protein, 23 aa, Cryptosporidium parvum
VSQLLIIDIIFIISNIYINRYML

SEQ ID NO: 2248707 - protein, 23 aa, Cryptosporidium parvum
VSQVYLYSYFSIFLNYSGSNDNE

SEQ ID NO: 2248708 - protein, 34 aa, Cryptosporidium parvum
VSSAILLTSIIYILLWAIISYLKVFYIKNMINDW

SEQ ID NO: 2248709 - protein, 20 aa, Cryptosporidium parvum
VSSFLAVLKPKRTWTQGQNQ

SEQ ID NO: 2248710 - protein, 32 aa, Cryptosporidium parvum
VSSIFSLIRISFWYEWIMIKIHLQLGIDHQDE

SEQ ID NO: 2248711 - protein, 28 aa, Cryptosporidium parvum
VSSRRDHFILYYKLLNISLVDTLDIGIL

SEQ ID NO: 2248712 - protein, 28 aa, Cryptosporidium parvum
VSSTIIVYLIWGLFSFIFTVVISGSIEK

SEQ ID NO: 2248713 - protein, 23 aa, Cryptosporidium parvum
VSTLEYLHPFTLKFRSEILEKKF

SEQ ID NO: 2248714 - protein, 24 aa, Cryptosporidium parvum
VSTTILFFFVKYFSPQDSCFSFVR

SEQ ID NO: 2248715 - protein, 36 aa, Cryptosporidium parvum; identical to SEQ ID NO: 2134152

SEQ ID NO: 2248716 - protein, 28 aa, Cryptosporidium parvum
VSVIPLFFEWCYILYRQKLNFSKNQIRE

SEQ ID NO: 2248717 - protein, 25 aa, Cryptosporidium parvum
VSWQLLFRYMEYIDRILDIGLGPMV

SEQ ID NO: 2248718 - protein, 23 aa, Cryptosporidium parvum
VSYFFFLFVKMLIDCIKYIKNKD

SEQ ID NO: 2248719 - protein, 37 aa, Cryptosporidium parvum; identical to SEQ ID NO: 2134154

SEQ ID NO: 2248720 - protein, 27 aa, Cryptosporidium parvum
VTAIVVCHYSFLRIPLSNRILSTIPNA

SEQ ID NO: 2248721 - protein, 33 aa, Cryptosporidium parvum
VTCQQLIDWSELLSLLLDMFVIKASDLDSSTAL

SEQ ID NO: 2248722 - protein, 24 aa, Cryptosporidium parvum
VTDKLLLGILLTSLGALWYSLDKQ

SEQ ID NO: 2248723 - protein, 29 aa, Cryptosporidium parvum
VTFDQIPVWIRWLGWISTVRYTYTGMILS

SEQ ID NO: 2248724 - protein, 18 aa, Cryptosporidium parvum
VTFIVNVEWFATIPKIIK

SEQ ID NO: 2248725 - protein, 28 aa, Cryptosporidium parvum
VTIHYLTLIHFLNLLLFFGISNNLHYTV

SEQ ID NO: 2248726 - protein, 27 aa, Cryptosporidium parvum
VTIVGVWGLLFFGSFLVPPITGISVGV

SEQ ID NO: 2248727 - protein, 26 aa, Cryptosporidium parvum
VTKKGYNLTFFVIISGIFGQLDQLKF

SEQ ID NO: 2248728 - protein, 24 aa, Cryptosporidium parvum
VTKVIFRIFKYQLYSQIYSHPSYF

SEQ ID NO: 2248729 - protein, 25 aa, Cryptosporidium parvum
VTSVLNLLVYYLMNIFVEIGDPVLE

SEQ ID NO: 2248730 - protein, 18 aa, Cryptosporidium parvum
VTVIAFLIVAGLTVFCCL

SEQ ID NO: 2248731 - protein, 26 aa, Cryptosporidium parvum
VTVNKLPLWVSWIKYISFQRYSYSAL

SEQ ID NO: 2248732 - protein, 18 aa, Cryptosporidium parvum
VVAIIIIAGIIHCLCICK

SEQ ID NO: 2248733 - protein, 25 aa, Cryptosporidium parvum
VVCLRWLQNRICYVFKFGCVVGWDL

SEQ ID NO: 2248734 - protein, 21 aa, Cryptosporidium parvum
VVGMLPLLRRGIGIHHGGLLP

SEQ ID NO: 2248735 - protein, 26 aa, Cryptosporidium parvum
VVGSVLYIPISLMRAIEYYHLDGDRR

SEQ ID NO: 2248736 - protein, 25 aa, Cryptosporidium parvum
VVHELWLFIIVSQHNNLKVGDQSTE

SEQ ID NO: 2248737 - protein, 18 aa, Cryptosporidium parvum
VVIFFMLNLILIHFIFEI

SEQ ID NO: 2248738 - protein, 18 aa, Cryptosporidium parvum
VVIIKHITQWHPKKRICV

SEQ ID NO: 2248739 - protein, 24 aa, Cryptosporidium parvum
VVISGRKYILKSILERLGGSGKFL

SEQ ID NO: 2248740 - protein, 24 aa, Cryptosporidium parvum
VVIVFIALFPFNTDALYFILNPGY

SEQ ID NO: 2248741 - protein, 17 aa, Cryptosporidium parvum
VVKLDPFLICHCPNKSN

SEQ ID NO: 2248742 - protein, 19 aa, Cryptosporidium parvum
VVPGHYLILILNGTKNFVN

SEQ ID NO: 2248743 - protein, 26 aa, Cryptosporidium parvum
VVQDLFKLFIYLPLLLDLSKHITRTW

SEQ ID NO: 2248744 - protein, 18 aa, Cryptosporidium parvum
VVRFEYFPNLTVAISYLG

SEQ ID NO: 2248745 - protein, 23 aa, Cryptosporidium parvum
VVSMLDMLLELFTVVFGNSPQAE

SEQ ID NO: 2248746 - protein, 23 aa, Cryptosporidium parvum
VVTPWFRHIFMDTLSLPVVLIIW

SEQ ID NO: 2248747 - protein, 17 aa, Cryptosporidium parvum
VVVSLFFIIPLHIYPML

SEQ ID NO: 2248748 - protein, 23 aa, Cryptosporidium parvum
VVWEESIILLPDTVRLVFLSATI

SEQ ID NO: 2248749 - protein, 29 aa, Cryptosporidium parvum
VVYCLYSLLGIAFILFKLGTMGLIPVNRG

SEQ ID NO: 2248750 - protein, 18 aa, Cryptosporidium parvum
VVYIPFPLSYSFKGMLQR

SEQ ID NO: 2248751 - protein, 17 aa, Cryptosporidium parvum
VWDILFVFLFSVARLSI

SEQ ID NO: 2248752 - protein, 29 aa, Cryptosporidium parvum
VWDLSNLIRIWWHFIPIPHCEIPCPVPKP

SEQ ID NO: 2248753 - protein, 42 aa, Cryptosporidium parvum
VWDSSNLYFTWLLATRIILSLTTYFPRILREIWLRNSNNKTQ

SEQ ID NO: 2248754 - protein, 17 aa, Cryptosporidium parvum
VWGFVTILLAFSSSYWE

SEQ ID NO: 2248755 - protein, 18 aa, Cryptosporidium parvum
VWIGIGVGAIVLIGLIIF

SEQ ID NO: 2248756 - protein, 21 aa, Cryptosporidium parvum
VWKSSPIWLHLKPSDTKNPKE

SEQ ID NO: 2248757 - protein, 27 aa, Cryptosporidium parvum
VWSAGVVMYFLLAGTLPFTGRSIKEVR

SEQ ID NO: 2248758 - protein, 54 aa, Cryptosporidium parvum; identical to SEQ ID NO: 2134187

SEQ ID NO: 2248759 - protein, 25 aa, Cryptosporidium parvum
VWVLIYFYIHYLLLNTIDCTFNFKD

SEQ ID NO: 2248760 - protein, 17 aa, Cryptosporidium parvum
VYAPIKDQTDPAPRYIS

SEQ ID NO: 2248761 - protein, 18 aa, Cryptosporidium parvum
VYLEILLPSLLIEDQMFN

SEQ ID NO: 2248762 - protein, 17 aa, Cryptosporidium parvum
VYMKLLKVALKPSIFML

SEQ ID NO: 2248763 - protein, 26 aa, Cryptosporidium parvum
VYPNPVRVRLYILSALALVVPIDYSE

SEQ ID NO: 2248764 - protein, 20 aa, Cryptosporidium parvum
VYSHMRLLFSYFSNYSKDGV

SEQ ID NO: 2248765 - protein, 18 aa, Cryptosporidium parvum
VYSISWIMVLIWDAYEYG

SEQ ID NO: 2248766 - protein, 27 aa, Cryptosporidium parvum
VYTDYRPVPLQHFIFPAGGNGVYLVMD

SEQ ID NO: 2248767 - protein, 17 aa, Cryptosporidium parvum
VYTLFPFLDSLECITNS

SEQ ID NO: 2248768 - protein, 34 aa, Cryptosporidium parvum
VYVDTIHVYLSVLKNLWVCLVSGIFKILKHKQRI

SEQ ID NO: 2248769 - protein, 18 aa, Cryptosporidium parvum
VYYDNFGNFPLLFKNNEY

SEQ ID NO: 2248770 - protein, 19 aa, Cryptosporidium parvum
WAHIGGFVAGLLWSFASME

SEQ ID NO: 2248771 - protein, 18 aa, Cryptosporidium parvum
WCIVWLSRFLLTSVIRSM

SEQ ID NO: 2248772 - protein, 19 aa, Cryptosporidium parvum
WCLFHSFFQVVSKDWLLGW

SEQ ID NO: 2248773 - protein, 26 aa, Cryptosporidium parvum
WCNTRIQFFILPISIINSIFPYITPF

SEQ ID NO: 2248774 - protein, 17 aa, Cryptosporidium parvum
WCTSRTYPIRIFTGHFG

SEQ ID NO: 2248775 - protein, 23 aa, Cryptosporidium parvum
WDHKKYFSLNLENFGPYYYANYG

SEQ ID NO: 2248776 - protein, 24 aa, Cryptosporidium parvum
WDSKKWCKRLLKSKRKKILRWYKY

SEQ ID NO: 2248777 - protein, 28 aa, Cryptosporidium parvum
WDSMILWNDLFVWRNFVFSIIMNLISRS

SEQ ID NO: 2248778 - protein, 18 aa, Cryptosporidium parvum
WELLIDPTIYLRNLANGE

SEQ ID NO: 2248779 - protein, 19 aa, Cryptosporidium parvum
WEPAQYLYKKYRNTYCLGF

SEQ ID NO: 2248780 - protein, 25 aa, Cryptosporidium parvum
WEVAKVNQFVFMELLFSKNSARGLG

SEQ ID NO: 2248781 - protein, 29 aa, Cryptosporidium parvum
WFLETVDTYWFFHSIWHIMAFLASTFIIH

SEQ ID NO: 2248782 - protein, 17 aa, Cryptosporidium parvum
WFLMAPTMCFQFWYPRT

SEQ ID NO: 2248783 - protein, 19 aa, Cryptosporidium parvum
WFNGLFFDHSMKKTTLFYT

SEQ ID NO: 2248784 - protein, 37 aa, Cryptosporidium parvum
WFSVYLVILKTFRRFYGIYFLLFSINLAISYFVKFQA

SEQ ID NO: 2248785 - protein, 20 aa, Cryptosporidium parvum
WFTHCLQKYFPLWFSDEDLD

SEQ ID NO: 2248786 - protein, 20 aa, Cryptosporidium parvum
WFYFPYIGICLWGISTQLLT

SEQ ID NO: 2248787 - protein, 26 aa, Cryptosporidium parvum
WGIQEKVYPYLACKVLGLLNQEKKED

SEQ ID NO: 2248788 - protein, 28 aa, Cryptosporidium parvum
WGVSTYFSFLLPLFHHYFKNEKNKEIPL

SEQ ID NO: 2248789 - protein, 25 aa, Cryptosporidium parvum
WHHLQSILYLIYGAGALVFVRLIAN

SEQ ID NO: 2248790 - protein, 17 aa, Cryptosporidium parvum
WHIFKETFAKDIGLIIF

SEQ ID NO: 2248791 - protein, 20 aa, Cryptosporidium parvum
WIAKYLLSLSWLFLGIGRVC

SEQ ID NO: 2248792 - protein, 23 aa, Cryptosporidium parvum
WICTKYEMLVLKLLQEYYKGNGE

SEQ ID NO: 2248793 - protein, 20 aa, Cryptosporidium parvum
WIILVTHYSIYSSGLHGPHT

SEQ ID NO: 2248794 - protein, 19 aa, Cryptosporidium parvum
WIPTYQIPYNFANLEIFKM

SEQ ID NO: 2248795 - protein, 30 aa, Cryptosporidium parvum; identical to SEQ ID NO: 2134218

SEQ ID NO: 2248796 - protein, 18 aa, Cryptosporidium parvum
WIQSFYKNYTNMANIKYE

SEQ ID NO: 2248797 - protein, 26 aa, Cryptosporidium parvum
WISSSQFKFVDLWKRIFISERCIIVK

SEQ ID NO: 2248798 - protein, 17 aa, Cryptosporidium parvum
WITGPCCWLDDKFKHLP

SEQ ID NO: 2248799 - protein, 18 aa, Cryptosporidium parvum
WIVPFLMDHLIHYSILVK

SEQ ID NO: 2248800 - protein, 17 aa, Cryptosporidium parvum
WIVVCYLFSKYKKKDNC

SEQ ID NO: 2248801 - protein, 31 aa, Cryptosporidium parvum
WKASISIRLYYFILRIVIIIGTISVLIPLNI

SEQ ID NO: 2248802 - protein, 17 aa, Cryptosporidium parvum
WKIIMGMNILYFMLLTF

SEQ ID NO: 2248803 - protein, 36 aa, Cryptosporidium parvum
WKIPHGYSLLSYIYTYLWQFQINPYYIISNNYFINI

SEQ ID NO: 2248804 - protein, 28 aa, Cryptosporidium parvum
WKLNKEFFELFLRWIFQISLTENFEIPL

SEQ ID NO: 2248805 - protein, 19 aa, Cryptosporidium parvum
WKRLENPIFIFKNGVIVAW

SEQ ID NO: 2248806 - protein, 21 aa, Cryptosporidium parvum
WKSFLWEFQFSRLYFKLARGD

SEQ ID NO: 2248807 - protein, 21 aa, Cryptosporidium parvum
WKVAWMIFSAFKSSYTILFIL

SEQ ID NO: 2248808 - protein, 18 aa, Cryptosporidium parvum
WKVKLSIYILSTLLCGLC

SEQ ID NO: 2248809 - protein, 19 aa, Cryptosporidium parvum
WKVLIYDKMGQTILSPLMK

SEQ ID NO: 2248810 - protein, 20 aa, Cryptosporidium parvum
WLFSQFYLTFASNAKTTRLF

SEQ ID NO: 2248811 - protein, 26 aa, Cryptosporidium parvum
WLLNSHKMILPIIFPENILMNNSQES

SEQ ID NO: 2248812 - protein, 17 aa, Cryptosporidium parvum
WLLPLLRVHINRTELSF

SEQ ID NO: 2248813 - protein, 17 aa, Cryptosporidium parvum
WLNLDWIHPMEPSCSNT

SEQ ID NO: 2248814 - protein, 26 aa, Cryptosporidium parvum
WLTLDIKYRYTKLAKLKLIPKLFGKD

SEQ ID NO: 2248815 - protein, 18 aa, Cryptosporidium parvum
WMLLLLYCGVLIDIESSR

SEQ ID NO: 2248816 - protein, 35 aa, Cryptosporidium parvum
WNGYYCNAYNTCKIRLNVYAPFWINNRQHIPIYVL

SEQ ID NO: 2248817 - protein, 30 aa, Cryptosporidium parvum
WNMPSSYWIRYLPILLGINTFCGFLGYRSE

SEQ ID NO: 2248818 - protein, 17 aa, Cryptosporidium parvum
WNRIFNKNFYLNGLLDN

SEQ ID NO: 2248819 - protein, 17 aa, Cryptosporidium parvum
WNTIWKEIKYNLISEQK

SEQ ID NO: 2248820 - protein, 25 aa, Cryptosporidium parvum
WNVVNTKLIPLWNISIDNIEIQSLI

SEQ ID NO: 2248821 - protein, 20 aa, Cryptosporidium parvum
WPILLIYFIFLFILTMRQQI

SEQ ID NO: 2248822 - protein, 21 aa, Cryptosporidium parvum
WPLLVVGDYLRLPFQAIMFLI

SEQ ID NO: 2248823 - protein, 19 aa, Cryptosporidium parvum
WQHPWSFFHSNECFMLYKM

SEQ ID NO: 2248824 - protein, 28 aa, Cryptosporidium parvum
WRIVVSKTIFHIYFKFPCIINSKLIVQS

SEQ ID NO: 2248825 - protein, 21 aa, Cryptosporidium parvum
WSIICIIFNILIYQITFKNPN

SEQ ID NO: 2248826 - protein, 24 aa, Cryptosporidium parvum
WSNHIVCPVLFYDAINHALNKFDC

SEQ ID NO: 2248827 - protein, 21 aa, Cryptosporidium parvum
WSNLKFLIKRLVDIGMDDLGI

SEQ ID NO: 2248828 - protein, 17 aa, Cryptosporidium parvum
WSSTKFPMNDDSVAPLL

SEQ ID NO: 2248829 - protein, 23 aa, Cryptosporidium parvum
WTKMFCFGVFAMEMFIDRFISFP

SEQ ID NO: 2248830 - protein, 25 aa, Cryptosporidium parvum
WTLGILIYEMVVGFPPFYDDEPMGI

SEQ ID NO: 2248831 - protein, 20 aa, Cryptosporidium parvum
WTLTLVLLIIQVVLGQNEKF

SEQ ID NO: 2248832 - protein, 40 aa, Cryptosporidium parvum; identical to SEQ ID NO: 2134252

SEQ ID NO: 2248833 - protein, 26 aa, Cryptosporidium parvum
WVDYFNLWLIYFFLKNYILGSSIKYI

SEQ ID NO: 2248834 - protein, 18 aa, Cryptosporidium parvum
WVELFKNMKYFSNFYDII

SEQ ID NO: 2248835 - protein, 18 aa, Cryptosporidium parvum
WVSILKRPNLIFLQQIPS

SEQ ID NO: 2248836 - protein, 23 aa, Cryptosporidium parvum
WVTRTIWTIILLSSFLVILAAGH

SEQ ID NO: 2248837 - protein, 17 aa, Cryptosporidium parvum
WVYVVAITFVFMLATSF

SEQ ID NO: 2248838 - protein, 17 aa, Cryptosporidium parvum
WWFSFLNGLSPCVYFFL

SEQ ID NO: 2248839 - protein, 20 aa, Cryptosporidium parvum
WWGSNKMLFSAALYAIANIC

SEQ ID NO: 2248840 - protein, 30 aa, Cryptosporidium parvum
WYCSINNTLLFFGISFLITMFPLKELIRED

SEQ ID NO: 2248841 - protein, 35 aa, Cryptosporidium parvum
WYKKLFPNNILVSSFFFVKACFLFVSAIGRVHSRS

SEQ ID NO: 2248842 - protein, 19 aa, Cryptosporidium parvum
WYYGILLLIISISPGILII

SEQ ID NO: 2248843 - protein, 31 aa, Cryptosporidium parvum
YAALSIFSEFYYYWSKFKYNIRRFSYENPIK

SEQ ID NO: 2248844 - protein, 22 aa, Cryptosporidium parvum
YAILLILIINSAFFTINEVHPS

SEQ ID NO: 2248845 - protein, 21 aa, Cryptosporidium parvum
YAIYSLKYYKYKGWYSFIIST

SEQ ID NO: 2248846 - protein, 22 aa, Cryptosporidium parvum
YALFPIFCVVASIILIFSLTGY

SEQ ID NO: 2248847 - protein, 18 aa, Cryptosporidium parvum
YALLFFSFSIISMSLLFY

SEQ ID NO: 2248848 - protein, 24 aa, Cryptosporidium parvum
YALRALIISIFTKCKQLGYNQLLR

SEQ ID NO: 2248849 - protein, 31 aa, Cryptosporidium parvum; identical to SEQ ID NO: 2134260

SEQ ID NO: 2248850 - protein, 17 aa, Cryptosporidium parvum
YANRTYLMYGNSLLSML

SEQ ID NO: 2248851 - protein, 22 aa, Cryptosporidium parvum
YANTILIISPILKEILFSKSVG

SEQ ID NO: 2248852 - protein, 21 aa, Cryptosporidium parvum
YCFHFLIYEPGVIYMAMTDRS

SEQ ID NO: 2248853 - protein, 25 aa, Cryptosporidium parvum
YCFNLLVLLIMIPFGYYLVEHKLKL

SEQ ID NO: 2248854 - protein, 31 aa, Cryptosporidium parvum
YCKVGLNYKYPLYPIWIIVNKNHYKCSFSFN

SEQ ID NO: 2248855 - protein, 17 aa, Cryptosporidium parvum
YCRYILKKTMEDEINED

SEQ ID NO: 2248856 - protein, 29 aa, Cryptosporidium parvum
YCSLYCSKWEYLKILPVAPKSLFGINSKG

SEQ ID NO: 2248857 - protein, 29 aa, Cryptosporidium parvum
YDDIMEVYKFYWRRLKSGIFSNIGSLFSI

SEQ ID NO: 2248858 - protein, 18 aa, Cryptosporidium parvum
YDELISNPILYYKKLNQS

SEQ ID NO: 2248859 - protein, 30 aa, Cryptosporidium parvum
YDGFNYVYRSFILKLVIKLNNYFLSFIDGN

SEQ ID NO: 2248860 - protein, 17 aa, Cryptosporidium parvum
YDIIKECELLIRATLQL

SEQ ID NO: 2248861 - protein, 20 aa, Cryptosporidium parvum
YDIKKGIHYYKGLKLKINKI

SEQ ID NO: 2248862 - protein, 30 aa, Cryptosporidium parvum
YDINVLLGEYLFYSFLPYHDMAEFCQLIRT

SEQ ID NO: 2248863 - protein, 23 aa, Cryptosporidium parvum
YDNFGIILRKLGFIDQAILCYER

SEQ ID NO: 2248864 - protein, 25 aa, Cryptosporidium parvum
YDNISGFEFFLSKISIRFQSWKLKF

SEQ ID NO: 2248865 - protein, 22 aa, Cryptosporidium parvum
YDNSVLFMFAIQSPISEEKSVL

SEQ ID NO: 2248866 - protein, 27 aa, Cryptosporidium parvum
YDSNSQLFIQIWRNLRLLYIEDNIYQG

SEQ ID NO: 2248867 - protein, 27 aa, Cryptosporidium parvum
YDWNCNKLLLFKFLDNLISIIIQYYQQ

SEQ ID NO: 2248868 - protein, 27 aa, Cryptosporidium parvum
YDYHEPLYLLGITKPFFSLKIFGIWSM

SEQ ID NO: 2248869 - protein, 23 aa, Cryptosporidium parvum
YEDYLIICNSLFLNDNYGLTQKL

SEQ ID NO: 2248870 - protein, 31 aa, Cryptosporidium parvum
YEKEIKPLLIRWIIFVIRLHKFSGLSDELCE

SEQ ID NO: 2248871 - protein, 28 aa, Cryptosporidium parvum
YEKISKMFKYAFQWLSGFLTNNDIIQNG

SEQ ID NO: 2248872 - protein, 31 aa, Cryptosporidium parvum; identical to SEQ ID NO: 2134271

SEQ ID NO: 2248873 - protein, 18 aa, Cryptosporidium parvum
YELYIIPTINYDYDNQLQ

SEQ ID NO: 2248874 - protein, 24 aa, Cryptosporidium parvum
YENGRLSFIFPIHSLKETDLTIEF

SEQ ID NO: 2248875 - protein, 24 aa, Cryptosporidium parvum
YEVIMMIQMELCIGVTLRSWLGDA

SEQ ID NO: 2248876 - protein, 19 aa, Cryptosporidium parvum
YEYGMVFYGLILSIYILKY

SEQ ID NO: 2248877 - protein, 35 aa, Cryptosporidium parvum
YFARLSEYFLCSPSLFVLMFIYIKRIIDNNPSYIF

SEQ ID NO: 2248878 - protein, 25 aa, Cryptosporidium parvum
YFDGGLFNDLLLDFSRQFSEYYILR

SEQ ID NO: 2248879 - protein, 17 aa, Cryptosporidium parvum
YFDGSMYKGFEYFNTSK

SEQ ID NO: 2248880 - protein, 22 aa, Cryptosporidium parvum
YFDPYFFSLLLLLDVICTKYVY

SEQ ID NO: 2248881 - protein, 17 aa, Cryptosporidium parvum
YFFLSEVIFFELITRIQ

SEQ ID NO: 2248882 - protein, 24 aa, Cryptosporidium parvum
YFFQAVFIFVIFFGLALSENIDEY

SEQ ID NO: 2248883 - protein, 24 aa, Cryptosporidium parvum
YFGIGFIVFVFLFNKNNIGHNFHL

SEQ ID NO: 2248884 - protein, 17 aa, Cryptosporidium parvum
YFGIKLDWRPVAASELF

SEQ ID NO: 2248885 - protein, 27 aa, Cryptosporidium parvum
YFGLIYSFPMIFFIPAITSLFIVSKYQ

SEQ ID NO: 2248886 - protein, 39 aa, Cryptosporidium parvum
YFGPNIMTIFWLLLVFFIISILIFCINIIALFGHFISIY

SEQ ID NO: 2248887 - protein, 20 aa, Cryptosporidium parvum
YFHLGEYLGFPFFRQKRNKK

SEQ ID NO: 2248888 - protein, 30 aa, Cryptosporidium parvum
YFHNELMYCFFCRIFIYLKKIKINNSIIHT

SEQ ID NO: 2248889 - protein, 25 aa, Cryptosporidium parvum
YFITNLLLIIPRLCNSFHIFIKMDS

SEQ ID NO: 2248890 - protein, 30 aa, Cryptosporidium parvum
YFKFKVEFLNYYLWFIKVKFIIQNENVESK

SEQ ID NO: 2248891 - protein, 20 aa, Cryptosporidium parvum
YFKICKILFSIYMNLAKNTH

SEQ ID NO: 2248892 - protein, 48 aa, Cryptosporidium parvum; identical to SEQ ID NO: 2134280

SEQ ID NO: 2248893 - protein, 22 aa, Cryptosporidium parvum
YFKPLKVPFLSWSEAAYHSLLS

SEQ ID NO: 2248894 - protein, 24 aa, Cryptosporidium parvum
YFLIIDIVLFLLHSGNFFASCESP

SEQ ID NO: 2248895 - protein, 17 aa, Cryptosporidium parvum
YFLLYFSSSREIASKQD

SEQ ID NO: 2248896 - protein, 19 aa, Cryptosporidium parvum
YFLYLFGYSILYAIGNGLL

SEQ ID NO: 2248897 - protein, 19 aa, Cryptosporidium parvum
YFNDGPFPSLSIPTSRFGN

SEQ ID NO: 2248898 - protein, 29 aa, Cryptosporidium parvum
YFNIEYYPLWVYPALLMAIEFSLLFIPSK

SEQ ID NO: 2248899 - protein, 44 aa, Cryptosporidium parvum
YFNSFILKYMSMIEYIFAILRTQPLYIINLMLECSFGEEFISIL

SEQ ID NO: 2248900 - protein, 18 aa, Cryptosporidium parvum
YFPHFHPLRMPKSKLEWK

SEQ ID NO: 2248901 - protein, 20 aa, Cryptosporidium parvum
YFPMHRRLFSGHQKISILKE

SEQ ID NO: 2248902 - protein, 19 aa, Cryptosporidium parvum
YFPTQAFGFAFKDMIRDMM

SEQ ID NO: 2248903 - protein, 17 aa, Cryptosporidium parvum
YFQIFKNMLLFLSIQPI

SEQ ID NO: 2248904 - protein, 18 aa, Cryptosporidium parvum
YFRRSFSLSVMLKGVMNY

SEQ ID NO: 2248905 - protein, 27 aa, Cryptosporidium parvum
YFSEISIHLYFSLTKLGTSKFKVINEI

SEQ ID NO: 2248906 - protein, 19 aa, Cryptosporidium parvum
YFSFFYYLTNWGCTSTLIF

SEQ ID NO: 2248907 - protein, 25 aa, Cryptosporidium parvum
YFSNTFLYLYISFIQNLLTSNYSDP

SEQ ID NO: 2248908 - protein, 18 aa, Cryptosporidium parvum
YFSVLKNFSFYKLIYCLL

SEQ ID NO: 2248909 - protein, 24 aa, Cryptosporidium parvum
YFTGNLWLEMLIALFSLDIICNKR

SEQ ID NO: 2248910 - protein, 22 aa, Cryptosporidium parvum
YFTHEMLRRFLALAKITIPNSG

SEQ ID NO: 2248911 - protein, 26 aa, Cryptosporidium parvum
YFVRLNYLPRVLANNFTWLIPMRDHY

SEQ ID NO: 2248912 - protein, 17 aa, Cryptosporidium parvum
YGACVFLLLFGFGSSVF

SEQ ID NO: 2248913 - protein, 19 aa, Cryptosporidium parvum
YGDFEVLRDLLIQSLRNSG

SEQ ID NO: 2248914 - protein, 26 aa, Cryptosporidium parvum
YGIAPLIIIFFVIVSGFYVTVNKLPL

SEQ ID NO: 2248915 - protein, 18 aa, Cryptosporidium parvum
YGIPMFPMAPNPGQLQNG

SEQ ID NO: 2248916 - protein, 28 aa, Cryptosporidium parvum
YGKANLFQKIFRFPKLLLSKDEVHNIES

SEQ ID NO: 2248917 - protein, 50 aa, Cryptosporidium parvum
YGKRSQFMLSKSFLFKILLLVLNLIPVTLLTLGVYLIIAEIWTIISSKVL

SEQ ID NO: 2248918 - protein, 39 aa, Cryptosporidium parvum; identical to SEQ ID NO: 2134305

SEQ ID NO: 2248919 - protein, 31 aa, Cryptosporidium parvum
YGPIVHSVWPRILFIQSIIIGRFKFLDDYKH

SEQ ID NO: 2248920 - protein, 20 aa, Cryptosporidium parvum
YGRRPFGVGLLLAGFDESGP

SEQ ID NO: 2248921 - protein, 30 aa, Cryptosporidium parvum; identical to SEQ ID NO: 2134306

SEQ ID NO: 2248922 - protein, 25 aa, Cryptosporidium parvum
YGSNLTLLYDYIYNLASRVIGSGQE

SEQ ID NO: 2248923 - protein, 32 aa, Cryptosporidium parvum
YGTIYLIYSLFAWLVYILIAIKRYLSTKVSEE

SEQ ID NO: 2248924 - protein, 26 aa, Cryptosporidium parvum
YGWALLWVVIIVFQFLSLKFQWISLS

SEQ ID NO: 2248925 - protein, 27 aa, Cryptosporidium parvum
YGYLNIPLRYISLLLLALKAVCVVLCT

SEQ ID NO: 2248926 - protein, 26 aa, Cryptosporidium parvum
YGYRRKLIYLITLFSLGNYNVIRKSA

SEQ ID NO: 2248927 - protein, 29 aa, Cryptosporidium parvum
YHAGTAYRWLFVRLEIMGCIAVFTAGTLG

SEQ ID NO: 2248928 - protein, 20 aa, Cryptosporidium parvum
YHAPLFPEPREYIYPGIFFE

SEQ ID NO: 2248929 - protein, 18 aa, Cryptosporidium parvum
YHDILALIRFGMVNNGLN

SEQ ID NO: 2248930 - protein, 18 aa, Cryptosporidium parvum
YHEESPWIHGGRLIWYKT

SEQ ID NO: 2248931 - protein, 26 aa, Cryptosporidium parvum
YHIKLLVIFLVIIIKIGVVNTEHDLV

SEQ ID NO: 2248932 - protein, 25 aa, Cryptosporidium parvum
YHKYLLGYLFGIHRWYKYLTGDLSI

SEQ ID NO: 2248933 - protein, 20 aa, Cryptosporidium parvum
YHLDLPKIYLNNLESNTGIG

SEQ ID NO: 2248934 - protein, 18 aa, Cryptosporidium parvum
YHLSIALNAIFISRSYRK

SEQ ID NO: 2248935 - protein, 24 aa, Cryptosporidium parvum
YHPYTCIISCILQLPFLSTNNING

SEQ ID NO: 2248936 - protein, 17 aa, Cryptosporidium parvum
YHTNMSRRGIFNIGPRI

SEQ ID NO: 2248937 - protein, 20 aa, Cryptosporidium parvum
YIAHQLGLLVSILHICVFTG

SEQ ID NO: 2248938 - protein, 25 aa, Cryptosporidium parvum
YIAPFGLFGHLKIYDFALSTIEVGL

SEQ ID NO: 2248939 - protein, 25 aa, Cryptosporidium parvum
YIDIEDRFFHPIYQKLILNSESLQP

SEQ ID NO: 2248940 - protein, 29 aa, Cryptosporidium parvum
YIEIPVKAYKYVFPRNINALKTALAKYGP

SEQ ID NO: 2248941 - protein, 18 aa, Cryptosporidium parvum
YIELAIITCRLAALDISS

SEQ ID NO: 2248942 - protein, 25 aa, Cryptosporidium parvum
YIENYYLYFDILLVNIAMDFIFKLN

SEQ ID NO: 2248943 - protein, 31 aa, Cryptosporidium parvum
YIFSRLDISFFYHYIRGQGLLKLYFIFNMLE

SEQ ID NO: 2248944 - protein, 25 aa, Cryptosporidium parvum
YIGENLMWLLEFYSKSFLIGESTGI

SEQ ID NO: 2248945 - protein, 28 aa, Cryptosporidium parvum
YIHSFGNSLLPFIDIYQNIPLISIGLIS

SEQ ID NO: 2248946 - protein, 17 aa, Cryptosporidium parvum
YIHTPKDFAIIGSLVVI

SEQ ID NO: 2248947 - protein, 31 aa, Cryptosporidium parvum
YIINKCELLILIFRNKVNHILFELLLEPGNE

SEQ ID NO: 2248948 - protein, 37 aa, Cryptosporidium parvum
YIIWSSPICILIYPILIWYYFKYIFKPTRIQTRESYR

SEQ ID NO: 2248949 - protein, 25 aa, Cryptosporidium parvum
YIKYLHINYFFFLNNNNLFEWINQY

SEQ ID NO: 2248950 - protein, 20 aa, Cryptosporidium parvum
YILKRLHRGILYYKQKNNYI

SEQ ID NO: 2248951 - protein, 24 aa, Cryptosporidium parvum
YILLIQVFVWLIASVCIFLYLVQY

SEQ ID NO: 2248952 - protein, 26 aa, Cryptosporidium parvum
YILSALIMFYYWVLNVLSTFLLMQCA

SEQ ID NO: 2248953 - protein, 17 aa, Cryptosporidium parvum
YILSSFKLCGLEADISY

SEQ ID NO: 2248954 - protein, 21 aa, Cryptosporidium parvum
YILWIFQAFLEITEGVVKKVP

SEQ ID NO: 2248955 - protein, 24 aa, Cryptosporidium parvum
YINFLFNEIKLSEPIFPILNDLKP

SEQ ID NO: 2248956 - protein, 20 aa, Cryptosporidium parvum
YIPESFSVQATLHVIPKYST

SEQ ID NO: 2248957 - protein, 24 aa, Cryptosporidium parvum
YIPLPIFTLIIHTFSLKSDNVIKS

SEQ ID NO: 2248958 - protein, 24 aa, Cryptosporidium parvum
YIPQMFIYDRIISTVISLLPVVDN

SEQ ID NO: 2248959 - protein, 21 aa, Cryptosporidium parvum
YIPSKLFFHYYDTTNTQYSYL

SEQ ID NO: 2248960 - protein, 18 aa, Cryptosporidium parvum
YIQDIKLDLIPFLTSEDN

SEQ ID NO: 2248961 - protein, 31 aa, Cryptosporidium parvum; identical to SEQ ID NO: 2199310

SEQ ID NO: 2248962 - protein, 19 aa, Cryptosporidium parvum
YIRLFKIWINRMEKVNNNN

SEQ ID NO: 2248963 - protein, 25 aa, Cryptosporidium parvum
YIRNLKALWIIMLSSAFAAILYQNH

SEQ ID NO: 2248964 - protein, 18 aa, Cryptosporidium parvum
YISFFSSLYSGEAGTFSS

SEQ ID NO: 2248965 - protein, 24 aa, Cryptosporidium parvum
YISKLALCTLFRALNNSRCINYIR

SEQ ID NO: 2248966 - protein, 25 aa, Cryptosporidium parvum
YISLKNILKMISFTPISWKKRPDPI

SEQ ID NO: 2248967 - protein, 25 aa, Cryptosporidium parvum
YISLKRRLHNTLQFFKSYSQSSNAS

SEQ ID NO: 2248968 - protein, 28 aa, Cryptosporidium parvum
YISMESMILTTLILGELFIHGASMLIID

SEQ ID NO: 2248969 - protein, 28 aa, Cryptosporidium parvum
YISQIELILKFWFKRFRLTSNNFFDEYS

SEQ ID NO: 2248970 - protein, 46 aa, Cryptosporidium parvum
YIVSLSLNILCGILVAAAAMWVLYYYVFPWFLTGIREMQLVSTASH

SEQ ID NO: 2248971 - protein, 25 aa, Cryptosporidium parvum
YIYKIYLFIYSWSIFQFLSISILGI

SEQ ID NO: 2248972 - protein, 19 aa, Cryptosporidium parvum
YIYWNSRLYFWSPITFYTI

SEQ ID NO: 2248973 - protein, 18 aa, Cryptosporidium parvum
YKAYLLLDSFYAIEKQLF

SEQ ID NO: 2248974 - protein, 45 aa, Cryptosporidium parvum
YKEGSAAYFIDKIQKILRLISLIFSLFILGFIITSRINKGRKDIS

SEQ ID NO: 2248975 - protein, 23 aa, Cryptosporidium parvum
YKELYIYFVNTLRQLYIDSLSHN

SEQ ID NO: 2248976 - protein, 28 aa, Cryptosporidium parvum
YKEQGQVIFLLLFLSLKLITNHKHFLML

SEQ ID NO: 2248977 - protein, 40 aa, Cryptosporidium parvum; identical to SEQ ID NO: 2134327

SEQ ID NO: 2248978 - protein, 31 aa, Cryptosporidium parvum
YKGTGLVIFGLLFIILFGIKDVPVYNVHELG

SEQ ID NO: 2248979 - protein, 18 aa, Cryptosporidium parvum
YKIKDFPALPKFLTNFRD

SEQ ID NO: 2248980 - protein, 17 aa, Cryptosporidium parvum
YKIPPEVTFLILEGLDS

SEQ ID NO: 2248981 - protein, 21 aa, Cryptosporidium parvum
YKKIIIAESFNILISGRYLSN

SEQ ID NO: 2248982 - protein, 20 aa, Cryptosporidium parvum
YKLCIIYINFILKCDHPGSS

SEQ ID NO: 2248983 - protein, 23 aa, Cryptosporidium parvum
YKLFFLIFVSRLSKIYIILTLTI

SEQ ID NO: 2248984 - protein, 18 aa, Cryptosporidium parvum
YKMMTLVVCIGICYGAII

SEQ ID NO: 2248985 - protein, 17 aa, Cryptosporidium parvum
YKNEYSTVWFIRKDEKD

SEQ ID NO: 2248986 - protein, 24 aa, Cryptosporidium parvum
YKPSSILELFGGLPSYCLYYGTQS

SEQ ID NO: 2248987 - protein, 19 aa, Cryptosporidium parvum
YKTGNLIGKIFALIAALDY

SEQ ID NO: 2248988 - protein, 35 aa, Cryptosporidium parvum; identical to SEQ ID NO: 2134330

SEQ ID NO: 2248989 - protein, 27 aa, Cryptosporidium parvum
YKTIGFWMFTYCFFLSYNTIYFNSLVE

SEQ ID NO: 2248990 - protein, 26 aa, Cryptosporidium parvum
YLAIKNFCILTFVGLLFGYITCLTIL

SEQ ID NO: 2248991 - protein, 19 aa, Cryptosporidium parvum
YLCGYTFHKKGIKSMLYLN

SEQ ID NO: 2248992 - protein, 26 aa, Cryptosporidium parvum
YLCSTYPMLIFMRHLLQNRKRFKGPK

SEQ ID NO: 2248993 - protein, 29 aa, Cryptosporidium parvum
YLDNSRIIIASIFGIMEILLNRMVNPYEI

SEQ ID NO: 2248994 - protein, 25 aa, Cryptosporidium parvum
YLDPDKIQLLPNGRVYYFPRDHVCD

SEQ ID NO: 2248995 - protein, 20 aa, Cryptosporidium parvum
YLERFLGKYYSGEAITYLTQ

SEQ ID NO: 2248996 - protein, 25 aa, Cryptosporidium parvum
YLGFTLILSIWILKSQDWYNLDDLS

SEQ ID NO: 2248997 - protein, 27 aa, Cryptosporidium parvum
YLGPIIIFPIFYFFPTLIYGEPAPPKS

SEQ ID NO: 2248998 - protein, 18 aa, Cryptosporidium parvum
YLIELPIYKLVETRSSFC

SEQ ID NO: 2248999 - protein, 23 aa, Cryptosporidium parvum
YLIYTSALVISFLITSILGIFPH

SEQ ID NO: 2249000 - protein, 25 aa, Cryptosporidium parvum
YLKCNIFRFKLSLSSFKIVLSRKFT

SEQ ID NO: 2249001 - protein, 34 aa, Cryptosporidium parvum; identical to SEQ ID NO: 2134342

SEQ ID NO: 2249002 - protein, 28 aa, Cryptosporidium parvum
YLLCIISICFFLYPSWSLYVHIKINGIP

SEQ ID NO: 2249003 - protein, 29 aa, Cryptosporidium parvum
YLLDQDCLMSIWYGTPLFMSRYIADNPNN

SEQ ID NO: 2249004 - protein, 18 aa, Cryptosporidium parvum
YLLQAFPAILTFTMILIG

SEQ ID NO: 2249005 - protein, 25 aa, Cryptosporidium parvum
YLLWEELIEFTNFIYLYCFTNNNSN

SEQ ID NO: 2249006 - protein, 23 aa, Cryptosporidium parvum
YLNINWGYIYKLIPGISNFNCSN

SEQ ID NO: 2249007 - protein, 17 aa, Cryptosporidium parvum
YLNMVKFAEVALLVGIS

SEQ ID NO: 2249008 - protein, 22 aa, Cryptosporidium parvum
YLNQFLYIFSLVTSIGIISAEA

SEQ ID NO: 2249009 - protein, 17 aa, Cryptosporidium parvum
YLNVLKFLNEYNSNVIL

SEQ ID NO: 2249010 - protein, 32 aa, Cryptosporidium parvum
YLNYHFFTSINIIIIIIIQMSSSFLSASSSIS

SEQ ID NO: 2249011 - protein, 17 aa, Cryptosporidium parvum
YLPFHSKLLSKIVEQKR

SEQ ID NO: 2249012 - protein, 19 aa, Cryptosporidium parvum
YLPIIYPSDFWCIERNFKM

SEQ ID NO: 2249013 - protein, 22 aa, Cryptosporidium parvum
YLPMFFVVLFVVMPFSSYLMPD

SEQ ID NO: 2249014 - protein, 17 aa, Cryptosporidium parvum
YLPNCFLCYTLPKIQHP

SEQ ID NO: 2249015 - protein, 19 aa, Cryptosporidium parvum
YLPYKSIYDNVVYPSLFTL

SEQ ID NO: 2249016 - protein, 17 aa, Cryptosporidium parvum
YLSYFEVLSWIKITQEQ

SEQ ID NO: 2249017 - protein, 19 aa, Cryptosporidium parvum
YLTILLSTFSTCISLYCKI

SEQ ID NO: 2249018 - protein, 20 aa, Cryptosporidium parvum
YLTVLLLGTVLFFIGFNGEK

SEQ ID NO: 2249019 - protein, 19 aa, Cryptosporidium parvum
YLVNVFIFYWRQALTEYYL

SEQ ID NO: 2249020 - protein, 17 aa, Cryptosporidium parvum
YLVTMSKVPIYIVTGFL

SEQ ID NO: 2249021 - protein, 20 aa, Cryptosporidium parvum
YLVVIFFTILCENIDEKLLS

SEQ ID NO: 2249022 - protein, 17 aa, Cryptosporidium parvum
YLYDYNIEKLLLNINLK

SEQ ID NO: 2249023 - protein, 22 aa, Cryptosporidium parvum
YLYILVIFKVNYVISIRNNKSS

SEQ ID NO: 2249024 - protein, 25 aa, Cryptosporidium parvum
YMGSVFIVLTLLKILVETQYSYWCG

SEQ ID NO: 2249025 - protein, 31 aa, Cryptosporidium parvum
YMIDYSILLFIMFLFRPFKSLKLFSNVLAKH

SEQ ID NO: 2249026 - protein, 17 aa, Cryptosporidium parvum
YMILSEELNPMFLNTLR

SEQ ID NO: 2249027 - protein, 32 aa, Cryptosporidium parvum
YMKINLYFFGVILHAFLAIYWIYKCIRNSKQL

SEQ ID NO: 2249028 - protein, 23 aa, Cryptosporidium parvum
YMKLLEFFHLNPSLCKLFFEMKQ

SEQ ID NO: 2249029 - protein, 18 aa, Cryptosporidium parvum
YMQNLIPVRVYVDNIILN

SEQ ID NO: 2249030 - protein, 19 aa, Cryptosporidium parvum
YMQYSIILSIYINSAYISN

SEQ ID NO: 2249031 - protein, 17 aa, Cryptosporidium parvum
YMRDRISYINFSTINYL

SEQ ID NO: 2249032 - protein, 21 aa, Cryptosporidium parvum
YMVVILPCEVLYMIHRKLKQI

SEQ ID NO: 2249033 - protein, 25 aa, Cryptosporidium parvum
YMVVPGIIYFFLSILLNFIGIPKHV

SEQ ID NO: 2249034 - protein, 21 aa, Cryptosporidium parvum
YNEVTWWIGVISYAFGAIIHI

SEQ ID NO: 2249035 - protein, 24 aa, Cryptosporidium parvum
YNFKKLKLLLPDPPTINYFELKFE

SEQ ID NO: 2249036 - protein, 24 aa, Cryptosporidium parvum
YNIDHLIWDLIVSDYILSLRKKGI

SEQ ID NO: 2249037 - protein, 36 aa, Cryptosporidium parvum
YNIHLSSFLVLRDCIYIVFSLIYYSKSRDLDDFIID

SEQ ID NO: 2249038 - protein, 18 aa, Cryptosporidium parvum
YNIIFPLCKLINYFIILQ

SEQ ID NO: 2249039 - protein, 18 aa, Cryptosporidium parvum
YNIILIISLTISIYGIML

SEQ ID NO: 2249040 - protein, 23 aa, Cryptosporidium parvum
YNKILTYTMNLMLEKLRTCDSRV

SEQ ID NO: 2249041 - protein, 18 aa, Cryptosporidium parvum
YNKPILNSFKLLINTIYD

SEQ ID NO: 2249042 - protein, 18 aa, Cryptosporidium parvum
YNLPILMICPQPNMPRHF

SEQ ID NO: 2249043 - protein, 22 aa, Cryptosporidium parvum
YNLPLFAFIWWSYFNLSENQKS

SEQ ID NO: 2249044 - protein, 17 aa, Cryptosporidium parvum
YNMNFPCEQVHYWFLAY

SEQ ID NO: 2249045 - protein, 17 aa, Cryptosporidium parvum
YNMSSLMNLTLSKCIKP

SEQ ID NO: 2249046 - protein, 27 aa, Cryptosporidium parvum
YNNLNNRFLILSIPKLKSLKKVKAVLY

SEQ ID NO: 2249047 - protein, 24 aa, Cryptosporidium parvum
YNNNIFPKFWKIELTFWCVFFLML

SEQ ID NO: 2249048 - protein, 32 aa, Cryptosporidium parvum
YNPILKEIYTTTPFWSLTILNSPFLLPSCNMA

SEQ ID NO: 2249049 - protein, 24 aa, Cryptosporidium parvum
YNPINIFVSLFGISFNLYNQLNLY

SEQ ID NO: 2249050 - protein, 28 aa, Cryptosporidium parvum
YNRCKFWWLSLVQFPECIWILYCISICL

SEQ ID NO: 2249051 - protein, 17 aa, Cryptosporidium parvum
YNRLMELGIQYGKKFKT

SEQ ID NO: 2249052 - protein, 20 aa, Cryptosporidium parvum
YNSFLLDYALFLADNRVGLV

SEQ ID NO: 2249053 - protein, 25 aa, Cryptosporidium parvum
YNSLTNLKFIHPINRLFACIKNKKI

SEQ ID NO: 2249054 - protein, 26 aa, Cryptosporidium parvum
YNSVSALYFILTIKSIFHYNIVQVEN

SEQ ID NO: 2249055 - protein, 27 aa, Cryptosporidium parvum
YNTIKQYLIKILTFIFQKELQTEDTSI

SEQ ID NO: 2249056 - protein, 26 aa, Cryptosporidium parvum
YPGANKLLLGGILYDLSRLDQNQRKA

SEQ ID NO: 2249057 - protein, 41 aa, Cryptosporidium parvum
YPLTLSLINTEFYRIFRFNLYNLFTILYKCGGENISDLLKR

SEQ ID NO: 2249058 - protein, 33 aa, Cryptosporidium parvum
YPLTVSFLHFTAFIYYWQLLSMISSPIISVILA

SEQ ID NO: 2249059 - protein, 24 aa, Cryptosporidium parvum
YPSNSFIILILLISTIIIINHGWY

SEQ ID NO: 2249060 - protein, 18 aa, Cryptosporidium parvum
YPVELLKPLSNIWPGDGR

SEQ ID NO: 2249061 - protein, 17 aa, Cryptosporidium parvum
YPVIYGFPFIFFINPNY

SEQ ID NO: 2249062 - protein, 38 aa, Cryptosporidium parvum; identical to SEQ ID NO: 2134370

SEQ ID NO: 2249063 - protein, 17 aa, Cryptosporidium parvum
YQIFTFIFGSIWFPNFL

SEQ ID NO: 2249064 - protein, 18 aa, Cryptosporidium parvum
YQKAITSYLFLTIGVINS

SEQ ID NO: 2249065 - protein, 22 aa, Cryptosporidium parvum
YQPFFLLHGLYLYAYIIGILLA

SEQ ID NO: 2249066 - protein, 26 aa, Cryptosporidium parvum
YQQFYTKIYSRTLTWSYFLGTCIMDY

SEQ ID NO: 2249067 - protein, 21 aa, Cryptosporidium parvum
YQRHYPISTLLPVVTLLLFSW

SEQ ID NO: 2249068 - protein, 23 aa, Cryptosporidium parvum
YQTNFLLQILGITISFFGNIFNS

SEQ ID NO: 2249069 - protein, 17 aa, Cryptosporidium parvum
YQYILPSKYSKISKTII

SEQ ID NO: 2249070 - protein, 29 aa, Cryptosporidium parvum
YQYLLEKYLIKFGFLSDFLFNSKLNKLFS

SEQ ID NO: 2249071 - protein, 21 aa, Cryptosporidium parvum
YRDLFELLSKIFISKLKNKKI

SEQ ID NO: 2249072 - protein, 24 aa, Cryptosporidium parvum
YRDVLFIFVTRGILLTLCFTWASL

SEQ ID NO: 2249073 - protein, 18 aa, Cryptosporidium parvum
YRENCILSIFGVINYVIS

SEQ ID NO: 2249074 - protein, 20 aa, Cryptosporidium parvum
YRIEAIIMKFLKHKQKSSLL

SEQ ID NO: 2249075 - protein, 27 aa, Cryptosporidium parvum
YRIHIFKIQNMLLLISSYYLNINWGYI

SEQ ID NO: 2249076 - protein, 25 aa, Cryptosporidium parvum
YRILKSIWYGSRLYKYNLSIIYNYA

SEQ ID NO: 2249077 - protein, 22 aa, Cryptosporidium parvum
YRKLWLIICLAILALTGITEKT

SEQ ID NO: 2249078 - protein, 25 aa, Cryptosporidium parvum
YRKMLEFCLSIFSFELREFDWSDEI

SEQ ID NO: 2249079 - protein, 17 aa, Cryptosporidium parvum
YRLGKIFKVWRLIKKNN

SEQ ID NO: 2249080 - protein, 19 aa, Cryptosporidium parvum
YRMRIAGIYLALGSPISSA

SEQ ID NO: 2249081 - protein, 19 aa, Cryptosporidium parvum
YRTNYSIVLSPIDDIKQLN

SEQ ID NO: 2249082 - protein, 20 aa, Cryptosporidium parvum
YRVLILFNKSDLITSRSISY

SEQ ID NO: 2249083 - protein, 18 aa, Cryptosporidium parvum
YSAPKKLPSRNFLEQLFA

SEQ ID NO: 2249084 - protein, 26 aa, Cryptosporidium parvum
YSASTWFYCFLLIILNVQYSKLHLKV

SEQ ID NO: 2249085 - protein, 28 aa, Cryptosporidium parvum
YSDHLPCAVWLPWIPQLIAGIDRIEGSA

SEQ ID NO: 2249086 - protein, 26 aa, Cryptosporidium parvum
YSDLIDLWTILWRNYLNENIHLFYNK

SEQ ID NO: 2249087 - protein, 32 aa, Cryptosporidium parvum; identical to SEQ ID NO: 2134382

SEQ ID NO: 2249088 - protein, 28 aa, Cryptosporidium parvum
YSFIHPEHLFLFNNYIKLKILISSQSQS

SEQ ID NO: 2249089 - protein, 26 aa, Cryptosporidium parvum
YSFLYCLIYLIFTIVYFILKLPNPQS

SEQ ID NO: 2249090 - protein, 30 aa, Cryptosporidium parvum
YSGIYLSIPLLNYVFFNIKSLFINKNGSSL

SEQ ID NO: 2249091 - protein, 22 aa, Cryptosporidium parvum
YSILIHFVSLFFDDSFEKRNEY

SEQ ID NO: 2249092 - protein, 29 aa, Cryptosporidium parvum
YSIQQINLLYKQKLIWLRIHLTVGIIDSE

SEQ ID NO: 2249093 - protein, 22 aa, Cryptosporidium parvum
YSITLIVIVWLACTSNQISEFQ

SEQ ID NO: 2249094 - protein, 30 aa, Cryptosporidium parvum
YSIVISTMPFLLIIFAIIAAPILRYFREKE

SEQ ID NO: 2249095 - protein, 22 aa, Cryptosporidium parvum
YSKELCIHLLGASLSIIYKNVN

SEQ ID NO: 2249096 - protein, 29 aa, Cryptosporidium parvum
YSKKITPYLILMIPIITSIGLIFLKSILD

SEQ ID NO: 2249097 - protein, 33 aa, Cryptosporidium parvum
YSKKSGFIFFQWYFWYCLESRRYPSKDFLLKFV

SEQ ID NO: 2249098 - protein, 39 aa, Cryptosporidium parvum
YSKLITFYKKWTIPYKKFITLYFYQLPTLLNHLFSRSDS

SEQ ID NO: 2249099 - protein, 19 aa, Cryptosporidium parvum
YSLFIQVFGSKFSWRWFLP

SEQ ID NO: 2249100 - protein, 26 aa, Cryptosporidium parvum
YSLILLTLFSYFEFNSPLIVGVCISL

SEQ ID NO: 2249101 - protein, 25 aa, Cryptosporidium parvum
YSLKPIHSFYFLRSYVRQYLEYIFK

SEQ ID NO: 2249102 - protein, 26 aa, Cryptosporidium parvum
YSLLHYIRIIINIYIILNYSLKMIAQ

SEQ ID NO: 2249103 - protein, 26 aa, Cryptosporidium parvum
YSNFKWVFAIFILKPSILFLCRVFTL

SEQ ID NO: 2249104 - protein, 33 aa, Cryptosporidium parvum
YSNSQPTIIHWLIILLSALFSCYLFNGVDQKDV

SEQ ID NO: 2249105 - protein, 21 aa, Cryptosporidium parvum
YSPELIVHPLFPSYGELSKEE

SEQ ID NO: 2249106 - protein, 24 aa, Cryptosporidium parvum
YSPFGIPFYFRDIEIIIFDVLGGK

SEQ ID NO: 2249107 - protein, 17 aa, Cryptosporidium parvum
YSRDVLMSMNALIGLIL

SEQ ID NO: 2249108 - protein, 29 aa, Cryptosporidium parvum
YSRKYNDWLVFFLFLNKFFRIKEKNTKCL

SEQ ID NO: 2249109 - protein, 23 aa, Cryptosporidium parvum
YSSDRPRWYPLLSAAHYGIMVGQ

SEQ ID NO: 2249110 - protein, 19 aa, Cryptosporidium parvum
YSSFIFGTICKFIGLPLLL

SEQ ID NO: 2249111 - protein, 21 aa, Cryptosporidium parvum
YSSFIVIILSYFNNYFRDKDG

SEQ ID NO: 2249112 - protein, 32 aa, Cryptosporidium parvum
YSSKFPTKYDLNGLLFWNVSSDTYIYWGYQNK

SEQ ID NO: 2249113 - protein, 23 aa, Cryptosporidium parvum
YSSKWNRRLLARKHNLPLGNSDS

SEQ ID NO: 2249114 - protein, 18 aa, Cryptosporidium parvum
YSSLFREFGITNFNFIQG

SEQ ID NO: 2249115 - protein, 28 aa, Cryptosporidium parvum
YSSTSLLLSWFFNGLFHAGVYPMLVKYL

SEQ ID NO: 2249116 - protein, 22 aa, Cryptosporidium parvum
YSTIFIFLYSCFTVFNYATCEL

SEQ ID NO: 2249117 - protein, 17 aa, Cryptosporidium parvum
YSVIIKLSEKFESEIDP

SEQ ID NO: 2249118 - protein, 19 aa, Cryptosporidium parvum
YSVLASLSLLLLNFTIQAE

SEQ ID NO: 2249119 - protein, 17 aa, Cryptosporidium parvum
YSVLSCIISHLITFLLI

SEQ ID NO: 2249120 - protein, 24 aa, Cryptosporidium parvum
YSYLNCMVSPWKNLEFICVMDTVT

SEQ ID NO: 2249121 - protein, 24 aa, Cryptosporidium parvum
YTCDLLHYNLLLIIKALSFLESYE

SEQ ID NO: 2249122 - protein, 20 aa, Cryptosporidium parvum
YTCMPMWTSIPVLHAGSKND

SEQ ID NO: 2249123 - protein, 19 aa, Cryptosporidium parvum
YTGMILSVFIPGERFSKVT

SEQ ID NO: 2249124 - protein, 20 aa, Cryptosporidium parvum
YTLNVFFLGLILPIGGYINK

SEQ ID NO: 2249125 - protein, 20 aa, Cryptosporidium parvum
YTLRLRGKIPDSINLFASKF

SEQ ID NO: 2249126 - protein, 17 aa, Cryptosporidium parvum
YTLVISPVVGWLTSTKR

SEQ ID NO: 2249127 - protein, 22 aa, Cryptosporidium parvum
YTMAKFYFFERINQMFYDKVFT

SEQ ID NO: 2249128 - protein, 21 aa, Cryptosporidium parvum
YTNFNVLMCVSLSLIFHSRLH

SEQ ID NO: 2249129 - protein, 25 aa, Cryptosporidium parvum
YTNIQAEYRSMLIRDLINIARNDSD

SEQ ID NO: 2249130 - protein, 32 aa, Cryptosporidium parvum
YTNYSATLKPIPLIVILFSCLKYLIVNCNSLP

SEQ ID NO: 2249131 - protein, 19 aa, Cryptosporidium parvum
YTPVPCIVNFPFNAKISRI

SEQ ID NO: 2249132 - protein, 19 aa, Cryptosporidium parvum
YTRELYYTSLLSKQNFPLI

SEQ ID NO: 2249133 - protein, 22 aa, Cryptosporidium parvum
YTRRIPLEGLEMYCKTVWKCIV

SEQ ID NO: 2249134 - protein, 22 aa, Cryptosporidium parvum
YTSFFALISYKLAVVFLKSVSS

SEQ ID NO: 2249135 - protein, 21 aa, Cryptosporidium parvum
YTSIDIIWLNIILQLEDLCKD

SEQ ID NO: 2249136 - protein, 24 aa, Cryptosporidium parvum
YVAHIMRQIMAALAYFHSRNIVHK

SEQ ID NO: 2249137 - protein, 22 aa, Cryptosporidium parvum
YVAKALTMGLYNKGLEVIVEPL

SEQ ID NO: 2249138 - protein, 31 aa, Cryptosporidium parvum
YVEDPFKIIPYIRRAPFGSLYPIHLVKEGTT

SEQ ID NO: 2249139 - protein, 26 aa, Cryptosporidium parvum
YVELHYLFISFWNYTPFYFYNNQHHN

SEQ ID NO: 2249140 - protein, 27 aa, Cryptosporidium parvum
YVIAAVYYYFIRWQGIPQVYGQFVIEK

SEQ ID NO: 2249141 - protein, 25 aa, Cryptosporidium parvum
YVIKKILLIICPYITFFTQNKRKSF

SEQ ID NO: 2249142 - protein, 17 aa, Cryptosporidium parvum
YVKLPYSDLSNIILFCM

SEQ ID NO: 2249143 - protein, 19 aa, Cryptosporidium parvum
YVLLFSLNEFPILILITIS

SEQ ID NO: 2249144 - protein, 27 aa, Cryptosporidium parvum
YVLSIVIILVYWLLNVICTILMFKCAD

SEQ ID NO: 2249145 - protein, 31 aa, Cryptosporidium parvum; identical to SEQ ID NO: 2134412

SEQ ID NO: 2249146 - protein, 27 aa, Cryptosporidium parvum
YVQGYFSIFFIYLFSRIIEADKLDRKL

SEQ ID NO: 2249147 - protein, 17 aa, Cryptosporidium parvum
YVQSIDTVLSRLATPWS

SEQ ID NO: 2249148 - protein, 28 aa, Cryptosporidium parvum
YVSTTIYLFVFCFVCILAKRVNVSSSRR

SEQ ID NO: 2249149 - protein, 26 aa, Cryptosporidium parvum
YVTIYRVEDLLFKKGLRDPFITVEFS

SEQ ID NO: 2249150 - protein, 28 aa, Cryptosporidium parvum
YVYVCTYWGLFYFKIPKKYGIYLNKHTD

SEQ ID NO: 2249151 - protein, 20 aa, Cryptosporidium parvum
YWDFNTVFEFVFFNKNNQFD

SEQ ID NO: 2249152 - protein, 35 aa, Cryptosporidium parvum; identical to SEQ ID NO: 2134419

SEQ ID NO: 2249153 - protein, 27 aa, Cryptosporidium parvum
YYCLRYPCLINYLFKLYSRIVDEINKN

SEQ ID NO: 2249154 - protein, 41 aa, Cryptosporidium parvum; identical to SEQ ID NO: 2134420

SEQ ID NO: 2249155 - protein, 19 aa, Cryptosporidium parvum
YYEKLPLIFDRFFEEILRL

SEQ ID NO: 2249156 - protein, 18 aa, Cryptosporidium parvum
YYFGIYSLIIELLSDSRR

SEQ ID NO: 2249157 - protein, 21 aa, Cryptosporidium parvum
YYGILLFNQIQPYLIGLVLQL

SEQ ID NO: 2249158 - protein, 24 aa, Cryptosporidium parvum
YYIGLFVFFIALFSELDAYSGSFT

SEQ ID NO: 2249159 - protein, 25 aa, Cryptosporidium parvum
YYIIMPVHTVIILRSLWLSKKESTD

SEQ ID NO: 2249160 - protein, 20 aa, Cryptosporidium parvum
YYKQILSEYKLDKSFLHIGS

SEQ ID NO: 2249161 - protein, 24 aa, Cryptosporidium parvum
YYLFFIVIINILILSNGATVPDNR

SEQ ID NO: 2249162 - protein, 17 aa, Cryptosporidium parvum
YYLLFQVNKQIQKEILL

SEQ ID NO: 2249163 - protein, 17 aa, Cryptosporidium parvum
YYLLNIEQYKFTYLQDT

SEQ ID NO: 2249164 - protein, 17 aa, Cryptosporidium parvum
YYLVIALRKSFDLLTRY

SEQ ID NO: 2249165 - protein, 26 aa, Cryptosporidium parvum
YYQSILILLVLFDIFGTLLINQLFNQ

SEQ ID NO: 2249166 - protein, 19 aa, Cryptosporidium parvum
YYREFLAFVYYRCIYGAEG

SEQ ID NO: 2249167 - protein, 27 aa, Cryptosporidium parvum
YYSAMIYLLISILPNRPQLITSIKPFI

SEQ ID NO: 2249168 - protein, 24 aa, Cryptosporidium parvum
AALDYFIWFFLEFFYPKESIEHCI

SEQ ID NO: 2249169 - protein, 23 aa, Cryptosporidium parvum
ACFILIRYFWLAKLIKINKRKYR

SEQ ID NO: 2249170 - protein, 25 aa, Cryptosporidium parvum
AEEMYILLFAFYYSIYQTLKYCKIV

SEQ ID NO: 2249171 - protein, 18 aa, Cryptosporidium parvum
AEIIWILVHSFFSTLTSL

SEQ ID NO: 2249172 - protein, 23 aa, Cryptosporidium parvum
AFEILFYKYRLLIRLILNKERII

SEQ ID NO: 2249173 - protein, 21 aa, Cryptosporidium parvum
AFFALYLICWIFAYVKDLSDW

SEQ ID NO: 2249174 - protein, 27 aa, Cryptosporidium parvum
AGFGILYLFIFHWLIFLPSFVLDEKRI

SEQ ID NO: 2249175 - protein, 29 aa, Cryptosporidium parvum
AGFSLFFQFWFWFPLVHCISLSYVPTCIV

SEQ ID NO: 2249176 - protein, 22 aa, Cryptosporidium parvum
AHIGSLLAWLFQNMAQHVEQDR

SEQ ID NO: 2249177 - protein, 29 aa, Cryptosporidium parvum
AIALVAVIMNPLFSLAFKSSNRLEMRIES

SEQ ID NO: 2249178 - protein, 24 aa, Cryptosporidium parvum
AIGIWRLIRTLFCGILLMFVLFIC

SEQ ID NO: 2249179 - protein, 24 aa, Cryptosporidium parvum
ALELIQICFFLLNGLNVLSVFEEQ

SEQ ID NO: 2249180 - protein, 17 aa, Cryptosporidium parvum
ALIHLLNFLWPNVFENS

SEQ ID NO: 2249181 - protein, 23 aa, Cryptosporidium parvum
ALLILFLMIFLIIEIGIGIYIKL

SEQ ID NO: 2249182 - protein, 25 aa, Cryptosporidium parvum
ALLISVPWMFFPKPLYLIYKSRKQK

SEQ ID NO: 2249183 - protein, 18 aa, Cryptosporidium parvum
ALLKPFIPLFPSYTLIGL

SEQ ID NO: 2249184 - protein, 26 aa, Cryptosporidium parvum
ALLQILHYFLIPMFPLDLVSFNSIFV

SEQ ID NO: 2249185 - protein, 22 aa, Cryptosporidium parvum
ALLSILLIWFMTIMLVYEAIQR

SEQ ID NO: 2249186 - protein, 23 aa, Cryptosporidium parvum
ALTLLIIYLLNKILFWFIVISIF

SEQ ID NO: 2249187 - protein, 25 aa, Cryptosporidium parvum
AMWVLYYYVFPWFLTGIREMQLVST

SEQ ID NO: 2249188 - protein, 25 aa, Cryptosporidium parvum
ANFLLKHPFILLKAKRPNSLGIFIQ

SEQ ID NO: 2249189 - protein, 26 aa, Cryptosporidium parvum
AQFDDLLVRILLGAALMSFFFALIGD

SEQ ID NO: 2249190 - protein, 23 aa, Cryptosporidium parvum
ARNELYFVTIFYGLQFALNRIFQ

SEQ ID NO: 2249191 - protein, 24 aa, Cryptosporidium parvum
ASLIFTLWEFFWFLSVKISRKHAT

SEQ ID NO: 2249192 - protein, 21 aa, Cryptosporidium parvum
ASLLLFCIFVGIAIKTFEGMR

SEQ ID NO: 2249193 - protein, 23 aa, Cryptosporidium parvum
ATFARILLLWWYSIPDIREIQHR

SEQ ID NO: 2249194 - protein, 17 aa, Cryptosporidium parvum
ATFMFFSFALFGLIPML

SEQ ID NO: 2249195 - protein, 18 aa, Cryptosporidium parvum
AVVGALLYYLFRSDSSEN

SEQ ID NO: 2249196 - protein, 28 aa, Cryptosporidium parvum
AYMVMAFLAIYWQSALFSLGLKSSHFWK

SEQ ID NO: 2249197 - protein, 19 aa, Cryptosporidium parvum
CCRITLVTLVFISVSLIIV

SEQ ID NO: 2249198 - protein, 18 aa, Cryptosporidium parvum
CFFLIVCGWVINVFWPFV

SEQ ID NO: 2249199 - protein, 19 aa, Cryptosporidium parvum
CFFVTIFFSISSLFFLLCL

SEQ ID NO: 2249200 - protein, 18 aa, Cryptosporidium parvum
CFGSLFIILFAFICTSCC

SEQ ID NO: 2249201 - protein, 20 aa, Cryptosporidium parvum
CIFECFFEPLLYYKNKHNLP

SEQ ID NO: 2249202 - protein, 23 aa, Cryptosporidium parvum
CIMLQLHYLLFFYKNNKMDFLIN

SEQ ID NO: 2249203 - protein, 17 aa, Cryptosporidium parvum
CLIFSFLITMKLPFNCY

SEQ ID NO: 2249204 - protein, 29 aa, Cryptosporidium parvum
CLIKKLYMELWYNGWLALLKLVQCMNPHK

SEQ ID NO: 2249205 - protein, 19 aa, Cryptosporidium parvum
CNKPMWFVIGFQEDIFLEY

SEQ ID NO: 2249206 - protein, 28 aa, Cryptosporidium parvum
CRNKLLYLVLVIILLWALSFTIVHQLVI

SEQ ID NO: 2249207 - protein, 25 aa, Cryptosporidium parvum
CSFLSFLLVNYYITKWIWGSNLTSS

SEQ ID NO: 2249208 - protein, 18 aa, Cryptosporidium parvum
CSIGIFFLLFLTSNIIWF

SEQ ID NO: 2249209 - protein, 23 aa, Cryptosporidium parvum
CSQIPSYLWYLPSDKIFPFPITS

SEQ ID NO: 2249210 - protein, 19 aa, Cryptosporidium parvum
CTRFDGILLPLRKGYQIDF

SEQ ID NO: 2249211 - protein, 29 aa, Cryptosporidium parvum
CVNRAVFFLHWWLITWPKIPFYANDFVLA

SEQ ID NO: 2249212 - protein, 36 aa, Cryptosporidium parvum
DALRPIWLKIRIVYVIFAILLFFIIGAVYPALFYQS

SEQ ID NO: 2249213 - protein, 25 aa, Cryptosporidium parvum
DAWEIYYLITFIQLSFREIFIIFSQ

SEQ ID NO: 2249214 - protein, 18 aa, Cryptosporidium parvum
DCIYIVFSLIYYSKSRDL

SEQ ID NO: 2249215 - protein, 22 aa, Cryptosporidium parvum
DDFYKNIIFLLRLIALYSEKNE

SEQ ID NO: 2249216 - protein, 24 aa, Cryptosporidium parvum
DDSVAPLLIFKWFDQTTLDITLLS

SEQ ID NO: 2249217 - protein, 25 aa, Cryptosporidium parvum
DEIDLYLQFFIFKRPYLSAFSLVFS

SEQ ID NO: 2249218 - protein, 22 aa, Cryptosporidium parvum
DEKPFFWCEYLRYLNLSRNKFE

SEQ ID NO: 2249219 - protein, 17 aa, Cryptosporidium parvum
DFFFIILISTFLKEVSR

SEQ ID NO: 2249220 - protein, 21 aa, Cryptosporidium parvum
DFLLNILLVLFDLGIERFLGS

SEQ ID NO: 2249221 - protein, 24 aa, Cryptosporidium parvum
DFQDLLWHLIIYSIAPFIVYIYNR

SEQ ID NO: 2249222 - protein, 17 aa, Cryptosporidium parvum
DFYTYLFPKVLLDFSIL

SEQ ID NO: 2249223 - protein, 19 aa, Cryptosporidium parvum
DHQYLFFGIIRMISGPRDK

SEQ ID NO: 2249224 - protein, 18 aa, Cryptosporidium parvum
DIILFWMPFYYLFKLCFL

SEQ ID NO: 2249225 - protein, 30 aa, Cryptosporidium parvum
DILNNYYWKLLLFIIIRRHSLIFFKLNSKS

SEQ ID NO: 2249226 - protein, 26 aa, Cryptosporidium parvum
DIMNSRLILILFSIILIIGWVESSSN

SEQ ID NO: 2249227 - protein, 18 aa, Cryptosporidium parvum
DISLIRIIHFLSVLTFFG

SEQ ID NO: 2249228 - protein, 17 aa, Cryptosporidium parvum
DIVFWLDIILDISNLFK

SEQ ID NO: 2249229 - protein, 26 aa, Cryptosporidium parvum
DIYMLGIIMFWIWSDGGIWKYSDTRQ

SEQ ID NO: 2249230 - protein, 19 aa, Cryptosporidium parvum
DLALFYYRLLQFDYKIARN

SEQ ID NO: 2249231 - protein, 23 aa, Cryptosporidium parvum
DLFIGILLITIFILFVRLFSTFI

SEQ ID NO: 2249232 - protein, 24 aa, Cryptosporidium parvum
DLIRGNNFCFLTLWKKIEELTQQK

SEQ ID NO: 2249233 - protein, 20 aa, Cryptosporidium parvum
DLLIRWFQLGIWFPFYRIHN

SEQ ID NO: 2249234 - protein, 24 aa, Cryptosporidium parvum
DLYGIILNWIITFYFKSIAVHLER

SEQ ID NO: 2249235 - protein, 19 aa, Cryptosporidium parvum
DPIIFPWINDWIFPEISQD

SEQ ID NO: 2249236 - protein, 21 aa, Cryptosporidium parvum
DPLMRFHCFIFGAIYLESAHA

SEQ ID NO: 2249237 - protein, 24 aa, Cryptosporidium parvum
DPNYLLTCFKYLLEKDWIYSIDSI

SEQ ID NO: 2249238 - protein, 18 aa, Cryptosporidium parvum
DQGWWLLALILNVVDLIS

SEQ ID NO: 2249239 - protein, 25 aa, Cryptosporidium parvum
DRIFPYLLTIIVFSASIELPPAPLN

SEQ ID NO: 2249240 - protein, 20 aa, Cryptosporidium parvum
DRLHFYYHYIAELRFNHYQP

SEQ ID NO: 2249241 - protein, 23 aa, Cryptosporidium parvum
DSEDFLLVLVIYSKLWLNGSIAI

SEQ ID NO: 2249242 - protein, 24 aa, Cryptosporidium parvum
DSIWHSLLPLKFSIGWLTCPSILI

SEQ ID NO: 2249243 - protein, 23 aa, Cryptosporidium parvum
DVWSIGVILFILLAGYPPFGGQT

SEQ ID NO: 2249244 - protein, 20 aa, Cryptosporidium parvum
DWVLAFFYRYMQWGFHVAGI

SEQ ID NO: 2249245 - protein, 22 aa, Cryptosporidium parvum
DYNLCFIIKILIYLISNVKDGL

SEQ ID NO: 2249246 - protein, 25 aa, Cryptosporidium parvum
DYSIIRLIHFIFKRALRKFPSDEKL

SEQ ID NO: 2249247 - protein, 23 aa, Cryptosporidium parvum
DYSILLFIMFLFRPFKSLKLFSN

SEQ ID NO: 2249248 - protein, 23 aa, Cryptosporidium parvum
DYYHWWFLCIDIVFSGISISQNS

SEQ ID NO: 2249249 - protein, 19 aa, Cryptosporidium parvum
EAFYKWIQVLYYKVLNNNI

SEQ ID NO: 2249250 - protein, 17 aa, Cryptosporidium parvum
ECENPEYLFPWGNDYLN

SEQ ID NO: 2249251 - protein, 23 aa, Cryptosporidium parvum
ECNSFVDLLLLKRIYRFSQITLD

SEQ ID NO: 2249252 - protein, 23 aa, Cryptosporidium parvum
EDLLLQLDPLVFVKTAIPPTASS

SEQ ID NO: 2249253 - protein, 24 aa, Cryptosporidium parvum
EDNSLLQVPPWANPLLLIAILISV

SEQ ID NO: 2249254 - protein, 30 aa, Cryptosporidium parvum
EEEMNISKFWLLIAIILIYITSLEKDVEEK

SEQ ID NO: 2249255 - protein, 18 aa, Cryptosporidium parvum
EEEVILMMLLFVLLYFTL

SEQ ID NO: 2249256 - protein, 28 aa, Cryptosporidium parvum
EEVGPALFWFITWGLILLCAAGAIVVLT

SEQ ID NO: 2249257 - protein, 19 aa, Cryptosporidium parvum
EGKKFALIYIILALIQLAV

SEQ ID NO: 2249258 - protein, 20 aa, Cryptosporidium parvum
EGLFNFLFLFQKLNGRPTEN

SEQ ID NO: 2249259 - protein, 25 aa, Cryptosporidium parvum
EGMSIIYLYIYWHIQFRAKNERKTP

SEQ ID NO: 2249260 - protein, 20 aa, Cryptosporidium parvum
EIFKKFISYILLFLNVSRTA

SEQ ID NO: 2249261 - protein, 25 aa, Cryptosporidium parvum
EIKPLLIRWIIFVIRLHKFSGLSDE

SEQ ID NO: 2249262 - protein, 21 aa, Cryptosporidium parvum
EILDRNVLFSRLFWLDIAYSE

SEQ ID NO: 2249263 - protein, 21 aa, Cryptosporidium parvum
EITPIPIEKMLDKYTRMIYDY

SEQ ID NO: 2249264 - protein, 19 aa, Cryptosporidium parvum
EIVFLKRPLHYLQNAYLAC

SEQ ID NO: 2249265 - protein, 23 aa, Cryptosporidium parvum
EKLLAFFLLIMAVLILILCLSAI

SEQ ID NO: 2249266 - protein, 18 aa, Cryptosporidium parvum
EKYYLPCQLLITSLGFKP

SEQ ID NO: 2249267 - protein, 19 aa, Cryptosporidium parvum
ELNKKLFPTFLRLSLSPVN

SEQ ID NO: 2249268 - protein, 20 aa, Cryptosporidium parvum
ELQPVLRLLKYWLHIRRLPV

SEQ ID NO: 2249269 - protein, 20 aa, Cryptosporidium parvum
ELRYSLIPYWYTLLAKYSFY

SEQ ID NO: 2249270 - protein, 21 aa, Cryptosporidium parvum
EMIRMFWAMWMHTGFIHIGFN

SEQ ID NO: 2249271 - protein, 20 aa, Cryptosporidium parvum
ENPEYLFPWGNDYLNSCLSF

SEQ ID NO: 2249272 - protein, 22 aa, Cryptosporidium parvum
ENQLILEWFIVLVTKFLISYLN

SEQ ID NO: 2249273 - protein, 20 aa, Cryptosporidium parvum
EPIWRIFLSQFTSLVVSLLL

SEQ ID NO: 2249274 - protein, 19 aa, Cryptosporidium parvum
EQFAKFFWHLLNSIREKYY

SEQ ID NO: 2249275 - protein, 20 aa, Cryptosporidium parvum
EQILKYYVTFSSDSFLYILM

SEQ ID NO: 2249276 - protein, 30 aa, Cryptosporidium parvum
ERDLNILYIVWKLLLYITLGVSIMLCIIQN

SEQ ID NO: 2249277 - protein, 18 aa, Cryptosporidium parvum
ESAKKFLKLLYIQKLWGS

SEQ ID NO: 2249278 - protein, 17 aa, Cryptosporidium parvum
ESKYLWFLPLRNIIRPN

SEQ ID NO: 2249279 - protein, 21 aa, Cryptosporidium parvum
ESTRFLFWIIRHFDLNYLSPT

SEQ ID NO: 2249280 - protein, 21 aa, Cryptosporidium parvum
ETFFFPLKTLLGISLSPIIGL

SEQ ID NO: 2249281 - protein, 22 aa, Cryptosporidium parvum
ETLFIMYMLLISLGWRVLRDSL

SEQ ID NO: 2249282 - protein, 18 aa, Cryptosporidium parvum
ETLYYKFYYYISSAIRPL

SEQ ID NO: 2249283 - protein, 23 aa, Cryptosporidium parvum
EVDKLMIRMIYGSLPSLGCEQLQ

SEQ ID NO: 2249284 - protein, 23 aa, Cryptosporidium parvum
EWKEIIIPLLPLILTYYYDSIDE

SEQ ID NO: 2249285 - protein, 19 aa, Cryptosporidium parvum
FAIFLVVFLNFLGLQTFFN

SEQ ID NO: 2249286 - protein, 21 aa, Cryptosporidium parvum
FCIYRPLIKTLWRPTLEALLL

SEQ ID NO: 2249287 - protein, 19 aa, Cryptosporidium parvum
FDSNFWLFLKRVCTRILEC

SEQ ID NO: 2249288 - protein, 24 aa, Cryptosporidium parvum
FEKLQPFIFILYNDVSWRIRSNVS

SEQ ID NO: 2249289 - protein, 17 aa, Cryptosporidium parvum
FFFFFFFLTEKKGIGYL

SEQ ID NO: 2249290 - protein, 24 aa, Cryptosporidium parvum
FFKNRYFWIISCLFTILFKTNNII

SEQ ID NO: 2249291 - protein, 20 aa, Cryptosporidium parvum
FFLWALFLFIINFDNSNETK

SEQ ID NO: 2249292 - protein, 17 aa, Cryptosporidium parvum
FFQYRYIFRIYSSLATN

SEQ ID NO: 2249293 - protein, 17 aa, Cryptosporidium parvum
FFVIIVHFISFSIGEQQ

SEQ ID NO: 2249294 - protein, 19 aa, Cryptosporidium parvum
FFWGMIIILFFLTSTLPMS

SEQ ID NO: 2249295 - protein, 22 aa, Cryptosporidium parvum
FFYFILFYLFHFIFEEKKTIET

SEQ ID NO: 2249296 - protein, 26 aa, Cryptosporidium parvum
FGFEILKVLFPWKWISWLPTISQLLL

SEQ ID NO: 2249297 - protein, 25 aa, Cryptosporidium parvum
FHIMGWIFCFFLDKTWFYFPYIGIC

SEQ ID NO: 2249298 - protein, 18 aa, Cryptosporidium parvum
FHSSLFPGLYLTGSRTSD

SEQ ID NO: 2249299 - protein, 22 aa, Cryptosporidium parvum
FIEPIVILFILVLNAFVGVWQE

SEQ ID NO: 2249300 - protein, 20 aa, Cryptosporidium parvum
FIFIIYFFALFFNNISQIKA

SEQ ID NO: 2249301 - protein, 19 aa, Cryptosporidium parvum
FIFLLFCILFALLAKNAAQ

SEQ ID NO: 2249302 - protein, 24 aa, Cryptosporidium parvum
FIFVYLFVILQIYIKFEFAGANSV

SEQ ID NO: 2249303 - protein, 20 aa, Cryptosporidium parvum
FIIKFRLPIDPHILSYYLKE

SEQ ID NO: 2249304 - protein, 19 aa, Cryptosporidium parvum
FIIKKYINWFLIPAADIFG

SEQ ID NO: 2249305 - protein, 18 aa, Cryptosporidium parvum
FIIRNYLNGTLALILTWL

SEQ ID NO: 2249306 - protein, 26 aa, Cryptosporidium parvum
FIIWILQWYFFVLLVILMAGRIYGES

SEQ ID NO: 2249307 - protein, 18 aa, Cryptosporidium parvum
FILLSYQLTHFLLFFIFI

SEQ ID NO: 2249308 - protein, 17 aa, Cryptosporidium parvum
FIMALIQFILLPCRIFV

SEQ ID NO: 2249309 - protein, 17 aa, Cryptosporidium parvum
FINSVVSGLYLMLWRFL

SEQ ID NO: 2249310 - protein, 17 aa, Cryptosporidium parvum
FIQIWRNLRLLYIEDNI

SEQ ID NO: 2249311 - protein, 26 aa, Cryptosporidium parvum
FISLWLECFFLCFFYRSTKSSFEQFF

SEQ ID NO: 2249312 - protein, 19 aa, Cryptosporidium parvum
FISRIIFAIWITTTLSLNF

SEQ ID NO: 2249313 - protein, 17 aa, Cryptosporidium parvum
FIVYWDLYGIILNWIIT

SEQ ID NO: 2249314 - protein, 26 aa, Cryptosporidium parvum
FKEPIGEPLLWNYIIQIVLALVHIHS

SEQ ID NO: 2249315 - protein, 19 aa, Cryptosporidium parvum
FKFPQLLYRRIISILPIMF

SEQ ID NO: 2249316 - protein, 19 aa, Cryptosporidium parvum
FKICLLLNFLIISGVLSIL

SEQ ID NO: 2249317 - protein, 23 aa, Cryptosporidium parvum
FKIFIWLCMYAHDPHIYNGVLAY

SEQ ID NO: 2249318 - protein, 32 aa, Cryptosporidium parvum
FKKISVIFLFIIVILLFLNFELLYASDAKESE

SEQ ID NO: 2249319 - protein, 22 aa, Cryptosporidium parvum
FLATFFLFGILNALQIHESVTS

SEQ ID NO: 2249320 - protein, 18 aa, Cryptosporidium parvum
FLCIVLLKLAQNGMLATD

SEQ ID NO: 2249321 - protein, 17 aa, Cryptosporidium parvum
FLCLSILLALVVLIDFI

SEQ ID NO: 2249322 - protein, 31 aa, Cryptosporidium parvum
FLGAYTIFGSLLTALLLLSIATFHGRQYAEK

SEQ ID NO: 2249323 - protein, 29 aa, Cryptosporidium parvum
FLILKLGHLLLFLLILKLLVYIYTKWTKT

SEQ ID NO: 2249324 - protein, 18 aa, Cryptosporidium parvum
FLINIIWAFLWALDSNYL

SEQ ID NO: 2249325 - protein, 24 aa, Cryptosporidium parvum
FLISFLVFIPFLIVILIKRLNNHS

SEQ ID NO: 2249326 - protein, 18 aa, Cryptosporidium parvum
FLKFFIQEIFLSLGILIG

SEQ ID NO: 2249327 - protein, 20 aa, Cryptosporidium parvum
FLLVGSGLYIHYFFRRNKRL

SEQ ID NO: 2249328 - protein, 17 aa, Cryptosporidium parvum
FLLVVTIIVYFNNLMFN

SEQ ID NO: 2249329 - protein, 24 aa, Cryptosporidium parvum
FLSQLNPLCLLLFALEITKLSGSH

SEQ ID NO: 2249330 - protein, 19 aa, Cryptosporidium parvum
FLVIFGFIQFLKFKGPKAA

SEQ ID NO: 2249331 - protein, 31 aa, Cryptosporidium parvum
FMLSKSFLFKILLLVLNLIPVTLLTLGVYLI

SEQ ID NO: 2249332 - protein, 19 aa, Cryptosporidium parvum
FPFIFYYLEFIESFNLPHI

SEQ ID NO: 2249333 - protein, 21 aa, Cryptosporidium parvum
FPIDPISYLPFAKNGELIDPI

SEQ ID NO: 2249334 - protein, 22 aa, Cryptosporidium parvum
FPSLLIWVRFFHQTILKNQETK

SEQ ID NO: 2249335 - protein, 25 aa, Cryptosporidium parvum
FPVLYPILTFFIFSLTVFYLVETGP

SEQ ID NO: 2249336 - protein, 27 aa, Cryptosporidium parvum
FPYFTPFFLIWIMLIIKPICLKFISSY

SEQ ID NO: 2249337 - protein, 21 aa, Cryptosporidium parvum
FQFFVLYIFIQFTSVLYLYSK

SEQ ID NO: 2249338 - protein, 20 aa, Cryptosporidium parvum
FRPQIMPIILKWSKGESFAS

SEQ ID NO: 2249339 - protein, 18 aa, Cryptosporidium parvum
FSFFFFHLWLVFNSMTTI

SEQ ID NO: 2249340 - protein, 23 aa, Cryptosporidium parvum
FSGIPLFMIFVQSNNLILSSRSY

SEQ ID NO: 2249341 - protein, 27 aa, Cryptosporidium parvum
FSIFTYSVFILFILLTILSLNTLFENK

SEQ ID NO: 2249342 - protein, 18 aa, Cryptosporidium parvum
FSILCLVFWYNLMKVTNV

SEQ ID NO: 2249343 - protein, 25 aa, Cryptosporidium parvum
FSIYIIFYIIFFYIQVVYSLYSNLS

SEQ ID NO: 2249344 - protein, 18 aa, Cryptosporidium parvum
FSLIYLYSYLFFDQNTGY

SEQ ID NO: 2249345 - protein, 20 aa, Cryptosporidium parvum
FSSPLFLCLSILLALVVLID

SEQ ID NO: 2249346 - protein, 18 aa, Cryptosporidium parvum
FTIWYLNGFLRACLFRKL

SEQ ID NO: 2249347 - protein, 22 aa, Cryptosporidium parvum
FTMNWIMFIVPFALAIIIGIPI

SEQ ID NO: 2249348 - protein, 36 aa, Cryptosporidium parvum; identical to SEQ ID NO: 2134564

SEQ ID NO: 2249349 - protein, 18 aa, Cryptosporidium parvum
FVLLAYFLNVFGVKDAMD

SEQ ID NO: 2249350 - protein, 17 aa, Cryptosporidium parvum
FVRFLIIGLYVGIATVG

SEQ ID NO: 2249351 - protein, 24 aa, Cryptosporidium parvum
FVSIYLMFLMRNFWDQVLLNTDKS

SEQ ID NO: 2249352 - protein, 23 aa, Cryptosporidium parvum
FVYFLDLNYIWVLRLGFDPFRSK

SEQ ID NO: 2249353 - protein, 17 aa, Cryptosporidium parvum
FWHLLNSIREKYYPEKS

SEQ ID NO: 2249354 - protein, 18 aa, Cryptosporidium parvum
FWYIFLLIPIYIIYKIGK

SEQ ID NO: 2249355 - protein, 17 aa, Cryptosporidium parvum
FYAFPKLYQAFVLIDLY

SEQ ID NO: 2249356 - protein, 27 aa, Cryptosporidium parvum
FYGHLYFIFALLLIGVSFYFALDRLNK

SEQ ID NO: 2249357 - protein, 18 aa, Cryptosporidium parvum
FYGIPIIKPLFWLNQKDF

SEQ ID NO: 2249358 - protein, 17 aa, Cryptosporidium parvum
FYGYSLLSLSAIVLFSG

SEQ ID NO: 2249359 - protein, 22 aa, Cryptosporidium parvum
FYLLLLFIFGFIVKIQAAEGGE

SEQ ID NO: 2249360 - protein, 17 aa, Cryptosporidium parvum
FYYRLLQFDYKIARNII

SEQ ID NO: 2249361 - protein, 22 aa, Cryptosporidium parvum
GDIVHLGYFFTDGHLLICIGDT

SEQ ID NO: 2249362 - protein, 25 aa, Cryptosporidium parvum
GFFPVKFFPILFFSITINNGLFSRN

SEQ ID NO: 2249363 - protein, 20 aa, Cryptosporidium parvum
GFWILSSMFFICFSLVYGTK

SEQ ID NO: 2249364 - protein, 22 aa, Cryptosporidium parvum
GGDYLLFFLYLSLNLEDLKEFY

SEQ ID NO: 2249365 - protein, 22 aa, Cryptosporidium parvum
GGLPCIVWLLLAIVHCSVNGNK

SEQ ID NO: 2249366 - protein, 24 aa, Cryptosporidium parvum
GGQKTLVALAFLFALHRADPAPMY

SEQ ID NO: 2249367 - protein, 22 aa, Cryptosporidium parvum
GGYYYYYNFYPPPPPMQPEPFP

SEQ ID NO: 2249368 - protein, 21 aa, Cryptosporidium parvum
GHLFFEIFPFLSGIENMILKQ

SEQ ID NO: 2249369 - protein, 20 aa, Cryptosporidium parvum
GIAFRIPFKWLPSASEKLSF

SEQ ID NO: 2249370 - protein, 25 aa, Cryptosporidium parvum
GIIFTILILSLLISAPILGLLAVAI

SEQ ID NO: 2249371 - protein, 22 aa, Cryptosporidium parvum
GIKSFYIGSFLRALWLTIGGII

SEQ ID NO: 2249372 - protein, 24 aa, Cryptosporidium parvum
GISIPLFLLYFGLALQKIPLTPNY

SEQ ID NO: 2249373 - protein, 24 aa, Cryptosporidium parvum
GIYFDPLWFIDLPFMYNNAWWDSY

SEQ ID NO: 2249374 - protein, 24 aa, Cryptosporidium parvum
GIYKEFLVILPWFLDTTIKMQKET

SEQ ID NO: 2249375 - protein, 23 aa, Cryptosporidium parvum
  misc_feature (21)..(21): Xaa can be any naturally occurring amino acid
GKFYLFYLFIYYYYFFFFTIXLG

SEQ ID NO: 2249376 - protein, 19 aa, Cryptosporidium parvum
GKLWLLWYVSFKQKDCQMR

SEQ ID NO: 2249377 - protein, 20 aa, Cryptosporidium parvum
GLGKLYWYLTILGLLSYSVI

SEQ ID NO: 2249378 - protein, 23 aa, Cryptosporidium parvum
GLIKLILVLNYKVAVPIPNLRKV

SEQ ID NO: 2249379 - protein, 21 aa, Cryptosporidium parvum
GLLFKYIVLFDLLIMFLILTI

SEQ ID NO: 2249380 - protein, 17 aa, Cryptosporidium parvum
GLYIYNGLILDFKILYK

SEQ ID NO: 2249381 - protein, 24 aa, Cryptosporidium parvum
GSKLFFELLFQLYNFLYTSVPPII

SEQ ID NO: 2249382 - protein, 25 aa, Cryptosporidium parvum
GSLILFIFLVYILLAIILAIIHFII

SEQ ID NO: 2249383 - protein, 25 aa, Cryptosporidium parvum
GSVRSQWDFLLQEMTWMSKDYYEER

SEQ ID NO: 2249384 - protein, 22 aa, Cryptosporidium parvum
GTAYRWLFVRLEIMGCIAVFTA

SEQ ID NO: 2249385 - protein, 22 aa, Cryptosporidium parvum
GTEFLLNILQWLSSMPFSNVPI

SEQ ID NO: 2249386 - protein, 26 aa, Cryptosporidium parvum
GVIEIPYLYFWIYPLSIHLDIDTIKE

SEQ ID NO: 2249387 - protein, 18 aa, Cryptosporidium parvum
GVYPLLPYFGLKADFSKK

SEQ ID NO: 2249388 - protein, 21 aa, Cryptosporidium parvum
HAIKIFPITFLPSIKILEIGL

SEQ ID NO: 2249389 - protein, 29 aa, Cryptosporidium parvum
HARIVLVIALFIIIFMLKQGMFGDWTRFG

SEQ ID NO: 2249390 - protein, 17 aa, Cryptosporidium parvum
HFDLYFPTKIDLLNISS

SEQ ID NO: 2249391 - protein, 18 aa, Cryptosporidium parvum
HFFLQVVILLSINGISLG

SEQ ID NO: 2249392 - protein, 26 aa, Cryptosporidium parvum
HFLVSSYTLPIIWLLKSMNLSDSISI

SEQ ID NO: 2249393 - protein, 24 aa, Cryptosporidium parvum
HIKNIFMFLPYKFLTKMKKSIDLI

SEQ ID NO: 2249394 - protein, 17 aa, Cryptosporidium parvum
HKSWYRFWEKKPKYVHK

SEQ ID NO: 2249395 - protein, 20 aa, Cryptosporidium parvum
HLFKIPMNYLPYIPKDTGES

SEQ ID NO: 2249396 - protein, 28 aa, Cryptosporidium parvum
HLKREWHRLWLVRSFLAFAWESYLEDLM

SEQ ID NO: 2249397 - protein, 20 aa, Cryptosporidium parvum
HLTLIIIYLISTLNLIKKKK

SEQ ID NO: 2249398 - protein, 21 aa, Cryptosporidium parvum
HLVFLMWIVLSLIFTLYSKWL

SEQ ID NO: 2249399 - protein, 22 aa, Cryptosporidium parvum
HNWRPIFITSLILSDKLWDDSC

SEQ ID NO: 2249400 - protein, 28 aa, Cryptosporidium parvum
HSCLIFGLVRLLWNIVFILYGATSLVNI

SEQ ID NO: 2249401 - protein, 23 aa, Cryptosporidium parvum
HSIIQMIIILPYIFEKLLLIIEL

SEQ ID NO: 2249402 - protein, 17 aa, Cryptosporidium parvum
HSRKLFYQVYRPSILIF

SEQ ID NO: 2249403 - protein, 24 aa, Cryptosporidium parvum
ICFDIFFYIFNWKSIPKMGMAIEM

SEQ ID NO: 2249404 - protein, 22 aa, Cryptosporidium parvum
ICFLWLTILVELFWFNKESRKN

SEQ ID NO: 2249405 - protein, 21 aa, Cryptosporidium parvum
IDKFLLLFEMLGIILSIPDSS

SEQ ID NO: 2249406 - protein, 21 aa, Cryptosporidium parvum
IDLIFQLLFGFSKHSFGASSV

SEQ ID NO: 2249407 - protein, 23 aa, Cryptosporidium parvum
IDPYSLWMLVDYRWGWPLVNSYF

SEQ ID NO: 2249408 - protein, 24 aa, Cryptosporidium parvum
IEEETLFLFLFFLSYLPSTNNSNS

SEQ ID NO: 2249409 - protein, 18 aa, Cryptosporidium parvum
IERFWLLNPFHFSINISN

SEQ ID NO: 2249410 - protein, 17 aa, Cryptosporidium parvum
IESLIICYLILSGNTDE

SEQ ID NO: 2249411 - protein, 17 aa, Cryptosporidium parvum
IESYLMIFLLILPPIMV

SEQ ID NO: 2249412 - protein, 20 aa, Cryptosporidium parvum
IEYYGIPKLFPIYIFTSKYT

SEQ ID NO: 2249413 - protein, 20 aa, Cryptosporidium parvum
IFESNLIAIPLFMPCNGRVA

SEQ ID NO: 2249414 - protein, 20 aa, Cryptosporidium parvum
IFFLFINFLFLFENVTDNFL

SEQ ID NO: 2249415 - protein, 20 aa, Cryptosporidium parvum
IFFLVFAISALNVNSQELIL

SEQ ID NO: 2249416 - protein, 18 aa, Cryptosporidium parvum
IFGLTFILILVFILSYYS

SEQ ID NO: 2249417 - protein, 20 aa, Cryptosporidium parvum
IFIGIFIWILIKSKFHRDKV

SEQ ID NO: 2249418 - protein, 21 aa, Cryptosporidium parvum
IFISFLVLYISYFYSFEESNE

SEQ ID NO: 2249419 - protein, 24 aa, Cryptosporidium parvum
IFLFLFALRFYFWVRGRFSFNVGS

SEQ ID NO: 2249420 - protein, 17 aa, Cryptosporidium parvum
IFLICIYTLNLDVAEGF

SEQ ID NO: 2249421 - protein, 18 aa, Cryptosporidium parvum
IFLIFLILVIYNFYRKRL

SEQ ID NO: 2249422 - protein, 21 aa, Cryptosporidium parvum
IFLMMLIFCSLIASSYVLYYG

SEQ ID NO: 2249423 - protein, 18 aa, Cryptosporidium parvum
IFNFCKWYNIISTSNISI

SEQ ID NO: 2249424 - protein, 17 aa, Cryptosporidium parvum
IFQDLIPLPLPWTHPQK

SEQ ID NO: 2249425 - protein, 20 aa, Cryptosporidium parvum
IFSWWYRFILSTPSRVFNTG

SEQ ID NO: 2249426 - protein, 18 aa, Cryptosporidium parvum
IGGWLPPPVAIPCPSHAP

SEQ ID NO: 2249427 - protein, 23 aa, Cryptosporidium parvum
IGNPWLVFVPLFKKYDVWTSYIL

SEQ ID NO: 2249428 - protein, 22 aa, Cryptosporidium parvum
IGRIYFLIFLLVCILKIGVTKS

SEQ ID NO: 2249429 - protein, 23 aa, Cryptosporidium parvum
IGYLNFLIFFKWLTPIEGYNKPS

SEQ ID NO: 2249430 - protein, 27 aa, Cryptosporidium parvum
IIAVIFGCVSKYYFFDKIVLTEENLPN

SEQ ID NO: 2249431 - protein, 20 aa, Cryptosporidium parvum
IIAVYYFKHPWFLKSWKFVN

SEQ ID NO: 2249432 - protein, 24 aa, Cryptosporidium parvum
IIFTYLYVFLFMFPILCLDAKREA

SEQ ID NO: 2249433 - protein, 22 aa, Cryptosporidium parvum
IIIIDFIFRRFGALTLFDNITN

SEQ ID NO: 2249434 - protein, 18 aa, Cryptosporidium parvum
IIIVFITLYIIFGIIFVI

SEQ ID NO: 2249435 - protein, 24 aa, Cryptosporidium parvum
IILDPYLLLRFIKLSFEELKAGIL

SEQ ID NO: 2249436 - protein, 18 aa, Cryptosporidium parvum
IILFVIPLAFIIYYRRQK

SEQ ID NO: 2249437 - protein, 19 aa, Cryptosporidium parvum
IILKRWIYYLFYSTLSWFS

SEQ ID NO: 2249438 - protein, 18 aa, Cryptosporidium parvum
IILLDYLVTWILINVSVF

SEQ ID NO: 2249439 - protein, 19 aa, Cryptosporidium parvum
IILLLLFINFLFLFENITD

SEQ ID NO: 2249440 - protein, 24 aa, Cryptosporidium parvum
IIMIWGFLLFILATILYCTFSVVY

SEQ ID NO: 2249441 - protein, 18 aa, Cryptosporidium parvum
IIPYIRRAPFGSLYPIHL

SEQ ID NO: 2249442 - protein, 19 aa, Cryptosporidium parvum
IISMIYLIKLFIFRVNNEI

SEQ ID NO: 2249443 - protein, 31 aa, Cryptosporidium parvum; identical to SEQ ID NO: 2134625

SEQ ID NO: 2249444 - protein, 24 aa, Cryptosporidium parvum
IISTLPFWPYLPKKFLFSIIDQVL

SEQ ID NO: 2249445 - protein, 24 aa, Cryptosporidium parvum
IITFIWKPLYYLLTFFTFNFILKA

SEQ ID NO: 2249446 - protein, 19 aa, Cryptosporidium parvum
IIYFISSLIFIYYGIDFEL

SEQ ID NO: 2249447 - protein, 18 aa, Cryptosporidium parvum
IIYFLRKLSKFTGVVWSC

SEQ ID NO: 2249448 - protein, 19 aa, Cryptosporidium parvum
IIYQLPLALIFYSFAIYLL

SEQ ID NO: 2249449 - protein, 24 aa, Cryptosporidium parvum
IKEKLKIMYLIRLYTLFLDFQGKF

SEQ ID NO: 2249450 - protein, 21 aa, Cryptosporidium parvum
IKLIRIIFSIFTYSVFILFIL

SEQ ID NO: 2249451 - protein, 27 aa, Cryptosporidium parvum
IKTYLFWALFIYFSISSSLLVYMMLKV

SEQ ID NO: 2249452 - protein, 17 aa, Cryptosporidium parvum
ILCTQNIYFWIISLERI

SEQ ID NO: 2249453 - protein, 24 aa, Cryptosporidium parvum
ILEYYLLVIILAKLFFIFSRKMLS

SEQ ID NO: 2249454 - protein, 20 aa, Cryptosporidium parvum
ILFLFVCCIIFRILGDHSEI

SEQ ID NO: 2249455 - protein, 19 aa, Cryptosporidium parvum
ILFTILLIKSLTILSPSSI

SEQ ID NO: 2249456 - protein, 18 aa, Cryptosporidium parvum
ILLGYYMIALGNRGLFRT

SEQ ID NO: 2249457 - protein, 28 aa, Cryptosporidium parvum
ILLLLLILLVFLLILFSGGITIGQMAPP

SEQ ID NO: 2249458 - protein, 19 aa, Cryptosporidium parvum
ILLQIYIVQKYVICSKLTH

SEQ ID NO: 2249459 - protein, 25 aa, Cryptosporidium parvum
ILLTSIIYILLWAIISYLKVFYIKN

SEQ ID NO: 2249460 - protein, 17 aa, Cryptosporidium parvum
ILLWLRFGEIPLEGKIS

SEQ ID NO: 2249461 - protein, 18 aa, Cryptosporidium parvum
ILNIFYKLIVVFSIIIHS

SEQ ID NO: 2249462 - protein, 18 aa, Cryptosporidium parvum
ILPPFIMDIYIYAKIRFQ

SEQ ID NO: 2249463 - protein, 17 aa, Cryptosporidium parvum
ILPPIRIYELWKGTPMD

SEQ ID NO: 2249464 - protein, 18 aa, Cryptosporidium parvum
ILPPLMALVPRAFRYRQG

SEQ ID NO: 2249465 - protein, 18 aa, Cryptosporidium parvum
ILPRFYRYLGLYYSLICI

SEQ ID NO: 2249466 - protein, 17 aa, Cryptosporidium parvum
ILRPIWILGVLFSCILN

SEQ ID NO: 2249467 - protein, 17 aa, Cryptosporidium parvum
ILTFFIWIVISQIYEEI

SEQ ID NO: 2249468 - protein, 18 aa, Cryptosporidium parvum
ILTIPIYFLLLRDQERAT

SEQ ID NO: 2249469 - protein, 19 aa, Cryptosporidium parvum
ILYFTYFVCIFLAILSVIA

SEQ ID NO: 2249470 - protein, 21 aa, Cryptosporidium parvum
INFHIIPWKGILRWIDSWEGV

SEQ ID NO: 2249471 - protein, 24 aa, Cryptosporidium parvum
INFNYIMLPSYYLWGNIYSILGQW

SEQ ID NO: 2249472 - protein, 24 aa, Cryptosporidium parvum
INKCPFLALLLLYISSHRRHLKER

SEQ ID NO: 2249473 - protein, 24 aa, Cryptosporidium parvum
INMIFNFLMIDLFFIRYFELKILN

SEQ ID NO: 2249474 - protein, 27 aa, Cryptosporidium parvum
INTIWAIFRVQFLVLLLFLNNLACENE

SEQ ID NO: 2249475 - protein, 18 aa, Cryptosporidium parvum
IPICIFLSLYKCKIKIIY

SEQ ID NO: 2249476 - protein, 25 aa, Cryptosporidium parvum
IPIGFLFLLFIYWNYLSYFINTCRT

SEQ ID NO: 2249477 - protein, 18 aa, Cryptosporidium parvum
IPVTLLTLGVYLIIAEIW

SEQ ID NO: 2249478 - protein, 18 aa, Cryptosporidium parvum
IPVWLYPYRILPMMFKDI

SEQ ID NO: 2249479 - protein, 24 aa, Cryptosporidium parvum
IQILPVLLMLFLAIMGNFMPTLFP

SEQ ID NO: 2249480 - protein, 24 aa, Cryptosporidium parvum
IQKYFYFLIIFLSSIFHLKVDQMY

SEQ ID NO: 2249481 - protein, 26 aa, Cryptosporidium parvum
IQLSNLMFNYWYLKILLIIIERIGMD

SEQ ID NO: 2249482 - protein, 17 aa, Cryptosporidium parvum
IRILFIVPIIFSLILSL

SEQ ID NO: 2249483 - protein, 25 aa, Cryptosporidium parvum
IRILNLFFILLLVIPFIYITTSGAC

SEQ ID NO: 2249484 - protein, 27 aa, Cryptosporidium parvum
IRISMRILLLFLFALIFSISSINGSNL

SEQ ID NO: 2249485 - protein, 18 aa, Cryptosporidium parvum
IRKLNILPPIRIYELWKG

SEQ ID NO: 2249486 - protein, 21 aa, Cryptosporidium parvum
IRLIFNIIIVFITLYIIFGII

SEQ ID NO: 2249487 - protein, 18 aa, Cryptosporidium parvum
ISIILFYIDIFQSFPYVN

SEQ ID NO: 2249488 - protein, 23 aa, Cryptosporidium parvum
ISLLILYFLIFLGNVKSSPTVTK

SEQ ID NO: 2249489 - protein, 18 aa, Cryptosporidium parvum
ISLLPYYLKISWYIYYLS

SEQ ID NO: 2249490 - protein, 20 aa, Cryptosporidium parvum
ISLWKTIFPWIWNNLEHQQR

SEQ ID NO: 2249491 - protein, 23 aa, Cryptosporidium parvum
ISTCIFIFFILYIVLNALSRNKE

SEQ ID NO: 2249492 - protein, 23 aa, Cryptosporidium parvum
ISYQFLFLIYRKILISKTKYLVI

SEQ ID NO: 2249493 - protein, 17 aa, Cryptosporidium parvum
ITINFHIIPWKGILRWI

SEQ ID NO: 2249494 - protein, 23 aa, Cryptosporidium parvum
ITLLPIIFFLIQSIHFHITQRSK

SEQ ID NO: 2249495 - protein, 22 aa, Cryptosporidium parvum
ITPQFLFFIPPIFYAFYCVAKK

SEQ ID NO: 2249496 - protein, 23 aa, Cryptosporidium parvum
ITSPPWWMVWQSQFYPRLSIEKN

SEQ ID NO: 2249497 - protein, 17 aa, Cryptosporidium parvum
IVFLYFILRIITSFTRL

SEQ ID NO: 2249498 - protein, 20 aa, Cryptosporidium parvum
IVHWIIIFLCILHMAIFLAI

SEQ ID NO: 2249499 - protein, 22 aa, Cryptosporidium parvum
IVLFLIIFFYISSFLCVSSDSK

SEQ ID NO: 2249500 - protein, 20 aa, Cryptosporidium parvum
IVLIGLIIFFITKSRSNNSQ

SEQ ID NO: 2249501 - protein, 21 aa, Cryptosporidium parvum
IVSLYIIFWTVLLPVFYGIYG

SEQ ID NO: 2249502 - protein, 21 aa, Cryptosporidium parvum
IVWTIFLGIIVLFFHLIYKYL

SEQ ID NO: 2249503 - protein, 21 aa, Cryptosporidium parvum
IVYAPFWFFYINSVGKILSRF

SEQ ID NO: 2249504 - protein, 22 aa, Cryptosporidium parvum
IWFEYFCLILWRLLPIFEQSIP

SEQ ID NO: 2249505 - protein, 30 aa, Cryptosporidium parvum
IYIPSAVRYIILLLLWTIFTKNVYSKSSEE

SEQ ID NO: 2249506 - protein, 19 aa, Cryptosporidium parvum
IYITYYQLFHPPLIIRTGK

SEQ ID NO: 2249507 - protein, 18 aa, Cryptosporidium parvum
IYIYRIYTDKYKRKIIKR

SEQ ID NO: 2249508 - protein, 28 aa, Cryptosporidium parvum
IYKFKWVLIYLILLIFSAYIQLNCVGCY

SEQ ID NO: 2249509 - protein, 17 aa, Cryptosporidium parvum
IYSLMWFVRLYFTVNMK

SEQ ID NO: 2249510 - protein, 21 aa, Cryptosporidium parvum
IYYTWFMFGFYWILSVRPNVE

SEQ ID NO: 2249511 - protein, 23 aa, Cryptosporidium parvum
KAGHWYFLIFTTLIASIVTIAIL

SEQ ID NO: 2249512 - protein, 28 aa, Cryptosporidium parvum
KANSFFFFSWIFMVILPLLISLTYRFGS

SEQ ID NO: 2249513 - protein, 22 aa, Cryptosporidium parvum
KASCILPKLPEAFLFLSKKEDQ

SEQ ID NO: 2249514 - protein, 25 aa, Cryptosporidium parvum
KATKYIFIYMIFALLLKKLEDNSHK

SEQ ID NO: 2249515 - protein, 23 aa, Cryptosporidium parvum
KCFIVFAMNIFLKPYKHLLTNSS

SEQ ID NO: 2249516 - protein, 32 aa, Cryptosporidium parvum
KCITTKLLLLFYKYIILLLRFISIFDLSDAKD

SEQ ID NO: 2249517 - protein, 23 aa, Cryptosporidium parvum
KDDSVYEIFKWIDSLALDKNNLI

SEQ ID NO: 2249518 - protein, 22 aa, Cryptosporidium parvum
KDKLIPFHIFLQTSIFMSTELE

SEQ ID NO: 2249519 - protein, 23 aa, Cryptosporidium parvum
KEGLHLYIFLGLAALGLVRSNLH

SEQ ID NO: 2249520 - protein, 20 aa, Cryptosporidium parvum
KELLLLLRKYIRTNGSCLQS

SEQ ID NO: 2249521 - protein, 24 aa, Cryptosporidium parvum
KEQGQVIFLLLFLSLKLITNHKHF

SEQ ID NO: 2249522 - protein, 27 aa, Cryptosporidium parvum
KERNILRYFYLKLFLFVYKLSIGLANK

SEQ ID NO: 2249523 - protein, 28 aa, Cryptosporidium parvum
KEYYLLFDFVIFLFYIINAYKSAVEKLD

SEQ ID NO: 2249524 - protein, 26 aa, Cryptosporidium parvum
KFCFLYILYFFTFYFSMVVTISLRSP

SEQ ID NO: 2249525 - protein, 20 aa, Cryptosporidium parvum
KFHLNICNLPRPAFSRPVLR

SEQ ID NO: 2249526 - protein, 18 aa, Cryptosporidium parvum
KFIVFINFISFLSIITKI

SEQ ID NO: 2249527 - protein, 23 aa, Cryptosporidium parvum
KFKHIYLCLIFIATFIGYIFCSE

SEQ ID NO: 2249528 - protein, 25 aa, Cryptosporidium parvum
KFLICIPVLAYLFFQVSKKYAPMLR

SEQ ID NO: 2249529 - protein, 18 aa, Cryptosporidium parvum
KFLKLLYIQKLWGSNVSK

SEQ ID NO: 2249530 - protein, 17 aa, Cryptosporidium parvum
KFWLKLRKEAIGWFIYT

SEQ ID NO: 2249531 - protein, 24 aa, Cryptosporidium parvum
KHEKMLFLMVLWIKHYLSNKVENK

SEQ ID NO: 2249532 - protein, 21 aa, Cryptosporidium parvum
KHFLLFLAYVFLFCAYSLILI

SEQ ID NO: 2249533 - protein, 22 aa, Cryptosporidium parvum
KHIFYFLSFFFFILSIFLFERS

SEQ ID NO: 2249534 - protein, 18 aa, Cryptosporidium parvum
KHRMLFVSFLVLGLALVT

SEQ ID NO: 2249535 - protein, 26 aa, Cryptosporidium parvum
KIFSLIFFFFNILNLLNGEEIDNKSL

SEQ ID NO: 2249536 - protein, 18 aa, Cryptosporidium parvum
KIGQFFYGKRLYSLLSGN

SEQ ID NO: 2249537 - protein, 20 aa, Cryptosporidium parvum
KIIVIIIWLGFLGVSIYGFT

SEQ ID NO: 2249538 - protein, 21 aa, Cryptosporidium parvum
KILRLISLIFSLFILGFIITS

SEQ ID NO: 2249539 - protein, 19 aa, Cryptosporidium parvum
KISFIIIIWCPLIIINYSN

SEQ ID NO: 2249540 - protein, 17 aa, Cryptosporidium parvum
KITFLKKLFSRISNDDV

SEQ ID NO: 2249541 - protein, 26 aa, Cryptosporidium parvum
KKFSSILRFLVILAAFISLLVLIKLP

SEQ ID NO: 2249542 - protein, 25 aa, Cryptosporidium parvum
KKFTLFYFFFRWITYYVEMEIAANY

SEQ ID NO: 2249543 - protein, 21 aa, Cryptosporidium parvum
KKILKFNIYIYRIYTDKYKRK

SEQ ID NO: 2249544 - protein, 27 aa, Cryptosporidium parvum
KKLTILIHLFIIYFLVIYNNEWNSLDS

SEQ ID NO: 2249545 - protein, 31 aa, Cryptosporidium parvum
KKSHWGVFWYILPIILILFSSGAGFAYYYYL

SEQ ID NO: 2249546 - protein, 25 aa, Cryptosporidium parvum
KKSSLFIILLMLIMAIFQVCNYSGF

SEQ ID NO: 2249547 - protein, 27 aa, Cryptosporidium parvum
KLGLNIQLFWFLRLNSLKFDFVSDNNS

SEQ ID NO: 2249548 - protein, 33 aa, Cryptosporidium parvum; identical to SEQ ID NO: 2134689

SEQ ID NO: 2249549 - protein, 23 aa, Cryptosporidium parvum
KLKNMFYIFILSASIYFFKKEIK

SEQ ID NO: 2249550 - protein, 22 aa, Cryptosporidium parvum
KLLFFLFFQVSINLIIMSLICS

SEQ ID NO: 2249551 - protein, 17 aa, Cryptosporidium parvum
KLNFCTFEFMLSPTLIG

SEQ ID NO: 2249552 - protein, 28 aa, Cryptosporidium parvum
KLNVRPILFLWIFFLISMVYTFSIFLDE

SEQ ID NO: 2249553 - protein, 25 aa, Cryptosporidium parvum
KLQSYILWLLLCLNLNMGTVRPFVN

SEQ ID NO: 2249554 - protein, 22 aa, Cryptosporidium parvum
KLTLFKLLIFVSLLVAIYVLIT

SEQ ID NO: 2249555 - protein, 25 aa, Cryptosporidium parvum
KLTSKIFFFFFLNIYFQIYNLEHIL

SEQ ID NO: 2249556 - protein, 25 aa, Cryptosporidium parvum
KLTYQLLIMILITGSIQWAFWNTAL

SEQ ID NO: 2249557 - protein, 33 aa, Cryptosporidium parvum
KMGFGPWFSFFYYWKFIPLTFYYNIIKSYSDLS

SEQ ID NO: 2249558 - protein, 22 aa, Cryptosporidium parvum
KMKFVDFPLLFLRRFLPKKRSS

SEQ ID NO: 2249559 - protein, 23 aa, Cryptosporidium parvum
KNEKEWFLYWSSIFGKLCGKEPI

SEQ ID NO: 2249560 - protein, 20 aa, Cryptosporidium parvum
KNMTIINYLLLLLKERKWLK

SEQ ID NO: 2249561 - protein, 18 aa, Cryptosporidium parvum
KNRLFYWLRILLPETRTN

SEQ ID NO: 2249562 - protein, 24 aa, Cryptosporidium parvum
KNVDIFWFMAYTMITLCVFAGIVV

SEQ ID NO: 2249563 - protein, 20 aa, Cryptosporidium parvum
KPFIPLFPSYTLIGLFGDSI

SEQ ID NO: 2249564 - protein, 33 aa, Cryptosporidium parvum
KPKSFLEKVLFWSIIIFCIVFTVVLLLIWFATK

SEQ ID NO: 2249565 - protein, 17 aa, Cryptosporidium parvum
KPNKKFISFLTLLIFII

SEQ ID NO: 2249566 - protein, 25 aa, Cryptosporidium parvum
KQFWLIFWLLFLFSQYVHFIASWWK

SEQ ID NO: 2249567 - protein, 27 aa, Cryptosporidium parvum
KQGFYMKIFSGLKLLFWNLDKIGDIFG

SEQ ID NO: 2249568 - protein, 24 aa, Cryptosporidium parvum
KRKYMYWIWRRWRYLLSAKERMPI

SEQ ID NO: 2249569 - protein, 26 aa, Cryptosporidium parvum
KRLCWNLLKILYLFTLLLFILSDSEF

SEQ ID NO: 2249570 - protein, 25 aa, Cryptosporidium parvum
KRMFRFLFIIKIFPILILKVNCQIQ

SEQ ID NO: 2249571 - protein, 19 aa, Cryptosporidium parvum
KRWKMFLDILPFSDILPLL

SEQ ID NO: 2249572 - protein, 23 aa, Cryptosporidium parvum
KSELLCRLFFLYRGLRLTEERNE

SEQ ID NO: 2249573 - protein, 19 aa, Cryptosporidium parvum
KSFTYLLLLALVGIIIIDF

SEQ ID NO: 2249574 - protein, 25 aa, Cryptosporidium parvum
KSGFIFFQWYFWYCLESRRYPSKDF

SEQ ID NO: 2249575 - protein, 27 aa, Cryptosporidium parvum
KSNLLQFLWIRFYGFRVIFRKFNDLLL

SEQ ID NO: 2249576 - protein, 20 aa, Cryptosporidium parvum
KTFFCWVWKSLYQGTVIMLG

SEQ ID NO: 2249577 - protein, 30 aa, Cryptosporidium parvum
KTQKKMLWIILCIFILILVVLLPIIIGFTI

SEQ ID NO: 2249578 - protein, 24 aa, Cryptosporidium parvum
KVEFLNYYLWFIKVKFIIQNENVE

SEQ ID NO: 2249579 - protein, 27 aa, Cryptosporidium parvum
KVFTFFNFVWKIILFFIIWKSRNDFIK

SEQ ID NO: 2249580 - protein, 17 aa, Cryptosporidium parvum
KVLPLWAFLFMKVVEQS

SEQ ID NO: 2249581 - protein, 22 aa, Cryptosporidium parvum
KVNPWFAVILCISLLNGISIWD

SEQ ID NO: 2249582 - protein, 22 aa, Cryptosporidium parvum
KYEFGWPLLFNKSWFYGDLFCN

SEQ ID NO: 2249583 - protein, 20 aa, Cryptosporidium parvum
KYICIFSFKVIMFRFFLLIS

SEQ ID NO: 2249584 - protein, 21 aa, Cryptosporidium parvum
KYKFIINLSLLWFLAFSQEPE

SEQ ID NO: 2249585 - protein, 19 aa, Cryptosporidium parvum
KYMGIFLQSHFRFLYSAIK

SEQ ID NO: 2249586 - protein, 26 aa, Cryptosporidium parvum
KYMQYFFLIIILLPSTYFLPQIKGII

SEQ ID NO: 2249587 - protein, 24 aa, Cryptosporidium parvum
KYNDWLVFFLFLNKFFRIKEKNTK

SEQ ID NO: 2249588 - protein, 17 aa, Cryptosporidium parvum
KYSILLSRVLWLLPHDS

SEQ ID NO: 2249589 - protein, 22 aa, Cryptosporidium parvum
LAKLIYRIFEPNSGKIRIFGKE

SEQ ID NO: 2249590 - protein, 18 aa, Cryptosporidium parvum
LALILFFLTKISQIYCDI

SEQ ID NO: 2249591 - protein, 18 aa, Cryptosporidium parvum
LAPWTLPIFLIMMGLILF

SEQ ID NO: 2249592 - protein, 18 aa, Cryptosporidium parvum
LAVFLLNIIFFDANIGLF

SEQ ID NO: 2249593 - protein, 20 aa, Cryptosporidium parvum
LCFLSLIILFVIPLAFIIYY

SEQ ID NO: 2249594 - protein, 24 aa, Cryptosporidium parvum
LCIISICFFLYPSWSLYVHIKING

SEQ ID NO: 2249595 - protein, 22 aa, Cryptosporidium parvum
LCKKYLYFRKYGPIKLLNTSAM

SEQ ID NO: 2249596 - protein, 17 aa, Cryptosporidium parvum
LCKVWLLSPFNALDVLL

SEQ ID NO: 2249597 - protein, 17 aa, Cryptosporidium parvum
LCLLLFSTFSFLILIPA

SEQ ID NO: 2249598 - protein, 17 aa, Cryptosporidium parvum
LCWVVFPILLEYELSGD

SEQ ID NO: 2249599 - protein, 21 aa, Cryptosporidium parvum
LDCFYFIFIVFIFETISDTGF

SEQ ID NO: 2249600 - protein, 25 aa, Cryptosporidium parvum
LDILSYFFLFWFTGFHPIFIFINAI

SEQ ID NO: 2249601 - protein, 17 aa, Cryptosporidium parvum
LEEEGLRIFWKGPIHTV

SEQ ID NO: 2249602 - protein, 19 aa, Cryptosporidium parvum
LEGIIFPGWLIPGWSKLSK

SEQ ID NO: 2249603 - protein, 23 aa, Cryptosporidium parvum
LEKFCKLFFPALWLSCNDLKPDV

SEQ ID NO: 2249604 - protein, 17 aa, Cryptosporidium parvum
LEKNWIIDFLLLKRLLY

SEQ ID NO: 2249605 - protein, 24 aa, Cryptosporidium parvum
LEMILYLVLLLLHQFILLFGEKVL

SEQ ID NO: 2249606 - protein, 21 aa, Cryptosporidium parvum
LERTFVKFFIKFLIFLQQKKD

SEQ ID NO: 2249607 - protein, 31 aa, Cryptosporidium parvum
LFAPLILGMLILAILFWFRRYKWKKNLEDDQ

SEQ ID NO: 2249608 - protein, 21 aa, Cryptosporidium parvum
LFCGIWLLFHSWSISLLKGVQ

SEQ ID NO: 2249609 - protein, 17 aa, Cryptosporidium parvum
LFDLYEEYFFLSNLKLL

SEQ ID NO: 2249610 - protein, 31 aa, Cryptosporidium parvum
LFIQKWVIILIGIIFIFLPLYFRIRTRRRKA

SEQ ID NO: 2249611 - protein, 23 aa, Cryptosporidium parvum
LFMLGFLRYFRVLNPVPILTIIL

SEQ ID NO: 2249612 - protein, 19 aa, Cryptosporidium parvum
LFPTFLRLSLSPVNFDISE

SEQ ID NO: 2249613 - protein, 18 aa, Cryptosporidium parvum
LFQYIYVTILLGISLIFV

SEQ ID NO: 2249614 - protein, 17 aa, Cryptosporidium parvum
LFVHIFLNSINATYGQI

SEQ ID NO: 2249615 - protein, 19 aa, Cryptosporidium parvum
LFYQVYRPSILIFGIFLYL

SEQ ID NO: 2249616 - protein, 18 aa, Cryptosporidium parvum
LGIFFKMNFLLGQSLILV

SEQ ID NO: 2249617 - protein, 25 aa, Cryptosporidium parvum
LGKHDFVFKLFYKKGYYYLDSSFTS

SEQ ID NO: 2249618 - protein, 23 aa, Cryptosporidium parvum
LGWYWYHLGIYNLILIKIIYLNL

SEQ ID NO: 2249619 - protein, 18 aa, Cryptosporidium parvum
LHFTAFIYYWQLLSMISS

SEQ ID NO: 2249620 - protein, 23 aa, Cryptosporidium parvum
LHIFIFVGIAIIILLISSIILIN

SEQ ID NO: 2249621 - protein, 19 aa, Cryptosporidium parvum
LHSAFWISLYRLSFIPSKN

SEQ ID NO: 2249622 - protein, 17 aa, Cryptosporidium parvum
LHTCYIPIYLYILGCFS

SEQ ID NO: 2249623 - protein, 17 aa, Cryptosporidium parvum
LICFLILSFLEALKSIQ

SEQ ID NO: 2249624 - protein, 20 aa, Cryptosporidium parvum
LIDFLVPYFLLESAKICIEY

SEQ ID NO: 2249625 - protein, 19 aa, Cryptosporidium parvum
LIIALLFTTLFISQIILFK

SEQ ID NO: 2249626 - protein, 23 aa, Cryptosporidium parvum
LIIFNYLFIIKLLKKIIQIESTS

SEQ ID NO: 2249627 - protein, 19 aa, Cryptosporidium parvum
LIIIIDFMLEYLLLLLENG

SEQ ID NO: 2249628 - protein, 24 aa, Cryptosporidium parvum
LIIITFLLLLPIVQLLFTYSQTLT

SEQ ID NO: 2249629 - protein, 19 aa, Cryptosporidium parvum
LIIKNIIFFIYWKIIKQIS

SEQ ID NO: 2249630 - protein, 18 aa, Cryptosporidium parvum
LIINCLFALGYKKIALVK

SEQ ID NO: 2249631 - protein, 17 aa, Cryptosporidium parvum
LIKTLWRPTLEALLLRL

SEQ ID NO: 2249632 - protein, 19 aa, Cryptosporidium parvum
LILIFALILYLIISIIDIG

SEQ ID NO: 2249633 - protein, 18 aa, Cryptosporidium parvum
LILVPILTFLIFFNFVDS

SEQ ID NO: 2249634 - protein, 28 aa, Cryptosporidium parvum
LIMNIKIFFFFILKLYQFIRFPLNVLNL

SEQ ID NO: 2249635 - protein, 30 aa, Cryptosporidium parvum
LIPSFKLFLFIFFLFRFRKSIIKSLRDEVK

SEQ ID NO: 2249636 - protein, 20 aa, Cryptosporidium parvum
LIQFFYRLLSKIFTKNFFFL

SEQ ID NO: 2249637 - protein, 20 aa, Cryptosporidium parvum
LIQFILLPCRIFVASLLMYR

SEQ ID NO: 2249638 - protein, 19 aa, Cryptosporidium parvum
LIRIIHFLSVLTFFGLPNT

SEQ ID NO: 2249639 - protein, 18 aa, Cryptosporidium parvum
LIVELILIDILFSKFLKK

SEQ ID NO: 2249640 - protein, 17 aa, Cryptosporidium parvum
LIVYFRRAMNLLTVSEA

SEQ ID NO: 2249641 - protein, 21 aa, Cryptosporidium parvum
LIWNVLFQFILLRIKLPVSTI

SEQ ID NO: 2249642 - protein, 26 aa, Cryptosporidium parvum
LIWRWRRNLRYYWIKLLVLFEEIGMF

SEQ ID NO: 2249643 - protein, 18 aa, Cryptosporidium parvum
LIYIYIIVFFGVFHSFTK

SEQ ID NO: 2249644 - protein, 22 aa, Cryptosporidium parvum
LKCIRIFLLRLKADLMWNYTPN

SEQ ID NO: 2249645 - protein, 28 aa, Cryptosporidium parvum
LKEWFIYLFNALYDFIIYQLPLALIFYS

SEQ ID NO: 2249646 - protein, 24 aa, Cryptosporidium parvum
LKNNLTQQFPFNGSLLLNGKVANI

SEQ ID NO: 2249647 - protein, 25 aa, Cryptosporidium parvum
LKYKILCHLWIFRFIMSIAAISFPG

SEQ ID NO: 2249648 - protein, 19 aa, Cryptosporidium parvum
LKYVIGMLLGVFFGIWILS

SEQ ID NO: 2249649 - protein, 24 aa, Cryptosporidium parvum
LLESKAWWICGIPLSVYSLLAEIS

SEQ ID NO: 2249650 - protein, 17 aa, Cryptosporidium parvum
LLFIRPLRNLTSKEVML

SEQ ID NO: 2249651 - protein, 17 aa, Cryptosporidium parvum
LLFPIPPSKVYKFREKG

SEQ ID NO: 2249652 - protein, 18 aa, Cryptosporidium parvum
LLHQLFSQFFWALHDDPE

SEQ ID NO: 2249653 - protein, 22 aa, Cryptosporidium parvum
LLIFPIRFLLTWILLKEHVGSV

SEQ ID NO: 2249654 - protein, 17 aa, Cryptosporidium parvum
LLIVIMLSTFFISYKIN

SEQ ID NO: 2249655 - protein, 17 aa, Cryptosporidium parvum
LLLALVGIIIIDFIFRR

SEQ ID NO: 2249656 - protein, 24 aa, Cryptosporidium parvum
LLLKERKWLKFINNLIIIIDKLLG

SEQ ID NO: 2249657 - protein, 24 aa, Cryptosporidium parvum
LLLSPLYYIVFSKANMLSPRGECR

SEQ ID NO: 2249658 - protein, 17 aa, Cryptosporidium parvum
LLMLFKSWIPFLENEFN

SEQ ID NO: 2249659 - protein, 18 aa, Cryptosporidium parvum
LLNLVYISSIFIVCLSLI

SEQ ID NO: 2249660 - protein, 30 aa, Cryptosporidium parvum; identical to SEQ ID NO: 2134749

SEQ ID NO: 2249661 - protein, 18 aa, Cryptosporidium parvum
LLPRVIFIFVIQCLSLII

SEQ ID NO: 2249662 - protein, 24 aa, Cryptosporidium parvum
LLSKALYILFLLKLVMLIGFGSYY

SEQ ID NO: 2249663 - protein, 17 aa, Cryptosporidium parvum
LLVLFDLGIERFLGSSA

SEQ ID NO: 2249664 - protein, 17 aa, Cryptosporidium parvum
LMLWRFLEQQFESVLSV

SEQ ID NO: 2249665 - protein, 19 aa, Cryptosporidium parvum
LMVLNFFLTAFKGLAMLFR

SEQ ID NO: 2249666 - protein, 22 aa, Cryptosporidium parvum
LNCLYLLLRLLILLISDVVKLS

SEQ ID NO: 2249667 - protein, 23 aa, Cryptosporidium parvum
LNDPQLLFLLLKLLLNSNGINDN

SEQ ID NO: 2249668 - protein, 31 aa, Cryptosporidium parvum
LNFINRLHILLWPHLIHFIYELLPVAITIRL

SEQ ID NO: 2249669 - protein, 25 aa, Cryptosporidium parvum
LNHIMLWFGLIIFWAITQIYGKSPV

SEQ ID NO: 2249670 - protein, 22 aa, Cryptosporidium parvum
LNICYWIQFIGWLCSSKGIYLS

SEQ ID NO: 2249671 - protein, 17 aa, Cryptosporidium parvum
LNTPVKLPLLFGSILMF

SEQ ID NO: 2249672 - protein, 18 aa, Cryptosporidium parvum
LPFLCFPLSIFIMNNVIK

SEQ ID NO: 2249673 - protein, 19 aa, Cryptosporidium parvum
LPIFLIMMGLILFKIFLPM

SEQ ID NO: 2249674 - protein, 18 aa, Cryptosporidium parvum
LPIVWLFLSIIVALIIFK

SEQ ID NO: 2249675 - protein, 19 aa, Cryptosporidium parvum
LPKYKLLLTFLLILGSSIV

SEQ ID NO: 2249676 - protein, 29 aa, Cryptosporidium parvum
LPVVLIIWDNFLLLGLPLLFQAGLSLLKL

SEQ ID NO: 2249677 - protein, 17 aa, Cryptosporidium parvum
LQKISLIFYLFNKTREL

SEQ ID NO: 2249678 - protein, 36 aa, Cryptosporidium parvum
LQSIIKYLFFFIQIISLIYLFTILFLISEYDYIWFL

SEQ ID NO: 2249679 - protein, 27 aa, Cryptosporidium parvum
LREKKLLWTFRILSGILLLFYFVIGWL

SEQ ID NO: 2249680 - protein, 20 aa, Cryptosporidium parvum
LRIYKPLIKVFWFQCLMVLL

SEQ ID NO: 2249681 - protein, 17 aa, Cryptosporidium parvum
LRLYLMHIPSILPSIYT

SEQ ID NO: 2249682 - protein, 22 aa, Cryptosporidium parvum
LRSIYILVLYQLILFNILNSSS

SEQ ID NO: 2249683 - protein, 18 aa, Cryptosporidium parvum
LRYFLLNYIVIILGMTML

SEQ ID NO: 2249684 - protein, 27 aa, Cryptosporidium parvum
LSGILLLFYFVIGWLGTFYPPLYWPNP

SEQ ID NO: 2249685 - protein, 22 aa, Cryptosporidium parvum
LSIFFFDLVAYIFLILSAVLFD

SEQ ID NO: 2249686 - protein, 20 aa, Cryptosporidium parvum
LSILYGLCLGLLFLGKREAC

SEQ ID NO: 2249687 - protein, 20 aa, Cryptosporidium parvum
LSIPLLNYVFFNIKSLFINK

SEQ ID NO: 2249688 - protein, 24 aa, Cryptosporidium parvum
LSKKDYVWIACSFLSFLLVNYYIT

SEQ ID NO: 2249689 - protein, 17 aa, Cryptosporidium parvum
LSYWLIPSEYLLYLIFR

SEQ ID NO: 2249690 - protein, 18 aa, Cryptosporidium parvum
LTIIFLIFIYKVFGYVER

SEQ ID NO: 2249691 - protein, 26 aa, Cryptosporidium parvum
LTKRLLLIPIPLLIQLLQAIFMFLTA

SEQ ID NO: 2249692 - protein, 26 aa, Cryptosporidium parvum
LTLLAISMFLLWFLLGSLINSDNILP

SEQ ID NO: 2249693 - protein, 19 aa, Cryptosporidium parvum
LTMPIIILLDRLASLWFGS

SEQ ID NO: 2249694 - protein, 17 aa, Cryptosporidium parvum
LVALLICFLLCNTVLTS

SEQ ID NO: 2249695 - protein, 18 aa, Cryptosporidium parvum
LVCQLVFLLLLFSRVMSI

SEQ ID NO: 2249696 - protein, 19 aa, Cryptosporidium parvum
LVLFILCWVVFPILLEYEL

SEQ ID NO: 2249697 - protein, 23 aa, Cryptosporidium parvum
LVMKRIFFCPTFILQYLMLSTTF

SEQ ID NO: 2249698 - protein, 19 aa, Cryptosporidium parvum
LVSSFFFVKACFLFVSAIG

SEQ ID NO: 2249699 - protein, 21 aa, Cryptosporidium parvum
LWFISYLFGRQFLNPSLFKLK

SEQ ID NO: 2249700 - protein, 19 aa, Cryptosporidium parvum
LYEAEGLVFWLFRVHNLVT

SEQ ID NO: 2249701 - protein, 27 aa, Cryptosporidium parvum
LYIILKFFILFIFFVYLKTRHDLIKYD

SEQ ID NO: 2249702 - protein, 18 aa, Cryptosporidium parvum
LYLLGITKPFFSLKIFGI

SEQ ID NO: 2249703 - protein, 18 aa, Cryptosporidium parvum
LYRCYMKFFRGILRYFLI

SEQ ID NO: 2249704 - protein, 18 aa, Cryptosporidium parvum
LYRRAYRLGILGFLLVLE

SEQ ID NO: 2249705 - protein, 18 aa, Cryptosporidium parvum
LYYYIIFNSWNTLSLLVE

SEQ ID NO: 2249706 - protein, 17 aa, Cryptosporidium parvum
MCNFTFRLFACLFFIVV

SEQ ID NO: 2249707 - protein, 19 aa, Cryptosporidium parvum
MDTFITPWILLYREPIDNF

SEQ ID NO: 2249708 - protein, 24 aa, Cryptosporidium parvum
MEDISLILSLFVLAVDHLPAFLNR

SEQ ID NO: 2249709 - protein, 26 aa, Cryptosporidium parvum
MELTPLFLLKISIFCWYFFEKLERWL

SEQ ID NO: 2249710 - protein, 18 aa, Cryptosporidium parvum
MERVLFLWAIRNPASGYV

SEQ ID NO: 2249711 - protein, 18 aa, Cryptosporidium parvum
MFAWLRLRLDFLLPVVLT

SEQ ID NO: 2249712 - protein, 18 aa, Cryptosporidium parvum
MIHRFLISQSTWSSIGKL

SEQ ID NO: 2249713 - protein, 17 aa, Cryptosporidium parvum
MIIILFFLTSTLPMSII

SEQ ID NO: 2249714 - protein, 19 aa, Cryptosporidium parvum
MIVRYLLYSLIFTIITFIT

SEQ ID NO: 2249715 - protein, 26 aa, Cryptosporidium parvum
MLCGILSICLLIIIVLLVVLGIRKNK

SEQ ID NO: 2249716 - protein, 19 aa, Cryptosporidium parvum
MLESLYWFFNFYSFTETYQ

SEQ ID NO: 2249717 - protein, 18 aa, Cryptosporidium parvum
MLFFRKIIGIFFLINLII

SEQ ID NO: 2249718 - protein, 24 aa, Cryptosporidium parvum
MLPYKLRFFIGFSSISSLFGSFGQ

SEQ ID NO: 2249719 - protein, 28 aa, Cryptosporidium parvum
MLVKWGLVVLIFQLFFSLLVKAGDLDLP

SEQ ID NO: 2249720 - protein, 18 aa, Cryptosporidium parvum
MNIPWMIFVLYLFIRHVK

SEQ ID NO: 2249721 - protein, 22 aa, Cryptosporidium parvum
MNKLLSFLLFLFDKGLKNHEIC

SEQ ID NO: 2249722 - protein, 17 aa, Cryptosporidium parvum
MPIILKWSKGESFASIL

SEQ ID NO: 2249723 - protein, 23 aa, Cryptosporidium parvum
MPLYKRVFPKWFPITWFEDNNIR

SEQ ID NO: 2249724 - protein, 20 aa, Cryptosporidium parvum
MRLDFFDMLFKELMPSLAYH

SEQ ID NO: 2249725 - protein, 20 aa, Cryptosporidium parvum
MSHIAMILLLFNINLMEAFK

SEQ ID NO: 2249726 - protein, 18 aa, Cryptosporidium parvum
MSTKTFFCWVWKSLYQGT

SEQ ID NO: 2249727 - protein, 30 aa, Cryptosporidium parvum
MVFVTHFCLFLWKIIKPFIILSIFILISFI

SEQ ID NO: 2249728 - protein, 24 aa, Cryptosporidium parvum
MWLRRPRWFVYEIIPLVILFTKIF

SEQ ID NO: 2249729 - protein, 18 aa, Cryptosporidium parvum
MYFLSILVLFSWISIVIG

SEQ ID NO: 2249730 - protein, 23 aa, Cryptosporidium parvum
MYQDTFLFLMFLIGDIPLLMNFL

SEQ ID NO: 2249731 - protein, 25 aa, Cryptosporidium parvum
NAVINFLIFYLINGTLIYIFTRKMN

SEQ ID NO: 2249732 - protein, 17 aa, Cryptosporidium parvum
NDYLFYVNVLIKTLLKS

SEQ ID NO: 2249733 - protein, 19 aa, Cryptosporidium parvum
NEILLFPLIIPCPKLHLVC

SEQ ID NO: 2249734 - protein, 24 aa, Cryptosporidium parvum
NEKYIVYLIFWVVVKFFESIKIVE

SEQ ID NO: 2249735 - protein, 20 aa, Cryptosporidium parvum
NFFNFFYLIVALFQLIPELR

SEQ ID NO: 2249736 - protein, 24 aa, Cryptosporidium parvum
NFGKIWLWLVKLLNKNSPHRLFVF

SEQ ID NO: 2249737 - protein, 23 aa, Cryptosporidium parvum
NFIFFNFLLYLASIGPQLFISFI

SEQ ID NO: 2249738 - protein, 17 aa, Cryptosporidium parvum
NFLFIWSCVYIALVLLF

SEQ ID NO: 2249739 - protein, 20 aa, Cryptosporidium parvum
NFTPFILSNLFIFGLIIYSV

SEQ ID NO: 2249740 - protein, 20 aa, Cryptosporidium parvum
NFYLVLLYFHFVLESKFSLL

SEQ ID NO: 2249741 - protein, 22 aa, Cryptosporidium parvum
NGMQIYFHLINQIKLNYFQHKH

SEQ ID NO: 2249742 - protein, 26 aa, Cryptosporidium parvum
NGTLALILTWLIVLIVMKFSKKLQHY

SEQ ID NO: 2249743 - protein, 36 aa, Cryptosporidium parvum
NGTQVLTLMFFISVIIFGLFILAIALIPRYAKRFGF

SEQ ID NO: 2249744 - protein, 21 aa, Cryptosporidium parvum
NHWVFLWTQILKKVLVIVLSY

SEQ ID NO: 2249745 - protein, 23 aa, Cryptosporidium parvum
NIAIIWIFILRLFGQFSSISSNF

SEQ ID NO: 2249746 - protein, 22 aa, Cryptosporidium parvum
NIHYLYTVLLPFLNERNLYDNW

SEQ ID NO: 2249747 - protein, 23 aa, Cryptosporidium parvum
NIILLIILFILLSLLICSIDTIV

SEQ ID NO: 2249748 - protein, 31 aa, Cryptosporidium parvum
NIKTWFFWIVYSFLVFIIYFSADYLYIFKNS

SEQ ID NO: 2249749 - protein, 25 aa, Cryptosporidium parvum
NIMTIFWLLLVFFIISILIFCINII

SEQ ID NO: 2249750 - protein, 23 aa, Cryptosporidium parvum
NINELWPFFYLHYNYIQKKLIIS

SEQ ID NO: 2249751 - protein, 18 aa, Cryptosporidium parvum
NIYFWIISLERITNYQLK

SEQ ID NO: 2249752 - protein, 22 aa, Cryptosporidium parvum
NKEFFELFLRWIFQISLTENFE

SEQ ID NO: 2249753 - protein, 21 aa, Cryptosporidium parvum
NKIKLLDFILLLPLKLETIII

SEQ ID NO: 2249754 - protein, 25 aa, Cryptosporidium parvum
NKKFISFLTLLIFIIYILEFNSTLA

SEQ ID NO: 2249755 - protein, 17 aa, Cryptosporidium parvum
NKLLFAIILVSYIYKFA

SEQ ID NO: 2249756 - protein, 23 aa, Cryptosporidium parvum
NKSAFYFVRFNLLLHLAAIVIQC

SEQ ID NO: 2249757 - protein, 23 aa, Cryptosporidium parvum
NKSLIFVYLLLSTVPLLSFKIIE

SEQ ID NO: 2249758 - protein, 18 aa, Cryptosporidium parvum
NLFHSVFPYYRGEVPKLT

SEQ ID NO: 2249759 - protein, 21 aa, Cryptosporidium parvum
NLFQKIFRFPKLLLSKDEVHN

SEQ ID NO: 2249760 - protein, 25 aa, Cryptosporidium parvum
NLFVIYIDWLHYLFTLYSTIESDIN

SEQ ID NO: 2249761 - protein, 21 aa, Cryptosporidium parvum
NLLELLYLSDASEFFFCLECI

SEQ ID NO: 2249762 - protein, 23 aa, Cryptosporidium parvum
NLPAPMFMFIFSLFSLIIGMILS

SEQ ID NO: 2249763 - protein, 28 aa, Cryptosporidium parvum
NLVLKTLLLLLLEYLIINFPGVSSIDEK

SEQ ID NO: 2249764 - protein, 18 aa, Cryptosporidium parvum
NLYCMFVQLITLITKLRD

SEQ ID NO: 2249765 - protein, 20 aa, Cryptosporidium parvum
NLYFTWLLATRIILSLTTYF

SEQ ID NO: 2249766 - protein, 18 aa, Cryptosporidium parvum
NMYWIYYRIFHGIPFELF

SEQ ID NO: 2249767 - protein, 24 aa, Cryptosporidium parvum
NNDDLCIILKPPFWYCPIEGTGMD

SEQ ID NO: 2249768 - protein, 27 aa, Cryptosporidium parvum
NNIFKLFLLIIPNLLFQFYCEWSWTLL

SEQ ID NO: 2249769 - protein, 23 aa, Cryptosporidium parvum
NNIIPLFNFPLITQLKILLTKNY

SEQ ID NO: 2249770 - protein, 20 aa, Cryptosporidium parvum
NNYFFKYKLWLFVNQFLIEC

SEQ ID NO: 2249771 - protein, 20 aa, Cryptosporidium parvum
NPLGFLWVLIIQRFRIFLYI

SEQ ID NO: 2249772 - protein, 32 aa, Cryptosporidium parvum
NPTWDFFMSLPFPIPYLLILSVLHLIIIHTTF

SEQ ID NO: 2249773 - protein, 30 aa, Cryptosporidium parvum
NQILHFYCIKFLWKFLPLTSTKDFLEQYSR

SEQ ID NO: 2249774 - protein, 24 aa, Cryptosporidium parvum
NREEFLYWVINLHYDRFLFNGLNT

SEQ ID NO: 2249775 - protein, 24 aa, Cryptosporidium parvum
NRIISLFKFKFFNEPLWNAISWYS

SEQ ID NO: 2249776 - protein, 18 aa, Cryptosporidium parvum
NRLTWIVIILLAIDCFFS

SEQ ID NO: 2249777 - protein, 21 aa, Cryptosporidium parvum
NSIFLFYLKLLSQPITIAWGI

SEQ ID NO: 2249778 - protein, 23 aa, Cryptosporidium parvum
NSIFMWVILGFIVLLLTLICICG

SEQ ID NO: 2249779 - protein, 25 aa, Cryptosporidium parvum
NSKQCYIIVFLLQKITTCLLFRGRR

SEQ ID NO: 2249780 - protein, 22 aa, Cryptosporidium parvum
NSLLNLMFMELLIKLKLATNDN

SEQ ID NO: 2249781 - protein, 26 aa, Cryptosporidium parvum
NSPEFFRLWTLLILCGLLSMLLNYFT

SEQ ID NO: 2249782 - protein, 27 aa, Cryptosporidium parvum
NSQPTIIHWLIILLSALFSCYLFNGVD

SEQ ID NO: 2249783 - protein, 17 aa, Cryptosporidium parvum
NTIRGGYLLILQKILFA

SEQ ID NO: 2249784 - protein, 19 aa, Cryptosporidium parvum
NVLFLKLIFLFSCSLCSIV

SEQ ID NO: 2249785 - protein, 27 aa, Cryptosporidium parvum
NVMIFPLLLLLLLLISIDFIQCEDFEN

SEQ ID NO: 2249786 - protein, 23 aa, Cryptosporidium parvum
NVSIMICLYLNFIPSIYKIPGVP

SEQ ID NO: 2249787 - protein, 20 aa, Cryptosporidium parvum
NWNLIALSHNYFFGALYGRM

SEQ ID NO: 2249788 - protein, 19 aa, Cryptosporidium parvum
NWSSYFYFIRRMSSFSIIT

SEQ ID NO: 2249789 - protein, 32 aa, Cryptosporidium parvum
NYFRNNPIMRLFFFIFVLAMFSPANISNGFQK

SEQ ID NO: 2249790 - protein, 25 aa, Cryptosporidium parvum
NYNYNIFFYISYMNWIPKIFINSND

SEQ ID NO: 2249791 - protein, 19 aa, Cryptosporidium parvum
PALYAILFAPLILGMLILA

SEQ ID NO: 2249792 - protein, 20 aa, Cryptosporidium parvum
PCAVWLPWIPQLIAGIDRIE

SEQ ID NO: 2249793 - protein, 24 aa, Cryptosporidium parvum
PCEQVHYWFLAYWAFRIGSGQILW

SEQ ID NO: 2249794 - protein, 24 aa, Cryptosporidium parvum
PDNDFLFKIFPFLSIFNEGSKRIM

SEQ ID NO: 2249795 - protein, 23 aa, Cryptosporidium parvum
PDVFIYILLIIFYILSHITSTLL

SEQ ID NO: 2249796 - protein, 18 aa, Cryptosporidium parvum
PDWMRPLLFTKSPNEALV

SEQ ID NO: 2249797 - protein, 25 aa, Cryptosporidium parvum
PENQISVWLFLTASLLTSLLLYRNV

SEQ ID NO: 2249798 - protein, 22 aa, Cryptosporidium parvum
PFEKFPIPSWLYKLFSRLVEVD

SEQ ID NO: 2249799 - protein, 19 aa, Cryptosporidium parvum
PFIFLGLFQSIFLFCSGEE

SEQ ID NO: 2249800 - protein, 24 aa, Cryptosporidium parvum
PFIRLIQIILFPLLKPISVILDKA

SEQ ID NO: 2249801 - protein, 23 aa, Cryptosporidium parvum
PFKSLYLMNAIIILKFGLVCIFN

SEQ ID NO: 2249802 - protein, 22 aa, Cryptosporidium parvum
PFTYPFFILLLDVFTYIIIMCL

SEQ ID NO: 2249803 - protein, 28 aa, Cryptosporidium parvum
PICILIYPILIWYYFKYIFKPTRIQTRE

SEQ ID NO: 2249804 - protein, 20 aa, Cryptosporidium parvum
PILLIACLGFFLLLAGKIHF

SEQ ID NO: 2249805 - protein, 18 aa, Cryptosporidium parvum
PINFLWVIPLGTLPSPHI

SEQ ID NO: 2249806 - protein, 19 aa, Cryptosporidium parvum
PIQLPGIRYFALFIFSKQV

SEQ ID NO: 2249807 - protein, 22 aa, Cryptosporidium parvum
PISLYFLSLLPWYTIDQNVNDA

SEQ ID NO: 2249808 - protein, 20 aa, Cryptosporidium parvum
PIYMLFLPFMTIITYNCISI

SEQ ID NO: 2249809 - protein, 18 aa, Cryptosporidium parvum
PKFWSLLFDIMLGPDLDS

SEQ ID NO: 2249810 - protein, 18 aa, Cryptosporidium parvum
PNIFAFEYIYLLSPVLST

SEQ ID NO: 2249811 - protein, 21 aa, Cryptosporidium parvum
PNLLNKYRFLSLLKLPKSHFE

SEQ ID NO: 2249812 - protein, 18 aa, Cryptosporidium parvum
PPEIAIIRPIYPLNPPTV

SEQ ID NO: 2249813 - protein, 25 aa, Cryptosporidium parvum
PRIYVIFIIFIIFFSNVECLLKKAN

SEQ ID NO: 2249814 - protein, 22 aa, Cryptosporidium parvum
PRWIPKFFFLLNFRIPRSRFDR

SEQ ID NO: 2249815 - protein, 19 aa, Cryptosporidium parvum
PSLILFIRALNELNPQKNA

SEQ ID NO: 2249816 - protein, 20 aa, Cryptosporidium parvum
PSRCILLIYIGLSSPVYFGS

SEQ ID NO: 2249817 - protein, 17 aa, Cryptosporidium parvum
PTWFHCLVWKSLTERDN

SEQ ID NO: 2249818 - protein, 21 aa, Cryptosporidium parvum
PWVILRFLFIDIWIGLLLFQI

SEQ ID NO: 2249819 - protein, 17 aa, Cryptosporidium parvum
PWWIYLCLVLLSLVILG

SEQ ID NO: 2249820 - protein, 18 aa, Cryptosporidium parvum
PWYAPLKKIGINIISGKN

SEQ ID NO: 2249821 - protein, 19 aa, Cryptosporidium parvum
PYAVYYWFISILNLLVVFI

SEQ ID NO: 2249822 - protein, 18 aa, Cryptosporidium parvum
PYGFSILILLSLFKIIPI

SEQ ID NO: 2249823 - protein, 22 aa, Cryptosporidium parvum
PYKKFITLYFYQLPTLLNHLFS

SEQ ID NO: 2249824 - protein, 26 aa, Cryptosporidium parvum
PYQALLLQIFIFISPFLRSVQLSSNI

SEQ ID NO: 2249825 - protein, 17 aa, Cryptosporidium parvum
PYYLKISWYIYYLSTIS

SEQ ID NO: 2249826 - protein, 25 aa, Cryptosporidium parvum
QAIQQPLIRLLLYGIILPILEQCNA

SEQ ID NO: 2249827 - protein, 20 aa, Cryptosporidium parvum
QAMFFLNIIKIIFIIHFFTL

SEQ ID NO: 2249828 - protein, 22 aa, Cryptosporidium parvum
QDEKMWFTFYYLNKKSSICNVQ

SEQ ID NO: 2249829 - protein, 23 aa, Cryptosporidium parvum
QDFLFHIFSFLIKFLFGYRYRDL

SEQ ID NO: 2249830 - protein, 24 aa, Cryptosporidium parvum
QDNWYFIYVLYVWLSTLVLIPFSF

SEQ ID NO: 2249831 - protein, 26 aa, Cryptosporidium parvum
QERIPTNLFIISFLALITGAFFLQYI

SEQ ID NO: 2249832 - protein, 20 aa, Cryptosporidium parvum
QFNSILEFAPWLAPKVLACI

SEQ ID NO: 2249833 - protein, 27 aa, Cryptosporidium parvum
QGKYQFYKYILKFKPFLTLISTLPLDL

SEQ ID NO: 2249834 - protein, 28 aa, Cryptosporidium parvum
QIFGTHTIYWWLYILAIGAGFLNMAFDE

SEQ ID NO: 2249835 - protein, 20 aa, Cryptosporidium parvum
QIFRPLLWKVQTAYVSYLYY

SEQ ID NO: 2249836 - protein, 24 aa, Cryptosporidium parvum
QILLWIFLFPYLLYNEKFKIIIMG

SEQ ID NO: 2249837 - protein, 29 aa, Cryptosporidium parvum
QKIIDIVYLLPLWFDLMRLPDKILRSKLL

SEQ ID NO: 2249838 - protein, 20 aa, Cryptosporidium parvum
QKILFYYFLMLIINGAINCA

SEQ ID NO: 2249839 - protein, 23 aa, Cryptosporidium parvum
QKKLLIRFIPFHLFSITGMTLDV

SEQ ID NO: 2249840 - protein, 19 aa, Cryptosporidium parvum
QKMYLLLDILILIKQNWEK

SEQ ID NO: 2249841 - protein, 18 aa, Cryptosporidium parvum
QLFHPPLIIRTGKLLSFS

SEQ ID NO: 2249842 - protein, 17 aa, Cryptosporidium parvum
QLFILCFLSLIILFVIP

SEQ ID NO: 2249843 - protein, 23 aa, Cryptosporidium parvum
QLIVFIIFYLFIGTSLNLPAALA

SEQ ID NO: 2249844 - protein, 18 aa, Cryptosporidium parvum
QLLYWLLQIAFELDGNQE

SEQ ID NO: 2249845 - protein, 26 aa, Cryptosporidium parvum
QMFTRKMIVLFLFAGFLGLFPGSFFH

SEQ ID NO: 2249846 - protein, 18 aa, Cryptosporidium parvum
QNYIFFPQSFLNLSLKNN

SEQ ID NO: 2249847 - protein, 25 aa, Cryptosporidium parvum
QQIPSWWVVFWPCWFWCGVIFSFST

SEQ ID NO: 2249848 - protein, 22 aa, Cryptosporidium parvum
QRGMYLVFLMTFLTILFPMLKQ

SEQ ID NO: 2249849 - protein, 21 aa, Cryptosporidium parvum
QSLIIQVLFWLTIPPDESWRS

SEQ ID NO: 2249850 - protein, 25 aa, Cryptosporidium parvum
QTFSLILLIIIFTPLIFFSIHIIIS

SEQ ID NO: 2249851 - protein, 26 aa, Cryptosporidium parvum
QTILFSILFYIIYKYIFRYFIHSCRL

SEQ ID NO: 2249852 - protein, 23 aa, Cryptosporidium parvum
QVFLSWFKHFLTPWLKFGTVFDH

SEQ ID NO: 2249853 - protein, 20 aa, Cryptosporidium parvum
QVYSFLLFLAMLLSSINIIG

SEQ ID NO: 2249854 - protein, 24 aa, Cryptosporidium parvum
QWFALEWFLCFFVTSLPLKSIMEI

SEQ ID NO: 2249855 - protein, 23 aa, Cryptosporidium parvum
QYFKWIILGFVLIFAILPPFIMD

SEQ ID NO: 2249856 - protein, 18 aa, Cryptosporidium parvum
QYFLNWFKKIYKNSNLFM

SEQ ID NO: 2249857 - protein, 17 aa, Cryptosporidium parvum
QYPILKLQLWSYGLIQS

SEQ ID NO: 2249858 - protein, 18 aa, Cryptosporidium parvum
RASMYWYRVFRSLSLLLY

SEQ ID NO: 2249859 - protein, 18 aa, Cryptosporidium parvum
RFLPNLMMTIIFSTCTDL

SEQ ID NO: 2249860 - protein, 18 aa, Cryptosporidium parvum
RFPETLFIYFTPPKNAKK

SEQ ID NO: 2249861 - protein, 22 aa, Cryptosporidium parvum
RGFLLIKFIRWVIMKDPFNNVQ

SEQ ID NO: 2249862 - protein, 38 aa, Cryptosporidium parvum; identical to SEQ ID NO: 2134871

SEQ ID NO: 2249863 - protein, 23 aa, Cryptosporidium parvum
RGIIKYILPFYSFQMFLKDTYLH

SEQ ID NO: 2249864 - protein, 28 aa, Cryptosporidium parvum
RHLLFTLFFLFLGLFLKLNQFLLLKEND

SEQ ID NO: 2249865 - protein, 18 aa, Cryptosporidium parvum
RIILFIYISFLSMLHDIT

SEQ ID NO: 2249866 - protein, 26 aa, Cryptosporidium parvum
RIIVTLILITTVIWSIIGLLGIILIF

SEQ ID NO: 2249867 - protein, 18 aa, Cryptosporidium parvum
RIPYLFEVLYINLGIPIL

SEQ ID NO: 2249868 - protein, 26 aa, Cryptosporidium parvum
RIRGKFFLILMVQLFCFFFLCMWFSY

SEQ ID NO: 2249869 - protein, 24 aa, Cryptosporidium parvum
RISINIILFIWSSLLLRLSLWIRS

SEQ ID NO: 2249870 - protein, 20 aa, Cryptosporidium parvum
RIWLDFPTILLPIPLQWAKL

SEQ ID NO: 2249871 - protein, 23 aa, Cryptosporidium parvum
RKMLLFLIIVIACSIAILHSPIY

SEQ ID NO: 2249872 - protein, 21 aa, Cryptosporidium parvum
RKWIILLIIIEFVIKINLLYG

SEQ ID NO: 2249873 - protein, 20 aa, Cryptosporidium parvum
RLDIPRLCYTVHLLALISHI

SEQ ID NO: 2249874 - protein, 19 aa, Cryptosporidium parvum
RLKIWLTPLLLFHDLISSK

SEQ ID NO: 2249875 - protein, 17 aa, Cryptosporidium parvum
RLLKYWLHIRRLPVAKD

SEQ ID NO: 2249876 - protein, 18 aa, Cryptosporidium parvum
RMLLFVNFFLKREKLRIL

SEQ ID NO: 2249877 - protein, 27 aa, Cryptosporidium parvum
RQPQNIPWWIYLLIIILGFDEITYVLT

SEQ ID NO: 2249878 - protein, 23 aa, Cryptosporidium parvum
RRILYFILIHILIFNILEINSLP

SEQ ID NO: 2249879 - protein, 20 aa, Cryptosporidium parvum
RRRLNILWSQRYKNIKLRLF

SEQ ID NO: 2249880 - protein, 18 aa, Cryptosporidium parvum
RSAILFTILLIKSLTILS

SEQ ID NO: 2249881 - protein, 25 aa, Cryptosporidium parvum
RSFLPLFLVFVFLALQFIGLSIMIF

SEQ ID NO: 2249882 - protein, 24 aa, Cryptosporidium parvum
RSFNIFDMFFFYKVLNFYYNDLNG

SEQ ID NO: 2249883 - protein, 21 aa, Cryptosporidium parvum
RSTLIFTFLTEKTNKFFDCFL

SEQ ID NO: 2249884 - protein, 32 aa, Cryptosporidium parvum
RSTTSFILIYITSLLFLLLLFETKHVVSDNTS

SEQ ID NO: 2249885 - protein, 26 aa, Cryptosporidium parvum
RTEIGIFWIGLLTLFLIILDILLEVY

SEQ ID NO: 2249886 - protein, 18 aa, Cryptosporidium parvum
RTHLMMLIFFGGNILRGL

SEQ ID NO: 2249887 - protein, 29 aa, Cryptosporidium parvum
RTNALQWYIAWTWFVDLILSISTCSLENS

SEQ ID NO: 2249888 - protein, 17 aa, Cryptosporidium parvum
RVGLIHFFRYFLGGAFQ

SEQ ID NO: 2249889 - protein, 23 aa, Cryptosporidium parvum
RVIPILMIFLIYYRKVRVRRQSI

SEQ ID NO: 2249890 - protein, 20 aa, Cryptosporidium parvum
RYFSPLIIYVLDKALAYYSS

SEQ ID NO: 2249891 - protein, 20 aa, Cryptosporidium parvum
SAFYWIRRGFYLPRSYNLLK

SEQ ID NO: 2249892 - protein, 18 aa, Cryptosporidium parvum
SALWLWVLMAGSAILAIC

SEQ ID NO: 2249893 - protein, 25 aa, Cryptosporidium parvum
SCETYFYFHFFFTTNSKPLTFFFNE

SEQ ID NO: 2249894 - protein, 19 aa, Cryptosporidium parvum
SCEYILFITLVFLISISIM

SEQ ID NO: 2249895 - protein, 20 aa, Cryptosporidium parvum
SCLFILQILVALATITWVIV

SEQ ID NO: 2249896 - protein, 25 aa, Cryptosporidium parvum
SDPSTGLPFIPGFNVLVDPQTGEQI

SEQ ID NO: 2249897 - protein, 17 aa, Cryptosporidium parvum
SDPWIWLDLIETSFLPL

SEQ ID NO: 2249898 - protein, 19 aa, Cryptosporidium parvum
SEILLFPSILILKLLSIQN

SEQ ID NO: 2249899 - protein, 23 aa, Cryptosporidium parvum
SEKRRWIIDFFVYLIGGGLYGAV

SEQ ID NO: 2249900 - protein, 22 aa, Cryptosporidium parvum
SFEFHLFIKPWSYLDDIIENNT

SEQ ID NO: 2249901 - protein, 17 aa, Cryptosporidium parvum
SFIFLLFICLSFGIIVA

SEQ ID NO: 2249902 - protein, 22 aa, Cryptosporidium parvum
SFIGFIILIALIRIIYFAAKKR

SEQ ID NO: 2249903 - protein, 17 aa, Cryptosporidium parvum
SFILFTLIAYALPLIRE

SEQ ID NO: 2249904 - protein, 18 aa, Cryptosporidium parvum
SFLYILMEYAEGGSLYGL

SEQ ID NO: 2249905 - protein, 24 aa, Cryptosporidium parvum
SFSSYFWYFKLIGPKWMIVFTLGC

SEQ ID NO: 2249906 - protein, 23 aa, Cryptosporidium parvum
SFVLLFCLFFYQLDKLHAEVIYA

SEQ ID NO: 2249907 - protein, 26 aa, Cryptosporidium parvum
SGFSIHPFLLQLLFDFIKLYNIEEII

SEQ ID NO: 2249908 - protein, 17 aa, Cryptosporidium parvum
SGGLLIIGLCPWGWEYI

SEQ ID NO: 2249909 - protein, 27 aa, Cryptosporidium parvum
SHGFFLTLVFLLFSILSRIFSVIINIK

SEQ ID NO: 2249910 - protein, 25 aa, Cryptosporidium parvum
SHIYLLLVIILLVNLGIGLFFCGRN

SEQ ID NO: 2249911 - protein, 21 aa, Cryptosporidium parvum
SHPLVIIFIFILVVCMFAGGS

SEQ ID NO: 2249912 - protein, 22 aa, Cryptosporidium parvum
SHSKLPWFPTLSSALYLTEDAS

SEQ ID NO: 2249913 - protein, 19 aa, Cryptosporidium parvum
SICPTLCSLFLLLKSKVIR

SEQ ID NO: 2249914 - protein, 23 aa, Cryptosporidium parvum
SIFTRVIFIWLFQSFGKSQLNDL

SEQ ID NO: 2249915 - protein, 22 aa, Cryptosporidium parvum
SIFVFMLISLIFWALTRFFSFA

SEQ ID NO: 2249916 - protein, 25 aa, Cryptosporidium parvum
SIGMRWLIPWYLIEALLTKPNQINL

SEQ ID NO: 2249917 - protein, 18 aa, Cryptosporidium parvum
SIIIYLRPLILQELLCLF

SEQ ID NO: 2249918 - protein, 20 aa, Cryptosporidium parvum
SILSLLFKIIYLIRILNSLR

SEQ ID NO: 2249919 - protein, 25 aa, Cryptosporidium parvum
SILSVLRLIVYLIKSVFNIFSNISS

SEQ ID NO: 2249920 - protein, 25 aa, Cryptosporidium parvum
SISIRLYYFILRIVIIIGTISVLIP

SEQ ID NO: 2249921 - protein, 23 aa, Cryptosporidium parvum
SIVKFFWKLAYLVLFILCWVVFP

SEQ ID NO: 2249922 - protein, 20 aa, Cryptosporidium parvum
SIWFTVLLCFILILLITSSI

SEQ ID NO: 2249923 - protein, 18 aa, Cryptosporidium parvum
SIYLCIIILIITGLISII

SEQ ID NO: 2249924 - protein, 19 aa, Cryptosporidium parvum
SIYNFVFIFSIIISTIYLL

SEQ ID NO: 2249925 - protein, 19 aa, Cryptosporidium parvum
SKCSALIQSFWLGIADNVD

SEQ ID NO: 2249926 - protein, 24 aa, Cryptosporidium parvum
SKFAVFVFYAFFILQNSIVNAIDQ

SEQ ID NO: 2249927 - protein, 22 aa, Cryptosporidium parvum
SKLFNRFLLFSFLFFSTGLGYY

SEQ ID NO: 2249928 - protein, 17 aa, Cryptosporidium parvum
SKLKLWIKNWYIIDLIL

SEQ ID NO: 2249929 - protein, 26 aa, Cryptosporidium parvum
SKQLIDWVWIISSLPELIFGLLIQND

SEQ ID NO: 2249930 - protein, 17 aa, Cryptosporidium parvum
SKYIYYFEYIGRIYFLI

SEQ ID NO: 2249931 - protein, 22 aa, Cryptosporidium parvum
SKYLIYVFFIALFSFTVKLTIF

SEQ ID NO: 2249932 - protein, 18 aa, Cryptosporidium parvum
SLFAWLVYILIAIKRYLS

SEQ ID NO: 2249933 - protein, 21 aa, Cryptosporidium parvum
SLGILIWMKYLIKLAPIESIE

SEQ ID NO: 2249934 - protein, 24 aa, Cryptosporidium parvum
SLIGLVFWHILIPIVYLLCIYFDT

SEQ ID NO: 2249935 - protein, 21 aa, Cryptosporidium parvum
SLILLLFRWVILLMYIVAQLF

SEQ ID NO: 2249936 - protein, 33 aa, Cryptosporidium parvum
SLIPERILFGKLIFFLLGLLNIMYIKELKICGF

SEQ ID NO: 2249937 - protein, 18 aa, Cryptosporidium parvum
SLKHSFLWPHNNATLISA

SEQ ID NO: 2249938 - protein, 25 aa, Cryptosporidium parvum
SLLILVLSLYFLILSLDLSFINGDN

SEQ ID NO: 2249939 - protein, 26 aa, Cryptosporidium parvum
SLPFNFLLLFTLLVFSIGVVSVKSND

SEQ ID NO: 2249940 - protein, 35 aa, Cryptosporidium parvum
SLRIWIYRKLGKILNYIFKIIKTLSLFLIIGTFLF

SEQ ID NO: 2249941 - protein, 18 aa, Cryptosporidium parvum
SLSLLLYFSRKYIKEYAT

SEQ ID NO: 2249942 - protein, 25 aa, Cryptosporidium parvum
SLWQGIFLRFYIWAVLWAIMIIFTT

SEQ ID NO: 2249943 - protein, 17 aa, Cryptosporidium parvum
SLYILFDVGFFLSSSRG

SEQ ID NO: 2249944 - protein, 20 aa, Cryptosporidium parvum
SMILPYFQLLPIPSSEFKPI

SEQ ID NO: 2249945 - protein, 21 aa, Cryptosporidium parvum
SNFDYLKIFKIPLILFILSFI

SEQ ID NO: 2249946 - protein, 23 aa, Cryptosporidium parvum
SNLIRIWWHFIPIPHCEIPCPVP

SEQ ID NO: 2249947 - protein, 22 aa, Cryptosporidium parvum
SPINWLFWILDSDRISLLTMHE

SEQ ID NO: 2249948 - protein, 21 aa, Cryptosporidium parvum
SPTFLSVIPLIFRQFIDISYM

SEQ ID NO: 2249949 - protein, 23 aa, Cryptosporidium parvum
SQTIKFIFIIFKPNNLSINTPLS

SEQ ID NO: 2249950 - protein, 23 aa, Cryptosporidium parvum
SRPAMFCIIFISLLITILEICLA

SEQ ID NO: 2249951 - protein, 20 aa, Cryptosporidium parvum
SSAFGLRYIVPSVFAIFAAL

SEQ ID NO: 2249952 - protein, 22 aa, Cryptosporidium parvum
SSCKIIYKIILWLLKYSKNIDE

SEQ ID NO: 2249953 - protein, 24 aa, Cryptosporidium parvum
SSHPWFLIFWLVLCYIWIVAYTAF

SEQ ID NO: 2249954 - protein, 24 aa, Cryptosporidium parvum
SSIILLWIINFLKLQKQLPCLKQI

SEQ ID NO: 2249955 - protein, 17 aa, Cryptosporidium parvum
SSRKFILLSYQLTHFLL

SEQ ID NO: 2249956 - protein, 23 aa, Cryptosporidium parvum
SSRRTLMWFSISIIIVLLNIFIG

SEQ ID NO: 2249957 - protein, 22 aa, Cryptosporidium parvum
STFWKVLLGNIFLIILCLSNVY

SEQ ID NO: 2249958 - protein, 27 aa, Cryptosporidium parvum
STIFIIIIGIWLAWIFRYKRQTEIYDM

SEQ ID NO: 2249959 - protein, 22 aa, Cryptosporidium parvum
STRNIWIIPIANPWGFYHNKRT

SEQ ID NO: 2249960 - protein, 22 aa, Cryptosporidium parvum
SVALFLIIGWISCPILPLIWTL

SEQ ID NO: 2249961 - protein, 18 aa, Cryptosporidium parvum
SVFLLITLCLLIITRNSE

SEQ ID NO: 2249962 - protein, 24 aa, Cryptosporidium parvum
SVLFSYLVFILKTTPWWLNISDLI

SEQ ID NO: 2249963 - protein, 23 aa, Cryptosporidium parvum
SVVALFMFPAWPLAIKISVWYIS

SEQ ID NO: 2249964 - protein, 22 aa, Cryptosporidium parvum
SWAFFIYLIFFTSIFLICKIIF

SEQ ID NO: 2249965 - protein, 19 aa, Cryptosporidium parvum
SWIQWLFKFHRISSVPLNS

SEQ ID NO: 2249966 - protein, 17 aa, Cryptosporidium parvum
SWVFSLFIVSFFCYFSM

SEQ ID NO: 2249967 - protein, 17 aa, Cryptosporidium parvum
SWYRFWEKKPKYVHKNI

SEQ ID NO: 2249968 - protein, 23 aa, Cryptosporidium parvum
SYFFLIWSVWLFTISFLFIFMLS

SEQ ID NO: 2249969 - protein, 19 aa, Cryptosporidium parvum
SYILHMMFILIGSLDYYNL

SEQ ID NO: 2249970 - protein, 19 aa, Cryptosporidium parvum
SYIRLRYLIENLYLRMIVD

SEQ ID NO: 2249971 - protein, 20 aa, Cryptosporidium parvum
SYIYTYLWQFQINPYYIISN

SEQ ID NO: 2249972 - protein, 22 aa, Cryptosporidium parvum
SYTYYFSSLILWLFSKSNDSIV

SEQ ID NO: 2249973 - protein, 24 aa, Cryptosporidium parvum
TATYQLLYFLPISALVVVLSKGRV

SEQ ID NO: 2249974 - protein, 28 aa, Cryptosporidium parvum
TCDQFEFPWWFYNIIIVLAVLAVGIFYK

SEQ ID NO: 2249975 - protein, 23 aa, Cryptosporidium parvum
TCTRKYFVLGYLKSSLFLSNIVK

SEQ ID NO: 2249976 - protein, 22 aa, Cryptosporidium parvum
TDWIFFSIILFLTIVRGIEILV

SEQ ID NO: 2249977 - protein, 19 aa, Cryptosporidium parvum
TFCFGFMMVILFFNSSGSV

SEQ ID NO: 2249978 - protein, 24 aa, Cryptosporidium parvum
TFINYLLIFFFILFDSVTLFESKS

SEQ ID NO: 2249979 - protein, 27 aa, Cryptosporidium parvum
TFLITILIFLIFFFKRRLVIDLLLIVE

SEQ ID NO: 2249980 - protein, 23 aa, Cryptosporidium parvum
TFVRCLIICLFVFSWPISKFLDY

SEQ ID NO: 2249981 - protein, 20 aa, Cryptosporidium parvum
TFYLRIINILLFKLIYDIIQ

SEQ ID NO: 2249982 - protein, 27 aa, Cryptosporidium parvum
TGKYSLYFLFLAILIFLTTFAQNSFLQ

SEQ ID NO: 2249983 - protein, 26 aa, Cryptosporidium parvum
TGSIEFYLCILFSIALIFFGGILSGL

SEQ ID NO: 2249984 - protein, 22 aa, Cryptosporidium parvum
THIFKLFDIIWIKLSYLWCGER

SEQ ID NO: 2249985 - protein, 25 aa, Cryptosporidium parvum
TIENSFPWFIPVKTSVQFFDLNSTR

SEQ ID NO: 2249986 - protein, 32 aa, Cryptosporidium parvum; identical to SEQ ID NO: 2134959

SEQ ID NO: 2249987 - protein, 20 aa, Cryptosporidium parvum
TIGMYIFTLMPWWNPDPTYL

SEQ ID NO: 2249988 - protein, 24 aa, Cryptosporidium parvum
TIIFNIIIFLYLLSSFNIIRCNGE

SEQ ID NO: 2249989 - protein, 23 aa, Cryptosporidium parvum
TILMIELILFSFPFNIPNLPLPK

SEQ ID NO: 2249990 - protein, 25 aa, Cryptosporidium parvum
TIRDYFNYKLFWKYYINIEYLEITR

SEQ ID NO: 2249991 - protein, 19 aa, Cryptosporidium parvum
TIVFPPCPILLFSLRDINS

SEQ ID NO: 2249992 - protein, 18 aa, Cryptosporidium parvum
TIWIPLYNNVLLWITLIS

SEQ ID NO: 2249993 - protein, 17 aa, Cryptosporidium parvum
TIYIGYFIYLDYRFIIV

SEQ ID NO: 2249994 - protein, 23 aa, Cryptosporidium parvum
TKFNLFMFITYDKYIDLLLESGQ

SEQ ID NO: 2249995 - protein, 23 aa, Cryptosporidium parvum
TKLFWILIPIIICIISLSTNIFD

SEQ ID NO: 2249996 - protein, 17 aa, Cryptosporidium parvum
TLFIFVLKFVAIAANQD

SEQ ID NO: 2249997 - protein, 21 aa, Cryptosporidium parvum
TLFINLMIKYEFLWQSWKNNN

SEQ ID NO: 2249998 - protein, 26 aa, Cryptosporidium parvum
TLFLLSLLFFIVFLSGIYFLWKKYPA

SEQ ID NO: 2249999 - protein, 22 aa, Cryptosporidium parvum
TLKPIPLIVILFSCLKYLIVNC

SEQ ID NO: 2250000 - protein, 23 aa, Cryptosporidium parvum
TLSKILFLLLIITSFVLVFCKGF

SEQ ID NO: 2250001 - protein, 29 aa, Cryptosporidium parvum
TLSLFLIIGTFLFIIWNSINHFGQYGESK

SEQ ID NO: 2250002 - protein, 24 aa, Cryptosporidium parvum
TLWSKLFFTWLSPWMSKFLGPGVN

SEQ ID NO: 2250003 - protein, 17 aa, Cryptosporidium parvum
TMPLFYILSCWKLLWCL

SEQ ID NO: 2250004 - protein, 22 aa, Cryptosporidium parvum
TNRILIFHFIVVIFVVIITLIV

SEQ ID NO: 2250005 - protein, 26 aa, Cryptosporidium parvum
TPDLYLFPRFLSFYKLAPIKLRQQMW

SEQ ID NO: 2250006 - protein, 22 aa, Cryptosporidium parvum
TPHYLILIYIFVGITFITVGIF

SEQ ID NO: 2250007 - protein, 19 aa, Cryptosporidium parvum
TPYIFIPLLKDINSKKDKS

SEQ ID NO: 2250008 - protein, 23 aa, Cryptosporidium parvum
TRILQKIRILNIPDIYIQATAKK

SEQ ID NO: 2250009 - protein, 23 aa, Cryptosporidium parvum
TRWYLPGYWWYEKVTFTSEVSLP

SEQ ID NO: 2250010 - protein, 22 aa, Cryptosporidium parvum
TRYNPYFLGWILSELIALLTNQ

SEQ ID NO: 2250011 - protein, 20 aa, Cryptosporidium parvum
TSEFPWFTSAWLRRACLALE

SEQ ID NO: 2250012 - protein, 24 aa, Cryptosporidium parvum
TSKKYFHRALFDPTFLQYIYMILG

SEQ ID NO: 2250013 - protein, 25 aa, Cryptosporidium parvum
TSQYFLWWFILFPLALRVYLTNNIA

SEQ ID NO: 2250014 - protein, 18 aa, Cryptosporidium parvum
TVFLFRILRYWNNDITSS

SEQ ID NO: 2250015 - protein, 18 aa, Cryptosporidium parvum
TVFPWCISLLLYSLLHFT

SEQ ID NO: 2250016 - protein, 22 aa, Cryptosporidium parvum
TVTFNLLFMLFLHIFGLVLTRN

SEQ ID NO: 2250017 - protein, 20 aa, Cryptosporidium parvum
TVVKQPWYAPLKKIGINIIS

SEQ ID NO: 2250018 - protein, 22 aa, Cryptosporidium parvum
VDLYLPIFLLFLETFSFEDLNG

SEQ ID NO: 2250019 - protein, 18 aa, Cryptosporidium parvum
VEIQLIYYLVYSLSIHNI

SEQ ID NO: 2250020 - protein, 22 aa, Cryptosporidium parvum
VETIIRLLFFFNYFVRMSTEMN

SEQ ID NO: 2250021 - protein, 23 aa, Cryptosporidium parvum
VETKLFLIFIIKTSLLGIQNTFF

SEQ ID NO: 2250022 - protein, 19 aa, Cryptosporidium parvum
VFITYFLIIYTVSATELDS

SEQ ID NO: 2250023 - protein, 19 aa, Cryptosporidium parvum
VFLIATFIIMLLSPILCFI

SEQ ID NO: 2250024 - protein, 24 aa, Cryptosporidium parvum
VFNWFTFIIFVIYILLIGCRHIDL

SEQ ID NO: 2250025 - protein, 22 aa, Cryptosporidium parvum
VFVIICRFLFFPVSTLRRIKMQ

SEQ ID NO: 2250026 - protein, 19 aa, Cryptosporidium parvum
VIDLLLIVELILIDILFSK

SEQ ID NO: 2250027 - protein, 29 aa, Cryptosporidium parvum
VIERLMLYFIIFVLLLANIYVFFRRILGR

SEQ ID NO: 2250028 - protein, 18 aa, Cryptosporidium parvum
VIGLFFLSQLNPLCLLLF

SEQ ID NO: 2250029 - protein, 25 aa, Cryptosporidium parvum
VILMMLLFVLLYFTLNNSLSIIKDY

SEQ ID NO: 2250030 - protein, 24 aa, Cryptosporidium parvum
VIVNYFFIFIILFSVLGIKIYKRV

SEQ ID NO: 2250031 - protein, 23 aa, Cryptosporidium parvum
VKRNYFLKLFWKITRKITIALRN

SEQ ID NO: 2250032 - protein, 19 aa, Cryptosporidium parvum
VLERYIFGILTFLSEKILN

SEQ ID NO: 2250033 - protein, 27 aa, Cryptosporidium parvum
VLGFAILICFLIGFYLILFSAKHPTSK

SEQ ID NO: 2250034 - protein, 19 aa, Cryptosporidium parvum
VLVFCIVLNILNLSFVTSK

SEQ ID NO: 2250035 - protein, 17 aa, Cryptosporidium parvum
VMYFLLAGTLPFTGRSI

SEQ ID NO: 2250036 - protein, 17 aa, Cryptosporidium parvum
VPIHQLLRQYFPHCTVF

SEQ ID NO: 2250037 - protein, 26 aa, Cryptosporidium parvum
VPSIILLSLLAFVVWFLLAYYDKVDP

SEQ ID NO: 2250038 - protein, 26 aa, Cryptosporidium parvum
VQLFNLFFMFFAFTSFIMILMDSLEC

SEQ ID NO: 2250039 - protein, 24 aa, Cryptosporidium parvum
VSIQELFGFVLSVLHLGGFNVSSF

SEQ ID NO: 2250040 - protein, 30 aa, Cryptosporidium parvum; identical to SEQ ID NO: 2135003

SEQ ID NO: 2250041 - protein, 18 aa, Cryptosporidium parvum
VSSSIYNFVFIFSIIIST

SEQ ID NO: 2250042 - protein, 21 aa, Cryptosporidium parvum
VSWFIFRYFFDFIRYFIEENK

SEQ ID NO: 2250043 - protein, 20 aa, Cryptosporidium parvum
VSYFFFLFVKMLIDCIKYIK

SEQ ID NO: 2250044 - protein, 17 aa, Cryptosporidium parvum
VTLLLLLASFIYSYLTG

SEQ ID NO: 2250045 - protein, 17 aa, Cryptosporidium parvum
VTLVFISVSLIIVLIFK

SEQ ID NO: 2250046 - protein, 24 aa, Cryptosporidium parvum
VTYPYYYRPFFGYGFPLLGTEPYF

SEQ ID NO: 2250047 - protein, 24 aa, Cryptosporidium parvum
VVGRYFYMILVEKLSFNTGGICSF

SEQ ID NO: 2250048 - protein, 20 aa, Cryptosporidium parvum
VVNFLRLYLIKVLPKNILGT

SEQ ID NO: 2250049 - protein, 22 aa, Cryptosporidium parvum
VVYPSLFTLFPLFRQILIREKI

SEQ ID NO: 2250050 - protein, 20 aa, Cryptosporidium parvum
VWVLIYFYIHYLLLNTIDCT

SEQ ID NO: 2250051 - protein, 18 aa, Cryptosporidium parvum
VYFFLFSLYYFLSYSNHI

SEQ ID NO: 2250052 - protein, 19 aa, Cryptosporidium parvum
VYGCILLTSLIFITIYLFI

SEQ ID NO: 2250053 - protein, 18 aa, Cryptosporidium parvum
WFLVIPYWIIYFIQSGNN

SEQ ID NO: 2250054 - protein, 17 aa, Cryptosporidium parvum
WFVIGFQEDIFLEYIAL

SEQ ID NO: 2250055 - protein, 22 aa, Cryptosporidium parvum
WGIFLGMFLAIVRIIPAGFASF

SEQ ID NO: 2250056 - protein, 20 aa, Cryptosporidium parvum
WGILRFFLLFFLSGVGGNLA

SEQ ID NO: 2250057 - protein, 20 aa, Cryptosporidium parvum
WGLLLFWLFSALESSFFYIY

SEQ ID NO: 2250058 - protein, 17 aa, Cryptosporidium parvum
WIAQGHELLFFYLTYYS

SEQ ID NO: 2250059 - protein, 24 aa, Cryptosporidium parvum
WIIPQWFLIYLRLSVFLYLLIMLG

SEQ ID NO: 2250060 - protein, 17 aa, Cryptosporidium parvum
WILCFIYGTFIALTDSY

SEQ ID NO: 2250061 - protein, 25 aa, Cryptosporidium parvum
WLIPSEYLLYLIFRISSESYSDSLI

SEQ ID NO: 2250062 - protein, 27 aa, Cryptosporidium parvum
WMELIAFWVLLIMVIVLLRGIRSNYEV

SEQ ID NO: 2250063 - protein, 21 aa, Cryptosporidium parvum
WRNIFGLIWVIFYTKPFKPKD

SEQ ID NO: 2250064 - protein, 17 aa, Cryptosporidium parvum
WSFLNPLGFLWVLIIQR

SEQ ID NO: 2250065 - protein, 17 aa, Cryptosporidium parvum
WSWTLLQLLDIVSLYII

SEQ ID NO: 2250066 - protein, 17 aa, Cryptosporidium parvum
WTLTLVLLIIQVVLGQN

SEQ ID NO: 2250067 - protein, 18 aa, Cryptosporidium parvum
WVNLYWTQPPYGGAAELF

SEQ ID NO: 2250068 - protein, 24 aa, Cryptosporidium parvum
WYIIQWLICMLITLSFYTLSYIDK

SEQ ID NO: 2250069 - protein, 17 aa, Cryptosporidium parvum
WYVSFARFMLLLSSIIP

SEQ ID NO: 2250070 - protein, 17 aa, Cryptosporidium parvum
YAILLILIINSAFFTIN

SEQ ID NO: 2250071 - protein, 17 aa, Cryptosporidium parvum
YAIYFWSDAINAKVYSP

SEQ ID NO: 2250072 - protein, 25 aa, Cryptosporidium parvum
YALIWMTWCLWLLGSFLFSFGRVML

SEQ ID NO: 2250073 - protein, 17 aa, Cryptosporidium parvum
YCFFCRIFIYLKKIKIN

SEQ ID NO: 2250074 - protein, 24 aa, Cryptosporidium parvum
YDDAYIWQYLFDTPWFKIDCVPDV

SEQ ID NO: 2250075 - protein, 17 aa, Cryptosporidium parvum
YEEYFFLSNLKLLELVD

SEQ ID NO: 2250076 - protein, 20 aa, Cryptosporidium parvum
YERLFRQLLCTLITLLGVSS

SEQ ID NO: 2250077 - protein, 17 aa, Cryptosporidium parvum
YERPWYFIFGSVLLTLI

SEQ ID NO: 2250078 - protein, 19 aa, Cryptosporidium parvum
YFEFPIQILFWFGYENTRL

SEQ ID NO: 2250079 - protein, 22 aa, Cryptosporidium parvum
YFFQAVFIFVIFFGLALSENID

SEQ ID NO: 2250080 - protein, 19 aa, Cryptosporidium parvum
YFHHLYLFIYFFFTLNISI

SEQ ID NO: 2250081 - protein, 26 aa, Cryptosporidium parvum
YFINIAKLIFHYILNPRLNTLKELYP

SEQ ID NO: 2250082 - protein, 17 aa, Cryptosporidium parvum
YFKKKIIPKMTILDLIE

SEQ ID NO: 2250083 - protein, 17 aa, Cryptosporidium parvum
YFKLFLYYIVISNLVHS

SEQ ID NO: 2250084 - protein, 26 aa, Cryptosporidium parvum
YFKSAYFFFLVFFALHFFIVKGQIQL

SEQ ID NO: 2250085 - protein, 19 aa, Cryptosporidium parvum
YFKYAYVLFSWLTRVLYKQ

SEQ ID NO: 2250086 - protein, 19 aa, Cryptosporidium parvum
YFLIVYLVFPILRRHFYAT

SEQ ID NO: 2250087 - protein, 19 aa, Cryptosporidium parvum
YFQYDFVLRYIFLNSLKIS

SEQ ID NO: 2250088 - protein, 18 aa, Cryptosporidium parvum
YFYQYIYITYYQLFHPPL

SEQ ID NO: 2250089 - protein, 17 aa, Cryptosporidium parvum
YGDFFFIILISTFLKEV

SEQ ID NO: 2250090 - protein, 25 aa, Cryptosporidium parvum
YGYLKFIILYFLSLVLWGLYRHHLH

SEQ ID NO: 2250091 - protein, 25 aa, Cryptosporidium parvum
YICSHGTFFWILKRYILPWDTYSDY

SEQ ID NO: 2250092 - protein, 28 aa, Cryptosporidium parvum
YIFCCLLFFIWYICTWFVGAHLLRIETK

SEQ ID NO: 2250093 - protein, 19 aa, Cryptosporidium parvum
YIFNYWFAIYLLYSTRYIN

SEQ ID NO: 2250094 - protein, 22 aa, Cryptosporidium parvum
YIGLLLYYFINIAKLIFHYILN

SEQ ID NO: 2250095 - protein, 30 aa, Cryptosporidium parvum
YIGYFIYLDYRFIIVFLPISYFFNKFRIRA

SEQ ID NO: 2250096 - protein, 25 aa, Cryptosporidium parvum
YILNNRLFSLWLFVQKRLTTIQIAI

SEQ ID NO: 2250097 - protein, 19 aa, Cryptosporidium parvum
YILWIFQAFLEITEGVVKK

SEQ ID NO: 2250098 - protein, 19 aa, Cryptosporidium parvum
YIPLPIFTLIIHTFSLKSD

SEQ ID NO: 2250099 - protein, 24 aa, Cryptosporidium parvum
YIPYHLFFLIVLFSIVSILWIINI

SEQ ID NO: 2250100 - protein, 19 aa, Cryptosporidium parvum
YIRSLLRLFFLFSSFKEDN

SEQ ID NO: 2250101 - protein, 17 aa, Cryptosporidium parvum
YIYNGLILDFKILYKVY

SEQ ID NO: 2250102 - protein, 37 aa, Cryptosporidium parvum
YIYPYYWKYILEPIRYIISIIFYFIWGIELTPKKEFD

SEQ ID NO: 2250103 - protein, 19 aa, Cryptosporidium parvum
YIYYFEYIGRIYFLIFLLV

SEQ ID NO: 2250104 - protein, 22 aa, Cryptosporidium parvum
YKKSMWLFFGIGIVQMTLSLFL

SEQ ID NO: 2250105 - protein, 17 aa, Cryptosporidium parvum
YKLYWKLMLTCGVATIC

SEQ ID NO: 2250106 - protein, 17 aa, Cryptosporidium parvum
YLKILLIIIERIGMDLT

SEQ ID NO: 2250107 - protein, 17 aa, Cryptosporidium parvum
YLPCQLLITSLGFKPKY

SEQ ID NO: 2250108 - protein, 19 aa, Cryptosporidium parvum
YLRIPLLLQFFSDENRINS

SEQ ID NO: 2250109 - protein, 20 aa, Cryptosporidium parvum
YLRYLYACRIILYSKNYNLI

SEQ ID NO: 2250110 - protein, 24 aa, Cryptosporidium parvum
YLSDWIFIYELLTGYFPLEVIPGE

SEQ ID NO: 2250111 - protein, 18 aa, Cryptosporidium parvum
YLVVIFFTILCENIDEKL

SEQ ID NO: 2250112 - protein, 20 aa, Cryptosporidium parvum
YLYILVIFKVNYVISIRNNK

SEQ ID NO: 2250113 - protein, 21 aa, Cryptosporidium parvum
YMESFFKYFYQYIYITYYQLF

SEQ ID NO: 2250114 - protein, 20 aa, Cryptosporidium parvum
YNDFLFEFIIKFILKQESCQ

SEQ ID NO: 2250115 - protein, 18 aa, Cryptosporidium parvum
YNELLFYSHFRWLKGEYI

SEQ ID NO: 2250116 - protein, 19 aa, Cryptosporidium parvum
YNYHYFWDPALLLNAFYSQ

SEQ ID NO: 2250117 - protein, 17 aa, Cryptosporidium parvum
YPKFLNFSLLKSSLFDY

SEQ ID NO: 2250118 - protein, 18 aa, Cryptosporidium parvum
YQDGFLSSLWKFIKNIYF

SEQ ID NO: 2250119 - protein, 21 aa, Cryptosporidium parvum
YQLLRFQPLVIKAFLGRLVFP

SEQ ID NO: 2250120 - protein, 18 aa, Cryptosporidium parvum
YQLYILLVFLIESSDWFI

SEQ ID NO: 2250121 - protein, 17 aa, Cryptosporidium parvum
YRFWEKKPKYVHKNING

SEQ ID NO: 2250122 - protein, 18 aa, Cryptosporidium parvum
YTLILTFKWELFIIFSLV

SEQ ID NO: 2250123 - protein, 22 aa, Cryptosporidium parvum
YTLLTIFIIMFITTFINYSIEI

SEQ ID NO: 2250124 - protein, 17 aa, Cryptosporidium parvum
YTTTPFWSLTILNSPFL

SEQ ID NO: 2250125 - protein, 20 aa, Cryptosporidium parvum
YVGLLVIISGIWLVSRLAKI

SEQ ID NO: 2250126 - protein, 17 aa, Cryptosporidium parvum
YVKFKTLLTYLFTYFKE

SEQ ID NO: 2250127 - protein, 21 aa, Cryptosporidium parvum
YVSLFNPFLIPIILDCFSVII

SEQ ID NO: 2250128 - protein, 25 aa, Cryptosporidium parvum
YVSRYLYLVVSLLDLPYFVDSFSLF

SEQ ID NO: 2250129 - protein, 20 aa, Cryptosporidium parvum
YWYFSKLKWSWTIALFILCY

SEQ ID NO: 2250130 - protein, 22 aa, Cryptosporidium parvum
YWYRVFRSLSLLLYFSRKYIKE

SEQ ID NO: 2250131 - protein, 21 aa, Cryptosporidium parvum
YYLFFIVIINILILSNGATVP

SEQ ID NO: 2250132 - protein, 17 aa, Cryptosporidium parvum
YYLFYSTLSWFSSSFSG

SEQ ID NO: 2250133 - protein, 21 aa, Cryptosporidium parvum
YYLLTFFTFNFILKALIPASI

SEQ ID NO: 2250134 - protein, 17 aa, Cryptosporidium parvum
YYMMIYDLEWTWKYILS

SEQ ID NO: 2250135 - protein, 25 aa, Cryptosporidium parvum
YYYYYYYYIILMPILMDKLNNPLYC

SEQ ID NO: 2250136 - protein, 8 aa, Cryptosporidium parvum
GPPGTGKT

SEQ ID NO: 2250137 - protein, 4 aa, Cryptosporidium parvum
AGGL

SEQ ID NO: 2250138 - protein, 8 aa, Cryptosporidium parvum
EPSDTIEN

SEQ ID NO: 2250139 - protein, 12 aa, Cryptosporidium parvum
KIQDKEGIPPDQ

SEQ ID NO: 2250140 - protein, 8 aa, Cryptosporidium parvum
QLEDGRTL

SEQ ID NO: 2250141 - protein, 4 aa, Cryptosporidium parvum
SSSI

SEQ ID NO: 2250142 - protein, 4 aa, Cryptosporidium parvum
TPEE

SEQ ID NO: 2250143 - protein, 4 aa, Cryptosporidium parvum
DEID

SEQ ID NO: 2250144 - protein, 4 aa, Cryptosporidium parvum
GNPL

SEQ ID NO: 2250145 - protein, 5 aa, Cryptosporidium parvum
IQKES

SEQ ID NO: 2250146 - protein, 4 aa, Cryptosporidium parvum
ISDE

SEQ ID NO: 2250147 - protein, 4 aa, Cryptosporidium parvum
KDLE

SEQ ID NO: 2250148 - protein, 8 aa, Cryptosporidium parvum
MKEKRPDI

SEQ ID NO: 2250149 - protein, 4 aa, Cryptosporidium parvum
NKIT

SEQ ID NO: 2250150 - protein, 4 aa, Cryptosporidium parvum
NSEI

SEQ ID NO: 2250151 - protein, 4 aa, Cryptosporidium parvum
NSLE

SEQ ID NO: 2250152 - protein, 13 aa, Cryptosporidium parvum
PGDPGPPGGDCSG

SEQ ID NO: 2250153 - protein, 5 aa, Cryptosporidium parvum
PPGCG

SEQ ID NO: 2250154 - protein, 5 aa, Cryptosporidium parvum
TPLQN

SEQ ID NO: 2250155 - protein, 17 aa, Cryptosporidium parvum
VERVSSSRNADKFKEDM

SEQ ID NO: 2250156 - protein, 11 aa, Cryptosporidium parvum
YGTAGSESKVE

SEQ ID NO: 2250157 - protein, 6 aa, Cryptosporidium parvum
AAGKTT

SEQ ID NO: 2250158 - protein, 13 aa, Cryptosporidium parvum
ADVGYNSKPEINL

SEQ ID NO: 2250159 - protein, 4 aa, Cryptosporidium parvum
AGET

SEQ ID NO: 2250160 - protein, 6 aa, Cryptosporidium parvum
AGQERF

SEQ ID NO: 2250161 - protein, 7 aa, Cryptosporidium parvum
AGQERYR

SEQ ID NO: 2250162 - protein, 4 aa, Cryptosporidium parvum
ANER

SEQ ID NO: 2250163 - protein, 7 aa, Cryptosporidium parvum
ASDDRGI

SEQ ID NO: 2250164 - protein, 4 aa, Cryptosporidium parvum
ATEL

SEQ ID NO: 2250165 - protein, 4 aa, Cryptosporidium parvum
ATQI

SEQ ID NO: 2250166 - protein, 4 aa, Cryptosporidium parvum
DDQY

SEQ ID NO: 2250167 - protein, 5 aa, Cryptosporidium parvum
DEKEY

SEQ ID NO: 2250168 - protein, 4 aa, Cryptosporidium parvum
DGVT

SEQ ID NO: 2250169 - protein, 4 aa, Cryptosporidium parvum
DKSN

SEQ ID NO: 2250170 - protein, 10 aa, Cryptosporidium parvum
DLKGQEKSVF

SEQ ID NO: 2250171 - protein, 8 aa, Cryptosporidium parvum
DPSTAKSQ

SEQ ID NO: 2250172 - protein, 4 aa, Cryptosporidium parvum
DPTV

SEQ ID NO: 2250173 - protein, 4 aa, Cryptosporidium parvum
DQRN

SEQ ID NO: 2250174 - protein, 4 aa, Cryptosporidium parvum
DSED

SEQ ID NO: 2250175 - protein, 4 aa, Cryptosporidium parvum
DSEK

SEQ ID NO: 2250176 - protein, 5 aa, Cryptosporidium parvum
DSSWE

SEQ ID NO: 2250177 - protein, 4 aa, Cryptosporidium parvum
DVNE

SEQ ID NO: 2250178 - protein, 4 aa, Cryptosporidium parvum
DYYS

SEQ ID NO: 2250179 - protein, 4 aa, Cryptosporidium parvum
EDES

SEQ ID NO: 2250180 - protein, 5 aa, Cryptosporidium parvum
EDPKE

SEQ ID NO: 2250181 - protein, 5 aa, Cryptosporidium parvum
EDSNL

SEQ ID NO: 2250182 - protein, 4 aa, Cryptosporidium parvum
EEAI

SEQ ID NO: 2250183 - protein, 4 aa, Cryptosporidium parvum
EEDD

SEQ ID NO: 2250184 - protein, 4 aa, Cryptosporidium parvum
EEDI

SEQ ID NO: 2250185 - protein, 4 aa, Cryptosporidium parvum
EESS

SEQ ID NO: 2250186 - protein, 4 aa, Cryptosporidium parvum
EETN

SEQ ID NO: 2250187 - protein, 5 aa, Cryptosporidium parvum
EITSN

SEQ ID NO: 2250188 - protein, 4 aa, Cryptosporidium parvum
EKDS

SEQ ID NO: 2250189 - protein, 5 aa, Cryptosporidium parvum
ELEEE

SEQ ID NO: 2250190 - protein, 4 aa, Cryptosporidium parvum
ELKE

SEQ ID NO: 2250191 - protein, 4 aa, Cryptosporidium parvum
ENEE

SEQ ID NO: 2250192 - protein, 4 aa, Cryptosporidium parvum
ENNE

SEQ ID NO: 2250193 - protein, 4 aa, Cryptosporidium parvum
ENRK

SEQ ID NO: 2250194 - protein, 8 aa, Cryptosporidium parvum
EQSRRDDL

SEQ ID NO: 2250195 - protein, 4 aa, Cryptosporidium parvum
ERIN

SEQ ID NO: 2250196 - protein, 4 aa, Cryptosporidium parvum
ERTI

SEQ ID NO: 2250197 - protein, 4 aa, Cryptosporidium parvum
ESED

SEQ ID NO: 2250198 - protein, 4 aa, Cryptosporidium parvum
ESIT

SEQ ID NO: 2250199 - protein, 4 aa, Cryptosporidium parvum
ETGK

SEQ ID NO: 2250200 - protein, 7 aa, Cryptosporidium parvum
ETGSGKT

SEQ ID NO: 2250201 - protein, 10 aa, Cryptosporidium parvum
ETGSGKTTQI

SEQ ID NO: 2250202 - protein, 4 aa, Cryptosporidium parvum
ETSV

SEQ ID NO: 2250203 - protein, 4 aa, Cryptosporidium parvum
FESD

SEQ ID NO: 2250204 - protein, 4 aa, Cryptosporidium parvum
FGSN

SEQ ID NO: 2250205 - protein, 5 aa, Cryptosporidium parvum
FSESG

SEQ ID NO: 2250206 - protein, 6 aa, Cryptosporidium parvum
FSPSGK

SEQ ID NO: 2250207 - protein, 4 aa, Cryptosporidium parvum
GAGN

SEQ ID NO: 2250208 - protein, 4 aa, Cryptosporidium parvum
GDPS

SEQ ID NO: 2250209 - protein, 4 aa, Cryptosporidium parvum
GENS

SEQ ID NO: 2250210 - protein, 4 aa, Cryptosporidium parvum
GERS

SEQ ID NO: 2250211 - protein, 4 aa, Cryptosporidium parvum
GGDG

SEQ ID NO: 2250212 - protein, 4 aa, Cryptosporidium parvum
GKST

SEQ ID NO: 2250213 - protein, 5 aa, Cryptosporidium parvum
GQDKI

SEQ ID NO: 2250214 - protein, 10 aa, Cryptosporidium parvum
GQTNYSAANS

SEQ ID NO: 2250215 - protein, 7 aa, Cryptosporidium parvum
GSDENGI

SEQ ID NO: 2250216 - protein, 5 aa, Cryptosporidium parvum
GTFRP

SEQ ID NO: 2250217 - protein, 4 aa, Cryptosporidium parvum
IDPS

SEQ ID NO: 2250218 - protein, 4 aa, Cryptosporidium parvum
IEAS

SEQ ID NO: 2250219 - protein, 4 aa, Cryptosporidium parvum
IEDS

SEQ ID NO: 2250220 - protein, 4 aa, Cryptosporidium parvum
IEGS

SEQ ID NO: 2250221 - protein, 4 aa, Cryptosporidium parvum
IEKS

SEQ ID NO: 2250222 - protein, 4 aa, Cryptosporidium parvum
IQLE

SEQ ID NO: 2250223 - protein, 4 aa, Cryptosporidium parvum
IQQN

SEQ ID NO: 2250224 - protein, 26 aa, Cryptosporidium parvum
IRIPPKKDFSTPPIKKEADTSIQTKS

SEQ ID NO: 2250225 - protein, 4 aa, Cryptosporidium parvum
ISNS

SEQ ID NO: 2250226 - protein, 6 aa, Cryptosporidium parvum
ISSNGQ

SEQ ID NO: 2250227 - protein, 4 aa, Cryptosporidium parvum
ISTL

SEQ ID NO: 2250228 - protein, 5 aa, Cryptosporidium parvum
ITKKE

SEQ ID NO: 2250229 - protein, 4 aa, Cryptosporidium parvum
ITSY

SEQ ID NO: 2250230 - protein, 4 aa, Cryptosporidium parvum
KEEE

SEQ ID NO: 2250231 - protein, 4 aa, Cryptosporidium parvum
KEKI

SEQ ID NO: 2250232 - protein, 4 aa, Cryptosporidium parvum
KELD

SEQ ID NO: 2250233 - protein, 4 aa, Cryptosporidium parvum
KESF

SEQ ID NO: 2250234 - protein, 4 aa, Cryptosporidium parvum
KEVE

SEQ ID NO: 2250235 - protein, 4 aa, Cryptosporidium parvum
KGYS

SEQ ID NO: 2250236 - protein, 4 aa, Cryptosporidium parvum
KISS

SEQ ID NO: 2250237 - protein, 5 aa, Cryptosporidium parvum
KLPSS

SEQ ID NO: 2250238 - protein, 5 aa, Cryptosporidium parvum
KNKER

SEQ ID NO: 2250239 - protein, 4 aa, Cryptosporidium parvum
KNNS

SEQ ID NO: 2250240 - protein, 5 aa, Cryptosporidium parvum
KRTNS

SEQ ID NO: 2250241 - protein, 4 aa, Cryptosporidium parvum
KSAL

SEQ ID NO: 2250242 - protein, 4 aa, Cryptosporidium parvum
KSDE

SEQ ID NO: 2250243 - protein, 4 aa, Cryptosporidium parvum
KSKD

SEQ ID NO: 2250244 - protein, 4 aa, Cryptosporidium parvum
KTGI

SEQ ID NO: 2250245 - protein, 4 aa, Cryptosporidium parvum
KTQR

SEQ ID NO: 2250246 - protein, 4 aa, Cryptosporidium parvum
KTSN

SEQ ID NO: 2250247 - protein, 4 aa, Cryptosporidium parvum
LDPS

SEQ ID NO: 2250248 - protein, 4 aa, Cryptosporidium parvum
LEEQ

SEQ ID NO: 2250249 - protein, 6 aa, Cryptosporidium parvum
LENQDD

SEQ ID NO: 2250250 - protein, 4 aa, Cryptosporidium parvum
LESN

SEQ ID NO: 2250251 - protein, 4 aa, Cryptosporidium parvum
LESS

SEQ ID NO: 2250252 - protein, 27 aa, Cryptosporidium parvum
LKIPPKKDFSTPPIKKEADTSIQTKSN

SEQ ID NO: 2250253 - protein, 27 aa, Cryptosporidium parvum
LKIPPKKDFSTPPVKKEADTSIQTKSN

SEQ ID NO: 2250254 - protein, 27 aa, Cryptosporidium parvum
LKIPPKKDLSTPPVKKEADTSIQTKSN

SEQ ID NO: 2250255 - protein, 5 aa, Cryptosporidium parvum
LNEDE

SEQ ID NO: 2250256 - protein, 4 aa, Cryptosporidium parvum
LNEG

SEQ ID NO: 2250257 - protein, 4 aa, Cryptosporidium parvum
LNNE

SEQ ID NO: 2250258 - protein, 15 aa, Cryptosporidium parvum
LNNVGSEKEDRHNNE

SEQ ID NO: 2250259 - protein, 4 aa, Cryptosporidium parvum
LPPG

SEQ ID NO: 2250260 - protein, 5 aa, Cryptosporidium parvum
LSENE

SEQ ID NO: 2250261 - protein, 4 aa, Cryptosporidium parvum
LSSE

SEQ ID NO: 2250262 - protein, 5 aa, Cryptosporidium parvum
LSSSS

SEQ ID NO: 2250263 - protein, 4 aa, Cryptosporidium parvum
MGGA

SEQ ID NO: 2250264 - protein, 9 aa, Cryptosporidium parvum
NAGPNTNGS

SEQ ID NO: 2250265 - protein, 4 aa, Cryptosporidium parvum
NEEN

SEQ ID NO: 2250266 - protein, 5 aa, Cryptosporidium parvum
NIKSE

SEQ ID NO: 2250267 - protein, 4 aa, Cryptosporidium parvum
NINS

SEQ ID NO: 2250268 - protein, 4 aa, Cryptosporidium parvum
NKPL

SEQ ID NO: 2250269 - protein, 5 aa, Cryptosporidium parvum
NNRDS

SEQ ID NO: 2250270 - protein, 4 aa, Cryptosporidium parvum
NNYN

SEQ ID NO: 2250271 - protein, 4 aa, Cryptosporidium parvum
NPER

SEQ ID NO: 2250272 - protein, 4 aa, Cryptosporidium parvum
NQNE

SEQ ID NO: 2250273 - protein, 4 aa, Cryptosporidium parvum
NRSR

SEQ ID NO: 2250274 - protein, 5 aa, Cryptosporidium parvum
NSKLN

SEQ ID NO: 2250275 - protein, 5 aa, Cryptosporidium parvum
NSPIT

SEQ ID NO: 2250276 - protein, 4 aa, Cryptosporidium parvum
NSSQ

SEQ ID NO: 2250277 - protein, 4 aa, Cryptosporidium parvum
NTNE

SEQ ID NO: 2250278 - protein, 4 aa, Cryptosporidium parvum
NTPK

SEQ ID NO: 2250279 - protein, 4 aa, Cryptosporidium parvum
PASN

SEQ ID NO: 2250280 - protein, 5 aa, Cryptosporidium parvum
PDLEP

SEQ ID NO: 2250281 - protein, 4 aa, Cryptosporidium parvum
PEKL

SEQ ID NO: 2250282 - protein, 4 aa, Cryptosporidium parvum
PESE

SEQ ID NO: 2250283 - protein, 4 aa, Cryptosporidium parvum
PGRL

SEQ ID NO: 2250284 - protein, 4 aa, Cryptosporidium parvum
PNEN

SEQ ID NO: 2250285 - protein, 4 aa, Cryptosporidium parvum
PNNV

SEQ ID NO: 2250286 - protein, 4 aa, Cryptosporidium parvum
PNVP

SEQ ID NO: 2250287 - protein, 5 aa, Cryptosporidium parvum
PPLPD

SEQ ID NO: 2250288 - protein, 4 aa, Cryptosporidium parvum
PPSL

SEQ ID NO: 2250289 - protein, 4 aa, Cryptosporidium parvum
QKNI

SEQ ID NO: 2250290 - protein, 4 aa, Cryptosporidium parvum
QKNL

SEQ ID NO: 2250291 - protein, 4 aa, Cryptosporidium parvum
QSSS

SEQ ID NO: 2250292 - protein, 4 aa, Cryptosporidium parvum
QTLS

SEQ ID NO: 2250293 - protein, 4 aa, Cryptosporidium parvum
QTNF

SEQ ID NO: 2250294 - protein, 4 aa, Cryptosporidium parvum
RDPR

SEQ ID NO: 2250295 - protein, 4 aa, Cryptosporidium parvum
REEA

SEQ ID NO: 2250296 - protein, 4 aa, Cryptosporidium parvum
RFSD

SEQ ID NO: 2250297 - protein, 4 aa, Cryptosporidium parvum
RFTE

SEQ ID NO: 2250298 - protein, 4 aa, Cryptosporidium parvum
RIGQ

SEQ ID NO: 2250299 - protein, 4 aa, Cryptosporidium parvum
RLSG

SEQ ID NO: 2250300 - protein, 4 aa, Cryptosporidium parvum
RNGT

SEQ ID NO: 2250301 - protein, 11 aa, Cryptosporidium parvum
RSANNDSLRDI

SEQ ID NO: 2250302 - protein, 4 aa, Cryptosporidium parvum
SAPN

SEQ ID NO: 2250303 - protein, 4 aa, Cryptosporidium parvum
SDDG

SEQ ID NO: 2250304 - protein, 4 aa, Cryptosporidium parvum
SDQK

SEQ ID NO: 2250305 - protein, 4 aa, Cryptosporidium parvum
SDSG

SEQ ID NO: 2250306 - protein, 4 aa, Cryptosporidium parvum
SEEI

SEQ ID NO: 2250307 - protein, 4 aa, Cryptosporidium parvum
SEIE

SEQ ID NO: 2250308 - protein, 4 aa, Cryptosporidium parvum
SESL

SEQ ID NO: 2250309 - protein, 44 aa, Cryptosporidium parvum
SETTPAPPPTPTATINPEPTKTPTDIPKESSTPPQPQPPAEESS

SEQ ID NO: 2250310 - protein, 4 aa, Cryptosporidium parvum
SGIE

SEQ ID NO: 2250311 - protein, 4 aa, Cryptosporidium parvum
SGQN

SEQ ID NO: 2250312 - protein, 5 aa, Cryptosporidium parvum
SGVAG

SEQ ID NO: 2250313 - protein, 4 aa, Cryptosporidium parvum
SKES

SEQ ID NO: 2250314 - protein, 4 aa, Cryptosporidium parvum
SKNI

SEQ ID NO: 2250315 - protein, 7 aa, Cryptosporidium parvum
SLGPKGM

SEQ ID NO: 2250316 - protein, 4 aa, Cryptosporidium parvum
SNEK

SEQ ID NO: 2250317 - protein, 4 aa, Cryptosporidium parvum
SNGL

SEQ ID NO: 2250318 - protein, 4 aa, Cryptosporidium parvum
SNKF

SEQ ID NO: 2250319 - protein, 4 aa, Cryptosporidium parvum
SNNN

SEQ ID NO: 2250320 - protein, 4 aa, Cryptosporidium parvum
SNPQ

SEQ ID NO: 2250321 - protein, 4 aa, Cryptosporidium parvum
SNSV

SEQ ID NO: 2250322 - protein, 4 aa, Cryptosporidium parvum
SQGE

SEQ ID NO: 2250323 - protein, 5 aa, Cryptosporidium parvum
SRNNI

SEQ ID NO: 2250324 - protein, 4 aa, Cryptosporidium parvum
SSDG

SEQ ID NO: 2250325 - protein, 4 aa, Cryptosporidium parvum
SSER

SEQ ID NO: 2250326 - protein, 5 aa, Cryptosporidium parvum
SSIEG

SEQ ID NO: 2250327 - protein, 6 aa, Cryptosporidium parvum
SSNFES

SEQ ID NO: 2250328 - protein, 4 aa, Cryptosporidium parvum
SSNT

SEQ ID NO: 2250329 - protein, 4 aa, Cryptosporidium parvum
SSPI

SEQ ID NO: 2250330 - protein, 4 aa, Cryptosporidium parvum
SSQI

SEQ ID NO: 2250331 - protein, 4 aa, Cryptosporidium parvum
SSSL

SEQ ID NO: 2250332 - protein, 6 aa, Cryptosporidium parvum
SSSTIE

SEQ ID NO: 2250333 - protein, 17 aa, Cryptosporidium parvum
STASGKSVSIDEESLNR

SEQ ID NO: 2250334 - protein, 4 aa, Cryptosporidium parvum
STPI

SEQ ID NO: 2250335 - protein, 5 aa, Cryptosporidium parvum
TENEE

SEQ ID NO: 2250336 - protein, 5 aa, Cryptosporidium parvum
TENHK

SEQ ID NO: 2250337 - protein, 4 aa, Cryptosporidium parvum
TESK

SEQ ID NO: 2250338 - protein, 13 aa, Cryptosporidium parvum
TIPETGSGSDHAP

SEQ ID NO: 2250339 - protein, 4 aa, Cryptosporidium parvum
TNLT

SEQ ID NO: 2250340 - protein, 4 aa, Cryptosporidium parvum
TPLQ

SEQ ID NO: 2250341 - protein, 4 aa, Cryptosporidium parvum
TQNS

SEQ ID NO: 2250342 - protein, 5 aa, Cryptosporidium parvum
TVSGG

SEQ ID NO: 2250343 - protein, 13 aa, Cryptosporidium parvum
VGGSPSGGSPIGR

SEQ ID NO: 2250344 - protein, 4 aa, Cryptosporidium parvum
YRGA

SEQ ID NO: 2250345 - protein, 8 aa, Cryptosporidium parvum
AAAAAAAA

SEQ ID NO: 2250346 - protein, 18 aa, Cryptosporidium parvum
AAAAAAAANNAASSTIQN

SEQ ID NO: 2250347 - protein, 12 aa, Cryptosporidium parvum
AAAAAAAANPYN

SEQ ID NO: 2250348 - protein, 23 aa, Cryptosporidium parvum
AAAAAAAAVGSNNTHIGSGSSNS

SEQ ID NO: 2250349 - protein, 35 aa, Cryptosporidium parvum
AAAAAIASTPTKSQAPTKDHASSQSTATPQPQVRG

SEQ ID NO: 2250350 - protein, 24 aa, Cryptosporidium parvum
AAAAGGRAKRKKWSKGKQKDKANH

SEQ ID NO: 2250351 - protein, 32 aa, Cryptosporidium parvum
AAAASATNATANFSASNPPSPSLGSKKRTIDA

SEQ ID NO: 2250352 - protein, 26 aa, Cryptosporidium parvum
AAAATAATSTGSGGQAQIPAQPQNMP

SEQ ID NO: 2250353 - protein, 5 aa, Cryptosporidium parvum
AAAEE

SEQ ID NO: 2250354 - protein, 10 aa, Cryptosporidium parvum
AAANGYVRGE

SEQ ID NO: 2250355 - protein, 15 aa, Cryptosporidium parvum
AAANQRSGRAGRVRP

SEQ ID NO: 2250356 - protein, 8 aa, Cryptosporidium parvum
AAASPSMQ

SEQ ID NO: 2250357 - protein, 8 aa, Cryptosporidium parvum
AACGTDKG

SEQ ID NO: 2250358 - protein, 11 aa, Cryptosporidium parvum
AADGVTGTSDP

SEQ ID NO: 2250359 - protein, 24 aa, Cryptosporidium parvum
AADTESKHLSQTDKDKLNKAKKGF

SEQ ID NO: 2250360 - protein, 6 aa, Cryptosporidium parvum
AADTYR

SEQ ID NO: 2250361 - protein, 47 aa, Cryptosporidium parvum
AAEAANPEVENAPELKTIEKEKSGSGRSSKSSSVESKKSGKKTSKVA

SEQ ID NO: 2250362 - protein, 6 aa, Cryptosporidium parvum
AAEKSI

SEQ ID NO: 2250363 - protein, 7 aa, Cryptosporidium parvum
AAESLAG

SEQ ID NO: 2250364 - protein, 7 aa, Cryptosporidium parvum
AAESNQR

SEQ ID NO: 2250365 - protein, 10 aa, Cryptosporidium parvum
AAGETSGNAI

SEQ ID NO: 2250366 - protein, 13 aa, Cryptosporidium parvum
AAGGNSNDKKDVD

SEQ ID NO: 2250367 - protein, 6 aa, Cryptosporidium parvum
AAGGRY

SEQ ID NO: 2250368 - protein, 8 aa, Cryptosporidium parvum
AAGGSVEP

SEQ ID NO: 2250369 - protein, 7 aa, Cryptosporidium parvum
AAGNGKH

SEQ ID NO: 2250370 - protein, 5 aa, Cryptosporidium parvum
AAGVS

SEQ ID NO: 2250371 - protein, 19 aa, Cryptosporidium parvum
AAHHNGSQYNEFSTEDARH

SEQ ID NO: 2250372 - protein, 10 aa, Cryptosporidium parvum
AAHSDDGKPV

SEQ ID NO: 2250373 - protein, 6 aa, Cryptosporidium parvum
AAIKAA

SEQ ID NO: 2250374 - protein, 6 aa, Cryptosporidium parvum
AAITNS

SEQ ID NO: 2250375 - protein, 6 aa, Cryptosporidium parvum
AAKEAN

SEQ ID NO: 2250376 - protein, 6 aa, Cryptosporidium parvum
AAKEYS

SEQ ID NO: 2250377 - protein, 4 aa, Cryptosporidium parvum
AAKK

SEQ ID NO: 2250378 - protein, 14 aa, Cryptosporidium parvum
AAKNQVARNPENTV

SEQ ID NO: 2250379 - protein, 10 aa, Cryptosporidium parvum
AAKPNRKIKT

SEQ ID NO: 2250380 - protein, 11 aa, Cryptosporidium parvum
AAKPPNGGNLD

SEQ ID NO: 2250381 - protein, 5 aa, Cryptosporidium parvum
AAKRM

SEQ ID NO: 2250382 - protein, 17 aa, Cryptosporidium parvum
AAKSDINTNNAQDSVAD

SEQ ID NO: 2250383 - protein, 10 aa, Cryptosporidium parvum
AAKSGETTVR

SEQ ID NO: 2250384 - protein, 4 aa, Cryptosporidium parvum
AAKT

SEQ ID NO: 2250385 - protein, 5 aa, Cryptosporidium parvum
AAKTG

SEQ ID NO: 2250386 - protein, 14 aa, Cryptosporidium parvum
AALEQRKKRENKNS

SEQ ID NO: 2250387 - protein, 15 aa, Cryptosporidium parvum
AALGSSIKNIGWSWR

SEQ ID NO: 2250388 - protein, 68 aa, Cryptosporidium parvum
AALNNEEKINKLDNKDDNNTNKSNNSNEKDNFNDSSNKAQNNLENDDNSHLNESNNTNENDNKIDGLS

SEQ ID NO: 2250389 - protein, 11 aa, Cryptosporidium parvum
AANDKKTDPKI

SEQ ID NO: 2250390 - protein, 35 aa, Cryptosporidium parvum; identical to SEQ ID NO: 2135295

SEQ ID NO: 2250391 - protein, 11 aa, Cryptosporidium parvum
AANKDEIAYSD

SEQ ID NO: 2250392 - protein, 4 aa, Cryptosporidium parvum
AANN

SEQ ID NO: 2250393 - protein, 9 aa, Cryptosporidium parvum
AANNDNTSN

SEQ ID NO: 2250394 - protein, 17 aa, Cryptosporidium parvum
AANQQLKSSKQLGSQKL

SEQ ID NO: 2250395 - protein, 12 aa, Cryptosporidium parvum
AANSKSNQKNLG

SEQ ID NO: 2250396 - protein, 31 aa, Cryptosporidium parvum
AAPAEPEPEPNKEEPKEEQKTEEPAATSWWG

SEQ ID NO: 2250397 - protein, 19 aa, Cryptosporidium parvum
AAPAEQRGIPAKRPAPDYF

SEQ ID NO: 2250398 - protein, 9 aa, Cryptosporidium parvum
AAPGGKTTY

SEQ ID NO: 2250399 - protein, 16 aa, Cryptosporidium parvum
AAPHPGSSTQFHQGQY

SEQ ID NO: 2250400 - protein, 8 aa, Cryptosporidium parvum
AAPPDNSD

SEQ ID NO: 2250401 - protein, 22 aa, Cryptosporidium parvum
AAPSPSLDKKSSSKKQSSKVGA

SEQ ID NO: 2250402 - protein, 9 aa, Cryptosporidium parvum
AAQKSLKDP

SEQ ID NO: 2250403 - protein, 6 aa, Cryptosporidium parvum
AAQRQF

SEQ ID NO: 2250404 - protein, 9 aa, Cryptosporidium parvum
AAQSKTRDE

SEQ ID NO: 2250405 - protein, 10 aa, Cryptosporidium parvum
AARAKDLRRN

SEQ ID NO: 2250406 - protein, 9 aa, Cryptosporidium parvum
AARDSNNVP

SEQ ID NO: 2250407 - protein, 13 aa, Cryptosporidium parvum
AARGALSTRARVP

SEQ ID NO: 2250408 - protein, 8 aa, Cryptosporidium parvum
AARGNGTS

SEQ ID NO: 2250409 - protein, 5 aa, Cryptosporidium parvum
AARGQ

SEQ ID NO: 2250410 - protein, 6 aa, Cryptosporidium parvum
AARRAQ

SEQ ID NO: 2250411 - protein, 7 aa, Cryptosporidium parvum
AASAQTA

SEQ ID NO: 2250412 - protein, 25 aa, Cryptosporidium parvum
AASEYSCSSGSFRDLNSSAEQTTFE

SEQ ID NO: 2250413 - protein, 6 aa, Cryptosporidium parvum
AASIRD

SEQ ID NO: 2250414 - protein, 5 aa, Cryptosporidium parvum
AASNT

SEQ ID NO: 2250415 - protein, 24 aa, Cryptosporidium parvum
AASPPKPASGAAAGGAAPAQPKED

SEQ ID NO: 2250416 - protein, 12 aa, Cryptosporidium parvum
AASQQTNKSDVK

SEQ ID NO: 2250417 - protein, 4 aa, Cryptosporidium parvum
AASS

SEQ ID NO: 2250418 - protein, 5 aa, Cryptosporidium parvum
AASSD

SEQ ID NO: 2250419 - protein, 13 aa, Cryptosporidium parvum
AASSNTISIWDLL

SEQ ID NO: 2250420 - protein, 8 aa, Cryptosporidium parvum
AASSPHSS

SEQ ID NO: 2250421 - protein, 14 aa, Cryptosporidium parvum
AATAQDDISGDGTT

SEQ ID NO: 2250422 - protein, 6 aa, Cryptosporidium parvum
AATEGV

SEQ ID NO: 2250423 - protein, 9 aa, Cryptosporidium parvum
AATGRGRGR

SEQ ID NO: 2250424 - protein, 7 aa, Cryptosporidium parvum
AATKSVA

SEQ ID NO: 2250425 - protein, 4 aa, Cryptosporidium parvum
AATS

SEQ ID NO: 2250426 - protein, 8 aa, Cryptosporidium parvum
AATSGKAF

SEQ ID NO: 2250427 - protein, 7 aa, Cryptosporidium parvum
AATSSIS

SEQ ID NO: 2250428 - protein, 30 aa, Cryptosporidium parvum
AAVDSAAAANEWGGVSGNWGGSAADEWRNA

SEQ ID NO: 2250429 - protein, 18 aa, Cryptosporidium parvum
AAVNGQKSVTISGKKESV

SEQ ID NO: 2250430 - protein, 8 aa, Cryptosporidium parvum
AAVNKPRN

SEQ ID NO: 2250431 - protein, 6 aa, Cryptosporidium parvum
AAVNPE

SEQ ID NO: 2250432 - protein, 4 aa, Cryptosporidium parvum
AAVS

SEQ ID NO: 2250433 - protein, 6 aa, Cryptosporidium parvum
AAYRAT

SEQ ID NO: 2250434 - protein, 6 aa, Cryptosporidium parvum
AAYSPA

SEQ ID NO: 2250435 - protein, 5 aa, Cryptosporidium parvum
ACDAL

SEQ ID NO: 2250436 - protein, 31 aa, Cryptosporidium parvum
ACGPSTEAEKRLARSKRFGSTSEDDKRKLRQ

SEQ ID NO: 2250437 - protein, 7 aa, Cryptosporidium parvum
ACKNGDN

SEQ ID NO: 2250438 - protein, 14 aa, Cryptosporidium parvum
ACQESNKYVTSEEK

SEQ ID NO: 2250439 - protein, 5 aa, Cryptosporidium parvum
ACSNS

SEQ ID NO: 2250440 - protein, 8 aa, Cryptosporidium parvum
ACTGSGKT

SEQ ID NO: 2250441 - protein, 4 aa, Cryptosporidium parvum
ACTH

SEQ ID NO: 2250442 - protein, 14 aa, Cryptosporidium parvum
ACTSTGKKGAQVGD

SEQ ID NO: 2250443 - protein, 4 aa, Cryptosporidium parvum
ADAL

SEQ ID NO: 2250444 - protein, 30 aa, Cryptosporidium parvum
ADASKKMESDQDQNKDLEIKPKDEKKTKLS

SEQ ID NO: 2250445 - protein, 7 aa, Cryptosporidium parvum
ADASKSS

SEQ ID NO: 2250446 - protein, 12 aa, Cryptosporidium parvum
ADCRAKTSSGCT

SEQ ID NO: 2250447 - protein, 41 aa, Cryptosporidium parvum
ADDGTSKLAELEDTSPKKKSKTRLKNSKSSKFTTKTNQEIK

SEQ ID NO: 2250448 - protein, 20 aa, Cryptosporidium parvum
ADDHFDDSQIDGTTNQLEIS

SEQ ID NO: 2250449 - protein, 9 aa, Cryptosporidium parvum
ADDNNVEMN

SEQ ID NO: 2250450 - protein, 6 aa, Cryptosporidium parvum
ADDNQY

SEQ ID NO: 2250451 - protein, 8 aa, Cryptosporidium parvum
ADDSGDIT

SEQ ID NO: 2250452 - protein, 6 aa, Cryptosporidium parvum
ADDSNF

SEQ ID NO: 2250453 - protein, 8 aa, Cryptosporidium parvum
ADDSRFDP

SEQ ID NO: 2250454 - protein, 14 aa, Cryptosporidium parvum
ADDTLNPGLNDSET

SEQ ID NO: 2250455 - protein, 12 aa, Cryptosporidium parvum
ADEEDISGGNKK

SEQ ID NO: 2250456 - protein, 6 aa, Cryptosporidium parvum
ADEEEL

SEQ ID NO: 2250457 - protein, 7 aa, Cryptosporidium parvum
ADEEFSE

SEQ ID NO: 2250458 - protein, 6 aa, Cryptosporidium parvum
ADEEVD

SEQ ID NO: 2250459 - protein, 5 aa, Cryptosporidium parvum
ADENG

SEQ ID NO: 2250460 - protein, 14 aa, Cryptosporidium parvum
ADENQDNYGDEQIS

SEQ ID NO: 2250461 - protein, 9 aa, Cryptosporidium parvum
ADESTGTIK

SEQ ID NO: 2250462 - protein, 6 aa, Cryptosporidium parvum
ADETVA

SEQ ID NO: 2250463 - protein, 10 aa, Cryptosporidium parvum
ADFSSSENYQ

SEQ ID NO: 2250464 - protein, 9 aa, Cryptosporidium parvum
ADGASYEGE

SEQ ID NO: 2250465 - protein, 13 aa, Cryptosporidium parvum
ADGEDEEVHYEGD

SEQ ID NO: 2250466 - protein, 7 aa, Cryptosporidium parvum
ADGGSGI

SEQ ID NO: 2250467 - protein, 5 aa, Cryptosporidium parvum
ADGLK

SEQ ID NO: 2250468 - protein, 8 aa, Cryptosporidium parvum
ADGLPNIG

SEQ ID NO: 2250469 - protein, 31 aa, Cryptosporidium parvum
ADGNATTCETTPCKSKNLKSDKFGVETTGRR

SEQ ID NO: 2250470 - protein, 7 aa, Cryptosporidium parvum
ADGQGWH

SEQ ID NO: 2250471 - protein, 7 aa, Cryptosporidium parvum
ADGQSNS

SEQ ID NO: 2250472 - protein, 4 aa, Cryptosporidium parvum
ADGS

SEQ ID NO: 2250473 - protein, 6 aa, Cryptosporidium parvum
ADGSEI

SEQ ID NO: 2250474 - protein, 7 aa, Cryptosporidium parvum
ADGSYLE

SEQ ID NO: 2250475 - protein, 7 aa, Cryptosporidium parvum
ADGTLHS

SEQ ID NO: 2250476 - protein, 16 aa, Cryptosporidium parvum
ADHNQNLERGSSNHNL

SEQ ID NO: 2250477 - protein, 5 aa, Cryptosporidium parvum
ADHYE

SEQ ID NO: 2250478 - protein, 8 aa, Cryptosporidium parvum
ADIDNDEG

SEQ ID NO: 2250479 - protein, 6 aa, Cryptosporidium parvum
ADITSR

SEQ ID NO: 2250480 - protein, 6 aa, Cryptosporidium parvum
ADKISE

SEQ ID NO: 2250481 - protein, 20 aa, Cryptosporidium parvum
ADKNENGKTLNQNQEEKNHV

SEQ ID NO: 2250482 - protein, 6 aa, Cryptosporidium parvum
ADKNYQ

SEQ ID NO: 2250483 - protein, 17 aa, Cryptosporidium parvum
ADKPQPGSLSSGGYGPS

SEQ ID NO: 2250484 - protein, 10 aa, Cryptosporidium parvum
ADKSSPANLE

SEQ ID NO: 2250485 - protein, 35 aa, Cryptosporidium parvum; identical to SEQ ID NO: 2135369

SEQ ID NO: 2250486 - protein, 9 aa, Cryptosporidium parvum
ADLGGPPLS

SEQ ID NO: 2250487 - protein, 18 aa, Cryptosporidium parvum
ADLKEQSNPGNHQQISTN

SEQ ID NO: 2250488 - protein, 21 aa, Cryptosporidium parvum
ADLNAKASSFNNANEGLSKSQ

SEQ ID NO: 2250489 - protein, 27 aa, Cryptosporidium parvum
ADLSGSDKELDTNSQIPPHSEVGQNMG

SEQ ID NO: 2250490 - protein, 13 aa, Cryptosporidium parvum
ADLTSKWQGESEK

SEQ ID NO: 2250491 - protein, 5 aa, Cryptosporidium parvum
ADMEE

SEQ ID NO: 2250492 - protein, 4 aa, Cryptosporidium parvum
ADNA

SEQ ID NO: 2250493 - protein, 5 aa, Cryptosporidium parvum
ADNDR

SEQ ID NO: 2250494 - protein, 9 aa, Cryptosporidium parvum
ADNESDKGH

SEQ ID NO: 2250495 - protein, 6 aa, Cryptosporidium parvum
ADNGDA

SEQ ID NO: 2250496 - protein, 12 aa, Cryptosporidium parvum
ADNISKKEDQNF

SEQ ID NO: 2250497 - protein, 17 aa, Cryptosporidium parvum
ADNKNYPQNGNGFNGRN

SEQ ID NO: 2250498 - protein, 8 aa, Cryptosporidium parvum
ADNPNKKN

SEQ ID NO: 2250499 - protein, 8 aa, Cryptosporidium parvum
ADNQITSQ

SEQ ID NO: 2250500 - protein, 6 aa, Cryptosporidium parvum
ADNQSG

SEQ ID NO: 2250501 - protein, 32 aa, Cryptosporidium parvum
ADNSGVTEANSSYSSVKNKIDSIDEKSRMESS

SEQ ID NO: 2250502 - protein, 6 aa, Cryptosporidium parvum
ADNSPW

SEQ ID NO: 2250503 - protein, 9 aa, Cryptosporidium parvum
ADPDKTGKC

SEQ ID NO: 2250504 - protein, 21 aa, Cryptosporidium parvum
ADPDSGSNLIPNGKDLPFTNA

SEQ ID NO: 2250505 - protein, 8 aa, Cryptosporidium parvum
ADPDTQNV

SEQ ID NO: 2250506 - protein, 8 aa, Cryptosporidium parvum
ADPKTVGA

SEQ ID NO: 2250507 - protein, 11 aa, Cryptosporidium parvum
ADPSKAEKELG

SEQ ID NO: 2250508 - protein, 7 aa, Cryptosporidium parvum
ADPSQNE

SEQ ID NO: 2250509 - protein, 9 aa, Cryptosporidium parvum
ADPTNAEEN

SEQ ID NO: 2250510 - protein, 4 aa, Cryptosporidium parvum
ADQA

SEQ ID NO: 2250511 - protein, 7 aa, Cryptosporidium parvum
ADQDTSK

SEQ ID NO: 2250512 - protein, 23 aa, Cryptosporidium parvum
ADQENDENDSFDNYEDEDEDDID

SEQ ID NO: 2250513 - protein, 9 aa, Cryptosporidium parvum
ADQGSRGKK

SEQ ID NO: 2250514 - protein, 4 aa, Cryptosporidium parvum
ADQI

SEQ ID NO: 2250515 - protein, 10 aa, Cryptosporidium parvum
ADQKEKKKFN

SEQ ID NO: 2250516 - protein, 16 aa, Cryptosporidium parvum
ADQKRQRQSDQRRPVQ

SEQ ID NO: 2250517 - protein, 11 aa, Cryptosporidium parvum
ADQNNTNEEKQ

SEQ ID NO: 2250518 - protein, 38 aa, Cryptosporidium parvum
ADQSPTNGNNSTELGNFEEEEGGYEKEQEKEDEGIQDD

SEQ ID NO: 2250519 - protein, 16 aa, Cryptosporidium parvum
ADQSTLSQSDKREIPS

SEQ ID NO: 2250520 - protein, 6 aa, Cryptosporidium parvum
ADRDKI

SEQ ID NO: 2250521 - protein, 6 aa, Cryptosporidium parvum
ADRIAE

SEQ ID NO: 2250522 - protein, 9 aa, Cryptosporidium parvum
ADRISNTEE

SEQ ID NO: 2250523 - protein, 6 aa, Cryptosporidium parvum
ADRPTV

SEQ ID NO: 2250524 - protein, 8 aa, Cryptosporidium parvum
ADSDGSSS

SEQ ID NO: 2250525 - protein, 13 aa, Cryptosporidium parvum
ADSDSESAKNAHK

SEQ ID NO: 2250526 - protein, 6 aa, Cryptosporidium parvum
ADSGES

SEQ ID NO: 2250527 - protein, 26 aa, Cryptosporidium parvum
ADSHGLPDDDDDDDFDDDDDEDAGQV

SEQ ID NO: 2250528 - protein, 5 aa, Cryptosporidium parvum
ADSIR

SEQ ID NO: 2250529 - protein, 9 aa, Cryptosporidium parvum
ADSNGDGEI

SEQ ID NO: 2250530 - protein, 8 aa, Cryptosporidium parvum
ADSNGRQV

SEQ ID NO: 2250531 - protein, 5 aa, Cryptosporidium parvum
ADSQD

SEQ ID NO: 2250532 - protein, 8 aa, Cryptosporidium parvum
ADSSESSV

SEQ ID NO: 2250533 - protein, 6 aa, Cryptosporidium parvum
ADSSIQ

SEQ ID NO: 2250534 - protein, 25 aa, Cryptosporidium parvum
ADSVNTNSSQTNKVSYNTISQSSLS

SEQ ID NO: 2250535 - protein, 9 aa, Cryptosporidium parvum
ADTFEENSI

SEQ ID NO: 2250536 - protein, 29 aa, Cryptosporidium parvum
ADTSIQDQCRQNSNKSGNSQNGNPNTNKN

SEQ ID NO: 2250537 - protein, 15 aa, Cryptosporidium parvum
ADTTPQSLRPQLRNT

SEQ ID NO: 2250538 - protein, 13 aa, Cryptosporidium parvum
ADVNAKDKYGRTP

SEQ ID NO: 2250539 - protein, 9 aa, Cryptosporidium parvum
ADVPGEGEH

SEQ ID NO: 2250540 - protein, 43 aa, Cryptosporidium parvum
ADYNSSSGNSQTTNNNNAQNFNSIPSASNDTNNGTNHNSNDPF

SEQ ID NO: 2250541 - protein, 5 aa, Cryptosporidium parvum
ADYSN

SEQ ID NO: 2250542 - protein, 11 aa, Cryptosporidium parvum
AEAAPKTSPFG

SEQ ID NO: 2250543 - protein, 4 aa, Cryptosporidium parvum
AEAG

SEQ ID NO: 2250544 - protein, 8 aa, Cryptosporidium parvum
AEAGDFGN

SEQ ID NO: 2250545 - protein, 13 aa, Cryptosporidium parvum
AEANKNINGTGGI

SEQ ID NO: 2250546 - protein, 13 aa, Cryptosporidium parvum
AECGEKSGKKCDV

SEQ ID NO: 2250547 - protein, 10 aa, Cryptosporidium parvum
AECQKQGKEL

SEQ ID NO: 2250548 - protein, 4 aa, Cryptosporidium parvum
AEDC

SEQ ID NO: 2250549 - protein, 21 aa, Cryptosporidium parvum
AEDDDDDDVIDGKKPKKPKRM

SEQ ID NO: 2250550 - protein, 26 aa, Cryptosporidium parvum
AEDDEHNKQNSKANSPPGSDHGSCSE

SEQ ID NO: 2250551 - protein, 10 aa, Cryptosporidium parvum
AEDEGIPSTA

SEQ ID NO: 2250552 - protein, 10 aa, Cryptosporidium parvum
AEDENSSKFY

SEQ ID NO: 2250553 - protein, 10 aa, Cryptosporidium parvum
AEDEYRQKGD

SEQ ID NO: 2250554 - protein, 5 aa, Cryptosporidium parvum
AEDGD

SEQ ID NO: 2250555 - protein, 6 aa, Cryptosporidium parvum
AEDPFQ

SEQ ID NO: 2250556 - protein, 5 aa, Cryptosporidium parvum
AEEAA

SEQ ID NO: 2250557 - protein, 11 aa, Cryptosporidium parvum
AEEAQTGQCGK

SEQ ID NO: 2250558 - protein, 5 aa, Cryptosporidium parvum
AEEAV

SEQ ID NO: 2250559 - protein, 11 aa, Cryptosporidium parvum
AEEEASEDNSK

SEQ ID NO: 2250560 - protein, 14 aa, Cryptosporidium parvum
AEEFGSGNKRRLSG

SEQ ID NO: 2250561 - protein, 8 aa, Cryptosporidium parvum
AEEGAYSG

SEQ ID NO: 2250562 - protein, 7 aa, Cryptosporidium parvum
AEEKEEQ

SEQ ID NO: 2250563 - protein, 6 aa, Cryptosporidium parvum
AEEKEI

SEQ ID NO: 2250564 - protein, 9 aa, Cryptosporidium parvum
AEEKHYSSC

SEQ ID NO: 2250565 - protein, 8 aa, Cryptosporidium parvum
AEERQGEA

SEQ ID NO: 2250566 - protein, 9 aa, Cryptosporidium parvum
AEESAKETN

SEQ ID NO: 2250567 - protein, 18 aa, Cryptosporidium parvum
AEESKETKTEIQKDEEMA

SEQ ID NO: 2250568 - protein, 5 aa, Cryptosporidium parvum
AEESS

SEQ ID NO: 2250569 - protein, 5 aa, Cryptosporidium parvum
AEEYE

SEQ ID NO: 2250570 - protein, 12 aa, Cryptosporidium parvum
AEEYNNQKKTRA

SEQ ID NO: 2250571 - protein, 5 aa, Cryptosporidium parvum
AEEYT

SEQ ID NO: 2250572 - protein, 9 aa, Cryptosporidium parvum
AEGARNTLK

SEQ ID NO: 2250573 - protein, 20 aa, Cryptosporidium parvum
AEGERSEIQYDSGDYKRDPV

SEQ ID NO: 2250574 - protein, 6 aa, Cryptosporidium parvum
AEGFDA

SEQ ID NO: 2250575 - protein, 56 aa, Cryptosporidium parvum
AEGGMPGGMPGGMPGGMPGGMPGGMPGGMPGGMPGGMPGGMPGGMPGSNGPTVEEV

SEQ ID NO: 2250576 - protein, 13 aa, Cryptosporidium parvum
AEGGSSDAQLSAE

SEQ ID NO: 2250577 - protein, 10 aa, Cryptosporidium parvum
AEGLEGNSRE

SEQ ID NO: 2250578 - protein, 6 aa, Cryptosporidium parvum
AEGSGI

SEQ ID NO: 2250579 - protein, 5 aa, Cryptosporidium parvum
AEGVS

SEQ ID NO: 2250580 - protein, 18 aa, Cryptosporidium parvum
AEHKNKGPSQGSFHGEKK

SEQ ID NO: 2250581 - protein, 8 aa, Cryptosporidium parvum
AEHQSGVP

SEQ ID NO: 2250582 - protein, 4 aa, Cryptosporidium parvum
AEHS

SEQ ID NO: 2250583 - protein, 10 aa, Cryptosporidium parvum
AEIDDDDEKI

SEQ ID NO: 2250584 - protein, 14 aa, Cryptosporidium parvum
AEIDENNPSGFDET

SEQ ID NO: 2250585 - protein, 6 aa, Cryptosporidium parvum
AEINEG

SEQ ID NO: 2250586 - protein, 6 aa, Cryptosporidium parvum
AEISRP

SEQ ID NO: 2250587 - protein, 8 aa, Cryptosporidium parvum
AEITELTP

SEQ ID NO: 2250588 - protein, 23 aa, Cryptosporidium parvum
AEIYSEEDEEPKDRGAYESSVTP

SEQ ID NO: 2250589 - protein, 11 aa, Cryptosporidium parvum
AEKAGKGSTGF

SEQ ID NO: 2250590 - protein, 10 aa, Cryptosporidium parvum
AEKCKPKEQL

SEQ ID NO: 2250591 - protein, 6 aa, Cryptosporidium parvum
AEKDGL

SEQ ID NO: 2250592 - protein, 7 aa, Cryptosporidium parvum
AEKDSFS

SEQ ID NO: 2250593 - protein, 8 aa, Cryptosporidium parvum
AEKEAYIN

SEQ ID NO: 2250594 - protein, 29 aa, Cryptosporidium parvum
AEKEQQKKSEEKPKVNKKSAGSKQASSKR

SEQ ID NO: 2250595 - protein, 8 aa, Cryptosporidium parvum
AEKKRNSI

SEQ ID NO: 2250596 - protein, 5 aa, Cryptosporidium parvum
AEKNR

SEQ ID NO: 2250597 - protein, 9 aa, Cryptosporidium parvum
AEKNSESYR

SEQ ID NO: 2250598 - protein, 10 aa, Cryptosporidium parvum
AEKNTNDNPV

SEQ ID NO: 2250599 - protein, 8 aa, Cryptosporidium parvum
AEKQMDDI

SEQ ID NO: 2250600 - protein, 24 aa, Cryptosporidium parvum
AEKREREKQRRSGNKKLSETKDKG

SEQ ID NO: 2250601 - protein, 4 aa, Cryptosporidium parvum
AEKY

SEQ ID NO: 2250602 - protein, 13 aa, Cryptosporidium parvum
AEKYKGEDEQNRL

SEQ ID NO: 2250603 - protein, 4 aa, Cryptosporidium parvum
AELD

SEQ ID NO: 2250604 - protein, 6 aa, Cryptosporidium parvum
AELKES

SEQ ID NO: 2250605 - protein, 11 aa, Cryptosporidium parvum
AELNDSNEKTA

SEQ ID NO: 2250606 - protein, 10 aa, Cryptosporidium parvum
AELNEKSHSE

SEQ ID NO: 2250607 - protein, 17 aa, Cryptosporidium parvum
AELNSQKDELDKQGIEL

SEQ ID NO: 2250608 - protein, 50 aa, Cryptosporidium parvum
AELRTRDGKLRHPTLSNGNSEVANQNQGQSQSQSQAQSQSQYQSAAQLPT

SEQ ID NO: 2250609 - protein, 13 aa, Cryptosporidium parvum
AELSGSSKLEDEN

SEQ ID NO: 2250610 - protein, 9 aa, Cryptosporidium parvum
AEMKSSSTL

SEQ ID NO: 2250611 - protein, 8 aa, Cryptosporidium parvum
AEMYPEGD

SEQ ID NO: 2250612 - protein, 12 aa, Cryptosporidium parvum
AENAGLDQQETT

SEQ ID NO: 2250613 - protein, 16 aa, Cryptosporidium parvum
AENAKNNSQEELPNSQ

SEQ ID NO: 2250614 - protein, 8 aa, Cryptosporidium parvum
AENDHDKI

SEQ ID NO: 2250615 - protein, 7 aa, Cryptosporidium parvum
AENDSGE

SEQ ID NO: 2250616 - protein, 12 aa, Cryptosporidium parvum
AENEKNYSGRFG

SEQ ID NO: 2250617 - protein, 7 aa, Cryptosporidium parvum
AENGPEY

SEQ ID NO: 2250618 - protein, 6 aa, Cryptosporidium parvum
AENITK

SEQ ID NO: 2250619 - protein, 26 aa, Cryptosporidium parvum
AENKKLKDGRRSNTADFGKRGSESLI

SEQ ID NO: 2250620 - protein, 14 aa, Cryptosporidium parvum
AENKKMEGNLDYEK

SEQ ID NO: 2250621 - protein, 7 aa, Cryptosporidium parvum
AENKNKD

SEQ ID NO: 2250622 - protein, 5 aa, Cryptosporidium parvum
AENNG

SEQ ID NO: 2250623 - protein, 7 aa, Cryptosporidium parvum
AENNNFQ

SEQ ID NO: 2250624 - protein, 8 aa, Cryptosporidium parvum
AENNSSLS

SEQ ID NO: 2250625 - protein, 8 aa, Cryptosporidium parvum
AENNTLRG

SEQ ID NO: 2250626 - protein, 4 aa, Cryptosporidium parvum
AENQ

SEQ ID NO: 2250627 - protein, 17 aa, Cryptosporidium parvum
AENQSLKDYEKTNLNEQ

SEQ ID NO: 2250628 - protein, 26 aa, Cryptosporidium parvum
AENQTQTDDDKGHWSEESAESNSRTM

SEQ ID NO: 2250629 - protein, 8 aa, Cryptosporidium parvum
AENSETEI

SEQ ID NO: 2250630 - protein, 8 aa, Cryptosporidium parvum
AENSHTTR

SEQ ID NO: 2250631 - protein, 10 aa, Cryptosporidium parvum
AENSSPQHDI

SEQ ID NO: 2250632 - protein, 13 aa, Cryptosporidium parvum
AENSSTKGKKKNE

SEQ ID NO: 2250633 - protein, 14 aa, Cryptosporidium parvum
AENSTQKSDSDSLD

SEQ ID NO: 2250634 - protein, 6 aa, Cryptosporidium parvum
AENTKD

SEQ ID NO: 2250635 - protein, 5 aa, Cryptosporidium parvum
AENYE

SEQ ID NO: 2250636 - protein, 16 aa, Cryptosporidium parvum
AENYNEDKKDGKIAAK

SEQ ID NO: 2250637 - protein, 7 aa, Cryptosporidium parvum
AEPIRKT

SEQ ID NO: 2250638 - protein, 6 aa, Cryptosporidium parvum
AEPNFY

SEQ ID NO: 2250639 - protein, 5 aa, Cryptosporidium parvum
AEPSN

SEQ ID NO: 2250640 - protein, 8 aa, Cryptosporidium parvum
AEQDESIK

SEQ ID NO: 2250641 - protein, 6 aa, Cryptosporidium parvum
AEQIKY

SEQ ID NO: 2250642 - protein, 15 aa, Cryptosporidium parvum
AEQKISKAESDCEQD

SEQ ID NO: 2250643 - protein, 7 aa, Cryptosporidium parvum
AEQKKSF

SEQ ID NO: 2250644 - protein, 6 aa, Cryptosporidium parvum
AEQQIT

SEQ ID NO: 2250645 - protein, 26 aa, Cryptosporidium parvum
AEQQQKPSVALKNSSSQTSSTQETIT

SEQ ID NO: 2250646 - protein, 7 aa, Cryptosporidium parvum
AEQSEWS

SEQ ID NO: 2250647 - protein, 7 aa, Cryptosporidium parvum
AEQSVHD

SEQ ID NO: 2250648 - protein, 12 aa, Cryptosporidium parvum
AERESGKDAKKG

SEQ ID NO: 2250649 - protein, 15 aa, Cryptosporidium parvum
AERETGTNDPRLNTP

SEQ ID NO: 2250650 - protein, 7 aa, Cryptosporidium parvum
AERGTRM

SEQ ID NO: 2250651 - protein, 6 aa, Cryptosporidium parvum
AERING

SEQ ID NO: 2250652 - protein, 6 aa, Cryptosporidium parvum
AERREL

SEQ ID NO: 2250653 - protein, 5 aa, Cryptosporidium parvum
AERSL

SEQ ID NO: 2250654 - protein, 7 aa, Cryptosporidium parvum
AERSSEV

SEQ ID NO: 2250655 - protein, 24 aa, Cryptosporidium parvum
AERSSTNDFPNNVNNTELAGPPIL

SEQ ID NO: 2250656 - protein, 23 aa, Cryptosporidium parvum
AESDLDENMEGNNNSSDDEFNMT

SEQ ID NO: 2250657 - protein, 43 aa, Cryptosporidium parvum
AESDLNINSNDKVKENSKVKPKSKAINDSDLSNEYDNNKSTQL

SEQ ID NO: 2250658 - protein, 8 aa, Cryptosporidium parvum
AESDSEKK

SEQ ID NO: 2250659 - protein, 7 aa, Cryptosporidium parvum
AESESPI

SEQ ID NO: 2250660 - protein, 23 aa, Cryptosporidium parvum
AESFEKRKSAESEKKNANGSYKS

SEQ ID NO: 2250661 - protein, 10 aa, Cryptosporidium parvum
AESFPTPGTE

SEQ ID NO: 2250662 - protein, 5 aa, Cryptosporidium parvum
AESII

SEQ ID NO: 2250663 - protein, 6 aa, Cryptosporidium parvum
AESIKD

SEQ ID NO: 2250664 - protein, 6 aa, Cryptosporidium parvum
AESKNL

SEQ ID NO: 2250665 - protein, 7 aa, Cryptosporidium parvum
AESKRQF

SEQ ID NO: 2250666 - protein, 8 aa, Cryptosporidium parvum
AESMETVG

SEQ ID NO: 2250667 - protein, 6 aa, Cryptosporidium parvum
AESNCD

SEQ ID NO: 2250668 - protein, 5 aa, Cryptosporidium parvum
AESNR

SEQ ID NO: 2250669 - protein, 7 aa, Cryptosporidium parvum
AESNSKQ

SEQ ID NO: 2250670 - protein, 7 aa, Cryptosporidium parvum
AESQHRI

SEQ ID NO: 2250671 - protein, 60 aa, Cryptosporidium parvum
AESSEGSSPNRNRGRTNSNAQSSRTSRSSRSRRTRTDRRTRSGVSRRDNSRSERSATGTS

SEQ ID NO: 2250672 - protein, 6 aa, Cryptosporidium parvum
AESSIN

SEQ ID NO: 2250673 - protein, 41 aa, Cryptosporidium parvum
AESSPPPPPPPTPTLRPKDKPKWSPPPPLEPIDNSANTQTI

SEQ ID NO: 2250674 - protein, 5 aa, Cryptosporidium parvum
AESSS

SEQ ID NO: 2250675 - protein, 15 aa, Cryptosporidium parvum
AESTAREWNRLYAKG

SEQ ID NO: 2250676 - protein, 7 aa, Cryptosporidium parvum
AESTMSR

SEQ ID NO: 2250677 - protein, 6 aa, Cryptosporidium parvum
AETHSE

SEQ ID NO: 2250678 - protein, 7 aa, Cryptosporidium parvum
AETIPGL

SEQ ID NO: 2250679 - protein, 33 aa, Cryptosporidium parvum
AETNHGTAKHRIDGDQNSGSGVVGQNENIGGFS

SEQ ID NO: 2250680 - protein, 7 aa, Cryptosporidium parvum
AETNIEP

SEQ ID NO: 2250681 - protein, 7 aa, Cryptosporidium parvum
AETNKSN

SEQ ID NO: 2250682 - protein, 8 aa, Cryptosporidium parvum
AETPGSLG

SEQ ID NO: 2250683 - protein, 6 aa, Cryptosporidium parvum
AETPQE

SEQ ID NO: 2250684 - protein, 8 aa, Cryptosporidium parvum
AETSTSGL

SEQ ID NO: 2250685 - protein, 4 aa, Cryptosporidium parvum
AETV

SEQ ID NO: 2250686 - protein, 5 aa, Cryptosporidium parvum
AEVER

SEQ ID NO: 2250687 - protein, 10 aa, Cryptosporidium parvum
AEVNEEDQSN

SEQ ID NO: 2250688 - protein, 4 aa, Cryptosporidium parvum
AEVT

SEQ ID NO: 2250689 - protein, 10 aa, Cryptosporidium parvum
AEVTNGNSTE

SEQ ID NO: 2250690 - protein, 6 aa, Cryptosporidium parvum
AEYEKQ

SEQ ID NO: 2250691 - protein, 4 aa, Cryptosporidium parvum
AEYK

SEQ ID NO: 2250692 - protein, 4 aa, Cryptosporidium parvum
AEYN

SEQ ID NO: 2250693 - protein, 6 aa, Cryptosporidium parvum
AEYNST

SEQ ID NO: 2250694 - protein, 6 aa, Cryptosporidium parvum
AEYPTD

SEQ ID NO: 2250695 - protein, 14 aa, Cryptosporidium parvum
AEYSPSSPLDETKN

SEQ ID NO: 2250696 - protein, 4 aa, Cryptosporidium parvum
AFDN

SEQ ID NO: 2250697 - protein, 10 aa, Cryptosporidium parvum
AFDNSEDSFG

SEQ ID NO: 2250698 - protein, 10 aa, Cryptosporidium parvum
AFESNKNSYS

SEQ ID NO: 2250699 - protein, 5 aa, Cryptosporidium parvum
AFGGG

SEQ ID NO: 2250700 - protein, 8 aa, Cryptosporidium parvum
AFGQNSKK

SEQ ID NO: 2250701 - protein, 6 aa, Cryptosporidium parvum
AFGRSD

SEQ ID NO: 2250702 - protein, 9 aa, Cryptosporidium parvum
AFKPGEKVS

SEQ ID NO: 2250703 - protein, 14 aa, Cryptosporidium parvum
AFNKPTKTITDSFN

SEQ ID NO: 2250704 - protein, 6 aa, Cryptosporidium parvum
AFNSEG

SEQ ID NO: 2250705 - protein, 6 aa, Cryptosporidium parvum
AFPANK

SEQ ID NO: 2250706 - protein, 5 aa, Cryptosporidium parvum
AFPNS

SEQ ID NO: 2250707 - protein, 6 aa, Cryptosporidium parvum
AFPPLT

SEQ ID NO: 2250708 - protein, 12 aa, Cryptosporidium parvum
AFQGNKKSTINF

SEQ ID NO: 2250709 - protein, 15 aa, Cryptosporidium parvum
AFSNSSSVSISDDGN

SEQ ID NO: 2250710 - protein, 7 aa, Cryptosporidium parvum
AFSSSNN

SEQ ID NO: 2250711 - protein, 5 aa, Cryptosporidium parvum
AFTDE

SEQ ID NO: 2250712 - protein, 8 aa, Cryptosporidium parvum
AGAAARGV

SEQ ID NO: 2250713 - protein, 6 aa, Cryptosporidium parvum
AGADSS

SEQ ID NO: 2250714 - protein, 6 aa, Cryptosporidium parvum
AGAGKS

SEQ ID NO: 2250715 - protein, 8 aa, Cryptosporidium parvum
AGAGKTSM

SEQ ID NO: 2250716 - protein, 9 aa, Cryptosporidium parvum
AGAGTAADL

SEQ ID NO: 2250717 - protein, 10 aa, Cryptosporidium parvum
AGAKNAERIS

SEQ ID NO: 2250718 - protein, 10 aa, Cryptosporidium parvum
AGANPNAVSA

SEQ ID NO: 2250719 - protein, 20 aa, Cryptosporidium parvum
AGASKGPKQLVGQDQRPYPL

SEQ ID NO: 2250720 - protein, 12 aa, Cryptosporidium parvum
AGATGLDPSQTS

SEQ ID NO: 2250721 - protein, 10 aa, Cryptosporidium parvum
AGATQKEDFD

SEQ ID NO: 2250722 - protein, 6 aa, Cryptosporidium parvum
AGDANG

SEQ ID NO: 2250723 - protein, 8 aa, Cryptosporidium parvum
AGDGGVST

SEQ ID NO: 2250724 - protein, 8 aa, Cryptosporidium parvum
AGDLETET

SEQ ID NO: 2250725 - protein, 6 aa, Cryptosporidium parvum
AGDSAN

SEQ ID NO: 2250726 - protein, 14 aa, Cryptosporidium parvum
AGDSRAVLSRSGQA

SEQ ID NO: 2250727 - protein, 7 aa, Cryptosporidium parvum
AGDTIDD

SEQ ID NO: 2250728 - protein, 8 aa, Cryptosporidium parvum
AGEAEGNL

SEQ ID NO: 2250729 - protein, 4 aa, Cryptosporidium parvum
AGED

SEQ ID NO: 2250730 - protein, 7 aa, Cryptosporidium parvum
AGEDTIS

SEQ ID NO: 2250731 - protein, 6 aa, Cryptosporidium parvum
AGEEAP

SEQ ID NO: 2250732 - protein, 6 aa, Cryptosporidium parvum
AGEITD

SEQ ID NO: 2250733 - protein, 4 aa, Cryptosporidium parvum
AGEN

SEQ ID NO: 2250734 - protein, 13 aa, Cryptosporidium parvum
AGESAEASPSSTK

SEQ ID NO: 2250735 - protein, 10 aa, Cryptosporidium parvum
AGESSKSKVS

SEQ ID NO: 2250736 - protein, 5 aa, Cryptosporidium parvum
AGETV

SEQ ID NO: 2250737 - protein, 4 aa, Cryptosporidium parvum
AGEY

SEQ ID NO: 2250738 - protein, 25 aa, Cryptosporidium parvum
AGFSNDSIKAEDAVENPSRKNHISS

SEQ ID NO: 2250739 - protein, 8 aa, Cryptosporidium parvum
AGFTRPEA

SEQ ID NO: 2250740 - protein, 4 aa, Cryptosporidium parvum
AGGD

SEQ ID NO: 2250741 - protein, 6 aa, Cryptosporidium parvum
AGGEGL

SEQ ID NO: 2250742 - protein, 4 aa, Cryptosporidium parvum
AGGF

SEQ ID NO: 2250743 - protein, 4 aa, Cryptosporidium parvum
AGGI

SEQ ID NO: 2250744 - protein, 5 aa, Cryptosporidium parvum
AGGIE

SEQ ID NO: 2250745 - protein, 42 aa, Cryptosporidium parvum
AGGLADDTSFTPVKKTSSRASASKGAVFTPKRRDSQGADGSV

SEQ ID NO: 2250746 - protein, 6 aa, Cryptosporidium parvum
AGGSDQ

SEQ ID NO: 2250747 - protein, 13 aa, Cryptosporidium parvum
AGGSLGGAQSVNE

SEQ ID NO: 2250748 - protein, 6 aa, Cryptosporidium parvum
AGGSNL

SEQ ID NO: 2250749 - protein, 7 aa, Cryptosporidium parvum
AGGTGDV

SEQ ID NO: 2250750 - protein, 9 aa, Cryptosporidium parvum
AGGTGSGMG

SEQ ID NO: 2250751 - protein, 73 aa, Cryptosporidium parvum
AGGTNKIKKDQGANSIVNTNSNQPTKGSSLISDDDDTFEIDNSSSKNGVITNGTSSVALSSHSSTTTTSSGVT

SEQ ID NO: 2250752 - protein, 18 aa, Cryptosporidium parvum
AGGTSKNSLNSSSNERSR

SEQ ID NO: 2250753 - protein, 6 aa, Cryptosporidium parvum
AGIGGA

SEQ ID NO: 2250754 - protein, 6 aa, Cryptosporidium parvum
AGIGPG

SEQ ID NO: 2250755 - protein, 13 aa, Cryptosporidium parvum
AGIGTGAGIEAGV

SEQ ID NO: 2250756 - protein, 8 aa, Cryptosporidium parvum
AGIGTGIG

SEQ ID NO: 2250757 - protein, 5 aa, Cryptosporidium parvum
AGISD

SEQ ID NO: 2250758 - protein, 6 aa, Cryptosporidium parvum
AGISEE

SEQ ID NO: 2250759 - protein, 8 aa, Cryptosporidium parvum
AGITTTLN

SEQ ID NO: 2250760 - protein, 6 aa, Cryptosporidium parvum
AGKEEM

SEQ ID NO: 2250761 - protein, 14 aa, Cryptosporidium parvum
AGKQAYNNKVDASE

SEQ ID NO: 2250762 - protein, 19 aa, Cryptosporidium parvum
AGKQDHTEAIKNGENTDQS

SEQ ID NO: 2250763 - protein, 6 aa, Cryptosporidium parvum
AGKRGL

SEQ ID NO: 2250764 - protein, 23 aa, Cryptosporidium parvum
AGKSAKTKIDPRRVSEKSSKKVP

SEQ ID NO: 2250765 - protein, 11 aa, Cryptosporidium parvum
AGKSFRKSAPA

SEQ ID NO: 2250766 - protein, 8 aa, Cryptosporidium parvum
AGKSTSAV

SEQ ID NO: 2250767 - protein, 8 aa, Cryptosporidium parvum
AGKSTTCG

SEQ ID NO: 2250768 - protein, 31 aa, Cryptosporidium parvum
AGKVKNQTPRVEKQEKKKALTGRAKKRQQYN

SEQ ID NO: 2250769 - protein, 12 aa, Cryptosporidium parvum
AGLGERKLKKLL

SEQ ID NO: 2250770 - protein, 16 aa, Cryptosporidium parvum
AGLLDPSQRPSISSNG

SEQ ID NO: 2250771 - protein, 14 aa, Cryptosporidium parvum
AGLTPGVSTDSGRI

SEQ ID NO: 2250772 - protein, 12 aa, Cryptosporidium parvum
AGNDEESGNSEL

SEQ ID NO: 2250773 - protein, 6 aa, Cryptosporidium parvum
AGNDTN

SEQ ID NO: 2250774 - protein, 10 aa, Cryptosporidium parvum
AGNENDAQGL

SEQ ID NO: 2250775 - protein, 7 aa, Cryptosporidium parvum
AGNGYTN

SEQ ID NO: 2250776 - protein, 18 aa, Cryptosporidium parvum
AGNKSSVAGRDTKENVSS

SEQ ID NO: 2250777 - protein, 11 aa, Cryptosporidium parvum
AGNNPGNTSSL

SEQ ID NO: 2250778 - protein, 6 aa, Cryptosporidium parvum
AGNNYH

SEQ ID NO: 2250779 - protein, 8 aa, Cryptosporidium parvum
AGNSESSS

SEQ ID NO: 2250780 - protein, 8 aa, Cryptosporidium parvum
AGNTGITT

SEQ ID NO: 2250781 - protein, 27 aa, Cryptosporidium parvum
AGNVPNSTVLDGPSSNRRTALGNVSPN

SEQ ID NO: 2250782 - protein, 6 aa, Cryptosporidium parvum
AGPGIS

SEQ ID NO: 2250783 - protein, 9 aa, Cryptosporidium parvum
AGPNITSYT

SEQ ID NO: 2250784 - protein, 10 aa, Cryptosporidium parvum
AGPPGTGKTA

SEQ ID NO: 2250785 - protein, 4 aa, Cryptosporidium parvum
AGPY

SEQ ID NO: 2250786 - protein, 17 aa, Cryptosporidium parvum
AGQDDGIEGETRLEKKK

SEQ ID NO: 2250787 - protein, 8 aa, Cryptosporidium parvum
AGQEKFGG

SEQ ID NO: 2250788 - protein, 5 aa, Cryptosporidium parvum
AGQER

SEQ ID NO: 2250789 - protein, 8 aa, Cryptosporidium parvum
AGQERYRS

SEQ ID NO: 2250790 - protein, 7 aa, Cryptosporidium parvum
AGQESFR

SEQ ID NO: 2250791 - protein, 9 aa, Cryptosporidium parvum
AGQGDDNIE

SEQ ID NO: 2250792 - protein, 10 aa, Cryptosporidium parvum
AGQIDNADEH

SEQ ID NO: 2250793 - protein, 7 aa, Cryptosporidium parvum
AGRFGTK

SEQ ID NO: 2250794 - protein, 11 aa, Cryptosporidium parvum
AGRGRGKSAAL

SEQ ID NO: 2250795 - protein, 4 aa, Cryptosporidium parvum
AGRI

SEQ ID NO: 2250796 - protein, 7 aa, Cryptosporidium parvum
AGRKDKR

SEQ ID NO: 2250797 - protein, 7 aa, Cryptosporidium parvum
AGRKNLE

SEQ ID NO: 2250798 - protein, 7 aa, Cryptosporidium parvum
AGRPQFE

SEQ ID NO: 2250799 - protein, 9 aa, Cryptosporidium parvum
AGRTQIAAG

SEQ ID NO: 2250800 - protein, 6 aa, Cryptosporidium parvum
AGRTTG

SEQ ID NO: 2250801 - protein, 4 aa, Cryptosporidium parvum
AGSI

SEQ ID NO: 2250802 - protein, 12 aa, Cryptosporidium parvum
AGSIESEEAPLS

SEQ ID NO: 2250803 - protein, 33 aa, Cryptosporidium parvum
AGSNVGSSISYHSESQCQGSELDNSVNCSRKQR

SEQ ID NO: 2250804 - protein, 9 aa, Cryptosporidium parvum
AGSPLDPNS

SEQ ID NO: 2250805 - protein, 5 aa, Cryptosporidium parvum
AGSSD

SEQ ID NO: 2250806 - protein, 7 aa, Cryptosporidium parvum
AGSSEPQ

SEQ ID NO: 2250807 - protein, 5 aa, Cryptosporidium parvum
AGSSG

SEQ ID NO: 2250808 - protein, 7 aa, Cryptosporidium parvum
AGSSGEI

SEQ ID NO: 2250809 - protein, 7 aa, Cryptosporidium parvum
AGSSNEF

SEQ ID NO: 2250810 - protein, 6 aa, Cryptosporidium parvum
AGSTAE

SEQ ID NO: 2250811 - protein, 8 aa, Cryptosporidium parvum
AGSTEPNA

SEQ ID NO: 2250812 - protein, 7 aa, Cryptosporidium parvum
AGSVDEN

SEQ ID NO: 2250813 - protein, 7 aa, Cryptosporidium parvum
AGTDGHY

SEQ ID NO: 2250814 - protein, 6 aa, Cryptosporidium parvum
AGTEEA

SEQ ID NO: 2250815 - protein, 6 aa, Cryptosporidium parvum
AGTGFS

SEQ ID NO: 2250816 - protein, 9 aa, Cryptosporidium parvum
AGTGTYPPE

SEQ ID NO: 2250817 - protein, 18 aa, Cryptosporidium parvum
AGTHGFEENGEKNKKQKF

SEQ ID NO: 2250818 - protein, 4 aa, Cryptosporidium parvum
AGTL

SEQ ID NO: 2250819 - protein, 6 aa, Cryptosporidium parvum
AGTRMY

SEQ ID NO: 2250820 - protein, 27 aa, Cryptosporidium parvum
AGTSLQPYSGAYKRTKGKRWSTEQTNK

SEQ ID NO: 2250821 - protein, 35 aa, Cryptosporidium parvum
AGTVASSSITINSNTNTNSASVSSPNYLEQPSTTV

SEQ ID NO: 2250822 - protein, 4 aa, Cryptosporidium parvum
AGTY

SEQ ID NO: 2250823 - protein, 25 aa, Cryptosporidium parvum
AGVGSGVGVGAGTGIDAGAGSGGVG

SEQ ID NO: 2250824 - protein, 11 aa, Cryptosporidium parvum
AGVGTQTEIER

SEQ ID NO: 2250825 - protein, 42 aa, Cryptosporidium parvum
AGVNQGEGSYFSDSKERKSRGMSRKSLTSNSNLSYTNSGLFS

SEQ ID NO: 2250826 - protein, 6 aa, Cryptosporidium parvum
AGVTLN

SEQ ID NO: 2250827 - protein, 63 aa, Cryptosporidium parvum
AGVTNNSLTKTPSKTRTRKVRESSDDFGNSSSGPSVHSKSGYSSNSSGESCSFGSSSNVSEDL

SEQ ID NO: 2250828 - protein, 6 aa, Cryptosporidium parvum
AGVTTE

SEQ ID NO: 2250829 - protein, 7 aa, Cryptosporidium parvum
AGYAADA

SEQ ID NO: 2250830 - protein, 5 aa, Cryptosporidium parvum
AGYGI

SEQ ID NO: 2250831 - protein, 4 aa, Cryptosporidium parvum
AGYI

SEQ ID NO: 2250832 - protein, 4 aa, Cryptosporidium parvum
AGYV

SEQ ID NO: 2250833 - protein, 59 aa, Cryptosporidium parvum
AHANTDSNAESQKKVSSSTAANTSNNSSNNASTSAPNTTSNNAAANTSSASSPSPLDPV

SEQ ID NO: 2250834 - protein, 8 aa, Cryptosporidium parvum
AHDETDLN

SEQ ID NO: 2250835 - protein, 16 aa, Cryptosporidium parvum
AHDGSKAQAKVSKLRE

SEQ ID NO: 2250836 - protein, 8 aa, Cryptosporidium parvum
AHEARRNL

SEQ ID NO: 2250837 - protein, 4 aa, Cryptosporidium parvum
AHEK

SEQ ID NO: 2250838 - protein, 4 aa, Cryptosporidium parvum
AHEL

SEQ ID NO: 2250839 - protein, 9 aa, Cryptosporidium parvum
AHENDKNSI

SEQ ID NO: 2250840 - protein, 7 aa, Cryptosporidium parvum
AHEQTKS

SEQ ID NO: 2250841 - protein, 5 aa, Cryptosporidium parvum
AHESE

SEQ ID NO: 2250842 - protein, 11 aa, Cryptosporidium parvum
AHFDSKDGQYL

SEQ ID NO: 2250843 - protein, 6 aa, Cryptosporidium parvum
AHGGTF

SEQ ID NO: 2250844 - protein, 12 aa, Cryptosporidium parvum
AHKSNIKREHMN

SEQ ID NO: 2250845 - protein, 13 aa, Cryptosporidium parvum
AHLGDEAAGSCNA

SEQ ID NO: 2250846 - protein, 7 aa, Cryptosporidium parvum
AHNGPAA

SEQ ID NO: 2250847 - protein, 4 aa, Cryptosporidium parvum
AHNL

SEQ ID NO: 2250848 - protein, 21 aa, Cryptosporidium parvum
AHNNNAISSYYSSTSEANDLE

SEQ ID NO: 2250849 - protein, 5 aa, Cryptosporidium parvum
AHNSN

SEQ ID NO: 2250850 - protein, 6 aa, Cryptosporidium parvum
AHNTQL

SEQ ID NO: 2250851 - protein, 5 aa, Cryptosporidium parvum
AHPEM

SEQ ID NO: 2250852 - protein, 6 aa, Cryptosporidium parvum
AHPGAK

SEQ ID NO: 2250853 - protein, 6 aa, Cryptosporidium parvum
AHPNDV

SEQ ID NO: 2250854 - protein, 4 aa, Cryptosporidium parvum
AHQK

SEQ ID NO: 2250855 - protein, 15 aa, Cryptosporidium parvum
AHRADAQCSSCGGTL

SEQ ID NO: 2250856 - protein, 23 aa, Cryptosporidium parvum
AHREEQIEEEEHATPSSNDSFST

SEQ ID NO: 2250857 - protein, 7 aa, Cryptosporidium parvum
AHRIGQK

SEQ ID NO: 2250858 - protein, 4 aa, Cryptosporidium parvum
AHRK

SEQ ID NO: 2250859 - protein, 8 aa, Cryptosporidium parvum
AHRPPKHQ

SEQ ID NO: 2250860 - protein, 7 aa, Cryptosporidium parvum
AHSKGQL

SEQ ID NO: 2250861 - protein, 4 aa, Cryptosporidium parvum
AHSL

SEQ ID NO: 2250862 - protein, 6 aa, Cryptosporidium parvum
AHTFTP

SEQ ID NO: 2250863 - protein, 6 aa, Cryptosporidium parvum
AHTKEE

SEQ ID NO: 2250864 - protein, 12 aa, Cryptosporidium parvum
AHTTEDTPNNYS

SEQ ID NO: 2250865 - protein, 5 aa, Cryptosporidium parvum
AIAAT

SEQ ID NO: 2250866 - protein, 7 aa, Cryptosporidium parvum
AIDSGAG

SEQ ID NO: 2250867 - protein, 19 aa, Cryptosporidium parvum
AIEASQKAIEASKKAIEAS

SEQ ID NO: 2250868 - protein, 50 aa, Cryptosporidium parvum
AIEDKDQQTKLDMTTKSSEEEQVDKEDQYPASVSSITETQSVHSNSNSFV

SEQ ID NO: 2250869 - protein, 12 aa, Cryptosporidium parvum
AIEEEYKKNQEN

SEQ ID NO: 2250870 - protein, 7 aa, Cryptosporidium parvum
AIEETEQ

SEQ ID NO: 2250871 - protein, 14 aa, Cryptosporidium parvum
AIEPSIAPPIPPIP

SEQ ID NO: 2250872 - protein, 5 aa, Cryptosporidium parvum
AIERE

SEQ ID NO: 2250873 - protein, 16 aa, Cryptosporidium parvum
AIESQNYETKKVNSSL

SEQ ID NO: 2250874 - protein, 10 aa, Cryptosporidium parvum
AIGGGGSYSL

SEQ ID NO: 2250875 - protein, 84 aa, Cryptosporidium parvum
AIGGPDRGSSSRGGMSTRGRGTGRFPSRGGSSSATAGSSSRGGASSGTVGTIGGSVRGGGSSRGGLNSRTRGTEIIPGRGRLSS

SEQ ID NO: 2250876 - protein, 9 aa, Cryptosporidium parvum
AIGKDMQNA

SEQ ID NO: 2250877 - protein, 13 aa, Cryptosporidium parvum
AIGNEENMETELK

SEQ ID NO: 2250878 - protein, 11 aa, Cryptosporidium parvum
AIGPVNKNISQ

SEQ ID NO: 2250879 - protein, 11 aa, Cryptosporidium parvum
AIGQNNQTATS

SEQ ID NO: 2250880 - protein, 10 aa, Cryptosporidium parvum
AIGTAQEGAE

SEQ ID NO: 2250881 - protein, 20 aa, Cryptosporidium parvum
AIGTGPLNTGSSNNYFGGQS

SEQ ID NO: 2250882 - protein, 16 aa, Cryptosporidium parvum
AIKDNEKFKEKHKNLK

SEQ ID NO: 2250883 - protein, 4 aa, Cryptosporidium parvum
AIKG

SEQ ID NO: 2250884 - protein, 5 aa, Cryptosporidium parvum
AIKQG

SEQ ID NO: 2250885 - protein, 6 aa, Cryptosporidium parvum
AINGNN

SEQ ID NO: 2250886 - protein, 16 aa, Cryptosporidium parvum
AINGPKSVTISGSRSS

SEQ ID NO: 2250887 - protein, 10 aa, Cryptosporidium parvum
AINKERKEQK

SEQ ID NO: 2250888 - protein, 14 aa, Cryptosporidium parvum
AINNQKRQVVHSPF

SEQ ID NO: 2250889 - protein, 6 aa, Cryptosporidium parvum
AINNQS

SEQ ID NO: 2250890 - protein, 5 aa, Cryptosporidium parvum
AINSA

SEQ ID NO: 2250891 - protein, 10 aa, Cryptosporidium parvum
AINSKEESEI

SEQ ID NO: 2250892 - protein, 5 aa, Cryptosporidium parvum
AIPEE

SEQ ID NO: 2250893 - protein, 15 aa, Cryptosporidium parvum
AIPGQVDTSTPQANP

SEQ ID NO: 2250894 - protein, 12 aa, Cryptosporidium parvum
AIPNGSSSNTNC

SEQ ID NO: 2250895 - protein, 4 aa, Cryptosporidium parvum
AIPS

SEQ ID NO: 2250896 - protein, 6 aa, Cryptosporidium parvum
AIQDSP

SEQ ID NO: 2250897 - protein, 10 aa, Cryptosporidium parvum
AIQYDTRSNE

SEQ ID NO: 2250898 - protein, 31 aa, Cryptosporidium parvum
AIRKYDGNIDEDNDFDDNDYTGSRKGDSILD

SEQ ID NO: 2250899 - protein, 9 aa, Cryptosporidium parvum
AISGSASST

SEQ ID NO: 2250900 - protein, 8 aa, Cryptosporidium parvum
AISGSGSG

SEQ ID NO: 2250901 - protein, 5 aa, Cryptosporidium parvum
AISKE

SEQ ID NO: 2250902 - protein, 8 aa, Cryptosporidium parvum
AISNGEDK

SEQ ID NO: 2250903 - protein, 5 aa, Cryptosporidium parvum
AISRK

SEQ ID NO: 2250904 - protein, 22 aa, Cryptosporidium parvum
AISRKSANYGKDRNQLHENNNS

SEQ ID NO: 2250905 - protein, 11 aa, Cryptosporidium parvum
AISSGTSNGKY

SEQ ID NO: 2250906 - protein, 6 aa, Cryptosporidium parvum
AISSMP

SEQ ID NO: 2250907 - protein, 6 aa, Cryptosporidium parvum
AISSNS

SEQ ID NO: 2250908 - protein, 8 aa, Cryptosporidium parvum
AISTDEEN

SEQ ID NO: 2250909 - protein, 11 aa, Cryptosporidium parvum
AISTPRDPVEQ

SEQ ID NO: 2250910 - protein, 6 aa, Cryptosporidium parvum
AISTSN

SEQ ID NO: 2250911 - protein, 4 aa, Cryptosporidium parvum
AITD

SEQ ID NO: 2250912 - protein, 13 aa, Cryptosporidium parvum
AKAAAPSYSGLPA

SEQ ID NO: 2250913 - protein, 17 aa, Cryptosporidium parvum
AKAERLIPKSGTTDQIG

SEQ ID NO: 2250914 - protein, 7 aa, Cryptosporidium parvum
AKAFSGT

SEQ ID NO: 2250915 - protein, 4 aa, Cryptosporidium parvum
AKAK

SEQ ID NO: 2250916 - protein, 13 aa, Cryptosporidium parvum
AKAKAKSKSNSVL

SEQ ID NO: 2250917 - protein, 10 aa, Cryptosporidium parvum
AKAKESRTTH

SEQ ID NO: 2250918 - protein, 6 aa, Cryptosporidium parvum
AKAMEE

SEQ ID NO: 2250919 - protein, 7 aa, Cryptosporidium parvum
AKANENI

SEQ ID NO: 2250920 - protein, 9 aa, Cryptosporidium parvum
AKANSEAQL

SEQ ID NO: 2250921 - protein, 7 aa, Cryptosporidium parvum
AKAPEVN

SEQ ID NO: 2250922 - protein, 6 aa, Cryptosporidium parvum
AKAPLL

SEQ ID NO: 2250923 - protein, 20 aa, Cryptosporidium parvum
AKAQGNKDDKKSGTSDKATV

SEQ ID NO: 2250924 - protein, 9 aa, Cryptosporidium parvum
AKASTSVPI

SEQ ID NO: 2250925 - protein, 7 aa, Cryptosporidium parvum
AKCPHGS

SEQ ID NO: 2250926 - protein, 6 aa, Cryptosporidium parvum
AKDASQ

SEQ ID NO: 2250927 - protein, 6 aa, Cryptosporidium parvum
AKDASR

SEQ ID NO: 2250928 - protein, 15 aa, Cryptosporidium parvum
AKDEDEDEDEADEDE

SEQ ID NO: 2250929 - protein, 9 aa, Cryptosporidium parvum
AKDEKSIAE

SEQ ID NO: 2250930 - protein, 11 aa, Cryptosporidium parvum
AKDEQGKQEYK

SEQ ID NO: 2250931 - protein, 26 aa, Cryptosporidium parvum
AKDGDSIAEYSTSKGSNSMIDGGTST

SEQ ID NO: 2250932 - protein, 7 aa, Cryptosporidium parvum
AKDHPNL

SEQ ID NO: 2250933 - protein, 8 aa, Cryptosporidium parvum
AKDIGSLP

SEQ ID NO: 2250934 - protein, 10 aa, Cryptosporidium parvum
AKDKANEIEA

SEQ ID NO: 2250935 - protein, 13 aa, Cryptosporidium parvum
AKDLTEESENDTL

SEQ ID NO: 2250936 - protein, 7 aa, Cryptosporidium parvum
AKDQDTL

SEQ ID NO: 2250937 - protein, 7 aa, Cryptosporidium parvum
AKDSQGR

SEQ ID NO: 2250938 - protein, 5 aa, Cryptosporidium parvum
AKDTI

SEQ ID NO: 2250939 - protein, 6 aa, Cryptosporidium parvum
AKDVPA

SEQ ID NO: 2250940 - protein, 6 aa, Cryptosporidium parvum
AKEDKV

SEQ ID NO: 2250941 - protein, 6 aa, Cryptosporidium parvum
AKEEKI

SEQ ID NO: 2250942 - protein, 5 aa, Cryptosporidium parvum
AKEKG

SEQ ID NO: 2250943 - protein, 7 aa, Cryptosporidium parvum
AKELEEK

SEQ ID NO: 2250944 - protein, 4 aa, Cryptosporidium parvum
AKEM

SEQ ID NO: 2250945 - protein, 48 aa, Cryptosporidium parvum
AKENNGNSTSETSNNNNATSINNNSSSSTNKHDESNKSINQNGQDEYN

SEQ ID NO: 2250946 - protein, 32 aa, Cryptosporidium parvum; identical to SEQ ID NO: 2135774

SEQ ID NO: 2250947 - protein, 13 aa, Cryptosporidium parvum
AKESENLKKSQQT

SEQ ID NO: 2250948 - protein, 9 aa, Cryptosporidium parvum
AKESERRNI

SEQ ID NO: 2250949 - protein, 6 aa, Cryptosporidium parvum
AKESGL

SEQ ID NO: 2250950 - protein, 7 aa, Cryptosporidium parvum
AKESNSL

SEQ ID NO: 2250951 - protein, 8 aa, Cryptosporidium parvum
AKESSLRR

SEQ ID NO: 2250952 - protein, 17 aa, Cryptosporidium parvum
AKETETWSKDSSMGKSC

SEQ ID NO: 2250953 - protein, 7 aa, Cryptosporidium parvum
AKETLND

SEQ ID NO: 2250954 - protein, 15 aa, Cryptosporidium parvum
AKETYSDYKQGNGFS

SEQ ID NO: 2250955 - protein, 13 aa, Cryptosporidium parvum
AKEYEDEAQAKRK

SEQ ID NO: 2250956 - protein, 12 aa, Cryptosporidium parvum
AKFAPISQESDD

SEQ ID NO: 2250957 - protein, 12 aa, Cryptosporidium parvum
AKFSKENRLEYL

SEQ ID NO: 2250958 - protein, 8 aa, Cryptosporidium parvum
AKFSKNPS

SEQ ID NO: 2250959 - protein, 15 aa, Cryptosporidium parvum
AKGGGGSQGHSSTPQ

SEQ ID NO: 2250960 - protein, 10 aa, Cryptosporidium parvum
AKGGGKVQPN

SEQ ID NO: 2250961 - protein, 13 aa, Cryptosporidium parvum
AKGIPTATTNDAR

SEQ ID NO: 2250962 - protein, 9 aa, Cryptosporidium parvum
AKGKSSIKL

SEQ ID NO: 2250963 - protein, 4 aa, Cryptosporidium parvum
AKGL

SEQ ID NO: 2250964 - protein, 11 aa, Cryptosporidium parvum
AKGLSNSTLRQ

SEQ ID NO: 2250965 - protein, 7 aa, Cryptosporidium parvum
AKGPEER

SEQ ID NO: 2250966 - protein, 12 aa, Cryptosporidium parvum
AKGQPQYDRAED

SEQ ID NO: 2250967 - protein, 8 aa, Cryptosporidium parvum
AKGTSKRV

SEQ ID NO: 2250968 - protein, 11 aa, Cryptosporidium parvum
AKHGLTKTIEN

SEQ ID NO: 2250969 - protein, 9 aa, Cryptosporidium parvum
AKIDPSSLK

SEQ ID NO: 2250970 - protein, 5 aa, Cryptosporidium parvum
AKIPK

SEQ ID NO: 2250971 - protein, 16 aa, Cryptosporidium parvum
AKIPSNSTSRSSQNVK

SEQ ID NO: 2250972 - protein, 14 aa, Cryptosporidium parvum
AKIQAKRNSSKKNY

SEQ ID NO: 2250973 - protein, 4 aa, Cryptosporidium parvum
AKIS

SEQ ID NO: 2250974 - protein, 14 aa, Cryptosporidium parvum
AKITKKNTGSSTIR

SEQ ID NO: 2250975 - protein, 8 aa, Cryptosporidium parvum
AKKAGGAT

SEQ ID NO: 2250976 - protein, 9 aa, Cryptosporidium parvum
AKKDGNEKA

SEQ ID NO: 2250977 - protein, 25 aa, Cryptosporidium parvum
AKKDKSKFNLDNNNNNNNKNNKIGQ

SEQ ID NO: 2250978 - protein, 4 aa, Cryptosporidium parvum
AKKE

SEQ ID NO: 2250979 - protein, 9 aa, Cryptosporidium parvum
AKKEKSLEL

SEQ ID NO: 2250980 - protein, 75 aa, Cryptosporidium parvum
AKKERQKKANLTQSRVRNGRGGKGQNLKKRGERRPNSVNSNGRRNFKGSPGKISRSRGGNRGRGFDQGKRMSRDQ

SEQ ID NO: 2250981 - protein, 6 aa, Cryptosporidium parvum
AKKGFK

SEQ ID NO: 2250982 - protein, 8 aa, Cryptosporidium parvum
AKKGSNEI

SEQ ID NO: 2250983 - protein, 8 aa, Cryptosporidium parvum
AKKGTNGI

SEQ ID NO: 2250984 - protein, 7 aa, Cryptosporidium parvum
AKKIKKP

SEQ ID NO: 2250985 - protein, 6 aa, Cryptosporidium parvum
AKKIQN

SEQ ID NO: 2250986 - protein, 18 aa, Cryptosporidium parvum
AKKKKSRQKWAEISKNQK

SEQ ID NO: 2250987 - protein, 10 aa, Cryptosporidium parvum
AKKKQKNVMD

SEQ ID NO: 2250988 - protein, 9 aa, Cryptosporidium parvum
AKKLTDSSS

SEQ ID NO: 2250989 - protein, 8 aa, Cryptosporidium parvum
AKKMANDD

SEQ ID NO: 2250990 - protein, 7 aa, Cryptosporidium parvum
AKKPEMP

SEQ ID NO: 2250991 - protein, 47 aa, Cryptosporidium parvum; identical to SEQ ID NO: 2135809

SEQ ID NO: 2250992 - protein, 7 aa, Cryptosporidium parvum
AKKRDHR

SEQ ID NO: 2250993 - protein, 15 aa, Cryptosporidium parvum
AKKRKEEEQREQQKT

SEQ ID NO: 2250994 - protein, 6 aa, Cryptosporidium parvum
AKKTVN

SEQ ID NO: 2250995 - protein, 7 aa, Cryptosporidium parvum
AKLDESK

SEQ ID NO: 2250996 - protein, 8 aa, Cryptosporidium parvum
AKLPRKKM

SEQ ID NO: 2250997 - protein, 7 aa, Cryptosporidium parvum
AKLQEEK

SEQ ID NO: 2250998 - protein, 6 aa, Cryptosporidium parvum
AKLQSR

SEQ ID NO: 2250999 - protein, 7 aa, Cryptosporidium parvum
AKMAKNL

SEQ ID NO: 2251000 - protein, 14 aa, Cryptosporidium parvum
AKMKREKSKHSSNM

SEQ ID NO: 2251001 - protein, 32 aa, Cryptosporidium parvum
AKNATNIESGQNLYSSSSANGAGFNSSSDLTS

SEQ ID NO: 2251002 - protein, 6 aa, Cryptosporidium parvum
AKNDYK

SEQ ID NO: 2251003 - protein, 7 aa, Cryptosporidium parvum
AKNEFEA

SEQ ID NO: 2251004 - protein, 10 aa, Cryptosporidium parvum
AKNEKKYKNL

SEQ ID NO: 2251005 - protein, 6 aa, Cryptosporidium parvum
AKNGYN

SEQ ID NO: 2251006 - protein, 73 aa, Cryptosporidium parvum
AKNKGDNGNGDDDDDDDDDDDDDDDDDNNNNNNNNNNNSNNDVNNNDRANDESREDGEGKEGEYGREGGESEL

SEQ ID NO: 2251007 - protein, 19 aa, Cryptosporidium parvum
AKNRGDEPSSLLKGSADSS

SEQ ID NO: 2251008 - protein, 14 aa, Cryptosporidium parvum
AKNSFRGGGKRGKR

SEQ ID NO: 2251009 - protein, 5 aa, Cryptosporidium parvum
AKNSL

SEQ ID NO: 2251010 - protein, 10 aa, Cryptosporidium parvum
AKNSSKNSHE

SEQ ID NO: 2251011 - protein, 18 aa, Cryptosporidium parvum
AKNVSSRSGGNVSGTVGG

SEQ ID NO: 2251012 - protein, 7 aa, Cryptosporidium parvum
AKPEEPC

SEQ ID NO: 2251013 - protein, 9 aa, Cryptosporidium parvum
AKPESIETN

SEQ ID NO: 2251014 - protein, 10 aa, Cryptosporidium parvum
AKPESSEWGN

SEQ ID NO: 2251015 - protein, 4 aa, Cryptosporidium parvum
AKPI

SEQ ID NO: 2251016 - protein, 8 aa, Cryptosporidium parvum
AKPNEGHR

SEQ ID NO: 2251017 - protein, 8 aa, Cryptosporidium parvum
AKPQGASF

SEQ ID NO: 2251018 - protein, 7 aa, Cryptosporidium parvum
AKPSPNL

SEQ ID NO: 2251019 - protein, 9 aa, Cryptosporidium parvum
AKPTSKEER

SEQ ID NO: 2251020 - protein, 12 aa, Cryptosporidium parvum
AKQFSRNKHEIK

SEQ ID NO: 2251021 - protein, 6 aa, Cryptosporidium parvum
AKQGDA

SEQ ID NO: 2251022 - protein, 9 aa, Cryptosporidium parvum
AKQKSQDVS

SEQ ID NO: 2251023 - protein, 8 aa, Cryptosporidium parvum
AKQPNSAV

SEQ ID NO: 2251024 - protein, 10 aa, Cryptosporidium parvum
AKQQSLEREK

SEQ ID NO: 2251025 - protein, 7 aa, Cryptosporidium parvum
AKQRVPP

SEQ ID NO: 2251026 - protein, 6 aa, Cryptosporidium parvum
AKQSLN

SEQ ID NO: 2251027 - protein, 8 aa, Cryptosporidium parvum
AKQSPKYE

SEQ ID NO: 2251028 - protein, 5 aa, Cryptosporidium parvum
AKREL

SEQ ID NO: 2251029 - protein, 6 aa, Cryptosporidium parvum
AKRGNY

SEQ ID NO: 2251030 - protein, 7 aa, Cryptosporidium parvum
AKRKNSS

SEQ ID NO: 2251031 - protein, 22 aa, Cryptosporidium parvum
AKRPRAETSFSDKLDSDTLEPT

SEQ ID NO: 2251032 - protein, 4 aa, Cryptosporidium parvum
AKRQ

SEQ ID NO: 2251033 - protein, 49 aa, Cryptosporidium parvum
AKRRKLAEKNKETAQFSQNNINSEGSNVDKKGVESNEGIKPKEELQDSE

SEQ ID NO: 2251034 - protein, 7 aa, Cryptosporidium parvum
AKRRTVQ

SEQ ID NO: 2251035 - protein, 8 aa, Cryptosporidium parvum
AKRSEASG

SEQ ID NO: 2251036 - protein, 12 aa, Cryptosporidium parvum
AKRSKEKYKDSM

SEQ ID NO: 2251037 - protein, 11 aa, Cryptosporidium parvum
AKRTESTNLED

SEQ ID NO: 2251038 - protein, 4 aa, Cryptosporidium parvum
AKSD

SEQ ID NO: 2251039 - protein, 5 aa, Cryptosporidium parvum
AKSEF

SEQ ID NO: 2251040 - protein, 6 aa, Cryptosporidium parvum
AKSEHN

SEQ ID NO: 2251041 - protein, 6 aa, Cryptosporidium parvum
AKSGKK

SEQ ID NO: 2251042 - protein, 7 aa, Cryptosporidium parvum
AKSGTDF

SEQ ID NO: 2251043 - protein, 8 aa, Cryptosporidium parvum
AKSGTGKT

SEQ ID NO: 2251044 - protein, 24 aa, Cryptosporidium parvum
AKSHKDSNKASEISFNENNENKRI

SEQ ID NO: 2251045 - protein, 6 aa, Cryptosporidium parvum
AKSIGT

SEQ ID NO: 2251046 - protein, 25 aa, Cryptosporidium parvum
AKSIRNKRRKIEDSNSSYTNSENLN

SEQ ID NO: 2251047 - protein, 17 aa, Cryptosporidium parvum
AKSISKSFSKSSMKSFQ

SEQ ID NO: 2251048 - protein, 11 aa, Cryptosporidium parvum
AKSKANHNSLN

SEQ ID NO: 2251049 - protein, 8 aa, Cryptosporidium parvum
AKSKGRRH

SEQ ID NO: 2251050 - protein, 9 aa, Cryptosporidium parvum
AKSKSERDG

SEQ ID NO: 2251051 - protein, 5 aa, Cryptosporidium parvum
AKSKV

SEQ ID NO: 2251052 - protein, 25 aa, Cryptosporidium parvum
AKSMNNNLESNSDADTVLNQALTKQ

SEQ ID NO: 2251053 - protein, 14 aa, Cryptosporidium parvum
AKSNISNKEPAKHR

SEQ ID NO: 2251054 - protein, 7 aa, Cryptosporidium parvum
AKSPIWD

SEQ ID NO: 2251055 - protein, 11 aa, Cryptosporidium parvum
AKSPPANDPFK

SEQ ID NO: 2251056 - protein, 7 aa, Cryptosporidium parvum
AKSRSKS

SEQ ID NO: 2251057 - protein, 5 aa, Cryptosporidium parvum
AKSRY

SEQ ID NO: 2251058 - protein, 12 aa, Cryptosporidium parvum
AKSSSRTSTETD

SEQ ID NO: 2251059 - protein, 19 aa, Cryptosporidium parvum
AKSSSSLFQNNPNKKNTKL

SEQ ID NO: 2251060 - protein, 6 aa, Cryptosporidium parvum
AKSTDS

SEQ ID NO: 2251061 - protein, 16 aa, Cryptosporidium parvum
AKTGDVESKSQVSTKL

SEQ ID NO: 2251062 - protein, 8 aa, Cryptosporidium parvum
AKTHNTNL

SEQ ID NO: 2251063 - protein, 6 aa, Cryptosporidium parvum
AKTINK

SEQ ID NO: 2251064 - protein, 4 aa, Cryptosporidium parvum
AKTL

SEQ ID NO: 2251065 - protein, 7 aa, Cryptosporidium parvum
AKTLNKT

SEQ ID NO: 2251066 - protein, 12 aa, Cryptosporidium parvum
AKTLRNNNSSRF

SEQ ID NO: 2251067 - protein, 9 aa, Cryptosporidium parvum
AKTMNSLGT

SEQ ID NO: 2251068 - protein, 4 aa, Cryptosporidium parvum
AKTN

SEQ ID NO: 2251069 - protein, 8 aa, Cryptosporidium parvum
AKTNDETK

SEQ ID NO: 2251070 - protein, 9 aa, Cryptosporidium parvum
AKTNNAFSK

SEQ ID NO: 2251071 - protein, 6 aa, Cryptosporidium parvum
AKTSEF

SEQ ID NO: 2251072 - protein, 8 aa, Cryptosporidium parvum
AKTSEHSS

SEQ ID NO: 2251073 - protein, 6 aa, Cryptosporidium parvum
AKTSLK

SEQ ID NO: 2251074 - protein, 34 aa, Cryptosporidium parvum
AKTSSKIKVKGSRANVSSIKSKHSHSEKETPTIS

SEQ ID NO: 2251075 - protein, 12 aa, Cryptosporidium parvum
AKTVSNPLLYSN

SEQ ID NO: 2251076 - protein, 11 aa, Cryptosporidium parvum
AKVSSEWESTE

SEQ ID NO: 2251077 - protein, 18 aa, Cryptosporidium parvum
AKWRPGRGNSSKSQATKR

SEQ ID NO: 2251078 - protein, 4 aa, Cryptosporidium parvum
AKYE

SEQ ID NO: 2251079 - protein, 4 aa, Cryptosporidium parvum
AKYG

SEQ ID NO: 2251080 - protein, 4 aa, Cryptosporidium parvum
AKYI

SEQ ID NO: 2251081 - protein, 9 aa, Cryptosporidium parvum
AKYKQETQP

SEQ ID NO: 2251082 - protein, 4 aa, Cryptosporidium parvum
AKYQ

SEQ ID NO: 2251083 - protein, 11 aa, Cryptosporidium parvum
ALDASKKCEDV

SEQ ID NO: 2251084 - protein, 7 aa, Cryptosporidium parvum
ALDDSDT

SEQ ID NO: 2251085 - protein, 6 aa, Cryptosporidium parvum
ALDKDY

SEQ ID NO: 2251086 - protein, 7 aa, Cryptosporidium parvum
ALDPRNV

SEQ ID NO: 2251087 - protein, 5 aa, Cryptosporidium parvum
ALEDE

SEQ ID NO: 2251088 - protein, 14 aa, Cryptosporidium parvum
ALEENKNSDSSPSF

SEQ ID NO: 2251089 - protein, 6 aa, Cryptosporidium parvum
ALEEQK

SEQ ID NO: 2251090 - protein, 14 aa, Cryptosporidium parvum
ALEESNDKLEPDEV

SEQ ID NO: 2251091 - protein, 8 aa, Cryptosporidium parvum
ALEKENES

SEQ ID NO: 2251092 - protein, 9 aa, Cryptosporidium parvum
ALENEERNV

SEQ ID NO: 2251093 - protein, 13 aa, Cryptosporidium parvum
ALERNKDKLDNED

SEQ ID NO: 2251094 - protein, 27 aa, Cryptosporidium parvum
ALGRDDCSADSNTPEHREGPQSNQNNV

SEQ ID NO: 2251095 - protein, 9 aa, Cryptosporidium parvum
ALKSGGGGK

SEQ ID NO: 2251096 - protein, 8 aa, Cryptosporidium parvum
ALKTEKNE

SEQ ID NO: 2251097 - protein, 5 aa, Cryptosporidium parvum
ALKTM

SEQ ID NO: 2251098 - protein, 8 aa, Cryptosporidium parvum
ALLPTDSS

SEQ ID NO: 2251099 - protein, 9 aa, Cryptosporidium parvum
ALNDAKKNA

SEQ ID NO: 2251100 - protein, 5 aa, Cryptosporidium parvum
ALNDS

SEQ ID NO: 2251101 - protein, 11 aa, Cryptosporidium parvum
ALNNEQEKQKA

SEQ ID NO: 2251102 - protein, 9 aa, Cryptosporidium parvum
ALNQVNSDS

SEQ ID NO: 2251103 - protein, 9 aa, Cryptosporidium parvum
ALNSSTEFG

SEQ ID NO: 2251104 - protein, 5 aa, Cryptosporidium parvum
ALPNE

SEQ ID NO: 2251105 - protein, 14 aa, Cryptosporidium parvum
ALPNNKKIESKNCS

SEQ ID NO: 2251106 - protein, 12 aa, Cryptosporidium parvum
ALPNTNSYLGNS

SEQ ID NO: 2251107 - protein, 12 aa, Cryptosporidium parvum
ALPPPKGFESNP

SEQ ID NO: 2251108 - protein, 8 aa, Cryptosporidium parvum
ALPPSSFG

SEQ ID NO: 2251109 - protein, 20 aa, Cryptosporidium parvum
ALPSSTTESQELDPKSNSTE

SEQ ID NO: 2251110 - protein, 20 aa, Cryptosporidium parvum
ALPTEPEKEKNLETPPSEEY

SEQ ID NO: 2251111 - protein, 23 aa, Cryptosporidium parvum
ALQDQLDARKARAANLKQKRKVL

SEQ ID NO: 2251112 - protein, 10 aa, Cryptosporidium parvum
ALQEKEGGGK

SEQ ID NO: 2251113 - protein, 8 aa, Cryptosporidium parvum
ALQGDKNS

SEQ ID NO: 2251114 - protein, 6 aa, Cryptosporidium parvum
ALQKNT

SEQ ID NO: 2251115 - protein, 12 aa, Cryptosporidium parvum
ALQNSPKESIKE

SEQ ID NO: 2251116 - protein, 8 aa, Cryptosporidium parvum
ALQSKTDS

SEQ ID NO: 2251117 - protein, 13 aa, Cryptosporidium parvum
ALRKQNSSHRISP

SEQ ID NO: 2251118 - protein, 8 aa, Cryptosporidium parvum
ALRNPDEF

SEQ ID NO: 2251119 - protein, 20 aa, Cryptosporidium parvum
ALSANNSKQNTINSGKPGVV

SEQ ID NO: 2251120 - protein, 7 aa, Cryptosporidium parvum
ALSDSEG

SEQ ID NO: 2251121 - protein, 9 aa, Cryptosporidium parvum
ALSNADQKL

SEQ ID NO: 2251122 - protein, 4 aa, Cryptosporidium parvum
ALSR

SEQ ID NO: 2251123 - protein, 8 aa, Cryptosporidium parvum
ALSSEEYQ

SEQ ID NO: 2251124 - protein, 7 aa, Cryptosporidium parvum
ALSSQKY

SEQ ID NO: 2251125 - protein, 11 aa, Cryptosporidium parvum
ALSTGENSEGV

SEQ ID NO: 2251126 - protein, 7 aa, Cryptosporidium parvum
ALTGEGV

SEQ ID NO: 2251127 - protein, 14 aa, Cryptosporidium parvum
ALTGKNIRHVSDKI

SEQ ID NO: 2251128 - protein, 8 aa, Cryptosporidium parvum
ALTPSSNS

SEQ ID NO: 2251129 - protein, 6 aa, Cryptosporidium parvum
ALTTRS

SEQ ID NO: 2251130 - protein, 10 aa, Cryptosporidium parvum
AMASAKSKAF

SEQ ID NO: 2251131 - protein, 8 aa, Cryptosporidium parvum
AMDNDENK

SEQ ID NO: 2251132 - protein, 17 aa, Cryptosporidium parvum
AMGRNDKTKARSIRENK

SEQ ID NO: 2251133 - protein, 14 aa, Cryptosporidium parvum
AMGSVSGQSVIDPS

SEQ ID NO: 2251134 - protein, 10 aa, Cryptosporidium parvum
AMKSGSGDRY

SEQ ID NO: 2251135 - protein, 12 aa, Cryptosporidium parvum
AMNKDHSNEYEQ

SEQ ID NO: 2251136 - protein, 11 aa, Cryptosporidium parvum
AMNNPNSNLGA

SEQ ID NO: 2251137 - protein, 4 aa, Cryptosporidium parvum
AMNS

SEQ ID NO: 2251138 - protein, 10 aa, Cryptosporidium parvum
AMPQNQNRPL

SEQ ID NO: 2251139 - protein, 4 aa, Cryptosporidium parvum
AMQG

SEQ ID NO: 2251140 - protein, 10 aa, Cryptosporidium parvum
AMSEKTSSTL

SEQ ID NO: 2251141 - protein, 6 aa, Cryptosporidium parvum
AMYPNS

SEQ ID NO: 2251142 - protein, 7 aa, Cryptosporidium parvum
ANACNPE

SEQ ID NO: 2251143 - protein, 17 aa, Cryptosporidium parvum
ANAENNQVDEEKSINNM

SEQ ID NO: 2251144 - protein, 17 aa, Cryptosporidium parvum
ANAESTFSSENKPHTEI

SEQ ID NO: 2251145 - protein, 13 aa, Cryptosporidium parvum
ANAGANGPIPTNG

SEQ ID NO: 2251146 - protein, 32 aa, Cryptosporidium parvum
ANASASENTEKTLSETGSTPPPEESSDEESDV

SEQ ID NO: 2251147 - protein, 6 aa, Cryptosporidium parvum
ANASEE

SEQ ID NO: 2251148 - protein, 8 aa, Cryptosporidium parvum
ANDAARHE

SEQ ID NO: 2251149 - protein, 28 aa, Cryptosporidium parvum
ANDFGLADDKDESTDKKKSSSHKNLADR

SEQ ID NO: 2251150 - protein, 8 aa, Cryptosporidium parvum
ANDGSVTH

SEQ ID NO: 2251151 - protein, 5 aa, Cryptosporidium parvum
ANDLA

SEQ ID NO: 2251152 - protein, 9 aa, Cryptosporidium parvum
ANDLKNSIQ

SEQ ID NO: 2251153 - protein, 16 aa, Cryptosporidium parvum
ANDPDHITAESSEIPS

SEQ ID NO: 2251154 - protein, 18 aa, Cryptosporidium parvum
ANDPIYQKNRESSEKSIR

SEQ ID NO: 2251155 - protein, 17 aa, Cryptosporidium parvum
ANDPSPGINAEPDEDNY

SEQ ID NO: 2251156 - protein, 21 aa, Cryptosporidium parvum
ANDSNQQREEKGDKPDARRKV

SEQ ID NO: 2251157 - protein, 7 aa, Cryptosporidium parvum
ANDVSKL

SEQ ID NO: 2251158 - protein, 60 aa, Cryptosporidium parvum
ANEADESADSNNQASNNSGNTNANNANISGNSGSNTANSNSNVTGRSHIGGAGGSSGGFS

SEQ ID NO: 2251159 - protein, 21 aa, Cryptosporidium parvum
ANEEKDAVEKDPENVQKGAVP

SEQ ID NO: 2251160 - protein, 5 aa, Cryptosporidium parvum
ANEGS

SEQ ID NO: 2251161 - protein, 4 aa, Cryptosporidium parvum
ANEI

SEQ ID NO: 2251162 - protein, 5 aa, Cryptosporidium parvum
ANEKI

SEQ ID NO: 2251163 - protein, 10 aa, Cryptosporidium parvum
ANEKTNKQRE

SEQ ID NO: 2251164 - protein, 8 aa, Cryptosporidium parvum
ANENGSGD

SEQ ID NO: 2251165 - protein, 32 aa, Cryptosporidium parvum
ANENSKSHSINSQFQNNEHKRTSKNNKAVRDS

SEQ ID NO: 2251166 - protein, 13 aa, Cryptosporidium parvum
ANEQESNVKNKSF

SEQ ID NO: 2251167 - protein, 7 aa, Cryptosporidium parvum
ANEQNSN

SEQ ID NO: 2251168 - protein, 45 aa, Cryptosporidium parvum
ANERRGQPSSTSQIYSQNKKKPKPYFSDATKDKRTFGTKAGSGWD

SEQ ID NO: 2251169 - protein, 34 aa, Cryptosporidium parvum
ANERRLSRTNSPENRRFGTNSNTEGNDPNGSNGL

SEQ ID NO: 2251170 - protein, 8 aa, Cryptosporidium parvum
ANESNWPG

SEQ ID NO: 2251171 - protein, 6 aa, Cryptosporidium parvum
ANEYET

SEQ ID NO: 2251172 - protein, 4 aa, Cryptosporidium parvum
ANFR

SEQ ID NO: 2251173 - protein, 19 aa, Cryptosporidium parvum
ANGANRSVNSNVPNPAPQM

SEQ ID NO: 2251174 - protein, 9 aa, Cryptosporidium parvum
ANGDFNKST

SEQ ID NO: 2251175 - protein, 40 aa, Cryptosporidium parvum; identical to SEQ ID NO: 2135974

SEQ ID NO: 2251176 - protein, 8 aa, Cryptosporidium parvum
ANGGKSEL

SEQ ID NO: 2251177 - protein, 8 aa, Cryptosporidium parvum
ANGNPISE

SEQ ID NO: 2251178 - protein, 11 aa, Cryptosporidium parvum
ANGPAAGSKAR

SEQ ID NO: 2251179 - protein, 32 aa, Cryptosporidium parvum; identical to SEQ ID NO: 2135977

SEQ ID NO: 2251180 - protein, 4 aa, Cryptosporidium parvum
ANGR

SEQ ID NO: 2251181 - protein, 5 aa, Cryptosporidium parvum
ANGTG

SEQ ID NO: 2251182 - protein, 7 aa, Cryptosporidium parvum
ANGTTVS

SEQ ID NO: 2251183 - protein, 6 aa, Cryptosporidium parvum
ANGTVI

SEQ ID NO: 2251184 - protein, 13 aa, Cryptosporidium parvum
ANGVDGSSPRWAP

SEQ ID NO: 2251185 - protein, 4 aa, Cryptosporidium parvum
ANHD

SEQ ID NO: 2251186 - protein, 21 aa, Cryptosporidium parvum
ANHDDNNNNNKRITGRDRKYN

SEQ ID NO: 2251187 - protein, 23 aa, Cryptosporidium parvum
ANHENENLENTDNRLDNSDITYD

SEQ ID NO: 2251188 - protein, 25 aa, Cryptosporidium parvum
ANHSDDEESEISSLEGDESEKQVED

SEQ ID NO: 2251189 - protein, 5 aa, Cryptosporidium parvum
ANHTT

SEQ ID NO: 2251190 - protein, 6 aa, Cryptosporidium parvum
ANIASP

SEQ ID NO: 2251191 - protein, 7 aa, Cryptosporidium parvum
ANIDESS

SEQ ID NO: 2251192 - protein, 6 aa, Cryptosporidium parvum
ANIDPN

SEQ ID NO: 2251193 - protein, 9 aa, Cryptosporidium parvum
ANIGPNTSN

SEQ ID NO: 2251194 - protein, 16 aa, Cryptosporidium parvum
ANIGSNSGSNTTTTVK

SEQ ID NO: 2251195 - protein, 9 aa, Cryptosporidium parvum
ANIKTDSQS

SEQ ID NO: 2251196 - protein, 7 aa, Cryptosporidium parvum
ANIPKGN

SEQ ID NO: 2251197 - protein, 8 aa, Cryptosporidium parvum
ANIQSPSG

SEQ ID NO: 2251198 - protein, 24 aa, Cryptosporidium parvum
ANISSYPQDISKTQNVGRVQSTCS

SEQ ID NO: 2251199 - protein, 9 aa, Cryptosporidium parvum
ANITNGGNP

SEQ ID NO: 2251200 - protein, 16 aa, Cryptosporidium parvum
ANKADRYGNKSNSKNW

SEQ ID NO: 2251201 - protein, 36 aa, Cryptosporidium parvum
ANKANEKTFTEDKDELVGNTDKNELEDTQDDSTKIL

SEQ ID NO: 2251202 - protein, 8 aa, Cryptosporidium parvum
ANKDNTHI

SEQ ID NO: 2251203 - protein, 9 aa, Cryptosporidium parvum
ANKEGMKIE

SEQ ID NO: 2251204 - protein, 11 aa, Cryptosporidium parvum
ANKELERSTSN

SEQ ID NO: 2251205 - protein, 16 aa, Cryptosporidium parvum
ANKETTIKSEKGNQDE

SEQ ID NO: 2251206 - protein, 7 aa, Cryptosporidium parvum
ANKETYY

SEQ ID NO: 2251207 - protein, 6 aa, Cryptosporidium parvum
ANKGKN

SEQ ID NO: 2251208 - protein, 6 aa, Cryptosporidium parvum
ANKIES

SEQ ID NO: 2251209 - protein, 8 aa, Cryptosporidium parvum
ANKKKEDF

SEQ ID NO: 2251210 - protein, 10 aa, Cryptosporidium parvum
ANKKKNTRQR

SEQ ID NO: 2251211 - protein, 10 aa, Cryptosporidium parvum
ANKKSGVHGR

SEQ ID NO: 2251212 - protein, 28 aa, Cryptosporidium parvum
ANKLTENSRAQRPKKKKRRQQGSIIGGG

SEQ ID NO: 2251213 - protein, 5 aa, Cryptosporidium parvum
ANKND

SEQ ID NO: 2251214 - protein, 11 aa, Cryptosporidium parvum
ANKNSEHPESI

SEQ ID NO: 2251215 - protein, 10 aa, Cryptosporidium parvum
ANKPEDSALQ

SEQ ID NO: 2251216 - protein, 10 aa, Cryptosporidium parvum
ANKPTKMNNI

SEQ ID NO: 2251217 - protein, 6 aa, Cryptosporidium parvum
ANKQTP

SEQ ID NO: 2251218 - protein, 16 aa, Cryptosporidium parvum
ANKQVEEEDGLDSDNE

SEQ ID NO: 2251219 - protein, 31 aa, Cryptosporidium parvum
ANKRAKPKIKEKKHVKKKSNRSIVNENDSGN

SEQ ID NO: 2251220 - protein, 16 aa, Cryptosporidium parvum
ANKRSIPRANSITFRR

SEQ ID NO: 2251221 - protein, 14 aa, Cryptosporidium parvum
ANKSQGGSNQKGGN

SEQ ID NO: 2251222 - protein, 8 aa, Cryptosporidium parvum
ANKTSEGF

SEQ ID NO: 2251223 - protein, 4 aa, Cryptosporidium parvum
ANLE

SEQ ID NO: 2251224 - protein, 5 aa, Cryptosporidium parvum
ANLET

SEQ ID NO: 2251225 - protein, 18 aa, Cryptosporidium parvum
ANLQNSETIDSNSKKISL

SEQ ID NO: 2251226 - protein, 10 aa, Cryptosporidium parvum
ANLQSPPCNI

SEQ ID NO: 2251227 - protein, 4 aa, Cryptosporidium parvum
ANLS

SEQ ID NO: 2251228 - protein, 9 aa, Cryptosporidium parvum
ANLSHRSDT

SEQ ID NO: 2251229 - protein, 6 aa, Cryptosporidium parvum
ANLSSH

SEQ ID NO: 2251230 - protein, 10 aa, Cryptosporidium parvum
ANNDQSNTNF

SEQ ID NO: 2251231 - protein, 6 aa, Cryptosporidium parvum
ANNDSL

SEQ ID NO: 2251232 - protein, 11 aa, Cryptosporidium parvum
ANNDSSSGRAS

SEQ ID NO: 2251233 - protein, 9 aa, Cryptosporidium parvum
ANNGIPKRS

SEQ ID NO: 2251234 - protein, 5 aa, Cryptosporidium parvum
ANNGS

SEQ ID NO: 2251235 - protein, 8 aa, Cryptosporidium parvum
ANNGSSKE

SEQ ID NO: 2251236 - protein, 4 aa, Cryptosporidium parvum
ANNK

SEQ ID NO: 2251237 - protein, 9 aa, Cryptosporidium parvum
ANNKEEKYK

SEQ ID NO: 2251238 - protein, 7 aa, Cryptosporidium parvum
ANNNPHK

SEQ ID NO: 2251239 - protein, 15 aa, Cryptosporidium parvum
ANNPENSSNAINQNS

SEQ ID NO: 2251240 - protein, 6 aa, Cryptosporidium parvum
ANNPLK

SEQ ID NO: 2251241 - protein, 7 aa, Cryptosporidium parvum
ANNPNPA

SEQ ID NO: 2251242 - protein, 5 aa, Cryptosporidium parvum
ANNQS

SEQ ID NO: 2251243 - protein, 21 aa, Cryptosporidium parvum
ANNSNNNNNTNNNNVNNNSNN

SEQ ID NO: 2251244 - protein, 5 aa, Cryptosporidium parvum
ANNTE

SEQ ID NO: 2251245 - protein, 9 aa, Cryptosporidium parvum
ANNTSSGTF

SEQ ID NO: 2251246 - protein, 15 aa, Cryptosporidium parvum
ANNVPSGSRARVTPF

SEQ ID NO: 2251247 - protein, 6 aa, Cryptosporidium parvum
ANNVSP

SEQ ID NO: 2251248 - protein, 8 aa, Cryptosporidium parvum
ANNVSSRS

SEQ ID NO: 2251249 - protein, 14 aa, Cryptosporidium parvum
ANPISSRYDPKKSV

SEQ ID NO: 2251250 - protein, 4 aa, Cryptosporidium parvum
ANPL

SEQ ID NO: 2251251 - protein, 6 aa, Cryptosporidium parvum
ANPPGL

SEQ ID NO: 2251252 - protein, 5 aa, Cryptosporidium parvum
ANPRV

SEQ ID NO: 2251253 - protein, 14 aa, Cryptosporidium parvum
ANPSISSHDNSSLE

SEQ ID NO: 2251254 - protein, 22 aa, Cryptosporidium parvum
ANPTNSNNVSPVSVGNNTNQNM

SEQ ID NO: 2251255 - protein, 16 aa, Cryptosporidium parvum
ANPVSGRYDPRKSPVA

SEQ ID NO: 2251256 - protein, 9 aa, Cryptosporidium parvum
ANQDPEKLG

SEQ ID NO: 2251257 - protein, 7 aa, Cryptosporidium parvum
ANQENSS

SEQ ID NO: 2251258 - protein, 4 aa, Cryptosporidium parvum
ANQG

SEQ ID NO: 2251259 - protein, 9 aa, Cryptosporidium parvum
ANQGIQRDD

SEQ ID NO: 2251260 - protein, 12 aa, Cryptosporidium parvum
ANQHPPPHPSQL

SEQ ID NO: 2251261 - protein, 9 aa, Cryptosporidium parvum
ANQSTNFED

SEQ ID NO: 2251262 - protein, 6 aa, Cryptosporidium parvum
ANRAKN

SEQ ID NO: 2251263 - protein, 10 aa, Cryptosporidium parvum
ANREKRKEEI

SEQ ID NO: 2251264 - protein, 37 aa, Cryptosporidium parvum; identical to SEQ ID NO: 2136051

SEQ ID NO: 2251265 - protein, 13 aa, Cryptosporidium parvum
ANRMKEKGGQCYK

SEQ ID NO: 2251266 - protein, 38 aa, Cryptosporidium parvum
ANRNNNSDNINGEVKAESGIDNNNNNNNNNNGTQQVPT

SEQ ID NO: 2251267 - protein, 25 aa, Cryptosporidium parvum
ANRPQSHTGGASNSRTTTASQHSGL

SEQ ID NO: 2251268 - protein, 9 aa, Cryptosporidium parvum
ANRRNGKSE

SEQ ID NO: 2251269 - protein, 13 aa, Cryptosporidium parvum
ANRRTEAEKLSKG

SEQ ID NO: 2251270 - protein, 7 aa, Cryptosporidium parvum
ANRSVQN

SEQ ID NO: 2251271 - protein, 4 aa, Cryptosporidium parvum
ANSD

SEQ ID NO: 2251272 - protein, 8 aa, Cryptosporidium parvum
ANSEEEEA

SEQ ID NO: 2251273 - protein, 14 aa, Cryptosporidium parvum
ANSEKDALESAEEM

SEQ ID NO: 2251274 - protein, 5 aa, Cryptosporidium parvum
ANSGC

SEQ ID NO: 2251275 - protein, 60 aa, Cryptosporidium parvum
ANSIGKKDSLTSKEKNVTNDNNDDSDSIEDLEDDDEDLEEDDENENENEYENESHQEEID

SEQ ID NO: 2251276 - protein, 29 aa, Cryptosporidium parvum
ANSKIKSKPSTVSQATNSASSSTAPSNIS

SEQ ID NO: 2251277 - protein, 7 aa, Cryptosporidium parvum
ANSKNGE

SEQ ID NO: 2251278 - protein, 20 aa, Cryptosporidium parvum
ANSKSQGEIMEKRDELFEIS

SEQ ID NO: 2251279 - protein, 29 aa, Cryptosporidium parvum
ANSKSSGGSSNINNSSNNNSGGFNDRGDA

SEQ ID NO: 2251280 - protein, 8 aa, Cryptosporidium parvum
ANSKTGGY

SEQ ID NO: 2251281 - protein, 5 aa, Cryptosporidium parvum
ANSNN

SEQ ID NO: 2251282 - protein, 13 aa, Cryptosporidium parvum
ANSNQNPRNDPID

SEQ ID NO: 2251283 - protein, 8 aa, Cryptosporidium parvum
ANSNSQTK

SEQ ID NO: 2251284 - protein, 4 aa, Cryptosporidium parvum
ANSQ

SEQ ID NO: 2251285 - protein, 30 aa, Cryptosporidium parvum
ANSQGYKPNETLQSTNYSDNTTVSESQLSS

SEQ ID NO: 2251286 - protein, 5 aa, Cryptosporidium parvum
ANSQI

SEQ ID NO: 2251287 - protein, 13 aa, Cryptosporidium parvum
ANSQSINKQFEEK

SEQ ID NO: 2251288 - protein, 11 aa, Cryptosporidium parvum
ANSRNNKANID

SEQ ID NO: 2251289 - protein, 7 aa, Cryptosporidium parvum
ANSSEFK

SEQ ID NO: 2251290 - protein, 10 aa, Cryptosporidium parvum
ANSSNNVSSV

SEQ ID NO: 2251291 - protein, 14 aa, Cryptosporidium parvum
ANSSNTFDEPKDKT

SEQ ID NO: 2251292 - protein, 10 aa, Cryptosporidium parvum
ANSVGSEMDS

SEQ ID NO: 2251293 - protein, 7 aa, Cryptosporidium parvum
ANTAPKE

SEQ ID NO: 2251294 - protein, 6 aa, Cryptosporidium parvum
ANTENS

SEQ ID NO: 2251295 - protein, 12 aa, Cryptosporidium parvum
ANTGSAQRSEEC

SEQ ID NO: 2251296 - protein, 22 aa, Cryptosporidium parvum
ANTNLNTNHSISQNVNQTTYGQ

SEQ ID NO: 2251297 - protein, 9 aa, Cryptosporidium parvum
ANTNTHSSI

SEQ ID NO: 2251298 - protein, 6 aa, Cryptosporidium parvum
ANTPID

SEQ ID NO: 2251299 - protein, 7 aa, Cryptosporidium parvum
ANTSEKT

SEQ ID NO: 2251300 - protein, 6 aa, Cryptosporidium parvum
ANTSKE

SEQ ID NO: 2251301 - protein, 8 aa, Cryptosporidium parvum
ANTSSTGQ

SEQ ID NO: 2251302 - protein, 8 aa, Cryptosporidium parvum
ANVEESIR

SEQ ID NO: 2251303 - protein, 6 aa, Cryptosporidium parvum
ANVKDN

SEQ ID NO: 2251304 - protein, 7 aa, Cryptosporidium parvum
ANVNTFD

SEQ ID NO: 2251305 - protein, 4 aa, Cryptosporidium parvum
ANVQ

SEQ ID NO: 2251306 - protein, 7 aa, Cryptosporidium parvum
ANYDGTI

SEQ ID NO: 2251307 - protein, 4 aa, Cryptosporidium parvum
ANYK

SEQ ID NO: 2251308 - protein, 9 aa, Cryptosporidium parvum
ANYKNQPHM

SEQ ID NO: 2251309 - protein, 6 aa, Cryptosporidium parvum
ANYSQT

SEQ ID NO: 2251310 - protein, 5 aa, Cryptosporidium parvum
APAKD

SEQ ID NO: 2251311 - protein, 4 aa, Cryptosporidium parvum
APAT

SEQ ID NO: 2251312 - protein, 11 aa, Cryptosporidium parvum
APDGKKMSKSL

SEQ ID NO: 2251313 - protein, 10 aa, Cryptosporidium parvum
APDPNEVDSR

SEQ ID NO: 2251314 - protein, 6 aa, Cryptosporidium parvum
APDYDD

SEQ ID NO: 2251315 - protein, 13 aa, Cryptosporidium parvum
APDYEGKESGVGD

SEQ ID NO: 2251316 - protein, 6 aa, Cryptosporidium parvum
APEGLE

SEQ ID NO: 2251317 - protein, 4 aa, Cryptosporidium parvum
APEL

SEQ ID NO: 2251318 - protein, 4 aa, Cryptosporidium parvum
APEN

SEQ ID NO: 2251319 - protein, 9 aa, Cryptosporidium parvum
APENLNNGR

SEQ ID NO: 2251320 - protein, 16 aa, Cryptosporidium parvum
APEPKHDEKSEIPKAT

SEQ ID NO: 2251321 - protein, 10 aa, Cryptosporidium parvum
APERQVTEPL

SEQ ID NO: 2251322 - protein, 7 aa, Cryptosporidium parvum
APESDDE

SEQ ID NO: 2251323 - protein, 6 aa, Cryptosporidium parvum
APESVT

SEQ ID NO: 2251324 - protein, 6 aa, Cryptosporidium parvum
APFSQS

SEQ ID NO: 2251325 - protein, 9 aa, Cryptosporidium parvum
APGAPNTWP

SEQ ID NO: 2251326 - protein, 8 aa, Cryptosporidium parvum
APGDDPDI

SEQ ID NO: 2251327 - protein, 7 aa, Cryptosporidium parvum
APGFGDH

SEQ ID NO: 2251328 - protein, 19 aa, Cryptosporidium parvum
APGIPGPSGVQAPTVPNPL

SEQ ID NO: 2251329 - protein, 5 aa, Cryptosporidium parvum
APGKI

SEQ ID NO: 2251330 - protein, 8 aa, Cryptosporidium parvum
APGNYDSN

SEQ ID NO: 2251331 - protein, 5 aa, Cryptosporidium parvum
APGPL

SEQ ID NO: 2251332 - protein, 4 aa, Cryptosporidium parvum
APGQ

SEQ ID NO: 2251333 - protein, 10 aa, Cryptosporidium parvum
APGSGKGTQC

SEQ ID NO: 2251334 - protein, 8 aa, Cryptosporidium parvum
APGSKTSQ

SEQ ID NO: 2251335 - protein, 5 aa, Cryptosporidium parvum
APGSP

SEQ ID NO: 2251336 - protein, 5 aa, Cryptosporidium parvum
APGSW

SEQ ID NO: 2251337 - protein, 6 aa, Cryptosporidium parvum
APHPQW

SEQ ID NO: 2251338 - protein, 12 aa, Cryptosporidium parvum
APIEKKNPHDND

SEQ ID NO: 2251339 - protein, 11 aa, Cryptosporidium parvum
APIQPNEGFSG

SEQ ID NO: 2251340 - protein, 7 aa, Cryptosporidium parvum
APITPRM

SEQ ID NO: 2251341 - protein, 6 aa, Cryptosporidium parvum
APKKID

SEQ ID NO: 2251342 - protein, 6 aa, Cryptosporidium parvum
APKKSI

SEQ ID NO: 2251343 - protein, 23 aa, Cryptosporidium parvum
APKNQEKNRSENVAKEEKPKEFT

SEQ ID NO: 2251344 - protein, 17 aa, Cryptosporidium parvum
APKSNQFNSGAGVQSNP

SEQ ID NO: 2251345 - protein, 26 aa, Cryptosporidium parvum
APKSSLKLDPTKSKAKSKAAQTGPKL

SEQ ID NO: 2251346 - protein, 6 aa, Cryptosporidium parvum
APKTIG

SEQ ID NO: 2251347 - protein, 9 aa, Cryptosporidium parvum
APKVSGFGS

SEQ ID NO: 2251348 - protein, 9 aa, Cryptosporidium parvum
APLEPTPTH

SEQ ID NO: 2251349 - protein, 4 aa, Cryptosporidium parvum
APLP

SEQ ID NO: 2251350 - protein, 15 aa, Cryptosporidium parvum
APMGAGKLPSSYDNN

SEQ ID NO: 2251351 - protein, 5 aa, Cryptosporidium parvum
APNCC

SEQ ID NO: 2251352 - protein, 5 aa, Cryptosporidium parvum
APNDE

SEQ ID NO: 2251353 - protein, 16 aa, Cryptosporidium parvum
APNEEIHEKKDEDQVG

SEQ ID NO: 2251354 - protein, 4 aa, Cryptosporidium parvum
APNF

SEQ ID NO: 2251355 - protein, 8 aa, Cryptosporidium parvum
APNHSQYP

SEQ ID NO: 2251356 - protein, 15 aa, Cryptosporidium parvum
APNKRDPNNSEIDQS

SEQ ID NO: 2251357 - protein, 4 aa, Cryptosporidium parvum
APNL

SEQ ID NO: 2251358 - protein, 5 aa, Cryptosporidium parvum
APNLP

SEQ ID NO: 2251359 - protein, 22 aa, Cryptosporidium parvum
APNQNIYSNTNQTSLNADDTFS

SEQ ID NO: 2251360 - protein, 14 aa, Cryptosporidium parvum
APNQSNLSGNLPSS

SEQ ID NO: 2251361 - protein, 11 aa, Cryptosporidium parvum
APNQYSNSKQI

SEQ ID NO: 2251362 - protein, 5 aa, Cryptosporidium parvum
APNRC

SEQ ID NO: 2251363 - protein, 8 aa, Cryptosporidium parvum
APNSEEIT

SEQ ID NO: 2251364 - protein, 8 aa, Cryptosporidium parvum
APNSHTNN

SEQ ID NO: 2251365 - protein, 12 aa, Cryptosporidium parvum
APNSNVGSLESD

SEQ ID NO: 2251366 - protein, 10 aa, Cryptosporidium parvum
APPAGETSEF

SEQ ID NO: 2251367 - protein, 7 aa, Cryptosporidium parvum
APPAPIK

SEQ ID NO: 2251368 - protein, 20 aa, Cryptosporidium parvum
APPEMKKDELTKRDERREKA

SEQ ID NO: 2251369 - protein, 6 aa, Cryptosporidium parvum
APPERK

SEQ ID NO: 2251370 - protein, 5 aa, Cryptosporidium parvum
APPGC

SEQ ID NO: 2251371 - protein, 6 aa, Cryptosporidium parvum
APPKMM

SEQ ID NO: 2251372 - protein, 15 aa, Cryptosporidium parvum
APPKNQSTKPVEPTF

SEQ ID NO: 2251373 - protein, 5 aa, Cryptosporidium parvum
APPKS

SEQ ID NO: 2251374 - protein, 7 aa, Cryptosporidium parvum
APPPDYV

SEQ ID NO: 2251375 - protein, 6 aa, Cryptosporidium parvum
APPPLP

SEQ ID NO: 2251376 - protein, 25 aa, Cryptosporidium parvum
APPPSSIVTPSREKINRKESAARGH

SEQ ID NO: 2251377 - protein, 5 aa, Cryptosporidium parvum
APPPV

SEQ ID NO: 2251378 - protein, 15 aa, Cryptosporidium parvum
APPRISRKRRKERKK

SEQ ID NO: 2251379 - protein, 15 aa, Cryptosporidium parvum
APPRLDSSSGQGSVA

SEQ ID NO: 2251380 - protein, 10 aa, Cryptosporidium parvum
APPSPKKNVK

SEQ ID NO: 2251381 - protein, 7 aa, Cryptosporidium parvum
APQCPPD

SEQ ID NO: 2251382 - protein, 8 aa, Cryptosporidium parvum
APQDDRED

SEQ ID NO: 2251383 - protein, 6 aa, Cryptosporidium parvum
APQDPS

SEQ ID NO: 2251384 - protein, 6 aa, Cryptosporidium parvum
APQNGI

SEQ ID NO: 2251385 - protein, 22 aa, Cryptosporidium parvum
APQSTDNGADPALSVNSTPQIG

SEQ ID NO: 2251386 - protein, 11 aa, Cryptosporidium parvum
APRAATVKARG

SEQ ID NO: 2251387 - protein, 15 aa, Cryptosporidium parvum
APRAKMNQQRSRRYK

SEQ ID NO: 2251388 - protein, 7 aa, Cryptosporidium parvum
APRDQER

SEQ ID NO: 2251389 - protein, 6 aa, Cryptosporidium parvum
APRGTA

SEQ ID NO: 2251390 - protein, 20 aa, Cryptosporidium parvum
APRKPNKTIPGGKKRGRKRS

SEQ ID NO: 2251391 - protein, 5 aa, Cryptosporidium parvum
APRRP

SEQ ID NO: 2251392 - protein, 4 aa, Cryptosporidium parvum
APSD

SEQ ID NO: 2251393 - protein, 8 aa, Cryptosporidium parvum
APSEAEAQ

SEQ ID NO: 2251394 - protein, 42 aa, Cryptosporidium parvum
APSESESTKDNLTDNFQEQNKSKSNNQNSTTNGQISGNNDHF

SEQ ID NO: 2251395 - protein, 4 aa, Cryptosporidium parvum
APSH

SEQ ID NO: 2251396 - protein, 9 aa, Cryptosporidium parvum
APSISENSD

SEQ ID NO: 2251397 - protein, 20 aa, Cryptosporidium parvum
APSKSDLEQLNEETGGKVTY

SEQ ID NO: 2251398 - protein, 6 aa, Cryptosporidium parvum
APSLKR

SEQ ID NO: 2251399 - protein, 5 aa, Cryptosporidium parvum
APSLS

SEQ ID NO: 2251400 - protein, 65 aa, Cryptosporidium parvum
APSMPAAPSIPAAPMPAAPPMPAAPSMPAAPPMPAAPSMPTAPPMPAAPPMPAAPPMPTVPPMPK

SEQ ID NO: 2251401 - protein, 12 aa, Cryptosporidium parvum
APSTLTDTVSRQ

SEQ ID NO: 2251402 - protein, 5 aa, Cryptosporidium parvum
APTGH

SEQ ID NO: 2251403 - protein, 6 aa, Cryptosporidium parvum
APTGQI

SEQ ID NO: 2251404 - protein, 8 aa, Cryptosporidium parvum
APTGSGKT

SEQ ID NO: 2251405 - protein, 9 aa, Cryptosporidium parvum
APTGSGKTN

SEQ ID NO: 2251406 - protein, 8 aa, Cryptosporidium parvum
APTGTGKT

SEQ ID NO: 2251407 - protein, 7 aa, Cryptosporidium parvum
APTKQFP

SEQ ID NO: 2251408 - protein, 5 aa, Cryptosporidium parvum
APTNL

SEQ ID NO: 2251409 - protein, 14 aa, Cryptosporidium parvum
APTPTKFDNSDDSN

SEQ ID NO: 2251410 - protein, 11 aa, Cryptosporidium parvum
APTSGVKIDQG

SEQ ID NO: 2251411 - protein, 11 aa, Cryptosporidium parvum
APTTERDHNNV

SEQ ID NO: 2251412 - protein, 4 aa, Cryptosporidium parvum
APWK

SEQ ID NO: 2251413 - protein, 4 aa, Cryptosporidium parvum
APYE

SEQ ID NO: 2251414 - protein, 14 aa, Cryptosporidium parvum
APYYSTPCDKSRYG

SEQ ID NO: 2251415 - protein, 8 aa, Cryptosporidium parvum
AQAGPNDL

SEQ ID NO: 2251416 - protein, 6 aa, Cryptosporidium parvum
AQALQQ

SEQ ID NO: 2251417 - protein, 17 aa, Cryptosporidium parvum
AQANDADLQQGQDETLI

SEQ ID NO: 2251418 - protein, 7 aa, Cryptosporidium parvum
AQANNLG

SEQ ID NO: 2251419 - protein, 8 aa, Cryptosporidium parvum
AQAQEQYK

SEQ ID NO: 2251420 - protein, 11 aa, Cryptosporidium parvum
AQDDEVGDGTT

SEQ ID NO: 2251421 - protein, 10 aa, Cryptosporidium parvum
AQDDSDDLEC

SEQ ID NO: 2251422 - protein, 9 aa, Cryptosporidium parvum
AQDKDVENL

SEQ ID NO: 2251423 - protein, 8 aa, Cryptosporidium parvum
AQDLSGEG

SEQ ID NO: 2251424 - protein, 6 aa, Cryptosporidium parvum
AQDLTG

SEQ ID NO: 2251425 - protein, 8 aa, Cryptosporidium parvum
AQDSKDIE

SEQ ID NO: 2251426 - protein, 6 aa, Cryptosporidium parvum
AQDTGK

SEQ ID NO: 2251427 - protein, 12 aa, Cryptosporidium parvum
AQDVEVGDGTSS

SEQ ID NO: 2251428 - protein, 6 aa, Cryptosporidium parvum
AQEDYD

SEQ ID NO: 2251429 - protein, 7 aa, Cryptosporidium parvum
AQEIHES

SEQ ID NO: 2251430 - protein, 7 aa, Cryptosporidium parvum
AQENFEE

SEQ ID NO: 2251431 - protein, 8 aa, Cryptosporidium parvum
AQESESNF

SEQ ID NO: 2251432 - protein, 4 aa, Cryptosporidium parvum
AQEY

SEQ ID NO: 2251433 - protein, 9 aa, Cryptosporidium parvum
AQFENSETN

SEQ ID NO: 2251434 - protein, 10 aa, Cryptosporidium parvum
AQGAAGGGQG

SEQ ID NO: 2251435 - protein, 7 aa, Cryptosporidium parvum
AQGEHGL

SEQ ID NO: 2251436 - protein, 10 aa, Cryptosporidium parvum
AQGHGPGAGL

SEQ ID NO: 2251437 - protein, 10 aa, Cryptosporidium parvum
AQGSHAQKNF

SEQ ID NO: 2251438 - protein, 5 aa, Cryptosporidium parvum
AQIGS

SEQ ID NO: 2251439 - protein, 9 aa, Cryptosporidium parvum
AQINEQKKK

SEQ ID NO: 2251440 - protein, 12 aa, Cryptosporidium parvum
AQIQHQKHQSGI

SEQ ID NO: 2251441 - protein, 15 aa, Cryptosporidium parvum
AQIYSSSQNFNNPGK

SEQ ID NO: 2251442 - protein, 9 aa, Cryptosporidium parvum
AQKCTNNKY

SEQ ID NO: 2251443 - protein, 8 aa, Cryptosporidium parvum
AQKDSPEA

SEQ ID NO: 2251444 - protein, 9 aa, Cryptosporidium parvum
AQKELSSEN

SEQ ID NO: 2251445 - protein, 12 aa, Cryptosporidium parvum
AQKGKLDCQPGK

SEQ ID NO: 2251446 - protein, 9 aa, Cryptosporidium parvum
AQKISSKKR

SEQ ID NO: 2251447 - protein, 8 aa, Cryptosporidium parvum
AQKKNERQ

SEQ ID NO: 2251448 - protein, 24 aa, Cryptosporidium parvum
AQKKSNNKKENQSKRQNGNLKDER

SEQ ID NO: 2251449 - protein, 5 aa, Cryptosporidium parvum
AQKQL

SEQ ID NO: 2251450 - protein, 6 aa, Cryptosporidium parvum
AQKRNL

SEQ ID NO: 2251451 - protein, 8 aa, Cryptosporidium parvum
AQKSQAIR

SEQ ID NO: 2251452 - protein, 7 aa, Cryptosporidium parvum
AQLGDGH

SEQ ID NO: 2251453 - protein, 5 aa, Cryptosporidium parvum
AQLKQ

SEQ ID NO: 2251454 - protein, 6 aa, Cryptosporidium parvum
AQLSQE

SEQ ID NO: 2251455 - protein, 10 aa, Cryptosporidium parvum
AQNENTYKTV

SEQ ID NO: 2251456 - protein, 4 aa, Cryptosporidium parvum
AQNG

SEQ ID NO: 2251457 - protein, 17 aa, Cryptosporidium parvum
AQNPPNTQKSKSNPYSE

SEQ ID NO: 2251458 - protein, 9 aa, Cryptosporidium parvum
AQNQAMEGE

SEQ ID NO: 2251459 - protein, 13 aa, Cryptosporidium parvum
AQNQNSPPKSPNR

SEQ ID NO: 2251460 - protein, 19 aa, Cryptosporidium parvum
AQNQSINGVPYPASSIPQN

SEQ ID NO: 2251461 - protein, 6 aa, Cryptosporidium parvum
AQNRQI

SEQ ID NO: 2251462 - protein, 6 aa, Cryptosporidium parvum
AQPDQA

SEQ ID NO: 2251463 - protein, 5 aa, Cryptosporidium parvum
AQPEL

SEQ ID NO: 2251464 - protein, 6 aa, Cryptosporidium parvum
AQPGDM

SEQ ID NO: 2251465 - protein, 8 aa, Cryptosporidium parvum
AQPMSTHN

SEQ ID NO: 2251466 - protein, 19 aa, Cryptosporidium parvum
AQPSVGQNTGLKSPNSGGI

SEQ ID NO: 2251467 - protein, 4 aa, Cryptosporidium parvum
AQQQ

SEQ ID NO: 2251468 - protein, 9 aa, Cryptosporidium parvum
AQQQNSLSN

SEQ ID NO: 2251469 - protein, 13 aa, Cryptosporidium parvum
AQQQQKYTHRGGV

SEQ ID NO: 2251470 - protein, 5 aa, Cryptosporidium parvum
AQQRK

SEQ ID NO: 2251471 - protein, 8 aa, Cryptosporidium parvum
AQQSSDVR

SEQ ID NO: 2251472 - protein, 5 aa, Cryptosporidium parvum
AQQSV

SEQ ID NO: 2251473 - protein, 4 aa, Cryptosporidium parvum
AQRK

SEQ ID NO: 2251474 - protein, 16 aa, Cryptosporidium parvum
AQRLKSGYANNDQVEI

SEQ ID NO: 2251475 - protein, 25 aa, Cryptosporidium parvum
AQRTSLNSKVNSSNDSINSQTSNLG

SEQ ID NO: 2251476 - protein, 11 aa, Cryptosporidium parvum
AQSEGKEPTPV

SEQ ID NO: 2251477 - protein, 13 aa, Cryptosporidium parvum
AQSGNLRQKKDIG

SEQ ID NO: 2251478 - protein, 4 aa, Cryptosporidium parvum
AQSQ

SEQ ID NO: 2251479 - protein, 19 aa, Cryptosporidium parvum
AQSRSSPNPLSIINISSST

SEQ ID NO: 2251480 - protein, 7 aa, Cryptosporidium parvum
AQSSNPH

SEQ ID NO: 2251481 - protein, 6 aa, Cryptosporidium parvum
AQSSPH

SEQ ID NO: 2251482 - protein, 31 aa, Cryptosporidium parvum
AQSSSSRDSKDGKNNKKNSKINSSGLTNEDL

SEQ ID NO: 2251483 - protein, 7 aa, Cryptosporidium parvum
AQTETNY

SEQ ID NO: 2251484 - protein, 5 aa, Cryptosporidium parvum
AQTHT

SEQ ID NO: 2251485 - protein, 5 aa, Cryptosporidium parvum
AQTIP

SEQ ID NO: 2251486 - protein, 14 aa, Cryptosporidium parvum
AQTNTDKDEKTMEN

SEQ ID NO: 2251487 - protein, 24 aa, Cryptosporidium parvum
AQTPQQANTHNSNSEEEGANRAQQ

SEQ ID NO: 2251488 - protein, 7 aa, Cryptosporidium parvum
AQTSGLP

SEQ ID NO: 2251489 - protein, 11 aa, Cryptosporidium parvum
AQTTTTSNVNV

SEQ ID NO: 2251490 - protein, 15 aa, Cryptosporidium parvum
AQTVGTDEGIPSGSQ

SEQ ID NO: 2251491 - protein, 7 aa, Cryptosporidium parvum
AQVNEKN

SEQ ID NO: 2251492 - protein, 4 aa, Cryptosporidium parvum
AQVT

SEQ ID NO: 2251493 - protein, 6 aa, Cryptosporidium parvum
AQYEPY

SEQ ID NO: 2251494 - protein, 55 aa, Cryptosporidium parvum
ARAKRANKLTTKQVASSPKSKAVKQSPQKKTVKTKSSVETSGKTVETTKKQQAKK

SEQ ID NO: 2251495 - protein, 7 aa, Cryptosporidium parvum
ARANKSW

SEQ ID NO: 2251496 - protein, 4 aa, Cryptosporidium parvum
ARAR

SEQ ID NO: 2251497 - protein, 5 aa, Cryptosporidium parvum
ARDGL

SEQ ID NO: 2251498 - protein, 4 aa, Cryptosporidium parvum
ARDL

SEQ ID NO: 2251499 - protein, 8 aa, Cryptosporidium parvum
ARDMGRER

SEQ ID NO: 2251500 - protein, 4 aa, Cryptosporidium parvum
ARDR

SEQ ID NO: 2251501 - protein, 50 aa, Cryptosporidium parvum; identical to SEQ ID NO: 2136261

SEQ ID NO: 2251502 - protein, 11 aa, Cryptosporidium parvum
AREETEKEGSI

SEQ ID NO: 2251503 - protein, 10 aa, Cryptosporidium parvum
AREPKIVNGP

SEQ ID NO: 2251504 - protein, 5 aa, Cryptosporidium parvum
ARESA

SEQ ID NO: 2251505 - protein, 8 aa, Cryptosporidium parvum
ARESDKMD

SEQ ID NO: 2251506 - protein, 12 aa, Cryptosporidium parvum
ARESLESRAERS

SEQ ID NO: 2251507 - protein, 9 aa, Cryptosporidium parvum
ARESSSIDS

SEQ ID NO: 2251508 - protein, 10 aa, Cryptosporidium parvum
ARETSKKDIS

SEQ ID NO: 2251509 - protein, 6 aa, Cryptosporidium parvum
ARFEKE

SEQ ID NO: 2251510 - protein, 9 aa, Cryptosporidium parvum
ARFSPDDIY

SEQ ID NO: 2251511 - protein, 13 aa, Cryptosporidium parvum
ARGGNMGTSSNGI

SEQ ID NO: 2251512 - protein, 8 aa, Cryptosporidium parvum
ARGRGPRQ

SEQ ID NO: 2251513 - protein, 5 aa, Cryptosporidium parvum
ARGRI

SEQ ID NO: 2251514 - protein, 19 aa, Cryptosporidium parvum
ARGSDVEDPLESEVARTEQ

SEQ ID NO: 2251515 - protein, 7 aa, Cryptosporidium parvum
ARHEGED

SEQ ID NO: 2251516 - protein, 8 aa, Cryptosporidium parvum
ARHPDMPK

SEQ ID NO: 2251517 - protein, 7 aa, Cryptosporidium parvum
ARIDPDS

SEQ ID NO: 2251518 - protein, 7 aa, Cryptosporidium parvum
ARIKGGT

SEQ ID NO: 2251519 - protein, 31 aa, Cryptosporidium parvum
ARIQESSNKMRTKLENDAEDDQTPESDTNKN

SEQ ID NO: 2251520 - protein, 9 aa, Cryptosporidium parvum
ARKADSDIY

SEQ ID NO: 2251521 - protein, 13 aa, Cryptosporidium parvum
ARKKASGIKKTGI

SEQ ID NO: 2251522 - protein, 5 aa, Cryptosporidium parvum
ARKNE

SEQ ID NO: 2251523 - protein, 62 aa, Cryptosporidium parvum
ARKNNNKDIGSTLEKSQTTNSNNKDHKNSSNDTITKEKLSQDHSASTRQHQEQENTQETSSL

SEQ ID NO: 2251524 - protein, 12 aa, Cryptosporidium parvum
ARKNRSNGNSYS

SEQ ID NO: 2251525 - protein, 6 aa, Cryptosporidium parvum
ARKPRH

SEQ ID NO: 2251526 - protein, 6 aa, Cryptosporidium parvum
ARKSKT

SEQ ID NO: 2251527 - protein, 7 aa, Cryptosporidium parvum
ARKSPCL

SEQ ID NO: 2251528 - protein, 17 aa, Cryptosporidium parvum
ARKSSSSSQFGEEGGLN

SEQ ID NO: 2251529 - protein, 10 aa, Cryptosporidium parvum
ARLGDSAKNE

SEQ ID NO: 2251530 - protein, 18 aa, Cryptosporidium parvum
ARLSPSNYRSSRDKPLNR

SEQ ID NO: 2251531 - protein, 7 aa, Cryptosporidium parvum
ARLTPND

SEQ ID NO: 2251532 - protein, 6 aa, Cryptosporidium parvum
ARNDSG

SEQ ID NO: 2251533 - protein, 8 aa, Cryptosporidium parvum
ARNGRHSF

SEQ ID NO: 2251534 - protein, 4 aa, Cryptosporidium parvum
ARNN

SEQ ID NO: 2251535 - protein, 14 aa, Cryptosporidium parvum
ARNNKHANKELDED

SEQ ID NO: 2251536 - protein, 5 aa, Cryptosporidium parvum
ARNPD

SEQ ID NO: 2251537 - protein, 18 aa, Cryptosporidium parvum
ARPGPYAQGRYAPSGALP

SEQ ID NO: 2251538 - protein, 9 aa, Cryptosporidium parvum
ARPGSIEPD

SEQ ID NO: 2251539 - protein, 4 aa, Cryptosporidium parvum
ARPK

SEQ ID NO: 2251540 - protein, 7 aa, Cryptosporidium parvum
ARPKSQQ

SEQ ID NO: 2251541 - protein, 23 aa, Cryptosporidium parvum
ARPKTPPVKNSSYVNTSSPDEIF

SEQ ID NO: 2251542 - protein, 10 aa, Cryptosporidium parvum
ARPRNLEPSE

SEQ ID NO: 2251543 - protein, 8 aa, Cryptosporidium parvum
ARPSTVNN

SEQ ID NO: 2251544 - protein, 5 aa, Cryptosporidium parvum
ARPTL

SEQ ID NO: 2251545 - protein, 32 aa, Cryptosporidium parvum; identical to SEQ ID NO: 2136298

SEQ ID NO: 2251546 - protein, 6 aa, Cryptosporidium parvum
ARQNQD

SEQ ID NO: 2251547 - protein, 5 aa, Cryptosporidium parvum
ARQNS

SEQ ID NO: 2251548 - protein, 6 aa, Cryptosporidium parvum
ARQPNS

SEQ ID NO: 2251549 - protein, 5 aa, Cryptosporidium parvum
ARQRK

SEQ ID NO: 2251550 - protein, 5 aa, Cryptosporidium parvum
ARQRR

SEQ ID NO: 2251551 - protein, 41 aa, Cryptosporidium parvum
ARQTLNGEITPPQSIKKRRVNNNTLQEDHSSSYNSTNIENE

SEQ ID NO: 2251552 - protein, 8 aa, Cryptosporidium parvum
ARRRPYSS

SEQ ID NO: 2251553 - protein, 19 aa, Cryptosporidium parvum
ARRSRESGIQLSSSTVEER

SEQ ID NO: 2251554 - protein, 9 aa, Cryptosporidium parvum
ARRTSNSGV

SEQ ID NO: 2251555 - protein, 12 aa, Cryptosporidium parvum
ARSIETSSKSQD

SEQ ID NO: 2251556 - protein, 13 aa, Cryptosporidium parvum
ARSLEHSSKTAKR

SEQ ID NO: 2251557 - protein, 4 aa, Cryptosporidium parvum
ARSN

SEQ ID NO: 2251558 - protein, 9 aa, Cryptosporidium parvum
ARSNPNKYT

SEQ ID NO: 2251559 - protein, 8 aa, Cryptosporidium parvum
ARSQKLEK

SEQ ID NO: 2251560 - protein, 12 aa, Cryptosporidium parvum
ARSSEGNGATER

SEQ ID NO: 2251561 - protein, 13 aa, Cryptosporidium parvum
ARTGRSKQYGNSS

SEQ ID NO: 2251562 - protein, 6 aa, Cryptosporidium parvum
ARTPQK

SEQ ID NO: 2251563 - protein, 10 aa, Cryptosporidium parvum
ARTQKNKATN

SEQ ID NO: 2251564 - protein, 12 aa, Cryptosporidium parvum
ARTQKNKKTEYH

SEQ ID NO: 2251565 - protein, 21 aa, Cryptosporidium parvum
ARTSVSRRKQNVSKSKRRKTS

SEQ ID NO: 2251566 - protein, 8 aa, Cryptosporidium parvum
ARYRPEPG

SEQ ID NO: 2251567 - protein, 28 aa, Cryptosporidium parvum
ARYTEYDKVQDSNSSENKSNKQKRRRTM

SEQ ID NO: 2251568 - protein, 4 aa, Cryptosporidium parvum
ASAA

SEQ ID NO: 2251569 - protein, 7 aa, Cryptosporidium parvum
ASADDGR

SEQ ID NO: 2251570 - protein, 8 aa, Cryptosporidium parvum
ASADQGDA

SEQ ID NO: 2251571 - protein, 9 aa, Cryptosporidium parvum
ASAEGQSLS

SEQ ID NO: 2251572 - protein, 4 aa, Cryptosporidium parvum
ASAF

SEQ ID NO: 2251573 - protein, 12 aa, Cryptosporidium parvum
ASAGVPYSSGMG

SEQ ID NO: 2251574 - protein, 18 aa, Cryptosporidium parvum
ASAINISSSRSSSSNNNI

SEQ ID NO: 2251575 - protein, 8 aa, Cryptosporidium parvum
ASAKINQD

SEQ ID NO: 2251576 - protein, 16 aa, Cryptosporidium parvum
ASAKRTLSGTPVNSDD

SEQ ID NO: 2251577 - protein, 16 aa, Cryptosporidium parvum
ASANELNTESSQNKNY

SEQ ID NO: 2251578 - protein, 10 aa, Cryptosporidium parvum
ASANGYVRGE

SEQ ID NO: 2251579 - protein, 29 aa, Cryptosporidium parvum
ASAQQGQLNNYATKPTSSDLTVKSQDQDK

SEQ ID NO: 2251580 - protein, 14 aa, Cryptosporidium parvum
ASARRLAEDSNSFI

SEQ ID NO: 2251581 - protein, 15 aa, Cryptosporidium parvum
ASASQRSGRAGRVGP

SEQ ID NO: 2251582 - protein, 9 aa, Cryptosporidium parvum
ASASSDSTV

SEQ ID NO: 2251583 - protein, 4 aa, Cryptosporidium parvum
ASAT

SEQ ID NO: 2251584 - protein, 14 aa, Cryptosporidium parvum
ASATIPSSSNSNNI

SEQ ID NO: 2251585 - protein, 4 aa, Cryptosporidium parvum
ASCG

SEQ ID NO: 2251586 - protein, 8 aa, Cryptosporidium parvum
ASCGSAER

SEQ ID NO: 2251587 - protein, 21 aa, Cryptosporidium parvum
ASCPYSKPRKIKPIDSSHDSL

SEQ ID NO: 2251588 - protein, 4 aa, Cryptosporidium parvum
ASDA

SEQ ID NO: 2251589 - protein, 4 aa, Cryptosporidium parvum
ASDD

SEQ ID NO: 2251590 - protein, 8 aa, Cryptosporidium parvum
ASDDRTKE

SEQ ID NO: 2251591 - protein, 8 aa, Cryptosporidium parvum
ASDEKARF

SEQ ID NO: 2251592 - protein, 7 aa, Cryptosporidium parvum
ASDERGI

SEQ ID NO: 2251593 - protein, 4 aa, Cryptosporidium parvum
ASDF

SEQ ID NO: 2251594 - protein, 8 aa, Cryptosporidium parvum
ASDGIGKA

SEQ ID NO: 2251595 - protein, 6 aa, Cryptosporidium parvum
ASDKPM

SEQ ID NO: 2251596 - protein, 6 aa, Cryptosporidium parvum
ASDLAQ

SEQ ID NO: 2251597 - protein, 8 aa, Cryptosporidium parvum
ASDQDIKR

SEQ ID NO: 2251598 - protein, 18 aa, Cryptosporidium parvum
ASDQGIAKVSSPQSSTSY

SEQ ID NO: 2251599 - protein, 15 aa, Cryptosporidium parvum
ASDQSEDSNSTNEAI

SEQ ID NO: 2251600 - protein, 8 aa, Cryptosporidium parvum
ASDSHSFQ

SEQ ID NO: 2251601 - protein, 11 aa, Cryptosporidium parvum
ASDTSSLEFGP

SEQ ID NO: 2251602 - protein, 5 aa, Cryptosporidium parvum
ASDVS

SEQ ID NO: 2251603 - protein, 24 aa, Cryptosporidium parvum
ASEAKDNIEKEIKSEKLDSEEVQD

SEQ ID NO: 2251604 - protein, 4 aa, Cryptosporidium parvum
ASEC

SEQ ID NO: 2251605 - protein, 11 aa, Cryptosporidium parvum
ASEDEATEKIE

SEQ ID NO: 2251606 - protein, 10 aa, Cryptosporidium parvum
ASEDELEDDT

SEQ ID NO: 2251607 - protein, 5 aa, Cryptosporidium parvum
ASEDG

SEQ ID NO: 2251608 - protein, 7 aa, Cryptosporidium parvum
ASEDKTN

SEQ ID NO: 2251609 - protein, 6 aa, Cryptosporidium parvum
ASEELY

SEQ ID NO: 2251610 - protein, 10 aa, Cryptosporidium parvum
ASEGKNNKSF

SEQ ID NO: 2251611 - protein, 11 aa, Cryptosporidium parvum
ASEGNKRRAEY

SEQ ID NO: 2251612 - protein, 4 aa, Cryptosporidium parvum
ASEI

SEQ ID NO: 2251613 - protein, 10 aa, Cryptosporidium parvum
ASEKQKLNRP

SEQ ID NO: 2251614 - protein, 11 aa, Cryptosporidium parvum
ASEKRNGNEAV

SEQ ID NO: 2251615 - protein, 8 aa, Cryptosporidium parvum
ASENPELP

SEQ ID NO: 2251616 - protein, 15 aa, Cryptosporidium parvum
ASENPKEEVNSESLE

SEQ ID NO: 2251617 - protein, 26 aa, Cryptosporidium parvum
ASEQETQESACPESKASNGSKSESTI

SEQ ID NO: 2251618 - protein, 16 aa, Cryptosporidium parvum
ASERSDLDYKLVADQY

SEQ ID NO: 2251619 - protein, 8 aa, Cryptosporidium parvum
ASESNSSD

SEQ ID NO: 2251620 - protein, 13 aa, Cryptosporidium parvum
ASESSKSEREPKF

SEQ ID NO: 2251621 - protein, 4 aa, Cryptosporidium parvum
ASET

SEQ ID NO: 2251622 - protein, 15 aa, Cryptosporidium parvum
ASETSRPDPDLSDDD

SEQ ID NO: 2251623 - protein, 7 aa, Cryptosporidium parvum
ASETTTE

SEQ ID NO: 2251624 - protein, 5 aa, Cryptosporidium parvum
ASEYT

SEQ ID NO: 2251625 - protein, 8 aa, Cryptosporidium parvum
ASFESKSD

SEQ ID NO: 2251626 - protein, 4 aa, Cryptosporidium parvum
ASFG

SEQ ID NO: 2251627 - protein, 4 aa, Cryptosporidium parvum
ASGD

SEQ ID NO: 2251628 - protein, 7 aa, Cryptosporidium parvum
ASGDRKG

SEQ ID NO: 2251629 - protein, 9 aa, Cryptosporidium parvum
ASGEAQAAE

SEQ ID NO: 2251630 - protein, 30 aa, Cryptosporidium parvum
ASGGDGTGTTGGEEDEENNEEANEEPEIES

SEQ ID NO: 2251631 - protein, 9 aa, Cryptosporidium parvum
ASGGGTADR

SEQ ID NO: 2251632 - protein, 7 aa, Cryptosporidium parvum
ASGGRYV

SEQ ID NO: 2251633 - protein, 9 aa, Cryptosporidium parvum
ASGISPNTI

SEQ ID NO: 2251634 - protein, 7 aa, Cryptosporidium parvum
ASGNNPK

SEQ ID NO: 2251635 - protein, 11 aa, Cryptosporidium parvum
ASGNSKKNSSK

SEQ ID NO: 2251636 - protein, 12 aa, Cryptosporidium parvum
ASGRAGRRGYDV

SEQ ID NO: 2251637 - protein, 7 aa, Cryptosporidium parvum
ASGTGGK

SEQ ID NO: 2251638 - protein, 6 aa, Cryptosporidium parvum
ASGYDK

SEQ ID NO: 2251639 - protein, 8 aa, Cryptosporidium parvum
ASGYPANS

SEQ ID NO: 2251640 - protein, 7 aa, Cryptosporidium parvum
ASGYSSN

SEQ ID NO: 2251641 - protein, 7 aa, Cryptosporidium parvum
ASHEEEL

SEQ ID NO: 2251642 - protein, 8 aa, Cryptosporidium parvum
ASHKGNVS

SEQ ID NO: 2251643 - protein, 26 aa, Cryptosporidium parvum
ASHKTEKSDFQYNNTPQNKLPSDRSN

SEQ ID NO: 2251644 - protein, 4 aa, Cryptosporidium parvum
ASHN

SEQ ID NO: 2251645 - protein, 10 aa, Cryptosporidium parvum
ASIEDSSLTT

SEQ ID NO: 2251646 - protein, 4 aa, Cryptosporidium parvum
ASIN

SEQ ID NO: 2251647 - protein, 20 aa, Cryptosporidium parvum
ASINDENDSSSIETQSNSRD

SEQ ID NO: 2251648 - protein, 13 aa, Cryptosporidium parvum
ASINKQNNNGNSP

SEQ ID NO: 2251649 - protein, 4 aa, Cryptosporidium parvum
ASIP

SEQ ID NO: 2251650 - protein, 10 aa, Cryptosporidium parvum
ASIPDERGDI

SEQ ID NO: 2251651 - protein, 6 aa, Cryptosporidium parvum
ASIREK

SEQ ID NO: 2251652 - protein, 13 aa, Cryptosporidium parvum
ASIRGDRVSHESQ

SEQ ID NO: 2251653 - protein, 16 aa, Cryptosporidium parvum
ASISTNNTLSSPRSSE

SEQ ID NO: 2251654 - protein, 5 aa, Cryptosporidium parvum
ASITP

SEQ ID NO: 2251655 - protein, 5 aa, Cryptosporidium parvum
ASIVP

SEQ ID NO: 2251656 - protein, 26 aa, Cryptosporidium parvum
ASKEEVEIKDEDDVQNNKSNNEATSI

SEQ ID NO: 2251657 - protein, 19 aa, Cryptosporidium parvum
ASKEKGRYKQSGNESSQFR

SEQ ID NO: 2251658 - protein, 8 aa, Cryptosporidium parvum
ASKEKKDK

SEQ ID NO: 2251659 - protein, 4 aa, Cryptosporidium parvum
ASKF

SEQ ID NO: 2251660 - protein, 4 aa, Cryptosporidium parvum
ASKG

SEQ ID NO: 2251661 - protein, 7 aa, Cryptosporidium parvum
ASKGAIN

SEQ ID NO: 2251662 - protein, 13 aa, Cryptosporidium parvum
ASKGKSDSKVTKN

SEQ ID NO: 2251663 - protein, 8 aa, Cryptosporidium parvum
ASKGSFGA

SEQ ID NO: 2251664 - protein, 11 aa, Cryptosporidium parvum
ASKGTFVREST

SEQ ID NO: 2251665 - protein, 5 aa, Cryptosporidium parvum
ASKGV

SEQ ID NO: 2251666 - protein, 4 aa, Cryptosporidium parvum
ASKK

SEQ ID NO: 2251667 - protein, 8 aa, Cryptosporidium parvum
ASKKNGSF

SEQ ID NO: 2251668 - protein, 14 aa, Cryptosporidium parvum
ASKLRDSLKGNGMD

SEQ ID NO: 2251669 - protein, 9 aa, Cryptosporidium parvum
ASKNIDPES

SEQ ID NO: 2251670 - protein, 6 aa, Cryptosporidium parvum
ASKNPE

SEQ ID NO: 2251671 - protein, 6 aa, Cryptosporidium parvum
ASKNWD

SEQ ID NO: 2251672 - protein, 16 aa, Cryptosporidium parvum
ASKPSDQVCNESSKSC

SEQ ID NO: 2251673 - protein, 5 aa, Cryptosporidium parvum
ASKQI

SEQ ID NO: 2251674 - protein, 11 aa, Cryptosporidium parvum
ASKQNQSGESM

SEQ ID NO: 2251675 - protein, 7 aa, Cryptosporidium parvum
ASLETGV

SEQ ID NO: 2251676 - protein, 7 aa, Cryptosporidium parvum
ASLGPTI

SEQ ID NO: 2251677 - protein, 11 aa, Cryptosporidium parvum
ASLIDKQEDKI

SEQ ID NO: 2251678 - protein, 14 aa, Cryptosporidium parvum
ASLKENPKNVKAAY

SEQ ID NO: 2251679 - protein, 14 aa, Cryptosporidium parvum
ASLNEDKMNDSNDL

SEQ ID NO: 2251680 - protein, 11 aa, Cryptosporidium parvum
ASLNSGSPESR

SEQ ID NO: 2251681 - protein, 5 aa, Cryptosporidium parvum
ASLSR

SEQ ID NO: 2251682 - protein, 4 aa, Cryptosporidium parvum
ASMD

SEQ ID NO: 2251683 - protein, 4 aa, Cryptosporidium parvum
ASMG

SEQ ID NO: 2251684 - protein, 16 aa, Cryptosporidium parvum
ASMISGSETSDSEEIQ

SEQ ID NO: 2251685 - protein, 8 aa, Cryptosporidium parvum
ASNDENDV

SEQ ID NO: 2251686 - protein, 9 aa, Cryptosporidium parvum
ASNDRKPLD

SEQ ID NO: 2251687 - protein, 6 aa, Cryptosporidium parvum
ASNEPN

SEQ ID NO: 2251688 - protein, 36 aa, Cryptosporidium parvum
ASNERKNTHETPSRPPLSEKQKSETRKEVDSSLSCD

SEQ ID NO: 2251689 - protein, 8 aa, Cryptosporidium parvum
ASNFKNDS

SEQ ID NO: 2251690 - protein, 7 aa, Cryptosporidium parvum
ASNGTLS

SEQ ID NO: 2251691 - protein, 6 aa, Cryptosporidium parvum
ASNINE

SEQ ID NO: 2251692 - protein, 9 aa, Cryptosporidium parvum
ASNKHQEEV

SEQ ID NO: 2251693 - protein, 6 aa, Cryptosporidium parvum
ASNKNY

SEQ ID NO: 2251694 - protein, 9 aa, Cryptosporidium parvum
ASNKSLPLP

SEQ ID NO: 2251695 - protein, 4 aa, Cryptosporidium parvum
ASNL

SEQ ID NO: 2251696 - protein, 10 aa, Cryptosporidium parvum
ASNLKDKEIN

SEQ ID NO: 2251697 - protein, 53 aa, Cryptosporidium parvum
ASNLQKQEDEEREEELSSWQGGGRAAGSTESQGNHNEKPKSSRKLQKEHASEF

SEQ ID NO: 2251698 - protein, 29 aa, Cryptosporidium parvum
ASNMNDSNGLKSKMNEKNLDSMTKNVEKK

SEQ ID NO: 2251699 - protein, 8 aa, Cryptosporidium parvum
ASNNINNS

SEQ ID NO: 2251700 - protein, 5 aa, Cryptosporidium parvum
ASNNS

SEQ ID NO: 2251701 - protein, 9 aa, Cryptosporidium parvum
ASNNTKTNH

SEQ ID NO: 2251702 - protein, 5 aa, Cryptosporidium parvum
ASNNV

SEQ ID NO: 2251703 - protein, 7 aa, Cryptosporidium parvum
ASNPEKA

SEQ ID NO: 2251704 - protein, 40 aa, Cryptosporidium parvum
ASNPPKSQAPRKSLSSRGNSKYKRQTRRKQAQDQQDSSTT

SEQ ID NO: 2251705 - protein, 15 aa, Cryptosporidium parvum
ASNPSKTSSSSDEII

SEQ ID NO: 2251706 - protein, 7 aa, Cryptosporidium parvum
ASNPSNV

SEQ ID NO: 2251707 - protein, 9 aa, Cryptosporidium parvum
ASNRPTKQS

SEQ ID NO: 2251708 - protein, 16 aa, Cryptosporidium parvum
ASNSERNSPENKKDIN

SEQ ID NO: 2251709 - protein, 5 aa, Cryptosporidium parvum
ASNSI

SEQ ID NO: 2251710 - protein, 18 aa, Cryptosporidium parvum
ASNSNRRLAQPPEGTFYD

SEQ ID NO: 2251711 - protein, 8 aa, Cryptosporidium parvum
ASNTREFQ

SEQ ID NO: 2251712 - protein, 8 aa, Cryptosporidium parvum
ASNTRNSY

SEQ ID NO: 2251713 - protein, 40 aa, Cryptosporidium parvum
ASNTRSNNSNKNTRKNKTDFATKSPECNTKNKNKSYVDGI

SEQ ID NO: 2251714 - protein, 13 aa, Cryptosporidium parvum
ASNTSSFQSSDAP

SEQ ID NO: 2251715 - protein, 7 aa, Cryptosporidium parvum
ASNWPTI

SEQ ID NO: 2251716 - protein, 6 aa, Cryptosporidium parvum
ASPAIE

SEQ ID NO: 2251717 - protein, 8 aa, Cryptosporidium parvum
ASPDETAY

SEQ ID NO: 2251718 - protein, 7 aa, Cryptosporidium parvum
ASPDRIK

SEQ ID NO: 2251719 - protein, 7 aa, Cryptosporidium parvum
ASPGAAP

SEQ ID NO: 2251720 - protein, 7 aa, Cryptosporidium parvum
ASPGKNI

SEQ ID NO: 2251721 - protein, 14 aa, Cryptosporidium parvum
ASPISGSNRDSIGG

SEQ ID NO: 2251722 - protein, 6 aa, Cryptosporidium parvum
ASPKEF

SEQ ID NO: 2251723 - protein, 17 aa, Cryptosporidium parvum
ASPLQQNSANSVASATS

SEQ ID NO: 2251724 - protein, 29 aa, Cryptosporidium parvum
ASPLSTSQHQNLQQKKQQIHQNNHQQSSA

SEQ ID NO: 2251725 - protein, 7 aa, Cryptosporidium parvum
ASPLSTT

SEQ ID NO: 2251726 - protein, 7 aa, Cryptosporidium parvum
ASPNTKI

SEQ ID NO: 2251727 - protein, 34 aa, Cryptosporidium parvum
ASPNVSNAQTRQQNYVSSNSSSFNNKSQSNYKSN

SEQ ID NO: 2251728 - protein, 7 aa, Cryptosporidium parvum
ASPPEEI

SEQ ID NO: 2251729 - protein, 13 aa, Cryptosporidium parvum
ASPPNERKHPKGI

SEQ ID NO: 2251730 - protein, 10 aa, Cryptosporidium parvum
ASPPPGYPEV

SEQ ID NO: 2251731 - protein, 4 aa, Cryptosporidium parvum
ASPR

SEQ ID NO: 2251732 - protein, 16 aa, Cryptosporidium parvum
ASPVKSDTSTATPSSM

SEQ ID NO: 2251733 - protein, 5 aa, Cryptosporidium parvum
ASPYN

SEQ ID NO: 2251734 - protein, 8 aa, Cryptosporidium parvum
ASQAQSRM

SEQ ID NO: 2251735 - protein, 14 aa, Cryptosporidium parvum
ASQDDRKKRPNNPL

SEQ ID NO: 2251736 - protein, 7 aa, Cryptosporidium parvum
ASQDEAR

SEQ ID NO: 2251737 - protein, 10 aa, Cryptosporidium parvum
ASQDSKVTKD

SEQ ID NO: 2251738 - protein, 6 aa, Cryptosporidium parvum
ASQGVE

SEQ ID NO: 2251739 - protein, 4 aa, Cryptosporidium parvum
ASQI

SEQ ID NO: 2251740 - protein, 14 aa, Cryptosporidium parvum
ASQLKKKEKIPEKQ

SEQ ID NO: 2251741 - protein, 8 aa, Cryptosporidium parvum
ASQNLTKY

SEQ ID NO: 2251742 - protein, 23 aa, Cryptosporidium parvum
ASQQPPSSSYSLPPQFSNEPDVR

SEQ ID NO: 2251743 - protein, 28 aa, Cryptosporidium parvum
ASQQTPPENISGKKPCGSNCMPESPSEH

SEQ ID NO: 2251744 - protein, 5 aa, Cryptosporidium parvum
ASQRG

SEQ ID NO: 2251745 - protein, 8 aa, Cryptosporidium parvum
ASQRSNCV

SEQ ID NO: 2251746 - protein, 5 aa, Cryptosporidium parvum
ASQSF

SEQ ID NO: 2251747 - protein, 7 aa, Cryptosporidium parvum
ASQSPDV

SEQ ID NO: 2251748 - protein, 9 aa, Cryptosporidium parvum
ASQSSDQTV

SEQ ID NO: 2251749 - protein, 10 aa, Cryptosporidium parvum
ASQSSEMGNL

SEQ ID NO: 2251750 - protein, 7 aa, Cryptosporidium parvum
ASQTISE

SEQ ID NO: 2251751 - protein, 6 aa, Cryptosporidium parvum
ASQTNC

SEQ ID NO: 2251752 - protein, 15 aa, Cryptosporidium parvum
ASQTQNQPQTQINPQ

SEQ ID NO: 2251753 - protein, 10 aa, Cryptosporidium parvum
ASQYKETQLK

SEQ ID NO: 2251754 - protein, 7 aa, Cryptosporidium parvum
ASRAQIE

SEQ ID NO: 2251755 - protein, 5 aa, Cryptosporidium parvum
ASRDE

SEQ ID NO: 2251756 - protein, 6 aa, Cryptosporidium parvum
ASRDIQ

SEQ ID NO: 2251757 - protein, 6 aa, Cryptosporidium parvum
ASRDNT

SEQ ID NO: 2251758 - protein, 9 aa, Cryptosporidium parvum
ASREKISQL

SEQ ID NO: 2251759 - protein, 5 aa, Cryptosporidium parvum
ASRGL

SEQ ID NO: 2251760 - protein, 5 aa, Cryptosporidium parvum
ASRGM

SEQ ID NO: 2251761 - protein, 12 aa, Cryptosporidium parvum
ASRGVRSRKYRN

SEQ ID NO: 2251762 - protein, 7 aa, Cryptosporidium parvum
ASRHGQK

SEQ ID NO: 2251763 - protein, 10 aa, Cryptosporidium parvum
ASRHGQKGTI

SEQ ID NO: 2251764 - protein, 5 aa, Cryptosporidium parvum
ASRIN

SEQ ID NO: 2251765 - protein, 6 aa, Cryptosporidium parvum
ASRPGK

SEQ ID NO: 2251766 - protein, 6 aa, Cryptosporidium parvum
ASRSFN

SEQ ID NO: 2251767 - protein, 6 aa, Cryptosporidium parvum
ASRTCR

SEQ ID NO: 2251768 - protein, 11 aa, Cryptosporidium parvum
ASRTKNRKRNI

SEQ ID NO: 2251769 - protein, 5 aa, Cryptosporidium parvum
ASRYD

SEQ ID NO: 2251770 - protein, 9 aa, Cryptosporidium parvum
ASSCGNDPI

SEQ ID NO: 2251771 - protein, 6 aa, Cryptosporidium parvum
ASSDET

SEQ ID NO: 2251772 - protein, 14 aa, Cryptosporidium parvum
ASSEHTSTAEKRSR

SEQ ID NO: 2251773 - protein, 9 aa, Cryptosporidium parvum
ASSEMNSDS

SEQ ID NO: 2251774 - protein, 4 aa, Cryptosporidium parvum
ASSG

SEQ ID NO: 2251775 - protein, 6 aa, Cryptosporidium parvum
ASSGED

SEQ ID NO: 2251776 - protein, 5 aa, Cryptosporidium parvum
ASSGF

SEQ ID NO: 2251777 - protein, 9 aa, Cryptosporidium parvum
ASSGGGGKG

SEQ ID NO: 2251778 - protein, 10 aa, Cryptosporidium parvum
ASSGNHIGAG

SEQ ID NO: 2251779 - protein, 10 aa, Cryptosporidium parvum
ASSGNTPINN

SEQ ID NO: 2251780 - protein, 7 aa, Cryptosporidium parvum
ASSGNYY

SEQ ID NO: 2251781 - protein, 4 aa, Cryptosporidium parvum
ASSI

SEQ ID NO: 2251782 - protein, 10 aa, Cryptosporidium parvum
ASSKGKENVI

SEQ ID NO: 2251783 - protein, 14 aa, Cryptosporidium parvum
ASSKKISSQNNSQE

SEQ ID NO: 2251784 - protein, 20 aa, Cryptosporidium parvum
ASSKTDSTFDTSYSTYSDEN

SEQ ID NO: 2251785 - protein, 6 aa, Cryptosporidium parvum
ASSKTM

SEQ ID NO: 2251786 - protein, 14 aa, Cryptosporidium parvum
ASSLISDPKSQGRY

SEQ ID NO: 2251787 - protein, 12 aa, Cryptosporidium parvum
ASSLNNNRTNTI

SEQ ID NO: 2251788 - protein, 15 aa, Cryptosporidium parvum
ASSMGKFSTDRTIEE

SEQ ID NO: 2251789 - protein, 9 aa, Cryptosporidium parvum
ASSNEAEVR

SEQ ID NO: 2251790 - protein, 15 aa, Cryptosporidium parvum
ASSPTSNNATREDLG

SEQ ID NO: 2251791 - protein, 232 aa, Cryptosporidium parvum; identical to SEQ ID NO: 2136510

SEQ ID NO: 2251792 - protein, 10 aa, Cryptosporidium parvum
ASSQDNLECK

SEQ ID NO: 2251793 - protein, 9 aa, Cryptosporidium parvum
ASSQRDIRD

SEQ ID NO: 2251794 - protein, 13 aa, Cryptosporidium parvum
ASSRDHSKLDRSK

SEQ ID NO: 2251795 - protein, 16 aa, Cryptosporidium parvum
ASSSRNENSNISNSYY

SEQ ID NO: 2251796 - protein, 46 aa, Cryptosporidium parvum
ASSSSKVLGATPSAQISSSLSSSSSSSSSSLASSSSSSSSSPSLTL

SEQ ID NO: 2251797 - protein, 5 aa, Cryptosporidium parvum
ASSST

SEQ ID NO: 2251798 - protein, 5 aa, Cryptosporidium parvum
ASSTI

SEQ ID NO: 2251799 - protein, 6 aa, Cryptosporidium parvum
ASSTIK

SEQ ID NO: 2251800 - protein, 30 aa, Cryptosporidium parvum
ASSTSATKANAKKTAQAVKNSKRSSTTKIR

SEQ ID NO: 2251801 - protein, 16 aa, Cryptosporidium parvum
ASSTSNMNSNGGHSEY

SEQ ID NO: 2251802 - protein, 10 aa, Cryptosporidium parvum
ASSVEETASM

SEQ ID NO: 2251803 - protein, 30 aa, Cryptosporidium parvum
ASSVSGLKKDNIASDNATIKNSSEYKINTN

SEQ ID NO: 2251804 - protein, 16 aa, Cryptosporidium parvum
ASTGFKNDARKTVNRD

SEQ ID NO: 2251805 - protein, 7 aa, Cryptosporidium parvum
ASTGPRY

SEQ ID NO: 2251806 - protein, 69 aa, Cryptosporidium parvum
ASTGSSSSSSPLTVSGSTPGSSIVTSTSNSNSVSNIGPSTGTGTGTSSISTSNSNSNSNSSSNSNSSTI

SEQ ID NO: 2251807 - protein, 7 aa, Cryptosporidium parvum
ASTGTTI

SEQ ID NO: 2251808 - protein, 12 aa, Cryptosporidium parvum
ASTISTTPTRSI

SEQ ID NO: 2251809 - protein, 15 aa, Cryptosporidium parvum
ASTKRMEEKGIRKRR

SEQ ID NO: 2251810 - protein, 33 aa, Cryptosporidium parvum
ASTNPDNNNDSNNKNNNNNNDDNNNNMAENNHY

SEQ ID NO: 2251811 - protein, 13 aa, Cryptosporidium parvum
ASTNSSQEISPSS

SEQ ID NO: 2251812 - protein, 7 aa, Cryptosporidium parvum
ASTNSTE

SEQ ID NO: 2251813 - protein, 5 aa, Cryptosporidium parvum
ASTPS

SEQ ID NO: 2251814 - protein, 9 aa, Cryptosporidium parvum
ASTPTEKDK

SEQ ID NO: 2251815 - protein, 4 aa, Cryptosporidium parvum
ASTQ

SEQ ID NO: 2251816 - protein, 4 aa, Cryptosporidium parvum
ASTR

SEQ ID NO: 2251817 - protein, 18 aa, Cryptosporidium parvum
ASTSPVSPTSSNLTDSEY

SEQ ID NO: 2251818 - protein, 8 aa, Cryptosporidium parvum
ASTSTSHA

SEQ ID NO: 2251819 - protein, 15 aa, Cryptosporidium parvum
ASTTAREVESSEPEE

SEQ ID NO: 2251820 - protein, 10 aa, Cryptosporidium parvum
ASTTVSPNTN

SEQ ID NO: 2251821 - protein, 8 aa, Cryptosporidium parvum
ASTVPKDY

SEQ ID NO: 2251822 - protein, 5 aa, Cryptosporidium parvum
ASVGK

SEQ ID NO: 2251823 - protein, 6 aa, Cryptosporidium parvum
ASVLDG

SEQ ID NO: 2251824 - protein, 23 aa, Cryptosporidium parvum
ASVPSPALNTSRSFSSKTRGKSI

SEQ ID NO: 2251825 - protein, 15 aa, Cryptosporidium parvum
ASVSTPGSPDINSDT

SEQ ID NO: 2251826 - protein, 9 aa, Cryptosporidium parvum
ASWSSDGHT

SEQ ID NO: 2251827 - protein, 7 aa, Cryptosporidium parvum
ASYEKTM

SEQ ID NO: 2251828 - protein, 13 aa, Cryptosporidium parvum
ASYNSNNQNAVGR

SEQ ID NO: 2251829 - protein, 4 aa, Cryptosporidium parvum
ASYQ

SEQ ID NO: 2251830 - protein, 20 aa, Cryptosporidium parvum
ASYYSSSINNSNPIKKGGGF

SEQ ID NO: 2251831 - protein, 5 aa, Cryptosporidium parvum
ATADS

SEQ ID NO: 2251832 - protein, 18 aa, Cryptosporidium parvum
ATAETSINRSTETKPEKL

SEQ ID NO: 2251833 - protein, 7 aa, Cryptosporidium parvum
ATAGDGL

SEQ ID NO: 2251834 - protein, 13 aa, Cryptosporidium parvum
ATAGDTHLGGEDF

SEQ ID NO: 2251835 - protein, 7 aa, Cryptosporidium parvum
ATAPGTA

SEQ ID NO: 2251836 - protein, 12 aa, Cryptosporidium parvum
ATARKRTRDADY

SEQ ID NO: 2251837 - protein, 10 aa, Cryptosporidium parvum
ATASPKVQRD

SEQ ID NO: 2251838 - protein, 7 aa, Cryptosporidium parvum
ATASSDH

SEQ ID NO: 2251839 - protein, 4 aa, Cryptosporidium parvum
ATAT

SEQ ID NO: 2251840 - protein, 6 aa, Cryptosporidium parvum
ATCSDR

SEQ ID NO: 2251841 - protein, 8 aa, Cryptosporidium parvum
ATDAHDQF

SEQ ID NO: 2251842 - protein, 5 aa, Cryptosporidium parvum
ATDIT

SEQ ID NO: 2251843 - protein, 6 aa, Cryptosporidium parvum
ATDKDG

SEQ ID NO: 2251844 - protein, 9 aa, Cryptosporidium parvum
ATDNESKNL

SEQ ID NO: 2251845 - protein, 5 aa, Cryptosporidium parvum
ATDQE

SEQ ID NO: 2251846 - protein, 7 aa, Cryptosporidium parvum
ATDSNTI

SEQ ID NO: 2251847 - protein, 5 aa, Cryptosporidium parvum
ATEEE

SEQ ID NO: 2251848 - protein, 8 aa, Cryptosporidium parvum
ATEGDANT

SEQ ID NO: 2251849 - protein, 4 aa, Cryptosporidium parvum
ATEK

SEQ ID NO: 2251850 - protein, 8 aa, Cryptosporidium parvum
ATESARHN

SEQ ID NO: 2251851 - protein, 7 aa, Cryptosporidium parvum
ATESGSI

SEQ ID NO: 2251852 - protein, 5 aa, Cryptosporidium parvum
ATESN

SEQ ID NO: 2251853 - protein, 6 aa, Cryptosporidium parvum
ATESNE

SEQ ID NO: 2251854 - protein, 9 aa, Cryptosporidium parvum
ATESSNDER

SEQ ID NO: 2251855 - protein, 6 aa, Cryptosporidium parvum
ATGADD

SEQ ID NO: 2251856 - protein, 4 aa, Cryptosporidium parvum
ATGC

SEQ ID NO: 2251857 - protein, 10 aa, Cryptosporidium parvum
ATGDSKKRDY

SEQ ID NO: 2251858 - protein, 8 aa, Cryptosporidium parvum
ATGGCTDG

SEQ ID NO: 2251859 - protein, 7 aa, Cryptosporidium parvum
ATGGNDN

SEQ ID NO: 2251860 - protein, 7 aa, Cryptosporidium parvum
ATGGSDA

SEQ ID NO: 2251861 - protein, 10 aa, Cryptosporidium parvum
ATGKELPRGV

SEQ ID NO: 2251862 - protein, 17 aa, Cryptosporidium parvum
ATGNDKGDVLLYRINDY

SEQ ID NO: 2251863 - protein, 39 aa, Cryptosporidium parvum
ATGNKRQRLEGQEGGSSIQNTQQNSFKEENNMGNNTSNV

SEQ ID NO: 2251864 - protein, 6 aa, Cryptosporidium parvum
ATGRSK

SEQ ID NO: 2251865 - protein, 8 aa, Cryptosporidium parvum
ATGSADKT

SEQ ID NO: 2251866 - protein, 8 aa, Cryptosporidium parvum
ATGSKDET

SEQ ID NO: 2251867 - protein, 8 aa, Cryptosporidium parvum
ATGTGKTY

SEQ ID NO: 2251868 - protein, 8 aa, Cryptosporidium parvum
ATGVSKSS

SEQ ID NO: 2251869 - protein, 6 aa, Cryptosporidium parvum
ATHSRA

SEQ ID NO: 2251870 - protein, 4 aa, Cryptosporidium parvum
ATIE

SEQ ID NO: 2251871 - protein, 4 aa, Cryptosporidium parvum
ATIN

SEQ ID NO: 2251872 - protein, 11 aa, Cryptosporidium parvum
ATIQTPNPFPY

SEQ ID NO: 2251873 - protein, 13 aa, Cryptosporidium parvum
ATKENYAQNSQPQ

SEQ ID NO: 2251874 - protein, 12 aa, Cryptosporidium parvum
ATKETNFNVSDQ

SEQ ID NO: 2251875 - protein, 17 aa, Cryptosporidium parvum
ATKEVPGLSSGSGNGNR

SEQ ID NO: 2251876 - protein, 10 aa, Cryptosporidium parvum
ATKSSSGTEW

SEQ ID NO: 2251877 - protein, 5 aa, Cryptosporidium parvum
ATLED

SEQ ID NO: 2251878 - protein, 8 aa, Cryptosporidium parvum
ATLGEKDQ

SEQ ID NO: 2251879 - protein, 35 aa, Cryptosporidium parvum
ATLKANSRAQKEKNKLAKRTKKDSVIRDNTNKSLD

SEQ ID NO: 2251880 - protein, 4 aa, Cryptosporidium parvum
ATLS

SEQ ID NO: 2251881 - protein, 11 aa, Cryptosporidium parvum
ATLSKKAEELV

SEQ ID NO: 2251882 - protein, 4 aa, Cryptosporidium parvum
ATMH

SEQ ID NO: 2251883 - protein, 13 aa, Cryptosporidium parvum
ATNCTESDMGQTL

SEQ ID NO: 2251884 - protein, 11 aa, Cryptosporidium parvum
ATNDESEQRRV

SEQ ID NO: 2251885 - protein, 13 aa, Cryptosporidium parvum
ATNGNTSLGGEDF

SEQ ID NO: 2251886 - protein, 28 aa, Cryptosporidium parvum
ATNGSENYKRMSSKSKNSPRSHNKYTGN

SEQ ID NO: 2251887 - protein, 22 aa, Cryptosporidium parvum
ATNHNGRSASLTAPNGPSQTEV

SEQ ID NO: 2251888 - protein, 6 aa, Cryptosporidium parvum
ATNISK

SEQ ID NO: 2251889 - protein, 9 aa, Cryptosporidium parvum
ATPGQAQEA

SEQ ID NO: 2251890 - protein, 15 aa, Cryptosporidium parvum
ATPKPNSLNYTEPPI

SEQ ID NO: 2251891 - protein, 7 aa, Cryptosporidium parvum
ATPLSAE

SEQ ID NO: 2251892 - protein, 4 aa, Cryptosporidium parvum
ATPN

SEQ ID NO: 2251893 - protein, 7 aa, Cryptosporidium parvum
ATPNKGF

SEQ ID NO: 2251894 - protein, 15 aa, Cryptosporidium parvum
ATPNNNKLSSSNSNI

SEQ ID NO: 2251895 - protein, 12 aa, Cryptosporidium parvum
ATPQPPAQQYGT

SEQ ID NO: 2251896 - protein, 7 aa, Cryptosporidium parvum
ATPSLST

SEQ ID NO: 2251897 - protein, 6 aa, Cryptosporidium parvum
ATPSNL

SEQ ID NO: 2251898 - protein, 13 aa, Cryptosporidium parvum
ATPSSTISYNNNN

SEQ ID NO: 2251899 - protein, 5 aa, Cryptosporidium parvum
ATQSY

SEQ ID NO: 2251900 - protein, 7 aa, Cryptosporidium parvum
ATQTTKV

SEQ ID NO: 2251901 - protein, 13 aa, Cryptosporidium parvum
ATQVNNGQFFSID

SEQ ID NO: 2251902 - protein, 5 aa, Cryptosporidium parvum
ATREY

SEQ ID NO: 2251903 - protein, 4 aa, Cryptosporidium parvum
ATRQ

SEQ ID NO: 2251904 - protein, 8 aa, Cryptosporidium parvum
ATSDKTPL

SEQ ID NO: 2251905 - protein, 5 aa, Cryptosporidium parvum
ATSEF

SEQ ID NO: 2251906 - protein, 20 aa, Cryptosporidium parvum
ATSGNNGDADPDLEKQIGGL

SEQ ID NO: 2251907 - protein, 8 aa, Cryptosporidium parvum
ATSKESKN

SEQ ID NO: 2251908 - protein, 11 aa, Cryptosporidium parvum
ATSNSSNSSCN

SEQ ID NO: 2251909 - protein, 5 aa, Cryptosporidium parvum
ATSPA

SEQ ID NO: 2251910 - protein, 10 aa, Cryptosporidium parvum
ATSPKLNNLN

SEQ ID NO: 2251911 - protein, 6 aa, Cryptosporidium parvum
ATSPKR

SEQ ID NO: 2251912 - protein, 19 aa, Cryptosporidium parvum
ATSRTTNSNSNQPTSVYSG

SEQ ID NO: 2251913 - protein, 9 aa, Cryptosporidium parvum
ATSSSEPME

SEQ ID NO: 2251914 - protein, 12 aa, Cryptosporidium parvum
ATSTAGTHVTGG

SEQ ID NO: 2251915 - protein, 13 aa, Cryptosporidium parvum
ATSTSSKPANTTV

SEQ ID NO: 2251916 - protein, 5 aa, Cryptosporidium parvum
ATSYS

SEQ ID NO: 2251917 - protein, 18 aa, Cryptosporidium parvum
ATTASGGHPSVSNSQNIS

SEQ ID NO: 2251918 - protein, 9 aa, Cryptosporidium parvum
ATTASSGII

SEQ ID NO: 2251919 - protein, 8 aa, Cryptosporidium parvum
ATTGRGYV

SEQ ID NO: 2251920 - protein, 77 aa, Cryptosporidium parvum
ATTNKPRGSNLTPLNPVGTSGNDSDALGVATSTNTFTEKQATSTASATIVEQKDNSCESTDMKNEEKHSENDEKSDL

SEQ ID NO: 2251921 - protein, 7 aa, Cryptosporidium parvum
ATTPVDP

SEQ ID NO: 2251922 - protein, 4 aa, Cryptosporidium parvum
ATTS

SEQ ID NO: 2251923 - protein, 8 aa, Cryptosporidium parvum
ATTSNGPI

SEQ ID NO: 2251924 - protein, 4 aa, Cryptosporidium parvum
ATTT

SEQ ID NO: 2251925 - protein, 7 aa, Cryptosporidium parvum
ATTTSTA

SEQ ID NO: 2251926 - protein, 11 aa, Cryptosporidium parvum
ATVDPQTSEMD

SEQ ID NO: 2251927 - protein, 4 aa, Cryptosporidium parvum
ATYE

SEQ ID NO: 2251928 - protein, 5 aa, Cryptosporidium parvum
ATYGR

SEQ ID NO: 2251929 - protein, 31 aa, Cryptosporidium parvum; identical to SEQ ID NO: 2136637

SEQ ID NO: 2251930 - protein, 15 aa, Cryptosporidium parvum
AVDEDDELEEDDEGD

SEQ ID NO: 2251931 - protein, 8 aa, Cryptosporidium parvum
AVDGAAAL

SEQ ID NO: 2251932 - protein, 15 aa, Cryptosporidium parvum
AVDKTENKDIHQSIS

SEQ ID NO: 2251933 - protein, 11 aa, Cryptosporidium parvum
AVENYNDSSEL

SEQ ID NO: 2251934 - protein, 26 aa, Cryptosporidium parvum
AVETEEKRMGTEEKGIESKKKESIDS

SEQ ID NO: 2251935 - protein, 21 aa, Cryptosporidium parvum
AVGGTTSEDLKKKKNKKRFNK

SEQ ID NO: 2251936 - protein, 10 aa, Cryptosporidium parvum
AVGQNSKTVQ

SEQ ID NO: 2251937 - protein, 4 aa, Cryptosporidium parvum
AVKS

SEQ ID NO: 2251938 - protein, 9 aa, Cryptosporidium parvum
AVKVDEQDI

SEQ ID NO: 2251939 - protein, 6 aa, Cryptosporidium parvum
AVNGNT

SEQ ID NO: 2251940 - protein, 12 aa, Cryptosporidium parvum
AVNGSEVSVSAA

SEQ ID NO: 2251941 - protein, 11 aa, Cryptosporidium parvum
AVNPESETIET

SEQ ID NO: 2251942 - protein, 9 aa, Cryptosporidium parvum
AVNSEHNKN

SEQ ID NO: 2251943 - protein, 7 aa, Cryptosporidium parvum
AVQSSGT

SEQ ID NO: 2251944 - protein, 19 aa, Cryptosporidium parvum
AVQSTKNKTPISAFDPEGR

SEQ ID NO: 2251945 - protein, 10 aa, Cryptosporidium parvum
AVRKNERKRE

SEQ ID NO: 2251946 - protein, 16 aa, Cryptosporidium parvum
AVSEGTKAVTKFTGGQ

SEQ ID NO: 2251947 - protein, 5 aa, Cryptosporidium parvum
AVSGT

SEQ ID NO: 2251948 - protein, 9 aa, Cryptosporidium parvum
AVSNDTGLK

SEQ ID NO: 2251949 - protein, 25 aa, Cryptosporidium parvum
AVSNERQARSSIGLTTPRPITRRPD

SEQ ID NO: 2251950 - protein, 15 aa, Cryptosporidium parvum
AVSPTSSRSLENPDF

SEQ ID NO: 2251951 - protein, 8 aa, Cryptosporidium parvum
AVSSDGSY

SEQ ID NO: 2251952 - protein, 19 aa, Cryptosporidium parvum
AVSSPASISPEKNYIPASS

SEQ ID NO: 2251953 - protein, 6 aa, Cryptosporidium parvum
AVTARS

SEQ ID NO: 2251954 - protein, 15 aa, Cryptosporidium parvum
AVTGGGEGTNEDDEE

SEQ ID NO: 2251955 - protein, 8 aa, Cryptosporidium parvum
AVTGGNND

SEQ ID NO: 2251956 - protein, 6 aa, Cryptosporidium parvum
AVTPSG

SEQ ID NO: 2251957 - protein, 7 aa, Cryptosporidium parvum
AVTSSDS

SEQ ID NO: 2251958 - protein, 18 aa, Cryptosporidium parvum
AVTSSGNRVASGYPYKLP

SEQ ID NO: 2251959 - protein, 5 aa, Cryptosporidium parvum
AWSGG

SEQ ID NO: 2251960 - protein, 5 aa, Cryptosporidium parvum
AWSRK

SEQ ID NO: 2251961 - protein, 6 aa, Cryptosporidium parvum
AYDPNG

SEQ ID NO: 2251962 - protein, 4 aa, Cryptosporidium parvum
AYEP

SEQ ID NO: 2251963 - protein, 7 aa, Cryptosporidium parvum
AYKEGGE

SEQ ID NO: 2251964 - protein, 29 aa, Cryptosporidium parvum
AYKPGNSDNQSSENYANHEDNSCESQDSD

SEQ ID NO: 2251965 - protein, 7 aa, Cryptosporidium parvum
AYKTAQA

SEQ ID NO: 2251966 - protein, 7 aa, Cryptosporidium parvum
AYKTIGG

SEQ ID NO: 2251967 - protein, 10 aa, Cryptosporidium parvum
AYNGNKPSLS

SEQ ID NO: 2251968 - protein, 19 aa, Cryptosporidium parvum
AYNGPEGSNHRVRESSVGE

SEQ ID NO: 2251969 - protein, 17 aa, Cryptosporidium parvum
AYNKSKSQISNSSYNTS

SEQ ID NO: 2251970 - protein, 13 aa, Cryptosporidium parvum
AYNKTSTDKYTPE

SEQ ID NO: 2251971 - protein, 4 aa, Cryptosporidium parvum
AYNS

SEQ ID NO: 2251972 - protein, 11 aa, Cryptosporidium parvum
AYNSSKEGFLG

SEQ ID NO: 2251973 - protein, 11 aa, Cryptosporidium parvum
AYNSSKSGKKY

SEQ ID NO: 2251974 - protein, 20 aa, Cryptosporidium parvum
AYNSYKRKISNREKLDEANS

SEQ ID NO: 2251975 - protein, 6 aa, Cryptosporidium parvum
AYPAPN

SEQ ID NO: 2251976 - protein, 21 aa, Cryptosporidium parvum
AYPNTDANPSLASIPNSSIYN

SEQ ID NO: 2251977 - protein, 5 aa, Cryptosporidium parvum
AYQFS

SEQ ID NO: 2251978 - protein, 6 aa, Cryptosporidium parvum
AYQSAS

SEQ ID NO: 2251979 - protein, 6 aa, Cryptosporidium parvum
AYRDQT

SEQ ID NO: 2251980 - protein, 25 aa, Cryptosporidium parvum
AYRKKASKLHPDKQRSENDEQKEKS

SEQ ID NO: 2251981 - protein, 4 aa, Cryptosporidium parvum
AYRQ

SEQ ID NO: 2251982 - protein, 5 aa, Cryptosporidium parvum
AYSES

SEQ ID NO: 2251983 - protein, 4 aa, Cryptosporidium parvum
AYSK

SEQ ID NO: 2251984 - protein, 12 aa, Cryptosporidium parvum
AYSQSSSNNIEF

SEQ ID NO: 2251985 - protein, 47 aa, Cryptosporidium parvum
AYSSSRGGNSQRGANAVGTSSMTGNMSSAAASSSKGRSISDSRREGL

SEQ ID NO: 2251986 - protein, 13 aa, Cryptosporidium parvum
AYSTDQSQKLTST

SEQ ID NO: 2251987 - protein, 10 aa, Cryptosporidium parvum
AYTGEPLANA

SEQ ID NO: 2251988 - protein, 11 aa, Cryptosporidium parvum
AYWNSGNNATF
